United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 11

SEQ ID NO: 450683 - DNA, 16 bp, M. musculus
tgttctgcctctgcct

SEQ ID NO: 450684 - DNA, 16 bp, M. musculus
tgttctgcctgcaaga

SEQ ID NO: 450685 - DNA, 16 bp, M. musculus
tgttctgcctgcttgt

SEQ ID NO: 450686 - DNA, 16 bp, M. musculus
tgttctgctaaagcaa

SEQ ID NO: 450687 - DNA, 16 bp, M. musculus
tgttctgctttctgct

SEQ ID NO: 450688 - DNA, 17 bp, M. musculus
tgttctggaactcactc

SEQ ID NO: 450689 - DNA, 16 bp, M. musculus
tgttctggaatgttct

SEQ ID NO: 450690 - DNA, 16 bp, M. musculus
tgttctggagctttta

SEQ ID NO: 450691 - DNA, 16 bp, M. musculus
tgttctgtaagcttct

SEQ ID NO: 450692 - DNA, 16 bp, M. musculus
tgttctgtctgcatgt

SEQ ID NO: 450693 - DNA, 16 bp, M. musculus
tgttctgtgtgtgtat

SEQ ID NO: 450694 - DNA, 16 bp, M. musculus
tgttctgttactgtga

SEQ ID NO: 450695 - DNA, 16 bp, M. musculus
tgttctgttcagaaag

SEQ ID NO: 450696 - DNA, 16 bp, M. musculus
tgttctgttcatgaaa

SEQ ID NO: 450697 - DNA, 16 bp, M. musculus
tgttctgtttgtgatt

SEQ ID NO: 450698 - DNA, 16 bp, M. musculus
tgttcttaaccactaa

SEQ ID NO: 450699 - DNA, 16 bp, M. musculus
tgttcttaatttaaaa

SEQ ID NO: 450700 - DNA, 16 bp, M. musculus
tgttcttagatttggt

SEQ ID NO: 450701 - DNA, 16 bp, M. musculus
tgttcttagccactga

SEQ ID NO: 450702 - DNA, 16 bp, M. musculus
tgttcttagtgatcat

SEQ ID NO: 450703 - DNA, 16 bp, M. musculus
tgttcttcatatgggg

SEQ ID NO: 450704 - DNA, 16 bp, M. musculus
tgttcttccaaagaac

SEQ ID NO: 450705 - DNA, 16 bp, M. musculus
tgttcttccacccacc

SEQ ID NO: 450706 - DNA, 16 bp, M. musculus
tgttcttccagagggt

SEQ ID NO: 450707 - DNA, 16 bp, M. musculus
tgttcttcctatggat

SEQ ID NO: 450708 - DNA, 16 bp, M. musculus
tgttcttctatctggg

SEQ ID NO: 450709 - DNA, 16 bp, M. musculus
tgttcttctgtgtctg

SEQ ID NO: 450710 - DNA, 16 bp, M. musculus
tgttcttgcagaagac

SEQ ID NO: 450711 - DNA, 16 bp, M. musculus
tgttcttgcagagggc

SEQ ID NO: 450712 - DNA, 16 bp, M. musculus
tgttcttgctgtctct

SEQ ID NO: 450713 - DNA, 16 bp, M. musculus
tgttcttggaaaccaa

SEQ ID NO: 450714 - DNA, 16 bp, M. musculus
tgttcttgtagaggac

SEQ ID NO: 450715 - DNA, 16 bp, M. musculus
tgttcttgtattcagt

SEQ ID NO: 450716 - DNA, 17 bp, M. musculus
tgttcttgtggctctct

SEQ ID NO: 450717 - DNA, 16 bp, M. musculus
tgttcttgttttaaat

SEQ ID NO: 450718 - DNA, 16 bp, M. musculus
tgttcttgtttttcaa

SEQ ID NO: 450719 - DNA, 16 bp, M. musculus
tgttctttatttacat

SEQ ID NO: 450720 - DNA, 16 bp, M. musculus
tgttctttcaagatct

SEQ ID NO: 450721 - DNA, 16 bp, M. musculus
tgttctttcaaggtct

SEQ ID NO: 450722 - DNA, 16 bp, M. musculus
tgttctttcagaggac

SEQ ID NO: 450723 - DNA, 16 bp, M. musculus
tgttctttgataattt

SEQ ID NO: 450724 - DNA, 16 bp, M. musculus
tgttctttgtttctga

SEQ ID NO: 450725 - DNA, 16 bp, M. musculus
tgttcttttcatcaga

SEQ ID NO: 450726 - DNA, 16 bp, M. musculus
tgttcttttccatcac

SEQ ID NO: 450727 - DNA, 16 bp, M. musculus
tgttcttttgctgtga

SEQ ID NO: 450728 - DNA, 16 bp, M. musculus
tgttcttttttaaaaa

SEQ ID NO: 450729 - DNA, 16 bp, M. musculus
tgttcttttttctcca

SEQ ID NO: 450730 - DNA, 16 bp, M. musculus
tgttctttttttaaag

SEQ ID NO: 450731 - DNA, 16 bp, M. musculus
tgttgaaaaagcacca

SEQ ID NO: 450732 - DNA, 16 bp, M. musculus
tgttgaaaacagtgca

SEQ ID NO: 450733 - DNA, 16 bp, M. musculus
tgttgaaaatgatgtc

SEQ ID NO: 450734 - DNA, 16 bp, M. musculus
tgttgaaaatgcagtc

SEQ ID NO: 450735 - DNA, 16 bp, M. musculus
tgttgaaactgctgtc

SEQ ID NO: 450736 - DNA, 16 bp, M. musculus
tgttgaacattatttc

SEQ ID NO: 450737 - DNA, 16 bp, M. musculus
tgttgaacattttttt

SEQ ID NO: 450738 - DNA, 16 bp, M. musculus
tgttgaagaaagtgtg

SEQ ID NO: 450739 - DNA, 16 bp, M. musculus
tgttgaagaataaaaa

SEQ ID NO: 450740 - DNA, 16 bp, M. musculus
tgttgaagatgctctc

SEQ ID NO: 450741 - DNA, 16 bp, M. musculus
tgttgaagcttgtttt

SEQ ID NO: 450742 - DNA, 16 bp, M. musculus
tgttgaaggaagtgta

SEQ ID NO: 450743 - DNA, 16 bp, M. musculus
tgttgaaggacatcta

SEQ ID NO: 450744 - DNA, 16 bp, M. musculus
tgttgaagtcacccac

SEQ ID NO: 450745 - DNA, 28 bp, M. musculus
tgttgaagtctcccactattattgtgtg

SEQ ID NO: 450746 - DNA, 16 bp, M. musculus
tgttgaatgaatgaaa

SEQ ID NO: 450747 - DNA, 16 bp, M. musculus
tgttgaattccttctt

SEQ ID NO: 450748 - DNA, 16 bp, M. musculus
tgttgaattctttcag

SEQ ID NO: 450749 - DNA, 16 bp, M. musculus
tgttgaatttctcaaa

SEQ ID NO: 450750 - DNA, 16 bp, M. musculus
tgttgaatttgtcttc

SEQ ID NO: 450751 - DNA, 18 bp, M. musculus
tgttgacacaagcactgg

SEQ ID NO: 450752 - DNA, 16 bp, M. musculus
tgttgacattctgaat

SEQ ID NO: 450753 - DNA, 16 bp, M. musculus
tgttgacatttttatt

SEQ ID NO: 450754 - DNA, 16 bp, M. musculus
tgttgaccaggctggc

SEQ ID NO: 450755 - DNA, 16 bp, M. musculus
tgttgacctctgacct

SEQ ID NO: 450756 - DNA, 16 bp, M. musculus
tgttgactggcttgat

SEQ ID NO: 450757 - DNA, 16 bp, M. musculus
tgttgacttctctcag

SEQ ID NO: 450758 - DNA, 16 bp, M. musculus
tgttgactttctatta

SEQ ID NO: 450759 - DNA, 16 bp, M. musculus
tgttgagaaacatctg

SEQ ID NO: 450760 - DNA, 16 bp, M. musculus
tgttgagaatattttc

SEQ ID NO: 450761 - DNA, 16 bp, M. musculus
tgttgagacagagtct

SEQ ID NO: 450762 - DNA, 16 bp, M. musculus
tgttgagacagggtct

SEQ ID NO: 450763 - DNA, 16 bp, M. musculus
tgttgagattaaaggc

SEQ ID NO: 450764 - DNA, 16 bp, M. musculus
tgttgagattaaaggt

SEQ ID NO: 450765 - DNA, 17 bp, M. musculus
tgttgagggattatctt

SEQ ID NO: 450766 - DNA, 16 bp, M. musculus
tgttgaggtatccagg

SEQ ID NO: 450767 - DNA, 16 bp, M. musculus
tgttgagtaaaggctt

SEQ ID NO: 450768 - DNA, 16 bp, M. musculus
tgttgatattgaagat

SEQ ID NO: 450769 - DNA, 16 bp, M. musculus
tgttgatctcagtgcc

SEQ ID NO: 450770 - DNA, 16 bp, M. musculus
tgttgatgaacagcag

SEQ ID NO: 450771 - DNA, 16 bp, M. musculus
tgttgatgatgatgat

SEQ ID NO: 450772 - DNA, 16 bp, M. musculus
tgttgatgccaagaag

SEQ ID NO: 450773 - DNA, 16 bp, M. musculus
tgttgatggattactt

SEQ ID NO: 450774 - DNA, 16 bp, M. musculus
tgttgatgggatggat

SEQ ID NO: 450775 - DNA, 16 bp, M. musculus
tgttgattctttcaaa

SEQ ID NO: 450776 - DNA, 16 bp, M. musculus
tgttgattttctaaaa

SEQ ID NO: 450777 - DNA, 16 bp, M. musculus
tgttgattttctttaa

SEQ ID NO: 450778 - DNA, 16 bp, M. musculus
tgttgatttttttcaa

SEQ ID NO: 450779 - DNA, 16 bp, M. musculus
tgttgcagtcaacaaa

SEQ ID NO: 450780 - DNA, 16 bp, M. musculus
tgttgcatacaagaaa

SEQ ID NO: 450781 - DNA, 16 bp, M. musculus
tgttgcatgcctttaa

SEQ ID NO: 450782 - DNA, 16 bp, M. musculus
tgttgcattttccttt

SEQ ID NO: 450783 - DNA, 16 bp, M. musculus
tgttgccaggcaactg

SEQ ID NO: 450784 - DNA, 16 bp, M. musculus
tgttgccaggtaactg

SEQ ID NO: 450785 - DNA, 16 bp, M. musculus
tgttgccatggcaatc

SEQ ID NO: 450786 - DNA, 16 bp, M. musculus
tgttgccatggtaaca

SEQ ID NO: 450787 - DNA, 16 bp, M. musculus
tgttgccatggtgatg

SEQ ID NO: 450788 - DNA, 16 bp, M. musculus
tgttgccatggtgatt

SEQ ID NO: 450789 - DNA, 16 bp, M. musculus
tgttgccctgtgtcat

SEQ ID NO: 450790 - DNA, 16 bp, M. musculus
tgttgccttggtcaag

SEQ ID NO: 450791 - DNA, 26 bp, M. musculus
tgttgcggccgccagcagctcgcaac

SEQ ID NO: 450792 - DNA, 16 bp, M. musculus
tgttgctacctcataa

SEQ ID NO: 450793 - DNA, 16 bp, M. musculus
tgttgctactgctgct

SEQ ID NO: 450794 - DNA, 16 bp, M. musculus
tgttgctaggtaactg

SEQ ID NO: 450795 - DNA, 16 bp, M. musculus
tgttgctatcttcttt

SEQ ID NO: 450796 - DNA, 16 bp, M. musculus
tgttgctatgaccaaa

SEQ ID NO: 450797 - DNA, 16 bp, M. musculus
tgttgctatggcaaca

SEQ ID NO: 450798 - DNA, 16 bp, M. musculus
tgttgctcaggctggc

SEQ ID NO: 450799 - DNA, 16 bp, M. musculus
tgttgctctgtgtgtg

SEQ ID NO: 450800 - DNA, 16 bp, M. musculus
tgttgctgagacaaaa

SEQ ID NO: 450801 - DNA, 16 bp, M. musculus
tgttgctgatttgtga

SEQ ID NO: 450802 - DNA, 16 bp, M. musculus
tgttgctgccctgtgt

SEQ ID NO: 450803 - DNA, 16 bp, M. musculus
tgttgctgccttcaga

SEQ ID NO: 450804 - DNA, 16 bp, M. musculus
tgttgctgctgcttct

SEQ ID NO: 450805 - DNA, 16 bp, M. musculus
tgttgctgctgctttt

SEQ ID NO: 450806 - DNA, 16 bp, M. musculus
tgttgctgctggtggt

SEQ ID NO: 450807 - DNA, 16 bp, M. musculus
tgttgctgctgttatt

SEQ ID NO: 450808 - DNA, 16 bp, M. musculus
tgttgctgctgttgct

SEQ ID NO: 450809 - DNA, 16 bp, M. musculus
tgttgctgctgttggt

SEQ ID NO: 450810 - DNA, 16 bp, M. musculus
tgttgctgcttctgct

SEQ ID NO: 450811 - DNA, 16 bp, M. musculus
tgttgctgtgaagaga

SEQ ID NO: 450812 - DNA, 16 bp, M. musculus
tgttgctgttgttatt

SEQ ID NO: 450813 - DNA, 16 bp, M. musculus
tgttgctgttttgaga

SEQ ID NO: 450814 - DNA, 16 bp, M. musculus
tgttgcttaaataccc

SEQ ID NO: 450815 - DNA, 24 bp, M. musculus
tgttgcttaaatttctcctgcaaa

SEQ ID NO: 450816 - DNA, 16 bp, M. musculus
tgttgcttactagctt

SEQ ID NO: 450817 - DNA, 16 bp, M. musculus
tgttgcttatggtctt

SEQ ID NO: 450818 - DNA, 16 bp, M. musculus
tgttgcttctattgcc

SEQ ID NO: 450819 - DNA, 16 bp, M. musculus
tgttgcttctgaggcc

SEQ ID NO: 450820 - DNA, 16 bp, M. musculus
tgttgcttctgctgcc

SEQ ID NO: 450821 - DNA, 16 bp, M. musculus
tgttgcttctgctgct

SEQ ID NO: 450822 - DNA, 16 bp, M. musculus
tgttgctttggccaaa

SEQ ID NO: 450823 - DNA, 16 bp, M. musculus
tgttgcttttaacttt

SEQ ID NO: 450824 - DNA, 16 bp, M. musculus
tgttggaagaagtttg

SEQ ID NO: 450825 - DNA, 16 bp, M. musculus
tgttggaagtatgtga

SEQ ID NO: 450826 - DNA, 16 bp, M. musculus
tgttggaataggtgtg

SEQ ID NO: 450827 - DNA, 16 bp, M. musculus
tgttggaatttttgag

SEQ ID NO: 450828 - DNA, 16 bp, M. musculus
tgttggacttcctgtg

SEQ ID NO: 450829 - DNA, 16 bp, M. musculus
tgttggagaaagtgtg

SEQ ID NO: 450830 - DNA, 16 bp, M. musculus
tgttggagattggttc

SEQ ID NO: 450831 - DNA, 16 bp, M. musculus
tgttggagcacctggg

SEQ ID NO: 450832 - DNA, 16 bp, M. musculus
tgttggaggagccaag

SEQ ID NO: 450833 - DNA, 16 bp, M. musculus
tgttggagggggaagc

SEQ ID NO: 450834 - DNA, 16 bp, M. musculus
tgttggagtagatgtg

SEQ ID NO: 450835 - DNA, 16 bp, M. musculus
tgttggatgtcttcct

SEQ ID NO: 450836 - DNA, 16 bp, M. musculus
tgttggatttttaaaa

SEQ ID NO: 450837 - DNA, 16 bp, M. musculus
tgttggcaactggttt

SEQ ID NO: 450838 - DNA, 16 bp, M. musculus
tgttggccatcaatgg

SEQ ID NO: 450839 - DNA, 16 bp, M. musculus
tgttggctcacaacca

SEQ ID NO: 450840 - DNA, 16 bp, M. musculus
tgttggctgtgagcat

SEQ ID NO: 450841 - DNA, 16 bp, M. musculus
tgttggctgttggctt

SEQ ID NO: 450842 - DNA, 16 bp, M. musculus
tgttgggaattaaatt

SEQ ID NO: 450843 - DNA, 30 bp, M. musculus
tgttgggagccgcgcccacattcgccgtta

SEQ ID NO: 450844 - DNA, 20 bp, M. musculus
tgttgggagcgaccctgttt

SEQ ID NO: 450845 - DNA, 16 bp, M. musculus
tgttgggagttggact

SEQ ID NO: 450846 - DNA, 16 bp, M. musculus
tgttgggattaaagat

SEQ ID NO: 450847 - DNA, 16 bp, M. musculus
tgttgggattaaagga

SEQ ID NO: 450848 - DNA, 16 bp, M. musculus
tgttgggattaaaggc

SEQ ID NO: 450849 - DNA, 16 bp, M. musculus
tgttgggccctgtttg

SEQ ID NO: 450850 - DNA, 16 bp, M. musculus
tgttggggaaagtgtg

SEQ ID NO: 450851 - DNA, 16 bp, M. musculus
tgttggggtacccagg

SEQ ID NO: 450852 - DNA, 16 bp, M. musculus
tgttggggtatacagg

SEQ ID NO: 450853 - DNA, 16 bp, M. musculus
tgttgggtcagttgcc

SEQ ID NO: 450854 - DNA, 16 bp, M. musculus
tgttgggtcttccaga

SEQ ID NO: 450855 - DNA, 16 bp, M. musculus
tgttggtccctcctgc

SEQ ID NO: 450856 - DNA, 16 bp, M. musculus
tgttggtcttcctgtg

SEQ ID NO: 450857 - DNA, 16 bp, M. musculus
tgttggtgaaattgca

SEQ ID NO: 450858 - DNA, 16 bp, M. musculus
tgttggtgagacttca

SEQ ID NO: 450859 - DNA, 16 bp, M. musculus
tgttggtgattcttgc

SEQ ID NO: 450860 - DNA, 16 bp, M. musculus
tgttggtgcatcttct

SEQ ID NO: 450861 - DNA, 16 bp, M. musculus
tgttggtgggattgca

SEQ ID NO: 450862 - DNA, 16 bp, M. musculus
tgttggttcctcagaa

SEQ ID NO: 450863 - DNA, 16 bp, M. musculus
tgttggtttttataag

SEQ ID NO: 450864 - DNA, 16 bp, M. musculus
tgttgtaaaatatcca

SEQ ID NO: 450865 - DNA, 17 bp, M. musculus
tgttgtaagatcaagaa

SEQ ID NO: 450866 - DNA, 16 bp, M. musculus
tgttgtatgctgtctg

SEQ ID NO: 450867 - DNA, 16 bp, M. musculus
tgttgtcacttgctgt

SEQ ID NO: 450868 - DNA, 16 bp, M. musculus
tgttgtcattgttgct

SEQ ID NO: 450869 - DNA, 16 bp, M. musculus
tgttgtcattgttgtt

SEQ ID NO: 450870 - DNA, 16 bp, M. musculus
tgttgtcctccttcct

SEQ ID NO: 450871 - DNA, 16 bp, M. musculus
tgttgtccttaaaaga

SEQ ID NO: 450872 - DNA, 16 bp, M. musculus
tgttgtcctttacact

SEQ ID NO: 450873 - DNA, 16 bp, M. musculus
tgttgtctaattgtct

SEQ ID NO: 450874 - DNA, 16 bp, M. musculus
tgttgtgagccaccat

SEQ ID NO: 450875 - DNA, 16 bp, M. musculus
tgttgtgcattcattt

SEQ ID NO: 450876 - DNA, 16 bp, M. musculus
tgttgtggtgaccacc

SEQ ID NO: 450877 - DNA, 16 bp, M. musculus
tgttgtggtgagcccc

SEQ ID NO: 450878 - DNA, 16 bp, M. musculus
tgttgtggttaagaaa

SEQ ID NO: 450879 - DNA, 16 bp, M. musculus
tgttgtggtttgaatg

SEQ ID NO: 450880 - DNA, 16 bp, M. musculus
tgttgtgtatctgtgt

SEQ ID NO: 450881 - DNA, 16 bp, M. musculus
tgttgtgtctggccag

SEQ ID NO: 450882 - DNA, 16 bp, M. musculus
tgttgtgtttgcagac

SEQ ID NO: 450883 - DNA, 16 bp, M. musculus
tgttgttaccctgtgt

SEQ ID NO: 450884 - DNA, 16 bp, M. musculus
tgttgttactgttgtt

SEQ ID NO: 450885 - DNA, 16 bp, M. musculus
tgttgttattgctatt

SEQ ID NO: 450886 - DNA, 24 bp, M. musculus
tgttgttccacatatagggttgca

SEQ ID NO: 450887 - DNA, 16 bp, M. musculus
tgttgttccacctata

SEQ ID NO: 450888 - DNA, 25 bp, M. musculus
tgttgttccacctataggattgcag

SEQ ID NO: 450889 - DNA, 25 bp, M. musculus
tgttgttccacctatagggttgcag

SEQ ID NO: 450890 - DNA, 25 bp, M. musculus
tgttgttctacctatagggttgcag

SEQ ID NO: 450891 - DNA, 16 bp, M. musculus
tgttgttgaagatatt

SEQ ID NO: 450892 - DNA, 16 bp, M. musculus
tgttgttgctactgtt

SEQ ID NO: 450893 - DNA, 16 bp, M. musculus
tgttgttgctattgtt

SEQ ID NO: 450894 - DNA, 16 bp, M. musculus
tgttgttgctgctgct

SEQ ID NO: 450895 - DNA, 16 bp, M. musculus
tgttgttgctgggaac

SEQ ID NO: 450896 - DNA, 16 bp, M. musculus
tgttgttgcttcattt

SEQ ID NO: 450897 - DNA, 16 bp, M. musculus
tgttgttgctttttaa

SEQ ID NO: 450898 - DNA, 16 bp, M. musculus
tgttgttgctttttga

SEQ ID NO: 450899 - DNA, 16 bp, M. musculus
tgttgttgtcttcaga

SEQ ID NO: 450900 - DNA, 16 bp, M. musculus
tgttgttgttgccatt

SEQ ID NO: 450901 - DNA, 16 bp, M. musculus
tgttgttgttgtttca

SEQ ID NO: 450902 - DNA, 16 bp, M. musculus
tgttgttgttttaagc

SEQ ID NO: 450903 - DNA, 16 bp, M. musculus
tgttgttgttttgcaa

SEQ ID NO: 450904 - DNA, 16 bp, M. musculus
tgttgtttcctgttat

SEQ ID NO: 450905 - DNA, 16 bp, M. musculus
tgttgtttctgaagca

SEQ ID NO: 450906 - DNA, 16 bp, M. musculus
tgttgttttcctgatt

SEQ ID NO: 450907 - DNA, 16 bp, M. musculus
tgttgttttgatttgc

SEQ ID NO: 450908 - DNA, 16 bp, M. musculus
tgttgtttttcctgga

SEQ ID NO: 450909 - DNA, 16 bp, M. musculus
tgttgttttttaaaag

SEQ ID NO: 450910 - DNA, 16 bp, M. musculus
tgtttaaaaaaaaaac

SEQ ID NO: 450911 - DNA, 16 bp, M. musculus
tgtttaaaaacaaaca

SEQ ID NO: 450912 - DNA, 16 bp, M. musculus
tgtttaaaaatgttga

SEQ ID NO: 450913 - DNA, 16 bp, M. musculus
tgtttaaaatattttc

SEQ ID NO: 450914 - DNA, 16 bp, M. musculus
tgtttaaaatgttaaa

SEQ ID NO: 450915 - DNA, 20 bp, M. musculus
tgtttaaatcaagcctagta

SEQ ID NO: 450916 - DNA, 31 bp, M. musculus
tgtttaaatcaagcctagtagagccatgctg

SEQ ID NO: 450917 - DNA, 16 bp, M. musculus
tgtttaacagtgtttt

SEQ ID NO: 450918 - DNA, 16 bp, M. musculus
tgtttaatagaaaact

SEQ ID NO: 450919 - DNA, 16 bp, M. musculus
tgtttaattttgaaaa

SEQ ID NO: 450920 - DNA, 16 bp, M. musculus
tgtttacaacagtaaa

SEQ ID NO: 450921 - DNA, 16 bp, M. musculus
tgtttacagaggacat

SEQ ID NO: 450922 - DNA, 16 bp, M. musculus
tgtttacagatagaga

SEQ ID NO: 450923 - DNA, 16 bp, M. musculus
tgtttacatgcacaca

SEQ ID NO: 450924 - DNA, 16 bp, M. musculus
tgtttacatgtgtgtt

SEQ ID NO: 450925 - DNA, 16 bp, M. musculus
tgtttacatgtgtttt

SEQ ID NO: 450926 - DNA, 16 bp, M. musculus
tgtttacattccaaat

SEQ ID NO: 450927 - DNA, 37 bp, M. musculus
tgtttaccacttagaacacagctgtcagcgccatctt

SEQ ID NO: 450928 - DNA, 16 bp, M. musculus
tgtttaccattttgct

SEQ ID NO: 450929 - DNA, 16 bp, M. musculus
tgtttacctgtgttca

SEQ ID NO: 450930 - DNA, 16 bp, M. musculus
tgtttacctttctcct

SEQ ID NO: 450931 - DNA, 16 bp, M. musculus
tgtttactgccttgcc

SEQ ID NO: 450932 - DNA, 16 bp, M. musculus
tgtttacttgatcttt

SEQ ID NO: 450933 - DNA, 16 bp, M. musculus
tgtttagaaaatcatc

SEQ ID NO: 450934 - DNA, 16 bp, M. musculus
tgtttagaattctggg

SEQ ID NO: 450935 - DNA, 16 bp, M. musculus
tgtttagacagggtct

SEQ ID NO: 450936 - DNA, 16 bp, M. musculus
tgtttagatctgtacc

SEQ ID NO: 450937 - DNA, 16 bp, M. musculus
tgtttagatttgcatt

SEQ ID NO: 450938 - DNA, 16 bp, M. musculus
tgtttagcaagttgta

SEQ ID NO: 450939 - DNA, 16 bp, M. musculus
tgtttagcaatgtttt

SEQ ID NO: 450940 - DNA, 16 bp, M. musculus
tgtttagcatgcacaa

SEQ ID NO: 450941 - DNA, 16 bp, M. musculus
tgtttagctctgaggc

SEQ ID NO: 450942 - DNA, 16 bp, M. musculus
tgtttagctttttaaa

SEQ ID NO: 450943 - DNA, 16 bp, M. musculus
tgtttaggaaaaaaaa

SEQ ID NO: 450944 - DNA, 16 bp, M. musculus
tgtttagggttaggag

SEQ ID NO: 450945 - DNA, 16 bp, M. musculus
tgtttaggtatgtgtc

SEQ ID NO: 450946 - DNA, 16 bp, M. musculus
tgtttatatctgtacc

SEQ ID NO: 450947 - DNA, 16 bp, M. musculus
tgtttatatgtgcata

SEQ ID NO: 450948 - DNA, 16 bp, M. musculus
tgtttatatttccaca

SEQ ID NO: 450949 - DNA, 18 bp, M. musculus
tgtttatcaggtttagga

SEQ ID NO: 450950 - DNA, 16 bp, M. musculus
tgtttatgggcatctt

SEQ ID NO: 450951 - DNA, 16 bp, M. musculus
tgtttatgtggtggat

SEQ ID NO: 450952 - DNA, 16 bp, M. musculus
tgtttatgtgtgtgaa

SEQ ID NO: 450953 - DNA, 16 bp, M. musculus
tgtttatgttcttgcc

SEQ ID NO: 450954 - DNA, 16 bp, M. musculus
tgtttattctttcaaa

SEQ ID NO: 450955 - DNA, 16 bp, M. musculus
tgtttattttctaaat

SEQ ID NO: 450956 - DNA, 16 bp, M. musculus
tgtttcaaaaaacaaa

SEQ ID NO: 450957 - DNA, 16 bp, M. musculus
tgtttcaaaaagcaaa

SEQ ID NO: 450958 - DNA, 16 bp, M. musculus
tgtttcaaaaagtaaa

SEQ ID NO: 450959 - DNA, 16 bp, M. musculus
tgtttcaaaacaaaaa

SEQ ID NO: 450960 - DNA, 16 bp, M. musculus
tgtttcaaaataaaaa

SEQ ID NO: 450961 - DNA, 16 bp, M. musculus
tgtttcaaattaaaaa

SEQ ID NO: 450962 - DNA, 16 bp, M. musculus
tgtttcaataaaataa

SEQ ID NO: 450963 - DNA, 16 bp, M. musculus
tgtttcagaaaagaaa

SEQ ID NO: 450964 - DNA, 16 bp, M. musculus
tgtttcagaagatggc

SEQ ID NO: 450965 - DNA, 16 bp, M. musculus
tgtttcagatttgtcc

SEQ ID NO: 450966 - DNA, 16 bp, M. musculus
tgtttcagattttaaa

SEQ ID NO: 450967 - DNA, 16 bp, M. musculus
tgtttcaggatatttg

SEQ ID NO: 450968 - DNA, 16 bp, M. musculus
tgtttcaggccttcat

SEQ ID NO: 450969 - DNA, 16 bp, M. musculus
tgtttcagtttctgcc

SEQ ID NO: 450970 - DNA, 16 bp, M. musculus
tgtttcatcacagtaa

SEQ ID NO: 450971 - DNA, 16 bp, M. musculus
tgtttcatcttattat

SEQ ID NO: 450972 - DNA, 16 bp, M. musculus
tgtttcattatttata

SEQ ID NO: 450973 - DNA, 16 bp, M. musculus
tgtttcattattttaa

SEQ ID NO: 450974 - DNA, 16 bp, M. musculus
tgtttcatttaaattt

SEQ ID NO: 450975 - DNA, 16 bp, M. musculus
tgtttcattttttaaa

SEQ ID NO: 450976 - DNA, 16 bp, M. musculus
tgtttccaaaacaaaa

SEQ ID NO: 450977 - DNA, 16 bp, M. musculus
tgtttccaagatgaga

SEQ ID NO: 450978 - DNA, 16 bp, M. musculus
tgtttccagaggggaa

SEQ ID NO: 450979 - DNA, 16 bp, M. musculus
tgtttccagcttctct

SEQ ID NO: 450980 - DNA, 16 bp, M. musculus
tgtttccaggttcctg

SEQ ID NO: 450981 - DNA, 16 bp, M. musculus
tgtttccagtaattac

SEQ ID NO: 450982 - DNA, 16 bp, M. musculus
tgtttccagtttctca

SEQ ID NO: 450983 - DNA, 16 bp, M. musculus
tgtttccatggaaaca

SEQ ID NO: 450984 - DNA, 16 bp, M. musculus
tgtttccattcttcct

SEQ ID NO: 450985 - DNA, 16 bp, M. musculus
tgtttccattgctgtg

SEQ ID NO: 450986 - DNA, 16 bp, M. musculus
tgtttccccttctaaa

SEQ ID NO: 450987 - DNA, 16 bp, M. musculus
tgtttccctgcctgcc

SEQ ID NO: 450988 - DNA, 16 bp, M. musculus
tgtttcccttcagaaa

SEQ ID NO: 450989 - DNA, 16 bp, M. musculus
tgtttcccttgctcca

SEQ ID NO: 450990 - DNA, 16 bp, M. musculus
tgtttccctttgggtt

SEQ ID NO: 450991 - DNA, 16 bp, M. musculus
tgtttcctctttaatg

SEQ ID NO: 450992 - DNA, 16 bp, M. musculus
tgtttcctgggaccat

SEQ ID NO: 450993 - DNA, 16 bp, M. musculus
tgtttcctgggtgctg

SEQ ID NO: 450994 - DNA, 16 bp, M. musculus
tgtttcctttgggaga

SEQ ID NO: 450995 - DNA, 16 bp, M. musculus
tgtttccttttgtaaa

SEQ ID NO: 450996 - DNA, 16 bp, M. musculus
tgtttctaattcttta

SEQ ID NO: 450997 - DNA, 17 bp, M. musculus
tgtttctacttccaatt

SEQ ID NO: 450998 - DNA, 16 bp, M. musculus
tgtttctacttcccat

SEQ ID NO: 450999 - DNA, 16 bp, M. musculus
tgtttctacttctatt

SEQ ID NO: 451000 - DNA, 16 bp, M. musculus
tgtttctatgataaaa

SEQ ID NO: 451001 - DNA, 16 bp, M. musculus
tgtttctatgcattct

SEQ ID NO: 451002 - DNA, 16 bp, M. musculus
tgtttctatgtatgtg

SEQ ID NO: 451003 - DNA, 16 bp, M. musculus
tgtttctattctccaa

SEQ ID NO: 451004 - DNA, 16 bp, M. musculus
tgtttctcaacctgtg

SEQ ID NO: 451005 - DNA, 16 bp, M. musculus
tgtttctcagcaattt

SEQ ID NO: 451006 - DNA, 16 bp, M. musculus
tgtttctcagccactc

SEQ ID NO: 451007 - DNA, 16 bp, M. musculus
tgtttctcattttcca

SEQ ID NO: 451008 - DNA, 16 bp, M. musculus
tgtttctcctgtgatt

SEQ ID NO: 451009 - DNA, 16 bp, M. musculus
tgtttctctgaagtct

SEQ ID NO: 451010 - DNA, 16 bp, M. musculus
tgtttctctgtatgtt

SEQ ID NO: 451011 - DNA, 16 bp, M. musculus
tgtttctcttcttcca

SEQ ID NO: 451012 - DNA, 16 bp, M. musculus
tgtttctgaatagttt

SEQ ID NO: 451013 - DNA, 16 bp, M. musculus
tgtttctgaccagtgg

SEQ ID NO: 451014 - DNA, 16 bp, M. musculus
tgtttctgcagaggac

SEQ ID NO: 451015 - DNA, 16 bp, M. musculus
tgtttctgcctcctga

SEQ ID NO: 451016 - DNA, 16 bp, M. musculus
tgtttctgcctctctg

SEQ ID NO: 451017 - DNA, 16 bp, M. musculus
tgtttctgctgctgct

SEQ ID NO: 451018 - DNA, 16 bp, M. musculus
tgtttctgctgctgtg

SEQ ID NO: 451019 - DNA, 16 bp, M. musculus
tgtttctgtaataaaa

SEQ ID NO: 451020 - DNA, 16 bp, M. musculus
tgtttctgtatgtatg

SEQ ID NO: 451021 - DNA, 16 bp, M. musculus
tgtttctgtatgtgtg

SEQ ID NO: 451022 - DNA, 16 bp, M. musculus
tgtttctgtgagtggg

SEQ ID NO: 451023 - DNA, 16 bp, M. musculus
tgtttctgtgtatgtg

SEQ ID NO: 451024 - DNA, 16 bp, M. musculus
tgtttctgtgtgatct

SEQ ID NO: 451025 - DNA, 16 bp, M. musculus
tgtttctgttcttatg

SEQ ID NO: 451026 - DNA, 16 bp, M. musculus
tgtttctgttttgtga

SEQ ID NO: 451027 - DNA, 16 bp, M. musculus
tgtttcttaaaatttt

SEQ ID NO: 451028 - DNA, 16 bp, M. musculus
tgtttcttaatctctt

SEQ ID NO: 451029 - DNA, 16 bp, M. musculus
tgtttcttccaaatgt

SEQ ID NO: 451030 - DNA, 16 bp, M. musculus
tgtttcttcctttgaa

SEQ ID NO: 451031 - DNA, 16 bp, M. musculus
tgtttcttctacctgt

SEQ ID NO: 451032 - DNA, 16 bp, M. musculus
tgtttcttctttaaga

SEQ ID NO: 451033 - DNA, 16 bp, M. musculus
tgtttcttctttgagc

SEQ ID NO: 451034 - DNA, 17 bp, M. musculus
tgtttcttgagaccatt

SEQ ID NO: 451035 - DNA, 18 bp, M. musculus
tgtttcttgggatcccct

SEQ ID NO: 451036 - DNA, 16 bp, M. musculus
tgtttcttgtcaggta

SEQ ID NO: 451037 - DNA, 16 bp, M. musculus
tgtttcttgtccctcc

SEQ ID NO: 451038 - DNA, 17 bp, M. musculus
tgtttcttgtgccttct

SEQ ID NO: 451039 - DNA, 16 bp, M. musculus
tgtttctttcttacta

SEQ ID NO: 451040 - DNA, 16 bp, M. musculus
tgtttctttgtgtagc

SEQ ID NO: 451041 - DNA, 16 bp, M. musculus
tgtttcttttaaaaaa

SEQ ID NO: 451042 - DNA, 16 bp, M. musculus
tgtttcttttcttaaa

SEQ ID NO: 451043 - DNA, 16 bp, M. musculus
tgtttgaaaaacaaaa

SEQ ID NO: 451044 - DNA, 16 bp, M. musculus
tgtttgaagatagcta

SEQ ID NO: 451045 - DNA, 16 bp, M. musculus
tgtttgaatacttagt

SEQ ID NO: 451046 - DNA, 16 bp, M. musculus
tgtttgaatgcttggc

SEQ ID NO: 451047 - DNA, 16 bp, M. musculus
tgtttgaatgtgtgtg

SEQ ID NO: 451048 - DNA, 16 bp, M. musculus
tgtttgacaatctctg

SEQ ID NO: 451049 - DNA, 16 bp, M. musculus
tgtttgagaatgagtt

SEQ ID NO: 451050 - DNA, 16 bp, M. musculus
tgtttgagattataat

SEQ ID NO: 451051 - DNA, 16 bp, M. musculus
tgtttgaggcagggtc

SEQ ID NO: 451052 - DNA, 16 bp, M. musculus
tgtttgaggttcttcc

SEQ ID NO: 451053 - DNA, 16 bp, M. musculus
tgtttgagttggcatt

SEQ ID NO: 451054 - DNA, 16 bp, M. musculus
tgtttgagtttttaaa

SEQ ID NO: 451055 - DNA, 16 bp, M. musculus
tgtttgatattctcaa

SEQ ID NO: 451056 - DNA, 16 bp, M. musculus
tgtttgatgccactga

SEQ ID NO: 451057 - DNA, 16 bp, M. musculus
tgtttgcaagaagaaa

SEQ ID NO: 451058 - DNA, 16 bp, M. musculus
tgtttgcacagcaagc

SEQ ID NO: 451059 - DNA, 16 bp, M. musculus
tgtttgcacatgtgtg

SEQ ID NO: 451060 - DNA, 16 bp, M. musculus
tgtttgcagcaagaag

SEQ ID NO: 451061 - DNA, 16 bp, M. musculus
tgtttgcatgatctgt

SEQ ID NO: 451062 - DNA, 16 bp, M. musculus
tgtttgcatgtatgcc

SEQ ID NO: 451063 - DNA, 16 bp, M. musculus
tgtttgcatgtgtgta

SEQ ID NO: 451064 - DNA, 16 bp, M. musculus
tgtttgcattctttct

SEQ ID NO: 451065 - DNA, 16 bp, M. musculus
tgtttgccatgctcag

SEQ ID NO: 451066 - DNA, 16 bp, M. musculus
tgtttgccatgctgca

SEQ ID NO: 451067 - DNA, 16 bp, M. musculus
tgtttgccccagcaaa

SEQ ID NO: 451068 - DNA, 16 bp, M. musculus
tgtttgcctagcatgt

SEQ ID NO: 451069 - DNA, 16 bp, M. musculus
tgtttgcctttataaa

SEQ ID NO: 451070 - DNA, 16 bp, M. musculus
tgtttgctaggcccct

SEQ ID NO: 451071 - DNA, 16 bp, M. musculus
tgtttgctatcctagg

SEQ ID NO: 451072 - DNA, 16 bp, M. musculus
tgtttgctatcctgac

SEQ ID NO: 451073 - DNA, 16 bp, M. musculus
tgtttgctctctccag

SEQ ID NO: 451074 - DNA, 16 bp, M. musculus
tgtttgctgcacaagc

SEQ ID NO: 451075 - DNA, 16 bp, M. musculus
tgtttgctttttaaaa

SEQ ID NO: 451076 - DNA, 16 bp, M. musculus
tgtttgcttttttgag

SEQ ID NO: 451077 - DNA, 16 bp, M. musculus
tgtttggaattctggg

SEQ ID NO: 451078 - DNA, 16 bp, M. musculus
tgtttggagacagggt

SEQ ID NO: 451079 - DNA, 16 bp, M. musculus
tgtttggaggccagag

SEQ ID NO: 451080 - DNA, 16 bp, M. musculus
tgtttggagggtataa

SEQ ID NO: 451081 - DNA, 16 bp, M. musculus
tgtttgggaaggatta

SEQ ID NO: 451082 - DNA, 17 bp, M. musculus
tgtttgggtgcccagga

SEQ ID NO: 451083 - DNA, 16 bp, M. musculus
tgtttggtggctcagt

SEQ ID NO: 451084 - DNA, 16 bp, M. musculus
tgtttggttttgagac

SEQ ID NO: 451085 - DNA, 16 bp, M. musculus
tgtttgtaagaagaaa

SEQ ID NO: 451086 - DNA, 16 bp, M. musculus
tgtttgtaagcacatc

SEQ ID NO: 451087 - DNA, 16 bp, M. musculus
tgtttgtacacatgtg

SEQ ID NO: 451088 - DNA, 16 bp, M. musculus
tgtttgtacatatgta

SEQ ID NO: 451089 - DNA, 16 bp, M. musculus
tgtttgtagaaggaag

SEQ ID NO: 451090 - DNA, 16 bp, M. musculus
tgtttgtatgaatgtg

SEQ ID NO: 451091 - DNA, 16 bp, M. musculus
tgtttgtatgtatata

SEQ ID NO: 451092 - DNA, 16 bp, M. musculus
tgtttgtatgtatgaa

SEQ ID NO: 451093 - DNA, 16 bp, M. musculus
tgtttgtatgtatgta

SEQ ID NO: 451094 - DNA, 16 bp, M. musculus
tgtttgtcctgtcatt

SEQ ID NO: 451095 - DNA, 16 bp, M. musculus
tgtttgtctatatgtt

SEQ ID NO: 451096 - DNA, 16 bp, M. musculus
tgtttgtgactattgt

SEQ ID NO: 451097 - DNA, 16 bp, M. musculus
tgtttgtgagctgcca

SEQ ID NO: 451098 - DNA, 16 bp, M. musculus
tgtttgtgatcccttc

SEQ ID NO: 451099 - DNA, 16 bp, M. musculus
tgtttgtgcaaataaa

SEQ ID NO: 451100 - DNA, 16 bp, M. musculus
tgtttgtgcaggtata

SEQ ID NO: 451101 - DNA, 16 bp, M. musculus
tgtttgtgcatgtatg

SEQ ID NO: 451102 - DNA, 16 bp, M. musculus
tgtttgtgtaagtgtg

SEQ ID NO: 451103 - DNA, 16 bp, M. musculus
tgtttgtgtatatata

SEQ ID NO: 451104 - DNA, 16 bp, M. musculus
tgtttgtgtatcacat

SEQ ID NO: 451105 - DNA, 16 bp, M. musculus
tgtttgtgtcaagttg

SEQ ID NO: 451106 - DNA, 16 bp, M. musculus
tgtttgtgtctgtatg

SEQ ID NO: 451107 - DNA, 16 bp, M. musculus
tgtttgtgtgcatatg

SEQ ID NO: 451108 - DNA, 16 bp, M. musculus
tgtttgtgtgtctatc

SEQ ID NO: 451109 - DNA, 16 bp, M. musculus
tgtttgtgtgttttca

SEQ ID NO: 451110 - DNA, 16 bp, M. musculus
tgtttgtgtttcccca

SEQ ID NO: 451111 - DNA, 16 bp, M. musculus
tgtttgttccttgacc

SEQ ID NO: 451112 - DNA, 16 bp, M. musculus
tgtttgttgagtgaat

SEQ ID NO: 451113 - DNA, 16 bp, M. musculus
tgtttgttgggctctg

SEQ ID NO: 451114 - DNA, 16 bp, M. musculus
tgtttgtttataaaaa

SEQ ID NO: 451115 - DNA, 16 bp, M. musculus
tgtttgtttattcatg

SEQ ID NO: 451116 - DNA, 16 bp, M. musculus
tgtttgtttcactgtg

SEQ ID NO: 451117 - DNA, 16 bp, M. musculus
tgtttgtttcagacag

SEQ ID NO: 451118 - DNA, 16 bp, M. musculus
tgtttgtttccttata

SEQ ID NO: 451119 - DNA, 16 bp, M. musculus
tgtttgtttgaaacaa

SEQ ID NO: 451120 - DNA, 16 bp, M. musculus
tgtttgtttgagacac

SEQ ID NO: 451121 - DNA, 16 bp, M. musculus
tgtttgtttgagacag

SEQ ID NO: 451122 - DNA, 16 bp, M. musculus
tgtttgtttgtctgag

SEQ ID NO: 451123 - DNA, 16 bp, M. musculus
tgtttgtttgtttgca

SEQ ID NO: 451124 - DNA, 17 bp, M. musculus
tgtttgttttcgagaca

SEQ ID NO: 451125 - DNA, 16 bp, M. musculus
tgtttgttttctaaca

SEQ ID NO: 451126 - DNA, 16 bp, M. musculus
tgtttgttttctagtg

SEQ ID NO: 451127 - DNA, 16 bp, M. musculus
tgtttgttttcttaag

SEQ ID NO: 451128 - DNA, 16 bp, M. musculus
tgtttgttttggagac

SEQ ID NO: 451129 - DNA, 16 bp, M. musculus
tgtttgttttgtgcat

SEQ ID NO: 451130 - DNA, 16 bp, M. musculus
tgtttgtttttaaaag

SEQ ID NO: 451131 - DNA, 16 bp, M. musculus
tgtttgtttttaacca

SEQ ID NO: 451132 - DNA, 16 bp, M. musculus
tgtttgtttttaactc

SEQ ID NO: 451133 - DNA, 16 bp, M. musculus
tgtttgtttttccagt

SEQ ID NO: 451134 - DNA, 16 bp, M. musculus
tgtttgtttttctcca

SEQ ID NO: 451135 - DNA, 16 bp, M. musculus
tgtttgtttttgacac

SEQ ID NO: 451136 - DNA, 16 bp, M. musculus
tgtttgtttttgagaa

SEQ ID NO: 451137 - DNA, 16 bp, M. musculus
tgtttgttttttaaac

SEQ ID NO: 451138 - DNA, 16 bp, M. musculus
tgttttaaaaagccaa

SEQ ID NO: 451139 - DNA, 16 bp, M. musculus
tgttttaaaagaaaat

SEQ ID NO: 451140 - DNA, 16 bp, M. musculus
tgttttaaaataaact

SEQ ID NO: 451141 - DNA, 16 bp, M. musculus
tgttttaaagttttca

SEQ ID NO: 451142 - DNA, 16 bp, M. musculus
tgttttaaatcatttt

SEQ ID NO: 451143 - DNA, 16 bp, M. musculus
tgttttaaattatgtg

SEQ ID NO: 451144 - DNA, 16 bp, M. musculus
tgttttaacaaaagaa

SEQ ID NO: 451145 - DNA, 16 bp, M. musculus
tgttttaagaaataaa

SEQ ID NO: 451146 - DNA, 16 bp, M. musculus
tgttttacatatttta

SEQ ID NO: 451147 - DNA, 16 bp, M. musculus
tgttttacatgtatgt

SEQ ID NO: 451148 - DNA, 16 bp, M. musculus
tgttttaccttcatgt

SEQ ID NO: 451149 - DNA, 16 bp, M. musculus
tgttttacttgcatgt

SEQ ID NO: 451150 - DNA, 16 bp, M. musculus
tgttttagaagttgta

SEQ ID NO: 451151 - DNA, 16 bp, M. musculus
tgttttagttttggca

SEQ ID NO: 451152 - DNA, 16 bp, M. musculus
tgttttatcacagcaa

SEQ ID NO: 451153 - DNA, 16 bp, M. musculus
tgttttatcatagtaa

SEQ ID NO: 451154 - DNA, 16 bp, M. musculus
tgttttatctgtgtgt

SEQ ID NO: 451155 - DNA, 16 bp, M. musculus
tgttttatgaaaaaaa

SEQ ID NO: 451156 - DNA, 16 bp, M. musculus
tgttttatttcagaaa

SEQ ID NO: 451157 - DNA, 16 bp, M. musculus
tgttttatttcataaa

SEQ ID NO: 451158 - DNA, 16 bp, M. musculus
tgttttatttgagaca

SEQ ID NO: 451159 - DNA, 16 bp, M. musculus
tgttttcaaaatattt

SEQ ID NO: 451160 - DNA, 16 bp, M. musculus
tgttttcaaatatttt

SEQ ID NO: 451161 - DNA, 16 bp, M. musculus
tgttttcaagaacaaa

SEQ ID NO: 451162 - DNA, 16 bp, M. musculus
tgttttcaagacaggc

SEQ ID NO: 451163 - DNA, 16 bp, M. musculus
tgttttcaataaaata

SEQ ID NO: 451164 - DNA, 16 bp, M. musculus
tgttttcaatatattt

SEQ ID NO: 451165 - DNA, 16 bp, M. musculus
tgttttcaattaaaaa

SEQ ID NO: 451166 - DNA, 16 bp, M. musculus
tgttttcacttggttg

SEQ ID NO: 451167 - DNA, 16 bp, M. musculus
tgttttcagaaaaaaa

SEQ ID NO: 451168 - DNA, 16 bp, M. musculus
tgttttcagggctgac

SEQ ID NO: 451169 - DNA, 16 bp, M. musculus
tgttttcatggtgatt

SEQ ID NO: 451170 - DNA, 16 bp, M. musculus
tgttttcattgctact

SEQ ID NO: 451171 - DNA, 16 bp, M. musculus
tgttttcatttccatt

SEQ ID NO: 451172 - DNA, 16 bp, M. musculus
tgttttcatttcctgt

SEQ ID NO: 451173 - DNA, 16 bp, M. musculus
tgttttcatttcttca

SEQ ID NO: 451174 - DNA, 16 bp, M. musculus
tgttttcatttgcatt

SEQ ID NO: 451175 - DNA, 16 bp, M. musculus
tgttttcatttttaaa

SEQ ID NO: 451176 - DNA, 16 bp, M. musculus
tgttttccagcaccca

SEQ ID NO: 451177 - DNA, 16 bp, M. musculus
tgttttccagcctttt

SEQ ID NO: 451178 - DNA, 16 bp, M. musculus
tgttttccaggcactg

SEQ ID NO: 451179 - DNA, 16 bp, M. musculus
tgttttccatttatta

SEQ ID NO: 451180 - DNA, 16 bp, M. musculus
tgttttccattttaat

SEQ ID NO: 451181 - DNA, 16 bp, M. musculus
tgttttcccttaatat

SEQ ID NO: 451182 - DNA, 16 bp, M. musculus
tgttttcccttctgag

SEQ ID NO: 451183 - DNA, 16 bp, M. musculus
tgttttcccttttcca

SEQ ID NO: 451184 - DNA, 16 bp, M. musculus
tgttttcctctatttc

SEQ ID NO: 451185 - DNA, 16 bp, M. musculus
tgttttcctctttcca

SEQ ID NO: 451186 - DNA, 16 bp, M. musculus
tgttttcctgaagcag

SEQ ID NO: 451187 - DNA, 16 bp, M. musculus
tgttttcctgaagtga

SEQ ID NO: 451188 - DNA, 16 bp, M. musculus
tgttttcctgtatttc

SEQ ID NO: 451189 - DNA, 16 bp, M. musculus
tgttttccttcattct

SEQ ID NO: 451190 - DNA, 16 bp, M. musculus
tgttttccttctgctg

SEQ ID NO: 451191 - DNA, 16 bp, M. musculus
tgttttcctttgtaag

SEQ ID NO: 451192 - DNA, 16 bp, M. musculus
tgttttcctttgtgat

SEQ ID NO: 451193 - DNA, 16 bp, M. musculus
tgttttcctttttgag

SEQ ID NO: 451194 - DNA, 16 bp, M. musculus
tgttttctacaataaa

SEQ ID NO: 451195 - DNA, 16 bp, M. musculus
tgttttctacctgttt

SEQ ID NO: 451196 - DNA, 16 bp, M. musculus
tgttttctatgaaatc

SEQ ID NO: 451197 - DNA, 16 bp, M. musculus
tgttttctcagagtag

SEQ ID NO: 451198 - DNA, 16 bp, M. musculus
tgttttctccttgtat

SEQ ID NO: 451199 - DNA, 16 bp, M. musculus
tgttttctcttttgaa

SEQ ID NO: 451200 - DNA, 16 bp, M. musculus
tgttttctgaagagaa

SEQ ID NO: 451201 - DNA, 16 bp, M. musculus
tgttttctgacctcca

SEQ ID NO: 451202 - DNA, 16 bp, M. musculus
tgttttctgagtgctg

SEQ ID NO: 451203 - DNA, 22 bp, M. musculus
tgttttctgggagcacaaagaa

SEQ ID NO: 451204 - DNA, 16 bp, M. musculus
tgttttctgtggaatc

SEQ ID NO: 451205 - DNA, 16 bp, M. musculus
tgttttctgttgccat

SEQ ID NO: 451206 - DNA, 16 bp, M. musculus
tgttttcttataaaac

SEQ ID NO: 451207 - DNA, 16 bp, M. musculus
tgttttcttgaaattt

SEQ ID NO: 451208 - DNA, 16 bp, M. musculus
tgttttcttgaagcag

SEQ ID NO: 451209 - DNA, 16 bp, M. musculus
tgttttcttgagatag

SEQ ID NO: 451210 - DNA, 16 bp, M. musculus
tgttttcttggatata

SEQ ID NO: 451211 - DNA, 16 bp, M. musculus
tgttttctttaaaaaa

SEQ ID NO: 451212 - DNA, 16 bp, M. musculus
tgttttctttcagaaa

SEQ ID NO: 451213 - DNA, 16 bp, M. musculus
tgttttctttctgatc

SEQ ID NO: 451214 - DNA, 16 bp, M. musculus
tgttttctttgatagg

SEQ ID NO: 451215 - DNA, 16 bp, M. musculus
tgttttctttgattgg

SEQ ID NO: 451216 - DNA, 16 bp, M. musculus
tgttttctttggttag

SEQ ID NO: 451217 - DNA, 16 bp, M. musculus
tgttttcttttaaaat

SEQ ID NO: 451218 - DNA, 16 bp, M. musculus
tgttttcttttaaaga

SEQ ID NO: 451219 - DNA, 16 bp, M. musculus
tgttttcttttacaaa

SEQ ID NO: 451220 - DNA, 16 bp, M. musculus
tgttttcttttcctag

SEQ ID NO: 451221 - DNA, 16 bp, M. musculus
tgttttgaaaaataaa

SEQ ID NO: 451222 - DNA, 16 bp, M. musculus
tgttttgaaaatgttt

SEQ ID NO: 451223 - DNA, 16 bp, M. musculus
tgttttgaaacaggct

SEQ ID NO: 451224 - DNA, 16 bp, M. musculus
tgttttgaaatctcct

SEQ ID NO: 451225 - DNA, 16 bp, M. musculus
tgttttgactgcatgc

SEQ ID NO: 451226 - DNA, 16 bp, M. musculus
tgttttgagacagtct

SEQ ID NO: 451227 - DNA, 16 bp, M. musculus
tgttttgataactttg

SEQ ID NO: 451228 - DNA, 16 bp, M. musculus
tgttttgcaaacagtg

SEQ ID NO: 451229 - DNA, 16 bp, M. musculus
tgttttgcaaattata

SEQ ID NO: 451230 - DNA, 16 bp, M. musculus
tgttttgcatgcatgc

SEQ ID NO: 451231 - DNA, 16 bp, M. musculus
tgttttgccagcatgt

SEQ ID NO: 451232 - DNA, 16 bp, M. musculus
tgttttgcctacatga

SEQ ID NO: 451233 - DNA, 16 bp, M. musculus
tgttttgcctacatgt

SEQ ID NO: 451234 - DNA, 16 bp, M. musculus
tgttttgcctatatgt

SEQ ID NO: 451235 - DNA, 16 bp, M. musculus
tgttttgcctctgtgt

SEQ ID NO: 451236 - DNA, 16 bp, M. musculus
tgttttgcctgcatgt

SEQ ID NO: 451237 - DNA, 16 bp, M. musculus
tgttttgcctgcgtgt

SEQ ID NO: 451238 - DNA, 16 bp, M. musculus
tgttttgccttcatgt

SEQ ID NO: 451239 - DNA, 16 bp, M. musculus
tgttttgctaacatat

SEQ ID NO: 451240 - DNA, 16 bp, M. musculus
tgttttgctggggaaa

SEQ ID NO: 451241 - DNA, 16 bp, M. musculus
tgttttgctggggcat

SEQ ID NO: 451242 - DNA, 16 bp, M. musculus
tgttttgctgggtata

SEQ ID NO: 451243 - DNA, 16 bp, M. musculus
tgttttgctgtatatt

SEQ ID NO: 451244 - DNA, 16 bp, M. musculus
tgttttgcttacatgt

SEQ ID NO: 451245 - DNA, 16 bp, M. musculus
tgttttggagacagga

SEQ ID NO: 451246 - DNA, 16 bp, M. musculus
tgttttggataatgat

SEQ ID NO: 451247 - DNA, 16 bp, M. musculus
tgttttggttgggaga

SEQ ID NO: 451248 - DNA, 16 bp, M. musculus
tgttttgtaaataaag

SEQ ID NO: 451249 - DNA, 16 bp, M. musculus
tgttttgtaaatatct

SEQ ID NO: 451250 - DNA, 16 bp, M. musculus
tgttttgtaagaaaca

SEQ ID NO: 451251 - DNA, 16 bp, M. musculus
tgttttgtattttcaa

SEQ ID NO: 451252 - DNA, 16 bp, M. musculus
tgttttgtctgcatgt

SEQ ID NO: 451253 - DNA, 16 bp, M. musculus
tgttttgtgaccactt

SEQ ID NO: 451254 - DNA, 16 bp, M. musculus
tgttttgttcccaagt

SEQ ID NO: 451255 - DNA, 16 bp, M. musculus
tgttttgttcccattt

SEQ ID NO: 451256 - DNA, 16 bp, M. musculus
tgttttgttccctatt

SEQ ID NO: 451257 - DNA, 16 bp, M. musculus
tgttttgttgccaatt

SEQ ID NO: 451258 - DNA, 16 bp, M. musculus
tgttttgtttaaaaaa

SEQ ID NO: 451259 - DNA, 16 bp, M. musculus
tgttttgtttaagagt

SEQ ID NO: 451260 - DNA, 16 bp, M. musculus
tgttttgtttccatgt

SEQ ID NO: 451261 - DNA, 16 bp, M. musculus
tgttttgtttgcatgt

SEQ ID NO: 451262 - DNA, 16 bp, M. musculus
tgttttgttttaaact

SEQ ID NO: 451263 - DNA, 16 bp, M. musculus
tgttttgttttaaagc

SEQ ID NO: 451264 - DNA, 16 bp, M. musculus
tgttttgttttaagac

SEQ ID NO: 451265 - DNA, 16 bp, M. musculus
tgttttgttttcaaga

SEQ ID NO: 451266 - DNA, 16 bp, M. musculus
tgttttgttttcaatg

SEQ ID NO: 451267 - DNA, 16 bp, M. musculus
tgttttgttttcatga

SEQ ID NO: 451268 - DNA, 16 bp, M. musculus
tgttttgttttccaag

SEQ ID NO: 451269 - DNA, 16 bp, M. musculus
tgttttgttttcccat

SEQ ID NO: 451270 - DNA, 16 bp, M. musculus
tgttttgtttttaagc

SEQ ID NO: 451271 - DNA, 16 bp, M. musculus
tgtttttaaaaactgt

SEQ ID NO: 451272 - DNA, 16 bp, M. musculus
tgtttttaaaaagaaa

SEQ ID NO: 451273 - DNA, 16 bp, M. musculus
tgtttttaaaaatact

SEQ ID NO: 451274 - DNA, 16 bp, M. musculus
tgtttttaaaaatgaa

SEQ ID NO: 451275 - DNA, 16 bp, M. musculus
tgtttttaaaacattt

SEQ ID NO: 451276 - DNA, 16 bp, M. musculus
tgtttttaaaattctt

SEQ ID NO: 451277 - DNA, 16 bp, M. musculus
tgtttttaaagactta

SEQ ID NO: 451278 - DNA, 16 bp, M. musculus
tgtttttaaccactga

SEQ ID NO: 451279 - DNA, 16 bp, M. musculus
tgtttttaaggataga

SEQ ID NO: 451280 - DNA, 16 bp, M. musculus
tgtttttaataaagaa

SEQ ID NO: 451281 - DNA, 16 bp, M. musculus
tgtttttaataactgt

SEQ ID NO: 451282 - DNA, 16 bp, M. musculus
tgtttttaatgaatgt

SEQ ID NO: 451283 - DNA, 16 bp, M. musculus
tgtttttaatgagaaa

SEQ ID NO: 451284 - DNA, 16 bp, M. musculus
tgtttttacaaataaa

SEQ ID NO: 451285 - DNA, 16 bp, M. musculus
tgtttttagtagttga

SEQ ID NO: 451286 - DNA, 16 bp, M. musculus
tgtttttatcacagtg

SEQ ID NO: 451287 - DNA, 16 bp, M. musculus
tgtttttatgccaata

SEQ ID NO: 451288 - DNA, 16 bp, M. musculus
tgtttttattactgtg

SEQ ID NO: 451289 - DNA, 16 bp, M. musculus
tgtttttattgaagat

SEQ ID NO: 451290 - DNA, 16 bp, M. musculus
tgtttttcaaaggtct

SEQ ID NO: 451291 - DNA, 16 bp, M. musculus
tgtttttcaagacaga

SEQ ID NO: 451292 - DNA, 16 bp, M. musculus
tgtttttcaagcatgt

SEQ ID NO: 451293 - DNA, 16 bp, M. musculus
tgtttttcaggtttag

SEQ ID NO: 451294 - DNA, 16 bp, M. musculus
tgtttttcagtcattt

SEQ ID NO: 451295 - DNA, 16 bp, M. musculus
tgtttttccagtgtgt

SEQ ID NO: 451296 - DNA, 16 bp, M. musculus
tgtttttccctcttga

SEQ ID NO: 451297 - DNA, 16 bp, M. musculus
tgtttttctagaaatg

SEQ ID NO: 451298 - DNA, 16 bp, M. musculus
tgtttttctcattgtg

SEQ ID NO: 451299 - DNA, 16 bp, M. musculus
tgtttttctctgtgta

SEQ ID NO: 451300 - DNA, 16 bp, M. musculus
tgtttttctggaagct

SEQ ID NO: 451301 - DNA, 16 bp, M. musculus
tgtttttctttaaaaa

SEQ ID NO: 451302 - DNA, 16 bp, M. musculus
tgtttttctttataaa

SEQ ID NO: 451303 - DNA, 16 bp, M. musculus
tgtttttctttataag

SEQ ID NO: 451304 - DNA, 16 bp, M. musculus
tgtttttgaagaaact

SEQ ID NO: 451305 - DNA, 16 bp, M. musculus
tgtttttgagacatgt

SEQ ID NO: 451306 - DNA, 16 bp, M. musculus
tgtttttgagatagga

SEQ ID NO: 451307 - DNA, 16 bp, M. musculus
tgtttttgctgctgct

SEQ ID NO: 451308 - DNA, 16 bp, M. musculus
tgtttttgtacactgt

SEQ ID NO: 451309 - DNA, 16 bp, M. musculus
tgtttttgttgctact

SEQ ID NO: 451310 - DNA, 16 bp, M. musculus
tgttttttaaaaaaga

SEQ ID NO: 451311 - DNA, 16 bp, M. musculus
tgttttttaaagacag

SEQ ID NO: 451312 - DNA, 16 bp, M. musculus
tgttttttaaggaaaa

SEQ ID NO: 451313 - DNA, 16 bp, M. musculus
tgttttttcacaaaaa

SEQ ID NO: 451314 - DNA, 16 bp, M. musculus
tgttttttctaggatg

SEQ ID NO: 451315 - DNA, 16 bp, M. musculus
tgttttttctgcatct

SEQ ID NO: 451316 - DNA, 17 bp, M. musculus
tgttttttgaaacagga

SEQ ID NO: 451317 - DNA, 16 bp, M. musculus
tgttttttgagacaga

SEQ ID NO: 451318 - DNA, 16 bp, M. musculus
tgtttttttgaaacag

SEQ ID NO: 451319 - DNA, 16 bp, M. musculus
tgtttttttttccaag

SEQ ID NO: 451320 - DNA, 16 bp, M. musculus
ttaaaaaaaaaagtct

SEQ ID NO: 451321 - DNA, 16 bp, M. musculus
ttaaaaaaaaaatgct

SEQ ID NO: 451322 - DNA, 16 bp, M. musculus
ttaaaaaaaaatcctg

SEQ ID NO: 451323 - DNA, 16 bp, M. musculus
ttaaaaaaaaatctgt

SEQ ID NO: 451324 - DNA, 16 bp, M. musculus
ttaaaaaaaatcactg

SEQ ID NO: 451325 - DNA, 16 bp, M. musculus
ttaaaaaaaatctgtt

SEQ ID NO: 451326 - DNA, 16 bp, M. musculus
ttaaaaaaaatcttct

SEQ ID NO: 451327 - DNA, 16 bp, M. musculus
ttaaaaaaaatgactt

SEQ ID NO: 451328 - DNA, 16 bp, M. musculus
ttaaaaaaaatgttca

SEQ ID NO: 451329 - DNA, 16 bp, M. musculus
ttaaaaaaacattttg

SEQ ID NO: 451330 - DNA, 16 bp, M. musculus
ttaaaaaaatcataga

SEQ ID NO: 451331 - DNA, 16 bp, M. musculus
ttaaaaaaatgttctg

SEQ ID NO: 451332 - DNA, 16 bp, M. musculus
ttaaaaaacatttttg

SEQ ID NO: 451333 - DNA, 16 bp, M. musculus
ttaaaaaagatttatg

SEQ ID NO: 451334 - DNA, 16 bp, M. musculus
ttaaaaaataggtttt

SEQ ID NO: 451335 - DNA, 16 bp, M. musculus
ttaaaaaatggaaaca

SEQ ID NO: 451336 - DNA, 16 bp, M. musculus
ttaaaaaatgtattct

SEQ ID NO: 451337 - DNA, 16 bp, M. musculus
ttaaaaaattaaaagc

SEQ ID NO: 451338 - DNA, 16 bp, M. musculus
ttaaaaaattaagtgt

SEQ ID NO: 451339 - DNA, 16 bp, M. musculus
ttaaaaaatttgagat

SEQ ID NO: 451340 - DNA, 16 bp, M. musculus
ttaaaaacaaaaatgt

SEQ ID NO: 451341 - DNA, 16 bp, M. musculus
ttaaaaacaaaatgca

SEQ ID NO: 451342 - DNA, 16 bp, M. musculus
ttaaaaacaaacaagc

SEQ ID NO: 451343 - DNA, 16 bp, M. musculus
ttaaaaacaaagacag

SEQ ID NO: 451344 - DNA, 16 bp, M. musculus
ttaaaaacaaagattt

SEQ ID NO: 451345 - DNA, 16 bp, M. musculus
ttaaaaacaaggactt

SEQ ID NO: 451346 - DNA, 16 bp, M. musculus
ttaaaaacaaggatat

SEQ ID NO: 451347 - DNA, 16 bp, M. musculus
ttaaaaacacagtaaa

SEQ ID NO: 451348 - DNA, 16 bp, M. musculus
ttaaaaacactgactg

SEQ ID NO: 451349 - DNA, 16 bp, M. musculus
ttaaaaacatttatgt

SEQ ID NO: 451350 - DNA, 16 bp, M. musculus
ttaaaaacattttctt

SEQ ID NO: 451351 - DNA, 16 bp, M. musculus
ttaaaaaccctaaaat

SEQ ID NO: 451352 - DNA, 16 bp, M. musculus
ttaaaaactagatttt

SEQ ID NO: 451353 - DNA, 16 bp, M. musculus
ttaaaaacttaaagaa

SEQ ID NO: 451354 - DNA, 16 bp, M. musculus
ttaaaaacttgttttt

SEQ ID NO: 451355 - DNA, 16 bp, M. musculus
ttaaaaactttgaaat

SEQ ID NO: 451356 - DNA, 16 bp, M. musculus
ttaaaaagaaaacctt

SEQ ID NO: 451357 - DNA, 16 bp, M. musculus
ttaaaaagaaacattt

SEQ ID NO: 451358 - DNA, 16 bp, M. musculus
ttaaaaagaaagactt

SEQ ID NO: 451359 - DNA, 16 bp, M. musculus
ttaaaaagaaatcttt

SEQ ID NO: 451360 - DNA, 16 bp, M. musculus
ttaaaaagaatgattt

SEQ ID NO: 451361 - DNA, 16 bp, M. musculus
ttaaaaagacattaaa

SEQ ID NO: 451362 - DNA, 16 bp, M. musculus
ttaaaaagacttttta

SEQ ID NO: 451363 - DNA, 16 bp, M. musculus
ttaaaaagagtaaaac

SEQ ID NO: 451364 - DNA, 16 bp, M. musculus
ttaaaaagatcatcaa

SEQ ID NO: 451365 - DNA, 16 bp, M. musculus
ttaaaaagatgaattt

SEQ ID NO: 451366 - DNA, 16 bp, M. musculus
ttaaaaagatgttttt

SEQ ID NO: 451367 - DNA, 16 bp, M. musculus
ttaaaaagcaaaatat

SEQ ID NO: 451368 - DNA, 16 bp, M. musculus
ttaaaaagcaaaatga

SEQ ID NO: 451369 - DNA, 16 bp, M. musculus
ttaaaaagcagaagca

SEQ ID NO: 451370 - DNA, 16 bp, M. musculus
ttaaaaagcatttaaa

SEQ ID NO: 451371 - DNA, 16 bp, M. musculus
ttaaaaaggaaaattc

SEQ ID NO: 451372 - DNA, 16 bp, M. musculus
ttaaaaagtacattta

SEQ ID NO: 451373 - DNA, 16 bp, M. musculus
ttaaaaataaaagcat

SEQ ID NO: 451374 - DNA, 16 bp, M. musculus
ttaaaaataaaatcag

SEQ ID NO: 451375 - DNA, 16 bp, M. musculus
ttaaaaataaagacag

SEQ ID NO: 451376 - DNA, 16 bp, M. musculus
ttaaaaataaagtaca

SEQ ID NO: 451377 - DNA, 16 bp, M. musculus
ttaaaaataaatctgt

SEQ ID NO: 451378 - DNA, 16 bp, M. musculus
ttaaaaataagcttta

SEQ ID NO: 451379 - DNA, 16 bp, M. musculus
ttaaaaataaggacat

SEQ ID NO: 451380 - DNA, 16 bp, M. musculus
ttaaaaatagttttga

SEQ ID NO: 451381 - DNA, 16 bp, M. musculus
ttaaaaatatttgcaa

SEQ ID NO: 451382 - DNA, 16 bp, M. musculus
ttaaaaatattttcct

SEQ ID NO: 451383 - DNA, 16 bp, M. musculus
ttaaaaatattttgga

SEQ ID NO: 451384 - DNA, 16 bp, M. musculus
ttaaaaatcaaagtaa

SEQ ID NO: 451385 - DNA, 16 bp, M. musculus
ttaaaaatcttttaag

SEQ ID NO: 451386 - DNA, 16 bp, M. musculus
ttaaaaatgaaacaga

SEQ ID NO: 451387 - DNA, 16 bp, M. musculus
ttaaaaatgaaactca

SEQ ID NO: 451388 - DNA, 16 bp, M. musculus
ttaaaaatgaaagcaa

SEQ ID NO: 451389 - DNA, 16 bp, M. musculus
ttaaaaatgagagaga

SEQ ID NO: 451390 - DNA, 16 bp, M. musculus
ttaaaaatgatttctt

SEQ ID NO: 451391 - DNA, 16 bp, M. musculus
ttaaaaatgcaaataa

SEQ ID NO: 451392 - DNA, 16 bp, M. musculus
ttaaaaatgcctttta

SEQ ID NO: 451393 - DNA, 16 bp, M. musculus
ttaaaaatgctaattt

SEQ ID NO: 451394 - DNA, 16 bp, M. musculus
ttaaaaatgcttaaaa

SEQ ID NO: 451395 - DNA, 16 bp, M. musculus
ttaaaaatggggctaa

SEQ ID NO: 451396 - DNA, 16 bp, M. musculus
ttaaaaatgtcaaaat

SEQ ID NO: 451397 - DNA, 16 bp, M. musculus
ttaaaaatgtcttttt

SEQ ID NO: 451398 - DNA, 16 bp, M. musculus
ttaaaaatgtgtattt

SEQ ID NO: 451399 - DNA, 16 bp, M. musculus
ttaaaaatgttaaaca

SEQ ID NO: 451400 - DNA, 16 bp, M. musculus
ttaaaaatgtttacat

SEQ ID NO: 451401 - DNA, 16 bp, M. musculus
ttaaaaatgtttcaaa

SEQ ID NO: 451402 - DNA, 16 bp, M. musculus
ttaaaaatgtttttca

SEQ ID NO: 451403 - DNA, 16 bp, M. musculus
ttaaaacaataaaatg

SEQ ID NO: 451404 - DNA, 16 bp, M. musculus
ttaaaacaatggattt

SEQ ID NO: 451405 - DNA, 16 bp, M. musculus
ttaaaacacagagaaa

SEQ ID NO: 451406 - DNA, 16 bp, M. musculus
ttaaaacagcaacaac

SEQ ID NO: 451407 - DNA, 16 bp, M. musculus
ttaaaacagtttttaa

SEQ ID NO: 451408 - DNA, 16 bp, M. musculus
ttaaaacatccttcca

SEQ ID NO: 451409 - DNA, 16 bp, M. musculus
ttaaaacatcttttaa

SEQ ID NO: 451410 - DNA, 16 bp, M. musculus
ttaaaacatttccact

SEQ ID NO: 451411 - DNA, 16 bp, M. musculus
ttaaaacatttttcaa

SEQ ID NO: 451412 - DNA, 16 bp, M. musculus
ttaaaacattttttca

SEQ ID NO: 451413 - DNA, 16 bp, M. musculus
ttaaaaccatttattt

SEQ ID NO: 451414 - DNA, 16 bp, M. musculus
ttaaaacctgaaaatg

SEQ ID NO: 451415 - DNA, 16 bp, M. musculus
ttaaaactaaaatgaa

SEQ ID NO: 451416 - DNA, 16 bp, M. musculus
ttaaaactgaataaaa

SEQ ID NO: 451417 - DNA, 16 bp, M. musculus
ttaaaactgtttttaa

SEQ ID NO: 451418 - DNA, 16 bp, M. musculus
ttaaaagaaaaatact

SEQ ID NO: 451419 - DNA, 16 bp, M. musculus
ttaaaagaaaacattt

SEQ ID NO: 451420 - DNA, 16 bp, M. musculus
ttaaaagaaaattcta

SEQ ID NO: 451421 - DNA, 16 bp, M. musculus
ttaaaagaagttttaa

SEQ ID NO: 451422 - DNA, 16 bp, M. musculus
ttaaaagaatatttct

SEQ ID NO: 451423 - DNA, 16 bp, M. musculus
ttaaaagacaaagaag

SEQ ID NO: 451424 - DNA, 16 bp, M. musculus
ttaaaagacattttta

SEQ ID NO: 451425 - DNA, 16 bp, M. musculus
ttaaaagataaataca

SEQ ID NO: 451426 - DNA, 16 bp, M. musculus
ttaaaagatattttct

SEQ ID NO: 451427 - DNA, 16 bp, M. musculus
ttaaaagatgtatttt

SEQ ID NO: 451428 - DNA, 16 bp, M. musculus
ttaaaagcaaaactct

SEQ ID NO: 451429 - DNA, 16 bp, M. musculus
ttaaaagcacatctca

SEQ ID NO: 451430 - DNA, 66 bp, M. musculus
ttaaaagcagtaagggagaaaggtcaagtaacatataaaggaaggcctatcagaattacaccagac

SEQ ID NO: 451431 - DNA, 16 bp, M. musculus
ttaaaagcatgtgtca

SEQ ID NO: 451432 - DNA, 16 bp, M. musculus
ttaaaagcatttgttg

SEQ ID NO: 451433 - DNA, 16 bp, M. musculus
ttaaaagcccaaagtt

SEQ ID NO: 451434 - DNA, 18 bp, M. musculus
ttaaaagccccctactgt

SEQ ID NO: 451435 - DNA, 16 bp, M. musculus
ttaaaaggaagaaatg

SEQ ID NO: 451436 - DNA, 16 bp, M. musculus
ttaaaaggcattttta

SEQ ID NO: 451437 - DNA, 16 bp, M. musculus
ttaaaaggtatttatt

SEQ ID NO: 451438 - DNA, 16 bp, M. musculus
ttaaaagtatttcttt

SEQ ID NO: 451439 - DNA, 16 bp, M. musculus
ttaaaagtcatggaaa

SEQ ID NO: 451440 - DNA, 16 bp, M. musculus
ttaaaagtgagtacat

SEQ ID NO: 451441 - DNA, 16 bp, M. musculus
ttaaaagtgttttaaa

SEQ ID NO: 451442 - DNA, 16 bp, M. musculus
ttaaaagttaaaacaa

SEQ ID NO: 451443 - DNA, 16 bp, M. musculus
ttaaaagttcaaaatc

SEQ ID NO: 451444 - DNA, 16 bp, M. musculus
ttaaaagttcaaagtc

SEQ ID NO: 451445 - DNA, 16 bp, M. musculus
ttaaaagtttgtttgt

SEQ ID NO: 451446 - DNA, 16 bp, M. musculus
ttaaaagttttaaagt

SEQ ID NO: 451447 - DNA, 16 bp, M. musculus
ttaaaataaaatgtgt

SEQ ID NO: 451448 - DNA, 16 bp, M. musculus
ttaaaataaaccattt

SEQ ID NO: 451449 - DNA, 16 bp, M. musculus
ttaaaataaatccttt

SEQ ID NO: 451450 - DNA, 16 bp, M. musculus
ttaaaataaatgggtt

SEQ ID NO: 451451 - DNA, 16 bp, M. musculus
ttaaaataactgaaaa

SEQ ID NO: 451452 - DNA, 16 bp, M. musculus
ttaaaataatgaatgt

SEQ ID NO: 451453 - DNA, 16 bp, M. musculus
ttaaaatacatagaaa

SEQ ID NO: 451454 - DNA, 16 bp, M. musculus
ttaaaatactgaaaaa

SEQ ID NO: 451455 - DNA, 16 bp, M. musculus
ttaaaatatatttctg

SEQ ID NO: 451456 - DNA, 16 bp, M. musculus
ttaaaatatcttctta

SEQ ID NO: 451457 - DNA, 16 bp, M. musculus
ttaaaatatgttttct

SEQ ID NO: 451458 - DNA, 16 bp, M. musculus
ttaaaatatttctcat

SEQ ID NO: 451459 - DNA, 16 bp, M. musculus
ttaaaatatttttgct

SEQ ID NO: 451460 - DNA, 16 bp, M. musculus
ttaaaatcacatttaa

SEQ ID NO: 451461 - DNA, 16 bp, M. musculus
ttaaaatcactgactg

SEQ ID NO: 451462 - DNA, 16 bp, M. musculus
ttaaaatctatttgaa

SEQ ID NO: 451463 - DNA, 18 bp, M. musculus
ttaaaatcttggctctta

SEQ ID NO: 451464 - DNA, 16 bp, M. musculus
ttaaaatgacttattt

SEQ ID NO: 451465 - DNA, 16 bp, M. musculus
ttaaaatgagcagaat

SEQ ID NO: 451466 - DNA, 16 bp, M. musculus
ttaaaatgcatttatt

SEQ ID NO: 451467 - DNA, 16 bp, M. musculus
ttaaaatggaatttaa

SEQ ID NO: 451468 - DNA, 16 bp, M. musculus
ttaaaatggatatttt

SEQ ID NO: 451469 - DNA, 16 bp, M. musculus
ttaaaatgggatacag

SEQ ID NO: 451470 - DNA, 16 bp, M. musculus
ttaaaatggttttaaa

SEQ ID NO: 451471 - DNA, 16 bp, M. musculus
ttaaaatgtaaaatca

SEQ ID NO: 451472 - DNA, 16 bp, M. musculus
ttaaaatgtaactttt

SEQ ID NO: 451473 - DNA, 16 bp, M. musculus
ttaaaatgtcattttt

SEQ ID NO: 451474 - DNA, 16 bp, M. musculus
ttaaaatgttatttct

SEQ ID NO: 451475 - DNA, 16 bp, M. musculus
ttaaaatgttctgtag

SEQ ID NO: 451476 - DNA, 16 bp, M. musculus
ttaaaatgttttaaga

SEQ ID NO: 451477 - DNA, 16 bp, M. musculus
ttaaaatgttttaagt

SEQ ID NO: 451478 - DNA, 16 bp, M. musculus
ttaaaatgttttctat

SEQ ID NO: 451479 - DNA, 16 bp, M. musculus
ttaaaatgttttgaaa

SEQ ID NO: 451480 - DNA, 16 bp, M. musculus
ttaaaattaaaagcaa

SEQ ID NO: 451481 - DNA, 16 bp, M. musculus
ttaaaattctctcttt

SEQ ID NO: 451482 - DNA, 16 bp, M. musculus
ttaaaattctgtattt

SEQ ID NO: 451483 - DNA, 16 bp, M. musculus
ttaaaatttcaatctc

SEQ ID NO: 451484 - DNA, 16 bp, M. musculus
ttaaaatttcatgtgt

SEQ ID NO: 451485 - DNA, 16 bp, M. musculus
ttaaaatttctcttaa

SEQ ID NO: 451486 - DNA, 16 bp, M. musculus
ttaaaatttctgtttt

SEQ ID NO: 451487 - DNA, 16 bp, M. musculus
ttaaaatttgttcttt

SEQ ID NO: 451488 - DNA, 16 bp, M. musculus
ttaaaattttggagat

SEQ ID NO: 451489 - DNA, 16 bp, M. musculus
ttaaacaaaactggaa

SEQ ID NO: 451490 - DNA, 16 bp, M. musculus
ttaaacaaacagacaa

SEQ ID NO: 451491 - DNA, 16 bp, M. musculus
ttaaacacttcatcct

SEQ ID NO: 451492 - DNA, 16 bp, M. musculus
ttaaacagagaaataa

SEQ ID NO: 451493 - DNA, 16 bp, M. musculus
ttaaacatcagagagt

SEQ ID NO: 451494 - DNA, 16 bp, M. musculus
ttaaacatgtgggcca

SEQ ID NO: 451495 - DNA, 16 bp, M. musculus
ttaaaccagacttctc

SEQ ID NO: 451496 - DNA, 16 bp, M. musculus
ttaaacccttttattt

SEQ ID NO: 451497 - DNA, 16 bp, M. musculus
ttaaactcacagagat

SEQ ID NO: 451498 - DNA, 16 bp, M. musculus
ttaaactctaagaagt

SEQ ID NO: 451499 - DNA, 16 bp, M. musculus
ttaaacttgttttaat

SEQ ID NO: 451500 - DNA, 16 bp, M. musculus
ttaaacttttctggaa

SEQ ID NO: 451501 - DNA, 16 bp, M. musculus
ttaaagaaaaacagga

SEQ ID NO: 451502 - DNA, 16 bp, M. musculus
ttaaagaaaaattttc

SEQ ID NO: 451503 - DNA, 16 bp, M. musculus
ttaaagaaaacaattt

SEQ ID NO: 451504 - DNA, 16 bp, M. musculus
ttaaagaaaagcaatt

SEQ ID NO: 451505 - DNA, 16 bp, M. musculus
ttaaagaaaagtagtt

SEQ ID NO: 451506 - DNA, 16 bp, M. musculus
ttaaagaaaattgact

SEQ ID NO: 451507 - DNA, 16 bp, M. musculus
ttaaagaaagaaactg

SEQ ID NO: 451508 - DNA, 16 bp, M. musculus
ttaaagaaatacatga

SEQ ID NO: 451509 - DNA, 16 bp, M. musculus
ttaaagaaatattcag

SEQ ID NO: 451510 - DNA, 16 bp, M. musculus
ttaaagaaatgtttga

SEQ ID NO: 451511 - DNA, 16 bp, M. musculus
ttaaagaacaaagctt

SEQ ID NO: 451512 - DNA, 16 bp, M. musculus
ttaaagaacatctcag

SEQ ID NO: 451513 - DNA, 17 bp, M. musculus
ttaaagaacttgctgaa

SEQ ID NO: 451514 - DNA, 16 bp, M. musculus
ttaaagaagacctcag

SEQ ID NO: 451515 - DNA, 16 bp, M. musculus
ttaaagaagatctcaa

SEQ ID NO: 451516 - DNA, 16 bp, M. musculus
ttaaagaagcaaaggg

SEQ ID NO: 451517 - DNA, 16 bp, M. musculus
ttaaagaagctgaagg

SEQ ID NO: 451518 - DNA, 17 bp, M. musculus
ttaaagaattgcagaaa

SEQ ID NO: 451519 - DNA, 16 bp, M. musculus
ttaaagaatttcagga

SEQ ID NO: 451520 - DNA, 16 bp, M. musculus
ttaaagacacagatta

SEQ ID NO: 451521 - DNA, 16 bp, M. musculus
ttaaagacacatgcca

SEQ ID NO: 451522 - DNA, 16 bp, M. musculus
ttaaagacagtgtttc

SEQ ID NO: 451523 - DNA, 16 bp, M. musculus
ttaaagacatgtacta

SEQ ID NO: 451524 - DNA, 16 bp, M. musculus
ttaaagacattttaat

SEQ ID NO: 451525 - DNA, 16 bp, M. musculus
ttaaagactatttaga

SEQ ID NO: 451526 - DNA, 16 bp, M. musculus
ttaaagactttctctt

SEQ ID NO: 451527 - DNA, 16 bp, M. musculus
ttaaagacttttgaga

SEQ ID NO: 451528 - DNA, 16 bp, M. musculus
ttaaagactttttaaa

SEQ ID NO: 451529 - DNA, 16 bp, M. musculus
ttaaagactttttaca

SEQ ID NO: 451530 - DNA, 16 bp, M. musculus
ttaaagagaaaagacc

SEQ ID NO: 451531 - DNA, 16 bp, M. musculus
ttaaagaggaaaaaca

SEQ ID NO: 451532 - DNA, 16 bp, M. musculus
ttaaagagtttttaaa

SEQ ID NO: 451533 - DNA, 16 bp, M. musculus
ttaaagatagctctca

SEQ ID NO: 451534 - DNA, 17 bp, M. musculus
ttaaagatagctctcag

SEQ ID NO: 451535 - DNA, 16 bp, M. musculus
ttaaagatatgttcaa

SEQ ID NO: 451536 - DNA, 16 bp, M. musculus
ttaaagatggcaaaat

SEQ ID NO: 451537 - DNA, 16 bp, M. musculus
ttaaagatggttgtaa

SEQ ID NO: 451538 - DNA, 16 bp, M. musculus
ttaaagatgtgtacca

SEQ ID NO: 451539 - DNA, 16 bp, M. musculus
ttaaagatgttttctg

SEQ ID NO: 451540 - DNA, 16 bp, M. musculus
ttaaagatttatttag

SEQ ID NO: 451541 - DNA, 16 bp, M. musculus
ttaaagatttatttca

SEQ ID NO: 451542 - DNA, 16 bp, M. musculus
ttaaagcacacaccca

SEQ ID NO: 451543 - DNA, 16 bp, M. musculus
ttaaagcatacatttt

SEQ ID NO: 451544 - DNA, 16 bp, M. musculus
ttaaagcattccactg

SEQ ID NO: 451545 - DNA, 16 bp, M. musculus
ttaaagcattcctggg

SEQ ID NO: 451546 - DNA, 16 bp, M. musculus
ttaaagcatttaaaaa

SEQ ID NO: 451547 - DNA, 16 bp, M. musculus
ttaaagcatttaagaa

SEQ ID NO: 451548 - DNA, 16 bp, M. musculus
ttaaagcattttcttt

SEQ ID NO: 451549 - DNA, 16 bp, M. musculus
ttaaagccacatggaa

SEQ ID NO: 451550 - DNA, 16 bp, M. musculus
ttaaagccatgtgcca

SEQ ID NO: 451551 - DNA, 16 bp, M. musculus
ttaaagcccataccca

SEQ ID NO: 451552 - DNA, 16 bp, M. musculus
ttaaagcccatgccca

SEQ ID NO: 451553 - DNA, 16 bp, M. musculus
ttaaagctcactacag

SEQ ID NO: 451554 - DNA, 16 bp, M. musculus
ttaaagctcattgtgt

SEQ ID NO: 451555 - DNA, 16 bp, M. musculus
ttaaagctgtgtacca

SEQ ID NO: 451556 - DNA, 16 bp, M. musculus
ttaaagcttattataa

SEQ ID NO: 451557 - DNA, 16 bp, M. musculus
ttaaagctttatcttt

SEQ ID NO: 451558 - DNA, 16 bp, M. musculus
ttaaaggaaactggct

SEQ ID NO: 451559 - DNA, 16 bp, M. musculus
ttaaaggaactttagt

SEQ ID NO: 451560 - DNA, 16 bp, M. musculus
ttaaaggaagaaaatt

SEQ ID NO: 451561 - DNA, 16 bp, M. musculus
ttaaaggaggaaagat

SEQ ID NO: 451562 - DNA, 16 bp, M. musculus
ttaaaggatcgcagca

SEQ ID NO: 451563 - DNA, 16 bp, M. musculus
ttaaaggcatatgcca

SEQ ID NO: 451564 - DNA, 16 bp, M. musculus
ttaaaggcatgggcca

SEQ ID NO: 451565 - DNA, 16 bp, M. musculus
ttaaaggcattcacca

SEQ ID NO: 451566 - DNA, 16 bp, M. musculus
ttaaaggcctgtgcca

SEQ ID NO: 451567 - DNA, 16 bp, M. musculus
ttaaaggctgcaccac

SEQ ID NO: 451568 - DNA, 16 bp, M. musculus
ttaaagggacaccagg

SEQ ID NO: 451569 - DNA, 16 bp, M. musculus
ttaaagggatacaaat

SEQ ID NO: 451570 - DNA, 16 bp, M. musculus
ttaaagggtcagtaaa

SEQ ID NO: 451571 - DNA, 16 bp, M. musculus
ttaaagggttgcagca

SEQ ID NO: 451572 - DNA, 16 bp, M. musculus
ttaaaggtattcacca

SEQ ID NO: 451573 - DNA, 16 bp, M. musculus
ttaaaggtctgtgcca

SEQ ID NO: 451574 - DNA, 16 bp, M. musculus
ttaaaggtgtatgcca

SEQ ID NO: 451575 - DNA, 16 bp, M. musculus
ttaaaggtgtgtaaca

SEQ ID NO: 451576 - DNA, 16 bp, M. musculus
ttaaaggtgtgtacca

SEQ ID NO: 451577 - DNA, 16 bp, M. musculus
ttaaaggtgtgtgccg

SEQ ID NO: 451578 - DNA, 16 bp, M. musculus
ttaaagtactttttaa

SEQ ID NO: 451579 - DNA, 16 bp, M. musculus
ttaaagtatgtcttta

SEQ ID NO: 451580 - DNA, 16 bp, M. musculus
ttaaagtatttttctt

SEQ ID NO: 451581 - DNA, 16 bp, M. musculus
ttaaagtgatttttaa

SEQ ID NO: 451582 - DNA, 16 bp, M. musculus
ttaaagtggcagtttt

SEQ ID NO: 451583 - DNA, 16 bp, M. musculus
ttaaagtgttcttgga

SEQ ID NO: 451584 - DNA, 16 bp, M. musculus
ttaaagtgttttaaaa

SEQ ID NO: 451585 - DNA, 16 bp, M. musculus
ttaaagtgttttaaat

SEQ ID NO: 451586 - DNA, 16 bp, M. musculus
ttaaagttatttaaga

SEQ ID NO: 451587 - DNA, 16 bp, M. musculus
ttaaagttggatctca

SEQ ID NO: 451588 - DNA, 16 bp, M. musculus
ttaaagtttgattgtt

SEQ ID NO: 451589 - DNA, 16 bp, M. musculus
ttaaagtttgcatttt

SEQ ID NO: 451590 - DNA, 16 bp, M. musculus
ttaaagttttaacatc

SEQ ID NO: 451591 - DNA, 16 bp, M. musculus
ttaaataccttttgca

SEQ ID NO: 451592 - DNA, 16 bp, M. musculus
ttaaatactgtatttt

SEQ ID NO: 451593 - DNA, 16 bp, M. musculus
ttaaatactttcttac

SEQ ID NO: 451594 - DNA, 16 bp, M. musculus
ttaaatagccacaggt

SEQ ID NO: 451595 - DNA, 16 bp, M. musculus
ttaaatatacatttca

SEQ ID NO: 451596 - DNA, 16 bp, M. musculus
ttaaatatatatgtgt

SEQ ID NO: 451597 - DNA, 16 bp, M. musculus
ttaaatatgctggcaa

SEQ ID NO: 451598 - DNA, 16 bp, M. musculus
ttaaatatgggccttg

SEQ ID NO: 451599 - DNA, 16 bp, M. musculus
ttaaatatgtacatat

SEQ ID NO: 451600 - DNA, 16 bp, M. musculus
ttaaatatgtctaaaa

SEQ ID NO: 451601 - DNA, 16 bp, M. musculus
ttaaatattgttttca

SEQ ID NO: 451602 - DNA, 16 bp, M. musculus
ttaaatcaagagcaga

SEQ ID NO: 451603 - DNA, 16 bp, M. musculus
ttaaatcacacatcaa

SEQ ID NO: 451604 - DNA, 16 bp, M. musculus
ttaaatcccagcactc

SEQ ID NO: 451605 - DNA, 16 bp, M. musculus
ttaaatctctacctac

SEQ ID NO: 451606 - DNA, 16 bp, M. musculus
ttaaatcttctttgaa

SEQ ID NO: 451607 - DNA, 16 bp, M. musculus
ttaaatcttgggtatt

SEQ ID NO: 451608 - DNA, 16 bp, M. musculus
ttaaatgaaaatgaag

SEQ ID NO: 451609 - DNA, 16 bp, M. musculus
ttaaatgatttccttt

SEQ ID NO: 451610 - DNA, 16 bp, M. musculus
ttaaatgctaacattt

SEQ ID NO: 451611 - DNA, 16 bp, M. musculus
ttaaatgctatttaaa

SEQ ID NO: 451612 - DNA, 16 bp, M. musculus
ttaaatgctttaaaat

SEQ ID NO: 451613 - DNA, 16 bp, M. musculus
ttaaatgctttaacct

SEQ ID NO: 451614 - DNA, 16 bp, M. musculus
ttaaatgctttctctt

SEQ ID NO: 451615 - DNA, 16 bp, M. musculus
ttaaatggtgtgtgtg

SEQ ID NO: 451616 - DNA, 16 bp, M. musculus
ttaaatgtaaaatgtt

SEQ ID NO: 451617 - DNA, 16 bp, M. musculus
ttaaatgtatataaag

SEQ ID NO: 451618 - DNA, 16 bp, M. musculus
ttaaatgtattcattt

SEQ ID NO: 451619 - DNA, 16 bp, M. musculus
ttaaatgtattttgca

SEQ ID NO: 451620 - DNA, 16 bp, M. musculus
ttaaatgttaaaatgt

SEQ ID NO: 451621 - DNA, 25 bp, M. musculus
ttaaatgttaaccagatgctctgct

SEQ ID NO: 451622 - DNA, 16 bp, M. musculus
ttaaatgttctgtaga

SEQ ID NO: 451623 - DNA, 16 bp, M. musculus
ttaaatgtttacattt

SEQ ID NO: 451624 - DNA, 16 bp, M. musculus
ttaaatgtttatcttt

SEQ ID NO: 451625 - DNA, 16 bp, M. musculus
ttaaatgtttcaacct

SEQ ID NO: 451626 - DNA, 16 bp, M. musculus
ttaaatgtttcctttt

SEQ ID NO: 451627 - DNA, 16 bp, M. musculus
ttaaatgtttctcttt

SEQ ID NO: 451628 - DNA, 16 bp, M. musculus
ttaaatgtttgcattt

SEQ ID NO: 451629 - DNA, 16 bp, M. musculus
ttaaatgtttgtcttt

SEQ ID NO: 451630 - DNA, 16 bp, M. musculus
ttaaatgttttaaaga

SEQ ID NO: 451631 - DNA, 16 bp, M. musculus
ttaaatgttttacatt

SEQ ID NO: 451632 - DNA, 16 bp, M. musculus
ttaaattcttgatctt

SEQ ID NO: 451633 - DNA, 16 bp, M. musculus
ttaaattgacataaaa

SEQ ID NO: 451634 - DNA, 16 bp, M. musculus
ttaaatttaaaagcaa

SEQ ID NO: 451635 - DNA, 16 bp, M. musculus
ttaaatttctgtttct

SEQ ID NO: 451636 - DNA, 16 bp, M. musculus
ttaaatttgaatttca

SEQ ID NO: 451637 - DNA, 16 bp, M. musculus
ttaaatttgaccttag

SEQ ID NO: 451638 - DNA, 16 bp, M. musculus
ttaaatttgtatttct

SEQ ID NO: 451639 - DNA, 16 bp, M. musculus
ttaaatttgtgatgtt

SEQ ID NO: 451640 - DNA, 16 bp, M. musculus
ttaaattttcattttg

SEQ ID NO: 451641 - DNA, 16 bp, M. musculus
ttaaatttttgtttca

SEQ ID NO: 451642 - DNA, 16 bp, M. musculus
ttaacaaaatctgaaa

SEQ ID NO: 451643 - DNA, 16 bp, M. musculus
ttaacaaagagaaaat

SEQ ID NO: 451644 - DNA, 16 bp, M. musculus
ttaacaagcagaaggg

SEQ ID NO: 451645 - DNA, 16 bp, M. musculus
ttaacaagccaaaggg

SEQ ID NO: 451646 - DNA, 16 bp, M. musculus
ttaacaatagtcacaa

SEQ ID NO: 451647 - DNA, 16 bp, M. musculus
ttaacaatgaaagaac

SEQ ID NO: 451648 - DNA, 16 bp, M. musculus
ttaacagaatcagaaa

SEQ ID NO: 451649 - DNA, 16 bp, M. musculus
ttaacagcacacatga

SEQ ID NO: 451650 - DNA, 16 bp, M. musculus
ttaacatcaatggact

SEQ ID NO: 451651 - DNA, 16 bp, M. musculus
ttaacatctgagccat

SEQ ID NO: 451652 - DNA, 16 bp, M. musculus
ttaacatcttttaaaa

SEQ ID NO: 451653 - DNA, 16 bp, M. musculus
ttaacatgcagaagaa

SEQ ID NO: 451654 - DNA, 16 bp, M. musculus
ttaacattgcaaatga

SEQ ID NO: 451655 - DNA, 16 bp, M. musculus
ttaacatttcaaattt

SEQ ID NO: 451656 - DNA, 16 bp, M. musculus
ttaacattttaacaac

SEQ ID NO: 451657 - DNA, 16 bp, M. musculus
ttaacattttctaaat

SEQ ID NO: 451658 - DNA, 24 bp, M. musculus
ttaaccaatgtggttaaacttttt

SEQ ID NO: 451659 - DNA, 16 bp, M. musculus
ttaaccaccagttgtg

SEQ ID NO: 451660 - DNA, 16 bp, M. musculus
ttaaccaccctcatat

SEQ ID NO: 451661 - DNA, 16 bp, M. musculus
ttaaccactaaaccat

SEQ ID NO: 451662 - DNA, 16 bp, M. musculus
ttaaccactaagacat

SEQ ID NO: 451663 - DNA, 16 bp, M. musculus
ttaaccactaagccat

SEQ ID NO: 451664 - DNA, 16 bp, M. musculus
ttaaccactgagtcag

SEQ ID NO: 451665 - DNA, 16 bp, M. musculus
ttaaccagagccatct

SEQ ID NO: 451666 - DNA, 16 bp, M. musculus
ttaaccattgagccat

SEQ ID NO: 451667 - DNA, 16 bp, M. musculus
ttaacctagaattgtt

SEQ ID NO: 451668 - DNA, 16 bp, M. musculus
ttaacctctaaaaagt

SEQ ID NO: 451669 - DNA, 16 bp, M. musculus
ttaacctctgacctcc

SEQ ID NO: 451670 - DNA, 16 bp, M. musculus
ttaaccttagccattc

SEQ ID NO: 451671 - DNA, 16 bp, M. musculus
ttaactatcttaggat

SEQ ID NO: 451672 - DNA, 16 bp, M. musculus
ttaactcaaacaaaac

SEQ ID NO: 451673 - DNA, 16 bp, M. musculus
ttaactcacaggctta

SEQ ID NO: 451674 - DNA, 16 bp, M. musculus
ttaactgaagtgggaa

SEQ ID NO: 451675 - DNA, 17 bp, M. musculus
ttaactggagaaaaagc

SEQ ID NO: 451676 - DNA, 16 bp, M. musculus
ttaactggctgtctgt

SEQ ID NO: 451677 - DNA, 16 bp, M. musculus
ttaactgtcaacctga

SEQ ID NO: 451678 - DNA, 16 bp, M. musculus
ttaactgttgagccat

SEQ ID NO: 451679 - DNA, 16 bp, M. musculus
ttaacttagatgagct

SEQ ID NO: 451680 - DNA, 16 bp, M. musculus
ttaacttgttttgaaa

SEQ ID NO: 451681 - DNA, 16 bp, M. musculus
ttaacttttaaaagaa

SEQ ID NO: 451682 - DNA, 16 bp, M. musculus
ttaacttttaaaatgt

SEQ ID NO: 451683 - DNA, 16 bp, M. musculus
ttaagaaaaatcattt

SEQ ID NO: 451684 - DNA, 16 bp, M. musculus
ttaagaaaacccaaag

SEQ ID NO: 451685 - DNA, 16 bp, M. musculus
ttaagaaaatacccta

SEQ ID NO: 451686 - DNA, 16 bp, M. musculus
ttaagaaaatgcctta

SEQ ID NO: 451687 - DNA, 16 bp, M. musculus
ttaagaaaatgccttg

SEQ ID NO: 451688 - DNA, 16 bp, M. musculus
ttaagaaaatgcttta

SEQ ID NO: 451689 - DNA, 16 bp, M. musculus
ttaagaaaatgttcta

SEQ ID NO: 451690 - DNA, 16 bp, M. musculus
ttaagaacaatgactt

SEQ ID NO: 451691 - DNA, 16 bp, M. musculus
ttaagaacaccggctg

SEQ ID NO: 451692 - DNA, 16 bp, M. musculus
ttaagaacactgagtg

SEQ ID NO: 451693 - DNA, 16 bp, M. musculus
ttaagaacactttctg

SEQ ID NO: 451694 - DNA, 16 bp, M. musculus
ttaagaacattggctg

SEQ ID NO: 451695 - DNA, 17 bp, M. musculus
ttaagaaggccacacca

SEQ ID NO: 451696 - DNA, 16 bp, M. musculus
ttaagaaggttaaaaa

SEQ ID NO: 451697 - DNA, 16 bp, M. musculus
ttaagaatactgactg

SEQ ID NO: 451698 - DNA, 16 bp, M. musculus
ttaagaatacttgctg

SEQ ID NO: 451699 - DNA, 16 bp, M. musculus
ttaagaatgtttgctg

SEQ ID NO: 451700 - DNA, 16 bp, M. musculus
ttaagaattaaaatgt

SEQ ID NO: 451701 - DNA, 16 bp, M. musculus
ttaagaatttcataaa

SEQ ID NO: 451702 - DNA, 16 bp, M. musculus
ttaagacaaggtctct

SEQ ID NO: 451703 - DNA, 16 bp, M. musculus
ttaagacagtctcact

SEQ ID NO: 451704 - DNA, 16 bp, M. musculus
ttaagacagtgtttct

SEQ ID NO: 451705 - DNA, 23 bp, M. musculus
ttaagacattcctgaggctgctt

SEQ ID NO: 451706 - DNA, 16 bp, M. musculus
ttaagactatcaaaca

SEQ ID NO: 451707 - DNA, 16 bp, M. musculus
ttaagacttttgaaga

SEQ ID NO: 451708 - DNA, 16 bp, M. musculus
ttaagagaaagtactg

SEQ ID NO: 451709 - DNA, 16 bp, M. musculus
ttaagagaattattta

SEQ ID NO: 451710 - DNA, 22 bp, M. musculus
ttaagagatattaaggaaaagt

SEQ ID NO: 451711 - DNA, 16 bp, M. musculus
ttaagagcacatactg

SEQ ID NO: 451712 - DNA, 16 bp, M. musculus
ttaagagcacgggctg

SEQ ID NO: 451713 - DNA, 16 bp, M. musculus
ttaagagcactgactt

SEQ ID NO: 451714 - DNA, 16 bp, M. musculus
ttaagagcactgattg

SEQ ID NO: 451715 - DNA, 16 bp, M. musculus
ttaagagcactggcta

SEQ ID NO: 451716 - DNA, 16 bp, M. musculus
ttaagagcactgtctg

SEQ ID NO: 451717 - DNA, 16 bp, M. musculus
ttaagagcacttattg

SEQ ID NO: 451718 - DNA, 16 bp, M. musculus
ttaagagccagaggtg

SEQ ID NO: 451719 - DNA, 16 bp, M. musculus
ttaagagctctgactg

SEQ ID NO: 451720 - DNA, 16 bp, M. musculus
ttaagagtactggctg

SEQ ID NO: 451721 - DNA, 16 bp, M. musculus
ttaagagtgtgtgctg

SEQ ID NO: 451722 - DNA, 16 bp, M. musculus
ttaagatcactgactg

SEQ ID NO: 451723 - DNA, 16 bp, M. musculus
ttaagatttactttat

SEQ ID NO: 451724 - DNA, 16 bp, M. musculus
ttaagcaaaaatccct

SEQ ID NO: 451725 - DNA, 16 bp, M. musculus
ttaagcaacaacaaca

SEQ ID NO: 451726 - DNA, 16 bp, M. musculus
ttaagcagcactcctc

SEQ ID NO: 451727 - DNA, 16 bp, M. musculus
ttaagcattgagccat

SEQ ID NO: 451728 - DNA, 16 bp, M. musculus
ttaagccacagcagca

SEQ ID NO: 451729 - DNA, 16 bp, M. musculus
ttaagccatctcttca

SEQ ID NO: 451730 - DNA, 16 bp, M. musculus
ttaagccctccttgtt

SEQ ID NO: 451731 - DNA, 16 bp, M. musculus
ttaagctcttttataa

SEQ ID NO: 451732 - DNA, 16 bp, M. musculus
ttaaggaaaacaaaca

SEQ ID NO: 451733 - DNA, 16 bp, M. musculus
ttaaggaacaagcaag

SEQ ID NO: 451734 - DNA, 16 bp, M. musculus
ttaaggaagaaaatgt

SEQ ID NO: 451735 - DNA, 16 bp, M. musculus
ttaaggaaggaataaa

SEQ ID NO: 451736 - DNA, 16 bp, M. musculus
ttaaggacacttgctg

SEQ ID NO: 451737 - DNA, 17 bp, M. musculus
ttaaggagaattatcct

SEQ ID NO: 451738 - DNA, 16 bp, M. musculus
ttaaggagatctctga

SEQ ID NO: 451739 - DNA, 16 bp, M. musculus
ttaaggaggaactaga

SEQ ID NO: 451740 - DNA, 16 bp, M. musculus
ttaaggaggcagagaa

SEQ ID NO: 451741 - DNA, 16 bp, M. musculus
ttaaggatggttgtga

SEQ ID NO: 451742 - DNA, 16 bp, M. musculus
ttaaggatgttgaaat

SEQ ID NO: 451743 - DNA, 16 bp, M. musculus
ttaaggcaaggtctct

SEQ ID NO: 451744 - DNA, 16 bp, M. musculus
ttaaggcatgcaccac

SEQ ID NO: 451745 - DNA, 16 bp, M. musculus
ttaaggcattttatta

SEQ ID NO: 451746 - DNA, 16 bp, M. musculus
ttaaggccagcctgga

SEQ ID NO: 451747 - DNA, 16 bp, M. musculus
ttaaggctgctgtggt

SEQ ID NO: 451748 - DNA, 16 bp, M. musculus
ttaaggctggatgagg

SEQ ID NO: 451749 - DNA, 18 bp, M. musculus
ttaaggctttctttacca

SEQ ID NO: 451750 - DNA, 16 bp, M. musculus
ttaagggtgagccatc

SEQ ID NO: 451751 - DNA, 16 bp, M. musculus
ttaaggtcaatctaca

SEQ ID NO: 451752 - DNA, 16 bp, M. musculus
ttaaggtcattttctt

SEQ ID NO: 451753 - DNA, 16 bp, M. musculus
ttaaggttttaaaatt

SEQ ID NO: 451754 - DNA, 16 bp, M. musculus
ttaagtatactatcat

SEQ ID NO: 451755 - DNA, 16 bp, M. musculus
ttaagtgtaagagcct

SEQ ID NO: 451756 - DNA, 16 bp, M. musculus
ttaagtgtccataggt

SEQ ID NO: 451757 - DNA, 16 bp, M. musculus
ttaagtgtccctcctt

SEQ ID NO: 451758 - DNA, 16 bp, M. musculus
ttaagttaggatagat

SEQ ID NO: 451759 - DNA, 16 bp, M. musculus
ttaagttgaaaatatt

SEQ ID NO: 451760 - DNA, 17 bp, M. musculus
ttaagttgaaaatcttc

SEQ ID NO: 451761 - DNA, 16 bp, M. musculus
ttaagtttaaattact

SEQ ID NO: 451762 - DNA, 16 bp, M. musculus
ttaagttttaaaagtt

SEQ ID NO: 451763 - DNA, 16 bp, M. musculus
ttaagttttctttaaa

SEQ ID NO: 451764 - DNA, 16 bp, M. musculus
ttaataaaaaatgcat

SEQ ID NO: 451765 - DNA, 16 bp, M. musculus
ttaataaaatatgtct

SEQ ID NO: 451766 - DNA, 16 bp, M. musculus
ttaataaacttgcttg

SEQ ID NO: 451767 - DNA, 16 bp, M. musculus
ttaataaaggatctct

SEQ ID NO: 451768 - DNA, 16 bp, M. musculus
ttaataaatgagacct

SEQ ID NO: 451769 - DNA, 16 bp, M. musculus
ttaataacaattggtg

SEQ ID NO: 451770 - DNA, 16 bp, M. musculus
ttaataacagggagga

SEQ ID NO: 451771 - DNA, 16 bp, M. musculus
ttaataactcacttaa

SEQ ID NO: 451772 - DNA, 16 bp, M. musculus
ttaataacttacttaa

SEQ ID NO: 451773 - DNA, 16 bp, M. musculus
ttaataataaaatctg

SEQ ID NO: 451774 - DNA, 16 bp, M. musculus
ttaataatattgagta

SEQ ID NO: 451775 - DNA, 16 bp, M. musculus
ttaatacaagctctat

SEQ ID NO: 451776 - DNA, 16 bp, M. musculus
ttaataccagcactgg

SEQ ID NO: 451777 - DNA, 16 bp, M. musculus
ttaatactgctgacac

SEQ ID NO: 451778 - DNA, 16 bp, M. musculus
ttaatagagaagaaag

SEQ ID NO: 451779 - DNA, 48 bp, M. musculus
ttaataggggacgactgggatgagactggactcgggtgtcgcactccc

SEQ ID NO: 451780 - DNA, 16 bp, M. musculus
ttaatagtatcagggg

SEQ ID NO: 451781 - DNA, 16 bp, M. musculus
ttaatatactatatga

SEQ ID NO: 451782 - DNA, 16 bp, M. musculus
ttaatatcttaatatc

SEQ ID NO: 451783 - DNA, 16 bp, M. musculus
ttaatatgattacatg

SEQ ID NO: 451784 - DNA, 16 bp, M. musculus
ttaatattatatccag

SEQ ID NO: 451785 - DNA, 17 bp, M. musculus
ttaatattctgtaataa

SEQ ID NO: 451786 - DNA, 16 bp, M. musculus
ttaatattcttgcttt

SEQ ID NO: 451787 - DNA, 16 bp, M. musculus
ttaatatttcatgaat

SEQ ID NO: 451788 - DNA, 16 bp, M. musculus
ttaatatttccagcaa

SEQ ID NO: 451789 - DNA, 16 bp, M. musculus
ttaatatttgaaatgt

SEQ ID NO: 451790 - DNA, 16 bp, M. musculus
ttaatcactgagacat

SEQ ID NO: 451791 - DNA, 16 bp, M. musculus
ttaatcccaacactca

SEQ ID NO: 451792 - DNA, 16 bp, M. musculus
ttaatcccagcccttg

SEQ ID NO: 451793 - DNA, 16 bp, M. musculus
ttaatcctagcactgg

SEQ ID NO: 451794 - DNA, 16 bp, M. musculus
ttaatcctagctcttg

SEQ ID NO: 451795 - DNA, 16 bp, M. musculus
ttaatctgtatatact

SEQ ID NO: 451796 - DNA, 16 bp, M. musculus
ttaatctgtcctgaaa

SEQ ID NO: 451797 - DNA, 16 bp, M. musculus
ttaatctgtttatctc

SEQ ID NO: 451798 - DNA, 16 bp, M. musculus
ttaatcttactgatcc

SEQ ID NO: 451799 - DNA, 16 bp, M. musculus
ttaatcttcactgtca

SEQ ID NO: 451800 - DNA, 16 bp, M. musculus
ttaatgaaaatgaacc

SEQ ID NO: 451801 - DNA, 16 bp, M. musculus
ttaatgacaccagaga

SEQ ID NO: 451802 - DNA, 16 bp, M. musculus
ttaatgactgatgtgg

SEQ ID NO: 451803 - DNA, 16 bp, M. musculus
ttaatgatattcttct

SEQ ID NO: 451804 - DNA, 16 bp, M. musculus
ttaatgcattttaaaa

SEQ ID NO: 451805 - DNA, 16 bp, M. musculus
ttaatggaaatgcttt

SEQ ID NO: 451806 - DNA, 16 bp, M. musculus
ttaatggaactatttt

SEQ ID NO: 451807 - DNA, 16 bp, M. musculus
ttaatggctatctttg

SEQ ID NO: 451808 - DNA, 16 bp, M. musculus
ttaatgggaaaaaaga

SEQ ID NO: 451809 - DNA, 16 bp, M. musculus
ttaatgggccagtaaa

SEQ ID NO: 451810 - DNA, 16 bp, M. musculus
ttaatgtgaaaattaa

SEQ ID NO: 451811 - DNA, 16 bp, M. musculus
ttaatgttcaaacaag

SEQ ID NO: 451812 - DNA, 16 bp, M. musculus
ttaatgttttcattat

SEQ ID NO: 451813 - DNA, 16 bp, M. musculus
ttaattaaagcttgct

SEQ ID NO: 451814 - DNA, 16 bp, M. musculus
ttaattaagaaaatac

SEQ ID NO: 451815 - DNA, 16 bp, M. musculus
ttaattacatgtattt

SEQ ID NO: 451816 - DNA, 16 bp, M. musculus
ttaattagggaagcag

SEQ ID NO: 451817 - DNA, 16 bp, M. musculus
ttaattagttagttaa

SEQ ID NO: 451818 - DNA, 16 bp, M. musculus
ttaattatgagaaatt

SEQ ID NO: 451819 - DNA, 16 bp, M. musculus
ttaattcaaaaagaaa

SEQ ID NO: 451820 - DNA, 25 bp, M. musculus
ttaattcaagcctcatagatgactt

SEQ ID NO: 451821 - DNA, 16 bp, M. musculus
ttaattcctagcacct

SEQ ID NO: 451822 - DNA, 16 bp, M. musculus
ttaattctttgacaat

SEQ ID NO: 451823 - DNA, 16 bp, M. musculus
ttaattgacctttttc

SEQ ID NO: 451824 - DNA, 16 bp, M. musculus
ttaattgactaagacc

SEQ ID NO: 451825 - DNA, 16 bp, M. musculus
ttaattgagactgctg

SEQ ID NO: 451826 - DNA, 16 bp, M. musculus
ttaattgaggatggct

SEQ ID NO: 451827 - DNA, 16 bp, M. musculus
ttaattgaggtaggaa

SEQ ID NO: 451828 - DNA, 16 bp, M. musculus
ttaattgatgttacat

SEQ ID NO: 451829 - DNA, 16 bp, M. musculus
ttaattgattctttgt

SEQ ID NO: 451830 - DNA, 16 bp, M. musculus
ttaattgctgttcaaa

SEQ ID NO: 451831 - DNA, 16 bp, M. musculus
ttaattgcttctgaga

SEQ ID NO: 451832 - DNA, 16 bp, M. musculus
ttaattgggacttgct

SEQ ID NO: 451833 - DNA, 16 bp, M. musculus
ttaattgtagtagtga

SEQ ID NO: 451834 - DNA, 16 bp, M. musculus
ttaattgtcaacctga

SEQ ID NO: 451835 - DNA, 16 bp, M. musculus
ttaattgtcaacttga

SEQ ID NO: 451836 - DNA, 16 bp, M. musculus
ttaattgttcatctta

SEQ ID NO: 451837 - DNA, 16 bp, M. musculus
ttaatttcagcacttg

SEQ ID NO: 451838 - DNA, 16 bp, M. musculus
ttaatttcattgacaa

SEQ ID NO: 451839 - DNA, 16 bp, M. musculus
ttaatttcccaataaa

SEQ ID NO: 451840 - DNA, 16 bp, M. musculus
ttaatttctgctctga

SEQ ID NO: 451841 - DNA, 16 bp, M. musculus
ttaatttctgggtttt

SEQ ID NO: 451842 - DNA, 16 bp, M. musculus
ttaatttctttaaagg

SEQ ID NO: 451843 - DNA, 16 bp, M. musculus
ttaatttgcatttctc

SEQ ID NO: 451844 - DNA, 16 bp, M. musculus
ttaatttgcttttccc

SEQ ID NO: 451845 - DNA, 16 bp, M. musculus
ttaatttggaataaca

SEQ ID NO: 451846 - DNA, 16 bp, M. musculus
ttaatttggctctttt

SEQ ID NO: 451847 - DNA, 16 bp, M. musculus
ttaatttgtatactga

SEQ ID NO: 451848 - DNA, 16 bp, M. musculus
ttaattttaaaatgct

SEQ ID NO: 451849 - DNA, 16 bp, M. musculus
ttaattttcattgtca

SEQ ID NO: 451850 - DNA, 16 bp, M. musculus
ttaattttgcatttta

SEQ ID NO: 451851 - DNA, 16 bp, M. musculus
ttaatttttaaaagtg

SEQ ID NO: 451852 - DNA, 16 bp, M. musculus
ttaatttttaaagaca

SEQ ID NO: 451853 - DNA, 16 bp, M. musculus
ttaatttttccctctg

SEQ ID NO: 451854 - DNA, 16 bp, M. musculus
ttaatttttttacagt

SEQ ID NO: 451855 - DNA, 16 bp, M. musculus
ttaatttttttccaga

SEQ ID NO: 451856 - DNA, 16 bp, M. musculus
ttacaaaacatttttt

SEQ ID NO: 451857 - DNA, 16 bp, M. musculus
ttacaaaatgaaataa

SEQ ID NO: 451858 - DNA, 16 bp, M. musculus
ttacaaacatttgtga

SEQ ID NO: 451859 - DNA, 16 bp, M. musculus
ttacaaagagagttcc

SEQ ID NO: 451860 - DNA, 16 bp, M. musculus
ttacaaagatttattt

SEQ ID NO: 451861 - DNA, 16 bp, M. musculus
ttacaaagttattttt

SEQ ID NO: 451862 - DNA, 16 bp, M. musculus
ttacaaagtttaaaaa

SEQ ID NO: 451863 - DNA, 23 bp, M. musculus
ttacaaataaactcaggcaagat

SEQ ID NO: 451864 - DNA, 16 bp, M. musculus
ttacaaataatgctgc

SEQ ID NO: 451865 - DNA, 16 bp, M. musculus
ttacaaatgaatgaga

SEQ ID NO: 451866 - DNA, 16 bp, M. musculus
ttacaaatggttgtaa

SEQ ID NO: 451867 - DNA, 17 bp, M. musculus
ttacaaattaaagaact

SEQ ID NO: 451868 - DNA, 16 bp, M. musculus
ttacaacaaaacagaa

SEQ ID NO: 451869 - DNA, 16 bp, M. musculus
ttacaaccatctgcaa

SEQ ID NO: 451870 - DNA, 19 bp, M. musculus
ttacaaccatctgtaatga

SEQ ID NO: 451871 - DNA, 19 bp, M. musculus
ttacaaccatctgtaatgg

SEQ ID NO: 451872 - DNA, 16 bp, M. musculus
ttacaaccctctgtaa

SEQ ID NO: 451873 - DNA, 16 bp, M. musculus
ttacaactatctgtaa

SEQ ID NO: 451874 - DNA, 16 bp, M. musculus
ttacaactctctgtaa

SEQ ID NO: 451875 - DNA, 16 bp, M. musculus
ttacaagcagttgtga

SEQ ID NO: 451876 - DNA, 16 bp, M. musculus
ttacaagtgtgagcca

SEQ ID NO: 451877 - DNA, 16 bp, M. musculus
ttacaagttcagaagt

SEQ ID NO: 451878 - DNA, 16 bp, M. musculus
ttacaatacatagcaa

SEQ ID NO: 451879 - DNA, 16 bp, M. musculus
ttacaatagccagaag

SEQ ID NO: 451880 - DNA, 16 bp, M. musculus
ttacaatataattaca

SEQ ID NO: 451881 - DNA, 16 bp, M. musculus
ttacaattatgaagta

SEQ ID NO: 451882 - DNA, 16 bp, M. musculus
ttacacaatggaaaac

SEQ ID NO: 451883 - DNA, 16 bp, M. musculus
ttacacaatgtagtac

SEQ ID NO: 451884 - DNA, 16 bp, M. musculus
ttacacacacaaacac

SEQ ID NO: 451885 - DNA, 16 bp, M. musculus
ttacacacacacatac

SEQ ID NO: 451886 - DNA, 16 bp, M. musculus
ttacacataaacacat

SEQ ID NO: 451887 - DNA, 16 bp, M. musculus
ttacacatatatgtat

SEQ ID NO: 451888 - DNA, 16 bp, M. musculus
ttacaccagaattctc

SEQ ID NO: 451889 - DNA, 16 bp, M. musculus
ttacaccagacttcta

SEQ ID NO: 451890 - DNA, 16 bp, M. musculus
ttacaccatatttttc

SEQ ID NO: 451891 - DNA, 16 bp, M. musculus
ttacaccttctgctgg

SEQ ID NO: 451892 - DNA, 16 bp, M. musculus
ttacactattactgag

SEQ ID NO: 451893 - DNA, 16 bp, M. musculus
ttacactccatatttc

SEQ ID NO: 451894 - DNA, 16 bp, M. musculus
ttacactgatacctaa

SEQ ID NO: 451895 - DNA, 16 bp, M. musculus
ttacactgcatattct

SEQ ID NO: 451896 - DNA, 17 bp, M. musculus
ttacacttccacattgt

SEQ ID NO: 451897 - DNA, 16 bp, M. musculus
ttacacttcttcattg

SEQ ID NO: 451898 - DNA, 16 bp, M. musculus
ttacacttggttgatt

SEQ ID NO: 451899 - DNA, 16 bp, M. musculus
ttacagaaaaacaact

SEQ ID NO: 451900 - DNA, 16 bp, M. musculus
ttacagaaaaagagaa

SEQ ID NO: 451901 - DNA, 16 bp, M. musculus
ttacagaaaacaaaga

SEQ ID NO: 451902 - DNA, 16 bp, M. musculus
ttacagaaaagtaatt

SEQ ID NO: 451903 - DNA, 16 bp, M. musculus
ttacagaaagctcttg

SEQ ID NO: 451904 - DNA, 16 bp, M. musculus
ttacagaagaaaacaa

SEQ ID NO: 451905 - DNA, 16 bp, M. musculus
ttacagaagctttgta

SEQ ID NO: 451906 - DNA, 16 bp, M. musculus
ttacagaagtgaaaac

SEQ ID NO: 451907 - DNA, 16 bp, M. musculus
ttacagaagttatgaa

SEQ ID NO: 451908 - DNA, 16 bp, M. musculus
ttacagacacaccaga

SEQ ID NO: 451909 - DNA, 16 bp, M. musculus
ttacagacacttgtga

SEQ ID NO: 451910 - DNA, 16 bp, M. musculus
ttacagacagctgtga

SEQ ID NO: 451911 - DNA, 16 bp, M. musculus
ttacagacagttatga

SEQ ID NO: 451912 - DNA, 16 bp, M. musculus
ttacagacagttgtaa

SEQ ID NO: 451913 - DNA, 16 bp, M. musculus
ttacagacagttgtga

SEQ ID NO: 451914 - DNA, 16 bp, M. musculus
ttacagacatgcacca

SEQ ID NO: 451915 - DNA, 16 bp, M. musculus
ttacagagaaaatgtt

SEQ ID NO: 451916 - DNA, 16 bp, M. musculus
ttacagagaacccaag

SEQ ID NO: 451917 - DNA, 16 bp, M. musculus
ttacagagacaaattt

SEQ ID NO: 451918 - DNA, 16 bp, M. musculus
ttacagagatcaaaga

SEQ ID NO: 451919 - DNA, 16 bp, M. musculus
ttacagaggacataga

SEQ ID NO: 451920 - DNA, 16 bp, M. musculus
ttacagaggacctggg

SEQ ID NO: 451921 - DNA, 16 bp, M. musculus
ttacagaggagaaagt

SEQ ID NO: 451922 - DNA, 16 bp, M. musculus
ttacagagggttgtga

SEQ ID NO: 451923 - DNA, 16 bp, M. musculus
ttacagatagttttga

SEQ ID NO: 451924 - DNA, 16 bp, M. musculus
ttacagatgaggaagc

SEQ ID NO: 451925 - DNA, 16 bp, M. musculus
ttacagatgcttatga

SEQ ID NO: 451926 - DNA, 16 bp, M. musculus
ttacagatggctgtga

SEQ ID NO: 451927 - DNA, 16 bp, M. musculus
ttacagatggtgtgag

SEQ ID NO: 451928 - DNA, 16 bp, M. musculus
ttacagatggttgtgt

SEQ ID NO: 451929 - DNA, 16 bp, M. musculus
ttacagatgtaagcat

SEQ ID NO: 451930 - DNA, 16 bp, M. musculus
ttacagatgtagtcaa

SEQ ID NO: 451931 - DNA, 16 bp, M. musculus
ttacagatgtctgtga

SEQ ID NO: 451932 - DNA, 16 bp, M. musculus
ttacagatgtgtacca

SEQ ID NO: 451933 - DNA, 16 bp, M. musculus
ttacagatgtttttga

SEQ ID NO: 451934 - DNA, 16 bp, M. musculus
ttacagcaacagaaag

SEQ ID NO: 451935 - DNA, 16 bp, M. musculus
ttacagcacaagtcat

SEQ ID NO: 451936 - DNA, 16 bp, M. musculus
ttacagcacccaggac

SEQ ID NO: 451937 - DNA, 16 bp, M. musculus
ttacagcagaagacag

SEQ ID NO: 451938 - DNA, 16 bp, M. musculus
ttacagccagttgtga

SEQ ID NO: 451939 - DNA, 21 bp, M. musculus
ttacagccattgtgatgtccg

SEQ ID NO: 451940 - DNA, 16 bp, M. musculus
ttacagccttttcatt

SEQ ID NO: 451941 - DNA, 16 bp, M. musculus
ttacagctgaatctca

SEQ ID NO: 451942 - DNA, 32 bp, M. musculus
ttacaggagagcactgctaaagagttacaggc

SEQ ID NO: 451943 - DNA, 21 bp, M. musculus
ttacaggcagtgctaaagcaa

SEQ ID NO: 451944 - DNA, 16 bp, M. musculus
ttacaggcatgagcca

SEQ ID NO: 451945 - DNA, 16 bp, M. musculus
ttacagggccctcctg

SEQ ID NO: 451946 - DNA, 16 bp, M. musculus
ttacaggtagttgtga

SEQ ID NO: 451947 - DNA, 16 bp, M. musculus
ttacaggtgtgaacca

SEQ ID NO: 451948 - DNA, 16 bp, M. musculus
ttacaggtgtgaacta

SEQ ID NO: 451949 - DNA, 16 bp, M. musculus
ttacaggtgtgtacca

SEQ ID NO: 451950 - DNA, 16 bp, M. musculus
ttacagtccagtcatt

SEQ ID NO: 451951 - DNA, 16 bp, M. musculus
ttacagttaagagatt

SEQ ID NO: 451952 - DNA, 16 bp, M. musculus
ttacagttccagagga

SEQ ID NO: 451953 - DNA, 29 bp, M. musculus
ttacagtttgcccaaaatcaatctgttgt

SEQ ID NO: 451954 - DNA, 16 bp, M. musculus
ttacagtttgtttgta

SEQ ID NO: 451955 - DNA, 16 bp, M. musculus
ttacagtttttttaaa

SEQ ID NO: 451956 - DNA, 16 bp, M. musculus
ttacataagctttgca

SEQ ID NO: 451957 - DNA, 16 bp, M. musculus
ttacataatgaaatat

SEQ ID NO: 451958 - DNA, 16 bp, M. musculus
ttacatacaatatatt

SEQ ID NO: 451959 - DNA, 16 bp, M. musculus
ttacatatatgtacat

SEQ ID NO: 451960 - DNA, 16 bp, M. musculus
ttacatatattacata

SEQ ID NO: 451961 - DNA, 16 bp, M. musculus
ttacatatgtgcagag

SEQ ID NO: 451962 - DNA, 16 bp, M. musculus
ttacatatttaataca

SEQ ID NO: 451963 - DNA, 16 bp, M. musculus
ttacatctaataaata

SEQ ID NO: 451964 - DNA, 16 bp, M. musculus
ttacatctacacaatg

SEQ ID NO: 451965 - DNA, 16 bp, M. musculus
ttacatcttcaggaaa

SEQ ID NO: 451966 - DNA, 16 bp, M. musculus
ttacatcttgtcctca

SEQ ID NO: 451967 - DNA, 16 bp, M. musculus
ttacatctttaggagc

SEQ ID NO: 451968 - DNA, 16 bp, M. musculus
ttacatgcaagtatta

SEQ ID NO: 451969 - DNA, 16 bp, M. musculus
ttacatgcatgtatgt

SEQ ID NO: 451970 - DNA, 16 bp, M. musculus
ttacatgctcactgtg

SEQ ID NO: 451971 - DNA, 16 bp, M. musculus
ttacatgtatttatat

SEQ ID NO: 451972 - DNA, 16 bp, M. musculus
ttacatgtatttattg

SEQ ID NO: 451973 - DNA, 16 bp, M. musculus
ttacatgttgaagcat

SEQ ID NO: 451974 - DNA, 16 bp, M. musculus
ttacattaaaaaaatg

SEQ ID NO: 451975 - DNA, 16 bp, M. musculus
ttacattatctccagt

SEQ ID NO: 451976 - DNA, 18 bp, M. musculus
ttacattcccaatgctat

SEQ ID NO: 451977 - DNA, 16 bp, M. musculus
ttacattgatgaattt

SEQ ID NO: 451978 - DNA, 16 bp, M. musculus
ttacattgctgtgaag

SEQ ID NO: 451979 - DNA, 16 bp, M. musculus
ttacattgtgattcat

SEQ ID NO: 451980 - DNA, 16 bp, M. musculus
ttacatttcaaacatt

SEQ ID NO: 451981 - DNA, 18 bp, M. musculus
ttacatttcaaatgttac

SEQ ID NO: 451982 - DNA, 16 bp, M. musculus
ttacatttcagaggtt

SEQ ID NO: 451983 - DNA, 18 bp, M. musculus
ttacatttccaatgctat

SEQ ID NO: 451984 - DNA, 16 bp, M. musculus
ttacatttccaatgtt

SEQ ID NO: 451985 - DNA, 16 bp, M. musculus
ttacatttccatattg

SEQ ID NO: 451986 - DNA, 16 bp, M. musculus
ttacatttctgatgct

SEQ ID NO: 451987 - DNA, 16 bp, M. musculus
ttacattttcaaatgt

SEQ ID NO: 451988 - DNA, 16 bp, M. musculus
ttacattttgaatgct

SEQ ID NO: 451989 - DNA, 17 bp, M. musculus
ttacatttttagttgct

SEQ ID NO: 451990 - DNA, 16 bp, M. musculus
ttaccaaaagcagtct

SEQ ID NO: 451991 - DNA, 16 bp, M. musculus
ttaccaaaataccaca

SEQ ID NO: 451992 - DNA, 16 bp, M. musculus
ttaccaacagaataca

SEQ ID NO: 451993 - DNA, 16 bp, M. musculus
ttaccaactgaaccat

SEQ ID NO: 451994 - DNA, 16 bp, M. musculus
ttaccaatgaagactt

SEQ ID NO: 451995 - DNA, 16 bp, M. musculus
ttaccacagcaacaga

SEQ ID NO: 451996 - DNA, 16 bp, M. musculus
ttaccactgagccatc

SEQ ID NO: 451997 - DNA, 16 bp, M. musculus
ttaccagagatggaga

SEQ ID NO: 451998 - DNA, 16 bp, M. musculus
ttaccagatggggaaa

SEQ ID NO: 451999 - DNA, 16 bp, M. musculus
ttaccagcatctgctg

SEQ ID NO: 452000 - DNA, 16 bp, M. musculus
ttaccagccacaagta

SEQ ID NO: 452001 - DNA, 16 bp, M. musculus
ttaccagctgagccat

SEQ ID NO: 452002 - DNA, 16 bp, M. musculus
ttaccagctggaacat

SEQ ID NO: 452003 - DNA, 16 bp, M. musculus
ttaccagcttctggct

SEQ ID NO: 452004 - DNA, 16 bp, M. musculus
ttaccaggaaaaaaaa

SEQ ID NO: 452005 - DNA, 16 bp, M. musculus
ttaccagggtctccat

SEQ ID NO: 452006 - DNA, 17 bp, M. musculus
ttaccatgtttaggtat

SEQ ID NO: 452007 - DNA, 16 bp, M. musculus
ttaccatgtttcatct

SEQ ID NO: 452008 - DNA, 16 bp, M. musculus
ttaccatttattctct

SEQ ID NO: 452009 - DNA, 16 bp, M. musculus
ttaccatttcagaggt

SEQ ID NO: 452010 - DNA, 16 bp, M. musculus
ttacccactgaaccat

SEQ ID NO: 452011 - DNA, 16 bp, M. musculus
ttacccactgagacat

SEQ ID NO: 452012 - DNA, 16 bp, M. musculus
ttacccactgagctct

SEQ ID NO: 452013 - DNA, 16 bp, M. musculus
ttacccactgagctgt

SEQ ID NO: 452014 - DNA, 16 bp, M. musculus
ttacccatcaaaccat

SEQ ID NO: 452015 - DNA, 16 bp, M. musculus
ttacccattgagccat

SEQ ID NO: 452016 - DNA, 16 bp, M. musculus
ttaccctgcaaagggt

SEQ ID NO: 452017 - DNA, 17 bp, M. musculus
ttaccggtggttgtgag

SEQ ID NO: 452018 - DNA, 16 bp, M. musculus
ttacctattcagtaac

SEQ ID NO: 452019 - DNA, 16 bp, M. musculus
ttacctcacacagaat

SEQ ID NO: 452020 - DNA, 18 bp, M. musculus
ttacctcactcaggatga

SEQ ID NO: 452021 - DNA, 16 bp, M. musculus
ttacctcagcctttgt

SEQ ID NO: 452022 - DNA, 16 bp, M. musculus
ttacctcccaaatgct

SEQ ID NO: 452023 - DNA, 16 bp, M. musculus
ttacctcctgagtgct

SEQ ID NO: 452024 - DNA, 16 bp, M. musculus
ttacctctcacttctc

SEQ ID NO: 452025 - DNA, 16 bp, M. musculus
ttacctctcctgggca

SEQ ID NO: 452026 - DNA, 16 bp, M. musculus
ttacctctctcagaat

SEQ ID NO: 452027 - DNA, 16 bp, M. musculus
ttacctctgagcccca

SEQ ID NO: 452028 - DNA, 16 bp, M. musculus
ttacctctgccttcca

SEQ ID NO: 452029 - DNA, 16 bp, M. musculus
ttacctgaggacccag

SEQ ID NO: 452030 - DNA, 16 bp, M. musculus
ttacctgcagagccat

SEQ ID NO: 452031 - DNA, 16 bp, M. musculus
ttacctgcctctgcct

SEQ ID NO: 452032 - DNA, 16 bp, M. musculus
ttacctgctaagccat

SEQ ID NO: 452033 - DNA, 16 bp, M. musculus
ttacctgggacagaag

SEQ ID NO: 452034 - DNA, 16 bp, M. musculus
ttacctgtgctctcag

SEQ ID NO: 452035 - DNA, 16 bp, M. musculus
ttacctgtttacctgt

SEQ ID NO: 452036 - DNA, 16 bp, M. musculus
ttaccttagatggaga

SEQ ID NO: 452037 - DNA, 16 bp, M. musculus
ttaccttctctcagca

SEQ ID NO: 452038 - DNA, 16 bp, M. musculus
ttaccttctgttccgc

SEQ ID NO: 452039 - DNA, 16 bp, M. musculus
ttacctttcaaatgct

SEQ ID NO: 452040 - DNA, 22 bp, M. musculus
ttacggatggttgtgagccacc

SEQ ID NO: 452041 - DNA, 16 bp, M. musculus
ttacgggaacctttat

SEQ ID NO: 452042 - DNA, 16 bp, M. musculus
ttacgtttgcctttca

SEQ ID NO: 452043 - DNA, 16 bp, M. musculus
ttactaatcaagaaaa

SEQ ID NO: 452044 - DNA, 16 bp, M. musculus
ttactatagctttgta

SEQ ID NO: 452045 - DNA, 22 bp, M. musculus
ttactatatgtaagtacactgt

SEQ ID NO: 452046 - DNA, 16 bp, M. musculus
ttactattcagctatt

SEQ ID NO: 452047 - DNA, 16 bp, M. musculus
ttactattgctatgat

SEQ ID NO: 452048 - DNA, 16 bp, M. musculus
ttactattgctgtgat

SEQ ID NO: 452049 - DNA, 16 bp, M. musculus
ttactcaagatgatat

SEQ ID NO: 452050 - DNA, 16 bp, M. musculus
ttactcaataaatatt

SEQ ID NO: 452051 - DNA, 16 bp, M. musculus
ttactcactgagccat

SEQ ID NO: 452052 - DNA, 16 bp, M. musculus
ttactcactgataagt

SEQ ID NO: 452053 - DNA, 16 bp, M. musculus
ttactcagtcatcaca

SEQ ID NO: 452054 - DNA, 16 bp, M. musculus
ttactcctggtgttgg

SEQ ID NO: 452055 - DNA, 16 bp, M. musculus
ttactctaacccagag

SEQ ID NO: 452056 - DNA, 16 bp, M. musculus
ttactctaagatagtg

SEQ ID NO: 452057 - DNA, 16 bp, M. musculus
ttactctgaaacctaa

SEQ ID NO: 452058 - DNA, 16 bp, M. musculus
ttactctgaaacttag

SEQ ID NO: 452059 - DNA, 16 bp, M. musculus
ttactctgagatagtt

SEQ ID NO: 452060 - DNA, 16 bp, M. musculus
ttactctgtagcccag

SEQ ID NO: 452061 - DNA, 16 bp, M. musculus
ttactcttctgttgct

SEQ ID NO: 452062 - DNA, 16 bp, M. musculus
ttactctttgagaatt

SEQ ID NO: 452063 - DNA, 16 bp, M. musculus
ttactgaagatttttt

SEQ ID NO: 452064 - DNA, 16 bp, M. musculus
ttactgagaaaaatat

SEQ ID NO: 452065 - DNA, 16 bp, M. musculus
ttactgagccatctct

SEQ ID NO: 452066 - DNA, 16 bp, M. musculus
ttactgaggctatgaa

SEQ ID NO: 452067 - DNA, 16 bp, M. musculus
ttactgatgctgtgat

SEQ ID NO: 452068 - DNA, 16 bp, M. musculus
ttactgccatgcagca

SEQ ID NO: 452069 - DNA, 16 bp, M. musculus
ttactgctgtgaacaa

SEQ ID NO: 452070 - DNA, 16 bp, M. musculus
ttactggattgcttcc

SEQ ID NO: 452071 - DNA, 16 bp, M. musculus
ttactggcttgcttcc

SEQ ID NO: 452072 - DNA, 27 bp, M. musculus
ttactggcttgcttcccctggcttgct

SEQ ID NO: 452073 - DNA, 16 bp, M. musculus
ttactggttggaatat

SEQ ID NO: 452074 - DNA, 16 bp, M. musculus
ttactgtaaatataaa

SEQ ID NO: 452075 - DNA, 16 bp, M. musculus
ttactgtaacatgaaa

SEQ ID NO: 452076 - DNA, 16 bp, M. musculus
ttactgtatcaatttt

SEQ ID NO: 452077 - DNA, 16 bp, M. musculus
ttactgtcctgacttc

SEQ ID NO: 452078 - DNA, 16 bp, M. musculus
ttactgtgataaaaca

SEQ ID NO: 452079 - DNA, 16 bp, M. musculus
ttactgttgctgctgt

SEQ ID NO: 452080 - DNA, 16 bp, M. musculus
ttactgttgttttgct

SEQ ID NO: 452081 - DNA, 16 bp, M. musculus
ttacttaaaaaagaaa

SEQ ID NO: 452082 - DNA, 16 bp, M. musculus
ttacttagcatgcaca

SEQ ID NO: 452083 - DNA, 16 bp, M. musculus
ttacttattcacttta

SEQ ID NO: 452084 - DNA, 16 bp, M. musculus
ttacttcaaaatttta

SEQ ID NO: 452085 - DNA, 16 bp, M. musculus
ttacttctctgttgct

SEQ ID NO: 452086 - DNA, 16 bp, M. musculus
ttacttgacccttttt

SEQ ID NO: 452087 - DNA, 16 bp, M. musculus
ttacttggaatcatca

SEQ ID NO: 452088 - DNA, 16 bp, M. musculus
ttacttgtatatattt

SEQ ID NO: 452089 - DNA, 16 bp, M. musculus
ttacttgtatgtatat

SEQ ID NO: 452090 - DNA, 16 bp, M. musculus
ttactttaaaaaatga

SEQ ID NO: 452091 - DNA, 16 bp, M. musculus
ttactttcaaaacaca

SEQ ID NO: 452092 - DNA, 17 bp, M. musculus
ttactttgatgtaggct

SEQ ID NO: 452093 - DNA, 16 bp, M. musculus
ttactttgtagaccag

SEQ ID NO: 452094 - DNA, 16 bp, M. musculus
ttactttgttgaactt

SEQ ID NO: 452095 - DNA, 16 bp, M. musculus
ttacttttctattgct

SEQ ID NO: 452096 - DNA, 16 bp, M. musculus
ttacttttctcattgt

SEQ ID NO: 452097 - DNA, 16 bp, M. musculus
ttacttttgaaaaaaa

SEQ ID NO: 452098 - DNA, 16 bp, M. musculus
ttactttttaagataa

SEQ ID NO: 452099 - DNA, 16 bp, M. musculus
ttagaaaaataacatt

SEQ ID NO: 452100 - DNA, 16 bp, M. musculus
ttagaaaaattcttag

SEQ ID NO: 452101 - DNA, 16 bp, M. musculus
ttagaaaagcagttga

SEQ ID NO: 452102 - DNA, 16 bp, M. musculus
ttagaaacatcatcta

SEQ ID NO: 452103 - DNA, 16 bp, M. musculus
ttagaaagaaaaatgt

SEQ ID NO: 452104 - DNA, 16 bp, M. musculus
ttagaaagcagaggca

SEQ ID NO: 452105 - DNA, 16 bp, M. musculus
ttagaaataatttcaa

SEQ ID NO: 452106 - DNA, 16 bp, M. musculus
ttagaaatgatctgta

SEQ ID NO: 452107 - DNA, 16 bp, M. musculus
ttagaaattattttcc

SEQ ID NO: 452108 - DNA, 16 bp, M. musculus
ttagaaattctttcat

SEQ ID NO: 452109 - DNA, 16 bp, M. musculus
ttagaacccagttctc

SEQ ID NO: 452110 - DNA, 17 bp, M. musculus
ttagaactcactctgta

SEQ ID NO: 452111 - DNA, 16 bp, M. musculus
ttagaagaacaaaata

SEQ ID NO: 452112 - DNA, 16 bp, M. musculus
ttagaagaattaggag

SEQ ID NO: 452113 - DNA, 16 bp, M. musculus
ttagaagagaaagtgg

SEQ ID NO: 452114 - DNA, 16 bp, M. musculus
ttagaagaggaaacaa

SEQ ID NO: 452115 - DNA, 16 bp, M. musculus
ttagaagatgtggccc

SEQ ID NO: 452116 - DNA, 16 bp, M. musculus
ttagaagcagaaaaag

SEQ ID NO: 452117 - DNA, 18 bp, M. musculus
ttagaaggagaaatttgc

SEQ ID NO: 452118 - DNA, 16 bp, M. musculus
ttagaaggggaacaaa

SEQ ID NO: 452119 - DNA, 16 bp, M. musculus
ttagaataaaagccaa

SEQ ID NO: 452120 - DNA, 16 bp, M. musculus
ttagaataggtgtggc

SEQ ID NO: 452121 - DNA, 16 bp, M. musculus
ttagaatcaagaatag

SEQ ID NO: 452122 - DNA, 16 bp, M. musculus
ttagaatgccagaagg

SEQ ID NO: 452123 - DNA, 16 bp, M. musculus
ttagaattttactgct

SEQ ID NO: 452124 - DNA, 16 bp, M. musculus
ttagaattttactttt

SEQ ID NO: 452125 - DNA, 16 bp, M. musculus
ttagacaaatatgcca

SEQ ID NO: 452126 - DNA, 16 bp, M. musculus
ttagacaacagaagga

SEQ ID NO: 452127 - DNA, 16 bp, M. musculus
ttagacaataaatctt

SEQ ID NO: 452128 - DNA, 16 bp, M. musculus
ttagacagtcatgttg

SEQ ID NO: 452129 - DNA, 16 bp, M. musculus
ttagacatttcttttt

SEQ ID NO: 452130 - DNA, 16 bp, M. musculus
ttagaccacaaaagga

SEQ ID NO: 452131 - DNA, 17 bp, M. musculus
ttagaccaggctggcct

SEQ ID NO: 452132 - DNA, 16 bp, M. musculus
ttagactgagctcagg

SEQ ID NO: 452133 - DNA, 16 bp, M. musculus
ttagacttgagctttg

SEQ ID NO: 452134 - DNA, 16 bp, M. musculus
ttagacttttttttaa

SEQ ID NO: 452135 - DNA, 16 bp, M. musculus
ttagagaaaatcaaca

SEQ ID NO: 452136 - DNA, 16 bp, M. musculus
ttagagagttacagga

SEQ ID NO: 452137 - DNA, 21 bp, M. musculus
ttagagcaatatatctttata

SEQ ID NO: 452138 - DNA, 16 bp, M. musculus
ttagagcaggtgtgaa

SEQ ID NO: 452139 - DNA, 16 bp, M. musculus
ttagagctttatttta

SEQ ID NO: 452140 - DNA, 16 bp, M. musculus
ttagagggaggaaagg

SEQ ID NO: 452141 - DNA, 16 bp, M. musculus
ttagagggggaaaaaa

SEQ ID NO: 452142 - DNA, 16 bp, M. musculus
ttagagtcaagaatag

SEQ ID NO: 452143 - DNA, 16 bp, M. musculus
ttagagtcacaccaag

SEQ ID NO: 452144 - DNA, 16 bp, M. musculus
ttagagtctaatgaaa

SEQ ID NO: 452145 - DNA, 16 bp, M. musculus
ttagagttcttttcca

SEQ ID NO: 452146 - DNA, 16 bp, M. musculus
ttagagtttaaagaaa

SEQ ID NO: 452147 - DNA, 103 bp, M. musculus
ttagagtttgagattaagcttcagaggctgactaatgagcttcgggaactaaaaaagatgtcagaagcggagaagagtaactcttctgtagttcaccaggtgc

SEQ ID NO: 452148 - DNA, 16 bp, M. musculus
ttagagtttgatgaaa

SEQ ID NO: 452149 - DNA, 16 bp, M. musculus
ttagataaatggatgg

SEQ ID NO: 452150 - DNA, 20 bp, M. musculus
ttagatagatagatagatag

SEQ ID NO: 452151 - DNA, 16 bp, M. musculus
ttagatcaaagaattt

SEQ ID NO: 452152 - DNA, 16 bp, M. musculus
ttagatcccttggaac

SEQ ID NO: 452153 - DNA, 16 bp, M. musculus
ttagatctattcattt

SEQ ID NO: 452154 - DNA, 16 bp, M. musculus
ttagatcttttcttta

SEQ ID NO: 452155 - DNA, 16 bp, M. musculus
ttagatgaagaaaaag

SEQ ID NO: 452156 - DNA, 16 bp, M. musculus
ttagatgagctagctg

SEQ ID NO: 452157 - DNA, 16 bp, M. musculus
ttagatggagaaacaa

SEQ ID NO: 452158 - DNA, 16 bp, M. musculus
ttagatggttgtgagc

SEQ ID NO: 452159 - DNA, 16 bp, M. musculus
ttagatgtggctcttt

SEQ ID NO: 452160 - DNA, 16 bp, M. musculus
ttagattgggaacaaa

SEQ ID NO: 452161 - DNA, 17 bp, M. musculus
ttagatttccaatgcta

SEQ ID NO: 452162 - DNA, 16 bp, M. musculus
ttagatttgcttttac

SEQ ID NO: 452163 - DNA, 16 bp, M. musculus
ttagatttggaaacaa

SEQ ID NO: 452164 - DNA, 16 bp, M. musculus
ttagcaaaataagaca

SEQ ID NO: 452165 - DNA, 16 bp, M. musculus
ttagcaaaattacagt

SEQ ID NO: 452166 - DNA, 16 bp, M. musculus
ttagcaaagaatcctt

SEQ ID NO: 452167 - DNA, 16 bp, M. musculus
ttagcaagtagaagaa

SEQ ID NO: 452168 - DNA, 16 bp, M. musculus
ttagcaattagggaaa

SEQ ID NO: 452169 - DNA, 16 bp, M. musculus
ttagcacagttcctca

SEQ ID NO: 452170 - DNA, 17 bp, M. musculus
ttagcagaacatccttt

SEQ ID NO: 452171 - DNA, 17 bp, M. musculus
ttagcagaagatggcct

SEQ ID NO: 452172 - DNA, 16 bp, M. musculus
ttagcaggagagagag

SEQ ID NO: 452173 - DNA, 16 bp, M. musculus
ttagcaggtaaaggtg

SEQ ID NO: 452174 - DNA, 16 bp, M. musculus
ttagcagtgttcccct

SEQ ID NO: 452175 - DNA, 16 bp, M. musculus
ttagcatgagaacaca

SEQ ID NO: 452176 - DNA, 16 bp, M. musculus
ttagcatggttttgtc

SEQ ID NO: 452177 - DNA, 16 bp, M. musculus
ttagcatgtaaaagaa

SEQ ID NO: 452178 - DNA, 16 bp, M. musculus
ttagcattaactgtca

SEQ ID NO: 452179 - DNA, 16 bp, M. musculus
ttagcattacaatata

SEQ ID NO: 452180 - DNA, 16 bp, M. musculus
ttagcatttatttatt

SEQ ID NO: 452181 - DNA, 16 bp, M. musculus
ttagcattttaaaaca

SEQ ID NO: 452182 - DNA, 16 bp, M. musculus
ttagcatttttaaaat

SEQ ID NO: 452183 - DNA, 16 bp, M. musculus
ttagccagaagcagaa

SEQ ID NO: 452184 - DNA, 16 bp, M. musculus
ttagccagactcagta

SEQ ID NO: 452185 - DNA, 34 bp, M. musculus
ttagccattctgactggtgtgagatggaatctca

SEQ ID NO: 452186 - DNA, 16 bp, M. musculus
ttagccatttctattt

SEQ ID NO: 452187 - DNA, 16 bp, M. musculus
ttagccattttgactg

SEQ ID NO: 452188 - DNA, 16 bp, M. musculus
ttagcccagaaactag

SEQ ID NO: 452189 - DNA, 16 bp, M. musculus
ttagcccaggctggtc

SEQ ID NO: 452190 - DNA, 16 bp, M. musculus
ttagccctgagcccca

SEQ ID NO: 452191 - DNA, 16 bp, M. musculus
ttagccgggcgtggtg

SEQ ID NO: 452192 - DNA, 18 bp, M. musculus
ttagcctctatcagcaga

SEQ ID NO: 452193 - DNA, 16 bp, M. musculus
ttagcctctatgagca

SEQ ID NO: 452194 - DNA, 16 bp, M. musculus
ttagcctttaatttct

SEQ ID NO: 452195 - DNA, 16 bp, M. musculus
ttagcctttgtcagca

SEQ ID NO: 452196 - DNA, 16 bp, M. musculus
ttagctagaaaaataa

SEQ ID NO: 452197 - DNA, 16 bp, M. musculus
ttagctatcagagaaa

SEQ ID NO: 452198 - DNA, 37 bp, M. musculus
ttagctatgtcagaattcaatcttaaaaggcacttat

SEQ ID NO: 452199 - DNA, 16 bp, M. musculus
ttagctattaaaaaga

SEQ ID NO: 452200 - DNA, 16 bp, M. musculus
ttagctcaaccaggaa

SEQ ID NO: 452201 - DNA, 16 bp, M. musculus
ttagctcaactgggaa

SEQ ID NO: 452202 - DNA, 16 bp, M. musculus
ttagctccattctttc

SEQ ID NO: 452203 - DNA, 18 bp, M. musculus
ttagctcctctgaagaaa

SEQ ID NO: 452204 - DNA, 16 bp, M. musculus
ttagctctgagctcca

SEQ ID NO: 452205 - DNA, 16 bp, M. musculus
ttagctctgctctctg

SEQ ID NO: 452206 - DNA, 16 bp, M. musculus
ttagctgaaataacca

SEQ ID NO: 452207 - DNA, 16 bp, M. musculus
ttagctgaaatgctca

SEQ ID NO: 452208 - DNA, 17 bp, M. musculus
ttagctgacatcactct

SEQ ID NO: 452209 - DNA, 22 bp, M. musculus
ttagctgactctaggcagggct

SEQ ID NO: 452210 - DNA, 16 bp, M. musculus
ttagctggagttaaga

SEQ ID NO: 452211 - DNA, 16 bp, M. musculus
ttagctgtgcccacag

SEQ ID NO: 452212 - DNA, 16 bp, M. musculus
ttagctgtgcctctct

SEQ ID NO: 452213 - DNA, 16 bp, M. musculus
ttagctgtgttttcct

SEQ ID NO: 452214 - DNA, 16 bp, M. musculus
ttagctgttaagagca

SEQ ID NO: 452215 - DNA, 16 bp, M. musculus
ttagcttccaaatgct

SEQ ID NO: 452216 - DNA, 16 bp, M. musculus
ttagcttctgggggag

SEQ ID NO: 452217 - DNA, 16 bp, M. musculus
ttagcttctgtagttc

SEQ ID NO: 452218 - DNA, 16 bp, M. musculus
ttagcttctgtattcc

SEQ ID NO: 452219 - DNA, 16 bp, M. musculus
ttaggaaaataacacc

SEQ ID NO: 452220 - DNA, 16 bp, M. musculus
ttaggaaaatatattt

SEQ ID NO: 452221 - DNA, 16 bp, M. musculus
ttaggaaagtggaaaa

SEQ ID NO: 452222 - DNA, 16 bp, M. musculus
ttaggaaagttgagaa

SEQ ID NO: 452223 - DNA, 16 bp, M. musculus
ttaggaactttgggaa

SEQ ID NO: 452224 - DNA, 16 bp, M. musculus
ttaggaagactgagaa

SEQ ID NO: 452225 - DNA, 16 bp, M. musculus
ttaggaaggctgagaa

SEQ ID NO: 452226 - DNA, 16 bp, M. musculus
ttaggaagggtgagga

SEQ ID NO: 452227 - DNA, 16 bp, M. musculus
ttaggaaggtagaaaa

SEQ ID NO: 452228 - DNA, 16 bp, M. musculus
ttaggaatgaggacat

SEQ ID NO: 452229 - DNA, 16 bp, M. musculus
ttaggagatggggcct

SEQ ID NO: 452230 - DNA, 16 bp, M. musculus
ttaggaggcagaagca

SEQ ID NO: 452231 - DNA, 16 bp, M. musculus
ttaggaggcatggcct

SEQ ID NO: 452232 - DNA, 16 bp, M. musculus
ttaggaggtagaggca

SEQ ID NO: 452233 - DNA, 16 bp, M. musculus
ttaggagttcaaagtc

SEQ ID NO: 452234 - DNA, 16 bp, M. musculus
ttaggagttttttatg

SEQ ID NO: 452235 - DNA, 16 bp, M. musculus
ttaggatatatatata

SEQ ID NO: 452236 - DNA, 16 bp, M. musculus
ttaggattataggtgt

SEQ ID NO: 452237 - DNA, 16 bp, M. musculus
ttaggatttagggatg

SEQ ID NO: 452238 - DNA, 16 bp, M. musculus
ttaggatttccattgc

SEQ ID NO: 452239 - DNA, 16 bp, M. musculus
ttaggatttctattgt

SEQ ID NO: 452240 - DNA, 16 bp, M. musculus
ttaggcaaggggtggg

SEQ ID NO: 452241 - DNA, 16 bp, M. musculus
ttaggcagagctcagg

SEQ ID NO: 452242 - DNA, 16 bp, M. musculus
ttaggcaggtgaggaa

SEQ ID NO: 452243 - DNA, 16 bp, M. musculus
ttaggcagtgagggag

SEQ ID NO: 452244 - DNA, 16 bp, M. musculus
ttaggctactaatcat

SEQ ID NO: 452245 - DNA, 16 bp, M. musculus
ttaggcttggcagcaa

SEQ ID NO: 452246 - DNA, 16 bp, M. musculus
ttagggaaaaactgga

SEQ ID NO: 452247 - DNA, 16 bp, M. musculus
ttagggaaatgcaaat

SEQ ID NO: 452248 - DNA, 16 bp, M. musculus
ttagggaagtctgaaa

SEQ ID NO: 452249 - DNA, 16 bp, M. musculus
ttagggagagatatag

SEQ ID NO: 452250 - DNA, 16 bp, M. musculus
ttagggatgtgtgtgt

SEQ ID NO: 452251 - DNA, 16 bp, M. musculus
ttagggctggtgagat

SEQ ID NO: 452252 - DNA, 16 bp, M. musculus
ttaggggaaagcctat

SEQ ID NO: 452253 - DNA, 16 bp, M. musculus
ttagggtgggtctttc

SEQ ID NO: 452254 - DNA, 16 bp, M. musculus
ttagggtttctctgtg

SEQ ID NO: 452255 - DNA, 17 bp, M. musculus
ttaggtaaagatccttt

SEQ ID NO: 452256 - DNA, 16 bp, M. musculus
ttaggtaacccctgtg

SEQ ID NO: 452257 - DNA, 16 bp, M. musculus
ttaggtatttccctca

SEQ ID NO: 452258 - DNA, 20 bp, M. musculus
ttaggtgagggtaagattct

SEQ ID NO: 452259 - DNA, 16 bp, M. musculus
ttaggttaactgaggt

SEQ ID NO: 452260 - DNA, 16 bp, M. musculus
ttaggttgaaaatgta

SEQ ID NO: 452261 - DNA, 16 bp, M. musculus
ttaggtttaaatagag

SEQ ID NO: 452262 - DNA, 16 bp, M. musculus
ttaggtttggttttct

SEQ ID NO: 452263 - DNA, 16 bp, M. musculus
ttaggttttgtcttct

SEQ ID NO: 452264 - DNA, 16 bp, M. musculus
ttaggtttttcaaaac

SEQ ID NO: 452265 - DNA, 16 bp, M. musculus
ttagtaaagatcaaag

SEQ ID NO: 452266 - DNA, 18 bp, M. musculus
ttagtaaagctcaaagca

SEQ ID NO: 452267 - DNA, 16 bp, M. musculus
ttagtaatgtgtgtgt

SEQ ID NO: 452268 - DNA, 16 bp, M. musculus
ttagtaattctaatat

SEQ ID NO: 452269 - DNA, 16 bp, M. musculus
ttagtacaaaaacaat

SEQ ID NO: 452270 - DNA, 16 bp, M. musculus
ttagtacagttcctca

SEQ ID NO: 452271 - DNA, 16 bp, M. musculus
ttagtagcctgggctg

SEQ ID NO: 452272 - DNA, 23 bp, M. musculus
ttagtagggccggtgcaagcctt

SEQ ID NO: 452273 - DNA, 16 bp, M. musculus
ttagtatagaatagag

SEQ ID NO: 452274 - DNA, 16 bp, M. musculus
ttagtatctgtttcca

SEQ ID NO: 452275 - DNA, 16 bp, M. musculus
ttagtcaccatggaga

SEQ ID NO: 452276 - DNA, 16 bp, M. musculus
ttagtcagggtttcca

SEQ ID NO: 452277 - DNA, 16 bp, M. musculus
ttagtccagaagctca

SEQ ID NO: 452278 - DNA, 16 bp, M. musculus
ttagtccattttctgt

SEQ ID NO: 452279 - DNA, 20 bp, M. musculus
ttagtcccagggagctctgg

SEQ ID NO: 452280 - DNA, 16 bp, M. musculus
ttagtctatatatttt

SEQ ID NO: 452281 - DNA, 16 bp, M. musculus
ttagtctatggtggtc

SEQ ID NO: 452282 - DNA, 17 bp, M. musculus
ttagtctggtgtatgga

SEQ ID NO: 452283 - DNA, 16 bp, M. musculus
ttagtcttcctttttc

SEQ ID NO: 452284 - DNA, 16 bp, M. musculus
ttagtctttttattgg

SEQ ID NO: 452285 - DNA, 16 bp, M. musculus
ttagtgaagaatcctt

SEQ ID NO: 452286 - DNA, 16 bp, M. musculus
ttagtgagactgtctc

SEQ ID NO: 452287 - DNA, 32 bp, M. musculus
ttagtgagggaagctgaaaagatctttaataa

SEQ ID NO: 452288 - DNA, 16 bp, M. musculus
ttagtgcagagtgcta

SEQ ID NO: 452289 - DNA, 17 bp, M. musculus
ttagtgcatttgttatt

SEQ ID NO: 452290 - DNA, 16 bp, M. musculus
ttagtggaaatgcttt

SEQ ID NO: 452291 - DNA, 16 bp, M. musculus
ttagtggaaatgtttt

SEQ ID NO: 452292 - DNA, 16 bp, M. musculus
ttagtggaatttcttt

SEQ ID NO: 452293 - DNA, 16 bp, M. musculus
ttagtggcttgcttcc

SEQ ID NO: 452294 - DNA, 16 bp, M. musculus
ttagtgggattccttc

SEQ ID NO: 452295 - DNA, 16 bp, M. musculus
ttagtggtagaacact

SEQ ID NO: 452296 - DNA, 16 bp, M. musculus
ttagtgtaattgtgaa

SEQ ID NO: 452297 - DNA, 58 bp, M. musculus
ttagtgtctgtataacatctgtccaggctcttctggctttcatagtctctggtgaaaa

SEQ ID NO: 452298 - DNA, 16 bp, M. musculus
ttagtgtggcatgtcc

SEQ ID NO: 452299 - DNA, 16 bp, M. musculus
ttagtgtgtgtgtctg

SEQ ID NO: 452300 - DNA, 16 bp, M. musculus
ttagtgttacagctct

SEQ ID NO: 452301 - DNA, 16 bp, M. musculus
ttagtgttcctgttgt

SEQ ID NO: 452302 - DNA, 16 bp, M. musculus
ttagtgttgcttgtat

SEQ ID NO: 452303 - DNA, 16 bp, M. musculus
ttagttaattccagat

SEQ ID NO: 452304 - DNA, 16 bp, M. musculus
ttagttactgaatggg

SEQ ID NO: 452305 - DNA, 16 bp, M. musculus
ttagttagtgtgtgtg

SEQ ID NO: 452306 - DNA, 16 bp, M. musculus
ttagttcaaaatgttg

SEQ ID NO: 452307 - DNA, 16 bp, M. musculus
ttagttcatggtggtc

SEQ ID NO: 452308 - DNA, 16 bp, M. musculus
ttagttcccagataaa

SEQ ID NO: 452309 - DNA, 16 bp, M. musculus
ttagttcccagcacac

SEQ ID NO: 452310 - DNA, 16 bp, M. musculus
ttagttcctgggagct

SEQ ID NO: 452311 - DNA, 16 bp, M. musculus
ttagttctttgagaaa

SEQ ID NO: 452312 - DNA, 16 bp, M. musculus
ttagttgagactgatg

SEQ ID NO: 452313 - DNA, 16 bp, M. musculus
ttagttgagattgctg

SEQ ID NO: 452314 - DNA, 16 bp, M. musculus
ttagttgattggttgg

SEQ ID NO: 452315 - DNA, 63 bp, M. musculus
ttagttgggagggttcgaactctagggtgaggagttcaggaatgcattctggggtgaagagtt

SEQ ID NO: 452316 - DNA, 16 bp, M. musculus
ttagtttctgtttcta

SEQ ID NO: 452317 - DNA, 16 bp, M. musculus
ttagtttcttcatcta

SEQ ID NO: 452318 - DNA, 16 bp, M. musculus
ttagtttcttcatctg

SEQ ID NO: 452319 - DNA, 16 bp, M. musculus
ttagtttcttttctca

SEQ ID NO: 452320 - DNA, 16 bp, M. musculus
ttagtttgaggccagc

SEQ ID NO: 452321 - DNA, 16 bp, M. musculus
ttagttttctattgct

SEQ ID NO: 452322 - DNA, 16 bp, M. musculus
ttagttttggtttaaa

SEQ ID NO: 452323 - DNA, 16 bp, M. musculus
ttagtttttaagacag

SEQ ID NO: 452324 - DNA, 16 bp, M. musculus
ttagtttttgagacag

SEQ ID NO: 452325 - DNA, 16 bp, M. musculus
ttataaaaagaaactt

SEQ ID NO: 452326 - DNA, 16 bp, M. musculus
ttataaaagaaatcat

SEQ ID NO: 452327 - DNA, 16 bp, M. musculus
ttataaaagaaatgtt

SEQ ID NO: 452328 - DNA, 16 bp, M. musculus
ttataaaatgcatttt

SEQ ID NO: 452329 - DNA, 16 bp, M. musculus
ttataaacagcccttc

SEQ ID NO: 452330 - DNA, 16 bp, M. musculus
ttataaacagttgtga

SEQ ID NO: 452331 - DNA, 16 bp, M. musculus
ttataaagaaaatgtt

SEQ ID NO: 452332 - DNA, 16 bp, M. musculus
ttataaagatgataga

SEQ ID NO: 452333 - DNA, 16 bp, M. musculus
ttataaagggggaaag

SEQ ID NO: 452334 - DNA, 16 bp, M. musculus
ttataaagtagcaata

SEQ ID NO: 452335 - DNA, 16 bp, M. musculus
ttataaagtataagat

SEQ ID NO: 452336 - DNA, 16 bp, M. musculus
ttataaatggatatta

SEQ ID NO: 452337 - DNA, 16 bp, M. musculus
ttataaattcatgcat

SEQ ID NO: 452338 - DNA, 16 bp, M. musculus
ttataactgctgagcc

SEQ ID NO: 452339 - DNA, 16 bp, M. musculus
ttataactgtaatttt

SEQ ID NO: 452340 - DNA, 16 bp, M. musculus
ttataagagttacctt

SEQ ID NO: 452341 - DNA, 16 bp, M. musculus
ttataagggagaaagg

SEQ ID NO: 452342 - DNA, 16 bp, M. musculus
ttataatagccaaaag

SEQ ID NO: 452343 - DNA, 16 bp, M. musculus
ttataatataaagcat

SEQ ID NO: 452344 - DNA, 16 bp, M. musculus
ttataatcccagcact

SEQ ID NO: 452345 - DNA, 16 bp, M. musculus
ttataatcctagcact

SEQ ID NO: 452346 - DNA, 16 bp, M. musculus
ttataatggactgaac

SEQ ID NO: 452347 - DNA, 16 bp, M. musculus
ttataatgtaattaca

SEQ ID NO: 452348 - DNA, 16 bp, M. musculus
ttataatgtagaagaa

SEQ ID NO: 452349 - DNA, 16 bp, M. musculus
ttataattgatacaaa

SEQ ID NO: 452350 - DNA, 16 bp, M. musculus
ttataatttgcataat

SEQ ID NO: 452351 - DNA, 16 bp, M. musculus
ttatacaaatgaaaaa

SEQ ID NO: 452352 - DNA, 16 bp, M. musculus
ttatacaactcaggac

SEQ ID NO: 452353 - DNA, 16 bp, M. musculus
ttatacaatccaggac

SEQ ID NO: 452354 - DNA, 17 bp, M. musculus
ttatacacacacacaca

SEQ ID NO: 452355 - DNA, 16 bp, M. musculus
ttatacagaaactaag

SEQ ID NO: 452356 - DNA, 16 bp, M. musculus
ttatacagcaagcact

SEQ ID NO: 452357 - DNA, 16 bp, M. musculus
ttatacataattgaaa

SEQ ID NO: 452358 - DNA, 16 bp, M. musculus
ttatacatgttttata

SEQ ID NO: 452359 - DNA, 16 bp, M. musculus
ttatacatttaaaaca

SEQ ID NO: 452360 - DNA, 16 bp, M. musculus
ttataccaaaaaattg

SEQ ID NO: 452361 - DNA, 16 bp, M. musculus
ttataccagatctgtt

SEQ ID NO: 452362 - DNA, 16 bp, M. musculus
ttataccctccaaaca

SEQ ID NO: 452363 - DNA, 17 bp, M. musculus
ttatagaacccaggact

SEQ ID NO: 452364 - DNA, 16 bp, M. musculus
ttatagaactaagact

SEQ ID NO: 452365 - DNA, 16 bp, M. musculus
ttatagaagaaaacat

SEQ ID NO: 452366 - DNA, 16 bp, M. musculus
ttatagaagctttaca

SEQ ID NO: 452367 - DNA, 16 bp, M. musculus
ttatagaaggtacaaa

SEQ ID NO: 452368 - DNA, 16 bp, M. musculus
ttatagacagttgtga

SEQ ID NO: 452369 - DNA, 16 bp, M. musculus
ttatagaccaggctgt

SEQ ID NO: 452370 - DNA, 16 bp, M. musculus
ttatagagatctgcct

SEQ ID NO: 452371 - DNA, 16 bp, M. musculus
ttatagatgaagaaat

SEQ ID NO: 452372 - DNA, 16 bp, M. musculus
ttatagccaattgaaa

SEQ ID NO: 452373 - DNA, 16 bp, M. musculus
ttatagctgggtgtgg

SEQ ID NO: 452374 - DNA, 16 bp, M. musculus
ttatagctgtctcctg

SEQ ID NO: 452375 - DNA, 16 bp, M. musculus
ttataggaatatgttt

SEQ ID NO: 452376 - DNA, 16 bp, M. musculus
ttataggcagttgtga

SEQ ID NO: 452377 - DNA, 16 bp, M. musculus
ttataggcatgagcca

SEQ ID NO: 452378 - DNA, 16 bp, M. musculus
ttataggcatgtacca

SEQ ID NO: 452379 - DNA, 16 bp, M. musculus
ttataggccagcctgg

SEQ ID NO: 452380 - DNA, 16 bp, M. musculus
ttataggtgtgcacca

SEQ ID NO: 452381 - DNA, 16 bp, M. musculus
ttatagtgggctgggc

SEQ ID NO: 452382 - DNA, 16 bp, M. musculus
ttatatacatatactt

SEQ ID NO: 452383 - DNA, 16 bp, M. musculus
ttatatacatgtatta

SEQ ID NO: 452384 - DNA, 16 bp, M. musculus
ttatataccttctgaa

SEQ ID NO: 452385 - DNA, 16 bp, M. musculus
ttatatactggattaa

SEQ ID NO: 452386 - DNA, 16 bp, M. musculus
ttatatagaccaggct

SEQ ID NO: 452387 - DNA, 16 bp, M. musculus
ttatatagtggattat

SEQ ID NO: 452388 - DNA, 16 bp, M. musculus
ttatatataccatata

SEQ ID NO: 452389 - DNA, 16 bp, M. musculus
ttatatatatacacac

SEQ ID NO: 452390 - DNA, 16 bp, M. musculus
ttatatatatgcatat

SEQ ID NO: 452391 - DNA, 20 bp, M. musculus
ttatatatatgtgtgtgtgt

SEQ ID NO: 452392 - DNA, 16 bp, M. musculus
ttatatatgagtacac

SEQ ID NO: 452393 - DNA, 16 bp, M. musculus
ttatatatgtacatat

SEQ ID NO: 452394 - DNA, 16 bp, M. musculus
ttatatatgttataca

SEQ ID NO: 452395 - DNA, 16 bp, M. musculus
ttatatattttcctca

SEQ ID NO: 452396 - DNA, 16 bp, M. musculus
ttatatccaactactg

SEQ ID NO: 452397 - DNA, 16 bp, M. musculus
ttatatccatagcaac

SEQ ID NO: 452398 - DNA, 16 bp, M. musculus
ttatatctacaatttc

SEQ ID NO: 452399 - DNA, 16 bp, M. musculus
ttatatctgtgattat

SEQ ID NO: 452400 - DNA, 17 bp, M. musculus
ttatatggtcaattttg

SEQ ID NO: 452401 - DNA, 16 bp, M. musculus
ttatatgtatatgtgt

SEQ ID NO: 452402 - DNA, 16 bp, M. musculus
ttatatgtatgaatat

SEQ ID NO: 452403 - DNA, 16 bp, M. musculus
ttatatgtatgtgtgt

SEQ ID NO: 452404 - DNA, 16 bp, M. musculus
ttatatgtcttggtta

SEQ ID NO: 452405 - DNA, 16 bp, M. musculus
ttatatgtgtatgtgt

SEQ ID NO: 452406 - DNA, 16 bp, M. musculus
ttatatgttggatatt

SEQ ID NO: 452407 - DNA, 16 bp, M. musculus
ttatattatgattcat

SEQ ID NO: 452408 - DNA, 16 bp, M. musculus
ttatattctctccaaa

SEQ ID NO: 452409 - DNA, 16 bp, M. musculus
ttatattctttctgct

SEQ ID NO: 452410 - DNA, 16 bp, M. musculus
ttatattgcatatttt

SEQ ID NO: 452411 - DNA, 16 bp, M. musculus
ttatattgctgtgaag

SEQ ID NO: 452412 - DNA, 16 bp, M. musculus
ttatatttaatatgcc

SEQ ID NO: 452413 - DNA, 16 bp, M. musculus
ttatatttagaaatgt

SEQ ID NO: 452414 - DNA, 16 bp, M. musculus
ttatatttccaatgtt

SEQ ID NO: 452415 - DNA, 16 bp, M. musculus
ttatattttaaaactg

SEQ ID NO: 452416 - DNA, 16 bp, M. musculus
ttatattttaatatgc

SEQ ID NO: 452417 - DNA, 16 bp, M. musculus
ttatattttatatgca

SEQ ID NO: 452418 - DNA, 16 bp, M. musculus
ttatattttcagaggt

SEQ ID NO: 452419 - DNA, 16 bp, M. musculus
ttatattttgagagaa

SEQ ID NO: 452420 - DNA, 16 bp, M. musculus
ttatattttgcatagt

SEQ ID NO: 452421 - DNA, 16 bp, M. musculus
ttatcaaaaaggaaaa

SEQ ID NO: 452422 - DNA, 16 bp, M. musculus
ttatcaaagacttaaa

SEQ ID NO: 452423 - DNA, 17 bp, M. musculus
ttatcaaagtccttctt

SEQ ID NO: 452424 - DNA, 16 bp, M. musculus
ttatcaaatctttctt

SEQ ID NO: 452425 - DNA, 16 bp, M. musculus
ttatcaaccctacatc

SEQ ID NO: 452426 - DNA, 16 bp, M. musculus
ttatcaagaaaaaaat

SEQ ID NO: 452427 - DNA, 17 bp, M. musculus
ttatcaaggcctaggaa

SEQ ID NO: 452428 - DNA, 16 bp, M. musculus
ttatcacaattttaaa

SEQ ID NO: 452429 - DNA, 17 bp, M. musculus
ttatcacacagatcttt

SEQ ID NO: 452430 - DNA, 16 bp, M. musculus
ttatcacagtttttaa

SEQ ID NO: 452431 - DNA, 16 bp, M. musculus
ttatcaccatggtggg

SEQ ID NO: 452432 - DNA, 16 bp, M. musculus
ttatcaccctgtacaa

SEQ ID NO: 452433 - DNA, 16 bp, M. musculus
ttatcactatagctct

SEQ ID NO: 452434 - DNA, 16 bp, M. musculus
ttatcactgaaggaag

SEQ ID NO: 452435 - DNA, 16 bp, M. musculus
ttatcagaaaaggacc

SEQ ID NO: 452436 - DNA, 16 bp, M. musculus
ttatcagaagatggcc

SEQ ID NO: 452437 - DNA, 16 bp, M. musculus
ttatcagtcagattta

SEQ ID NO: 452438 - DNA, 16 bp, M. musculus
ttatcagtgagcacat

SEQ ID NO: 452439 - DNA, 20 bp, M. musculus
ttatcatacagatctttcac

SEQ ID NO: 452440 - DNA, 16 bp, M. musculus
ttatcatagcaggaag

SEQ ID NO: 452441 - DNA, 16 bp, M. musculus
ttatcatcacagtggg

SEQ ID NO: 452442 - DNA, 16 bp, M. musculus
ttatcatcatcatctt

SEQ ID NO: 452443 - DNA, 16 bp, M. musculus
ttatcatcatcatttt

SEQ ID NO: 452444 - DNA, 16 bp, M. musculus
ttatcatcatggttgg

SEQ ID NO: 452445 - DNA, 16 bp, M. musculus
ttatcatttgtataat

SEQ ID NO: 452446 - DNA, 16 bp, M. musculus
ttatccaaaaagacaa

SEQ ID NO: 452447 - DNA, 16 bp, M. musculus
ttatccactgaaccat

SEQ ID NO: 452448 - DNA, 16 bp, M. musculus
ttatccaggttttcca

SEQ ID NO: 452449 - DNA, 16 bp, M. musculus
ttatccccatttcaca

SEQ ID NO: 452450 - DNA, 16 bp, M. musculus
ttatccccattttaca

SEQ ID NO: 452451 - DNA, 16 bp, M. musculus
ttatccctccactagg

SEQ ID NO: 452452 - DNA, 16 bp, M. musculus
ttatccctccactggg

SEQ ID NO: 452453 - DNA, 16 bp, M. musculus
ttatcctaaaaccaaa

SEQ ID NO: 452454 - DNA, 16 bp, M. musculus
ttatcctggaactcac

SEQ ID NO: 452455 - DNA, 16 bp, M. musculus
ttatcctgtttacaag

SEQ ID NO: 452456 - DNA, 16 bp, M. musculus
ttatctatctgtctgt

SEQ ID NO: 452457 - DNA, 16 bp, M. musculus
ttatctatttatgttc

SEQ ID NO: 452458 - DNA, 16 bp, M. musculus
ttatctcaactacagg

SEQ ID NO: 452459 - DNA, 16 bp, M. musculus
ttatctccagaacata

SEQ ID NO: 452460 - DNA, 16 bp, M. musculus
ttatctccagtgccac

SEQ ID NO: 452461 - DNA, 16 bp, M. musculus
ttatctctagctgcat

SEQ ID NO: 452462 - DNA, 16 bp, M. musculus
ttatctctctcaactt

SEQ ID NO: 452463 - DNA, 16 bp, M. musculus
ttatctctggcctcca

SEQ ID NO: 452464 - DNA, 16 bp, M. musculus
ttatctctggtgttat

SEQ ID NO: 452465 - DNA, 16 bp, M. musculus
ttatctcttcactaaa

SEQ ID NO: 452466 - DNA, 16 bp, M. musculus
ttatctgattttctgg

SEQ ID NO: 452467 - DNA, 16 bp, M. musculus
ttatctgcctgggtgt

SEQ ID NO: 452468 - DNA, 16 bp, M. musculus
ttatcttagttacttt

SEQ ID NO: 452469 - DNA, 41 bp, M. musculus
ttatcttcttgccccaaatgatacctttttggcatgttcca

SEQ ID NO: 452470 - DNA, 16 bp, M. musculus
ttatctttccaccaat

SEQ ID NO: 452471 - DNA, 16 bp, M. musculus
ttatcttttgagatag

SEQ ID NO: 452472 - DNA, 16 bp, M. musculus
ttatcttttttaaaag

SEQ ID NO: 452473 - DNA, 16 bp, M. musculus
ttatcttttttgataa

SEQ ID NO: 452474 - DNA, 16 bp, M. musculus
ttatcttttttgatga

SEQ ID NO: 452475 - DNA, 16 bp, M. musculus
ttatgaaagaatagga

SEQ ID NO: 452476 - DNA, 16 bp, M. musculus
ttatgaaaggatgttt

SEQ ID NO: 452477 - DNA, 16 bp, M. musculus
ttatgaaatataacat

SEQ ID NO: 452478 - DNA, 16 bp, M. musculus
ttatgaatatgataga

SEQ ID NO: 452479 - DNA, 16 bp, M. musculus
ttatgaattcccattt

SEQ ID NO: 452480 - DNA, 16 bp, M. musculus
ttatgacagacagaat

SEQ ID NO: 452481 - DNA, 16 bp, M. musculus
ttatgacatcccattt

SEQ ID NO: 452482 - DNA, 16 bp, M. musculus
ttatgactaatatcta

SEQ ID NO: 452483 - DNA, 24 bp, M. musculus
ttatgagttcaaggccagcctggt

SEQ ID NO: 452484 - DNA, 16 bp, M. musculus
ttatgatgatgatgat

SEQ ID NO: 452485 - DNA, 16 bp, M. musculus
ttatgatttttaaaag

SEQ ID NO: 452486 - DNA, 16 bp, M. musculus
ttatgcatacacacac

SEQ ID NO: 452487 - DNA, 16 bp, M. musculus
ttatgcatgcatatat

SEQ ID NO: 452488 - DNA, 16 bp, M. musculus
ttatgccagcaagatt

SEQ ID NO: 452489 - DNA, 16 bp, M. musculus
ttatgccatgggttgc

SEQ ID NO: 452490 - DNA, 16 bp, M. musculus
ttatgcccaagagtgg

SEQ ID NO: 452491 - DNA, 17 bp, M. musculus
ttatgcccacacccaca

SEQ ID NO: 452492 - DNA, 16 bp, M. musculus
ttatgctaagtgaaat

SEQ ID NO: 452493 - DNA, 22 bp, M. musculus
ttatgctgcgttatgccgtggg

SEQ ID NO: 452494 - DNA, 16 bp, M. musculus
ttatgctgctgctgct

SEQ ID NO: 452495 - DNA, 16 bp, M. musculus
ttatgctgtgtgtgtg

SEQ ID NO: 452496 - DNA, 16 bp, M. musculus
ttatgcttgcctcttg

SEQ ID NO: 452497 - DNA, 16 bp, M. musculus
ttatggaaaagctgga

SEQ ID NO: 452498 - DNA, 16 bp, M. musculus
ttatggaaaccttggt

SEQ ID NO: 452499 - DNA, 16 bp, M. musculus
ttatggaaattttctt

SEQ ID NO: 452500 - DNA, 16 bp, M. musculus
ttatggagatattttc

SEQ ID NO: 452501 - DNA, 16 bp, M. musculus
ttatggatggttatga

SEQ ID NO: 452502 - DNA, 16 bp, M. musculus
ttatggccttgttgga

SEQ ID NO: 452503 - DNA, 16 bp, M. musculus
ttatggctaaataaaa

SEQ ID NO: 452504 - DNA, 16 bp, M. musculus
ttatggctggggtcac

SEQ ID NO: 452505 - DNA, 16 bp, M. musculus
ttatgggaattgcatt

SEQ ID NO: 452506 - DNA, 16 bp, M. musculus
ttatgggagagaggga

SEQ ID NO: 452507 - DNA, 16 bp, M. musculus
ttatgggatggatccc

SEQ ID NO: 452508 - DNA, 16 bp, M. musculus
ttatgggctggatccc

SEQ ID NO: 452509 - DNA, 20 bp, M. musculus
ttatggggtagggatttgtt

SEQ ID NO: 452510 - DNA, 16 bp, M. musculus
ttatgggttcagaggt

SEQ ID NO: 452511 - DNA, 16 bp, M. musculus
ttatggtgtggctcag

SEQ ID NO: 452512 - DNA, 16 bp, M. musculus
ttatggttaggtatgg

SEQ ID NO: 452513 - DNA, 16 bp, M. musculus
ttatggttggggatca

SEQ ID NO: 452514 - DNA, 16 bp, M. musculus
ttatgtagccatggct

SEQ ID NO: 452515 - DNA, 16 bp, M. musculus
ttatgtagcctaggct

SEQ ID NO: 452516 - DNA, 16 bp, M. musculus
ttatgtagtccagact

SEQ ID NO: 452517 - DNA, 16 bp, M. musculus
ttatgtagtcctggct

SEQ ID NO: 452518 - DNA, 16 bp, M. musculus
ttatgtatatgagtaa

SEQ ID NO: 452519 - DNA, 16 bp, M. musculus
ttatgtatggtctcag

SEQ ID NO: 452520 - DNA, 16 bp, M. musculus
ttatgtcaaggtgaca

SEQ ID NO: 452521 - DNA, 16 bp, M. musculus
ttatgtcaccttgaca

SEQ ID NO: 452522 - DNA, 16 bp, M. musculus
ttatgtcagcttgaca

SEQ ID NO: 452523 - DNA, 16 bp, M. musculus
ttatgtccagaagaca

SEQ ID NO: 452524 - DNA, 16 bp, M. musculus
ttatgtctaattttct

SEQ ID NO: 452525 - DNA, 16 bp, M. musculus
ttatgtctgggtcttc

SEQ ID NO: 452526 - DNA, 16 bp, M. musculus
ttatgtctgtgtacca

SEQ ID NO: 452527 - DNA, 16 bp, M. musculus
ttatgtctttgtgtgt

SEQ ID NO: 452528 - DNA, 16 bp, M. musculus
ttatgtgaatgggtgt

SEQ ID NO: 452529 - DNA, 16 bp, M. musculus
ttatgtgcaggaaagg

SEQ ID NO: 452530 - DNA, 16 bp, M. musculus
ttatgtgcatgtctgt

SEQ ID NO: 452531 - DNA, 16 bp, M. musculus
ttatgtgcatttatgt

SEQ ID NO: 452532 - DNA, 16 bp, M. musculus
ttatgtgccaggagga

SEQ ID NO: 452533 - DNA, 17 bp, M. musculus
ttatgtgctgtagatgg

SEQ ID NO: 452534 - DNA, 16 bp, M. musculus
ttatgtggtgggagga

SEQ ID NO: 452535 - DNA, 16 bp, M. musculus
ttatgtggtttgtgaa

SEQ ID NO: 452536 - DNA, 16 bp, M. musculus
ttatgtgtagtgtgtg

SEQ ID NO: 452537 - DNA, 16 bp, M. musculus
ttatgtgtatgaatat

SEQ ID NO: 452538 - DNA, 16 bp, M. musculus
ttatgtgtatgagtac

SEQ ID NO: 452539 - DNA, 16 bp, M. musculus
ttatgtgtatgagtgc

SEQ ID NO: 452540 - DNA, 16 bp, M. musculus
ttatgtgtatgcacat

SEQ ID NO: 452541 - DNA, 16 bp, M. musculus
ttatgtgtatgtatgt

SEQ ID NO: 452542 - DNA, 20 bp, M. musculus
ttatgtgtccagaggaattt

SEQ ID NO: 452543 - DNA, 16 bp, M. musculus
ttatgtgtgtacacat

SEQ ID NO: 452544 - DNA, 16 bp, M. musculus
ttatgtgtgtatgtat

SEQ ID NO: 452545 - DNA, 16 bp, M. musculus
ttatgtgtgtgagtgt

SEQ ID NO: 452546 - DNA, 16 bp, M. musculus
ttatgtgtgtgtatat

SEQ ID NO: 452547 - DNA, 16 bp, M. musculus
ttatgtgtgtgtgcat

SEQ ID NO: 452548 - DNA, 16 bp, M. musculus
ttatgttaattgatgt

SEQ ID NO: 452549 - DNA, 16 bp, M. musculus
ttatgttcatgggcat

SEQ ID NO: 452550 - DNA, 16 bp, M. musculus
ttatgttgaaaaatat

SEQ ID NO: 452551 - DNA, 16 bp, M. musculus
ttatgttgagttcttt

SEQ ID NO: 452552 - DNA, 16 bp, M. musculus
ttatgttggaatatgt

SEQ ID NO: 452553 - DNA, 16 bp, M. musculus
ttatgtttacataaaa

SEQ ID NO: 452554 - DNA, 16 bp, M. musculus
ttatgtttgatgccaa

SEQ ID NO: 452555 - DNA, 16 bp, M. musculus
ttatgtttgccttttg

SEQ ID NO: 452556 - DNA, 16 bp, M. musculus
ttatgtttgttgaggg

SEQ ID NO: 452557 - DNA, 16 bp, M. musculus
ttatgttttcctataa

SEQ ID NO: 452558 - DNA, 16 bp, M. musculus
ttattaaaacaaaaag

SEQ ID NO: 452559 - DNA, 16 bp, M. musculus
ttattaaactctaaaa

SEQ ID NO: 452560 - DNA, 16 bp, M. musculus
ttattaaagaaaaaca

SEQ ID NO: 452561 - DNA, 16 bp, M. musculus
ttattaaagacacttt

SEQ ID NO: 452562 - DNA, 16 bp, M. musculus
ttattaaagtagattt

SEQ ID NO: 452563 - DNA, 17 bp, M. musculus
ttattaaagttcttctt

SEQ ID NO: 452564 - DNA, 16 bp, M. musculus
ttattaaatgaaaatc

SEQ ID NO: 452565 - DNA, 16 bp, M. musculus
ttattaagctcttttt

SEQ ID NO: 452566 - DNA, 71 bp, M. musculus
ttattaatcctactcttcggaccctgtattctcaaccgcttggtccagtttgtaaaagacagaatttcggt

SEQ ID NO: 452567 - DNA, 20 bp, M. musculus
ttattacatattttcctcaa

SEQ ID NO: 452568 - DNA, 16 bp, M. musculus
ttattagagttggcat

SEQ ID NO: 452569 - DNA, 17 bp, M. musculus
ttattagatattttctt

SEQ ID NO: 452570 - DNA, 16 bp, M. musculus
ttattaggagtcattt

SEQ ID NO: 452571 - DNA, 16 bp, M. musculus
ttattatatagcccag

SEQ ID NO: 452572 - DNA, 16 bp, M. musculus
ttattatatatgagta

SEQ ID NO: 452573 - DNA, 16 bp, M. musculus
ttattatatgtaagta

SEQ ID NO: 452574 - DNA, 17 bp, M. musculus
ttattatatgtgagtac

SEQ ID NO: 452575 - DNA, 16 bp, M. musculus
ttattatcctttaaag

SEQ ID NO: 452576 - DNA, 25 bp, M. musculus
ttattatcctttgaagggctggatt

SEQ ID NO: 452577 - DNA, 16 bp, M. musculus
ttattatgaacaaaca

SEQ ID NO: 452578 - DNA, 16 bp, M. musculus
ttattatgaaggaatt

SEQ ID NO: 452579 - DNA, 16 bp, M. musculus
ttattatggagtcatt

SEQ ID NO: 452580 - DNA, 16 bp, M. musculus
ttattatgtgtcagaa

SEQ ID NO: 452581 - DNA, 16 bp, M. musculus
ttattatgtgtttgga

SEQ ID NO: 452582 - DNA, 16 bp, M. musculus
ttattattattattgc

SEQ ID NO: 452583 - DNA, 16 bp, M. musculus
ttattattattgctat

SEQ ID NO: 452584 - DNA, 16 bp, M. musculus
ttattcacaatagtca

SEQ ID NO: 452585 - DNA, 16 bp, M. musculus
ttattcactttacatc

SEQ ID NO: 452586 - DNA, 16 bp, M. musculus
ttattcaggaaaaaaa

SEQ ID NO: 452587 - DNA, 16 bp, M. musculus
ttattcagtcttcatc

SEQ ID NO: 452588 - DNA, 16 bp, M. musculus
ttattcatttgtgtat

SEQ ID NO: 452589 - DNA, 16 bp, M. musculus
ttattccaaatgattt

SEQ ID NO: 452590 - DNA, 17 bp, M. musculus
ttattccaagttaaagg

SEQ ID NO: 452591 - DNA, 16 bp, M. musculus
ttattcccttgtttct

SEQ ID NO: 452592 - DNA, 16 bp, M. musculus
ttattcctcctgtgat

SEQ ID NO: 452593 - DNA, 18 bp, M. musculus
ttattcgcacaaggccct

SEQ ID NO: 452594 - DNA, 16 bp, M. musculus
ttattctaaatgaatt

SEQ ID NO: 452595 - DNA, 16 bp, M. musculus
ttattctcttctcctg

SEQ ID NO: 452596 - DNA, 16 bp, M. musculus
ttattctgtactttga

SEQ ID NO: 452597 - DNA, 16 bp, M. musculus
ttattcttctctcatg

SEQ ID NO: 452598 - DNA, 16 bp, M. musculus
ttattctttaaaaatg

SEQ ID NO: 452599 - DNA, 16 bp, M. musculus
ttattctttatgtaga

SEQ ID NO: 452600 - DNA, 16 bp, M. musculus
ttattcttttccagaa

SEQ ID NO: 452601 - DNA, 16 bp, M. musculus
ttattcttttgagctt

SEQ ID NO: 452602 - DNA, 16 bp, M. musculus
ttattgaagataagcc

SEQ ID NO: 452603 - DNA, 17 bp, M. musculus
ttattgaagctgtttat

SEQ ID NO: 452604 - DNA, 16 bp, M. musculus
ttattgaatttacaaa

SEQ ID NO: 452605 - DNA, 16 bp, M. musculus
ttattgagaagagtgt

SEQ ID NO: 452606 - DNA, 16 bp, M. musculus
ttattgagaattttgc

SEQ ID NO: 452607 - DNA, 16 bp, M. musculus
ttattgagcacctact

SEQ ID NO: 452608 - DNA, 16 bp, M. musculus
ttattgaggatttttc

SEQ ID NO: 452609 - DNA, 16 bp, M. musculus
ttattgagtgcttact

SEQ ID NO: 452610 - DNA, 16 bp, M. musculus
ttattgattggttgat

SEQ ID NO: 452611 - DNA, 16 bp, M. musculus
ttattgcaatgaacat

SEQ ID NO: 452612 - DNA, 16 bp, M. musculus
ttattgctgttgttgt

SEQ ID NO: 452613 - DNA, 16 bp, M. musculus
ttattgcttatattat

SEQ ID NO: 452614 - DNA, 16 bp, M. musculus
ttattggatactttct

SEQ ID NO: 452615 - DNA, 16 bp, M. musculus
ttattgtcaccaatag

SEQ ID NO: 452616 - DNA, 16 bp, M. musculus
ttattgtctaatttta

SEQ ID NO: 452617 - DNA, 16 bp, M. musculus
ttattgtctgtgttta

SEQ ID NO: 452618 - DNA, 16 bp, M. musculus
ttattgtcttgcttga

SEQ ID NO: 452619 - DNA, 16 bp, M. musculus
ttattgtctttgagtt

SEQ ID NO: 452620 - DNA, 16 bp, M. musculus
ttattgtgaaaggtgt

SEQ ID NO: 452621 - DNA, 16 bp, M. musculus
ttattgtgtccatgtt

SEQ ID NO: 452622 - DNA, 16 bp, M. musculus
ttattgtgtcccatag

SEQ ID NO: 452623 - DNA, 16 bp, M. musculus
ttattgttgctgttgt

SEQ ID NO: 452624 - DNA, 16 bp, M. musculus
ttatttaaaaacagaa

SEQ ID NO: 452625 - DNA, 16 bp, M. musculus
ttatttaaaatgagaa

SEQ ID NO: 452626 - DNA, 16 bp, M. musculus
ttatttaaaccaccac

SEQ ID NO: 452627 - DNA, 16 bp, M. musculus
ttatttaatgcatttg

SEQ ID NO: 452628 - DNA, 16 bp, M. musculus
ttatttaatgtgtgtg

SEQ ID NO: 452629 - DNA, 16 bp, M. musculus
ttatttacagatttaa

SEQ ID NO: 452630 - DNA, 16 bp, M. musculus
ttatttacattacaaa

SEQ ID NO: 452631 - DNA, 16 bp, M. musculus
ttatttactgaaaaaa

SEQ ID NO: 452632 - DNA, 16 bp, M. musculus
ttatttactttccaaa

SEQ ID NO: 452633 - DNA, 16 bp, M. musculus
ttatttagcttctttg

SEQ ID NO: 452634 - DNA, 16 bp, M. musculus
ttatttatatatctgt

SEQ ID NO: 452635 - DNA, 16 bp, M. musculus
ttatttatatgtgtgc

SEQ ID NO: 452636 - DNA, 16 bp, M. musculus
ttatttatgtattcat

SEQ ID NO: 452637 - DNA, 16 bp, M. musculus
ttatttatttctgaat

SEQ ID NO: 452638 - DNA, 16 bp, M. musculus
ttatttatttcttgag

SEQ ID NO: 452639 - DNA, 16 bp, M. musculus
ttatttatttgcaaat

SEQ ID NO: 452640 - DNA, 16 bp, M. musculus
ttatttatttgtgtac

SEQ ID NO: 452641 - DNA, 16 bp, M. musculus
ttatttcaaattctag

SEQ ID NO: 452642 - DNA, 16 bp, M. musculus
ttatttcaatcatctt

SEQ ID NO: 452643 - DNA, 16 bp, M. musculus
ttatttcagaagtatt

SEQ ID NO: 452644 - DNA, 16 bp, M. musculus
ttatttcagctcacag

SEQ ID NO: 452645 - DNA, 16 bp, M. musculus
ttatttcagctcccaa

SEQ ID NO: 452646 - DNA, 16 bp, M. musculus
ttatttcagcttacat

SEQ ID NO: 452647 - DNA, 16 bp, M. musculus
ttatttcagtcttctt

SEQ ID NO: 452648 - DNA, 16 bp, M. musculus
ttatttcatatgcatt

SEQ ID NO: 452649 - DNA, 16 bp, M. musculus
ttatttcatcttaaaa

SEQ ID NO: 452650 - DNA, 16 bp, M. musculus
ttatttcatcttacaa

SEQ ID NO: 452651 - DNA, 16 bp, M. musculus
ttatttcatcttacag

SEQ ID NO: 452652 - DNA, 16 bp, M. musculus
ttatttcatgtgtatg

SEQ ID NO: 452653 - DNA, 16 bp, M. musculus
ttatttccatgtgtgt

SEQ ID NO: 452654 - DNA, 16 bp, M. musculus
ttatttccctgatttc

SEQ ID NO: 452655 - DNA, 16 bp, M. musculus
ttatttcctgctgact

SEQ ID NO: 452656 - DNA, 16 bp, M. musculus
ttatttccttgagaca

SEQ ID NO: 452657 - DNA, 16 bp, M. musculus
ttatttctctcaccat

SEQ ID NO: 452658 - DNA, 16 bp, M. musculus
ttatttctctctctgt

SEQ ID NO: 452659 - DNA, 16 bp, M. musculus
ttatttctctgtttag

SEQ ID NO: 452660 - DNA, 16 bp, M. musculus
ttatttctgctcatgg

SEQ ID NO: 452661 - DNA, 16 bp, M. musculus
ttatttctggaagcat

SEQ ID NO: 452662 - DNA, 16 bp, M. musculus
ttatttctgtaatgaa

SEQ ID NO: 452663 - DNA, 16 bp, M. musculus
ttatttcttaagattt

SEQ ID NO: 452664 - DNA, 16 bp, M. musculus
ttatttcttccctgat

SEQ ID NO: 452665 - DNA, 16 bp, M. musculus
ttatttcttctgtgac

SEQ ID NO: 452666 - DNA, 16 bp, M. musculus
ttatttcttctttgaa

SEQ ID NO: 452667 - DNA, 16 bp, M. musculus
ttatttctttaagtga

SEQ ID NO: 452668 - DNA, 16 bp, M. musculus
ttatttcttttaaaga

SEQ ID NO: 452669 - DNA, 19 bp, M. musculus
ttatttgaatttctggagt

SEQ ID NO: 452670 - DNA, 16 bp, M. musculus
ttatttgacttctttg

SEQ ID NO: 452671 - DNA, 20 bp, M. musculus
ttatttgattttctggagtc

SEQ ID NO: 452672 - DNA, 16 bp, M. musculus
ttatttgcacaaacat

SEQ ID NO: 452673 - DNA, 16 bp, M. musculus
ttatttggcttctttg

SEQ ID NO: 452674 - DNA, 16 bp, M. musculus
ttatttgtaaaaatag

SEQ ID NO: 452675 - DNA, 16 bp, M. musculus
ttatttgtaatagaca

SEQ ID NO: 452676 - DNA, 16 bp, M. musculus
ttattttaaaaagtca

SEQ ID NO: 452677 - DNA, 16 bp, M. musculus
ttattttaaaaagttg

SEQ ID NO: 452678 - DNA, 16 bp, M. musculus
ttattttaaaaggcaa

SEQ ID NO: 452679 - DNA, 16 bp, M. musculus
ttattttaaaatgcaa

SEQ ID NO: 452680 - DNA, 16 bp, M. musculus
ttattttaaatacaca

SEQ ID NO: 452681 - DNA, 16 bp, M. musculus
ttattttaagtttcaa

SEQ ID NO: 452682 - DNA, 16 bp, M. musculus
ttattttacatgaaaa

SEQ ID NO: 452683 - DNA, 16 bp, M. musculus
ttattttactgtgtgt

SEQ ID NO: 452684 - DNA, 16 bp, M. musculus
ttattttagtgggatt

SEQ ID NO: 452685 - DNA, 16 bp, M. musculus
ttattttatgatttca

SEQ ID NO: 452686 - DNA, 16 bp, M. musculus
ttattttatgcatgtg

SEQ ID NO: 452687 - DNA, 16 bp, M. musculus
ttattttatgtacatg

SEQ ID NO: 452688 - DNA, 16 bp, M. musculus
ttattttattgttcag

SEQ ID NO: 452689 - DNA, 16 bp, M. musculus
ttattttatttctgag

SEQ ID NO: 452690 - DNA, 16 bp, M. musculus
ttattttcacattaaa

SEQ ID NO: 452691 - DNA, 16 bp, M. musculus
ttattttcatctatgt

SEQ ID NO: 452692 - DNA, 16 bp, M. musculus
ttattttcattgctat

SEQ ID NO: 452693 - DNA, 16 bp, M. musculus
ttattttcattttcag

SEQ ID NO: 452694 - DNA, 16 bp, M. musculus
ttattttccattaaaa

SEQ ID NO: 452695 - DNA, 16 bp, M. musculus
ttattttcctttgaaa

SEQ ID NO: 452696 - DNA, 16 bp, M. musculus
ttattttcgttgctac

SEQ ID NO: 452697 - DNA, 16 bp, M. musculus
ttattttctcaaaaaa

SEQ ID NO: 452698 - DNA, 16 bp, M. musculus
ttattttctgccgtct

SEQ ID NO: 452699 - DNA, 16 bp, M. musculus
ttattttctgtatatg

SEQ ID NO: 452700 - DNA, 16 bp, M. musculus
ttattttctgtttcaa

SEQ ID NO: 452701 - DNA, 16 bp, M. musculus
ttattttctttctcag

SEQ ID NO: 452702 - DNA, 16 bp, M. musculus
ttattttctttgaaat

SEQ ID NO: 452703 - DNA, 16 bp, M. musculus
ttattttgaaacagag

SEQ ID NO: 452704 - DNA, 16 bp, M. musculus
ttattttgagacaagt

SEQ ID NO: 452705 - DNA, 16 bp, M. musculus
ttattttgcttatact

SEQ ID NO: 452706 - DNA, 16 bp, M. musculus
ttattttggcaaagaa

SEQ ID NO: 452707 - DNA, 16 bp, M. musculus
ttattttgttccctat

SEQ ID NO: 452708 - DNA, 16 bp, M. musculus
ttattttgtttcccct

SEQ ID NO: 452709 - DNA, 16 bp, M. musculus
ttatttttaaaaacca

SEQ ID NO: 452710 - DNA, 16 bp, M. musculus
ttatttttaaacacat

SEQ ID NO: 452711 - DNA, 16 bp, M. musculus
ttatttttaactgtgt

SEQ ID NO: 452712 - DNA, 16 bp, M. musculus
ttatttttaaggcatt

SEQ ID NO: 452713 - DNA, 16 bp, M. musculus
ttatttttaatgactt

SEQ ID NO: 452714 - DNA, 16 bp, M. musculus
ttatttttaatggaaa

SEQ ID NO: 452715 - DNA, 16 bp, M. musculus
ttatttttaattgaca

SEQ ID NO: 452716 - DNA, 16 bp, M. musculus
ttatttttataggaaa

SEQ ID NO: 452717 - DNA, 16 bp, M. musculus
ttatttttatgagaca

SEQ ID NO: 452718 - DNA, 16 bp, M. musculus
ttatttttatttgcaa

SEQ ID NO: 452719 - DNA, 16 bp, M. musculus
ttatttttccattctg

SEQ ID NO: 452720 - DNA, 16 bp, M. musculus
ttatttttctgaaaca

SEQ ID NO: 452721 - DNA, 16 bp, M. musculus
ttatttttctgggtct

SEQ ID NO: 452722 - DNA, 16 bp, M. musculus
ttatttttctgtgtca

SEQ ID NO: 452723 - DNA, 16 bp, M. musculus
ttatttttcttaagaa

SEQ ID NO: 452724 - DNA, 16 bp, M. musculus
ttatttttcttacaca

SEQ ID NO: 452725 - DNA, 16 bp, M. musculus
ttatttttcttctgaa

SEQ ID NO: 452726 - DNA, 16 bp, M. musculus
ttatttttcttgaaat

SEQ ID NO: 452727 - DNA, 16 bp, M. musculus
ttatttttctttagaa

SEQ ID NO: 452728 - DNA, 16 bp, M. musculus
ttatttttgagaaaag

SEQ ID NO: 452729 - DNA, 16 bp, M. musculus
ttatttttgagatagg

SEQ ID NO: 452730 - DNA, 16 bp, M. musculus
ttatttttgaggcaga

SEQ ID NO: 452731 - DNA, 16 bp, M. musculus
ttatttttgctgttaa

SEQ ID NO: 452732 - DNA, 16 bp, M. musculus
ttatttttggaaaaaa

SEQ ID NO: 452733 - DNA, 16 bp, M. musculus
ttatttttgtcattaa

SEQ ID NO: 452734 - DNA, 16 bp, M. musculus
ttattttttaagacat

SEQ ID NO: 452735 - DNA, 16 bp, M. musculus
ttattttttcatatga

SEQ ID NO: 452736 - DNA, 16 bp, M. musculus
ttattttttgagagag

SEQ ID NO: 452737 - DNA, 16 bp, M. musculus
ttatttttttaaagca

SEQ ID NO: 452738 - DNA, 16 bp, M. musculus
ttatttttttaaagct

SEQ ID NO: 452739 - DNA, 16 bp, M. musculus
ttatttttttaagcaa

SEQ ID NO: 452740 - DNA, 16 bp, M. musculus
ttatttttttccagct

SEQ ID NO: 452741 - DNA, 16 bp, M. musculus
ttatttttttccccag

SEQ ID NO: 452742 - DNA, 16 bp, M. musculus
ttcaaaaacaacagaa

SEQ ID NO: 452743 - DNA, 16 bp, M. musculus
ttcaaaaagtctttct

SEQ ID NO: 452744 - DNA, 16 bp, M. musculus
ttcaaaaatggtgctg

SEQ ID NO: 452745 - DNA, 16 bp, M. musculus
ttcaaaacaaaatttt

SEQ ID NO: 452746 - DNA, 16 bp, M. musculus
ttcaaaacaaagaaac

SEQ ID NO: 452747 - DNA, 16 bp, M. musculus
ttcaaaacacatgaaa

SEQ ID NO: 452748 - DNA, 16 bp, M. musculus
ttcaaaacagaaaaat

SEQ ID NO: 452749 - DNA, 16 bp, M. musculus
ttcaaaacagcaatta

SEQ ID NO: 452750 - DNA, 16 bp, M. musculus
ttcaaaacataaattt

SEQ ID NO: 452751 - DNA, 16 bp, M. musculus
ttcaaaacatattttt

SEQ ID NO: 452752 - DNA, 16 bp, M. musculus
ttcaaaaccagcctca

SEQ ID NO: 452753 - DNA, 16 bp, M. musculus
ttcaaaacctgcaata

SEQ ID NO: 452754 - DNA, 16 bp, M. musculus
ttcaaaacttttaaaa

SEQ ID NO: 452755 - DNA, 16 bp, M. musculus
ttcaaaagaaatgaaa

SEQ ID NO: 452756 - DNA, 16 bp, M. musculus
ttcaaaagacaaagaa

SEQ ID NO: 452757 - DNA, 16 bp, M. musculus
ttcaaaagatttcaaa

SEQ ID NO: 452758 - DNA, 16 bp, M. musculus
ttcaaaagcaaacagg

SEQ ID NO: 452759 - DNA, 16 bp, M. musculus
ttcaaaagcatcagaa

SEQ ID NO: 452760 - DNA, 16 bp, M. musculus
ttcaaaagccaaagat

SEQ ID NO: 452761 - DNA, 16 bp, M. musculus
ttcaaaagtttttttt

SEQ ID NO: 452762 - DNA, 16 bp, M. musculus
ttcaaaatattatgca

SEQ ID NO: 452763 - DNA, 16 bp, M. musculus
ttcaaaatgaagacat

SEQ ID NO: 452764 - DNA, 16 bp, M. musculus
ttcaaaatgtaaaaaa

SEQ ID NO: 452765 - DNA, 16 bp, M. musculus
ttcaaaatgtactatt

SEQ ID NO: 452766 - DNA, 16 bp, M. musculus
ttcaaaatgtgtgtgt

SEQ ID NO: 452767 - DNA, 16 bp, M. musculus
ttcaaaattgtatttt

SEQ ID NO: 452768 - DNA, 16 bp, M. musculus
ttcaaaattgttttaa

SEQ ID NO: 452769 - DNA, 16 bp, M. musculus
ttcaaacacaacagaa

SEQ ID NO: 452770 - DNA, 16 bp, M. musculus
ttcaaacacatgagcc

SEQ ID NO: 452771 - DNA, 16 bp, M. musculus
ttcaaacagcaattaa

SEQ ID NO: 452772 - DNA, 16 bp, M. musculus
ttcaaacagtaacaga

SEQ ID NO: 452773 - DNA, 16 bp, M. musculus
ttcaaacatatgagcc

SEQ ID NO: 452774 - DNA, 16 bp, M. musculus
ttcaaacatcacatgt

SEQ ID NO: 452775 - DNA, 16 bp, M. musculus
ttcaaacatcagcaaa

SEQ ID NO: 452776 - DNA, 16 bp, M. musculus
ttcaaacatggctgct

SEQ ID NO: 452777 - DNA, 16 bp, M. musculus
ttcaaaccaaaactaa

SEQ ID NO: 452778 - DNA, 16 bp, M. musculus
ttcaaaccaagatcca

SEQ ID NO: 452779 - DNA, 16 bp, M. musculus
ttcaaaccaccaaaga

SEQ ID NO: 452780 - DNA, 16 bp, M. musculus
ttcaaaccaccacagg

SEQ ID NO: 452781 - DNA, 16 bp, M. musculus
ttcaaaccaccacatg

SEQ ID NO: 452782 - DNA, 16 bp, M. musculus
ttcaaacccagcctgg

SEQ ID NO: 452783 - DNA, 16 bp, M. musculus
ttcaaactcacagaaa

SEQ ID NO: 452784 - DNA, 16 bp, M. musculus
ttcaaacttttaaaaa

SEQ ID NO: 452785 - DNA, 16 bp, M. musculus
ttcaaagaaaagctaa

SEQ ID NO: 452786 - DNA, 16 bp, M. musculus
ttcaaagaaaatgaaa

SEQ ID NO: 452787 - DNA, 16 bp, M. musculus
ttcaaagaaaatgaag

SEQ ID NO: 452788 - DNA, 16 bp, M. musculus
ttcaaagaaacaaaca

SEQ ID NO: 452789 - DNA, 19 bp, M. musculus
ttcaaagaaagtcaccctg

SEQ ID NO: 452790 - DNA, 16 bp, M. musculus
ttcaaagaacacctaa

SEQ ID NO: 452791 - DNA, 16 bp, M. musculus
ttcaaagaagaactaa

SEQ ID NO: 452792 - DNA, 16 bp, M. musculus
ttcaaagaagaggtaa

SEQ ID NO: 452793 - DNA, 17 bp, M. musculus
ttcaaagaatcatccaa

SEQ ID NO: 452794 - DNA, 16 bp, M. musculus
ttcaaagacactgact

SEQ ID NO: 452795 - DNA, 16 bp, M. musculus
ttcaaagacacttgca

SEQ ID NO: 452796 - DNA, 16 bp, M. musculus
ttcaaagagaaaacaa

SEQ ID NO: 452797 - DNA, 16 bp, M. musculus
ttcaaagagaaagaaa

SEQ ID NO: 452798 - DNA, 16 bp, M. musculus
ttcaaagaggaactct

SEQ ID NO: 452799 - DNA, 16 bp, M. musculus
ttcaaagccagcttgg

SEQ ID NO: 452800 - DNA, 16 bp, M. musculus
ttcaaagctcttcccc

SEQ ID NO: 452801 - DNA, 16 bp, M. musculus
ttcaaaggaaaatgaa

SEQ ID NO: 452802 - DNA, 16 bp, M. musculus
ttcaaaggaagaaaag

SEQ ID NO: 452803 - DNA, 16 bp, M. musculus
ttcaaagggggaaaaa

SEQ ID NO: 452804 - DNA, 16 bp, M. musculus
ttcaaaggtttagtcc

SEQ ID NO: 452805 - DNA, 16 bp, M. musculus
ttcaaagtaaaagaaa

SEQ ID NO: 452806 - DNA, 16 bp, M. musculus
ttcaaagtacgatgag

SEQ ID NO: 452807 - DNA, 16 bp, M. musculus
ttcaaagtcagcctgt

SEQ ID NO: 452808 - DNA, 16 bp, M. musculus
ttcaaagtcatctttg

SEQ ID NO: 452809 - DNA, 16 bp, M. musculus
ttcaaagtcattcttg

SEQ ID NO: 452810 - DNA, 16 bp, M. musculus
ttcaaagtccatacct

SEQ ID NO: 452811 - DNA, 16 bp, M. musculus
ttcaaagtccttggtg

SEQ ID NO: 452812 - DNA, 16 bp, M. musculus
ttcaaagttccagtgt

SEQ ID NO: 452813 - DNA, 16 bp, M. musculus
ttcaaataagaaaaga

SEQ ID NO: 452814 - DNA, 16 bp, M. musculus
ttcaaatactatattg

SEQ ID NO: 452815 - DNA, 20 bp, M. musculus
ttcaaatatacaatcactgg

SEQ ID NO: 452816 - DNA, 16 bp, M. musculus
ttcaaatattatctcc

SEQ ID NO: 452817 - DNA, 16 bp, M. musculus
ttcaaatatttgaaga

SEQ ID NO: 452818 - DNA, 16 bp, M. musculus
ttcaaatatttttgtt

SEQ ID NO: 452819 - DNA, 16 bp, M. musculus
ttcaaatcccagaaac

SEQ ID NO: 452820 - DNA, 16 bp, M. musculus
ttcaaatcctagcact

SEQ ID NO: 452821 - DNA, 16 bp, M. musculus
ttcaaatccttcagtc

SEQ ID NO: 452822 - DNA, 16 bp, M. musculus
ttcaaatgaaaacaat

SEQ ID NO: 452823 - DNA, 16 bp, M. musculus
ttcaaatgaagaaata

SEQ ID NO: 452824 - DNA, 16 bp, M. musculus
ttcaaatgccagatat

SEQ ID NO: 452825 - DNA, 16 bp, M. musculus
ttcaaatgtgtgtgtg

SEQ ID NO: 452826 - DNA, 16 bp, M. musculus
ttcaaatgttttctca

SEQ ID NO: 452827 - DNA, 17 bp, M. musculus
ttcaaattcagccatcc

SEQ ID NO: 452828 - DNA, 16 bp, M. musculus
ttcaaattcatgacat

SEQ ID NO: 452829 - DNA, 16 bp, M. musculus
ttcaaattcttttaaa

SEQ ID NO: 452830 - DNA, 16 bp, M. musculus
ttcaaatttcacacaa

SEQ ID NO: 452831 - DNA, 16 bp, M. musculus
ttcaacaaaaagttat

SEQ ID NO: 452832 - DNA, 16 bp, M. musculus
ttcaacaaaaatatag

SEQ ID NO: 452833 - DNA, 16 bp, M. musculus
ttcaacaaacccaaag

SEQ ID NO: 452834 - DNA, 16 bp, M. musculus
ttcaacaaagtagctg

SEQ ID NO: 452835 - DNA, 16 bp, M. musculus
ttcaacaaatatttac

SEQ ID NO: 452836 - DNA, 16 bp, M. musculus
ttcaacaatatcatag

SEQ ID NO: 452837 - DNA, 16 bp, M. musculus
ttcaacacctcttcat

SEQ ID NO: 452838 - DNA, 16 bp, M. musculus
ttcaacagaagaatgg

SEQ ID NO: 452839 - DNA, 16 bp, M. musculus
ttcaacagagaaatgg

SEQ ID NO: 452840 - DNA, 16 bp, M. musculus
ttcaacatatgaaaat

SEQ ID NO: 452841 - DNA, 16 bp, M. musculus
ttcaacatgcatgtct

SEQ ID NO: 452842 - DNA, 16 bp, M. musculus
ttcaaccaacccagtg

SEQ ID NO: 452843 - DNA, 16 bp, M. musculus
ttcaaccacaggggtc

SEQ ID NO: 452844 - DNA, 16 bp, M. musculus
ttcaacccccaaaggg

SEQ ID NO: 452845 - DNA, 16 bp, M. musculus
ttcaacctctcttcta

SEQ ID NO: 452846 - DNA, 16 bp, M. musculus
ttcaacctctgagcca

SEQ ID NO: 452847 - DNA, 16 bp, M. musculus
ttcaactcagagatcc

SEQ ID NO: 452848 - DNA, 16 bp, M. musculus
ttcaactgcttgttgg

SEQ ID NO: 452849 - DNA, 16 bp, M. musculus
ttcaacttacatttcc

SEQ ID NO: 452850 - DNA, 16 bp, M. musculus
ttcaacttttatattc

SEQ ID NO: 452851 - DNA, 16 bp, M. musculus
ttcaagaaaatttccc

SEQ ID NO: 452852 - DNA, 16 bp, M. musculus
ttcaagaaagaaaaga

SEQ ID NO: 452853 - DNA, 16 bp, M. musculus
ttcaagaaatccagga

SEQ ID NO: 452854 - DNA, 16 bp, M. musculus
ttcaagaacaacaaca

SEQ ID NO: 452855 - DNA, 16 bp, M. musculus
ttcaagaacaacataa

SEQ ID NO: 452856 - DNA, 16 bp, M. musculus
ttcaagaacacatcaa

SEQ ID NO: 452857 - DNA, 16 bp, M. musculus
ttcaagaacttttccc

SEQ ID NO: 452858 - DNA, 16 bp, M. musculus
ttcaagaatacatcaa

SEQ ID NO: 452859 - DNA, 16 bp, M. musculus
ttcaagaatttttttc

SEQ ID NO: 452860 - DNA, 16 bp, M. musculus
ttcaagacacaatgaa

SEQ ID NO: 452861 - DNA, 16 bp, M. musculus
ttcaagacagccaagg

SEQ ID NO: 452862 - DNA, 16 bp, M. musculus
ttcaagaccagcctgt

SEQ ID NO: 452863 - DNA, 16 bp, M. musculus
ttcaagaccagtctga

SEQ ID NO: 452864 - DNA, 16 bp, M. musculus
ttcaagaccatcctgg

SEQ ID NO: 452865 - DNA, 16 bp, M. musculus
ttcaagacttttaaaa

SEQ ID NO: 452866 - DNA, 16 bp, M. musculus
ttcaagagaaaaagca

SEQ ID NO: 452867 - DNA, 16 bp, M. musculus
ttcaagagggaaaaac

SEQ ID NO: 452868 - DNA, 16 bp, M. musculus
ttcaagatcaccctca

SEQ ID NO: 452869 - DNA, 16 bp, M. musculus
ttcaagatctctggct

SEQ ID NO: 452870 - DNA, 16 bp, M. musculus
ttcaagatgtgagctc

SEQ ID NO: 452871 - DNA, 16 bp, M. musculus
ttcaagattgttttgg

SEQ ID NO: 452872 - DNA, 16 bp, M. musculus
ttcaagattttgtctt

SEQ ID NO: 452873 - DNA, 16 bp, M. musculus
ttcaagccagcctggg

SEQ ID NO: 452874 - DNA, 16 bp, M. musculus
ttcaagccccaggacc

SEQ ID NO: 452875 - DNA, 16 bp, M. musculus
ttcaagctcctgctgc

SEQ ID NO: 452876 - DNA, 16 bp, M. musculus
ttcaagctgaatatgg

SEQ ID NO: 452877 - DNA, 16 bp, M. musculus
ttcaaggaagaaaaaa

SEQ ID NO: 452878 - DNA, 16 bp, M. musculus
ttcaaggaagaaataa

SEQ ID NO: 452879 - DNA, 16 bp, M. musculus
ttcaaggacagcctgg

SEQ ID NO: 452880 - DNA, 16 bp, M. musculus
ttcaaggacttctacc

SEQ ID NO: 452881 - DNA, 16 bp, M. musculus
ttcaaggagctgaagg

SEQ ID NO: 452882 - DNA, 16 bp, M. musculus
ttcaaggccaacccag

SEQ ID NO: 452883 - DNA, 16 bp, M. musculus
ttcaaggccagcctgc

SEQ ID NO: 452884 - DNA, 16 bp, M. musculus
ttcaaggccagccttg

SEQ ID NO: 452885 - DNA, 16 bp, M. musculus
ttcaaggccatcttga

SEQ ID NO: 452886 - DNA, 16 bp, M. musculus
ttcaaggcctacctgg

SEQ ID NO: 452887 - DNA, 16 bp, M. musculus
ttcaaggccttcctgg

SEQ ID NO: 452888 - DNA, 16 bp, M. musculus
ttcaaggctagactgg

SEQ ID NO: 452889 - DNA, 16 bp, M. musculus
ttcaaggctcagggaa

SEQ ID NO: 452890 - DNA, 16 bp, M. musculus
ttcaaggctgacctgg

SEQ ID NO: 452891 - DNA, 16 bp, M. musculus
ttcaaggcttatacct

SEQ ID NO: 452892 - DNA, 16 bp, M. musculus
ttcaagggctggtgag

SEQ ID NO: 452893 - DNA, 16 bp, M. musculus
ttcaaggtcacacagc

SEQ ID NO: 452894 - DNA, 16 bp, M. musculus
ttcaaggtcactctca

SEQ ID NO: 452895 - DNA, 16 bp, M. musculus
ttcaaggtcagcctct

SEQ ID NO: 452896 - DNA, 16 bp, M. musculus
ttcaaggtcagcctgc

SEQ ID NO: 452897 - DNA, 16 bp, M. musculus
ttcaaggtcagcctgt

SEQ ID NO: 452898 - DNA, 16 bp, M. musculus
ttcaaggtcatcctta

SEQ ID NO: 452899 - DNA, 16 bp, M. musculus
ttcaaggtcatcttct

SEQ ID NO: 452900 - DNA, 48 bp, M. musculus
ttcaaggtccgccctatgcggagcccccgccctgcgtagtgcgtcagc

SEQ ID NO: 452901 - DNA, 16 bp, M. musculus
ttcaagtaattttttt

SEQ ID NO: 452902 - DNA, 16 bp, M. musculus
ttcaagtacaatgctg

SEQ ID NO: 452903 - DNA, 16 bp, M. musculus
ttcaagtacaatgttg

SEQ ID NO: 452904 - DNA, 16 bp, M. musculus
ttcaagtactacattg

SEQ ID NO: 452905 - DNA, 16 bp, M. musculus
ttcaagtactataatg

SEQ ID NO: 452906 - DNA, 16 bp, M. musculus
ttcaagtactatattg

SEQ ID NO: 452907 - DNA, 16 bp, M. musculus
ttcaagtcccagcagc

SEQ ID NO: 452908 - DNA, 16 bp, M. musculus
ttcaagtctctgacaa

SEQ ID NO: 452909 - DNA, 16 bp, M. musculus
ttcaagtctgaagaaa

SEQ ID NO: 452910 - DNA, 16 bp, M. musculus
ttcaagtctttgaaaa

SEQ ID NO: 452911 - DNA, 16 bp, M. musculus
ttcaagtgctaggatt

SEQ ID NO: 452912 - DNA, 16 bp, M. musculus
ttcaagtgttttgcaa

SEQ ID NO: 452913 - DNA, 16 bp, M. musculus
ttcaagttaaaaataa

SEQ ID NO: 452914 - DNA, 16 bp, M. musculus
ttcaagttatactaca

SEQ ID NO: 452915 - DNA, 16 bp, M. musculus
ttcaagttcaagttca

SEQ ID NO: 452916 - DNA, 16 bp, M. musculus
ttcaagttgttggtca

SEQ ID NO: 452917 - DNA, 16 bp, M. musculus
ttcaagtttctttctt

SEQ ID NO: 452918 - DNA, 16 bp, M. musculus
ttcaagtttgaggtca

SEQ ID NO: 452919 - DNA, 16 bp, M. musculus
ttcaagtttttcttta

SEQ ID NO: 452920 - DNA, 16 bp, M. musculus
ttcaataaaagtaaaa

SEQ ID NO: 452921 - DNA, 16 bp, M. musculus
ttcaataaactattct

SEQ ID NO: 452922 - DNA, 16 bp, M. musculus
ttcaataaagaaataa

SEQ ID NO: 452923 - DNA, 16 bp, M. musculus
ttcaataaattctaaa

SEQ ID NO: 452924 - DNA, 16 bp, M. musculus
ttcaataccagccatg

SEQ ID NO: 452925 - DNA, 16 bp, M. musculus
ttcaatatcaacataa

SEQ ID NO: 452926 - DNA, 16 bp, M. musculus
ttcaatccttttaaaa

SEQ ID NO: 452927 - DNA, 16 bp, M. musculus
ttcaatgaaaattaag

SEQ ID NO: 452928 - DNA, 16 bp, M. musculus
ttcaatgataacttgg

SEQ ID NO: 452929 - DNA, 16 bp, M. musculus
ttcaatgattttgttg

SEQ ID NO: 452930 - DNA, 16 bp, M. musculus
ttcaatgcaattctca

SEQ ID NO: 452931 - DNA, 17 bp, M. musculus
ttcaatgcacttaggtt

SEQ ID NO: 452932 - DNA, 16 bp, M. musculus
ttcaatggctttctgt

SEQ ID NO: 452933 - DNA, 16 bp, M. musculus
ttcaatgtaaaaaaaa

SEQ ID NO: 452934 - DNA, 16 bp, M. musculus
ttcaatgttttccttt

SEQ ID NO: 452935 - DNA, 16 bp, M. musculus
ttcaattaaatgtttt

SEQ ID NO: 452936 - DNA, 16 bp, M. musculus
ttcaattacacaatgg

SEQ ID NO: 452937 - DNA, 16 bp, M. musculus
ttcaattacatcacct

SEQ ID NO: 452938 - DNA, 16 bp, M. musculus
ttcaattatgtataat

SEQ ID NO: 452939 - DNA, 20 bp, M. musculus
ttcaattccatcacctgttt

SEQ ID NO: 452940 - DNA, 16 bp, M. musculus
ttcaattcccaacacc

SEQ ID NO: 452941 - DNA, 18 bp, M. musculus
ttcaattcccagcaaccc

SEQ ID NO: 452942 - DNA, 16 bp, M. musculus
ttcaattcccagcaat

SEQ ID NO: 452943 - DNA, 16 bp, M. musculus
ttcaattcccagcacc

SEQ ID NO: 452944 - DNA, 18 bp, M. musculus
ttcaattcccagcacctg

SEQ ID NO: 452945 - DNA, 16 bp, M. musculus
ttcaattcccagcatc

SEQ ID NO: 452946 - DNA, 16 bp, M. musculus
ttcaattcgcagcaac

SEQ ID NO: 452947 - DNA, 16 bp, M. musculus
ttcaattctgtcacct

SEQ ID NO: 452948 - DNA, 16 bp, M. musculus
ttcaattcttagcact

SEQ ID NO: 452949 - DNA, 16 bp, M. musculus
ttcaatttataagaca

SEQ ID NO: 452950 - DNA, 16 bp, M. musculus
ttcaattttaagaaga

SEQ ID NO: 452951 - DNA, 16 bp, M. musculus
ttcacaaaaataagat

SEQ ID NO: 452952 - DNA, 16 bp, M. musculus
ttcacaaaaatagaaa

SEQ ID NO: 452953 - DNA, 16 bp, M. musculus
ttcacaaaatatattt

SEQ ID NO: 452954 - DNA, 16 bp, M. musculus
ttcacaaactatttca

SEQ ID NO: 452955 - DNA, 16 bp, M. musculus
ttcacaaagccctggg

SEQ ID NO: 452956 - DNA, 16 bp, M. musculus
ttcacaacaatagcaa

SEQ ID NO: 452957 - DNA, 16 bp, M. musculus
ttcacaaccacctgta

SEQ ID NO: 452958 - DNA, 18 bp, M. musculus
ttcacaaccatctgtaac

SEQ ID NO: 452959 - DNA, 16 bp, M. musculus
ttcacaactgcctgta

SEQ ID NO: 452960 - DNA, 16 bp, M. musculus
ttcacaactgtctgta

SEQ ID NO: 452961 - DNA, 16 bp, M. musculus
ttcacaagaagaccaa

SEQ ID NO: 452962 - DNA, 23 bp, M. musculus
ttcacaaggctcaaaggagtagc

SEQ ID NO: 452963 - DNA, 16 bp, M. musculus
ttcacaatagccacaa

SEQ ID NO: 452964 - DNA, 16 bp, M. musculus
ttcacaattctaagaa

SEQ ID NO: 452965 - DNA, 16 bp, M. musculus
ttcacacacatataca

SEQ ID NO: 452966 - DNA, 16 bp, M. musculus
ttcacacatgcacaca

SEQ ID NO: 452967 - DNA, 16 bp, M. musculus
ttcacactaaaacaaa

SEQ ID NO: 452968 - DNA, 16 bp, M. musculus
ttcacagaaataaaac

SEQ ID NO: 452969 - DNA, 17 bp, M. musculus
ttcacagaaatccacct

SEQ ID NO: 452970 - DNA, 16 bp, M. musculus
ttcacagaagccttat

SEQ ID NO: 452971 - DNA, 16 bp, M. musculus
ttcacagaatgagttg

SEQ ID NO: 452972 - DNA, 16 bp, M. musculus
ttcacagacaaggaaa

SEQ ID NO: 452973 - DNA, 16 bp, M. musculus
ttcacagacttagaaa

SEQ ID NO: 452974 - DNA, 16 bp, M. musculus
ttcacagagatcagcc

SEQ ID NO: 452975 - DNA, 16 bp, M. musculus
ttcacagagttagaaa

SEQ ID NO: 452976 - DNA, 16 bp, M. musculus
ttcacagatctaaaag

SEQ ID NO: 452977 - DNA, 16 bp, M. musculus
ttcacagatggagaaa

SEQ ID NO: 452978 - DNA, 16 bp, M. musculus
ttcacagcaccaaggg

SEQ ID NO: 452979 - DNA, 16 bp, M. musculus
ttcacagcagacttcc

SEQ ID NO: 452980 - DNA, 16 bp, M. musculus
ttcacagccatctata

SEQ ID NO: 452981 - DNA, 16 bp, M. musculus
ttcacagcctgtttat

SEQ ID NO: 452982 - DNA, 16 bp, M. musculus
ttcacaggaatcagca

SEQ ID NO: 452983 - DNA, 16 bp, M. musculus
ttcacataaaaccaga

SEQ ID NO: 452984 - DNA, 16 bp, M. musculus
ttcacatacacacaca

SEQ ID NO: 452985 - DNA, 16 bp, M. musculus
ttcacatataataaat

SEQ ID NO: 452986 - DNA, 16 bp, M. musculus
ttcacatccaccatca

SEQ ID NO: 452987 - DNA, 16 bp, M. musculus
ttcacatccattctgt

SEQ ID NO: 452988 - DNA, 16 bp, M. musculus
ttcacatggaaaatga

SEQ ID NO: 452989 - DNA, 17 bp, M. musculus
ttcacatgtttgcccca

SEQ ID NO: 452990 - DNA, 16 bp, M. musculus
ttcacattcattctgt

SEQ ID NO: 452991 - DNA, 16 bp, M. musculus
ttcaccaaattgtgct

SEQ ID NO: 452992 - DNA, 17 bp, M. musculus
ttcaccaactctttcat

SEQ ID NO: 452993 - DNA, 16 bp, M. musculus
ttcaccaagatcaagt

SEQ ID NO: 452994 - DNA, 16 bp, M. musculus
ttcaccaagctggact

SEQ ID NO: 452995 - DNA, 16 bp, M. musculus
ttcaccaagttgaact

SEQ ID NO: 452996 - DNA, 16 bp, M. musculus
ttcaccagagaagact

SEQ ID NO: 452997 - DNA, 16 bp, M. musculus
ttcaccagtagcctct

SEQ ID NO: 452998 - DNA, 16 bp, M. musculus
ttcaccatcaccacca

SEQ ID NO: 452999 - DNA, 16 bp, M. musculus
ttcacccaggaggagt

SEQ ID NO: 453000 - DNA, 16 bp, M. musculus
ttcacccatgaggagt

SEQ ID NO: 453001 - DNA, 19 bp, M. musculus
ttcacccattatctctcca

SEQ ID NO: 453002 - DNA, 16 bp, M. musculus
ttcaccccaaaacaaa

SEQ ID NO: 453003 - DNA, 16 bp, M. musculus
ttcacccttgatcact

SEQ ID NO: 453004 - DNA, 16 bp, M. musculus
ttcacctcacaccagt

SEQ ID NO: 453005 - DNA, 16 bp, M. musculus
ttcacctcctggatca

SEQ ID NO: 453006 - DNA, 16 bp, M. musculus
ttcacctctgagaggg

SEQ ID NO: 453007 - DNA, 16 bp, M. musculus
ttcacctgcacagact

SEQ ID NO: 453008 - DNA, 16 bp, M. musculus
ttcacctgtactgggg

SEQ ID NO: 453009 - DNA, 16 bp, M. musculus
ttcacgtggaaaatga

SEQ ID NO: 453010 - DNA, 16 bp, M. musculus
ttcacgtggaaagtga

SEQ ID NO: 453011 - DNA, 16 bp, M. musculus
ttcactaaccttacat

SEQ ID NO: 453012 - DNA, 16 bp, M. musculus
ttcactacacaaagga

SEQ ID NO: 453013 - DNA, 16 bp, M. musculus
ttcactacagataaag

SEQ ID NO: 453014 - DNA, 16 bp, M. musculus
ttcactatgtagctct

SEQ ID NO: 453015 - DNA, 16 bp, M. musculus
ttcactcaagaggagt

SEQ ID NO: 453016 - DNA, 117 bp, M. musculus
ttcactcaagcattactggacacagttgtggagtcacacttaacccctttagattggaagactctttctaaggctaccctgtcaggaggagattttttgctttgggattctgaatgg

SEQ ID NO: 453017 - DNA, 16 bp, M. musculus
ttcactcatcacaact

SEQ ID NO: 453018 - DNA, 16 bp, M. musculus
ttcactcccattttcc

SEQ ID NO: 453019 - DNA, 16 bp, M. musculus
ttcactctctctcagg

SEQ ID NO: 453020 - DNA, 16 bp, M. musculus
ttcactgccagaggag

SEQ ID NO: 453021 - DNA, 16 bp, M. musculus
ttcactggctgagcca

SEQ ID NO: 453022 - DNA, 16 bp, M. musculus
ttcactgtgtagccaa

SEQ ID NO: 453023 - DNA, 16 bp, M. musculus
ttcactgtgtagccca

SEQ ID NO: 453024 - DNA, 17 bp, M. musculus
ttcactgtgtccctgtt

SEQ ID NO: 453025 - DNA, 16 bp, M. musculus
ttcactgtgtctctgt

SEQ ID NO: 453026 - DNA, 16 bp, M. musculus
ttcactgtgtctgttt

SEQ ID NO: 453027 - DNA, 16 bp, M. musculus
ttcactgtttctctgt

SEQ ID NO: 453028 - DNA, 16 bp, M. musculus
ttcacttatatgtaga

SEQ ID NO: 453029 - DNA, 16 bp, M. musculus
ttcacttatcagtaag

SEQ ID NO: 453030 - DNA, 16 bp, M. musculus
ttcacttcacttcact

SEQ ID NO: 453031 - DNA, 16 bp, M. musculus
ttcacttgaactttga

SEQ ID NO: 453032 - DNA, 16 bp, M. musculus
ttcacttggacttgag

SEQ ID NO: 453033 - DNA, 16 bp, M. musculus
ttcacttgtgtgtgtg

SEQ ID NO: 453034 - DNA, 16 bp, M. musculus
ttcactttaagaacac

SEQ ID NO: 453035 - DNA, 16 bp, M. musculus
ttcactttacatcatg

SEQ ID NO: 453036 - DNA, 16 bp, M. musculus
ttcactttacatcctg

SEQ ID NO: 453037 - DNA, 16 bp, M. musculus
ttcactttccatcctg

SEQ ID NO: 453038 - DNA, 16 bp, M. musculus
ttcacttttctacata

SEQ ID NO: 453039 - DNA, 16 bp, M. musculus
ttcactttttaaaatg

SEQ ID NO: 453040 - DNA, 16 bp, M. musculus
ttcagaaaaacatgat

SEQ ID NO: 453041 - DNA, 16 bp, M. musculus
ttcagaaaaacattct

SEQ ID NO: 453042 - DNA, 16 bp, M. musculus
ttcagaaaaataaata

SEQ ID NO: 453043 - DNA, 16 bp, M. musculus
ttcagaaaaatatttt

SEQ ID NO: 453044 - DNA, 16 bp, M. musculus
ttcagaaaacacttcc

SEQ ID NO: 453045 - DNA, 16 bp, M. musculus
ttcagaaaatgaaata

SEQ ID NO: 453046 - DNA, 16 bp, M. musculus
ttcagaaaattgaaaa

SEQ ID NO: 453047 - DNA, 16 bp, M. musculus
ttcagaaaattttccc

SEQ ID NO: 453048 - DNA, 16 bp, M. musculus
ttcagaaacaaatgaa

SEQ ID NO: 453049 - DNA, 16 bp, M. musculus
ttcagaaacatatttt

SEQ ID NO: 453050 - DNA, 16 bp, M. musculus
ttcagaaagaaccaga

SEQ ID NO: 453051 - DNA, 16 bp, M. musculus
ttcagaaagaagaaaa

SEQ ID NO: 453052 - DNA, 16 bp, M. musculus
ttcagaaaggaaaaaa

SEQ ID NO: 453053 - DNA, 16 bp, M. musculus
ttcagaaagttcttgc

SEQ ID NO: 453054 - DNA, 16 bp, M. musculus
ttcagaaccaaggctg

SEQ ID NO: 453055 - DNA, 16 bp, M. musculus
ttcagaacctgggaat

SEQ ID NO: 453056 - DNA, 16 bp, M. musculus
ttcagaagagcagcca

SEQ ID NO: 453057 - DNA, 16 bp, M. musculus
ttcagaagagcaggca

SEQ ID NO: 453058 - DNA, 16 bp, M. musculus
ttcagaaggaaagaat

SEQ ID NO: 453059 - DNA, 16 bp, M. musculus
ttcagaaggcagtcat

SEQ ID NO: 453060 - DNA, 16 bp, M. musculus
ttcagaagggaaatga

SEQ ID NO: 453061 - DNA, 16 bp, M. musculus
ttcagaagtcagaaga

SEQ ID NO: 453062 - DNA, 16 bp, M. musculus
ttcagaagtcagttct

SEQ ID NO: 453063 - DNA, 16 bp, M. musculus
ttcagaagttaagagc

SEQ ID NO: 453064 - DNA, 16 bp, M. musculus
ttcagaataaaataaa

SEQ ID NO: 453065 - DNA, 17 bp, M. musculus
ttcagaatagcatttga

SEQ ID NO: 453066 - DNA, 16 bp, M. musculus
ttcagaatattttctt

SEQ ID NO: 453067 - DNA, 16 bp, M. musculus
ttcagaattctaccag

SEQ ID NO: 453068 - DNA, 16 bp, M. musculus
ttcagacaagaacaat

SEQ ID NO: 453069 - DNA, 16 bp, M. musculus
ttcagacaaggacaaa

SEQ ID NO: 453070 - DNA, 16 bp, M. musculus
ttcagacaaggtctca

SEQ ID NO: 453071 - DNA, 16 bp, M. musculus
ttcagacacacaccaa

SEQ ID NO: 453072 - DNA, 18 bp, M. musculus
ttcagacacaccagaaga

SEQ ID NO: 453073 - DNA, 16 bp, M. musculus
ttcagacacaccagag

SEQ ID NO: 453074 - DNA, 16 bp, M. musculus
ttcagacacatcagaa

SEQ ID NO: 453075 - DNA, 16 bp, M. musculus
ttcagacacatgagtc

SEQ ID NO: 453076 - DNA, 19 bp, M. musculus
ttcagacactcgagaagag

SEQ ID NO: 453077 - DNA, 16 bp, M. musculus
ttcagacagacagaca

SEQ ID NO: 453078 - DNA, 16 bp, M. musculus
ttcagacagaccagaa

SEQ ID NO: 453079 - DNA, 17 bp, M. musculus
ttcagacaggaacaatt

SEQ ID NO: 453080 - DNA, 16 bp, M. musculus
ttcagacatttttttt

SEQ ID NO: 453081 - DNA, 16 bp, M. musculus
ttcagaccagaaggaa

SEQ ID NO: 453082 - DNA, 16 bp, M. musculus
ttcagaccattggttg

SEQ ID NO: 453083 - DNA, 16 bp, M. musculus
ttcagaccctccagaa

SEQ ID NO: 453084 - DNA, 16 bp, M. musculus
ttcagactctgcttca

SEQ ID NO: 453085 - DNA, 16 bp, M. musculus
ttcagactctgggagc

SEQ ID NO: 453086 - DNA, 16 bp, M. musculus
ttcagactgctttctt

SEQ ID NO: 453087 - DNA, 16 bp, M. musculus
ttcagactggcctcaa

SEQ ID NO: 453088 - DNA, 16 bp, M. musculus
ttcagagaaacagaaa

SEQ ID NO: 453089 - DNA, 16 bp, M. musculus
ttcagagaaggaaaaa

SEQ ID NO: 453090 - DNA, 16 bp, M. musculus
ttcagagacaccagaa

SEQ ID NO: 453091 - DNA, 16 bp, M. musculus
ttcagagacctgcctg

SEQ ID NO: 453092 - DNA, 16 bp, M. musculus
ttcagagagaaggaaa

SEQ ID NO: 453093 - DNA, 16 bp, M. musculus
ttcagagagagagaga

SEQ ID NO: 453094 - DNA, 16 bp, M. musculus
ttcagagcacttgctg

SEQ ID NO: 453095 - DNA, 16 bp, M. musculus
ttcagaggaaagatta

SEQ ID NO: 453096 - DNA, 16 bp, M. musculus
ttcagaggaagaaaag

SEQ ID NO: 453097 - DNA, 16 bp, M. musculus
ttcagaggaagatgta

SEQ ID NO: 453098 - DNA, 16 bp, M. musculus
ttcagaggacccaggc

SEQ ID NO: 453099 - DNA, 16 bp, M. musculus
ttcagaggagaaatga

SEQ ID NO: 453100 - DNA, 16 bp, M. musculus
ttcagaggatttttct

SEQ ID NO: 453101 - DNA, 16 bp, M. musculus
ttcagaggcaccagaa

SEQ ID NO: 453102 - DNA, 16 bp, M. musculus
ttcagaggcaggcaga

SEQ ID NO: 453103 - DNA, 16 bp, M. musculus
ttcagaggctagaggg

SEQ ID NO: 453104 - DNA, 16 bp, M. musculus
ttcagaggctggagag

SEQ ID NO: 453105 - DNA, 16 bp, M. musculus
ttcagagggagaaaag

SEQ ID NO: 453106 - DNA, 16 bp, M. musculus
ttcagaggttcactcc

SEQ ID NO: 453107 - DNA, 16 bp, M. musculus
ttcagaggttcagtca

SEQ ID NO: 453108 - DNA, 17 bp, M. musculus
ttcagaggttcagtcca

SEQ ID NO: 453109 - DNA, 16 bp, M. musculus
ttcagaggttcagtct

SEQ ID NO: 453110 - DNA, 16 bp, M. musculus
ttcagaggtttagtcc

SEQ ID NO: 453111 - DNA, 16 bp, M. musculus
ttcagagtggttttac

SEQ ID NO: 453112 - DNA, 16 bp, M. musculus
ttcagagttcatcttg

SEQ ID NO: 453113 - DNA, 16 bp, M. musculus
ttcagatcccaacacc

SEQ ID NO: 453114 - DNA, 16 bp, M. musculus
ttcagatccccagaac

SEQ ID NO: 453115 - DNA, 16 bp, M. musculus
ttcagatgaagatgtg

SEQ ID NO: 453116 - DNA, 16 bp, M. musculus
ttcagatggagatgta

SEQ ID NO: 453117 - DNA, 16 bp, M. musculus
ttcagatggttgtaag

SEQ ID NO: 453118 - DNA, 16 bp, M. musculus
ttcagatggttgtgag

SEQ ID NO: 453119 - DNA, 16 bp, M. musculus
ttcagatgtaccagaa

SEQ ID NO: 453120 - DNA, 16 bp, M. musculus
ttcagattccatctcc

SEQ ID NO: 453121 - DNA, 16 bp, M. musculus
ttcagatttaaaatta

SEQ ID NO: 453122 - DNA, 16 bp, M. musculus
ttcagattttgaattt

SEQ ID NO: 453123 - DNA, 16 bp, M. musculus
ttcagattttggaata

SEQ ID NO: 453124 - DNA, 16 bp, M. musculus
ttcagcaaattcagtc

SEQ ID NO: 453125 - DNA, 16 bp, M. musculus
ttcagcaagcttcagt

SEQ ID NO: 453126 - DNA, 16 bp, M. musculus
ttcagcagtcaaaaat

SEQ ID NO: 453127 - DNA, 16 bp, M. musculus
ttcagcataaaataaa

SEQ ID NO: 453128 - DNA, 16 bp, M. musculus
ttcagcattttaaaaa

SEQ ID NO: 453129 - DNA, 16 bp, M. musculus
ttcagccaatgacctt

SEQ ID NO: 453130 - DNA, 16 bp, M. musculus
ttcagccactgctgct

SEQ ID NO: 453131 - DNA, 16 bp, M. musculus
ttcagccagcacctga

SEQ ID NO: 453132 - DNA, 16 bp, M. musculus
ttcagccaggcagtgg

SEQ ID NO: 453133 - DNA, 16 bp, M. musculus
ttcagccagggctaca

SEQ ID NO: 453134 - DNA, 16 bp, M. musculus
ttcagccccagataac

SEQ ID NO: 453135 - DNA, 16 bp, M. musculus
ttcagcctcaagatct

SEQ ID NO: 453136 - DNA, 16 bp, M. musculus
ttcagcctctgaaact

SEQ ID NO: 453137 - DNA, 16 bp, M. musculus
ttcagcctctgagact

SEQ ID NO: 453138 - DNA, 16 bp, M. musculus
ttcagccttatttata

SEQ ID NO: 453139 - DNA, 16 bp, M. musculus
ttcagccttctggccc

SEQ ID NO: 453140 - DNA, 16 bp, M. musculus
ttcagctacagtgtac

SEQ ID NO: 453141 - DNA, 16 bp, M. musculus
ttcagctacatatgca

SEQ ID NO: 453142 - DNA, 16 bp, M. musculus
ttcagctacttctcca

SEQ ID NO: 453143 - DNA, 16 bp, M. musculus
ttcagctagagacatg

SEQ ID NO: 453144 - DNA, 16 bp, M. musculus
ttcagctcattatcat

SEQ ID NO: 453145 - DNA, 16 bp, M. musculus
ttcagctccctgggtc

SEQ ID NO: 453146 - DNA, 16 bp, M. musculus
ttcagctcctccagca

SEQ ID NO: 453147 - DNA, 16 bp, M. musculus
ttcagctccttcctca

SEQ ID NO: 453148 - DNA, 16 bp, M. musculus
ttcagctccttgggtg

SEQ ID NO: 453149 - DNA, 16 bp, M. musculus
ttcagctccttgtgtg

SEQ ID NO: 453150 - DNA, 16 bp, M. musculus
ttcagctctcagcacc

SEQ ID NO: 453151 - DNA, 16 bp, M. musculus
ttcagctctgagtttg

SEQ ID NO: 453152 - DNA, 16 bp, M. musculus
ttcagctgcctctgct

SEQ ID NO: 453153 - DNA, 16 bp, M. musculus
ttcagctgcttgatgg

SEQ ID NO: 453154 - DNA, 16 bp, M. musculus
ttcagctggagccatg

SEQ ID NO: 453155 - DNA, 16 bp, M. musculus
ttcagctgtaaggcat

SEQ ID NO: 453156 - DNA, 16 bp, M. musculus
ttcagcttctgctcca

SEQ ID NO: 453157 - DNA, 16 bp, M. musculus
ttcagcttgaagaagt

SEQ ID NO: 453158 - DNA, 16 bp, M. musculus
ttcagcttgatttctc

SEQ ID NO: 453159 - DNA, 16 bp, M. musculus
ttcagcttgtttcttg

SEQ ID NO: 453160 - DNA, 16 bp, M. musculus
ttcagcttttaaaaat

SEQ ID NO: 453161 - DNA, 16 bp, M. musculus
ttcaggaaatccagaa

SEQ ID NO: 453162 - DNA, 16 bp, M. musculus
ttcaggaacacagagc

SEQ ID NO: 453163 - DNA, 16 bp, M. musculus
ttcaggaacttcacaa

SEQ ID NO: 453164 - DNA, 16 bp, M. musculus
ttcaggaacttgtctc

SEQ ID NO: 453165 - DNA, 16 bp, M. musculus
ttcaggaagaaggaag

SEQ ID NO: 453166 - DNA, 16 bp, M. musculus
ttcaggaagcagaggc

SEQ ID NO: 453167 - DNA, 16 bp, M. musculus
ttcaggaagttgtctc

SEQ ID NO: 453168 - DNA, 16 bp, M. musculus
ttcaggaatgttttcc

SEQ ID NO: 453169 - DNA, 16 bp, M. musculus
ttcaggaatttgtgga

SEQ ID NO: 453170 - DNA, 16 bp, M. musculus
ttcaggaatttttcac

SEQ ID NO: 453171 - DNA, 16 bp, M. musculus
ttcaggaatttttttc

SEQ ID NO: 453172 - DNA, 16 bp, M. musculus
ttcaggacaaattcag

SEQ ID NO: 453173 - DNA, 16 bp, M. musculus
ttcaggacagacaggg

SEQ ID NO: 453174 - DNA, 16 bp, M. musculus
ttcaggacccacatga

SEQ ID NO: 453175 - DNA, 16 bp, M. musculus
ttcaggagaagctgag

SEQ ID NO: 453176 - DNA, 16 bp, M. musculus
ttcaggagagagagag

SEQ ID NO: 453177 - DNA, 16 bp, M. musculus
ttcaggaggaaaaaaa

SEQ ID NO: 453178 - DNA, 16 bp, M. musculus
ttcaggaggcagagcc

SEQ ID NO: 453179 - DNA, 24 bp, M. musculus
ttcaggagtcagaacaaatattac

SEQ ID NO: 453180 - DNA, 16 bp, M. musculus
ttcaggatagaatttg

SEQ ID NO: 453181 - DNA, 16 bp, M. musculus
ttcaggatgcacaggg

SEQ ID NO: 453182 - DNA, 16 bp, M. musculus
ttcaggattgttttag

SEQ ID NO: 453183 - DNA, 16 bp, M. musculus
ttcaggatttttcccc

SEQ ID NO: 453184 - DNA, 16 bp, M. musculus
ttcaggatttttttcc

SEQ ID NO: 453185 - DNA, 16 bp, M. musculus
ttcaggcaagagtgaa

SEQ ID NO: 453186 - DNA, 16 bp, M. musculus
ttcaggccacactgct

SEQ ID NO: 453187 - DNA, 16 bp, M. musculus
ttcaggctgacaagga

SEQ ID NO: 453188 - DNA, 16 bp, M. musculus
ttcaggctttttcttt

SEQ ID NO: 453189 - DNA, 16 bp, M. musculus
ttcagggaaggtgtac

SEQ ID NO: 453190 - DNA, 16 bp, M. musculus
ttcagggagtggcact

SEQ ID NO: 453191 - DNA, 16 bp, M. musculus
ttcagggccagccttg

SEQ ID NO: 453192 - DNA, 16 bp, M. musculus
ttcagggctgactatt

SEQ ID NO: 453193 - DNA, 16 bp, M. musculus
ttcaggggtgggggtg

SEQ ID NO: 453194 - DNA, 16 bp, M. musculus
ttcagggtccttgtca

SEQ ID NO: 453195 - DNA, 16 bp, M. musculus
ttcagggtgcttctct

SEQ ID NO: 453196 - DNA, 16 bp, M. musculus
ttcagggttggagaga

SEQ ID NO: 453197 - DNA, 16 bp, M. musculus
ttcaggtcctcatgtt

SEQ ID NO: 453198 - DNA, 16 bp, M. musculus
ttcaggtgcccacaga

SEQ ID NO: 453199 - DNA, 16 bp, M. musculus
ttcaggtgcttttcag

SEQ ID NO: 453200 - DNA, 16 bp, M. musculus
ttcaggtggtctgtga

SEQ ID NO: 453201 - DNA, 17 bp, M. musculus
ttcaggtgtgttagggt

SEQ ID NO: 453202 - DNA, 16 bp, M. musculus
ttcaggttacagtcca

SEQ ID NO: 453203 - DNA, 16 bp, M. musculus
ttcaggttcagtgaca

SEQ ID NO: 453204 - DNA, 16 bp, M. musculus
ttcaggttcagtgaga

SEQ ID NO: 453205 - DNA, 16 bp, M. musculus
ttcaggttcctgtctt

SEQ ID NO: 453206 - DNA, 16 bp, M. musculus
ttcaggtttttattta

SEQ ID NO: 453207 - DNA, 16 bp, M. musculus
ttcagtaaagctcaaa

SEQ ID NO: 453208 - DNA, 16 bp, M. musculus
ttcagtactttctcta

SEQ ID NO: 453209 - DNA, 16 bp, M. musculus
ttcagtagctggatat

SEQ ID NO: 453210 - DNA, 16 bp, M. musculus
ttcagtatgaaaaatt

SEQ ID NO: 453211 - DNA, 16 bp, M. musculus
ttcagtcacaaaagaa

SEQ ID NO: 453212 - DNA, 16 bp, M. musculus
ttcagtcaccaaaccc

SEQ ID NO: 453213 - DNA, 16 bp, M. musculus
ttcagtcagcagcaga

SEQ ID NO: 453214 - DNA, 16 bp, M. musculus
ttcagtccaggacccc

SEQ ID NO: 453215 - DNA, 18 bp, M. musculus
ttcagtccattatcatca

SEQ ID NO: 453216 - DNA, 20 bp, M. musculus
ttcagtccattatcatcaaa

SEQ ID NO: 453217 - DNA, 16 bp, M. musculus
ttcagtccattattat

SEQ ID NO: 453218 - DNA, 16 bp, M. musculus
ttcagtccccagcact

SEQ ID NO: 453219 - DNA, 16 bp, M. musculus
ttcagtccctagcacc

SEQ ID NO: 453220 - DNA, 16 bp, M. musculus
ttcagtccctgagacc

SEQ ID NO: 453221 - DNA, 16 bp, M. musculus
ttcagtccctgctcca

SEQ ID NO: 453222 - DNA, 16 bp, M. musculus
ttcagtccctgtgagc

SEQ ID NO: 453223 - DNA, 16 bp, M. musculus
ttcagtcccttcttca

SEQ ID NO: 453224 - DNA, 16 bp, M. musculus
ttcagtcctgaatttg

SEQ ID NO: 453225 - DNA, 16 bp, M. musculus
ttcagtcctttctcta

SEQ ID NO: 453226 - DNA, 16 bp, M. musculus
ttcagtcgcagctgtg

SEQ ID NO: 453227 - DNA, 16 bp, M. musculus
ttcagtctatgttgga

SEQ ID NO: 453228 - DNA, 16 bp, M. musculus
ttcagtctccagaacc

SEQ ID NO: 453229 - DNA, 16 bp, M. musculus
ttcagtctccagcact

SEQ ID NO: 453230 - DNA, 16 bp, M. musculus
ttcagtctctgagagc

SEQ ID NO: 453231 - DNA, 16 bp, M. musculus
ttcagtctctgatcca

SEQ ID NO: 453232 - DNA, 16 bp, M. musculus
ttcagtctctggtttt

SEQ ID NO: 453233 - DNA, 16 bp, M. musculus
ttcagtctctttaaaa

SEQ ID NO: 453234 - DNA, 36 bp, M. musculus
ttcagtctgtcctcactagaggccaatatttaactt

SEQ ID NO: 453235 - DNA, 16 bp, M. musculus
ttcagtctgttagtct

SEQ ID NO: 453236 - DNA, 16 bp, M. musculus
ttcagtcttaattttt

SEQ ID NO: 453237 - DNA, 16 bp, M. musculus
ttcagtctttctttct

SEQ ID NO: 453238 - DNA, 16 bp, M. musculus
ttcagtgaagtacctg

SEQ ID NO: 453239 - DNA, 16 bp, M. musculus
ttcagtgacaaagaca

SEQ ID NO: 453240 - DNA, 16 bp, M. musculus
ttcagtgagaaacctt

SEQ ID NO: 453241 - DNA, 16 bp, M. musculus
ttcagtgagaagctga

SEQ ID NO: 453242 - DNA, 16 bp, M. musculus
ttcagtgagagaccct

SEQ ID NO: 453243 - DNA, 16 bp, M. musculus
ttcagtgagtttttat

SEQ ID NO: 453244 - DNA, 16 bp, M. musculus
ttcagtgatgtagcca

SEQ ID NO: 453245 - DNA, 16 bp, M. musculus
ttcagtggtcagagct

SEQ ID NO: 453246 - DNA, 16 bp, M. musculus
ttcagtggtgaaaaaa

SEQ ID NO: 453247 - DNA, 16 bp, M. musculus
ttcagtgtatctgttt

SEQ ID NO: 453248 - DNA, 16 bp, M. musculus
ttcagtgtctgttgtt

SEQ ID NO: 453249 - DNA, 16 bp, M. musculus
ttcagtgtggggcagg

SEQ ID NO: 453250 - DNA, 16 bp, M. musculus
ttcagttaaaaaaaaa

SEQ ID NO: 453251 - DNA, 16 bp, M. musculus
ttcagttagcaagaac

SEQ ID NO: 453252 - DNA, 16 bp, M. musculus
ttcagttcattaccat

SEQ ID NO: 453253 - DNA, 16 bp, M. musculus
ttcagttcccagctca

SEQ ID NO: 453254 - DNA, 16 bp, M. musculus
ttcagttcctgtcttg

SEQ ID NO: 453255 - DNA, 16 bp, M. musculus
ttcagttctcagcaca

SEQ ID NO: 453256 - DNA, 16 bp, M. musculus
ttcagttctgagccca

SEQ ID NO: 453257 - DNA, 16 bp, M. musculus
ttcagttcttgtggct

SEQ ID NO: 453258 - DNA, 16 bp, M. musculus
ttcagttctttatata

SEQ ID NO: 453259 - DNA, 16 bp, M. musculus
ttcagttgtctctgat

SEQ ID NO: 453260 - DNA, 16 bp, M. musculus
ttcagttgtgggtctc

SEQ ID NO: 453261 - DNA, 16 bp, M. musculus
ttcagtttcatgaaat

SEQ ID NO: 453262 - DNA, 16 bp, M. musculus
ttcagtttccagaaag

SEQ ID NO: 453263 - DNA, 16 bp, M. musculus
ttcagtttctgtgagt

SEQ ID NO: 453264 - DNA, 16 bp, M. musculus
ttcagtttgattttct

SEQ ID NO: 453265 - DNA, 16 bp, M. musculus
ttcagtttgctttctt

SEQ ID NO: 453266 - DNA, 16 bp, M. musculus
ttcagttttggttttg

SEQ ID NO: 453267 - DNA, 16 bp, M. musculus
ttcataaaagaaacac

SEQ ID NO: 453268 - DNA, 16 bp, M. musculus
ttcataaagttgcaaa

SEQ ID NO: 453269 - DNA, 16 bp, M. musculus
ttcataaatatataca

SEQ ID NO: 453270 - DNA, 16 bp, M. musculus
ttcataacagtcttat

SEQ ID NO: 453271 - DNA, 16 bp, M. musculus
ttcataactagcaaaa

SEQ ID NO: 453272 - DNA, 16 bp, M. musculus
ttcataactgtaattg

SEQ ID NO: 453273 - DNA, 16 bp, M. musculus
ttcataactgtacttt

SEQ ID NO: 453274 - DNA, 16 bp, M. musculus
ttcataagaaaacaaa

SEQ ID NO: 453275 - DNA, 16 bp, M. musculus
ttcataatagcctcaa

SEQ ID NO: 453276 - DNA, 16 bp, M. musculus
ttcataatattgttgc

SEQ ID NO: 453277 - DNA, 16 bp, M. musculus
ttcatacacacaaata

SEQ ID NO: 453278 - DNA, 16 bp, M. musculus
ttcatacacataaagt

SEQ ID NO: 453279 - DNA, 16 bp, M. musculus
ttcatacacatataca

SEQ ID NO: 453280 - DNA, 16 bp, M. musculus
ttcatacagacataca

SEQ ID NO: 453281 - DNA, 16 bp, M. musculus
ttcatacatataaaat

SEQ ID NO: 453282 - DNA, 16 bp, M. musculus
ttcatactggagaagg

SEQ ID NO: 453283 - DNA, 16 bp, M. musculus
ttcatactttaaaaaa

SEQ ID NO: 453284 - DNA, 16 bp, M. musculus
ttcatagaaatagaaa

SEQ ID NO: 453285 - DNA, 16 bp, M. musculus
ttcatagaaatgaaac

SEQ ID NO: 453286 - DNA, 16 bp, M. musculus
ttcatagcagtagcaa

SEQ ID NO: 453287 - DNA, 16 bp, M. musculus
ttcatagcccaggctg

SEQ ID NO: 453288 - DNA, 16 bp, M. musculus
ttcatagctgctgctg

SEQ ID NO: 453289 - DNA, 16 bp, M. musculus
ttcataggaaaagtca

SEQ ID NO: 453290 - DNA, 16 bp, M. musculus
ttcataggacaaaggg

SEQ ID NO: 453291 - DNA, 16 bp, M. musculus
ttcatagggtctctct

SEQ ID NO: 453292 - DNA, 16 bp, M. musculus
ttcatataaatgaaat

SEQ ID NO: 453293 - DNA, 16 bp, M. musculus
ttcatatacatatgaa

SEQ ID NO: 453294 - DNA, 16 bp, M. musculus
ttcatatacatgcatg

SEQ ID NO: 453295 - DNA, 16 bp, M. musculus
ttcatatacttcattt

SEQ ID NO: 453296 - DNA, 16 bp, M. musculus
ttcatatatatgaata

SEQ ID NO: 453297 - DNA, 16 bp, M. musculus
ttcatatatgtatata

SEQ ID NO: 453298 - DNA, 16 bp, M. musculus
ttcatatatgtctata

SEQ ID NO: 453299 - DNA, 16 bp, M. musculus
ttcatatatgtgtatg

SEQ ID NO: 453300 - DNA, 16 bp, M. musculus
ttcatatattgaacca

SEQ ID NO: 453301 - DNA, 16 bp, M. musculus
ttcatatccattctgt

SEQ ID NO: 453302 - DNA, 16 bp, M. musculus
ttcatatggtctgtga

SEQ ID NO: 453303 - DNA, 16 bp, M. musculus
ttcatatgtaaaaaca

SEQ ID NO: 453304 - DNA, 16 bp, M. musculus
ttcatatgtatatgaa

SEQ ID NO: 453305 - DNA, 16 bp, M. musculus
ttcatattattattcc

SEQ ID NO: 453306 - DNA, 16 bp, M. musculus
ttcatattatttgtga

SEQ ID NO: 453307 - DNA, 22 bp, M. musculus
ttcatattgttgttcctcctat

SEQ ID NO: 453308 - DNA, 16 bp, M. musculus
ttcatattgttgttct

SEQ ID NO: 453309 - DNA, 16 bp, M. musculus
ttcatatttcatgtgt

SEQ ID NO: 453310 - DNA, 21 bp, M. musculus
ttcatcaactgtttcaatgaa

SEQ ID NO: 453311 - DNA, 16 bp, M. musculus
ttcatcaatatgaaga

SEQ ID NO: 453312 - DNA, 16 bp, M. musculus
ttcatcacagcagcag

SEQ ID NO: 453313 - DNA, 16 bp, M. musculus
ttcatcactgagagaa

SEQ ID NO: 453314 - DNA, 16 bp, M. musculus
ttcatcagggaaatga

SEQ ID NO: 453315 - DNA, 16 bp, M. musculus
ttcatcagtgggagga

SEQ ID NO: 453316 - DNA, 16 bp, M. musculus
ttcatcatcaaagaaa

SEQ ID NO: 453317 - DNA, 16 bp, M. musculus
ttcatcatcaccatca

SEQ ID NO: 453318 - DNA, 16 bp, M. musculus
ttcatcatcatcatca

SEQ ID NO: 453319 - DNA, 16 bp, M. musculus
ttcatcatccatccat

SEQ ID NO: 453320 - DNA, 16 bp, M. musculus
ttcatcatctttctgg

SEQ ID NO: 453321 - DNA, 26 bp, M. musculus
ttcatcatgagatatgcttttaaatc

SEQ ID NO: 453322 - DNA, 16 bp, M. musculus
ttcatcatggcaggaa

SEQ ID NO: 453323 - DNA, 16 bp, M. musculus
ttcatcattgaaggaa

SEQ ID NO: 453324 - DNA, 16 bp, M. musculus
ttcatcattttaaaaa

SEQ ID NO: 453325 - DNA, 16 bp, M. musculus
ttcatccagaaactga

SEQ ID NO: 453326 - DNA, 16 bp, M. musculus
ttcatccaggttttct

SEQ ID NO: 453327 - DNA, 16 bp, M. musculus
ttcatccagtttttcc

SEQ ID NO: 453328 - DNA, 16 bp, M. musculus
ttcatccttctcttgc

SEQ ID NO: 453329 - DNA, 16 bp, M. musculus
ttcatctcagcactca

SEQ ID NO: 453330 - DNA, 16 bp, M. musculus
ttcatctctctgtgct

SEQ ID NO: 453331 - DNA, 16 bp, M. musculus
ttcatctctgaatgaa

SEQ ID NO: 453332 - DNA, 16 bp, M. musculus
ttcatctctgggtttt

SEQ ID NO: 453333 - DNA, 16 bp, M. musculus
ttcatctgaaggaaga

SEQ ID NO: 453334 - DNA, 16 bp, M. musculus
ttcatctgcttcagaa

SEQ ID NO: 453335 - DNA, 16 bp, M. musculus
ttcatctggaacaaca

SEQ ID NO: 453336 - DNA, 16 bp, M. musculus
ttcatctgtaaaatgg

SEQ ID NO: 453337 - DNA, 16 bp, M. musculus
ttcatcttatttttga

SEQ ID NO: 453338 - DNA, 16 bp, M. musculus
ttcatcttcattgtca

SEQ ID NO: 453339 - DNA, 16 bp, M. musculus
ttcatcttctgaggtc

SEQ ID NO: 453340 - DNA, 17 bp, M. musculus
ttcatcttctgccaaga

SEQ ID NO: 453341 - DNA, 16 bp, M. musculus
ttcatcttctgtttct

SEQ ID NO: 453342 - DNA, 16 bp, M. musculus
ttcatctttaaaatat

SEQ ID NO: 453343 - DNA, 16 bp, M. musculus
ttcatgaaattcttag

SEQ ID NO: 453344 - DNA, 16 bp, M. musculus
ttcatgaaattttcag

SEQ ID NO: 453345 - DNA, 17 bp, M. musculus
ttcatgacaaaaccaaa

SEQ ID NO: 453346 - DNA, 16 bp, M. musculus
ttcatgacttcttcaa

SEQ ID NO: 453347 - DNA, 16 bp, M. musculus
ttcatgagatccagct

SEQ ID NO: 453348 - DNA, 16 bp, M. musculus
ttcatgagttttgcaa

SEQ ID NO: 453349 - DNA, 16 bp, M. musculus
ttcatgataaaaattt

SEQ ID NO: 453350 - DNA, 16 bp, M. musculus
ttcatgatctcttttt

SEQ ID NO: 453351 - DNA, 16 bp, M. musculus
ttcatgatgatgaaga

SEQ ID NO: 453352 - DNA, 16 bp, M. musculus
ttcatgatgccatttt

SEQ ID NO: 453353 - DNA, 16 bp, M. musculus
ttcatgatgtaaaatt

SEQ ID NO: 453354 - DNA, 16 bp, M. musculus
ttcatgatgtccttgc

SEQ ID NO: 453355 - DNA, 16 bp, M. musculus
ttcatgattaatgtgt

SEQ ID NO: 453356 - DNA, 16 bp, M. musculus
ttcatgcaacagagag

SEQ ID NO: 453357 - DNA, 16 bp, M. musculus
ttcatgcacacataca

SEQ ID NO: 453358 - DNA, 16 bp, M. musculus
ttcatgcagattcaac

SEQ ID NO: 453359 - DNA, 16 bp, M. musculus
ttcatgcccaaggtgg

SEQ ID NO: 453360 - DNA, 16 bp, M. musculus
ttcatgctttctctct

SEQ ID NO: 453361 - DNA, 16 bp, M. musculus
ttcatggaaaaatatt

SEQ ID NO: 453362 - DNA, 16 bp, M. musculus
ttcatggccagtctgg

SEQ ID NO: 453363 - DNA, 16 bp, M. musculus
ttcatggcctcttctt

SEQ ID NO: 453364 - DNA, 16 bp, M. musculus
ttcatgggctggagag

SEQ ID NO: 453365 - DNA, 16 bp, M. musculus
ttcatgggtgcagctt

SEQ ID NO: 453366 - DNA, 16 bp, M. musculus
ttcatggtaaaagttt

SEQ ID NO: 453367 - DNA, 16 bp, M. musculus
ttcatggtaaacccac

SEQ ID NO: 453368 - DNA, 16 bp, M. musculus
ttcatggtggtggtgg

SEQ ID NO: 453369 - DNA, 16 bp, M. musculus
ttcatgtacataaaat

SEQ ID NO: 453370 - DNA, 16 bp, M. musculus
ttcatgtatgttttct

SEQ ID NO: 453371 - DNA, 16 bp, M. musculus
ttcatgtattcattca

SEQ ID NO: 453372 - DNA, 16 bp, M. musculus
ttcatgtatttaggaa

SEQ ID NO: 453373 - DNA, 16 bp, M. musculus
ttcatgtatttttaaa

SEQ ID NO: 453374 - DNA, 16 bp, M. musculus
ttcatgtctgggtctt

SEQ ID NO: 453375 - DNA, 16 bp, M. musculus
ttcatgtcttcatttt

SEQ ID NO: 453376 - DNA, 16 bp, M. musculus
ttcatgtctttaaaaa

SEQ ID NO: 453377 - DNA, 16 bp, M. musculus
ttcatgtgaaaaaaaa

SEQ ID NO: 453378 - DNA, 16 bp, M. musculus
ttcatgtggatgctgg

SEQ ID NO: 453379 - DNA, 16 bp, M. musculus
ttcatgtgtgtgtgtg

SEQ ID NO: 453380 - DNA, 19 bp, M. musculus
ttcatgtgtttagcaaatt

SEQ ID NO: 453381 - DNA, 16 bp, M. musculus
ttcatgtgtttgaata

SEQ ID NO: 453382 - DNA, 16 bp, M. musculus
ttcatgttaaatgtct

SEQ ID NO: 453383 - DNA, 16 bp, M. musculus
ttcatgttctcacaag

SEQ ID NO: 453384 - DNA, 20 bp, M. musculus
ttcatgttgtggtgaccccc

SEQ ID NO: 453385 - DNA, 16 bp, M. musculus
ttcatgtttggtgttt

SEQ ID NO: 453386 - DNA, 16 bp, M. musculus
ttcatgtttttataaa

SEQ ID NO: 453387 - DNA, 16 bp, M. musculus
ttcatgttttttaaaa

SEQ ID NO: 453388 - DNA, 16 bp, M. musculus
ttcattaaactcaaaa

SEQ ID NO: 453389 - DNA, 16 bp, M. musculus
ttcattaaagagactt

SEQ ID NO: 453390 - DNA, 16 bp, M. musculus
ttcattaaagtaactt

SEQ ID NO: 453391 - DNA, 16 bp, M. musculus
ttcattaatttctgcc

SEQ ID NO: 453392 - DNA, 16 bp, M. musculus
ttcattagaaaaaaaa

SEQ ID NO: 453393 - DNA, 16 bp, M. musculus
ttcattatcaagaaaa

SEQ ID NO: 453394 - DNA, 16 bp, M. musculus
ttcattatgtaaatat

SEQ ID NO: 453395 - DNA, 16 bp, M. musculus
ttcattcaacttaatt

SEQ ID NO: 453396 - DNA, 16 bp, M. musculus
ttcattcagagatggt

SEQ ID NO: 453397 - DNA, 16 bp, M. musculus
ttcattcagtcattca

SEQ ID NO: 453398 - DNA, 16 bp, M. musculus
ttcattcatattctct

SEQ ID NO: 453399 - DNA, 16 bp, M. musculus
ttcattcatccatcca

SEQ ID NO: 453400 - DNA, 16 bp, M. musculus
ttcattcattcattca

SEQ ID NO: 453401 - DNA, 16 bp, M. musculus
ttcattcatttatcca

SEQ ID NO: 453402 - DNA, 16 bp, M. musculus
ttcattcatttgttcc

SEQ ID NO: 453403 - DNA, 16 bp, M. musculus
ttcattcctaattcct

SEQ ID NO: 453404 - DNA, 16 bp, M. musculus
ttcattcctacttaga

SEQ ID NO: 453405 - DNA, 16 bp, M. musculus
ttcattcctttaaaaa

SEQ ID NO: 453406 - DNA, 16 bp, M. musculus
ttcattctcatctgct

SEQ ID NO: 453407 - DNA, 16 bp, M. musculus
ttcattctcatctgta

SEQ ID NO: 453408 - DNA, 16 bp, M. musculus
ttcattctcatggtca

SEQ ID NO: 453409 - DNA, 16 bp, M. musculus
ttcattctcatttata

SEQ ID NO: 453410 - DNA, 16 bp, M. musculus
ttcattctctctctgt

SEQ ID NO: 453411 - DNA, 16 bp, M. musculus
ttcattcttaaaaaaa

SEQ ID NO: 453412 - DNA, 16 bp, M. musculus
ttcattcttatcaact

SEQ ID NO: 453413 - DNA, 16 bp, M. musculus
ttcattcttttgaata

SEQ ID NO: 453414 - DNA, 16 bp, M. musculus
ttcattgaactggaag

SEQ ID NO: 453415 - DNA, 16 bp, M. musculus
ttcattgaattttaga

SEQ ID NO: 453416 - DNA, 16 bp, M. musculus
ttcattgatctgcaga

SEQ ID NO: 453417 - DNA, 16 bp, M. musculus
ttcattgctacttcac

SEQ ID NO: 453418 - DNA, 16 bp, M. musculus
ttcattgctatgaaga

SEQ ID NO: 453419 - DNA, 16 bp, M. musculus
ttcattggagaccttg

SEQ ID NO: 453420 - DNA, 16 bp, M. musculus
ttcattggggaccctg

SEQ ID NO: 453421 - DNA, 16 bp, M. musculus
ttcattggttttaata

SEQ ID NO: 453422 - DNA, 23 bp, M. musculus
ttcattgtaataaggctgtactt

SEQ ID NO: 453423 - DNA, 16 bp, M. musculus
ttcattgtgtcctaga

SEQ ID NO: 453424 - DNA, 16 bp, M. musculus
ttcattgttacttcat

SEQ ID NO: 453425 - DNA, 16 bp, M. musculus
ttcattgttctctgct

SEQ ID NO: 453426 - DNA, 16 bp, M. musculus
ttcattgttttcaata

SEQ ID NO: 453427 - DNA, 16 bp, M. musculus
ttcatttaaaattcaa

SEQ ID NO: 453428 - DNA, 16 bp, M. musculus
ttcatttaaagaaaaa

SEQ ID NO: 453429 - DNA, 16 bp, M. musculus
ttcatttaataacatg

SEQ ID NO: 453430 - DNA, 18 bp, M. musculus
ttcatttacatttcaaat

SEQ ID NO: 453431 - DNA, 16 bp, M. musculus
ttcatttattcattca

SEQ ID NO: 453432 - DNA, 16 bp, M. musculus
ttcatttatttattga

SEQ ID NO: 453433 - DNA, 16 bp, M. musculus
ttcatttatttgtgtg

SEQ ID NO: 453434 - DNA, 16 bp, M. musculus
ttcatttcagattttg

SEQ ID NO: 453435 - DNA, 16 bp, M. musculus
ttcatttcatttacat

SEQ ID NO: 453436 - DNA, 16 bp, M. musculus
ttcatttcatttgatt

SEQ ID NO: 453437 - DNA, 16 bp, M. musculus
ttcatttccatttcaa

SEQ ID NO: 453438 - DNA, 16 bp, M. musculus
ttcatttcccagaacc

SEQ ID NO: 453439 - DNA, 16 bp, M. musculus
ttcatttcccttttaa

SEQ ID NO: 453440 - DNA, 16 bp, M. musculus
ttcatttcctcaggct

SEQ ID NO: 453441 - DNA, 16 bp, M. musculus
ttcatttccttcagtc

SEQ ID NO: 453442 - DNA, 16 bp, M. musculus
ttcatttccttgatga

SEQ ID NO: 453443 - DNA, 16 bp, M. musculus
ttcatttctctctgct

SEQ ID NO: 453444 - DNA, 16 bp, M. musculus
ttcatttctctgatca

SEQ ID NO: 453445 - DNA, 16 bp, M. musculus
ttcatttctgactttg

SEQ ID NO: 453446 - DNA, 16 bp, M. musculus
ttcatttctgcttttg

SEQ ID NO: 453447 - DNA, 16 bp, M. musculus
ttcatttctggatatt

SEQ ID NO: 453448 - DNA, 16 bp, M. musculus
ttcatttctgtcttct

SEQ ID NO: 453449 - DNA, 16 bp, M. musculus
ttcatttctgttgctt

SEQ ID NO: 453450 - DNA, 16 bp, M. musculus
ttcatttcttaaaata

SEQ ID NO: 453451 - DNA, 16 bp, M. musculus
ttcatttctttgggta

SEQ ID NO: 453452 - DNA, 16 bp, M. musculus
ttcatttgatgacaaa

SEQ ID NO: 453453 - DNA, 16 bp, M. musculus
ttcatttggatactgt

SEQ ID NO: 453454 - DNA, 16 bp, M. musculus
ttcatttgtattttaa

SEQ ID NO: 453455 - DNA, 16 bp, M. musculus
ttcatttgtttaaaaa

SEQ ID NO: 453456 - DNA, 16 bp, M. musculus
ttcatttgttttgaat

SEQ ID NO: 453457 - DNA, 16 bp, M. musculus
ttcattttaaaatatg

SEQ ID NO: 453458 - DNA, 16 bp, M. musculus
ttcattttaaaatgtg

SEQ ID NO: 453459 - DNA, 16 bp, M. musculus
ttcattttaaagaaag

SEQ ID NO: 453460 - DNA, 16 bp, M. musculus
ttcattttaatgaaaa

SEQ ID NO: 453461 - DNA, 16 bp, M. musculus
ttcattttacaaatga

SEQ ID NO: 453462 - DNA, 16 bp, M. musculus
ttcattttagaaaaga

SEQ ID NO: 453463 - DNA, 16 bp, M. musculus
ttcattttcaaatata

SEQ ID NO: 453464 - DNA, 16 bp, M. musculus
ttcattttcaaatgaa

SEQ ID NO: 453465 - DNA, 16 bp, M. musculus
ttcattttctgccagg

SEQ ID NO: 453466 - DNA, 16 bp, M. musculus
ttcattttcttgaaaa

SEQ ID NO: 453467 - DNA, 16 bp, M. musculus
ttcattttggaaaata

SEQ ID NO: 453468 - DNA, 16 bp, M. musculus
ttcattttgtaaatgt

SEQ ID NO: 453469 - DNA, 16 bp, M. musculus
ttcattttgtttccat

SEQ ID NO: 453470 - DNA, 16 bp, M. musculus
ttcatttttaaagtaa

SEQ ID NO: 453471 - DNA, 16 bp, M. musculus
ttcatttttgttccat

SEQ ID NO: 453472 - DNA, 16 bp, M. musculus
ttcatttttgttgctg

SEQ ID NO: 453473 - DNA, 16 bp, M. musculus
ttcattttttaaaatg

SEQ ID NO: 453474 - DNA, 16 bp, M. musculus
ttccaaaaagaaaaga

SEQ ID NO: 453475 - DNA, 16 bp, M. musculus
ttccaaaacaaccagg

SEQ ID NO: 453476 - DNA, 16 bp, M. musculus
ttccaaaaggaagaaa

SEQ ID NO: 453477 - DNA, 16 bp, M. musculus
ttccaaagctgcagga

SEQ ID NO: 453478 - DNA, 16 bp, M. musculus
ttccaaaggaaaaaaa

SEQ ID NO: 453479 - DNA, 16 bp, M. musculus
ttccaaagggcctgag

SEQ ID NO: 453480 - DNA, 16 bp, M. musculus
ttccaaaggtcctgaa

SEQ ID NO: 453481 - DNA, 16 bp, M. musculus
ttccaaagtccttcca

SEQ ID NO: 453482 - DNA, 16 bp, M. musculus
ttccaaagttcctgag

SEQ ID NO: 453483 - DNA, 16 bp, M. musculus
ttccaaagttcttcca

SEQ ID NO: 453484 - DNA, 16 bp, M. musculus
ttccaaataaaattta

SEQ ID NO: 453485 - DNA, 17 bp, M. musculus
ttccaaatgaatttgca

SEQ ID NO: 453486 - DNA, 17 bp, M. musculus
ttccaaatgggggattt

SEQ ID NO: 453487 - DNA, 19 bp, M. musculus
ttccaaatgtagtattact

SEQ ID NO: 453488 - DNA, 16 bp, M. musculus
ttccaaattttctctg

SEQ ID NO: 453489 - DNA, 16 bp, M. musculus
ttccaacaaccacatg

SEQ ID NO: 453490 - DNA, 16 bp, M. musculus
ttccaacaaggccata

SEQ ID NO: 453491 - DNA, 16 bp, M. musculus
ttccaacacttggaag

SEQ ID NO: 453492 - DNA, 16 bp, M. musculus
ttccaacacttgggag

SEQ ID NO: 453493 - DNA, 16 bp, M. musculus
ttccaaccccatagga

SEQ ID NO: 453494 - DNA, 16 bp, M. musculus
ttccaactcaattatt

SEQ ID NO: 453495 - DNA, 17 bp, M. musculus
ttccaactggtaataag

SEQ ID NO: 453496 - DNA, 16 bp, M. musculus
ttccaagaaagccagg

SEQ ID NO: 453497 - DNA, 16 bp, M. musculus
ttccaagaacattctt

SEQ ID NO: 453498 - DNA, 16 bp, M. musculus
ttccaagaaggggcaa

SEQ ID NO: 453499 - DNA, 16 bp, M. musculus
ttccaagaagtgcttg

SEQ ID NO: 453500 - DNA, 16 bp, M. musculus
ttccaagatagccaag

SEQ ID NO: 453501 - DNA, 16 bp, M. musculus
ttccaagcaaatgata

SEQ ID NO: 453502 - DNA, 16 bp, M. musculus
ttccaagcacccacat

SEQ ID NO: 453503 - DNA, 16 bp, M. musculus
ttccaagccaacctgg

SEQ ID NO: 453504 - DNA, 16 bp, M. musculus
ttccaagccagccagg

SEQ ID NO: 453505 - DNA, 16 bp, M. musculus
ttccaagccagtctgg

SEQ ID NO: 453506 - DNA, 16 bp, M. musculus
ttccaaggagctctgg

SEQ ID NO: 453507 - DNA, 16 bp, M. musculus
ttccaaggttcatatt

SEQ ID NO: 453508 - DNA, 16 bp, M. musculus
ttccaagtaaagaaaa

SEQ ID NO: 453509 - DNA, 16 bp, M. musculus
ttccaagtctgtgttc

SEQ ID NO: 453510 - DNA, 16 bp, M. musculus
ttccaagtgctgggat

SEQ ID NO: 453511 - DNA, 16 bp, M. musculus
ttccaagtttgcattc

SEQ ID NO: 453512 - DNA, 16 bp, M. musculus
ttccaataaaacttta

SEQ ID NO: 453513 - DNA, 16 bp, M. musculus
ttccaatacctctgct

SEQ ID NO: 453514 - DNA, 16 bp, M. musculus
ttccaatcaaaattcc

SEQ ID NO: 453515 - DNA, 16 bp, M. musculus
ttccaatctctctctc

SEQ ID NO: 453516 - DNA, 16 bp, M. musculus
ttccaatctgtaggtt

SEQ ID NO: 453517 - DNA, 16 bp, M. musculus
ttccaattccaagaag

SEQ ID NO: 453518 - DNA, 16 bp, M. musculus
ttccaattcctgtttt

SEQ ID NO: 453519 - DNA, 16 bp, M. musculus
ttccacaaaattggaa

SEQ ID NO: 453520 - DNA, 16 bp, M. musculus
ttccacaatgaacagt

SEQ ID NO: 453521 - DNA, 16 bp, M. musculus
ttccacacacacacac

SEQ ID NO: 453522 - DNA, 16 bp, M. musculus
ttccacacagtgcaca

SEQ ID NO: 453523 - DNA, 16 bp, M. musculus
ttccacactgggtaga

SEQ ID NO: 453524 - DNA, 16 bp, M. musculus
ttccacagcccactgt

SEQ ID NO: 453525 - DNA, 16 bp, M. musculus
ttccacagtgacacac

SEQ ID NO: 453526 - DNA, 16 bp, M. musculus
ttccacatcacagtcc

SEQ ID NO: 453527 - DNA, 16 bp, M. musculus
ttccacatcactgctc

SEQ ID NO: 453528 - DNA, 16 bp, M. musculus
ttccacatggccatgg

SEQ ID NO: 453529 - DNA, 16 bp, M. musculus
ttccacatgtatgtgg

SEQ ID NO: 453530 - DNA, 16 bp, M. musculus
ttccacattcctccaa

SEQ ID NO: 453531 - DNA, 16 bp, M. musculus
ttccacattgctgtcc

SEQ ID NO: 453532 - DNA, 16 bp, M. musculus
ttccaccaactcttcc

SEQ ID NO: 453533 - DNA, 16 bp, M. musculus
ttccaccacagcaagc

SEQ ID NO: 453534 - DNA, 16 bp, M. musculus
ttccaccctctcagag

SEQ ID NO: 453535 - DNA, 16 bp, M. musculus
ttccacctataaggtt

SEQ ID NO: 453536 - DNA, 16 bp, M. musculus
ttccacctatggggct

SEQ ID NO: 453537 - DNA, 16 bp, M. musculus
ttccacctcaaaagat

SEQ ID NO: 453538 - DNA, 16 bp, M. musculus
ttccacctcacaccaa

SEQ ID NO: 453539 - DNA, 16 bp, M. musculus
ttccacctcacaccac

SEQ ID NO: 453540 - DNA, 16 bp, M. musculus
ttccacctgagaactc

SEQ ID NO: 453541 - DNA, 16 bp, M. musculus
ttccaccttgcttgag

SEQ ID NO: 453542 - DNA, 16 bp, M. musculus
ttccaccttgtttgaa

SEQ ID NO: 453543 - DNA, 16 bp, M. musculus
ttccacctttacatgg

SEQ ID NO: 453544 - DNA, 16 bp, M. musculus
ttccacctttgtgtgg

SEQ ID NO: 453545 - DNA, 16 bp, M. musculus
ttccactaacagcctt

SEQ ID NO: 453546 - DNA, 16 bp, M. musculus
ttccactacctctgct

SEQ ID NO: 453547 - DNA, 18 bp, M. musculus
ttccactagcagccttca

SEQ ID NO: 453548 - DNA, 16 bp, M. musculus
ttccactatgttcaca

SEQ ID NO: 453549 - DNA, 16 bp, M. musculus
ttccactatgttcata

SEQ ID NO: 453550 - DNA, 16 bp, M. musculus
ttccactccactccag

SEQ ID NO: 453551 - DNA, 16 bp, M. musculus
ttccactccctgcccc

SEQ ID NO: 453552 - DNA, 16 bp, M. musculus
ttccactccctggctc

SEQ ID NO: 453553 - DNA, 16 bp, M. musculus
ttccactcctgacttc

SEQ ID NO: 453554 - DNA, 16 bp, M. musculus
ttccactgatgtctga

SEQ ID NO: 453555 - DNA, 44 bp, M. musculus
ttccactgatttactgtggtctatattgaatgcttctgctttag

SEQ ID NO: 453556 - DNA, 16 bp, M. musculus
ttccactgattttttt

SEQ ID NO: 453557 - DNA, 16 bp, M. musculus
ttccactggatggttt

SEQ ID NO: 453558 - DNA, 17 bp, M. musculus
ttccactggatggtttt

SEQ ID NO: 453559 - DNA, 28 bp, M. musculus
ttccactggatggttttagctcccttgt

SEQ ID NO: 453560 - DNA, 16 bp, M. musculus
ttccactgtaacttgg

SEQ ID NO: 453561 - DNA, 16 bp, M. musculus
ttccactgtgggttcc

SEQ ID NO: 453562 - DNA, 16 bp, M. musculus
ttccacttaccagagg

SEQ ID NO: 453563 - DNA, 16 bp, M. musculus
ttccacttgaccattt

SEQ ID NO: 453564 - DNA, 16 bp, M. musculus
ttccactttctccaca

SEQ ID NO: 453565 - DNA, 16 bp, M. musculus
ttccactttttaaaat

SEQ ID NO: 453566 - DNA, 16 bp, M. musculus
ttccagaaaacagaaa

SEQ ID NO: 453567 - DNA, 16 bp, M. musculus
ttccagaaaacccagg

SEQ ID NO: 453568 - DNA, 16 bp, M. musculus
ttccagaaaataaagg

SEQ ID NO: 453569 - DNA, 16 bp, M. musculus
ttccagaaaatagaag

SEQ ID NO: 453570 - DNA, 16 bp, M. musculus
ttccagaacaaccaga

SEQ ID NO: 453571 - DNA, 16 bp, M. musculus
ttccagaacacacaca

SEQ ID NO: 453572 - DNA, 16 bp, M. musculus
ttccagaacagccatg

SEQ ID NO: 453573 - DNA, 16 bp, M. musculus
ttccagaacagtcagg

SEQ ID NO: 453574 - DNA, 16 bp, M. musculus
ttccagaaccagaact

SEQ ID NO: 453575 - DNA, 16 bp, M. musculus
ttccagaacccacata

SEQ ID NO: 453576 - DNA, 16 bp, M. musculus
ttccagaactcaggag

SEQ ID NO: 453577 - DNA, 16 bp, M. musculus
ttccagaactttctca

SEQ ID NO: 453578 - DNA, 16 bp, M. musculus
ttccagaagaaggtgt

SEQ ID NO: 453579 - DNA, 16 bp, M. musculus
ttccagaagacccaag

SEQ ID NO: 453580 - DNA, 16 bp, M. musculus
ttccagaagacctgag

SEQ ID NO: 453581 - DNA, 16 bp, M. musculus
ttccagaagatctgac

SEQ ID NO: 453582 - DNA, 16 bp, M. musculus
ttccagaagctgctgg

SEQ ID NO: 453583 - DNA, 16 bp, M. musculus
ttccagaattctttct

SEQ ID NO: 453584 - DNA, 16 bp, M. musculus
ttccagaatttttttt

SEQ ID NO: 453585 - DNA, 16 bp, M. musculus
ttccagacacagcagg

SEQ ID NO: 453586 - DNA, 16 bp, M. musculus
ttccagacagcacaga

SEQ ID NO: 453587 - DNA, 16 bp, M. musculus
ttccagacaggagcct

SEQ ID NO: 453588 - DNA, 16 bp, M. musculus
ttccagaccaacctgg

SEQ ID NO: 453589 - DNA, 16 bp, M. musculus
ttccagagaaccaaat

SEQ ID NO: 453590 - DNA, 16 bp, M. musculus
ttccagagaggtttaa

SEQ ID NO: 453591 - DNA, 16 bp, M. musculus
ttccagagatggccaa

SEQ ID NO: 453592 - DNA, 16 bp, M. musculus
ttccagagcacctggg

SEQ ID NO: 453593 - DNA, 16 bp, M. musculus
ttccagagctgaggac

SEQ ID NO: 453594 - DNA, 16 bp, M. musculus
ttccagaggaactgag

SEQ ID NO: 453595 - DNA, 16 bp, M. musculus
ttccagaggacatgag

SEQ ID NO: 453596 - DNA, 16 bp, M. musculus
ttccagaggaccagaa

SEQ ID NO: 453597 - DNA, 16 bp, M. musculus
ttccagaggacctgcg

SEQ ID NO: 453598 - DNA, 16 bp, M. musculus
ttccagaggacctggg

SEQ ID NO: 453599 - DNA, 16 bp, M. musculus
ttccagaggactctgg

SEQ ID NO: 453600 - DNA, 16 bp, M. musculus
ttccagaggagggaag

SEQ ID NO: 453601 - DNA, 16 bp, M. musculus
ttccagaggagggagg

SEQ ID NO: 453602 - DNA, 16 bp, M. musculus
ttccagaggccccaag

SEQ ID NO: 453603 - DNA, 16 bp, M. musculus
ttccagagggcccagg

SEQ ID NO: 453604 - DNA, 16 bp, M. musculus
ttccagaggggaaacc

SEQ ID NO: 453605 - DNA, 16 bp, M. musculus
ttccagagggtgggat

SEQ ID NO: 453606 - DNA, 17 bp, M. musculus
ttccagaggtcctgagc

SEQ ID NO: 453607 - DNA, 16 bp, M. musculus
ttccagagtggttata

SEQ ID NO: 453608 - DNA, 16 bp, M. musculus
ttccagatctttccaa

SEQ ID NO: 453609 - DNA, 16 bp, M. musculus
ttccagatgttgtcaa

SEQ ID NO: 453610 - DNA, 16 bp, M. musculus
ttccagattctcacca

SEQ ID NO: 453611 - DNA, 16 bp, M. musculus
ttccagatttcttttc

SEQ ID NO: 453612 - DNA, 16 bp, M. musculus
ttccagcaaagggaag

SEQ ID NO: 453613 - DNA, 16 bp, M. musculus
ttccagcaaccacatg

SEQ ID NO: 453614 - DNA, 16 bp, M. musculus
ttccagcaatggtcag

SEQ ID NO: 453615 - DNA, 16 bp, M. musculus
ttccagcacacaggag

SEQ ID NO: 453616 - DNA, 16 bp, M. musculus
ttccagcacccacacc

SEQ ID NO: 453617 - DNA, 16 bp, M. musculus
ttccagcactgggaag

SEQ ID NO: 453618 - DNA, 16 bp, M. musculus
ttccagcacttgagaa

SEQ ID NO: 453619 - DNA, 16 bp, M. musculus
ttccagcagaaggtat

SEQ ID NO: 453620 - DNA, 16 bp, M. musculus
ttccagcagcagcagc

SEQ ID NO: 453621 - DNA, 16 bp, M. musculus
ttccagcaggggccct

SEQ ID NO: 453622 - DNA, 16 bp, M. musculus
ttccagcattcaggaa

SEQ ID NO: 453623 - DNA, 16 bp, M. musculus
ttccagccaggcatgg

SEQ ID NO: 453624 - DNA, 16 bp, M. musculus
ttccagccatctctcc

SEQ ID NO: 453625 - DNA, 16 bp, M. musculus
ttccagccccagcccc

SEQ ID NO: 453626 - DNA, 16 bp, M. musculus
ttccagccctcaggag

SEQ ID NO: 453627 - DNA, 16 bp, M. musculus
ttccagcctcagcaag

SEQ ID NO: 453628 - DNA, 16 bp, M. musculus
ttccagcctccagaac

SEQ ID NO: 453629 - DNA, 16 bp, M. musculus
ttccagcctggtctac

SEQ ID NO: 453630 - DNA, 16 bp, M. musculus
ttccagccttttactg

SEQ ID NO: 453631 - DNA, 16 bp, M. musculus
ttccagcctttttctc

SEQ ID NO: 453632 - DNA, 16 bp, M. musculus
ttccagctacttggga

SEQ ID NO: 453633 - DNA, 16 bp, M. musculus
ttccagctccaaggga

SEQ ID NO: 453634 - DNA, 16 bp, M. musculus
ttccagctcctggcta

SEQ ID NO: 453635 - DNA, 16 bp, M. musculus
ttccagctgattctgg

SEQ ID NO: 453636 - DNA, 16 bp, M. musculus
ttccagctgcagatag

SEQ ID NO: 453637 - DNA, 16 bp, M. musculus
ttccagcttccagcta

SEQ ID NO: 453638 - DNA, 16 bp, M. musculus
ttccagcttctcccca

SEQ ID NO: 453639 - DNA, 16 bp, M. musculus
ttccagcttcttgcta

SEQ ID NO: 453640 - DNA, 16 bp, M. musculus
ttccagcttttggcta

SEQ ID NO: 453641 - DNA, 16 bp, M. musculus
ttccaggaaagcaaga

SEQ ID NO: 453642 - DNA, 16 bp, M. musculus
ttccaggaaagccagg

SEQ ID NO: 453643 - DNA, 16 bp, M. musculus
ttccaggaagggaacc

SEQ ID NO: 453644 - DNA, 16 bp, M. musculus
ttccaggaatcccagg

SEQ ID NO: 453645 - DNA, 16 bp, M. musculus
ttccaggacaaaaaca

SEQ ID NO: 453646 - DNA, 16 bp, M. musculus
ttccaggacaaccagg

SEQ ID NO: 453647 - DNA, 16 bp, M. musculus
ttccaggacaaccagt

SEQ ID NO: 453648 - DNA, 16 bp, M. musculus
ttccaggacaaccggg

SEQ ID NO: 453649 - DNA, 16 bp, M. musculus
ttccaggacacagaga

SEQ ID NO: 453650 - DNA, 16 bp, M. musculus
ttccaggacagccaga

SEQ ID NO: 453651 - DNA, 16 bp, M. musculus
ttccaggacagccgga

SEQ ID NO: 453652 - DNA, 16 bp, M. musculus
ttccaggacagccggg

SEQ ID NO: 453653 - DNA, 16 bp, M. musculus
ttccaggacagcctgg

SEQ ID NO: 453654 - DNA, 16 bp, M. musculus
ttccaggacagctggg

SEQ ID NO: 453655 - DNA, 16 bp, M. musculus
ttccaggacaggacag

SEQ ID NO: 453656 - DNA, 16 bp, M. musculus
ttccaggacagtcaga

SEQ ID NO: 453657 - DNA, 16 bp, M. musculus
ttccaggacagttggg

SEQ ID NO: 453658 - DNA, 16 bp, M. musculus
ttccaggacatccaga

SEQ ID NO: 453659 - DNA, 16 bp, M. musculus
ttccaggacatccagt

SEQ ID NO: 453660 - DNA, 17 bp, M. musculus
ttccaggactccgccga

SEQ ID NO: 453661 - DNA, 16 bp, M. musculus
ttccaggactgccagg

SEQ ID NO: 453662 - DNA, 16 bp, M. musculus
ttccaggagacatccc

SEQ ID NO: 453663 - DNA, 16 bp, M. musculus
ttccaggagacccagg

SEQ ID NO: 453664 - DNA, 16 bp, M. musculus
ttccaggagagccagg

SEQ ID NO: 453665 - DNA, 16 bp, M. musculus
ttccaggagagcctgg

SEQ ID NO: 453666 - DNA, 16 bp, M. musculus
ttccaggagcatgagg

SEQ ID NO: 453667 - DNA, 27 bp, M. musculus
ttccaggagctgaagattgccacctga

SEQ ID NO: 453668 - DNA, 16 bp, M. musculus
ttccaggaggaagaag

SEQ ID NO: 453669 - DNA, 16 bp, M. musculus
ttccaggatagccaga

SEQ ID NO: 453670 - DNA, 16 bp, M. musculus
ttccaggcaagcctgg

SEQ ID NO: 453671 - DNA, 16 bp, M. musculus
ttccaggccaaccaga

SEQ ID NO: 453672 - DNA, 16 bp, M. musculus
ttccaggccaaccagg

SEQ ID NO: 453673 - DNA, 16 bp, M. musculus
ttccaggccagcctga

SEQ ID NO: 453674 - DNA, 16 bp, M. musculus
ttccaggccagcctgc

SEQ ID NO: 453675 - DNA, 16 bp, M. musculus
ttccaggccagccttg

SEQ ID NO: 453676 - DNA, 16 bp, M. musculus
ttccaggccagcttgg

SEQ ID NO: 453677 - DNA, 16 bp, M. musculus
ttccaggccagggaga

SEQ ID NO: 453678 - DNA, 16 bp, M. musculus
ttccaggccagtctag

SEQ ID NO: 453679 - DNA, 16 bp, M. musculus
ttccaggccagtctgg

SEQ ID NO: 453680 - DNA, 16 bp, M. musculus
ttccaggccatcctgg

SEQ ID NO: 453681 - DNA, 16 bp, M. musculus
ttccaggcctgcctgg

SEQ ID NO: 453682 - DNA, 16 bp, M. musculus
ttccaggctaccctgg

SEQ ID NO: 453683 - DNA, 16 bp, M. musculus
ttccaggctagccttg

SEQ ID NO: 453684 - DNA, 16 bp, M. musculus
ttccaggctggcctgg

SEQ ID NO: 453685 - DNA, 16 bp, M. musculus
ttccagggaacctgat

SEQ ID NO: 453686 - DNA, 16 bp, M. musculus
ttccagggatgctggg

SEQ ID NO: 453687 - DNA, 16 bp, M. musculus
ttccagggcagccagg

SEQ ID NO: 453688 - DNA, 16 bp, M. musculus
ttccagggcagtcagg

SEQ ID NO: 453689 - DNA, 16 bp, M. musculus
ttccaggggacccagg

SEQ ID NO: 453690 - DNA, 16 bp, M. musculus
ttccaggggacttggg

SEQ ID NO: 453691 - DNA, 16 bp, M. musculus
ttccaggggttctgag

SEQ ID NO: 453692 - DNA, 16 bp, M. musculus
ttccagggtggggatt

SEQ ID NO: 453693 - DNA, 16 bp, M. musculus
ttccaggtcagaggag

SEQ ID NO: 453694 - DNA, 16 bp, M. musculus
ttccaggtctgtgttt

SEQ ID NO: 453695 - DNA, 16 bp, M. musculus
ttccaggtgatccaat

SEQ ID NO: 453696 - DNA, 16 bp, M. musculus
ttccaggtggttgtga

SEQ ID NO: 453697 - DNA, 16 bp, M. musculus
ttccaggttagccaag

SEQ ID NO: 453698 - DNA, 16 bp, M. musculus
ttccaggtttaacttc

SEQ ID NO: 453699 - DNA, 16 bp, M. musculus
ttccagtaccatgaat

SEQ ID NO: 453700 - DNA, 16 bp, M. musculus
ttccagtccaggctac

SEQ ID NO: 453701 - DNA, 16 bp, M. musculus
ttccagtcctgacttt

SEQ ID NO: 453702 - DNA, 16 bp, M. musculus
ttccagtcctggcttc

SEQ ID NO: 453703 - DNA, 16 bp, M. musculus
ttccagtcctgtcttc

SEQ ID NO: 453704 - DNA, 16 bp, M. musculus
ttccagtctagcctgg

SEQ ID NO: 453705 - DNA, 16 bp, M. musculus
ttccagtctatttgga

SEQ ID NO: 453706 - DNA, 16 bp, M. musculus
ttccagtgaagggaag

SEQ ID NO: 453707 - DNA, 16 bp, M. musculus
ttccagtgatggccag

SEQ ID NO: 453708 - DNA, 16 bp, M. musculus
ttccagtggaaggagg

SEQ ID NO: 453709 - DNA, 16 bp, M. musculus
ttccagttcactctct

SEQ ID NO: 453710 - DNA, 16 bp, M. musculus
ttccagttgttaacat

SEQ ID NO: 453711 - DNA, 16 bp, M. musculus
ttccagtttcaggaga

SEQ ID NO: 453712 - DNA, 16 bp, M. musculus
ttccagtttcttttct

SEQ ID NO: 453713 - DNA, 16 bp, M. musculus
ttccagtttgttgagt

SEQ ID NO: 453714 - DNA, 16 bp, M. musculus
ttccagttttgttaaa

SEQ ID NO: 453715 - DNA, 16 bp, M. musculus
ttccagttttgttaag

SEQ ID NO: 453716 - DNA, 16 bp, M. musculus
ttccataaatccagcc

SEQ ID NO: 453717 - DNA, 16 bp, M. musculus
ttccataaggcaaagg

SEQ ID NO: 453718 - DNA, 16 bp, M. musculus
ttccataatcagcttc

SEQ ID NO: 453719 - DNA, 16 bp, M. musculus
ttccatagagaaaatc

SEQ ID NO: 453720 - DNA, 16 bp, M. musculus
ttccatagtgtaaatg

SEQ ID NO: 453721 - DNA, 16 bp, M. musculus
ttccatatattatcct

SEQ ID NO: 453722 - DNA, 16 bp, M. musculus
ttccatattcctcagt

SEQ ID NO: 453723 - DNA, 16 bp, M. musculus
ttccatcaaggccaca

SEQ ID NO: 453724 - DNA, 16 bp, M. musculus
ttccatcacctatttg

SEQ ID NO: 453725 - DNA, 16 bp, M. musculus
ttccatcagctgctga

SEQ ID NO: 453726 - DNA, 16 bp, M. musculus
ttccatccagttgcct

SEQ ID NO: 453727 - DNA, 16 bp, M. musculus
ttccatccatccatcc

SEQ ID NO: 453728 - DNA, 16 bp, M. musculus
ttccatccatttgcct

SEQ ID NO: 453729 - DNA, 16 bp, M. musculus
ttccatcccagcactg

SEQ ID NO: 453730 - DNA, 16 bp, M. musculus
ttccatcctgctgacc

SEQ ID NO: 453731 - DNA, 16 bp, M. musculus
ttccatctccagcact

SEQ ID NO: 453732 - DNA, 16 bp, M. musculus
ttccatctcctgtttg

SEQ ID NO: 453733 - DNA, 16 bp, M. musculus
ttccatctcttgtctt

SEQ ID NO: 453734 - DNA, 16 bp, M. musculus
ttccatcttataaatg

SEQ ID NO: 453735 - DNA, 16 bp, M. musculus
ttccatcttcccactg

SEQ ID NO: 453736 - DNA, 16 bp, M. musculus
ttccatcttctgaggt

SEQ ID NO: 453737 - DNA, 16 bp, M. musculus
ttccatgacaaaaaca

SEQ ID NO: 453738 - DNA, 16 bp, M. musculus
ttccatgacagccagg

SEQ ID NO: 453739 - DNA, 18 bp, M. musculus
ttccatgagtgttttgtt

SEQ ID NO: 453740 - DNA, 16 bp, M. musculus
ttccatgcagtgtgct

SEQ ID NO: 453741 - DNA, 16 bp, M. musculus
ttccatgccagcctgg

SEQ ID NO: 453742 - DNA, 16 bp, M. musculus
ttccatgccctcttct

SEQ ID NO: 453743 - DNA, 16 bp, M. musculus
ttccatgcttccccct

SEQ ID NO: 453744 - DNA, 16 bp, M. musculus
ttccatggatattttt

SEQ ID NO: 453745 - DNA, 16 bp, M. musculus
ttccatggcctctgta

SEQ ID NO: 453746 - DNA, 22 bp, M. musculus
ttccatgggtgttttgttccca

SEQ ID NO: 453747 - DNA, 16 bp, M. musculus
ttccatggtttatctg

SEQ ID NO: 453748 - DNA, 16 bp, M. musculus
ttccatgtaagactcc

SEQ ID NO: 453749 - DNA, 16 bp, M. musculus
ttccatgtgctttctt

SEQ ID NO: 453750 - DNA, 16 bp, M. musculus
ttccatgtggatgctg

SEQ ID NO: 453751 - DNA, 16 bp, M. musculus
ttccatgttctctatg

SEQ ID NO: 453752 - DNA, 16 bp, M. musculus
ttccatgttgctgctt

SEQ ID NO: 453753 - DNA, 16 bp, M. musculus
ttccatgtttcccctc

SEQ ID NO: 453754 - DNA, 16 bp, M. musculus
ttccattcacagctgc

SEQ ID NO: 453755 - DNA, 16 bp, M. musculus
ttccattcatccatcc

SEQ ID NO: 453756 - DNA, 16 bp, M. musculus
ttccattctcagcacc

SEQ ID NO: 453757 - DNA, 16 bp, M. musculus
ttccattctcctgtga

SEQ ID NO: 453758 - DNA, 16 bp, M. musculus
ttccattgttgttgtt

SEQ ID NO: 453759 - DNA, 16 bp, M. musculus
ttccatttagtatttt

SEQ ID NO: 453760 - DNA, 16 bp, M. musculus
ttccatttcctgtatt

SEQ ID NO: 453761 - DNA, 16 bp, M. musculus
ttccatttctgttttg

SEQ ID NO: 453762 - DNA, 16 bp, M. musculus
ttccattttacagata

SEQ ID NO: 453763 - DNA, 16 bp, M. musculus
ttccattttcatttca

SEQ ID NO: 453764 - DNA, 16 bp, M. musculus
ttccattttctgaaag

SEQ ID NO: 453765 - DNA, 16 bp, M. musculus
ttccattttcttcctg

SEQ ID NO: 453766 - DNA, 16 bp, M. musculus
ttccatttttaaattg

SEQ ID NO: 453767 - DNA, 16 bp, M. musculus
ttccattttttctaga

SEQ ID NO: 453768 - DNA, 16 bp, M. musculus
ttcccaaacagcacca

SEQ ID NO: 453769 - DNA, 16 bp, M. musculus
ttcccaaacagttcca

SEQ ID NO: 453770 - DNA, 16 bp, M. musculus
ttcccaaacagtttca

SEQ ID NO: 453771 - DNA, 16 bp, M. musculus
ttcccaaactgctttt

SEQ ID NO: 453772 - DNA, 16 bp, M. musculus
ttcccaaatgctggaa

SEQ ID NO: 453773 - DNA, 16 bp, M. musculus
ttcccaaatgctggga

SEQ ID NO: 453774 - DNA, 16 bp, M. musculus
ttcccaaattcaacaa

SEQ ID NO: 453775 - DNA, 16 bp, M. musculus
ttcccaacacccacat

SEQ ID NO: 453776 - DNA, 16 bp, M. musculus
ttcccaacagtgggga

SEQ ID NO: 453777 - DNA, 16 bp, M. musculus
ttcccaagactgttga

SEQ ID NO: 453778 - DNA, 16 bp, M. musculus
ttcccaagggagagca

SEQ ID NO: 453779 - DNA, 17 bp, M. musculus
ttcccaagtactgggat

SEQ ID NO: 453780 - DNA, 16 bp, M. musculus
ttcccaagtgccagga

SEQ ID NO: 453781 - DNA, 16 bp, M. musculus
ttcccaagtgctgaaa

SEQ ID NO: 453782 - DNA, 16 bp, M. musculus
ttcccaagtgctggaa

SEQ ID NO: 453783 - DNA, 16 bp, M. musculus
ttcccaagttctggga

SEQ ID NO: 453784 - DNA, 16 bp, M. musculus
ttcccaagttgctttc

SEQ ID NO: 453785 - DNA, 16 bp, M. musculus
ttcccaatatgtaggt

SEQ ID NO: 453786 - DNA, 16 bp, M. musculus
ttcccaatctgtggat

SEQ ID NO: 453787 - DNA, 16 bp, M. musculus
ttcccacaaaacagac

SEQ ID NO: 453788 - DNA, 16 bp, M. musculus
ttcccacacaggcgag

SEQ ID NO: 453789 - DNA, 16 bp, M. musculus
ttcccacagaggcctc

SEQ ID NO: 453790 - DNA, 16 bp, M. musculus
ttcccacagccagatg

SEQ ID NO: 453791 - DNA, 16 bp, M. musculus
ttcccacagttcctca

SEQ ID NO: 453792 - DNA, 16 bp, M. musculus
ttcccacatctcagac

SEQ ID NO: 453793 - DNA, 16 bp, M. musculus
ttcccaccactcacat

SEQ ID NO: 453794 - DNA, 16 bp, M. musculus
ttcccaccatgtgttt

SEQ ID NO: 453795 - DNA, 16 bp, M. musculus
ttcccacccagttccc

SEQ ID NO: 453796 - DNA, 16 bp, M. musculus
ttcccacctatcttcc

SEQ ID NO: 453797 - DNA, 16 bp, M. musculus
ttcccacctcaaaaga

SEQ ID NO: 453798 - DNA, 16 bp, M. musculus
ttcccacggattgagg

SEQ ID NO: 453799 - DNA, 16 bp, M. musculus
ttcccactgtctctgt

SEQ ID NO: 453800 - DNA, 16 bp, M. musculus
ttcccactgttaggag

SEQ ID NO: 453801 - DNA, 16 bp, M. musculus
ttcccactgttcccac

SEQ ID NO: 453802 - DNA, 16 bp, M. musculus
ttcccacttcttggcc

SEQ ID NO: 453803 - DNA, 16 bp, M. musculus
ttcccagaaaacacat

SEQ ID NO: 453804 - DNA, 16 bp, M. musculus
ttcccagaaatccaag

SEQ ID NO: 453805 - DNA, 16 bp, M. musculus
ttcccagaacccacat

SEQ ID NO: 453806 - DNA, 16 bp, M. musculus
ttcccagaacccatgt

SEQ ID NO: 453807 - DNA, 16 bp, M. musculus
ttcccagaactcacat

SEQ ID NO: 453808 - DNA, 16 bp, M. musculus
ttcccagaagatttca

SEQ ID NO: 453809 - DNA, 16 bp, M. musculus
ttcccagaagtccaag

SEQ ID NO: 453810 - DNA, 16 bp, M. musculus
ttcccagaatccactt

SEQ ID NO: 453811 - DNA, 16 bp, M. musculus
ttcccagaattccaaa

SEQ ID NO: 453812 - DNA, 16 bp, M. musculus
ttcccagaattccaag

SEQ ID NO: 453813 - DNA, 16 bp, M. musculus
ttcccagacactcctc

SEQ ID NO: 453814 - DNA, 16 bp, M. musculus
ttcccagaggcttctg

SEQ ID NO: 453815 - DNA, 16 bp, M. musculus
ttcccagagttcttca

SEQ ID NO: 453816 - DNA, 16 bp, M. musculus
ttcccagatgaatttg

SEQ ID NO: 453817 - DNA, 18 bp, M. musculus
ttcccagcaaccacatga

SEQ ID NO: 453818 - DNA, 24 bp, M. musculus
ttcccagcaaccacatggtggcta

SEQ ID NO: 453819 - DNA, 22 bp, M. musculus
ttcccagcaaccacatggtggt

SEQ ID NO: 453820 - DNA, 16 bp, M. musculus
ttcccagcaactatgt

SEQ ID NO: 453821 - DNA, 16 bp, M. musculus
ttcccagcaccaacat

SEQ ID NO: 453822 - DNA, 16 bp, M. musculus
ttcccagcacccaaat

SEQ ID NO: 453823 - DNA, 16 bp, M. musculus
ttcccagcacccacaa

SEQ ID NO: 453824 - DNA, 16 bp, M. musculus
ttcccagcacccacac

SEQ ID NO: 453825 - DNA, 16 bp, M. musculus
ttcccagcacccacag

SEQ ID NO: 453826 - DNA, 16 bp, M. musculus
ttcccagcacccacat

SEQ ID NO: 453827 - DNA, 16 bp, M. musculus
ttcccagcacccagat

SEQ ID NO: 453828 - DNA, 16 bp, M. musculus
ttcccagcacccatgc

SEQ ID NO: 453829 - DNA, 16 bp, M. musculus
ttcccagcaccccaca

SEQ ID NO: 453830 - DNA, 16 bp, M. musculus
ttcccagcaccccatg

SEQ ID NO: 453831 - DNA, 16 bp, M. musculus
ttcccagcacccctgt

SEQ ID NO: 453832 - DNA, 16 bp, M. musculus
ttcccagcacctgcat

SEQ ID NO: 453833 - DNA, 16 bp, M. musculus
ttcccagcactcacat

SEQ ID NO: 453834 - DNA, 16 bp, M. musculus
ttcccagcactcatgt

SEQ ID NO: 453835 - DNA, 16 bp, M. musculus
ttcccagcacttggaa

SEQ ID NO: 453836 - DNA, 16 bp, M. musculus
ttcccagcagccatgt

SEQ ID NO: 453837 - DNA, 16 bp, M. musculus
ttcccagcatccacat

SEQ ID NO: 453838 - DNA, 16 bp, M. musculus
ttcccagcatgcattt

SEQ ID NO: 453839 - DNA, 16 bp, M. musculus
ttcccagccatccacc

SEQ ID NO: 453840 - DNA, 16 bp, M. musculus
ttcccagctattggct

SEQ ID NO: 453841 - DNA, 16 bp, M. musculus
ttcccagctcccacat

SEQ ID NO: 453842 - DNA, 16 bp, M. musculus
ttcccagctccccacc

SEQ ID NO: 453843 - DNA, 16 bp, M. musculus
ttcccagctgagccat

SEQ ID NO: 453844 - DNA, 16 bp, M. musculus
ttcccagcttctggct

SEQ ID NO: 453845 - DNA, 16 bp, M. musculus
ttcccaggaacaggat

SEQ ID NO: 453846 - DNA, 16 bp, M. musculus
ttcccaggacccacat

SEQ ID NO: 453847 - DNA, 16 bp, M. musculus
ttcccaggcttggggt

SEQ ID NO: 453848 - DNA, 16 bp, M. musculus
ttcccagggagctctg

SEQ ID NO: 453849 - DNA, 16 bp, M. musculus
ttcccagggaggtctt

SEQ ID NO: 453850 - DNA, 16 bp, M. musculus
ttcccagtacccacac

SEQ ID NO: 453851 - DNA, 16 bp, M. musculus
ttcccagtacccatgt

SEQ ID NO: 453852 - DNA, 16 bp, M. musculus
ttcccagtccttccat

SEQ ID NO: 453853 - DNA, 16 bp, M. musculus
ttcccagtccttccct

SEQ ID NO: 453854 - DNA, 16 bp, M. musculus
ttcccagtgcccatgt

SEQ ID NO: 453855 - DNA, 16 bp, M. musculus
ttcccagtgctgggac

SEQ ID NO: 453856 - DNA, 16 bp, M. musculus
ttcccagttcccctcc

SEQ ID NO: 453857 - DNA, 16 bp, M. musculus
ttcccagttttccctc

SEQ ID NO: 453858 - DNA, 16 bp, M. musculus
ttcccatcatccacat

SEQ ID NO: 453859 - DNA, 16 bp, M. musculus
ttcccatcccacagtc

SEQ ID NO: 453860 - DNA, 16 bp, M. musculus
ttcccatctgctgcag

SEQ ID NO: 453861 - DNA, 16 bp, M. musculus
ttcccatctgcttcag

SEQ ID NO: 453862 - DNA, 16 bp, M. musculus
ttcccatctttaagta

SEQ ID NO: 453863 - DNA, 16 bp, M. musculus
ttcccatgccctaaat

SEQ ID NO: 453864 - DNA, 16 bp, M. musculus
ttcccatggagctcca

SEQ ID NO: 453865 - DNA, 16 bp, M. musculus
ttcccatgtgtgtgtg

SEQ ID NO: 453866 - DNA, 16 bp, M. musculus
ttcccattcacagctg

SEQ ID NO: 453867 - DNA, 16 bp, M. musculus
ttcccattctgtagac

SEQ ID NO: 453868 - DNA, 16 bp, M. musculus
ttcccattctttctgc

SEQ ID NO: 453869 - DNA, 16 bp, M. musculus
ttcccatttcctcctg

SEQ ID NO: 453870 - DNA, 16 bp, M. musculus
ttcccatttgagcaac

SEQ ID NO: 453871 - DNA, 16 bp, M. musculus
ttcccattttaaaaaa

SEQ ID NO: 453872 - DNA, 16 bp, M. musculus
ttcccattttaggtct

SEQ ID NO: 453873 - DNA, 16 bp, M. musculus
ttccccaaactccaaa

SEQ ID NO: 453874 - DNA, 16 bp, M. musculus
ttccccaacccaccta

SEQ ID NO: 453875 - DNA, 16 bp, M. musculus
ttccccaactggttct

SEQ ID NO: 453876 - DNA, 16 bp, M. musculus
ttccccaagaaaaaga

SEQ ID NO: 453877 - DNA, 16 bp, M. musculus
ttccccaataaaaaaa

SEQ ID NO: 453878 - DNA, 16 bp, M. musculus
ttccccacatccttgc

SEQ ID NO: 453879 - DNA, 16 bp, M. musculus
ttccccacatgctccc

SEQ ID NO: 453880 - DNA, 16 bp, M. musculus
ttccccaccaagcagg

SEQ ID NO: 453881 - DNA, 17 bp, M. musculus
ttccccaccagaggaga

SEQ ID NO: 453882 - DNA, 16 bp, M. musculus
ttccccaccatgatgg

SEQ ID NO: 453883 - DNA, 16 bp, M. musculus
ttccccagagaagagc

SEQ ID NO: 453884 - DNA, 16 bp, M. musculus
ttccccagcagcctct

SEQ ID NO: 453885 - DNA, 16 bp, M. musculus
ttccccagctcctccc

SEQ ID NO: 453886 - DNA, 16 bp, M. musculus
ttccccagctctggga

SEQ ID NO: 453887 - DNA, 16 bp, M. musculus
ttccccagctgaagag

SEQ ID NO: 453888 - DNA, 16 bp, M. musculus
ttccccagctgatgag

SEQ ID NO: 453889 - DNA, 16 bp, M. musculus
ttccccagttccagaa

SEQ ID NO: 453890 - DNA, 16 bp, M. musculus
ttccccatcatcctga

SEQ ID NO: 453891 - DNA, 17 bp, M. musculus
ttcccccaaaagttctt

SEQ ID NO: 453892 - DNA, 16 bp, M. musculus
ttcccccaattcttct

SEQ ID NO: 453893 - DNA, 16 bp, M. musculus
ttcccccaatttctcc

SEQ ID NO: 453894 - DNA, 16 bp, M. musculus
ttcccccagaaacaaa

SEQ ID NO: 453895 - DNA, 16 bp, M. musculus
ttcccccagaggctct

SEQ ID NO: 453896 - DNA, 16 bp, M. musculus
ttccccccactggatg

SEQ ID NO: 453897 - DNA, 16 bp, M. musculus
ttccccctctaagaag

SEQ ID NO: 453898 - DNA, 16 bp, M. musculus
ttccccctgactccta

SEQ ID NO: 453899 - DNA, 16 bp, M. musculus
ttccccctgctcacca

SEQ ID NO: 453900 - DNA, 16 bp, M. musculus
ttccccctgtttcagc

SEQ ID NO: 453901 - DNA, 16 bp, M. musculus
ttcccccttctaagga

SEQ ID NO: 453902 - DNA, 16 bp, M. musculus
ttcccctcagtttcct

SEQ ID NO: 453903 - DNA, 16 bp, M. musculus
ttcccctcccccactg

SEQ ID NO: 453904 - DNA, 16 bp, M. musculus
ttcccctccctcccag

SEQ ID NO: 453905 - DNA, 16 bp, M. musculus
ttcccctctggaaact

SEQ ID NO: 453906 - DNA, 16 bp, M. musculus
ttcccctgcaaaaatc

SEQ ID NO: 453907 - DNA, 16 bp, M. musculus
ttcccctgcttctatg

SEQ ID NO: 453908 - DNA, 16 bp, M. musculus
ttcccctgggttgctc

SEQ ID NO: 453909 - DNA, 16 bp, M. musculus
ttcccctgtactcggg

SEQ ID NO: 453910 - DNA, 16 bp, M. musculus
ttcccctgtactgggc

SEQ ID NO: 453911 - DNA, 29 bp, M. musculus
ttcccctgtactggggcatataaagtttg

SEQ ID NO: 453912 - DNA, 16 bp, M. musculus
ttccccttgagctgga

SEQ ID NO: 453913 - DNA, 16 bp, M. musculus
ttccccttgctgcttt

SEQ ID NO: 453914 - DNA, 16 bp, M. musculus
ttccccttggccttct

SEQ ID NO: 453915 - DNA, 16 bp, M. musculus
ttcccggcaaccacat

SEQ ID NO: 453916 - DNA, 16 bp, M. musculus
ttccctaatctaaaga

SEQ ID NO: 453917 - DNA, 16 bp, M. musculus
ttccctaattcaacaa

SEQ ID NO: 453918 - DNA, 16 bp, M. musculus
ttccctagggaagagc

SEQ ID NO: 453919 - DNA, 16 bp, M. musculus
ttccctcagactctgc

SEQ ID NO: 453920 - DNA, 16 bp, M. musculus
ttccctcagccttgag

SEQ ID NO: 453921 - DNA, 16 bp, M. musculus
ttccctcagctcttcc

SEQ ID NO: 453922 - DNA, 16 bp, M. musculus
ttccctcagtaatgga

SEQ ID NO: 453923 - DNA, 16 bp, M. musculus
ttccctcagtctcttc

SEQ ID NO: 453924 - DNA, 16 bp, M. musculus
ttccctcatgtctcct

SEQ ID NO: 453925 - DNA, 16 bp, M. musculus
ttccctcattgtgacc

SEQ ID NO: 453926 - DNA, 16 bp, M. musculus
ttccctccatctctgt

SEQ ID NO: 453927 - DNA, 16 bp, M. musculus
ttccctccatggggct

SEQ ID NO: 453928 - DNA, 16 bp, M. musculus
ttccctccttgaccaa

SEQ ID NO: 453929 - DNA, 16 bp, M. musculus
ttccctctcaaattca

SEQ ID NO: 453930 - DNA, 16 bp, M. musculus
ttccctctccccactg

SEQ ID NO: 453931 - DNA, 16 bp, M. musculus
ttccctctgaaacctc

SEQ ID NO: 453932 - DNA, 16 bp, M. musculus
ttccctctggctctta

SEQ ID NO: 453933 - DNA, 16 bp, M. musculus
ttccctctgtctctgc

SEQ ID NO: 453934 - DNA, 16 bp, M. musculus
ttccctctgtgcccat

SEQ ID NO: 453935 - DNA, 16 bp, M. musculus
ttccctcttctgatgt

SEQ ID NO: 453936 - DNA, 16 bp, M. musculus
ttccctgaaagaggag

SEQ ID NO: 453937 - DNA, 16 bp, M. musculus
ttccctgaaagattat

SEQ ID NO: 453938 - DNA, 16 bp, M. musculus
ttccctgaaggcaagg

SEQ ID NO: 453939 - DNA, 16 bp, M. musculus
ttccctgagcagatgt

SEQ ID NO: 453940 - DNA, 16 bp, M. musculus
ttccctgagctttagg

SEQ ID NO: 453941 - DNA, 16 bp, M. musculus
ttccctgattttagtg

SEQ ID NO: 453942 - DNA, 16 bp, M. musculus
ttccctggaagaggag

SEQ ID NO: 453943 - DNA, 16 bp, M. musculus
ttccctggagctggag

SEQ ID NO: 453944 - DNA, 16 bp, M. musculus
ttccctggagctgggg

SEQ ID NO: 453945 - DNA, 16 bp, M. musculus
ttccctggattgttct

SEQ ID NO: 453946 - DNA, 16 bp, M. musculus
ttccctgggaaagact

SEQ ID NO: 453947 - DNA, 16 bp, M. musculus
ttccctgggcaggtgg

SEQ ID NO: 453948 - DNA, 17 bp, M. musculus
ttccctggttcagtgaa

SEQ ID NO: 453949 - DNA, 16 bp, M. musculus
ttccctgtactggggc

SEQ ID NO: 453950 - DNA, 16 bp, M. musculus
ttccctgtctgtctgt

SEQ ID NO: 453951 - DNA, 16 bp, M. musculus
ttccctgtgatgttaa

SEQ ID NO: 453952 - DNA, 16 bp, M. musculus
ttccctgtgccaatgt

SEQ ID NO: 453953 - DNA, 16 bp, M. musculus
ttccctgtgctgggat

SEQ ID NO: 453954 - DNA, 16 bp, M. musculus
ttccctgtgtccctgt

SEQ ID NO: 453955 - DNA, 16 bp, M. musculus
ttccctgtgtggccct

SEQ ID NO: 453956 - DNA, 16 bp, M. musculus
ttccctgttcatttct

SEQ ID NO: 453957 - DNA, 16 bp, M. musculus
ttcccttaaaaacaaa

SEQ ID NO: 453958 - DNA, 16 bp, M. musculus
ttcccttaaagaaata

SEQ ID NO: 453959 - DNA, 16 bp, M. musculus
ttcccttaaattgttt

SEQ ID NO: 453960 - DNA, 16 bp, M. musculus
ttcccttagggtctgt

SEQ ID NO: 453961 - DNA, 16 bp, M. musculus
ttcccttatgaacata

SEQ ID NO: 453962 - DNA, 16 bp, M. musculus
ttcccttcagaaagga

SEQ ID NO: 453963 - DNA, 16 bp, M. musculus
ttcccttcaggaaaga

SEQ ID NO: 453964 - DNA, 16 bp, M. musculus
ttcccttctctgagga

SEQ ID NO: 453965 - DNA, 16 bp, M. musculus
ttcccttctgctgcct

SEQ ID NO: 453966 - DNA, 16 bp, M. musculus
ttcccttctttggaag

SEQ ID NO: 453967 - DNA, 16 bp, M. musculus
ttcccttgctgcccct

SEQ ID NO: 453968 - DNA, 16 bp, M. musculus
ttcccttgtactgagg

SEQ ID NO: 453969 - DNA, 16 bp, M. musculus
ttccctttatatgtta

SEQ ID NO: 453970 - DNA, 16 bp, M. musculus
ttccctttctgagaaa

SEQ ID NO: 453971 - DNA, 16 bp, M. musculus
ttccctttgctccaca

SEQ ID NO: 453972 - DNA, 16 bp, M. musculus
ttcccttttcaccatc

SEQ ID NO: 453973 - DNA, 16 bp, M. musculus
ttcccttttggaactt

SEQ ID NO: 453974 - DNA, 19 bp, M. musculus
ttccgaaggtcttgagttc

SEQ ID NO: 453975 - DNA, 16 bp, M. musculus
ttccgggaacaatctc

SEQ ID NO: 453976 - DNA, 17 bp, M. musculus
ttccgggacttcacaga

SEQ ID NO: 453977 - DNA, 16 bp, M. musculus
ttccggtgtgatggtg

SEQ ID NO: 453978 - DNA, 16 bp, M. musculus
ttcctaaaaagaaaaa

SEQ ID NO: 453979 - DNA, 16 bp, M. musculus
ttcctaaacagaacac

SEQ ID NO: 453980 - DNA, 16 bp, M. musculus
ttcctaaaccacacaa

SEQ ID NO: 453981 - DNA, 16 bp, M. musculus
ttcctaaagaaaaaaa

SEQ ID NO: 453982 - DNA, 16 bp, M. musculus
ttcctaaatataacat

SEQ ID NO: 453983 - DNA, 18 bp, M. musculus
ttcctaaatcccttggct

SEQ ID NO: 453984 - DNA, 16 bp, M. musculus
ttcctaactgtaattt

SEQ ID NO: 453985 - DNA, 16 bp, M. musculus
ttcctaagttttccat

SEQ ID NO: 453986 - DNA, 16 bp, M. musculus
ttcctaatgctgtgac

SEQ ID NO: 453987 - DNA, 16 bp, M. musculus
ttcctaattcctctct

SEQ ID NO: 453988 - DNA, 18 bp, M. musculus
ttcctacacaaacatcat

SEQ ID NO: 453989 - DNA, 16 bp, M. musculus
ttcctactttttaaaa

SEQ ID NO: 453990 - DNA, 16 bp, M. musculus
ttcctagaacctacat

SEQ ID NO: 453991 - DNA, 16 bp, M. musculus
ttcctagaagggggaa

SEQ ID NO: 453992 - DNA, 16 bp, M. musculus
ttcctagagagctgct

SEQ ID NO: 453993 - DNA, 16 bp, M. musculus
ttcctagcacccacaa

SEQ ID NO: 453994 - DNA, 16 bp, M. musculus
ttcctagcacccacag

SEQ ID NO: 453995 - DNA, 16 bp, M. musculus
ttcctagcacccacat

SEQ ID NO: 453996 - DNA, 16 bp, M. musculus
ttcctagcacccatat

SEQ ID NO: 453997 - DNA, 16 bp, M. musculus
ttcctagcatccacat

SEQ ID NO: 453998 - DNA, 16 bp, M. musculus
ttcctaggagacacag

SEQ ID NO: 453999 - DNA, 16 bp, M. musculus
ttcctaggatttcttt

SEQ ID NO: 454000 - DNA, 24 bp, M. musculus
ttcctagtcaagagttaatattta

SEQ ID NO: 454001 - DNA, 16 bp, M. musculus
ttcctataaaaagcct

SEQ ID NO: 454002 - DNA, 16 bp, M. musculus
ttcctatcagatcacc

SEQ ID NO: 454003 - DNA, 16 bp, M. musculus
ttcctatctaaaagaa

SEQ ID NO: 454004 - DNA, 16 bp, M. musculus
ttcctatgaggtcacc

SEQ ID NO: 454005 - DNA, 16 bp, M. musculus
ttcctatggggtcacc

SEQ ID NO: 454006 - DNA, 16 bp, M. musculus
ttcctattgttgtgat

SEQ ID NO: 454007 - DNA, 16 bp, M. musculus
ttcctcaaaggaggct

SEQ ID NO: 454008 - DNA, 16 bp, M. musculus
ttcctcaaatccagcc

SEQ ID NO: 454009 - DNA, 16 bp, M. musculus
ttcctcaaattctttc

SEQ ID NO: 454010 - DNA, 16 bp, M. musculus
ttcctcaacaaaccta

SEQ ID NO: 454011 - DNA, 16 bp, M. musculus
ttcctcaactgaggtt

SEQ ID NO: 454012 - DNA, 16 bp, M. musculus
ttcctcaagatctgga

SEQ ID NO: 454013 - DNA, 16 bp, M. musculus
ttcctcaagctgcagg

SEQ ID NO: 454014 - DNA, 16 bp, M. musculus
ttcctcaatggaggct

SEQ ID NO: 454015 - DNA, 16 bp, M. musculus
ttcctcaatggcctct

SEQ ID NO: 454016 - DNA, 16 bp, M. musculus
ttcctcacagacttgg

SEQ ID NO: 454017 - DNA, 16 bp, M. musculus
ttcctcaccatgatgg

SEQ ID NO: 454018 - DNA, 16 bp, M. musculus
ttcctcagaaaattag

SEQ ID NO: 454019 - DNA, 21 bp, M. musculus
ttcctcagaaaattggacata

SEQ ID NO: 454020 - DNA, 24 bp, M. musculus
ttcctcagaaaattggacatagta

SEQ ID NO: 454021 - DNA, 16 bp, M. musculus
ttcctcagaagccatc

SEQ ID NO: 454022 - DNA, 16 bp, M. musculus
ttcctcagaatggcct

SEQ ID NO: 454023 - DNA, 16 bp, M. musculus
ttcctcagaccctgtt

SEQ ID NO: 454024 - DNA, 16 bp, M. musculus
ttcctcagagacttga

SEQ ID NO: 454025 - DNA, 16 bp, M. musculus
ttcctcagatgaaggg

SEQ ID NO: 454026 - DNA, 16 bp, M. musculus
ttcctcagccataaac

SEQ ID NO: 454027 - DNA, 16 bp, M. musculus
ttcctcaggagccatt

SEQ ID NO: 454028 - DNA, 16 bp, M. musculus
ttcctcaggctctgtt

SEQ ID NO: 454029 - DNA, 16 bp, M. musculus
ttcctcagggtcagca

SEQ ID NO: 454030 - DNA, 16 bp, M. musculus
ttcctcaggtgctgtc

SEQ ID NO: 454031 - DNA, 16 bp, M. musculus
ttcctcagtctctgtt

SEQ ID NO: 454032 - DNA, 16 bp, M. musculus
ttcctcagtggcccct

SEQ ID NO: 454033 - DNA, 16 bp, M. musculus
ttcctcagttgagaat

SEQ ID NO: 454034 - DNA, 16 bp, M. musculus
ttcctcagttgaggaa

SEQ ID NO: 454035 - DNA, 16 bp, M. musculus
ttcctcagttgataat

SEQ ID NO: 454036 - DNA, 16 bp, M. musculus
ttcctcagttgcctat

SEQ ID NO: 454037 - DNA, 16 bp, M. musculus
ttcctcataaaattgg

SEQ ID NO: 454038 - DNA, 16 bp, M. musculus
ttcctcatcctcctca

SEQ ID NO: 454039 - DNA, 16 bp, M. musculus
ttcctcatctataaaa

SEQ ID NO: 454040 - DNA, 16 bp, M. musculus
ttcctcattaagactc

SEQ ID NO: 454041 - DNA, 16 bp, M. musculus
ttcctcattgagactc

SEQ ID NO: 454042 - DNA, 16 bp, M. musculus
ttcctccaaaaattgg

SEQ ID NO: 454043 - DNA, 16 bp, M. musculus
ttcctccaacaagatc

SEQ ID NO: 454044 - DNA, 16 bp, M. musculus
ttcctccaatgatgaa

SEQ ID NO: 454045 - DNA, 16 bp, M. musculus
ttcctccagaaaggcc

SEQ ID NO: 454046 - DNA, 16 bp, M. musculus
ttcctccaggagagaa

SEQ ID NO: 454047 - DNA, 16 bp, M. musculus
ttcctccagtgatgaa

SEQ ID NO: 454048 - DNA, 16 bp, M. musculus
ttcctccatgttttct

SEQ ID NO: 454049 - DNA, 16 bp, M. musculus
ttcctcccatgagtat

SEQ ID NO: 454050 - DNA, 16 bp, M. musculus
ttcctcccatggggct

SEQ ID NO: 454051 - DNA, 16 bp, M. musculus
ttcctcccgaaacata

SEQ ID NO: 454052 - DNA, 16 bp, M. musculus
ttcctccctcagcctc

SEQ ID NO: 454053 - DNA, 16 bp, M. musculus
ttcctcctatagggat

SEQ ID NO: 454054 - DNA, 16 bp, M. musculus
ttcctcctatggtgct

SEQ ID NO: 454055 - DNA, 16 bp, M. musculus
ttcctcctctgctgcc

SEQ ID NO: 454056 - DNA, 16 bp, M. musculus
ttcctcctgcaacaga

SEQ ID NO: 454057 - DNA, 16 bp, M. musculus
ttcctcctgtggagca

SEQ ID NO: 454058 - DNA, 16 bp, M. musculus
ttcctcctgtggggct

SEQ ID NO: 454059 - DNA, 16 bp, M. musculus
ttcctcctgttttcat

SEQ ID NO: 454060 - DNA, 16 bp, M. musculus
ttcctctacactgggc

SEQ ID NO: 454061 - DNA, 16 bp, M. musculus
ttcctctacattgggg

SEQ ID NO: 454062 - DNA, 18 bp, M. musculus
ttcctctatcccactctt

SEQ ID NO: 454063 - DNA, 16 bp, M. musculus
ttcctctcaagtccct

SEQ ID NO: 454064 - DNA, 16 bp, M. musculus
ttcctctcagatgact

SEQ ID NO: 454065 - DNA, 16 bp, M. musculus
ttcctctcccactaag

SEQ ID NO: 454066 - DNA, 16 bp, M. musculus
ttcctctcccagaagc

SEQ ID NO: 454067 - DNA, 16 bp, M. musculus
ttcctctccccactgt

SEQ ID NO: 454068 - DNA, 16 bp, M. musculus
ttcctctcctgcctca

SEQ ID NO: 454069 - DNA, 16 bp, M. musculus
ttcctctctgtgtctc

SEQ ID NO: 454070 - DNA, 16 bp, M. musculus
ttcctctgacctctac

SEQ ID NO: 454071 - DNA, 16 bp, M. musculus
ttcctctgagtgttgt

SEQ ID NO: 454072 - DNA, 16 bp, M. musculus
ttcctctggagctgga

SEQ ID NO: 454073 - DNA, 16 bp, M. musculus
ttcctctgtctctctg

SEQ ID NO: 454074 - DNA, 16 bp, M. musculus
ttcctctgtggtctct

SEQ ID NO: 454075 - DNA, 16 bp, M. musculus
ttcctctgttgaaggg

SEQ ID NO: 454076 - DNA, 16 bp, M. musculus
ttcctctgttgaagta

SEQ ID NO: 454077 - DNA, 16 bp, M. musculus
ttcctctgttgatttt

SEQ ID NO: 454078 - DNA, 16 bp, M. musculus
ttcctcttcaacttgc

SEQ ID NO: 454079 - DNA, 16 bp, M. musculus
ttcctcttcagaaaag

SEQ ID NO: 454080 - DNA, 16 bp, M. musculus
ttcctcttcctccaca

SEQ ID NO: 454081 - DNA, 16 bp, M. musculus
ttcctcttcctctgca

SEQ ID NO: 454082 - DNA, 18 bp, M. musculus
ttcctcttgatataaatt

SEQ ID NO: 454083 - DNA, 16 bp, M. musculus
ttcctcttgcagagga

SEQ ID NO: 454084 - DNA, 16 bp, M. musculus
ttcctctttctaagaa

SEQ ID NO: 454085 - DNA, 16 bp, M. musculus
ttcctctttctcacat

SEQ ID NO: 454086 - DNA, 16 bp, M. musculus
ttcctctttgaagatt

SEQ ID NO: 454087 - DNA, 16 bp, M. musculus
ttcctcttttcaaatt

SEQ ID NO: 454088 - DNA, 16 bp, M. musculus
ttcctcttttccaact

SEQ ID NO: 454089 - DNA, 18 bp, M. musculus
ttcctcttttgggagaaa

SEQ ID NO: 454090 - DNA, 16 bp, M. musculus
ttcctctttttaagtt

SEQ ID NO: 454091 - DNA, 16 bp, M. musculus
ttcctgaaaggaaaga

SEQ ID NO: 454092 - DNA, 16 bp, M. musculus
ttcctgaaaggctctg

SEQ ID NO: 454093 - DNA, 16 bp, M. musculus
ttcctgaaataaaaaa

SEQ ID NO: 454094 - DNA, 16 bp, M. musculus
ttcctgaactctggct

SEQ ID NO: 454095 - DNA, 16 bp, M. musculus
ttcctgaagatgcaca

SEQ ID NO: 454096 - DNA, 16 bp, M. musculus
ttcctgaagatgtaag

SEQ ID NO: 454097 - DNA, 16 bp, M. musculus
ttcctgaagctggagt

SEQ ID NO: 454098 - DNA, 16 bp, M. musculus
ttcctgaatgttttgg

SEQ ID NO: 454099 - DNA, 17 bp, M. musculus
ttcctgaccctggcatt

SEQ ID NO: 454100 - DNA, 16 bp, M. musculus
ttcctgacctctttcc

SEQ ID NO: 454101 - DNA, 16 bp, M. musculus
ttcctgacctgcttgt

SEQ ID NO: 454102 - DNA, 16 bp, M. musculus
ttcctgacctgtgtga

SEQ ID NO: 454103 - DNA, 16 bp, M. musculus
ttcctgaccttcttga

SEQ ID NO: 454104 - DNA, 16 bp, M. musculus
ttcctgactccaggtt

SEQ ID NO: 454105 - DNA, 16 bp, M. musculus
ttcctgacttgtttga

SEQ ID NO: 454106 - DNA, 16 bp, M. musculus
ttcctgacttttgtgg

SEQ ID NO: 454107 - DNA, 16 bp, M. musculus
ttcctgagaaactgcc

SEQ ID NO: 454108 - DNA, 16 bp, M. musculus
ttcctgagacagggtc

SEQ ID NO: 454109 - DNA, 16 bp, M. musculus
ttcctgagagtctctc

SEQ ID NO: 454110 - DNA, 16 bp, M. musculus
ttcctgaggacctgag

SEQ ID NO: 454111 - DNA, 16 bp, M. musculus
ttcctgaggacctggg

SEQ ID NO: 454112 - DNA, 16 bp, M. musculus
ttcctgaggctgacta

SEQ ID NO: 454113 - DNA, 16 bp, M. musculus
ttcctgagtgctgaga

SEQ ID NO: 454114 - DNA, 16 bp, M. musculus
ttcctgagtgctggaa

SEQ ID NO: 454115 - DNA, 16 bp, M. musculus
ttcctgagttctggga

SEQ ID NO: 454116 - DNA, 16 bp, M. musculus
ttcctgatcctcctgc

SEQ ID NO: 454117 - DNA, 16 bp, M. musculus
ttcctgatccttccaa

SEQ ID NO: 454118 - DNA, 16 bp, M. musculus
ttcctgatgctgtgac

SEQ ID NO: 454119 - DNA, 16 bp, M. musculus
ttcctgatggaggagt

SEQ ID NO: 454120 - DNA, 16 bp, M. musculus
ttcctgattttccaag

SEQ ID NO: 454121 - DNA, 16 bp, M. musculus
ttcctgattttcttgt

SEQ ID NO: 454122 - DNA, 16 bp, M. musculus
ttcctgatttttttcc

SEQ ID NO: 454123 - DNA, 16 bp, M. musculus
ttcctgcaatgatgat

SEQ ID NO: 454124 - DNA, 16 bp, M. musculus
ttcctgcaccatgcct

SEQ ID NO: 454125 - DNA, 16 bp, M. musculus
ttcctgcaccatgtct

SEQ ID NO: 454126 - DNA, 16 bp, M. musculus
ttcctgcaccctggct

SEQ ID NO: 454127 - DNA, 16 bp, M. musculus
ttcctgcactccagcc

SEQ ID NO: 454128 - DNA, 16 bp, M. musculus
ttcctgcagaggccag

SEQ ID NO: 454129 - DNA, 16 bp, M. musculus
ttcctgcagatcaaca

SEQ ID NO: 454130 - DNA, 16 bp, M. musculus
ttcctgcagtctctgc

SEQ ID NO: 454131 - DNA, 16 bp, M. musculus
ttcctgcattccttcc

SEQ ID NO: 454132 - DNA, 16 bp, M. musculus
ttcctgcattgcaatg

SEQ ID NO: 454133 - DNA, 16 bp, M. musculus
ttcctgccagtgtccc

SEQ ID NO: 454134 - DNA, 16 bp, M. musculus
ttcctgccatctacac

SEQ ID NO: 454135 - DNA, 16 bp, M. musculus
ttcctgccatgacaat

SEQ ID NO: 454136 - DNA, 16 bp, M. musculus
ttcctgccatgataac

SEQ ID NO: 454137 - DNA, 16 bp, M. musculus
ttcctgccccagcttc

SEQ ID NO: 454138 - DNA, 16 bp, M. musculus
ttcctgccctgctgga

SEQ ID NO: 454139 - DNA, 16 bp, M. musculus
ttcctgccctgttgga

SEQ ID NO: 454140 - DNA, 16 bp, M. musculus
ttcctgcctcaagatc

SEQ ID NO: 454141 - DNA, 16 bp, M. musculus
ttcctgcctcaagttc

SEQ ID NO: 454142 - DNA, 16 bp, M. musculus
ttcctgcctcagccta

SEQ ID NO: 454143 - DNA, 16 bp, M. musculus
ttcctgcctcagcctc

SEQ ID NO: 454144 - DNA, 16 bp, M. musculus
ttcctgcctcagtgtc

SEQ ID NO: 454145 - DNA, 16 bp, M. musculus
ttcctgcctccacatt

SEQ ID NO: 454146 - DNA, 16 bp, M. musculus
ttcctgcctccagatt

SEQ ID NO: 454147 - DNA, 16 bp, M. musculus
ttcctgcctccaggat

SEQ ID NO: 454148 - DNA, 16 bp, M. musculus
ttcctgcctccatttc

SEQ ID NO: 454149 - DNA, 16 bp, M. musculus
ttcctgcctctacttc

SEQ ID NO: 454150 - DNA, 16 bp, M. musculus
ttcctgcctctgtctt

SEQ ID NO: 454151 - DNA, 16 bp, M. musculus
ttcctgcctgcctgct

SEQ ID NO: 454152 - DNA, 16 bp, M. musculus
ttcctgcctgtctctg

SEQ ID NO: 454153 - DNA, 16 bp, M. musculus
ttcctgccttcatttc

SEQ ID NO: 454154 - DNA, 16 bp, M. musculus
ttcctgctccagctgt

SEQ ID NO: 454155 - DNA, 16 bp, M. musculus
ttcctgctctgcttga

SEQ ID NO: 454156 - DNA, 16 bp, M. musculus
ttcctgctgccatgcc

SEQ ID NO: 454157 - DNA, 16 bp, M. musculus
ttcctgctgcctgcct

SEQ ID NO: 454158 - DNA, 16 bp, M. musculus
ttcctgctgcctgctg

SEQ ID NO: 454159 - DNA, 16 bp, M. musculus
ttcctgctgcctgtag

SEQ ID NO: 454160 - DNA, 16 bp, M. musculus
ttcctgctggaggtga

SEQ ID NO: 454161 - DNA, 16 bp, M. musculus
ttcctgctggcacaag

SEQ ID NO: 454162 - DNA, 16 bp, M. musculus
ttcctgctggtcaggg

SEQ ID NO: 454163 - DNA, 16 bp, M. musculus
ttcctgcttcctgctt

SEQ ID NO: 454164 - DNA, 16 bp, M. musculus
ttcctgcttctgctcc

SEQ ID NO: 454165 - DNA, 16 bp, M. musculus
ttcctgcttctgctgc

SEQ ID NO: 454166 - DNA, 16 bp, M. musculus
ttcctgcttgcttgct

SEQ ID NO: 454167 - DNA, 16 bp, M. musculus
ttcctggaacccatgt

SEQ ID NO: 454168 - DNA, 16 bp, M. musculus
ttcctggaactgactg

SEQ ID NO: 454169 - DNA, 16 bp, M. musculus
ttcctggaagctctgg

SEQ ID NO: 454170 - DNA, 16 bp, M. musculus
ttcctggaatctatga

SEQ ID NO: 454171 - DNA, 16 bp, M. musculus
ttcctggaatgctggg

SEQ ID NO: 454172 - DNA, 16 bp, M. musculus
ttcctggaccccaaca

SEQ ID NO: 454173 - DNA, 16 bp, M. musculus
ttcctggagagccact

SEQ ID NO: 454174 - DNA, 16 bp, M. musculus
ttcctggagctatttt

SEQ ID NO: 454175 - DNA, 16 bp, M. musculus
ttcctggagctggaat

SEQ ID NO: 454176 - DNA, 16 bp, M. musculus
ttcctggagcttgctg

SEQ ID NO: 454177 - DNA, 16 bp, M. musculus
ttcctggaggaagtgt

SEQ ID NO: 454178 - DNA, 16 bp, M. musculus
ttcctggaggaggagg

SEQ ID NO: 454179 - DNA, 16 bp, M. musculus
ttcctggaggaggtgt

SEQ ID NO: 454180 - DNA, 16 bp, M. musculus
ttcctggaggtggccc

SEQ ID NO: 454181 - DNA, 16 bp, M. musculus
ttcctggagtctctct

SEQ ID NO: 454182 - DNA, 16 bp, M. musculus
ttcctggatcccacca

SEQ ID NO: 454183 - DNA, 16 bp, M. musculus
ttcctggatttcctgg

SEQ ID NO: 454184 - DNA, 16 bp, M. musculus
ttcctggcacctggga

SEQ ID NO: 454185 - DNA, 16 bp, M. musculus
ttcctggccagcctct

SEQ ID NO: 454186 - DNA, 16 bp, M. musculus
ttcctggccatccagg

SEQ ID NO: 454187 - DNA, 16 bp, M. musculus
ttcctggcccagacat

SEQ ID NO: 454188 - DNA, 17 bp, M. musculus
ttcctggccctggcatt

SEQ ID NO: 454189 - DNA, 16 bp, M. musculus
ttcctggcctctgtgg

SEQ ID NO: 454190 - DNA, 16 bp, M. musculus
ttcctggccttcacca

SEQ ID NO: 454191 - DNA, 16 bp, M. musculus
ttcctggctacaggag

SEQ ID NO: 454192 - DNA, 16 bp, M. musculus
ttcctggctagcctgg

SEQ ID NO: 454193 - DNA, 17 bp, M. musculus
ttcctggctctggcatt

SEQ ID NO: 454194 - DNA, 16 bp, M. musculus
ttcctggctgcctgca

SEQ ID NO: 454195 - DNA, 16 bp, M. musculus
ttcctggctgccttca

SEQ ID NO: 454196 - DNA, 16 bp, M. musculus
ttcctggctgtcctag

SEQ ID NO: 454197 - DNA, 16 bp, M. musculus
ttcctggctgtcctgg

SEQ ID NO: 454198 - DNA, 16 bp, M. musculus
ttcctggctgttgtga

SEQ ID NO: 454199 - DNA, 16 bp, M. musculus
ttcctgggacttgctg

SEQ ID NO: 454200 - DNA, 16 bp, M. musculus
ttcctgggagctctgt

SEQ ID NO: 454201 - DNA, 16 bp, M. musculus
ttcctgggatgaaacc

SEQ ID NO: 454202 - DNA, 16 bp, M. musculus
ttcctgggcattcctt

SEQ ID NO: 454203 - DNA, 16 bp, M. musculus
ttcctgggccagaggc

SEQ ID NO: 454204 - DNA, 16 bp, M. musculus
ttcctggggaaattcc

SEQ ID NO: 454205 - DNA, 16 bp, M. musculus
ttcctggggcttgctg

SEQ ID NO: 454206 - DNA, 16 bp, M. musculus
ttcctgggggaaggga

SEQ ID NO: 454207 - DNA, 16 bp, M. musculus
ttcctgggtgctggga

SEQ ID NO: 454208 - DNA, 16 bp, M. musculus
ttcctggtaccccttt

SEQ ID NO: 454209 - DNA, 16 bp, M. musculus
ttcctggtatcatggc

SEQ ID NO: 454210 - DNA, 16 bp, M. musculus
ttcctggtatctgtct

SEQ ID NO: 454211 - DNA, 16 bp, M. musculus
ttcctggtcttggcat

SEQ ID NO: 454212 - DNA, 16 bp, M. musculus
ttcctggtctttccaa

SEQ ID NO: 454213 - DNA, 16 bp, M. musculus
ttcctggtgtcccctc

SEQ ID NO: 454214 - DNA, 16 bp, M. musculus
ttcctggtgtcccttt

SEQ ID NO: 454215 - DNA, 16 bp, M. musculus
ttcctggtttcccctc

SEQ ID NO: 454216 - DNA, 16 bp, M. musculus
ttcctggtttcccctt

SEQ ID NO: 454217 - DNA, 16 bp, M. musculus
ttcctggtttctgtag

SEQ ID NO: 454218 - DNA, 16 bp, M. musculus
ttcctggtttctgtgg

SEQ ID NO: 454219 - DNA, 16 bp, M. musculus
ttcctggtttctttgg

SEQ ID NO: 454220 - DNA, 18 bp, M. musculus
ttcctgtaagcagcagaa

SEQ ID NO: 454221 - DNA, 16 bp, M. musculus
ttcctgtaatcccagt

SEQ ID NO: 454222 - DNA, 16 bp, M. musculus
ttcctgtcaacacaaa

SEQ ID NO: 454223 - DNA, 16 bp, M. musculus
ttcctgtcagtccttt

SEQ ID NO: 454224 - DNA, 16 bp, M. musculus
ttcctgtctccacctc

SEQ ID NO: 454225 - DNA, 16 bp, M. musculus
ttcctgtcttcctgtc

SEQ ID NO: 454226 - DNA, 16 bp, M. musculus
ttcctgtcttgacttc

SEQ ID NO: 454227 - DNA, 16 bp, M. musculus
ttcctgtcttgagttt

SEQ ID NO: 454228 - DNA, 16 bp, M. musculus
ttcctgtctttaaaaa

SEQ ID NO: 454229 - DNA, 16 bp, M. musculus
ttcctgtgacttctga

SEQ ID NO: 454230 - DNA, 16 bp, M. musculus
ttcctgtgagcagcaa

SEQ ID NO: 454231 - DNA, 16 bp, M. musculus
ttcctgtgctcagtcc

SEQ ID NO: 454232 - DNA, 16 bp, M. musculus
ttcctgtggaattcct

SEQ ID NO: 454233 - DNA, 16 bp, M. musculus
ttcctgtggaggagga

SEQ ID NO: 454234 - DNA, 16 bp, M. musculus
ttcctgtggtgatgaa

SEQ ID NO: 454235 - DNA, 16 bp, M. musculus
ttcctgtgtatatgtg

SEQ ID NO: 454236 - DNA, 16 bp, M. musculus
ttcctgtgtctgctcc

SEQ ID NO: 454237 - DNA, 16 bp, M. musculus
ttcctgtgtgtgtgtg

SEQ ID NO: 454238 - DNA, 16 bp, M. musculus
ttcctgttaattttgt

SEQ ID NO: 454239 - DNA, 16 bp, M. musculus
ttcctgttgctcctgt

SEQ ID NO: 454240 - DNA, 16 bp, M. musculus
ttcctgttgctgagac

SEQ ID NO: 454241 - DNA, 16 bp, M. musculus
ttcctgtttctgcctc

SEQ ID NO: 454242 - DNA, 16 bp, M. musculus
ttcctgtttcttcaca

SEQ ID NO: 454243 - DNA, 16 bp, M. musculus
ttcctgtttgagttcc

SEQ ID NO: 454244 - DNA, 16 bp, M. musculus
ttccttaaagaaggag

SEQ ID NO: 454245 - DNA, 16 bp, M. musculus
ttccttaagtgatgaa

SEQ ID NO: 454246 - DNA, 16 bp, M. musculus
ttccttactggcttgc

SEQ ID NO: 454247 - DNA, 16 bp, M. musculus
ttccttatgttgtggt

SEQ ID NO: 454248 - DNA, 16 bp, M. musculus
ttccttattgaattta

SEQ ID NO: 454249 - DNA, 16 bp, M. musculus
ttccttcaacaaagcc

SEQ ID NO: 454250 - DNA, 16 bp, M. musculus
ttccttcaactgtgtt

SEQ ID NO: 454251 - DNA, 16 bp, M. musculus
ttccttcacaaggttg

SEQ ID NO: 454252 - DNA, 16 bp, M. musculus
ttccttcactgcctaa

SEQ ID NO: 454253 - DNA, 16 bp, M. musculus
ttccttcacttgtttg

SEQ ID NO: 454254 - DNA, 16 bp, M. musculus
ttccttcagctccttc

SEQ ID NO: 454255 - DNA, 16 bp, M. musculus
ttccttcagtcctttt

SEQ ID NO: 454256 - DNA, 17 bp, M. musculus
ttccttcagtctctgct

SEQ ID NO: 454257 - DNA, 16 bp, M. musculus
ttccttcagtgatgga

SEQ ID NO: 454258 - DNA, 16 bp, M. musculus
ttccttcagtttctgc

SEQ ID NO: 454259 - DNA, 38 bp, M. musculus
ttccttcataactagtgtcgcaacaataaaatttgagc

SEQ ID NO: 454260 - DNA, 16 bp, M. musculus
ttccttccaaggtttc

SEQ ID NO: 454261 - DNA, 16 bp, M. musculus
ttccttccagcttctc

SEQ ID NO: 454262 - DNA, 16 bp, M. musculus
ttccttccagcttgca

SEQ ID NO: 454263 - DNA, 16 bp, M. musculus
ttccttccatttctgc

SEQ ID NO: 454264 - DNA, 16 bp, M. musculus
ttccttccccagcccc

SEQ ID NO: 454265 - DNA, 16 bp, M. musculus
ttccttcctccagcaa

SEQ ID NO: 454266 - DNA, 16 bp, M. musculus
ttccttcctgcctgcc

SEQ ID NO: 454267 - DNA, 16 bp, M. musculus
ttccttccttaaccaa

SEQ ID NO: 454268 - DNA, 16 bp, M. musculus
ttccttccttccaaat

SEQ ID NO: 454269 - DNA, 16 bp, M. musculus
ttccttccttggccaa

SEQ ID NO: 454270 - DNA, 16 bp, M. musculus
ttccttcctttctgaa

SEQ ID NO: 454271 - DNA, 16 bp, M. musculus
ttccttcctttggaag

SEQ ID NO: 454272 - DNA, 16 bp, M. musculus
ttccttcggtctctgc

SEQ ID NO: 454273 - DNA, 16 bp, M. musculus
ttccttctatgatttt

SEQ ID NO: 454274 - DNA, 16 bp, M. musculus
ttccttctctcttgat

SEQ ID NO: 454275 - DNA, 16 bp, M. musculus
ttccttctgataagaa

SEQ ID NO: 454276 - DNA, 16 bp, M. musculus
ttccttctgcagcaga

SEQ ID NO: 454277 - DNA, 16 bp, M. musculus
ttccttctgtcttagc

SEQ ID NO: 454278 - DNA, 16 bp, M. musculus
ttccttcttccaatgt

SEQ ID NO: 454279 - DNA, 16 bp, M. musculus
ttccttcttccagtgt

SEQ ID NO: 454280 - DNA, 16 bp, M. musculus
ttccttcttcccaggt

SEQ ID NO: 454281 - DNA, 16 bp, M. musculus
ttccttcttctcagat

SEQ ID NO: 454282 - DNA, 16 bp, M. musculus
ttccttcttgaatttc

SEQ ID NO: 454283 - DNA, 16 bp, M. musculus
ttccttctttaaaata

SEQ ID NO: 454284 - DNA, 16 bp, M. musculus
ttccttctttttaaaa

SEQ ID NO: 454285 - DNA, 16 bp, M. musculus
ttccttgatgactaag

SEQ ID NO: 454286 - DNA, 16 bp, M. musculus
ttccttgcagaaactt

SEQ ID NO: 454287 - DNA, 16 bp, M. musculus
ttccttgccaatttgt

SEQ ID NO: 454288 - DNA, 16 bp, M. musculus
ttccttgcccacctct

SEQ ID NO: 454289 - DNA, 16 bp, M. musculus
ttccttgccttgcctt

SEQ ID NO: 454290 - DNA, 16 bp, M. musculus
ttccttggagctggag

SEQ ID NO: 454291 - DNA, 16 bp, M. musculus
ttccttgggaccagtg

SEQ ID NO: 454292 - DNA, 16 bp, M. musculus
ttccttgggccctcct

SEQ ID NO: 454293 - DNA, 16 bp, M. musculus
ttccttggggccagtg

SEQ ID NO: 454294 - DNA, 16 bp, M. musculus
ttccttgggtctgtgg

SEQ ID NO: 454295 - DNA, 16 bp, M. musculus
ttccttgggttctttc

SEQ ID NO: 454296 - DNA, 17 bp, M. musculus
ttccttgtcctggcatt

SEQ ID NO: 454297 - DNA, 16 bp, M. musculus
ttccttgtgactcttg

SEQ ID NO: 454298 - DNA, 16 bp, M. musculus
ttccttgttgggtctt

SEQ ID NO: 454299 - DNA, 16 bp, M. musculus
ttcctttaaaaaacaa

SEQ ID NO: 454300 - DNA, 18 bp, M. musculus
ttcctttaaataccccct

SEQ ID NO: 454301 - DNA, 16 bp, M. musculus
ttcctttaagacaggg

SEQ ID NO: 454302 - DNA, 16 bp, M. musculus
ttcctttagtgatgaa

SEQ ID NO: 454303 - DNA, 16 bp, M. musculus
ttcctttccaacttgc

SEQ ID NO: 454304 - DNA, 16 bp, M. musculus
ttcctttcctatttgt

SEQ ID NO: 454305 - DNA, 16 bp, M. musculus
ttcctttcctcccagt

SEQ ID NO: 454306 - DNA, 16 bp, M. musculus
ttcctttcctgacttc

SEQ ID NO: 454307 - DNA, 16 bp, M. musculus
ttcctttctcactgag

SEQ ID NO: 454308 - DNA, 16 bp, M. musculus
ttcctttctctcagat

SEQ ID NO: 454309 - DNA, 16 bp, M. musculus
ttcctttctctgtggt

SEQ ID NO: 454310 - DNA, 16 bp, M. musculus
ttcctttctggctcct

SEQ ID NO: 454311 - DNA, 16 bp, M. musculus
ttcctttctgggtctt

SEQ ID NO: 454312 - DNA, 16 bp, M. musculus
ttcctttctgttgctg

SEQ ID NO: 454313 - DNA, 16 bp, M. musculus
ttcctttctttcaaat

SEQ ID NO: 454314 - DNA, 16 bp, M. musculus
ttcctttgaagagtat

SEQ ID NO: 454315 - DNA, 16 bp, M. musculus
ttcctttgaggcagag

SEQ ID NO: 454316 - DNA, 16 bp, M. musculus
ttcctttgatgagttt

SEQ ID NO: 454317 - DNA, 16 bp, M. musculus
ttcctttgatgataaa

SEQ ID NO: 454318 - DNA, 16 bp, M. musculus
ttcctttgcaaaaaaa

SEQ ID NO: 454319 - DNA, 16 bp, M. musculus
ttcctttgcattttct

SEQ ID NO: 454320 - DNA, 16 bp, M. musculus
ttcctttgcttttcca

SEQ ID NO: 454321 - DNA, 16 bp, M. musculus
ttcctttggtgatgaa

SEQ ID NO: 454322 - DNA, 16 bp, M. musculus
ttcctttgtaaatgtg

SEQ ID NO: 454323 - DNA, 16 bp, M. musculus
ttcctttgttctgtat

SEQ ID NO: 454324 - DNA, 16 bp, M. musculus
ttccttttatataaaa

SEQ ID NO: 454325 - DNA, 16 bp, M. musculus
ttccttttattaaaaa

SEQ ID NO: 454326 - DNA, 17 bp, M. musculus
ttccttttccccagtgt

SEQ ID NO: 454327 - DNA, 16 bp, M. musculus
ttccttttctttaaaa

SEQ ID NO: 454328 - DNA, 16 bp, M. musculus
ttccttttctttgaaa

SEQ ID NO: 454329 - DNA, 16 bp, M. musculus
ttccttttgaaaaaaa

SEQ ID NO: 454330 - DNA, 16 bp, M. musculus
ttccttttgtaaaatg

SEQ ID NO: 454331 - DNA, 16 bp, M. musculus
ttccttttgtactaga

SEQ ID NO: 454332 - DNA, 16 bp, M. musculus
ttccttttgttctaga

SEQ ID NO: 454333 - DNA, 16 bp, M. musculus
ttcctttttaaaaaaa

SEQ ID NO: 454334 - DNA, 16 bp, M. musculus
ttcctttttaaaatct

SEQ ID NO: 454335 - DNA, 16 bp, M. musculus
ttcctttttaaaatga

SEQ ID NO: 454336 - DNA, 16 bp, M. musculus
ttcctttttaaaggct

SEQ ID NO: 454337 - DNA, 16 bp, M. musculus
ttcctttttaagaatt

SEQ ID NO: 454338 - DNA, 16 bp, M. musculus
ttccttttttaaaaaa

SEQ ID NO: 454339 - DNA, 16 bp, M. musculus
ttccttttttgagaca

SEQ ID NO: 454340 - DNA, 16 bp, M. musculus
ttcctttttttaagat

SEQ ID NO: 454341 - DNA, 16 bp, M. musculus
ttcgaattgctctggc

SEQ ID NO: 454342 - DNA, 16 bp, M. musculus
ttcgaggacagcctga

SEQ ID NO: 454343 - DNA, 19 bp, M. musculus
ttcgaggccagtctggtct

SEQ ID NO: 454344 - DNA, 16 bp, M. musculus
ttcgagtgctgggatt

SEQ ID NO: 454345 - DNA, 17 bp, M. musculus
ttcgatgccagcctggt

SEQ ID NO: 454346 - DNA, 16 bp, M. musculus
ttcgatttgaaaaatt

SEQ ID NO: 454347 - DNA, 16 bp, M. musculus
ttcgccaccactgccc

SEQ ID NO: 454348 - DNA, 16 bp, M. musculus
ttcgccaccatgcccg

SEQ ID NO: 454349 - DNA, 17 bp, M. musculus
ttcgccccttcttagaa

SEQ ID NO: 454350 - DNA, 17 bp, M. musculus
ttcggacctgcctcctg

SEQ ID NO: 454351 - DNA, 19 bp, M. musculus
ttcggcaccaattgttatt

SEQ ID NO: 454352 - DNA, 16 bp, M. musculus
ttcggccaggaggaag

SEQ ID NO: 454353 - DNA, 16 bp, M. musculus
ttcggcggagtcctgg

SEQ ID NO: 454354 - DNA, 16 bp, M. musculus
ttcgggaggcagaggc

SEQ ID NO: 454355 - DNA, 16 bp, M. musculus
ttcggggtcttcctta

SEQ ID NO: 454356 - DNA, 16 bp, M. musculus
ttcggggttcttcttt

SEQ ID NO: 454357 - DNA, 17 bp, M. musculus
ttcggtcagttgatcat

SEQ ID NO: 454358 - DNA, 16 bp, M. musculus
ttcgtgtctgtctctg

SEQ ID NO: 454359 - DNA, 16 bp, M. musculus
ttcgttgtttttaata

SEQ ID NO: 454360 - DNA, 16 bp, M. musculus
ttctaaaaagaaaaag

SEQ ID NO: 454361 - DNA, 16 bp, M. musculus
ttctaaaacattttct

SEQ ID NO: 454362 - DNA, 16 bp, M. musculus
ttctaaaagaagaaaa

SEQ ID NO: 454363 - DNA, 16 bp, M. musculus
ttctaaaagatttatt

SEQ ID NO: 454364 - DNA, 16 bp, M. musculus
ttctaaaatccaaagt

SEQ ID NO: 454365 - DNA, 16 bp, M. musculus
ttctaaaatgatttct

SEQ ID NO: 454366 - DNA, 16 bp, M. musculus
ttctaaaatgtattta

SEQ ID NO: 454367 - DNA, 16 bp, M. musculus
ttctaaaatttacaat

SEQ ID NO: 454368 - DNA, 16 bp, M. musculus
ttctaaacaggtccac

SEQ ID NO: 454369 - DNA, 16 bp, M. musculus
ttctaaacatcacaca

SEQ ID NO: 454370 - DNA, 16 bp, M. musculus
ttctaaagaaaaacaa

SEQ ID NO: 454371 - DNA, 16 bp, M. musculus
ttctaaagatttattt

SEQ ID NO: 454372 - DNA, 16 bp, M. musculus
ttctaaatagaactaa

SEQ ID NO: 454373 - DNA, 16 bp, M. musculus
ttctaaatatttatgc

SEQ ID NO: 454374 - DNA, 16 bp, M. musculus
ttctaaatattttgca

SEQ ID NO: 454375 - DNA, 16 bp, M. musculus
ttctaacccaaagtca

SEQ ID NO: 454376 - DNA, 16 bp, M. musculus
ttctaactccagttct

SEQ ID NO: 454377 - DNA, 16 bp, M. musculus
ttctaactcttgtatt

SEQ ID NO: 454378 - DNA, 16 bp, M. musculus
ttctaagaaaatgttt

SEQ ID NO: 454379 - DNA, 16 bp, M. musculus
ttctaagaaacactga

SEQ ID NO: 454380 - DNA, 16 bp, M. musculus
ttctaagaaagaacaa

SEQ ID NO: 454381 - DNA, 16 bp, M. musculus
ttctaagaaggatcaa

SEQ ID NO: 454382 - DNA, 16 bp, M. musculus
ttctaagaaggggaaa

SEQ ID NO: 454383 - DNA, 16 bp, M. musculus
ttctaagaaggggcga

SEQ ID NO: 454384 - DNA, 16 bp, M. musculus
ttctaagaataagctg

SEQ ID NO: 454385 - DNA, 16 bp, M. musculus
ttctaagatggataga

SEQ ID NO: 454386 - DNA, 16 bp, M. musculus
ttctaagtaggactga

SEQ ID NO: 454387 - DNA, 34 bp, M. musculus
ttctaagtctattaacctggccattggggctgct

SEQ ID NO: 454388 - DNA, 16 bp, M. musculus
ttctaagtgtgctgtc

SEQ ID NO: 454389 - DNA, 16 bp, M. musculus
ttctaagttcttcttc

SEQ ID NO: 454390 - DNA, 16 bp, M. musculus
ttctaatagtgccact

SEQ ID NO: 454391 - DNA, 16 bp, M. musculus
ttctaatccttcccaa

SEQ ID NO: 454392 - DNA, 16 bp, M. musculus
ttctaatcctttaaaa

SEQ ID NO: 454393 - DNA, 16 bp, M. musculus
ttctaatcttctggct

SEQ ID NO: 454394 - DNA, 16 bp, M. musculus
ttctaatgctatttgt

SEQ ID NO: 454395 - DNA, 18 bp, M. musculus
ttctaattcgttgaagaa

SEQ ID NO: 454396 - DNA, 16 bp, M. musculus
ttctaattggatattt

SEQ ID NO: 454397 - DNA, 16 bp, M. musculus
ttctacaaaagaaaaa

SEQ ID NO: 454398 - DNA, 16 bp, M. musculus
ttctacaaaaggcaat

SEQ ID NO: 454399 - DNA, 16 bp, M. musculus
ttctacaaaaggctac

SEQ ID NO: 454400 - DNA, 16 bp, M. musculus
ttctacaaactaacat

SEQ ID NO: 454401 - DNA, 16 bp, M. musculus
ttctacaaagccacaa

SEQ ID NO: 454402 - DNA, 16 bp, M. musculus
ttctacaacatcatca

SEQ ID NO: 454403 - DNA, 16 bp, M. musculus
ttctacaagagcaaca

SEQ ID NO: 454404 - DNA, 16 bp, M. musculus
ttctacacagatacca

SEQ ID NO: 454405 - DNA, 16 bp, M. musculus
ttctacactaaaacca

SEQ ID NO: 454406 - DNA, 16 bp, M. musculus
ttctacatcatcatct

SEQ ID NO: 454407 - DNA, 16 bp, M. musculus
ttctacatccagattg

SEQ ID NO: 454408 - DNA, 16 bp, M. musculus
ttctacatcctcacca

SEQ ID NO: 454409 - DNA, 16 bp, M. musculus
ttctacatcttattct

SEQ ID NO: 454410 - DNA, 16 bp, M. musculus
ttctacatcttcaact

SEQ ID NO: 454411 - DNA, 16 bp, M. musculus
ttctacatcttcaccc

SEQ ID NO: 454412 - DNA, 16 bp, M. musculus
ttctacatcttcacct

SEQ ID NO: 454413 - DNA, 16 bp, M. musculus
ttctacatcttcttcc

SEQ ID NO: 454414 - DNA, 16 bp, M. musculus
ttctacatcttgacct

SEQ ID NO: 454415 - DNA, 16 bp, M. musculus
ttctacatcttgatcc

SEQ ID NO: 454416 - DNA, 16 bp, M. musculus
ttctacattccttcaa

SEQ ID NO: 454417 - DNA, 16 bp, M. musculus
ttctaccatgtgggtc

SEQ ID NO: 454418 - DNA, 20 bp, M. musculus
ttctacccagcttaattaga

SEQ ID NO: 454419 - DNA, 16 bp, M. musculus
ttctacccttctccac

SEQ ID NO: 454420 - DNA, 16 bp, M. musculus
ttctacctacctattc

SEQ ID NO: 454421 - DNA, 16 bp, M. musculus
ttctacctgtctctgg

SEQ ID NO: 454422 - DNA, 16 bp, M. musculus
ttctacctgtttgcct

SEQ ID NO: 454423 - DNA, 16 bp, M. musculus
ttctacctttttggtt

SEQ ID NO: 454424 - DNA, 26 bp, M. musculus
ttctacgcggaccacactggcgtagt

SEQ ID NO: 454425 - DNA, 16 bp, M. musculus
ttctacgtcttcatct

SEQ ID NO: 454426 - DNA, 16 bp, M. musculus
ttctactactcagagc

SEQ ID NO: 454427 - DNA, 16 bp, M. musculus
ttctactagcagcctt

SEQ ID NO: 454428 - DNA, 16 bp, M. musculus
ttctacttctgtgaag

SEQ ID NO: 454429 - DNA, 16 bp, M. musculus
ttctacttgtctgtct

SEQ ID NO: 454430 - DNA, 16 bp, M. musculus
ttctactttgaatcct

SEQ ID NO: 454431 - DNA, 16 bp, M. musculus
ttctactttgtgaaat

SEQ ID NO: 454432 - DNA, 16 bp, M. musculus
ttctagaaaactcttt

SEQ ID NO: 454433 - DNA, 16 bp, M. musculus
ttctagaaacttcttc

SEQ ID NO: 454434 - DNA, 16 bp, M. musculus
ttctagaaagttttaa

SEQ ID NO: 454435 - DNA, 16 bp, M. musculus
ttctagaacattccat

SEQ ID NO: 454436 - DNA, 16 bp, M. musculus
ttctagaaccttcttt

SEQ ID NO: 454437 - DNA, 16 bp, M. musculus
ttctagaagacctggg

SEQ ID NO: 454438 - DNA, 16 bp, M. musculus
ttctagaattttcttt

SEQ ID NO: 454439 - DNA, 16 bp, M. musculus
ttctagacaaggtttc

SEQ ID NO: 454440 - DNA, 16 bp, M. musculus
ttctagacagagcaat

SEQ ID NO: 454441 - DNA, 16 bp, M. musculus
ttctagagaaaaaaaa

SEQ ID NO: 454442 - DNA, 16 bp, M. musculus
ttctagagaaaagaaa

SEQ ID NO: 454443 - DNA, 16 bp, M. musculus
ttctagagatcctgag

SEQ ID NO: 454444 - DNA, 16 bp, M. musculus
ttctagagcttttaca

SEQ ID NO: 454445 - DNA, 16 bp, M. musculus
ttctagaggaacaatt

SEQ ID NO: 454446 - DNA, 16 bp, M. musculus
ttctagaggactcagg

SEQ ID NO: 454447 - DNA, 16 bp, M. musculus
ttctagaggttctccc

SEQ ID NO: 454448 - DNA, 16 bp, M. musculus
ttctagagtgtagttt

SEQ ID NO: 454449 - DNA, 16 bp, M. musculus
ttctagcaaaaatttt

SEQ ID NO: 454450 - DNA, 16 bp, M. musculus
ttctagcacttgggag

SEQ ID NO: 454451 - DNA, 16 bp, M. musculus
ttctagctagaacaat

SEQ ID NO: 454452 - DNA, 16 bp, M. musculus
ttctagctgtttacct

SEQ ID NO: 454453 - DNA, 16 bp, M. musculus
ttctagctgttttcct

SEQ ID NO: 454454 - DNA, 16 bp, M. musculus
ttctagctttcaaagt

SEQ ID NO: 454455 - DNA, 16 bp, M. musculus
ttctaggaaggaatga

SEQ ID NO: 454456 - DNA, 16 bp, M. musculus
ttctaggagatgttaa

SEQ ID NO: 454457 - DNA, 16 bp, M. musculus
ttctaggatgttggaa

SEQ ID NO: 454458 - DNA, 16 bp, M. musculus
ttctaggccagcctag

SEQ ID NO: 454459 - DNA, 16 bp, M. musculus
ttctaggctagcctgg

SEQ ID NO: 454460 - DNA, 16 bp, M. musculus
ttctaggctggcctgg

SEQ ID NO: 454461 - DNA, 16 bp, M. musculus
ttctagggaagaatga

SEQ ID NO: 454462 - DNA, 16 bp, M. musculus
ttctaggtattataaa

SEQ ID NO: 454463 - DNA, 16 bp, M. musculus
ttctaggtgaagaaaa

SEQ ID NO: 454464 - DNA, 16 bp, M. musculus
ttctagtattttctgt

SEQ ID NO: 454465 - DNA, 16 bp, M. musculus
ttctagtggaagactg

SEQ ID NO: 454466 - DNA, 16 bp, M. musculus
ttctagttgtttacct

SEQ ID NO: 454467 - DNA, 16 bp, M. musculus
ttctagttttaaaagt

SEQ ID NO: 454468 - DNA, 16 bp, M. musculus
ttctataaaatagaaa

SEQ ID NO: 454469 - DNA, 16 bp, M. musculus
ttctataaatatctat

SEQ ID NO: 454470 - DNA, 16 bp, M. musculus
ttctataagaaagcca

SEQ ID NO: 454471 - DNA, 16 bp, M. musculus
ttctataagaaattag

SEQ ID NO: 454472 - DNA, 21 bp, M. musculus
ttctataagagagcaagctga

SEQ ID NO: 454473 - DNA, 22 bp, M. musculus
ttctataagagagcagtctgag

SEQ ID NO: 454474 - DNA, 16 bp, M. musculus
ttctataattttattg

SEQ ID NO: 454475 - DNA, 16 bp, M. musculus
ttctatagaccaggct

SEQ ID NO: 454476 - DNA, 16 bp, M. musculus
ttctatatgaaattga

SEQ ID NO: 454477 - DNA, 16 bp, M. musculus
ttctatcaattctcaa

SEQ ID NO: 454478 - DNA, 16 bp, M. musculus
ttctatcacctgtttg

SEQ ID NO: 454479 - DNA, 16 bp, M. musculus
ttctatcatctattta

SEQ ID NO: 454480 - DNA, 16 bp, M. musculus
ttctatcccaaaagtc

SEQ ID NO: 454481 - DNA, 16 bp, M. musculus
ttctatctattataaa

SEQ ID NO: 454482 - DNA, 16 bp, M. musculus
ttctatcttgtgaaat

SEQ ID NO: 454483 - DNA, 16 bp, M. musculus
ttctatgaaaatgaaa

SEQ ID NO: 454484 - DNA, 16 bp, M. musculus
ttctatgaagagacac

SEQ ID NO: 454485 - DNA, 16 bp, M. musculus
ttctatgagtttgagg

SEQ ID NO: 454486 - DNA, 16 bp, M. musculus
ttctatggctgtgaag

SEQ ID NO: 454487 - DNA, 16 bp, M. musculus
ttctatgggccaagca

SEQ ID NO: 454488 - DNA, 16 bp, M. musculus
ttctatgtagccttgg

SEQ ID NO: 454489 - DNA, 16 bp, M. musculus
ttctattaatatacaa

SEQ ID NO: 454490 - DNA, 17 bp, M. musculus
ttctattcaggaatttt

SEQ ID NO: 454491 - DNA, 16 bp, M. musculus
ttctattcaggatttt

SEQ ID NO: 454492 - DNA, 16 bp, M. musculus
ttctattcccagcacc

SEQ ID NO: 454493 - DNA, 17 bp, M. musculus
ttctattcctccacaaa

SEQ ID NO: 454494 - DNA, 16 bp, M. musculus
ttctattcctgcacca

SEQ ID NO: 454495 - DNA, 16 bp, M. musculus
ttctattctgtggaat

SEQ ID NO: 454496 - DNA, 16 bp, M. musculus
ttctattctttctgct

SEQ ID NO: 454497 - DNA, 16 bp, M. musculus
ttctatttcaataaaa

SEQ ID NO: 454498 - DNA, 16 bp, M. musculus
ttctatttcatgaaat

SEQ ID NO: 454499 - DNA, 16 bp, M. musculus
ttctatttccttagtg

SEQ ID NO: 454500 - DNA, 16 bp, M. musculus
ttctatttccttgtga

SEQ ID NO: 454501 - DNA, 16 bp, M. musculus
ttctatttctccacat

SEQ ID NO: 454502 - DNA, 16 bp, M. musculus
ttctattttaaatgtt

SEQ ID NO: 454503 - DNA, 16 bp, M. musculus
ttctattttgagaaat

SEQ ID NO: 454504 - DNA, 16 bp, M. musculus
ttctattttgtgggat

SEQ ID NO: 454505 - DNA, 16 bp, M. musculus
ttctatttttaagaaa

SEQ ID NO: 454506 - DNA, 16 bp, M. musculus
ttctatttttttaaag

SEQ ID NO: 454507 - DNA, 16 bp, M. musculus
ttctcaaaaatatatt

SEQ ID NO: 454508 - DNA, 16 bp, M. musculus
ttctcaaaataagaaa

SEQ ID NO: 454509 - DNA, 16 bp, M. musculus
ttctcaaacacacaca

SEQ ID NO: 454510 - DNA, 16 bp, M. musculus
ttctcaaactattcca

SEQ ID NO: 454511 - DNA, 16 bp, M. musculus
ttctcaaactcctgtg

SEQ ID NO: 454512 - DNA, 16 bp, M. musculus
ttctcaaagaaaataa

SEQ ID NO: 454513 - DNA, 16 bp, M. musculus
ttctcaaaggagaagg

SEQ ID NO: 454514 - DNA, 16 bp, M. musculus
ttctcaacaaaatatt

SEQ ID NO: 454515 - DNA, 16 bp, M. musculus
ttctcaacctatgggt

SEQ ID NO: 454516 - DNA, 16 bp, M. musculus
ttctcaacctccctaa

SEQ ID NO: 454517 - DNA, 16 bp, M. musculus
ttctcaacctgtaggt

SEQ ID NO: 454518 - DNA, 16 bp, M. musculus
ttctcaacctgtgagt

SEQ ID NO: 454519 - DNA, 16 bp, M. musculus
ttctcaacctgtggat

SEQ ID NO: 454520 - DNA, 16 bp, M. musculus
ttctcaactatgcaaa

SEQ ID NO: 454521 - DNA, 16 bp, M. musculus
ttctcaactatgttca

SEQ ID NO: 454522 - DNA, 16 bp, M. musculus
ttctcaactgaagctc

SEQ ID NO: 454523 - DNA, 16 bp, M. musculus
ttctcaacttgtgggt

SEQ ID NO: 454524 - DNA, 16 bp, M. musculus
ttctcaactttcctaa

SEQ ID NO: 454525 - DNA, 16 bp, M. musculus
ttctcaaggtcctgag

SEQ ID NO: 454526 - DNA, 16 bp, M. musculus
ttctcaagtgctggga

SEQ ID NO: 454527 - DNA, 16 bp, M. musculus
ttctcaatcttacagt

SEQ ID NO: 454528 - DNA, 16 bp, M. musculus
ttctcaatgtgtgggt

SEQ ID NO: 454529 - DNA, 16 bp, M. musculus
ttctcaattaatgatt

SEQ ID NO: 454530 - DNA, 16 bp, M. musculus
ttctcaattcacaaga

SEQ ID NO: 454531 - DNA, 16 bp, M. musculus
ttctcacaccagtcag

SEQ ID NO: 454532 - DNA, 16 bp, M. musculus
ttctcacagtcaggag

SEQ ID NO: 454533 - DNA, 16 bp, M. musculus
ttctcacagttctggg

SEQ ID NO: 454534 - DNA, 16 bp, M. musculus
ttctcaccagagactg

SEQ ID NO: 454535 - DNA, 16 bp, M. musculus
ttctcacccattcagt

SEQ ID NO: 454536 - DNA, 16 bp, M. musculus
ttctcacctgagaaat

SEQ ID NO: 454537 - DNA, 16 bp, M. musculus
ttctcacctgtgcaga

SEQ ID NO: 454538 - DNA, 16 bp, M. musculus
ttctcactgaattcct

SEQ ID NO: 454539 - DNA, 16 bp, M. musculus
ttctcactggaggaat

SEQ ID NO: 454540 - DNA, 16 bp, M. musculus
ttctcactgtgtagct

SEQ ID NO: 454541 - DNA, 16 bp, M. musculus
ttctcacttgctgctt

SEQ ID NO: 454542 - DNA, 16 bp, M. musculus
ttctcagaaggtggca

SEQ ID NO: 454543 - DNA, 16 bp, M. musculus
ttctcagacagggtct

SEQ ID NO: 454544 - DNA, 16 bp, M. musculus
ttctcagaccacatga

SEQ ID NO: 454545 - DNA, 16 bp, M. musculus
ttctcagaccagcagt

SEQ ID NO: 454546 - DNA, 16 bp, M. musculus
ttctcagagaaaggga

SEQ ID NO: 454547 - DNA, 16 bp, M. musculus
ttctcagagaaggaga

SEQ ID NO: 454548 - DNA, 16 bp, M. musculus
ttctcagagaagggga

SEQ ID NO: 454549 - DNA, 16 bp, M. musculus
ttctcagagggcagcc

SEQ ID NO: 454550 - DNA, 16 bp, M. musculus
ttctcagatttctgat

SEQ ID NO: 454551 - DNA, 23 bp, M. musculus
ttctcagattttgtggccaaaat

SEQ ID NO: 454552 - DNA, 53 bp, M. musculus
ttctcagattttgtggccagaatgacagaggcagcagagcgtatttttggaga

SEQ ID NO: 454553 - DNA, 16 bp, M. musculus
ttctcagcaccacaaa

SEQ ID NO: 454554 - DNA, 16 bp, M. musculus
ttctcagcacccacat

SEQ ID NO: 454555 - DNA, 16 bp, M. musculus
ttctcagcattcacat

SEQ ID NO: 454556 - DNA, 16 bp, M. musculus
ttctcagccatttcag

SEQ ID NO: 454557 - DNA, 19 bp, M. musculus
ttctcagccatttggtatt

SEQ ID NO: 454558 - DNA, 16 bp, M. musculus
ttctcagcccctttat

SEQ ID NO: 454559 - DNA, 16 bp, M. musculus
ttctcagcctgtgggt

SEQ ID NO: 454560 - DNA, 16 bp, M. musculus
ttctcagcctgttgat

SEQ ID NO: 454561 - DNA, 16 bp, M. musculus
ttctcagccttcctaa

SEQ ID NO: 454562 - DNA, 16 bp, M. musculus
ttctcagcgccacatg

SEQ ID NO: 454563 - DNA, 16 bp, M. musculus
ttctcagctactgttc

SEQ ID NO: 454564 - DNA, 16 bp, M. musculus
ttctcagcttcctttc

SEQ ID NO: 454565 - DNA, 16 bp, M. musculus
ttctcagcttgtgggt

SEQ ID NO: 454566 - DNA, 16 bp, M. musculus
ttctcaggaggaagac

SEQ ID NO: 454567 - DNA, 16 bp, M. musculus
ttctcaggagtgctga

SEQ ID NO: 454568 - DNA, 16 bp, M. musculus
ttctcaggggtcacct

SEQ ID NO: 454569 - DNA, 16 bp, M. musculus
ttctcagtacctcatt

SEQ ID NO: 454570 - DNA, 17 bp, M. musculus
ttctcagtacctgtcca

SEQ ID NO: 454571 - DNA, 16 bp, M. musculus
ttctcagtctatttat

SEQ ID NO: 454572 - DNA, 16 bp, M. musculus
ttctcagtctcagaca

SEQ ID NO: 454573 - DNA, 16 bp, M. musculus
ttctcagtgccacatg

SEQ ID NO: 454574 - DNA, 16 bp, M. musculus
ttctcagtggttatca

SEQ ID NO: 454575 - DNA, 16 bp, M. musculus
ttctcagtgtagccct

SEQ ID NO: 454576 - DNA, 16 bp, M. musculus
ttctcagttctccaaa

SEQ ID NO: 454577 - DNA, 16 bp, M. musculus
ttctcataacccatat

SEQ ID NO: 454578 - DNA, 16 bp, M. musculus
ttctcatctactcctg

SEQ ID NO: 454579 - DNA, 16 bp, M. musculus
ttctcatggagctcca

SEQ ID NO: 454580 - DNA, 16 bp, M. musculus
ttctcatggtgtcttc

SEQ ID NO: 454581 - DNA, 16 bp, M. musculus
ttctcatgttgtggtg

SEQ ID NO: 454582 - DNA, 16 bp, M. musculus
ttctcattaaaataat

SEQ ID NO: 454583 - DNA, 16 bp, M. musculus
ttctcattcaagccac

SEQ ID NO: 454584 - DNA, 16 bp, M. musculus
ttctcattgaaaccac

SEQ ID NO: 454585 - DNA, 16 bp, M. musculus
ttctcattgcagcttt

SEQ ID NO: 454586 - DNA, 16 bp, M. musculus
ttctcattgctgtgac

SEQ ID NO: 454587 - DNA, 16 bp, M. musculus
ttctcattggcttgga

SEQ ID NO: 454588 - DNA, 16 bp, M. musculus
ttctcattgtgttctg

SEQ ID NO: 454589 - DNA, 16 bp, M. musculus
ttctcatttaaactac

SEQ ID NO: 454590 - DNA, 16 bp, M. musculus
ttctcattttaaaata

SEQ ID NO: 454591 - DNA, 16 bp, M. musculus
ttctcattttctacca

SEQ ID NO: 454592 - DNA, 16 bp, M. musculus
ttctcatttttaaaaa

SEQ ID NO: 454593 - DNA, 16 bp, M. musculus
ttctcatttttctaca

SEQ ID NO: 454594 - DNA, 16 bp, M. musculus
ttctccaaagaaatag

SEQ ID NO: 454595 - DNA, 16 bp, M. musculus
ttctccaaagaagaaa

SEQ ID NO: 454596 - DNA, 16 bp, M. musculus
ttctccaagactctgc

SEQ ID NO: 454597 - DNA, 16 bp, M. musculus
ttctccaaggccacac

SEQ ID NO: 454598 - DNA, 16 bp, M. musculus
ttctccaattcctcca

SEQ ID NO: 454599 - DNA, 16 bp, M. musculus
ttctccacaccctcac

SEQ ID NO: 454600 - DNA, 18 bp, M. musculus
ttctccacatcctcacca

SEQ ID NO: 454601 - DNA, 16 bp, M. musculus
ttctccacctgtgggt

SEQ ID NO: 454602 - DNA, 16 bp, M. musculus
ttctccactggtgaaa

SEQ ID NO: 454603 - DNA, 16 bp, M. musculus
ttctccagctcctcca

SEQ ID NO: 454604 - DNA, 16 bp, M. musculus
ttctccagctcttccc

SEQ ID NO: 454605 - DNA, 16 bp, M. musculus
ttctccagcttctcca

SEQ ID NO: 454606 - DNA, 16 bp, M. musculus
ttctccagctttggaa

SEQ ID NO: 454607 - DNA, 21 bp, M. musculus
ttctccaggccatgtgcttct

SEQ ID NO: 454608 - DNA, 16 bp, M. musculus
ttctccaggctatgtg

SEQ ID NO: 454609 - DNA, 16 bp, M. musculus
ttctccaggttcatct

SEQ ID NO: 454610 - DNA, 16 bp, M. musculus
ttctccagtgagactc

SEQ ID NO: 454611 - DNA, 16 bp, M. musculus
ttctccagtgctggga

SEQ ID NO: 454612 - DNA, 16 bp, M. musculus
ttctccatatttcctc

SEQ ID NO: 454613 - DNA, 16 bp, M. musculus
ttctccatctgtggtg

SEQ ID NO: 454614 - DNA, 16 bp, M. musculus
ttctccatgaagccag

SEQ ID NO: 454615 - DNA, 16 bp, M. musculus
ttctccatggcttctg

SEQ ID NO: 454616 - DNA, 16 bp, M. musculus
ttctccattccctctg

SEQ ID NO: 454617 - DNA, 16 bp, M. musculus
ttctccattgaggttc

SEQ ID NO: 454618 - DNA, 16 bp, M. musculus
ttctccatttattttg

SEQ ID NO: 454619 - DNA, 16 bp, M. musculus
ttctcccaactcttcc

SEQ ID NO: 454620 - DNA, 16 bp, M. musculus
ttctcccaagaggaat

SEQ ID NO: 454621 - DNA, 16 bp, M. musculus
ttctcccacaaggcca

SEQ ID NO: 454622 - DNA, 16 bp, M. musculus
ttctcccagagaccct

SEQ ID NO: 454623 - DNA, 16 bp, M. musculus
ttctcccatacctgat

SEQ ID NO: 454624 - DNA, 16 bp, M. musculus
ttctccccaaattgct

SEQ ID NO: 454625 - DNA, 16 bp, M. musculus
ttctcccctgagtttg

SEQ ID NO: 454626 - DNA, 16 bp, M. musculus
ttctcccctttctgaa

SEQ ID NO: 454627 - DNA, 16 bp, M. musculus
ttctccctcccaagag

SEQ ID NO: 454628 - DNA, 16 bp, M. musculus
ttctccctgcatccct

SEQ ID NO: 454629 - DNA, 16 bp, M. musculus
ttctccctgtagccct

SEQ ID NO: 454630 - DNA, 16 bp, M. musculus
ttctcccttccaagtg

SEQ ID NO: 454631 - DNA, 16 bp, M. musculus
ttctcctaacagcctt

SEQ ID NO: 454632 - DNA, 16 bp, M. musculus
ttctcctacttcaagg

SEQ ID NO: 454633 - DNA, 16 bp, M. musculus
ttctcctcagagaagg

SEQ ID NO: 454634 - DNA, 16 bp, M. musculus
ttctcctccaagattc

SEQ ID NO: 454635 - DNA, 16 bp, M. musculus
ttctcctcctccagga

SEQ ID NO: 454636 - DNA, 16 bp, M. musculus
ttctcctctaagatct

SEQ ID NO: 454637 - DNA, 16 bp, M. musculus
ttctcctctctccaaa

SEQ ID NO: 454638 - DNA, 16 bp, M. musculus
ttctcctctgagagga

SEQ ID NO: 454639 - DNA, 16 bp, M. musculus
ttctcctctgtgtgtg

SEQ ID NO: 454640 - DNA, 16 bp, M. musculus
ttctcctcttgggtgt

SEQ ID NO: 454641 - DNA, 16 bp, M. musculus
ttctcctgcctcaacc

SEQ ID NO: 454642 - DNA, 16 bp, M. musculus
ttctcctgcctcagct

SEQ ID NO: 454643 - DNA, 16 bp, M. musculus
ttctcctgcctctact

SEQ ID NO: 454644 - DNA, 16 bp, M. musculus
ttctcctgcctctgcc

SEQ ID NO: 454645 - DNA, 16 bp, M. musculus
ttctcctgcttccacc

SEQ ID NO: 454646 - DNA, 16 bp, M. musculus
ttctcctgcttctacc

SEQ ID NO: 454647 - DNA, 16 bp, M. musculus
ttctcctggctgcctt

SEQ ID NO: 454648 - DNA, 16 bp, M. musculus
ttctcctgtgtctgct

SEQ ID NO: 454649 - DNA, 16 bp, M. musculus
ttctcctgtttctgcc

SEQ ID NO: 454650 - DNA, 16 bp, M. musculus
ttctccttcaaaccac

SEQ ID NO: 454651 - DNA, 16 bp, M. musculus
ttctccttctaccatg

SEQ ID NO: 454652 - DNA, 16 bp, M. musculus
ttctccttgcagcttt

SEQ ID NO: 454653 - DNA, 16 bp, M. musculus
ttctcctttaagagct

SEQ ID NO: 454654 - DNA, 16 bp, M. musculus
ttctcctttcctgtca

SEQ ID NO: 454655 - DNA, 16 bp, M. musculus
ttctcctttctaagaa

SEQ ID NO: 454656 - DNA, 16 bp, M. musculus
ttctcgagacagggtt

SEQ ID NO: 454657 - DNA, 24 bp, M. musculus
ttctcgtcccaggtcttctcgtcc

SEQ ID NO: 454658 - DNA, 33 bp, M. musculus
ttctcgtcccgggtctcagcaccaactcttaca

SEQ ID NO: 454659 - DNA, 16 bp, M. musculus
ttctcgtcccgtcccg

SEQ ID NO: 454660 - DNA, 16 bp, M. musculus
ttctctaaggtcacac

SEQ ID NO: 454661 - DNA, 16 bp, M. musculus
ttctctaataaaaaga

SEQ ID NO: 454662 - DNA, 16 bp, M. musculus
ttctctaatttctcca

SEQ ID NO: 454663 - DNA, 16 bp, M. musculus
ttctctacacaaatga

SEQ ID NO: 454664 - DNA, 16 bp, M. musculus
ttctctaccctctctg

SEQ ID NO: 454665 - DNA, 16 bp, M. musculus
ttctctacctgtgggt

SEQ ID NO: 454666 - DNA, 16 bp, M. musculus
ttctctacttcctcca

SEQ ID NO: 454667 - DNA, 16 bp, M. musculus
ttctctagatatctgt

SEQ ID NO: 454668 - DNA, 16 bp, M. musculus
ttctctagctcatcca

SEQ ID NO: 454669 - DNA, 22 bp, M. musculus
ttctctaggccttttaggaaac

SEQ ID NO: 454670 - DNA, 16 bp, M. musculus
ttctctatacctctgt

SEQ ID NO: 454671 - DNA, 16 bp, M. musculus
ttctctatctcctcca

SEQ ID NO: 454672 - DNA, 16 bp, M. musculus
ttctctatctctgtgt

SEQ ID NO: 454673 - DNA, 16 bp, M. musculus
ttctctatgaccaaga

SEQ ID NO: 454674 - DNA, 16 bp, M. musculus
ttctctatggtatctt

SEQ ID NO: 454675 - DNA, 16 bp, M. musculus
ttctctatgtagacca

SEQ ID NO: 454676 - DNA, 16 bp, M. musculus
ttctctattttgttgg

SEQ ID NO: 454677 - DNA, 16 bp, M. musculus
ttctctccaggaagaa

SEQ ID NO: 454678 - DNA, 16 bp, M. musculus
ttctctccaggaggaa

SEQ ID NO: 454679 - DNA, 16 bp, M. musculus
ttctctccatcttctg

SEQ ID NO: 454680 - DNA, 16 bp, M. musculus
ttctctccatggaaca

SEQ ID NO: 454681 - DNA, 16 bp, M. musculus
ttctctccatgtggcc

SEQ ID NO: 454682 - DNA, 17 bp, M. musculus
ttctctccattcagttt

SEQ ID NO: 454683 - DNA, 16 bp, M. musculus
ttctctcccagaattc

SEQ ID NO: 454684 - DNA, 16 bp, M. musculus
ttctctccctgacccc

SEQ ID NO: 454685 - DNA, 16 bp, M. musculus
ttctctcctatctagt

SEQ ID NO: 454686 - DNA, 16 bp, M. musculus
ttctctcctgcagctc

SEQ ID NO: 454687 - DNA, 16 bp, M. musculus
ttctctcctgggcata

SEQ ID NO: 454688 - DNA, 16 bp, M. musculus
ttctctccttccatta

SEQ ID NO: 454689 - DNA, 16 bp, M. musculus
ttctctccttccgcca

SEQ ID NO: 454690 - DNA, 16 bp, M. musculus
ttctctccttttacca

SEQ ID NO: 454691 - DNA, 16 bp, M. musculus
ttctctctacctgtcc

SEQ ID NO: 454692 - DNA, 16 bp, M. musculus
ttctctctatttagtt

SEQ ID NO: 454693 - DNA, 16 bp, M. musculus
ttctctctcacacaca

SEQ ID NO: 454694 - DNA, 16 bp, M. musculus
ttctctctcagcttct

SEQ ID NO: 454695 - DNA, 16 bp, M. musculus
ttctctctccccactg

SEQ ID NO: 454696 - DNA, 16 bp, M. musculus
ttctctctcttgggct

SEQ ID NO: 454697 - DNA, 16 bp, M. musculus
ttctctctgccttgct

SEQ ID NO: 454698 - DNA, 16 bp, M. musculus
ttctctctgcttcact

SEQ ID NO: 454699 - DNA, 16 bp, M. musculus
ttctctctgggaagaa

SEQ ID NO: 454700 - DNA, 16 bp, M. musculus
ttctctctgtggagtc

SEQ ID NO: 454701 - DNA, 16 bp, M. musculus
ttctctcttcaacctg

SEQ ID NO: 454702 - DNA, 16 bp, M. musculus
ttctctcttccaaaat

SEQ ID NO: 454703 - DNA, 16 bp, M. musculus
ttctctcttccacttg

SEQ ID NO: 454704 - DNA, 16 bp, M. musculus
ttctctcttcccagat

SEQ ID NO: 454705 - DNA, 16 bp, M. musculus
ttctctctttcacaca

SEQ ID NO: 454706 - DNA, 16 bp, M. musculus
ttctctgaaaaaaaaa

SEQ ID NO: 454707 - DNA, 16 bp, M. musculus
ttctctgaagatggct

SEQ ID NO: 454708 - DNA, 16 bp, M. musculus
ttctctgaagcaaggg

SEQ ID NO: 454709 - DNA, 16 bp, M. musculus
ttctctgaccactgaa

SEQ ID NO: 454710 - DNA, 16 bp, M. musculus
ttctctgaccttgtct

SEQ ID NO: 454711 - DNA, 16 bp, M. musculus
ttctctgactcctcca

SEQ ID NO: 454712 - DNA, 16 bp, M. musculus
ttctctgactgaaacc

SEQ ID NO: 454713 - DNA, 16 bp, M. musculus
ttctctgacttccaca

SEQ ID NO: 454714 - DNA, 16 bp, M. musculus
ttctctgacttctaca

SEQ ID NO: 454715 - DNA, 16 bp, M. musculus
ttctctgagcaggtgg

SEQ ID NO: 454716 - DNA, 16 bp, M. musculus
ttctctgagcctcagt

SEQ ID NO: 454717 - DNA, 16 bp, M. musculus
ttctctgagccttgga

SEQ ID NO: 454718 - DNA, 16 bp, M. musculus
ttctctgatcaaggcc

SEQ ID NO: 454719 - DNA, 16 bp, M. musculus
ttctctgatgaggtct

SEQ ID NO: 454720 - DNA, 16 bp, M. musculus
ttctctgcacaaagga

SEQ ID NO: 454721 - DNA, 16 bp, M. musculus
ttctctgcagccctgg

SEQ ID NO: 454722 - DNA, 16 bp, M. musculus
ttctctgccctctttg

SEQ ID NO: 454723 - DNA, 16 bp, M. musculus
ttctctgcctgacctt

SEQ ID NO: 454724 - DNA, 16 bp, M. musculus
ttctctgctctctgct

SEQ ID NO: 454725 - DNA, 16 bp, M. musculus
ttctctgctgctgctg

SEQ ID NO: 454726 - DNA, 16 bp, M. musculus
ttctctgctttgtgct

SEQ ID NO: 454727 - DNA, 16 bp, M. musculus
ttctctggaactggag

SEQ ID NO: 454728 - DNA, 16 bp, M. musculus
ttctctggaagaacag

SEQ ID NO: 454729 - DNA, 16 bp, M. musculus
ttctctggaagaattt

SEQ ID NO: 454730 - DNA, 16 bp, M. musculus
ttctctggagcaccct

SEQ ID NO: 454731 - DNA, 16 bp, M. musculus
ttctctggagctggag

SEQ ID NO: 454732 - DNA, 16 bp, M. musculus
ttctctggaggaacag

SEQ ID NO: 454733 - DNA, 16 bp, M. musculus
ttctctggatagctca

SEQ ID NO: 454734 - DNA, 16 bp, M. musculus
ttctctggatttcctc

SEQ ID NO: 454735 - DNA, 16 bp, M. musculus
ttctctggcctccaca

SEQ ID NO: 454736 - DNA, 17 bp, M. musculus
ttctctggcctgttcct

SEQ ID NO: 454737 - DNA, 16 bp, M. musculus
ttctctggcttcaact

SEQ ID NO: 454738 - DNA, 16 bp, M. musculus
ttctctggcttcagct

SEQ ID NO: 454739 - DNA, 16 bp, M. musculus
ttctctgggacatcaa

SEQ ID NO: 454740 - DNA, 16 bp, M. musculus
ttctctgggggaattt

SEQ ID NO: 454741 - DNA, 17 bp, M. musculus
ttctctggtggaaattt

SEQ ID NO: 454742 - DNA, 16 bp, M. musculus
ttctctgtaaaataaa

SEQ ID NO: 454743 - DNA, 20 bp, M. musculus
ttctctgtatagctctggct

SEQ ID NO: 454744 - DNA, 16 bp, M. musculus
ttctctgtatattcct

SEQ ID NO: 454745 - DNA, 16 bp, M. musculus
ttctctgtgaagctct

SEQ ID NO: 454746 - DNA, 16 bp, M. musculus
ttctctgtgcagtctt

SEQ ID NO: 454747 - DNA, 16 bp, M. musculus
ttctctgtgcctcagt

SEQ ID NO: 454748 - DNA, 16 bp, M. musculus
ttctctgtgcctctct

SEQ ID NO: 454749 - DNA, 18 bp, M. musculus
ttctctgtgtaacagcct

SEQ ID NO: 454750 - DNA, 16 bp, M. musculus
ttctctgtgtatcctg

SEQ ID NO: 454751 - DNA, 16 bp, M. musculus
ttctctgtgtatttct

SEQ ID NO: 454752 - DNA, 16 bp, M. musculus
ttctctgtgtcttcat

SEQ ID NO: 454753 - DNA, 16 bp, M. musculus
ttctctgtgtgtatgt

SEQ ID NO: 454754 - DNA, 16 bp, M. musculus
ttctctgtgtgtctgt

SEQ ID NO: 454755 - DNA, 16 bp, M. musculus
ttctcttaggttctgt

SEQ ID NO: 454756 - DNA, 16 bp, M. musculus
ttctcttatagaaccc

SEQ ID NO: 454757 - DNA, 16 bp, M. musculus
ttctcttatgaacatt

SEQ ID NO: 454758 - DNA, 16 bp, M. musculus
ttctcttcaaactgta

SEQ ID NO: 454759 - DNA, 16 bp, M. musculus
ttctcttcagaaaaga

SEQ ID NO: 454760 - DNA, 16 bp, M. musculus
ttctcttcaggaactt

SEQ ID NO: 454761 - DNA, 16 bp, M. musculus
ttctcttcatctatat

SEQ ID NO: 454762 - DNA, 16 bp, M. musculus
ttctcttcctgtgact

SEQ ID NO: 454763 - DNA, 16 bp, M. musculus
ttctcttctggccttc

SEQ ID NO: 454764 - DNA, 16 bp, M. musculus
ttctcttcttccacca

SEQ ID NO: 454765 - DNA, 16 bp, M. musculus
ttctcttcttccactg

SEQ ID NO: 454766 - DNA, 16 bp, M. musculus
ttctcttgctctcagc

SEQ ID NO: 454767 - DNA, 16 bp, M. musculus
ttctcttggccatggc

SEQ ID NO: 454768 - DNA, 16 bp, M. musculus
ttctcttggtggattt

SEQ ID NO: 454769 - DNA, 16 bp, M. musculus
ttctcttggtgtcctc

SEQ ID NO: 454770 - DNA, 16 bp, M. musculus
ttctcttgtgtctgct

SEQ ID NO: 454771 - DNA, 16 bp, M. musculus
ttctctttaaaataga

SEQ ID NO: 454772 - DNA, 16 bp, M. musculus
ttctctttagaaaaca

SEQ ID NO: 454773 - DNA, 16 bp, M. musculus
ttctctttagaaaagg

SEQ ID NO: 454774 - DNA, 16 bp, M. musculus
ttctctttataagagt

SEQ ID NO: 454775 - DNA, 16 bp, M. musculus
ttctctttatcctcag

SEQ ID NO: 454776 - DNA, 16 bp, M. musculus
ttctctttcagaggac

SEQ ID NO: 454777 - DNA, 16 bp, M. musculus
ttctctttctccaaat

SEQ ID NO: 454778 - DNA, 16 bp, M. musculus
ttctctttgatggctt

SEQ ID NO: 454779 - DNA, 16 bp, M. musculus
ttctctttgcagcaga

SEQ ID NO: 454780 - DNA, 16 bp, M. musculus
ttctctttggaatctt

SEQ ID NO: 454781 - DNA, 16 bp, M. musculus
ttctctttggctggtt

SEQ ID NO: 454782 - DNA, 16 bp, M. musculus
ttctcttttaaaaact

SEQ ID NO: 454783 - DNA, 16 bp, M. musculus
ttctcttttaaataga

SEQ ID NO: 454784 - DNA, 16 bp, M. musculus
ttctcttttaagattt

SEQ ID NO: 454785 - DNA, 16 bp, M. musculus
ttctctttttaaaaaa

SEQ ID NO: 454786 - DNA, 16 bp, M. musculus
ttctctttttcaaaaa

SEQ ID NO: 454787 - DNA, 16 bp, M. musculus
ttctgaaaaaaaaaat

SEQ ID NO: 454788 - DNA, 16 bp, M. musculus
ttctgaaaaaaataaa

SEQ ID NO: 454789 - DNA, 16 bp, M. musculus
ttctgaaaaaacaaaa

SEQ ID NO: 454790 - DNA, 16 bp, M. musculus
ttctgaaacaaacaaa

SEQ ID NO: 454791 - DNA, 16 bp, M. musculus
ttctgaaacaggatct

SEQ ID NO: 454792 - DNA, 16 bp, M. musculus
ttctgaaacctcaaat

SEQ ID NO: 454793 - DNA, 16 bp, M. musculus
ttctgaaactgtaagc

SEQ ID NO: 454794 - DNA, 16 bp, M. musculus
ttctgaaacttttttt

SEQ ID NO: 454795 - DNA, 16 bp, M. musculus
ttctgaaataaaaaaa

SEQ ID NO: 454796 - DNA, 16 bp, M. musculus
ttctgaaatatatttt

SEQ ID NO: 454797 - DNA, 16 bp, M. musculus
ttctgaaattatttta

SEQ ID NO: 454798 - DNA, 16 bp, M. musculus
ttctgaacaacaacaa

SEQ ID NO: 454799 - DNA, 16 bp, M. musculus
ttctgaagaaatttta

SEQ ID NO: 454800 - DNA, 16 bp, M. musculus
ttctgaagaagaaatg

SEQ ID NO: 454801 - DNA, 16 bp, M. musculus
ttctgaagagaaaaca

SEQ ID NO: 454802 - DNA, 16 bp, M. musculus
ttctgaagaggaaaca

SEQ ID NO: 454803 - DNA, 16 bp, M. musculus
ttctgaagccctgagc

SEQ ID NO: 454804 - DNA, 16 bp, M. musculus
ttctgaaggaaaatga

SEQ ID NO: 454805 - DNA, 16 bp, M. musculus
ttctgaaggcaaatag

SEQ ID NO: 454806 - DNA, 16 bp, M. musculus
ttctgaagggaaacaa

SEQ ID NO: 454807 - DNA, 16 bp, M. musculus
ttctgaatccacactg

SEQ ID NO: 454808 - DNA, 16 bp, M. musculus
ttctgaatttctttgg

SEQ ID NO: 454809 - DNA, 16 bp, M. musculus
ttctgaatttttttaa

SEQ ID NO: 454810 - DNA, 16 bp, M. musculus
ttctgacagtatgaag

SEQ ID NO: 454811 - DNA, 16 bp, M. musculus
ttctgacatggctaaa

SEQ ID NO: 454812 - DNA, 16 bp, M. musculus
ttctgaccaaggaact

SEQ ID NO: 454813 - DNA, 16 bp, M. musculus
ttctgaccctggcatt

SEQ ID NO: 454814 - DNA, 16 bp, M. musculus
ttctgacctcctcaag

SEQ ID NO: 454815 - DNA, 16 bp, M. musculus
ttctgacctctatggg

SEQ ID NO: 454816 - DNA, 17 bp, M. musculus
ttctgactcaggagagg

SEQ ID NO: 454817 - DNA, 16 bp, M. musculus
ttctgactgatgtgag

SEQ ID NO: 454818 - DNA, 16 bp, M. musculus
ttctgactggggtaag

SEQ ID NO: 454819 - DNA, 16 bp, M. musculus
ttctgacttccacaca

SEQ ID NO: 454820 - DNA, 16 bp, M. musculus
ttctgacttccttcaa

SEQ ID NO: 454821 - DNA, 16 bp, M. musculus
ttctgacttctgaggg

SEQ ID NO: 454822 - DNA, 16 bp, M. musculus
ttctgagaaaccaaca

SEQ ID NO: 454823 - DNA, 16 bp, M. musculus
ttctgagaaactgcaa

SEQ ID NO: 454824 - DNA, 16 bp, M. musculus
ttctgagaaactgtca

SEQ ID NO: 454825 - DNA, 16 bp, M. musculus
ttctgagaacatgagg

SEQ ID NO: 454826 - DNA, 16 bp, M. musculus
ttctgagaaggggcaa

SEQ ID NO: 454827 - DNA, 16 bp, M. musculus
ttctgagaagtgtttc

SEQ ID NO: 454828 - DNA, 16 bp, M. musculus
ttctgagacaaggtct

SEQ ID NO: 454829 - DNA, 16 bp, M. musculus
ttctgagacaaggttt

SEQ ID NO: 454830 - DNA, 16 bp, M. musculus
ttctgagacagggcct

SEQ ID NO: 454831 - DNA, 16 bp, M. musculus
ttctgagacagggttc

SEQ ID NO: 454832 - DNA, 16 bp, M. musculus
ttctgagacagtgtct

SEQ ID NO: 454833 - DNA, 16 bp, M. musculus
ttctgagacagtttct

SEQ ID NO: 454834 - DNA, 16 bp, M. musculus
ttctgagacttccttt

SEQ ID NO: 454835 - DNA, 16 bp, M. musculus
ttctgagatcgaggcc

SEQ ID NO: 454836 - DNA, 17 bp, M. musculus
ttctgagatcttcgatt

SEQ ID NO: 454837 - DNA, 16 bp, M. musculus
ttctgagatctttttc

SEQ ID NO: 454838 - DNA, 16 bp, M. musculus
ttctgagattgtcttt

SEQ ID NO: 454839 - DNA, 17 bp, M. musculus
ttctgagcagatctctg

SEQ ID NO: 454840 - DNA, 16 bp, M. musculus
ttctgagccatctttc

SEQ ID NO: 454841 - DNA, 16 bp, M. musculus
ttctgaggaacagcca

SEQ ID NO: 454842 - DNA, 16 bp, M. musculus
ttctgaggaactgcca

SEQ ID NO: 454843 - DNA, 16 bp, M. musculus
ttctgaggaaggggtg

SEQ ID NO: 454844 - DNA, 16 bp, M. musculus
ttctgaggatcaaatt

SEQ ID NO: 454845 - DNA, 16 bp, M. musculus
ttctgaggcagggttt

SEQ ID NO: 454846 - DNA, 16 bp, M. musculus
ttctgagtgctaggat

SEQ ID NO: 454847 - DNA, 16 bp, M. musculus
ttctgagttcaattct

SEQ ID NO: 454848 - DNA, 16 bp, M. musculus
ttctgagttccctgag

SEQ ID NO: 454849 - DNA, 16 bp, M. musculus
ttctgagttccctgtg

SEQ ID NO: 454850 - DNA, 16 bp, M. musculus
ttctgagttcgagttc

SEQ ID NO: 454851 - DNA, 16 bp, M. musculus
ttctgagttgaggcca

SEQ ID NO: 454852 - DNA, 16 bp, M. musculus
ttctgagtttaaggct

SEQ ID NO: 454853 - DNA, 16 bp, M. musculus
ttctgagtttgaaacc

SEQ ID NO: 454854 - DNA, 16 bp, M. musculus
ttctgatagcagcctt

SEQ ID NO: 454855 - DNA, 16 bp, M. musculus
ttctgatatcttcctt

SEQ ID NO: 454856 - DNA, 21 bp, M. musculus
ttctgatcatggtgagtggtc

SEQ ID NO: 454857 - DNA, 16 bp, M. musculus
ttctgatcctcctgac

SEQ ID NO: 454858 - DNA, 16 bp, M. musculus
ttctgatcttagccat

SEQ ID NO: 454859 - DNA, 17 bp, M. musculus
ttctgatgatgccaagt

SEQ ID NO: 454860 - DNA, 21 bp, M. musculus
ttctgatgatggtgagtggtc

SEQ ID NO: 454861 - DNA, 16 bp, M. musculus
ttctgatgatggtgtg

SEQ ID NO: 454862 - DNA, 27 bp, M. musculus
ttctgatgattctaagaaggaagttaa

SEQ ID NO: 454863 - DNA, 16 bp, M. musculus
ttctgatgtgtctgaa

SEQ ID NO: 454864 - DNA, 16 bp, M. musculus
ttctgatgttcttagg

SEQ ID NO: 454865 - DNA, 21 bp, M. musculus
ttctgattatggtgagtggtc

SEQ ID NO: 454866 - DNA, 16 bp, M. musculus
ttctgattgctgggat

SEQ ID NO: 454867 - DNA, 19 bp, M. musculus
ttctgattggatgaggtgg

SEQ ID NO: 454868 - DNA, 16 bp, M. musculus
ttctgatttaaaatca

SEQ ID NO: 454869 - DNA, 16 bp, M. musculus
ttctgattttgttcat

SEQ ID NO: 454870 - DNA, 16 bp, M. musculus
ttctgcaaaagcaaca

SEQ ID NO: 454871 - DNA, 16 bp, M. musculus
ttctgcaaagcaaagg

SEQ ID NO: 454872 - DNA, 16 bp, M. musculus
ttctgcaagagcatca

SEQ ID NO: 454873 - DNA, 16 bp, M. musculus
ttctgcaagagtagcc

SEQ ID NO: 454874 - DNA, 16 bp, M. musculus
ttctgcaagatggcca

SEQ ID NO: 454875 - DNA, 16 bp, M. musculus
ttctgcaaggccagag

SEQ ID NO: 454876 - DNA, 16 bp, M. musculus
ttctgcaagggcagca

SEQ ID NO: 454877 - DNA, 16 bp, M. musculus
ttctgcacactgggga

SEQ ID NO: 454878 - DNA, 16 bp, M. musculus
ttctgcagaagtctag

SEQ ID NO: 454879 - DNA, 16 bp, M. musculus
ttctgcagaccaggct

SEQ ID NO: 454880 - DNA, 16 bp, M. musculus
ttctgcagatcaatga

SEQ ID NO: 454881 - DNA, 16 bp, M. musculus
ttctgcagcaaaactt

SEQ ID NO: 454882 - DNA, 16 bp, M. musculus
ttctgcatgcagacat

SEQ ID NO: 454883 - DNA, 16 bp, M. musculus
ttctgcattaaaacca

SEQ ID NO: 454884 - DNA, 16 bp, M. musculus
ttctgcattttggcca

SEQ ID NO: 454885 - DNA, 16 bp, M. musculus
ttctgccaatcacatt

SEQ ID NO: 454886 - DNA, 16 bp, M. musculus
ttctgccactgctgct

SEQ ID NO: 454887 - DNA, 16 bp, M. musculus
ttctgccagaagttct

SEQ ID NO: 454888 - DNA, 16 bp, M. musculus
ttctgccaggaggaag

SEQ ID NO: 454889 - DNA, 16 bp, M. musculus
ttctgccatttataaa

SEQ ID NO: 454890 - DNA, 16 bp, M. musculus
ttctgcccactttctc

SEQ ID NO: 454891 - DNA, 16 bp, M. musculus
ttctgcccagacattg

SEQ ID NO: 454892 - DNA, 16 bp, M. musculus
ttctgcctaatgtttg

SEQ ID NO: 454893 - DNA, 16 bp, M. musculus
ttctgcctcacaccag

SEQ ID NO: 454894 - DNA, 16 bp, M. musculus
ttctgcctcagactcc

SEQ ID NO: 454895 - DNA, 16 bp, M. musculus
ttctgcctcagccacc

SEQ ID NO: 454896 - DNA, 16 bp, M. musculus
ttctgcctcagcctcc

SEQ ID NO: 454897 - DNA, 16 bp, M. musculus
ttctgcctcagccttc

SEQ ID NO: 454898 - DNA, 16 bp, M. musculus
ttctgcctcagtttcc

SEQ ID NO: 454899 - DNA, 16 bp, M. musculus
ttctgcctcagtttct

SEQ ID NO: 454900 - DNA, 16 bp, M. musculus
ttctgcctcatcttct

SEQ ID NO: 454901 - DNA, 16 bp, M. musculus
ttctgcctccaggatc

SEQ ID NO: 454902 - DNA, 16 bp, M. musculus
ttctgcctccagttcc

SEQ ID NO: 454903 - DNA, 16 bp, M. musculus
ttctgcctccagtttc

SEQ ID NO: 454904 - DNA, 16 bp, M. musculus
ttctgcctcccaagtt

SEQ ID NO: 454905 - DNA, 16 bp, M. musculus
ttctgcctcttgagtg

SEQ ID NO: 454906 - DNA, 16 bp, M. musculus
ttctgccttccctgag

SEQ ID NO: 454907 - DNA, 16 bp, M. musculus
ttctgccttcctagtg

SEQ ID NO: 454908 - DNA, 16 bp, M. musculus
ttctgcctttgcttcc

SEQ ID NO: 454909 - DNA, 16 bp, M. musculus
ttctgcgattgtgtga

SEQ ID NO: 454910 - DNA, 16 bp, M. musculus
ttctgctaaagcaaac

SEQ ID NO: 454911 - DNA, 16 bp, M. musculus
ttctgctaaaggaaca

SEQ ID NO: 454912 - DNA, 16 bp, M. musculus
ttctgctacaccatca

SEQ ID NO: 454913 - DNA, 16 bp, M. musculus
ttctgctagctgcctt

SEQ ID NO: 454914 - DNA, 16 bp, M. musculus
ttctgctataccatca

SEQ ID NO: 454915 - DNA, 16 bp, M. musculus
ttctgctatgactttg

SEQ ID NO: 454916 - DNA, 16 bp, M. musculus
ttctgctatgcttgca

SEQ ID NO: 454917 - DNA, 16 bp, M. musculus
ttctgctcaatttgtg

SEQ ID NO: 454918 - DNA, 16 bp, M. musculus
ttctgctcactgcccc

SEQ ID NO: 454919 - DNA, 16 bp, M. musculus
ttctgctccaggttcc

SEQ ID NO: 454920 - DNA, 16 bp, M. musculus
ttctgctcccctctgc

SEQ ID NO: 454921 - DNA, 16 bp, M. musculus
ttctgctccctcaaga

SEQ ID NO: 454922 - DNA, 16 bp, M. musculus
ttctgctcccttctgc

SEQ ID NO: 454923 - DNA, 16 bp, M. musculus
ttctgctgagatggct

SEQ ID NO: 454924 - DNA, 16 bp, M. musculus
ttctgctgcaactgga

SEQ ID NO: 454925 - DNA, 16 bp, M. musculus
ttctgctgcctgaaga

SEQ ID NO: 454926 - DNA, 16 bp, M. musculus
ttctgctgcctgagga

SEQ ID NO: 454927 - DNA, 18 bp, M. musculus
ttctgctgctgctgctgt

SEQ ID NO: 454928 - DNA, 16 bp, M. musculus
ttctgctgctgctgtt

SEQ ID NO: 454929 - DNA, 16 bp, M. musculus
ttctgctgctgtgaag

SEQ ID NO: 454930 - DNA, 16 bp, M. musculus
ttctgctgctgtgatg

SEQ ID NO: 454931 - DNA, 16 bp, M. musculus
ttctgctgcttctgtt

SEQ ID NO: 454932 - DNA, 16 bp, M. musculus
ttctgctgcttgctga

SEQ ID NO: 454933 - DNA, 16 bp, M. musculus
ttctgctggagaccat

SEQ ID NO: 454934 - DNA, 16 bp, M. musculus
ttctgctggaggtgga

SEQ ID NO: 454935 - DNA, 16 bp, M. musculus
ttctgctggtgatgct

SEQ ID NO: 454936 - DNA, 16 bp, M. musculus
ttctgcttcatcttcc

SEQ ID NO: 454937 - DNA, 16 bp, M. musculus
ttctgcttccagagtg

SEQ ID NO: 454938 - DNA, 16 bp, M. musculus
ttctgcttccatctcc

SEQ ID NO: 454939 - DNA, 16 bp, M. musculus
ttctgcttcccaagtg

SEQ ID NO: 454940 - DNA, 16 bp, M. musculus
ttctgcttcccacatg

SEQ ID NO: 454941 - DNA, 16 bp, M. musculus
ttctgcttcctgagtg

SEQ ID NO: 454942 - DNA, 16 bp, M. musculus
ttctgcttctgcttcc

SEQ ID NO: 454943 - DNA, 16 bp, M. musculus
ttctgcttgagttcct

SEQ ID NO: 454944 - DNA, 16 bp, M. musculus
ttctgctttagttcct

SEQ ID NO: 454945 - DNA, 16 bp, M. musculus
ttctgcttttaatatt

SEQ ID NO: 454946 - DNA, 16 bp, M. musculus
ttctgcttttgcagag

SEQ ID NO: 454947 - DNA, 16 bp, M. musculus
ttctggaaaaaaaaat

SEQ ID NO: 454948 - DNA, 16 bp, M. musculus
ttctggaaagatcagg

SEQ ID NO: 454949 - DNA, 16 bp, M. musculus
ttctggaaatgaaaaa

SEQ ID NO: 454950 - DNA, 16 bp, M. musculus
ttctggaaatgggaca

SEQ ID NO: 454951 - DNA, 16 bp, M. musculus
ttctggaacattctct

SEQ ID NO: 454952 - DNA, 16 bp, M. musculus
ttctggaactctggct

SEQ ID NO: 454953 - DNA, 16 bp, M. musculus
ttctggaactttcttt

SEQ ID NO: 454954 - DNA, 16 bp, M. musculus
ttctggaagaacagcc

SEQ ID NO: 454955 - DNA, 16 bp, M. musculus
ttctggaagagcagcc

SEQ ID NO: 454956 - DNA, 16 bp, M. musculus
ttctggaagagcagga

SEQ ID NO: 454957 - DNA, 16 bp, M. musculus
ttctggaagctgtctt

SEQ ID NO: 454958 - DNA, 16 bp, M. musculus
ttctggaagcttcctg

SEQ ID NO: 454959 - DNA, 16 bp, M. musculus
ttctggaatccatctt

SEQ ID NO: 454960 - DNA, 16 bp, M. musculus
ttctggaattacaggt

SEQ ID NO: 454961 - DNA, 16 bp, M. musculus
ttctggactccctggc

SEQ ID NO: 454962 - DNA, 16 bp, M. musculus
ttctggagatcctgag

SEQ ID NO: 454963 - DNA, 16 bp, M. musculus
ttctggagattgaact

SEQ ID NO: 454964 - DNA, 16 bp, M. musculus
ttctggaggagaaact

SEQ ID NO: 454965 - DNA, 16 bp, M. musculus
ttctggaggggaaact

SEQ ID NO: 454966 - DNA, 16 bp, M. musculus
ttctggaggttcctca

SEQ ID NO: 454967 - DNA, 16 bp, M. musculus
ttctggagtcagttct

SEQ ID NO: 454968 - DNA, 16 bp, M. musculus
ttctggagtccaggtt

SEQ ID NO: 454969 - DNA, 16 bp, M. musculus
ttctggagtgctggga

SEQ ID NO: 454970 - DNA, 16 bp, M. musculus
ttctggagtgtcagaa

SEQ ID NO: 454971 - DNA, 16 bp, M. musculus
ttctggagtgtttgaa

SEQ ID NO: 454972 - DNA, 18 bp, M. musculus
ttctggagttcagcttct

SEQ ID NO: 454973 - DNA, 16 bp, M. musculus
ttctggatcagagttt

SEQ ID NO: 454974 - DNA, 16 bp, M. musculus
ttctggatggttttgt

SEQ ID NO: 454975 - DNA, 16 bp, M. musculus
ttctggattttctgga

SEQ ID NO: 454976 - DNA, 16 bp, M. musculus
ttctggcagaacctct

SEQ ID NO: 454977 - DNA, 16 bp, M. musculus
ttctggcaggaggcaa

SEQ ID NO: 454978 - DNA, 16 bp, M. musculus
ttctggcatccacagg

SEQ ID NO: 454979 - DNA, 16 bp, M. musculus
ttctggccctgttgga

SEQ ID NO: 454980 - DNA, 16 bp, M. musculus
ttctggcctccacaga

SEQ ID NO: 454981 - DNA, 16 bp, M. musculus
ttctggcctccgaggg

SEQ ID NO: 454982 - DNA, 16 bp, M. musculus
ttctggcctctgaaga

SEQ ID NO: 454983 - DNA, 16 bp, M. musculus
ttctggcctctgagaa

SEQ ID NO: 454984 - DNA, 16 bp, M. musculus
ttctggcctctgaggc

SEQ ID NO: 454985 - DNA, 16 bp, M. musculus
ttctggcctctgcaga

SEQ ID NO: 454986 - DNA, 16 bp, M. musculus
ttctggcctctgggca

SEQ ID NO: 454987 - DNA, 16 bp, M. musculus
ttctggcctctgtagg

SEQ ID NO: 454988 - DNA, 16 bp, M. musculus
ttctggccttcatcct

SEQ ID NO: 454989 - DNA, 16 bp, M. musculus
ttctggccttggtggg

SEQ ID NO: 454990 - DNA, 16 bp, M. musculus
ttctggcctttgtggg

SEQ ID NO: 454991 - DNA, 46 bp, M. musculus
ttctggctattataaataaggctgctatgaacatagtggagcatgt

SEQ ID NO: 454992 - DNA, 16 bp, M. musculus
ttctggctattgtgaa

SEQ ID NO: 454993 - DNA, 16 bp, M. musculus
ttctggctcagagttt

SEQ ID NO: 454994 - DNA, 16 bp, M. musculus
ttctggctccagacat

SEQ ID NO: 454995 - DNA, 16 bp, M. musculus
ttctggctgaagatga

SEQ ID NO: 454996 - DNA, 16 bp, M. musculus
ttctggctgaggatga

SEQ ID NO: 454997 - DNA, 16 bp, M. musculus
ttctggctgccctgga

SEQ ID NO: 454998 - DNA, 16 bp, M. musculus
ttctggctttcaaagt

SEQ ID NO: 454999 - DNA, 16 bp, M. musculus
ttctggctttcctgga

SEQ ID NO: 455000 - DNA, 16 bp, M. musculus
ttctggctttctggct

SEQ ID NO: 455001 - DNA, 16 bp, M. musculus
ttctgggaaagaaaag

SEQ ID NO: 455002 - DNA, 16 bp, M. musculus
ttctgggaaagtctct

SEQ ID NO: 455003 - DNA, 16 bp, M. musculus
ttctgggaaatgtagt

SEQ ID NO: 455004 - DNA, 16 bp, M. musculus
ttctgggaaatgtttt

SEQ ID NO: 455005 - DNA, 16 bp, M. musculus
ttctgggaattgaact

SEQ ID NO: 455006 - DNA, 16 bp, M. musculus
ttctgggacaggttct

SEQ ID NO: 455007 - DNA, 16 bp, M. musculus
ttctgggactccactg

SEQ ID NO: 455008 - DNA, 16 bp, M. musculus
ttctgggacttcctgc

SEQ ID NO: 455009 - DNA, 16 bp, M. musculus
ttctgggagaccagct

SEQ ID NO: 455010 - DNA, 16 bp, M. musculus
ttctgggagaccagtt

SEQ ID NO: 455011 - DNA, 16 bp, M. musculus
ttctgggagctgaact

SEQ ID NO: 455012 - DNA, 16 bp, M. musculus
ttctgggatagagcca

SEQ ID NO: 455013 - DNA, 16 bp, M. musculus
ttctgggatcacaggc

SEQ ID NO: 455014 - DNA, 16 bp, M. musculus
ttctgggatcacaggt

SEQ ID NO: 455015 - DNA, 16 bp, M. musculus
ttctgggcctgtggtg

SEQ ID NO: 455016 - DNA, 16 bp, M. musculus
ttctggggaaaaacag

SEQ ID NO: 455017 - DNA, 16 bp, M. musculus
ttctggggactaaact

SEQ ID NO: 455018 - DNA, 16 bp, M. musculus
ttctggggacttttca

SEQ ID NO: 455019 - DNA, 16 bp, M. musculus
ttctggggacttttta

SEQ ID NO: 455020 - DNA, 16 bp, M. musculus
ttctggggattaaact

SEQ ID NO: 455021 - DNA, 16 bp, M. musculus
ttctggggcatcaagc

SEQ ID NO: 455022 - DNA, 16 bp, M. musculus
ttctggggtccctggg

SEQ ID NO: 455023 - DNA, 16 bp, M. musculus
ttctggggtttctgaa

SEQ ID NO: 455024 - DNA, 16 bp, M. musculus
ttctgggtatatgtcc

SEQ ID NO: 455025 - DNA, 16 bp, M. musculus
ttctgggtctgggata

SEQ ID NO: 455026 - DNA, 16 bp, M. musculus
ttctgggtcttcaact

SEQ ID NO: 455027 - DNA, 16 bp, M. musculus
ttctgggtgtccttgg

SEQ ID NO: 455028 - DNA, 16 bp, M. musculus
ttctgggtgtgttaga

SEQ ID NO: 455029 - DNA, 16 bp, M. musculus
ttctgggttctgtaag

SEQ ID NO: 455030 - DNA, 16 bp, M. musculus
ttctgggttggagaga

SEQ ID NO: 455031 - DNA, 16 bp, M. musculus
ttctggtataattctg

SEQ ID NO: 455032 - DNA, 16 bp, M. musculus
ttctggtatgtctgaa

SEQ ID NO: 455033 - DNA, 16 bp, M. musculus
ttctggtcctctggaa

SEQ ID NO: 455034 - DNA, 16 bp, M. musculus
ttctggtctctgtggg

SEQ ID NO: 455035 - DNA, 16 bp, M. musculus
ttctggtctcttcagg

SEQ ID NO: 455036 - DNA, 16 bp, M. musculus
ttctggtctttgtggg

SEQ ID NO: 455037 - DNA, 16 bp, M. musculus
ttctggtgagattcct

SEQ ID NO: 455038 - DNA, 16 bp, M. musculus
ttctggtgctgtgctg

SEQ ID NO: 455039 - DNA, 16 bp, M. musculus
ttctggtggccagccc

SEQ ID NO: 455040 - DNA, 16 bp, M. musculus
ttctggtgtccacctt

SEQ ID NO: 455041 - DNA, 17 bp, M. musculus
ttctggtgtcctacatg

SEQ ID NO: 455042 - DNA, 16 bp, M. musculus
ttctggtgtctgaaga

SEQ ID NO: 455043 - DNA, 16 bp, M. musculus
ttctggttatcacaaa

SEQ ID NO: 455044 - DNA, 16 bp, M. musculus
ttctggttctattttg

SEQ ID NO: 455045 - DNA, 16 bp, M. musculus
ttctggttctggaatg

SEQ ID NO: 455046 - DNA, 16 bp, M. musculus
ttctggttctggttct

SEQ ID NO: 455047 - DNA, 16 bp, M. musculus
ttctggttggaatctg

SEQ ID NO: 455048 - DNA, 16 bp, M. musculus
ttctggtttccttgga

SEQ ID NO: 455049 - DNA, 16 bp, M. musculus
ttctggtttctatctg

SEQ ID NO: 455050 - DNA, 16 bp, M. musculus
ttctggtttttgtgaa

SEQ ID NO: 455051 - DNA, 16 bp, M. musculus
ttctgtaaaccaaagg

SEQ ID NO: 455052 - DNA, 16 bp, M. musculus
ttctgtaaccttgctc

SEQ ID NO: 455053 - DNA, 16 bp, M. musculus
ttctgtaagaaagcaa

SEQ ID NO: 455054 - DNA, 16 bp, M. musculus
ttctgtaagaacagca

SEQ ID NO: 455055 - DNA, 16 bp, M. musculus
ttctgtaagacaaaga

SEQ ID NO: 455056 - DNA, 16 bp, M. musculus
ttctgtaaggcaaatg

SEQ ID NO: 455057 - DNA, 16 bp, M. musculus
ttctgtaaggcagaag

SEQ ID NO: 455058 - DNA, 16 bp, M. musculus
ttctgtaatctattgg

SEQ ID NO: 455059 - DNA, 16 bp, M. musculus
ttctgtaattccagtt

SEQ ID NO: 455060 - DNA, 16 bp, M. musculus
ttctgtaatttttaaa

SEQ ID NO: 455061 - DNA, 16 bp, M. musculus
ttctgtacacaaagga

SEQ ID NO: 455062 - DNA, 16 bp, M. musculus
ttctgtacataaatat

SEQ ID NO: 455063 - DNA, 16 bp, M. musculus
ttctgtaccagcagag

SEQ ID NO: 455064 - DNA, 16 bp, M. musculus
ttctgtacttttttgg

SEQ ID NO: 455065 - DNA, 16 bp, M. musculus
ttctgtagaccagact

SEQ ID NO: 455066 - DNA, 16 bp, M. musculus
ttctgtagaccaggtt

SEQ ID NO: 455067 - DNA, 16 bp, M. musculus
ttctgtagagcaggct

SEQ ID NO: 455068 - DNA, 16 bp, M. musculus
ttctgtagctatctgt

SEQ ID NO: 455069 - DNA, 16 bp, M. musculus
ttctgtaggactggat

SEQ ID NO: 455070 - DNA, 16 bp, M. musculus
ttctgtatccatacct

SEQ ID NO: 455071 - DNA, 16 bp, M. musculus
ttctgtatgggttttt

SEQ ID NO: 455072 - DNA, 16 bp, M. musculus
ttctgtattcatttat

SEQ ID NO: 455073 - DNA, 16 bp, M. musculus
ttctgtattggtcagg

SEQ ID NO: 455074 - DNA, 16 bp, M. musculus
ttctgtatttctttaa

SEQ ID NO: 455075 - DNA, 16 bp, M. musculus
ttctgtatttttaaaa

SEQ ID NO: 455076 - DNA, 16 bp, M. musculus
ttctgtcaaatatttt

SEQ ID NO: 455077 - DNA, 24 bp, M. musculus
ttctgtccaaagagacagttttta

SEQ ID NO: 455078 - DNA, 16 bp, M. musculus
ttctgtccattggttg

SEQ ID NO: 455079 - DNA, 16 bp, M. musculus
ttctgtcctggatttc

SEQ ID NO: 455080 - DNA, 16 bp, M. musculus
ttctgtcctgtttgag

SEQ ID NO: 455081 - DNA, 16 bp, M. musculus
ttctgtctcaaaaacc

SEQ ID NO: 455082 - DNA, 16 bp, M. musculus
ttctgtctcagcctgt

SEQ ID NO: 455083 - DNA, 16 bp, M. musculus
ttctgtctcattttct

SEQ ID NO: 455084 - DNA, 16 bp, M. musculus
ttctgtctctacctcc

SEQ ID NO: 455085 - DNA, 16 bp, M. musculus
ttctgtctctctgtgt

SEQ ID NO: 455086 - DNA, 16 bp, M. musculus
ttctgtctctgtctgt

SEQ ID NO: 455087 - DNA, 16 bp, M. musculus
ttctgtctctgtgagc

SEQ ID NO: 455088 - DNA, 16 bp, M. musculus
ttctgtctgttccaga

SEQ ID NO: 455089 - DNA, 16 bp, M. musculus
ttctgtcttcacctgt

SEQ ID NO: 455090 - DNA, 16 bp, M. musculus
ttctgtgaaagcattg

SEQ ID NO: 455091 - DNA, 16 bp, M. musculus
ttctgtgaagaatgtt

SEQ ID NO: 455092 - DNA, 16 bp, M. musculus
ttctgtgaatattcac

SEQ ID NO: 455093 - DNA, 16 bp, M. musculus
ttctgtgactccagag

SEQ ID NO: 455094 - DNA, 16 bp, M. musculus
ttctgtgatctgtcca

SEQ ID NO: 455095 - DNA, 16 bp, M. musculus
ttctgtgatgaaacac

SEQ ID NO: 455096 - DNA, 16 bp, M. musculus
ttctgtgatgttccct

SEQ ID NO: 455097 - DNA, 16 bp, M. musculus
ttctgtgatgttcctt

SEQ ID NO: 455098 - DNA, 16 bp, M. musculus
ttctgtgattctgtga

SEQ ID NO: 455099 - DNA, 16 bp, M. musculus
ttctgtgattgtgtga

SEQ ID NO: 455100 - DNA, 16 bp, M. musculus
ttctgtgccaccctgc

SEQ ID NO: 455101 - DNA, 16 bp, M. musculus
ttctgtgcccagagat

SEQ ID NO: 455102 - DNA, 16 bp, M. musculus
ttctgtgctgtgtgct

SEQ ID NO: 455103 - DNA, 16 bp, M. musculus
ttctgtggcccatgtg

SEQ ID NO: 455104 - DNA, 16 bp, M. musculus
ttctgtgggttctggg

SEQ ID NO: 455105 - DNA, 16 bp, M. musculus
ttctgtggtgctgagg

SEQ ID NO: 455106 - DNA, 16 bp, M. musculus
ttctgtggttactcca

SEQ ID NO: 455107 - DNA, 16 bp, M. musculus
ttctgtgtaaccctgg

SEQ ID NO: 455108 - DNA, 16 bp, M. musculus
ttctgtgtagccctgg

SEQ ID NO: 455109 - DNA, 16 bp, M. musculus
ttctgtgtatatgtgt

SEQ ID NO: 455110 - DNA, 16 bp, M. musculus
ttctgtgtcaatgact

SEQ ID NO: 455111 - DNA, 16 bp, M. musculus
ttctgtgtctgttgct

SEQ ID NO: 455112 - DNA, 16 bp, M. musculus
ttctgtgtcttcattt

SEQ ID NO: 455113 - DNA, 16 bp, M. musculus
ttctgtgtgtttatgt

SEQ ID NO: 455114 - DNA, 16 bp, M. musculus
ttctgtgtttgcattt

SEQ ID NO: 455115 - DNA, 16 bp, M. musculus
ttctgtgttttccagg

SEQ ID NO: 455116 - DNA, 16 bp, M. musculus
ttctgtgttttctgat

SEQ ID NO: 455117 - DNA, 16 bp, M. musculus
ttctgttaaactgctt

SEQ ID NO: 455118 - DNA, 30 bp, M. musculus
ttctgttaactgaataccactctgtaattg

SEQ ID NO: 455119 - DNA, 16 bp, M. musculus
ttctgttactgtgaca

SEQ ID NO: 455120 - DNA, 20 bp, M. musculus
ttctgttagtaggattctta

SEQ ID NO: 455121 - DNA, 16 bp, M. musculus
ttctgttagtagggtt

SEQ ID NO: 455122 - DNA, 16 bp, M. musculus
ttctgttagtgtctgt

SEQ ID NO: 455123 - DNA, 16 bp, M. musculus
ttctgttagtttaact

SEQ ID NO: 455124 - DNA, 16 bp, M. musculus
ttctgttattaagatt

SEQ ID NO: 455125 - DNA, 16 bp, M. musculus
ttctgttcagaaagtt

SEQ ID NO: 455126 - DNA, 16 bp, M. musculus
ttctgttcaggaaact

SEQ ID NO: 455127 - DNA, 16 bp, M. musculus
ttctgttcaggagttt

SEQ ID NO: 455128 - DNA, 22 bp, M. musculus
ttctgttccacttctggattca

SEQ ID NO: 455129 - DNA, 16 bp, M. musculus
ttctgttccattgatt

SEQ ID NO: 455130 - DNA, 16 bp, M. musculus
ttctgttcccatttct

SEQ ID NO: 455131 - DNA, 16 bp, M. musculus
ttctgttccctattct

SEQ ID NO: 455132 - DNA, 16 bp, M. musculus
ttctgttcctgcctct

SEQ ID NO: 455133 - DNA, 16 bp, M. musculus
ttctgttctgtggctg

SEQ ID NO: 455134 - DNA, 16 bp, M. musculus
ttctgttctgttctga

SEQ ID NO: 455135 - DNA, 16 bp, M. musculus
ttctgttcttgcagct

SEQ ID NO: 455136 - DNA, 16 bp, M. musculus
ttctgttctttataaa

SEQ ID NO: 455137 - DNA, 16 bp, M. musculus
ttctgttgctgagata

SEQ ID NO: 455138 - DNA, 16 bp, M. musculus
ttctgttgctgatgct

SEQ ID NO: 455139 - DNA, 16 bp, M. musculus
ttctgttgctgctgct

SEQ ID NO: 455140 - DNA, 16 bp, M. musculus
ttctgttggttatgct

SEQ ID NO: 455141 - DNA, 16 bp, M. musculus
ttctgttgtgtctaaa

SEQ ID NO: 455142 - DNA, 16 bp, M. musculus
ttctgtttaggaaata

SEQ ID NO: 455143 - DNA, 16 bp, M. musculus
ttctgtttaggaaatg

SEQ ID NO: 455144 - DNA, 16 bp, M. musculus
ttctgtttattgtaaa

SEQ ID NO: 455145 - DNA, 16 bp, M. musculus
ttctgtttccatctcc

SEQ ID NO: 455146 - DNA, 16 bp, M. musculus
ttctgtttccatttct

SEQ ID NO: 455147 - DNA, 16 bp, M. musculus
ttctgtttctattctg

SEQ ID NO: 455148 - DNA, 16 bp, M. musculus
ttctgtttgctctggg

SEQ ID NO: 455149 - DNA, 16 bp, M. musculus
ttctgtttgtcttcag

SEQ ID NO: 455150 - DNA, 16 bp, M. musculus
ttctgttttaaaatgt

SEQ ID NO: 455151 - DNA, 16 bp, M. musculus
ttctgttttaaataaa

SEQ ID NO: 455152 - DNA, 16 bp, M. musculus
ttctgttttattagat

SEQ ID NO: 455153 - DNA, 16 bp, M. musculus
ttctgttttgaaattt

SEQ ID NO: 455154 - DNA, 16 bp, M. musculus
ttctgttttgtggaat

SEQ ID NO: 455155 - DNA, 16 bp, M. musculus
ttctgtttttccaaag

SEQ ID NO: 455156 - DNA, 16 bp, M. musculus
ttctgtttttctaaaa

SEQ ID NO: 455157 - DNA, 16 bp, M. musculus
ttctgttttttaaaag

SEQ ID NO: 455158 - DNA, 16 bp, M. musculus
ttcttaaaaagaaaat

SEQ ID NO: 455159 - DNA, 16 bp, M. musculus
ttcttaaaacagataa

SEQ ID NO: 455160 - DNA, 16 bp, M. musculus
ttcttaaaatatacaa

SEQ ID NO: 455161 - DNA, 16 bp, M. musculus
ttcttaaacactttaa

SEQ ID NO: 455162 - DNA, 16 bp, M. musculus
ttcttaaagatttatt

SEQ ID NO: 455163 - DNA, 17 bp, M. musculus
ttcttaaatgaatgtaa

SEQ ID NO: 455164 - DNA, 16 bp, M. musculus
ttcttaacctctgagc

SEQ ID NO: 455165 - DNA, 16 bp, M. musculus
ttcttaacctgtgggt

SEQ ID NO: 455166 - DNA, 16 bp, M. musculus
ttcttaactgctgagc

SEQ ID NO: 455167 - DNA, 16 bp, M. musculus
ttcttaagcttgcctc

SEQ ID NO: 455168 - DNA, 17 bp, M. musculus
ttcttaataaaattctc

SEQ ID NO: 455169 - DNA, 16 bp, M. musculus
ttcttaattaatgatc

SEQ ID NO: 455170 - DNA, 16 bp, M. musculus
ttcttaattcaaaata

SEQ ID NO: 455171 - DNA, 16 bp, M. musculus
ttcttaattcttaatg

SEQ ID NO: 455172 - DNA, 16 bp, M. musculus
ttcttaatttgtgatt

SEQ ID NO: 455173 - DNA, 16 bp, M. musculus
ttcttaattttgaaaa

SEQ ID NO: 455174 - DNA, 16 bp, M. musculus
ttcttacaaaccaaat

SEQ ID NO: 455175 - DNA, 16 bp, M. musculus
ttcttacacctcaaat

SEQ ID NO: 455176 - DNA, 16 bp, M. musculus
ttcttacatataataa

SEQ ID NO: 455177 - DNA, 17 bp, M. musculus
ttcttacatcttcagga

SEQ ID NO: 455178 - DNA, 16 bp, M. musculus
ttcttactcttgcctc

SEQ ID NO: 455179 - DNA, 16 bp, M. musculus
ttcttactggcttgct

SEQ ID NO: 455180 - DNA, 16 bp, M. musculus
ttcttagaaggggcaa

SEQ ID NO: 455181 - DNA, 16 bp, M. musculus
ttcttagaagggtgaa

SEQ ID NO: 455182 - DNA, 16 bp, M. musculus
ttcttagactttccat

SEQ ID NO: 455183 - DNA, 16 bp, M. musculus
ttcttagatttgatct

SEQ ID NO: 455184 - DNA, 16 bp, M. musculus
ttcttagcacccacat

SEQ ID NO: 455185 - DNA, 16 bp, M. musculus
ttcttagcatcagcaa

SEQ ID NO: 455186 - DNA, 16 bp, M. musculus
ttcttagcccatttat

SEQ ID NO: 455187 - DNA, 16 bp, M. musculus
ttcttagtcaccaggg

SEQ ID NO: 455188 - DNA, 16 bp, M. musculus
ttcttagttaaaaaaa

SEQ ID NO: 455189 - DNA, 16 bp, M. musculus
ttcttataaaactcag

SEQ ID NO: 455190 - DNA, 27 bp, M. musculus
ttcttatagaaccaagactaccagccc

SEQ ID NO: 455191 - DNA, 16 bp, M. musculus
ttcttatagagcccag

SEQ ID NO: 455192 - DNA, 16 bp, M. musculus
ttcttatatacagaag

SEQ ID NO: 455193 - DNA, 16 bp, M. musculus
ttcttatcatacagat

SEQ ID NO: 455194 - DNA, 16 bp, M. musculus
ttcttatggttgattt

SEQ ID NO: 455195 - DNA, 16 bp, M. musculus
ttcttattacaagttg

SEQ ID NO: 455196 - DNA, 16 bp, M. musculus
ttcttattgtgtcctg

SEQ ID NO: 455197 - DNA, 16 bp, M. musculus
ttcttatttttagaaa

SEQ ID NO: 455198 - DNA, 16 bp, M. musculus
ttcttcaaaatgaaaa

SEQ ID NO: 455199 - DNA, 16 bp, M. musculus
ttcttcaagacaaggt

SEQ ID NO: 455200 - DNA, 18 bp, M. musculus
ttcttcaaggaattggaa

SEQ ID NO: 455201 - DNA, 16 bp, M. musculus
ttcttcaatggagtga

SEQ ID NO: 455202 - DNA, 16 bp, M. musculus
ttcttcaatgtctttc

SEQ ID NO: 455203 - DNA, 16 bp, M. musculus
ttcttcaattccttca

SEQ ID NO: 455204 - DNA, 16 bp, M. musculus
ttcttcacaaactatt

SEQ ID NO: 455205 - DNA, 16 bp, M. musculus
ttcttcacacatttaa

SEQ ID NO: 455206 - DNA, 16 bp, M. musculus
ttcttcacctgtttgt

SEQ ID NO: 455207 - DNA, 16 bp, M. musculus
ttcttcactaaaacca

SEQ ID NO: 455208 - DNA, 16 bp, M. musculus
ttcttcagaaactatt

SEQ ID NO: 455209 - DNA, 16 bp, M. musculus
ttcttcagagactgga

SEQ ID NO: 455210 - DNA, 16 bp, M. musculus
ttcttcagctccttca

SEQ ID NO: 455211 - DNA, 16 bp, M. musculus
ttcttcagcttcttcc

SEQ ID NO: 455212 - DNA, 16 bp, M. musculus
ttcttcaggatcagtt

SEQ ID NO: 455213 - DNA, 16 bp, M. musculus
ttcttcaggatctgat

SEQ ID NO: 455214 - DNA, 16 bp, M. musculus
ttcttcaggattccag

SEQ ID NO: 455215 - DNA, 16 bp, M. musculus
ttcttcaggattgaac

SEQ ID NO: 455216 - DNA, 16 bp, M. musculus
ttcttcaggtccacaa

SEQ ID NO: 455217 - DNA, 16 bp, M. musculus
ttcttcagtcttttct

SEQ ID NO: 455218 - DNA, 16 bp, M. musculus
ttcttcagtgtcttaa

SEQ ID NO: 455219 - DNA, 16 bp, M. musculus
ttcttcagtttctact

SEQ ID NO: 455220 - DNA, 16 bp, M. musculus
ttcttcatattgatga

SEQ ID NO: 455221 - DNA, 16 bp, M. musculus
ttcttcatctataaaa

SEQ ID NO: 455222 - DNA, 16 bp, M. musculus
ttcttcatcttggctg

SEQ ID NO: 455223 - DNA, 16 bp, M. musculus
ttcttcatgctgtggt

SEQ ID NO: 455224 - DNA, 16 bp, M. musculus
ttcttcatggctcccc

SEQ ID NO: 455225 - DNA, 16 bp, M. musculus
ttcttcatgtagccct

SEQ ID NO: 455226 - DNA, 16 bp, M. musculus
ttcttcatttacatat

SEQ ID NO: 455227 - DNA, 16 bp, M. musculus
ttcttcattttgaaaa

SEQ ID NO: 455228 - DNA, 16 bp, M. musculus
ttcttccaaaatgact

SEQ ID NO: 455229 - DNA, 16 bp, M. musculus
ttcttccaaattcaag

SEQ ID NO: 455230 - DNA, 16 bp, M. musculus
ttcttccaactcttcc

SEQ ID NO: 455231 - DNA, 16 bp, M. musculus
ttcttccactgcatgg

SEQ ID NO: 455232 - DNA, 16 bp, M. musculus
ttcttccagaagaccc

SEQ ID NO: 455233 - DNA, 16 bp, M. musculus
ttcttccagaggaact

SEQ ID NO: 455234 - DNA, 16 bp, M. musculus
ttcttccagatgtcct

SEQ ID NO: 455235 - DNA, 16 bp, M. musculus
ttcttccatttctgtt

SEQ ID NO: 455236 - DNA, 16 bp, M. musculus
ttcttcccagggatgc

SEQ ID NO: 455237 - DNA, 16 bp, M. musculus
ttcttccctccaaact

SEQ ID NO: 455238 - DNA, 16 bp, M. musculus
ttcttccctgaccatg

SEQ ID NO: 455239 - DNA, 16 bp, M. musculus
ttcttcctaaaccatt

SEQ ID NO: 455240 - DNA, 16 bp, M. musculus
ttcttcctataaggtt

SEQ ID NO: 455241 - DNA, 16 bp, M. musculus
ttcttcctatggggtg

SEQ ID NO: 455242 - DNA, 16 bp, M. musculus
ttcttcctcctctgtg

SEQ ID NO: 455243 - DNA, 16 bp, M. musculus
ttcttcctgcaccatg

SEQ ID NO: 455244 - DNA, 16 bp, M. musculus
ttcttcctgcttctgc

SEQ ID NO: 455245 - DNA, 16 bp, M. musculus
ttcttcctggagagaa

SEQ ID NO: 455246 - DNA, 16 bp, M. musculus
ttcttcctggctggtc

SEQ ID NO: 455247 - DNA, 16 bp, M. musculus
ttcttcctgtatcaca

SEQ ID NO: 455248 - DNA, 16 bp, M. musculus
ttcttccttcagtttc

SEQ ID NO: 455249 - DNA, 16 bp, M. musculus
ttcttcctttgagaaa

SEQ ID NO: 455250 - DNA, 16 bp, M. musculus
ttcttccttttaaaaa

SEQ ID NO: 455251 - DNA, 16 bp, M. musculus
ttcttccttttcagtt

SEQ ID NO: 455252 - DNA, 16 bp, M. musculus
ttcttctaaaattaaa

SEQ ID NO: 455253 - DNA, 16 bp, M. musculus
ttcttctaggctccac

SEQ ID NO: 455254 - DNA, 16 bp, M. musculus
ttcttctatatgcaaa

SEQ ID NO: 455255 - DNA, 16 bp, M. musculus
ttcttctatgttcatg

SEQ ID NO: 455256 - DNA, 16 bp, M. musculus
ttcttctcaaacagtt

SEQ ID NO: 455257 - DNA, 16 bp, M. musculus
ttcttctcagcatctt

SEQ ID NO: 455258 - DNA, 16 bp, M. musculus
ttcttctcagctcctc

SEQ ID NO: 455259 - DNA, 16 bp, M. musculus
ttcttctcagcttctt

SEQ ID NO: 455260 - DNA, 16 bp, M. musculus
ttcttctccagtggca

SEQ ID NO: 455261 - DNA, 16 bp, M. musculus
ttcttctctcacatat

SEQ ID NO: 455262 - DNA, 16 bp, M. musculus
ttcttctctccagcct

SEQ ID NO: 455263 - DNA, 16 bp, M. musculus
ttcttctcttgaggga

SEQ ID NO: 455264 - DNA, 16 bp, M. musculus
ttcttctgcctcagct

SEQ ID NO: 455265 - DNA, 16 bp, M. musculus
ttcttctgcctcctga

SEQ ID NO: 455266 - DNA, 16 bp, M. musculus
ttcttctgcctctgcc

SEQ ID NO: 455267 - DNA, 16 bp, M. musculus
ttcttctggtctctga

SEQ ID NO: 455268 - DNA, 16 bp, M. musculus
ttcttctgtctcagct

SEQ ID NO: 455269 - DNA, 16 bp, M. musculus
ttcttctgtctccatc

SEQ ID NO: 455270 - DNA, 16 bp, M. musculus
ttcttctgttgaagaa

SEQ ID NO: 455271 - DNA, 16 bp, M. musculus
ttcttcttaagtttca

SEQ ID NO: 455272 - DNA, 16 bp, M. musculus
ttcttcttatggggct

SEQ ID NO: 455273 - DNA, 16 bp, M. musculus
ttcttcttgagcttca

SEQ ID NO: 455274 - DNA, 18 bp, M. musculus
ttcttcttgagtttcatg

SEQ ID NO: 455275 - DNA, 16 bp, M. musculus
ttcttcttggaggcat

SEQ ID NO: 455276 - DNA, 16 bp, M. musculus
ttcttctttaaggtct

SEQ ID NO: 455277 - DNA, 16 bp, M. musculus
ttcttcttttccaaat

SEQ ID NO: 455278 - DNA, 16 bp, M. musculus
ttcttgaatattttct

SEQ ID NO: 455279 - DNA, 16 bp, M. musculus
ttcttgactgtggatg

SEQ ID NO: 455280 - DNA, 16 bp, M. musculus
ttcttgagctttttgt

SEQ ID NO: 455281 - DNA, 16 bp, M. musculus
ttcttgagtactttct

SEQ ID NO: 455282 - DNA, 16 bp, M. musculus
ttcttgagtcctttat

SEQ ID NO: 455283 - DNA, 20 bp, M. musculus
ttcttgagttctttatatat

SEQ ID NO: 455284 - DNA, 16 bp, M. musculus
ttcttgagttctttct

SEQ ID NO: 455285 - DNA, 16 bp, M. musculus
ttcttgagttctttgt

SEQ ID NO: 455286 - DNA, 20 bp, M. musculus
ttcttgagtttcatgtgttt

SEQ ID NO: 455287 - DNA, 16 bp, M. musculus
ttcttgagtttgaggc

SEQ ID NO: 455288 - DNA, 16 bp, M. musculus
ttcttgatattacagc

SEQ ID NO: 455289 - DNA, 16 bp, M. musculus
ttcttgatctcagagc

SEQ ID NO: 455290 - DNA, 16 bp, M. musculus
ttcttgatcttagacc

SEQ ID NO: 455291 - DNA, 16 bp, M. musculus
ttcttgatctttccaa

SEQ ID NO: 455292 - DNA, 16 bp, M. musculus
ttcttgatgccatttc

SEQ ID NO: 455293 - DNA, 16 bp, M. musculus
ttcttgatggaaaaag

SEQ ID NO: 455294 - DNA, 16 bp, M. musculus
ttcttgattctttgtg

SEQ ID NO: 455295 - DNA, 16 bp, M. musculus
ttcttgattttaaaat

SEQ ID NO: 455296 - DNA, 16 bp, M. musculus
ttcttgattttcctgt

SEQ ID NO: 455297 - DNA, 16 bp, M. musculus
ttcttgcaaactaaat

SEQ ID NO: 455298 - DNA, 16 bp, M. musculus
ttcttgcagaagaccc

SEQ ID NO: 455299 - DNA, 16 bp, M. musculus
ttcttgcagaggaccc

SEQ ID NO: 455300 - DNA, 16 bp, M. musculus
ttcttgcattctttct

SEQ ID NO: 455301 - DNA, 16 bp, M. musculus
ttcttgcccagtggct

SEQ ID NO: 455302 - DNA, 16 bp, M. musculus
ttcttgcccatggaat

SEQ ID NO: 455303 - DNA, 16 bp, M. musculus
ttcttgccgggcagtg

SEQ ID NO: 455304 - DNA, 16 bp, M. musculus
ttcttgcctccaagtt

SEQ ID NO: 455305 - DNA, 16 bp, M. musculus
ttcttgccttgatatt

SEQ ID NO: 455306 - DNA, 16 bp, M. musculus
ttcttgctcatgggat

SEQ ID NO: 455307 - DNA, 16 bp, M. musculus
ttcttgctgctgctgc

SEQ ID NO: 455308 - DNA, 16 bp, M. musculus
ttcttgctgctgtctt

SEQ ID NO: 455309 - DNA, 16 bp, M. musculus
ttcttgctgcttctgt

SEQ ID NO: 455310 - DNA, 16 bp, M. musculus
ttcttgctggaggtgg

SEQ ID NO: 455311 - DNA, 16 bp, M. musculus
ttcttgctggcaagtc

SEQ ID NO: 455312 - DNA, 16 bp, M. musculus
ttcttgctgtcctgga

SEQ ID NO: 455313 - DNA, 16 bp, M. musculus
ttcttggaaacagatt

SEQ ID NO: 455314 - DNA, 16 bp, M. musculus
ttcttggaccaaggag

SEQ ID NO: 455315 - DNA, 16 bp, M. musculus
ttcttggattaggtta

SEQ ID NO: 455316 - DNA, 16 bp, M. musculus
ttcttggccatggtgt

SEQ ID NO: 455317 - DNA, 16 bp, M. musculus
ttcttggccccggtgt

SEQ ID NO: 455318 - DNA, 16 bp, M. musculus
ttcttggctaggggtg

SEQ ID NO: 455319 - DNA, 16 bp, M. musculus
ttcttggctcctccag

SEQ ID NO: 455320 - DNA, 17 bp, M. musculus
ttcttgggctctgtggt

SEQ ID NO: 455321 - DNA, 16 bp, M. musculus
ttcttgggctggtggt

SEQ ID NO: 455322 - DNA, 16 bp, M. musculus
ttcttggggaatcacc

SEQ ID NO: 455323 - DNA, 16 bp, M. musculus
ttcttggggctggaga

SEQ ID NO: 455324 - DNA, 16 bp, M. musculus
ttcttgggggaggggg

SEQ ID NO: 455325 - DNA, 33 bp, M. musculus
ttcttggtcatgatgtttgtgcaggaatagaaa

SEQ ID NO: 455326 - DNA, 33 bp, M. musculus
ttcttggtcatgatgtttgtgcaggaatagaag

SEQ ID NO: 455327 - DNA, 16 bp, M. musculus
ttcttggtgatgaaca

SEQ ID NO: 455328 - DNA, 16 bp, M. musculus
ttcttggtggacacag

SEQ ID NO: 455329 - DNA, 16 bp, M. musculus
ttcttggtgtcctcta

SEQ ID NO: 455330 - DNA, 16 bp, M. musculus
ttcttggttacaaaag

SEQ ID NO: 455331 - DNA, 16 bp, M. musculus
ttcttggttttttgag

SEQ ID NO: 455332 - DNA, 16 bp, M. musculus
ttcttgtaaagcttgt

SEQ ID NO: 455333 - DNA, 16 bp, M. musculus
ttcttgtaaaggtatt

SEQ ID NO: 455334 - DNA, 16 bp, M. musculus
ttcttgtagaacccag

SEQ ID NO: 455335 - DNA, 16 bp, M. musculus
ttcttgtatatttata

SEQ ID NO: 455336 - DNA, 16 bp, M. musculus
ttcttgtatgtagcaa

SEQ ID NO: 455337 - DNA, 16 bp, M. musculus
ttcttgtcagaacaac

SEQ ID NO: 455338 - DNA, 16 bp, M. musculus
ttcttgtccttgcctc

SEQ ID NO: 455339 - DNA, 16 bp, M. musculus
ttcttgtcttgacttc

SEQ ID NO: 455340 - DNA, 16 bp, M. musculus
ttcttgtgactgtctt

SEQ ID NO: 455341 - DNA, 16 bp, M. musculus
ttcttgtgggactctt

SEQ ID NO: 455342 - DNA, 16 bp, M. musculus
ttcttgtgtaaggcct

SEQ ID NO: 455343 - DNA, 16 bp, M. musculus
ttcttgtgtgtatgtg

SEQ ID NO: 455344 - DNA, 16 bp, M. musculus
ttcttgtgtgtgtgag

SEQ ID NO: 455345 - DNA, 16 bp, M. musculus
ttcttgttatacagat

SEQ ID NO: 455346 - DNA, 16 bp, M. musculus
ttcttgttttaaaatt

SEQ ID NO: 455347 - DNA, 16 bp, M. musculus
ttcttgttttttgaga

SEQ ID NO: 455348 - DNA, 16 bp, M. musculus
ttctttaaaaaacaca

SEQ ID NO: 455349 - DNA, 16 bp, M. musculus
ttctttaaaaaagaaa

SEQ ID NO: 455350 - DNA, 16 bp, M. musculus
ttctttaaaaaattgg

SEQ ID NO: 455351 - DNA, 16 bp, M. musculus
ttctttaaaaacaaag

SEQ ID NO: 455352 - DNA, 16 bp, M. musculus
ttctttaaaatgtata

SEQ ID NO: 455353 - DNA, 16 bp, M. musculus
ttctttaaagaagaaa

SEQ ID NO: 455354 - DNA, 16 bp, M. musculus
ttctttaaagaggaaa

SEQ ID NO: 455355 - DNA, 16 bp, M. musculus
ttctttaaaggatttt

SEQ ID NO: 455356 - DNA, 16 bp, M. musculus
ttctttaaagttcttt

SEQ ID NO: 455357 - DNA, 16 bp, M. musculus
ttctttaagaatttta

SEQ ID NO: 455358 - DNA, 16 bp, M. musculus
ttctttaagcatttct

SEQ ID NO: 455359 - DNA, 16 bp, M. musculus
ttctttaaggaaaaaa

SEQ ID NO: 455360 - DNA, 16 bp, M. musculus
ttctttaaggaattct

SEQ ID NO: 455361 - DNA, 16 bp, M. musculus
ttctttaagggtgtgg

SEQ ID NO: 455362 - DNA, 16 bp, M. musculus
ttctttaatgactgtg

SEQ ID NO: 455363 - DNA, 16 bp, M. musculus
ttctttacacacacac

SEQ ID NO: 455364 - DNA, 16 bp, M. musculus
ttctttactggtttgc

SEQ ID NO: 455365 - DNA, 16 bp, M. musculus
ttctttaggaaagcag

SEQ ID NO: 455366 - DNA, 16 bp, M. musculus
ttctttaggtctgtgg

SEQ ID NO: 455367 - DNA, 16 bp, M. musculus
ttctttaggtttggga

SEQ ID NO: 455368 - DNA, 16 bp, M. musculus
ttctttataaaagcaa

SEQ ID NO: 455369 - DNA, 16 bp, M. musculus
ttctttatatgcattt

SEQ ID NO: 455370 - DNA, 16 bp, M. musculus
ttctttatatgtatat

SEQ ID NO: 455371 - DNA, 16 bp, M. musculus
ttctttatatgtattg

SEQ ID NO: 455372 - DNA, 16 bp, M. musculus
ttctttatattttgaa

SEQ ID NO: 455373 - DNA, 16 bp, M. musculus
ttctttatgcattctt

SEQ ID NO: 455374 - DNA, 16 bp, M. musculus
ttctttatggaatttt

SEQ ID NO: 455375 - DNA, 16 bp, M. musculus
ttctttatgggatata

SEQ ID NO: 455376 - DNA, 16 bp, M. musculus
ttctttatttaaaaga

SEQ ID NO: 455377 - DNA, 16 bp, M. musculus
ttctttcaaaaagaaa

SEQ ID NO: 455378 - DNA, 16 bp, M. musculus
ttctttcaaatgaaaa

SEQ ID NO: 455379 - DNA, 16 bp, M. musculus
ttctttcaaatgtttt

SEQ ID NO: 455380 - DNA, 16 bp, M. musculus
ttctttcagccttccc

SEQ ID NO: 455381 - DNA, 16 bp, M. musculus
ttctttcagttgcttg

SEQ ID NO: 455382 - DNA, 16 bp, M. musculus
ttctttcatgtgtgtg

SEQ ID NO: 455383 - DNA, 16 bp, M. musculus
ttctttccagcttatg

SEQ ID NO: 455384 - DNA, 16 bp, M. musculus
ttctttccagttggaa

SEQ ID NO: 455385 - DNA, 16 bp, M. musculus
ttctttccctcaggct

SEQ ID NO: 455386 - DNA, 16 bp, M. musculus
ttctttcccttttgta

SEQ ID NO: 455387 - DNA, 16 bp, M. musculus
ttctttcctcttggcc

SEQ ID NO: 455388 - DNA, 16 bp, M. musculus
ttctttctaccatgtg

SEQ ID NO: 455389 - DNA, 16 bp, M. musculus
ttctttctaccttctg

SEQ ID NO: 455390 - DNA, 16 bp, M. musculus
ttctttctcagcatgt

SEQ ID NO: 455391 - DNA, 16 bp, M. musculus
ttctttctcagcctgg

SEQ ID NO: 455392 - DNA, 16 bp, M. musculus
ttctttctcagtgttt

SEQ ID NO: 455393 - DNA, 16 bp, M. musculus
ttctttctgacctctg

SEQ ID NO: 455394 - DNA, 16 bp, M. musculus
ttctttctgatggccc

SEQ ID NO: 455395 - DNA, 16 bp, M. musculus
ttctttctgtgtgtat

SEQ ID NO: 455396 - DNA, 16 bp, M. musculus
ttctttcttaaaaaat

SEQ ID NO: 455397 - DNA, 16 bp, M. musculus
ttctttcttcaaagac

SEQ ID NO: 455398 - DNA, 16 bp, M. musculus
ttctttcttcaagagg

SEQ ID NO: 455399 - DNA, 16 bp, M. musculus
ttctttcttcacagac

SEQ ID NO: 455400 - DNA, 16 bp, M. musculus
ttctttcttcagaaaa

SEQ ID NO: 455401 - DNA, 16 bp, M. musculus
ttctttcttcagagaa

SEQ ID NO: 455402 - DNA, 16 bp, M. musculus
ttctttcttctttgag

SEQ ID NO: 455403 - DNA, 16 bp, M. musculus
ttctttcttgtgtcta

SEQ ID NO: 455404 - DNA, 16 bp, M. musculus
ttctttctttaaatgt

SEQ ID NO: 455405 - DNA, 16 bp, M. musculus
ttctttctttcctgac

SEQ ID NO: 455406 - DNA, 16 bp, M. musculus
ttctttctttgaaaat

SEQ ID NO: 455407 - DNA, 16 bp, M. musculus
ttctttcttttcaaga

SEQ ID NO: 455408 - DNA, 16 bp, M. musculus
ttctttcttttctaga

SEQ ID NO: 455409 - DNA, 16 bp, M. musculus
ttctttgaaaaatttt

SEQ ID NO: 455410 - DNA, 16 bp, M. musculus
ttctttgaaggtctaa

SEQ ID NO: 455411 - DNA, 16 bp, M. musculus
ttctttgaaggtctga

SEQ ID NO: 455412 - DNA, 16 bp, M. musculus
ttctttgaaggtctgt

SEQ ID NO: 455413 - DNA, 16 bp, M. musculus
ttctttgaatgaacac

SEQ ID NO: 455414 - DNA, 16 bp, M. musculus
ttctttgaatgtgttt

SEQ ID NO: 455415 - DNA, 16 bp, M. musculus
ttctttgaccattgtg

SEQ ID NO: 455416 - DNA, 16 bp, M. musculus
ttctttgagaacttca

SEQ ID NO: 455417 - DNA, 16 bp, M. musculus
ttctttgagaatttta

SEQ ID NO: 455418 - DNA, 16 bp, M. musculus
ttctttgagacaggat

SEQ ID NO: 455419 - DNA, 16 bp, M. musculus
ttctttgagacatggt

SEQ ID NO: 455420 - DNA, 16 bp, M. musculus
ttctttgagctgggaa

SEQ ID NO: 455421 - DNA, 16 bp, M. musculus
ttctttgagtcagggt

SEQ ID NO: 455422 - DNA, 16 bp, M. musculus
ttctttgcatatatat

SEQ ID NO: 455423 - DNA, 16 bp, M. musculus
ttctttgccaaaatat

SEQ ID NO: 455424 - DNA, 16 bp, M. musculus
ttctttgcctgcttgc

SEQ ID NO: 455425 - DNA, 16 bp, M. musculus
ttctttgccttttaaa

SEQ ID NO: 455426 - DNA, 16 bp, M. musculus
ttctttgcttacaaat

SEQ ID NO: 455427 - DNA, 16 bp, M. musculus
ttctttgcttgcaaat

SEQ ID NO: 455428 - DNA, 16 bp, M. musculus
ttctttgctttttaaa

SEQ ID NO: 455429 - DNA, 16 bp, M. musculus
ttctttggaaaatcag

SEQ ID NO: 455430 - DNA, 16 bp, M. musculus
ttctttggaaagtcag

SEQ ID NO: 455431 - DNA, 16 bp, M. musculus
ttctttggagcaaatc

SEQ ID NO: 455432 - DNA, 16 bp, M. musculus
ttctttgggaagtcag

SEQ ID NO: 455433 - DNA, 16 bp, M. musculus
ttctttgtaaaatatt

SEQ ID NO: 455434 - DNA, 16 bp, M. musculus
ttctttgtaagagttg

SEQ ID NO: 455435 - DNA, 16 bp, M. musculus
ttctttgtacagttct

SEQ ID NO: 455436 - DNA, 16 bp, M. musculus
ttctttgtagctctgg

SEQ ID NO: 455437 - DNA, 16 bp, M. musculus
ttctttgtctacctca

SEQ ID NO: 455438 - DNA, 16 bp, M. musculus
ttctttgtgaaaaaaa

SEQ ID NO: 455439 - DNA, 16 bp, M. musculus
ttctttgtgaacttca

SEQ ID NO: 455440 - DNA, 17 bp, M. musculus
ttctttgtgaatgtgtt

SEQ ID NO: 455441 - DNA, 16 bp, M. musculus
ttctttgtgaatttca

SEQ ID NO: 455442 - DNA, 16 bp, M. musculus
ttctttgtgagtgtgt

SEQ ID NO: 455443 - DNA, 16 bp, M. musculus
ttctttgtgtcccata

SEQ ID NO: 455444 - DNA, 16 bp, M. musculus
ttctttgttcagcttt

SEQ ID NO: 455445 - DNA, 16 bp, M. musculus
ttctttgttcatctct

SEQ ID NO: 455446 - DNA, 16 bp, M. musculus
ttctttgtttgaaaag

SEQ ID NO: 455447 - DNA, 16 bp, M. musculus
ttcttttaaaaagtag

SEQ ID NO: 455448 - DNA, 16 bp, M. musculus
ttcttttaaaagaatt

SEQ ID NO: 455449 - DNA, 16 bp, M. musculus
ttcttttaaaagcttt

SEQ ID NO: 455450 - DNA, 16 bp, M. musculus
ttcttttaaaatttgt

SEQ ID NO: 455451 - DNA, 16 bp, M. musculus
ttcttttaagaattat

SEQ ID NO: 455452 - DNA, 16 bp, M. musculus
ttcttttaataaaaca

SEQ ID NO: 455453 - DNA, 16 bp, M. musculus
ttcttttacatttcaa

SEQ ID NO: 455454 - DNA, 16 bp, M. musculus
ttcttttacttaaaaa

SEQ ID NO: 455455 - DNA, 16 bp, M. musculus
ttcttttagaaaggaa

SEQ ID NO: 455456 - DNA, 16 bp, M. musculus
ttcttttagacaggaa

SEQ ID NO: 455457 - DNA, 16 bp, M. musculus
ttcttttagacaggga

SEQ ID NO: 455458 - DNA, 16 bp, M. musculus
ttcttttataagttgc

SEQ ID NO: 455459 - DNA, 16 bp, M. musculus
ttcttttatatgttgc

SEQ ID NO: 455460 - DNA, 16 bp, M. musculus
ttcttttatgtatatg

SEQ ID NO: 455461 - DNA, 16 bp, M. musculus
ttcttttatgtgagga

SEQ ID NO: 455462 - DNA, 16 bp, M. musculus
ttcttttattattcag

SEQ ID NO: 455463 - DNA, 16 bp, M. musculus
ttcttttatttaaaga

SEQ ID NO: 455464 - DNA, 16 bp, M. musculus
ttcttttattttgcaa

SEQ ID NO: 455465 - DNA, 16 bp, M. musculus
ttcttttcaaagaaaa

SEQ ID NO: 455466 - DNA, 16 bp, M. musculus
ttcttttcagaaaaga

SEQ ID NO: 455467 - DNA, 16 bp, M. musculus
ttcttttcagcttctg

SEQ ID NO: 455468 - DNA, 16 bp, M. musculus
ttcttttcatcagaga

SEQ ID NO: 455469 - DNA, 16 bp, M. musculus
ttcttttccactgaaa

SEQ ID NO: 455470 - DNA, 16 bp, M. musculus
ttcttttcctttcaga

SEQ ID NO: 455471 - DNA, 16 bp, M. musculus
ttcttttcctttctag

SEQ ID NO: 455472 - DNA, 16 bp, M. musculus
ttcttttctggtctca

SEQ ID NO: 455473 - DNA, 16 bp, M. musculus
ttcttttctgtaaaat

SEQ ID NO: 455474 - DNA, 16 bp, M. musculus
ttcttttctttgaaag

SEQ ID NO: 455475 - DNA, 16 bp, M. musculus
ttcttttctttgtaaa

SEQ ID NO: 455476 - DNA, 16 bp, M. musculus
ttcttttcttttaaga

SEQ ID NO: 455477 - DNA, 16 bp, M. musculus
ttcttttgaaaataat

SEQ ID NO: 455478 - DNA, 16 bp, M. musculus
ttcttttgaagaaaat

SEQ ID NO: 455479 - DNA, 16 bp, M. musculus
ttcttttgagtttctg

SEQ ID NO: 455480 - DNA, 16 bp, M. musculus
ttcttttgcaatatta

SEQ ID NO: 455481 - DNA, 16 bp, M. musculus
ttcttttggcctctgt

SEQ ID NO: 455482 - DNA, 16 bp, M. musculus
ttcttttgggaggcac

SEQ ID NO: 455483 - DNA, 16 bp, M. musculus
ttcttttggggggagg

SEQ ID NO: 455484 - DNA, 16 bp, M. musculus
ttcttttggtcatggt

SEQ ID NO: 455485 - DNA, 16 bp, M. musculus
ttcttttgtattaaaa

SEQ ID NO: 455486 - DNA, 16 bp, M. musculus
ttcttttgttactgag

SEQ ID NO: 455487 - DNA, 16 bp, M. musculus
ttcttttgttttgaga

SEQ ID NO: 455488 - DNA, 16 bp, M. musculus
ttctttttaaaaacat

SEQ ID NO: 455489 - DNA, 16 bp, M. musculus
ttctttttaaagaaat

SEQ ID NO: 455490 - DNA, 16 bp, M. musculus
ttctttttaaagaatg

SEQ ID NO: 455491 - DNA, 16 bp, M. musculus
ttctttttaaatcaaa

SEQ ID NO: 455492 - DNA, 16 bp, M. musculus
ttctttttaaatgatt

SEQ ID NO: 455493 - DNA, 16 bp, M. musculus
ttctttttaagaaaaa

SEQ ID NO: 455494 - DNA, 16 bp, M. musculus
ttctttttaatagaaa

SEQ ID NO: 455495 - DNA, 16 bp, M. musculus
ttctttttcaaataaa

SEQ ID NO: 455496 - DNA, 16 bp, M. musculus
ttctttttcaataaaa

SEQ ID NO: 455497 - DNA, 16 bp, M. musculus
ttctttttcctgggct

SEQ ID NO: 455498 - DNA, 16 bp, M. musculus
ttctttttctcaaaaa

SEQ ID NO: 455499 - DNA, 16 bp, M. musculus
ttctttttctcagaaa

SEQ ID NO: 455500 - DNA, 16 bp, M. musculus
ttctttttctctaaaa

SEQ ID NO: 455501 - DNA, 16 bp, M. musculus
ttctttttctgagaca

SEQ ID NO: 455502 - DNA, 16 bp, M. musculus
ttcttttttaaaaaag

SEQ ID NO: 455503 - DNA, 16 bp, M. musculus
ttcttttttaaaaaca

SEQ ID NO: 455504 - DNA, 16 bp, M. musculus
ttcttttttaaaattg

SEQ ID NO: 455505 - DNA, 16 bp, M. musculus
ttcttttttaaattga

SEQ ID NO: 455506 - DNA, 16 bp, M. musculus
ttcttttttaatagct

SEQ ID NO: 455507 - DNA, 16 bp, M. musculus
ttcttttttctcagcc

SEQ ID NO: 455508 - DNA, 16 bp, M. musculus
ttctttttttaaaaag

SEQ ID NO: 455509 - DNA, 16 bp, M. musculus
ttctttttttcctgag

SEQ ID NO: 455510 - DNA, 16 bp, M. musculus
ttgaaaaaaacaggaa

SEQ ID NO: 455511 - DNA, 16 bp, M. musculus
ttgaaaaaaatacttt

SEQ ID NO: 455512 - DNA, 16 bp, M. musculus
ttgaaaaaaattacaa

SEQ ID NO: 455513 - DNA, 16 bp, M. musculus
ttgaaaaaatcaacaa

SEQ ID NO: 455514 - DNA, 16 bp, M. musculus
ttgaaaaacaaaacca

SEQ ID NO: 455515 - DNA, 16 bp, M. musculus
ttgaaaaacaggaatt

SEQ ID NO: 455516 - DNA, 16 bp, M. musculus
ttgaaaaaccaaaaag

SEQ ID NO: 455517 - DNA, 16 bp, M. musculus
ttgaaaaaccacacac

SEQ ID NO: 455518 - DNA, 16 bp, M. musculus
ttgaaaaacctaaaaa

SEQ ID NO: 455519 - DNA, 16 bp, M. musculus
ttgaaaaagaaaagca

SEQ ID NO: 455520 - DNA, 16 bp, M. musculus
ttgaaaaatattttgt

SEQ ID NO: 455521 - DNA, 16 bp, M. musculus
ttgaaaacaatgaatt

SEQ ID NO: 455522 - DNA, 16 bp, M. musculus
ttgaaaacataaagaa

SEQ ID NO: 455523 - DNA, 16 bp, M. musculus
ttgaaaacatttttat

SEQ ID NO: 455524 - DNA, 16 bp, M. musculus
ttgaaaaccaaaccaa

SEQ ID NO: 455525 - DNA, 16 bp, M. musculus
ttgaaaaccaattttt

SEQ ID NO: 455526 - DNA, 16 bp, M. musculus
ttgaaaagcaaaacaa

SEQ ID NO: 455527 - DNA, 16 bp, M. musculus
ttgaaaagctacatga

SEQ ID NO: 455528 - DNA, 16 bp, M. musculus
ttgaaaataaagtttt

SEQ ID NO: 455529 - DNA, 16 bp, M. musculus
ttgaaaataaatcttt

SEQ ID NO: 455530 - DNA, 16 bp, M. musculus
ttgaaaataacttttt

SEQ ID NO: 455531 - DNA, 16 bp, M. musculus
ttgaaaatacaaaata

SEQ ID NO: 455532 - DNA, 16 bp, M. musculus
ttgaaaatactttctt

SEQ ID NO: 455533 - DNA, 16 bp, M. musculus
ttgaaaatatacatat

SEQ ID NO: 455534 - DNA, 16 bp, M. musculus
ttgaaaatatgaagta

SEQ ID NO: 455535 - DNA, 16 bp, M. musculus
ttgaaaatatgtattt

SEQ ID NO: 455536 - DNA, 16 bp, M. musculus
ttgaaaatatttttct

SEQ ID NO: 455537 - DNA, 16 bp, M. musculus
ttgaaaatcaaaacaa

SEQ ID NO: 455538 - DNA, 17 bp, M. musculus
ttgaaaatgctgtcatt

SEQ ID NO: 455539 - DNA, 16 bp, M. musculus
ttgaaaatgctttcct

SEQ ID NO: 455540 - DNA, 16 bp, M. musculus
ttgaaaatgttatctt

SEQ ID NO: 455541 - DNA, 16 bp, M. musculus
ttgaaaatgttttcat

SEQ ID NO: 455542 - DNA, 16 bp, M. musculus
ttgaaaattaaaacta

SEQ ID NO: 455543 - DNA, 16 bp, M. musculus
ttgaaaattctattta

SEQ ID NO: 455544 - DNA, 16 bp, M. musculus
ttgaaaattgttcttt

SEQ ID NO: 455545 - DNA, 16 bp, M. musculus
ttgaaaattttataca

SEQ ID NO: 455546 - DNA, 16 bp, M. musculus
ttgaaaattttcattt

SEQ ID NO: 455547 - DNA, 16 bp, M. musculus
ttgaaaattttctttt

SEQ ID NO: 455548 - DNA, 16 bp, M. musculus
ttgaaacaaagaaaac

SEQ ID NO: 455549 - DNA, 16 bp, M. musculus
ttgaaacaggatcttt

SEQ ID NO: 455550 - DNA, 16 bp, M. musculus
ttgaaaccagcctggg

SEQ ID NO: 455551 - DNA, 16 bp, M. musculus
ttgaaactcaagaaga

SEQ ID NO: 455552 - DNA, 16 bp, M. musculus
ttgaaactttaaagcc

SEQ ID NO: 455553 - DNA, 16 bp, M. musculus
ttgaaagaattttatt

SEQ ID NO: 455554 - DNA, 16 bp, M. musculus
ttgaaagatattaaag

SEQ ID NO: 455555 - DNA, 16 bp, M. musculus
ttgaaagatgatttta

SEQ ID NO: 455556 - DNA, 16 bp, M. musculus
ttgaaagatggctcag

SEQ ID NO: 455557 - DNA, 16 bp, M. musculus
ttgaaagccatcttat

SEQ ID NO: 455558 - DNA, 16 bp, M. musculus
ttgaaagctactcatg

SEQ ID NO: 455559 - DNA, 17 bp, M. musculus
ttgaaaggaccctgata

SEQ ID NO: 455560 - DNA, 35 bp, M. musculus
ttgaaaggttcctgaataaactgctttgagaagaa

SEQ ID NO: 455561 - DNA, 16 bp, M. musculus
ttgaaagtgtgtgtgt

SEQ ID NO: 455562 - DNA, 16 bp, M. musculus
ttgaaagttgtcttct

SEQ ID NO: 455563 - DNA, 16 bp, M. musculus
ttgaaataaaatttca

SEQ ID NO: 455564 - DNA, 16 bp, M. musculus
ttgaaatacaaataaa

SEQ ID NO: 455565 - DNA, 16 bp, M. musculus
ttgaaatatcaaaata

SEQ ID NO: 455566 - DNA, 16 bp, M. musculus
ttgaaatattattttc

SEQ ID NO: 455567 - DNA, 16 bp, M. musculus
ttgaaatcagggatgg

SEQ ID NO: 455568 - DNA, 16 bp, M. musculus
ttgaaatgcaaataaa

SEQ ID NO: 455569 - DNA, 16 bp, M. musculus
ttgaaatggacaaatt

SEQ ID NO: 455570 - DNA, 16 bp, M. musculus
ttgaaatgtaaaagaa

SEQ ID NO: 455571 - DNA, 16 bp, M. musculus
ttgaaatgtaaataat

SEQ ID NO: 455572 - DNA, 16 bp, M. musculus
ttgaaatgtaattaaa

SEQ ID NO: 455573 - DNA, 16 bp, M. musculus
ttgaaatgtatgtaaa

SEQ ID NO: 455574 - DNA, 16 bp, M. musculus
ttgaaatgtgaatgaa

SEQ ID NO: 455575 - DNA, 16 bp, M. musculus
ttgaaattataatgta

SEQ ID NO: 455576 - DNA, 16 bp, M. musculus
ttgaaattatccaatg

SEQ ID NO: 455577 - DNA, 16 bp, M. musculus
ttgaaatttatttctt

SEQ ID NO: 455578 - DNA, 16 bp, M. musculus
ttgaaatttcaaaagc

SEQ ID NO: 455579 - DNA, 16 bp, M. musculus
ttgaaattttatttct

SEQ ID NO: 455580 - DNA, 16 bp, M. musculus
ttgaaattttcaaaat

SEQ ID NO: 455581 - DNA, 16 bp, M. musculus
ttgaacaagcctatga

SEQ ID NO: 455582 - DNA, 16 bp, M. musculus
ttgaacacaggacctc

SEQ ID NO: 455583 - DNA, 16 bp, M. musculus
ttgaacacaggacctt

SEQ ID NO: 455584 - DNA, 16 bp, M. musculus
ttgaacacatctggaa

SEQ ID NO: 455585 - DNA, 16 bp, M. musculus
ttgaacagcacagaaa

SEQ ID NO: 455586 - DNA, 16 bp, M. musculus
ttgaacatgtttttag

SEQ ID NO: 455587 - DNA, 16 bp, M. musculus
ttgaacatttctgtag

SEQ ID NO: 455588 - DNA, 16 bp, M. musculus
ttgaacccacagagat

SEQ ID NO: 455589 - DNA, 16 bp, M. musculus
ttgaacccagagcttc

SEQ ID NO: 455590 - DNA, 16 bp, M. musculus
ttgaacccagggcttt

SEQ ID NO: 455591 - DNA, 16 bp, M. musculus
ttgaactcaaagaaat

SEQ ID NO: 455592 - DNA, 16 bp, M. musculus
ttgaactcaagagatc

SEQ ID NO: 455593 - DNA, 16 bp, M. musculus
ttgaactcaagtcctc

SEQ ID NO: 455594 - DNA, 16 bp, M. musculus
ttgaactcacaatcct

SEQ ID NO: 455595 - DNA, 16 bp, M. musculus
ttgaactcacagatat

SEQ ID NO: 455596 - DNA, 16 bp, M. musculus
ttgaactcacaggaat

SEQ ID NO: 455597 - DNA, 16 bp, M. musculus
ttgaactcactgtgta

SEQ ID NO: 455598 - DNA, 16 bp, M. musculus
ttgaactcagaaactc

SEQ ID NO: 455599 - DNA, 16 bp, M. musculus
ttgaactcagaacctc

SEQ ID NO: 455600 - DNA, 16 bp, M. musculus
ttgaactcagagatat

SEQ ID NO: 455601 - DNA, 16 bp, M. musculus
ttgaactcagctcttc

SEQ ID NO: 455602 - DNA, 16 bp, M. musculus
ttgaactcaggacccc

SEQ ID NO: 455603 - DNA, 16 bp, M. musculus
ttgaactcaggaccta

SEQ ID NO: 455604 - DNA, 16 bp, M. musculus
ttgaactcaggacctc

SEQ ID NO: 455605 - DNA, 16 bp, M. musculus
ttgaactcaggacctt

SEQ ID NO: 455606 - DNA, 17 bp, M. musculus
ttgaactcaggaccttc

SEQ ID NO: 455607 - DNA, 30 bp, M. musculus
ttgaactcaggacctttggaagagcagtca

SEQ ID NO: 455608 - DNA, 16 bp, M. musculus
ttgaactcaggtcctc

SEQ ID NO: 455609 - DNA, 16 bp, M. musculus
ttgaactcatagagat

SEQ ID NO: 455610 - DNA, 16 bp, M. musculus
ttgaactcatagatcc

SEQ ID NO: 455611 - DNA, 16 bp, M. musculus
ttgaactcatgacctt

SEQ ID NO: 455612 - DNA, 16 bp, M. musculus
ttgaactcatgatcct

SEQ ID NO: 455613 - DNA, 16 bp, M. musculus
ttgaactcatggcaat

SEQ ID NO: 455614 - DNA, 17 bp, M. musculus
ttgaactcattggcaca

SEQ ID NO: 455615 - DNA, 40 bp, M. musculus
ttgaactcctgaccttcggaagagcagtcgggtgctctta

SEQ ID NO: 455616 - DNA, 16 bp, M. musculus
ttgaactcctgatctt

SEQ ID NO: 455617 - DNA, 16 bp, M. musculus
ttgaactcctgattct

SEQ ID NO: 455618 - DNA, 16 bp, M. musculus
ttgaactcctgatttt

SEQ ID NO: 455619 - DNA, 16 bp, M. musculus
ttgaactcctggtctt

SEQ ID NO: 455620 - DNA, 16 bp, M. musculus
ttgaactctccatcct

SEQ ID NO: 455621 - DNA, 16 bp, M. musculus
ttgaactctggtcctc

SEQ ID NO: 455622 - DNA, 16 bp, M. musculus
ttgaactcttgattct

SEQ ID NO: 455623 - DNA, 16 bp, M. musculus
ttgaacttactttgta

SEQ ID NO: 455624 - DNA, 16 bp, M. musculus
ttgaacttaggacctc

SEQ ID NO: 455625 - DNA, 16 bp, M. musculus
ttgaacttataatgaa

SEQ ID NO: 455626 - DNA, 16 bp, M. musculus
ttgaacttctgatcct

SEQ ID NO: 455627 - DNA, 16 bp, M. musculus
ttgaacttctgatctt

SEQ ID NO: 455628 - DNA, 16 bp, M. musculus
ttgaacttctggtctt

SEQ ID NO: 455629 - DNA, 16 bp, M. musculus
ttgaacttgagacctt

SEQ ID NO: 455630 - DNA, 16 bp, M. musculus
ttgaacttgggtcctt

SEQ ID NO: 455631 - DNA, 16 bp, M. musculus
ttgaacttgggttctc

SEQ ID NO: 455632 - DNA, 16 bp, M. musculus
ttgaactttggacttt

SEQ ID NO: 455633 - DNA, 16 bp, M. musculus
ttgaagaaaacctcag

SEQ ID NO: 455634 - DNA, 16 bp, M. musculus
ttgaagaaagaaactg

SEQ ID NO: 455635 - DNA, 16 bp, M. musculus
ttgaagaaagaacaag

SEQ ID NO: 455636 - DNA, 16 bp, M. musculus
ttgaagaaagaagttg

SEQ ID NO: 455637 - DNA, 16 bp, M. musculus
ttgaagaaaggagatt

SEQ ID NO: 455638 - DNA, 20 bp, M. musculus
ttgaagaacaattgttagaa

SEQ ID NO: 455639 - DNA, 16 bp, M. musculus
ttgaagaaccagaaat

SEQ ID NO: 455640 - DNA, 16 bp, M. musculus
ttgaagaactggaatt

SEQ ID NO: 455641 - DNA, 16 bp, M. musculus
ttgaagaagatttcag

SEQ ID NO: 455642 - DNA, 16 bp, M. musculus
ttgaagaagctgaagg

SEQ ID NO: 455643 - DNA, 16 bp, M. musculus
ttgaagaagctttctt

SEQ ID NO: 455644 - DNA, 16 bp, M. musculus
ttgaagaagttatgaa

SEQ ID NO: 455645 - DNA, 16 bp, M. musculus
ttgaagaattactttc

SEQ ID NO: 455646 - DNA, 18 bp, M. musculus
ttgaagacagctacagtg

SEQ ID NO: 455647 - DNA, 16 bp, M. musculus
ttgaagaccaagaaat

SEQ ID NO: 455648 - DNA, 16 bp, M. musculus
ttgaagacccaggaat

SEQ ID NO: 455649 - DNA, 16 bp, M. musculus
ttgaagagccagaaat

SEQ ID NO: 455650 - DNA, 16 bp, M. musculus
ttgaagaggaacagtg

SEQ ID NO: 455651 - DNA, 16 bp, M. musculus
ttgaagaggacccagg

SEQ ID NO: 455652 - DNA, 16 bp, M. musculus
ttgaagataatggact

SEQ ID NO: 455653 - DNA, 16 bp, M. musculus
ttgaagatatatatat

SEQ ID NO: 455654 - DNA, 16 bp, M. musculus
ttgaagatatcagaag

SEQ ID NO: 455655 - DNA, 16 bp, M. musculus
ttgaagatattttcta

SEQ ID NO: 455656 - DNA, 16 bp, M. musculus
ttgaagatcagcctga

SEQ ID NO: 455657 - DNA, 16 bp, M. musculus
ttgaagcaaggtctct

SEQ ID NO: 455658 - DNA, 16 bp, M. musculus
ttgaagcaatctcact

SEQ ID NO: 455659 - DNA, 16 bp, M. musculus
ttgaagccaacctggg

SEQ ID NO: 455660 - DNA, 16 bp, M. musculus
ttgaagccatcatcag

SEQ ID NO: 455661 - DNA, 16 bp, M. musculus
ttgaagctagcttggg

SEQ ID NO: 455662 - DNA, 16 bp, M. musculus
ttgaagctattgtgaa

SEQ ID NO: 455663 - DNA, 16 bp, M. musculus
ttgaagctgggcagtg

SEQ ID NO: 455664 - DNA, 16 bp, M. musculus
ttgaaggaaatcagga

SEQ ID NO: 455665 - DNA, 16 bp, M. musculus
ttgaaggaagaaaata

SEQ ID NO: 455666 - DNA, 16 bp, M. musculus
ttgaaggaagccaagg

SEQ ID NO: 455667 - DNA, 16 bp, M. musculus
ttgaaggaagtgtgtt

SEQ ID NO: 455668 - DNA, 16 bp, M. musculus
ttgaaggaataaaaga

SEQ ID NO: 455669 - DNA, 16 bp, M. musculus
ttgaaggactgataga

SEQ ID NO: 455670 - DNA, 16 bp, M. musculus
ttgaaggagaatggcc

SEQ ID NO: 455671 - DNA, 16 bp, M. musculus
ttgaaggagcagagca

SEQ ID NO: 455672 - DNA, 16 bp, M. musculus
ttgaaggagccagagg

SEQ ID NO: 455673 - DNA, 16 bp, M. musculus
ttgaaggagtcagttt

SEQ ID NO: 455674 - DNA, 16 bp, M. musculus
ttgaaggatatctagg

SEQ ID NO: 455675 - DNA, 16 bp, M. musculus
ttgaaggatcactttc

SEQ ID NO: 455676 - DNA, 16 bp, M. musculus
ttgaaggatttccata

SEQ ID NO: 455677 - DNA, 16 bp, M. musculus
ttgaaggatttctgta

SEQ ID NO: 455678 - DNA, 16 bp, M. musculus
ttgaaggcatgaagtt

SEQ ID NO: 455679 - DNA, 16 bp, M. musculus
ttgaaggccagcctga

SEQ ID NO: 455680 - DNA, 16 bp, M. musculus
ttgaaggcttgatgcc

SEQ ID NO: 455681 - DNA, 16 bp, M. musculus
ttgaagggagaaaata

SEQ ID NO: 455682 - DNA, 16 bp, M. musculus
ttgaagggctggattt

SEQ ID NO: 455683 - DNA, 16 bp, M. musculus
ttgaagtatttttttc

SEQ ID NO: 455684 - DNA, 16 bp, M. musculus
ttgaagtcaattttat

SEQ ID NO: 455685 - DNA, 16 bp, M. musculus
ttgaagtctcccactg

SEQ ID NO: 455686 - DNA, 16 bp, M. musculus
ttgaagtctctgaaga

SEQ ID NO: 455687 - DNA, 16 bp, M. musculus
ttgaagtcttccacta

SEQ ID NO: 455688 - DNA, 16 bp, M. musculus
ttgaagtgggaagacc

SEQ ID NO: 455689 - DNA, 16 bp, M. musculus
ttgaagtgtccacact

SEQ ID NO: 455690 - DNA, 16 bp, M. musculus
ttgaagttgaaaatct

SEQ ID NO: 455691 - DNA, 16 bp, M. musculus
ttgaagttggactgaa

SEQ ID NO: 455692 - DNA, 16 bp, M. musculus
ttgaagttgtttatca

SEQ ID NO: 455693 - DNA, 16 bp, M. musculus
ttgaagtttcctcttc

SEQ ID NO: 455694 - DNA, 16 bp, M. musculus
ttgaagtttctctcca

SEQ ID NO: 455695 - DNA, 16 bp, M. musculus
ttgaagttttccaaag

SEQ ID NO: 455696 - DNA, 16 bp, M. musculus
ttgaagtttttaaaaa

SEQ ID NO: 455697 - DNA, 16 bp, M. musculus
ttgaagtttttaccat

SEQ ID NO: 455698 - DNA, 16 bp, M. musculus
ttgaagtttttcttat

SEQ ID NO: 455699 - DNA, 16 bp, M. musculus
ttgaagttttttaaaa

SEQ ID NO: 455700 - DNA, 16 bp, M. musculus
ttgaagtttttttcat

SEQ ID NO: 455701 - DNA, 16 bp, M. musculus
ttgaataaaaatgtcc

SEQ ID NO: 455702 - DNA, 16 bp, M. musculus
ttgaataaactttctg

SEQ ID NO: 455703 - DNA, 16 bp, M. musculus
ttgaataataatcctc

SEQ ID NO: 455704 - DNA, 17 bp, M. musculus
ttgaataggtagggaga

SEQ ID NO: 455705 - DNA, 19 bp, M. musculus
ttgaatatgcttggcccag

SEQ ID NO: 455706 - DNA, 16 bp, M. musculus
ttgaatattttgagaa

SEQ ID NO: 455707 - DNA, 16 bp, M. musculus
ttgaatattttttcag

SEQ ID NO: 455708 - DNA, 16 bp, M. musculus
ttgaatcatctgaaaa

SEQ ID NO: 455709 - DNA, 16 bp, M. musculus
ttgaatccattaatat

SEQ ID NO: 455710 - DNA, 16 bp, M. musculus
ttgaatccatttgttt

SEQ ID NO: 455711 - DNA, 16 bp, M. musculus
ttgaatcctgggagtc

SEQ ID NO: 455712 - DNA, 16 bp, M. musculus
ttgaatctcagaagag

SEQ ID NO: 455713 - DNA, 16 bp, M. musculus
ttgaatcttcagatat

SEQ ID NO: 455714 - DNA, 16 bp, M. musculus
ttgaatcttgggtatt

SEQ ID NO: 455715 - DNA, 16 bp, M. musculus
ttgaatgaaaatggtt

SEQ ID NO: 455716 - DNA, 16 bp, M. musculus
ttgaatgctgggattg

SEQ ID NO: 455717 - DNA, 16 bp, M. musculus
ttgaatggctgagatg

SEQ ID NO: 455718 - DNA, 16 bp, M. musculus
ttgaatgtattttcct

SEQ ID NO: 455719 - DNA, 16 bp, M. musculus
ttgaatgtgaagtgtc

SEQ ID NO: 455720 - DNA, 16 bp, M. musculus
ttgaattaagattctg

SEQ ID NO: 455721 - DNA, 16 bp, M. musculus
ttgaattagtcagctt

SEQ ID NO: 455722 - DNA, 16 bp, M. musculus
ttgaattcactgtgta

SEQ ID NO: 455723 - DNA, 16 bp, M. musculus
ttgaattcagaaattc

SEQ ID NO: 455724 - DNA, 16 bp, M. musculus
ttgaattcagagatcc

SEQ ID NO: 455725 - DNA, 16 bp, M. musculus
ttgaattcagccctga

SEQ ID NO: 455726 - DNA, 16 bp, M. musculus
ttgaattcagttccca

SEQ ID NO: 455727 - DNA, 16 bp, M. musculus
ttgaattccaggccag

SEQ ID NO: 455728 - DNA, 16 bp, M. musculus
ttgaattcccagagat

SEQ ID NO: 455729 - DNA, 16 bp, M. musculus
ttgaattccctggaac

SEQ ID NO: 455730 - DNA, 16 bp, M. musculus
ttgaatttactctgta

SEQ ID NO: 455731 - DNA, 16 bp, M. musculus
ttgaatttatgtttga

SEQ ID NO: 455732 - DNA, 16 bp, M. musculus
ttgaatttctctggct

SEQ ID NO: 455733 - DNA, 16 bp, M. musculus
ttgaatttctgatcct

SEQ ID NO: 455734 - DNA, 16 bp, M. musculus
ttgaatttgcaaatga

SEQ ID NO: 455735 - DNA, 16 bp, M. musculus
ttgaatttgtgattct

SEQ ID NO: 455736 - DNA, 16 bp, M. musculus
ttgaattttaattttc

SEQ ID NO: 455737 - DNA, 16 bp, M. musculus
ttgacaaaaatccaat

SEQ ID NO: 455738 - DNA, 16 bp, M. musculus
ttgacaaaacatctta

SEQ ID NO: 455739 - DNA, 16 bp, M. musculus
ttgacaaaatcaaaca

SEQ ID NO: 455740 - DNA, 16 bp, M. musculus
ttgacaaaatgcaaca

SEQ ID NO: 455741 - DNA, 16 bp, M. musculus
ttgacaaagaaaccaa

SEQ ID NO: 455742 - DNA, 16 bp, M. musculus
ttgacaaagaagacaa

SEQ ID NO: 455743 - DNA, 17 bp, M. musculus
ttgacaaatgagaccta

SEQ ID NO: 455744 - DNA, 20 bp, M. musculus
ttgacaaattacattcagat

SEQ ID NO: 455745 - DNA, 16 bp, M. musculus
ttgacaacatccaaca

SEQ ID NO: 455746 - DNA, 16 bp, M. musculus
ttgacaaccagaaata

SEQ ID NO: 455747 - DNA, 16 bp, M. musculus
ttgacaacttttggtt

SEQ ID NO: 455748 - DNA, 16 bp, M. musculus
ttgacaagctgcttct

SEQ ID NO: 455749 - DNA, 16 bp, M. musculus
ttgacaatttcataca

SEQ ID NO: 455750 - DNA, 16 bp, M. musculus
ttgacacaagctaaag

SEQ ID NO: 455751 - DNA, 16 bp, M. musculus
ttgacacaggatttct

SEQ ID NO: 455752 - DNA, 16 bp, M. musculus
ttgacaccagcctggt

SEQ ID NO: 455753 - DNA, 16 bp, M. musculus
ttgacactgctgctcc

SEQ ID NO: 455754 - DNA, 16 bp, M. musculus
ttgacagagggtctct

SEQ ID NO: 455755 - DNA, 16 bp, M. musculus
ttgacagcaagcacct

SEQ ID NO: 455756 - DNA, 16 bp, M. musculus
ttgacagcaagcccct

SEQ ID NO: 455757 - DNA, 16 bp, M. musculus
ttgacaggaaaggaga

SEQ ID NO: 455758 - DNA, 16 bp, M. musculus
ttgacaggggagctaa

SEQ ID NO: 455759 - DNA, 16 bp, M. musculus
ttgacagtggaaaatg

SEQ ID NO: 455760 - DNA, 16 bp, M. musculus
ttgacagttaaaacta

SEQ ID NO: 455761 - DNA, 16 bp, M. musculus
ttgacatatttttatt

SEQ ID NO: 455762 - DNA, 16 bp, M. musculus
ttgacatccctgggag

SEQ ID NO: 455763 - DNA, 16 bp, M. musculus
ttgacatttttatcat

SEQ ID NO: 455764 - DNA, 16 bp, M. musculus
ttgaccaggctgacct

SEQ ID NO: 455765 - DNA, 16 bp, M. musculus
ttgaccatttcctttg

SEQ ID NO: 455766 - DNA, 16 bp, M. musculus
ttgacctctctggctc

SEQ ID NO: 455767 - DNA, 16 bp, M. musculus
ttgacctctgacctct

SEQ ID NO: 455768 - DNA, 16 bp, M. musculus
ttgacctctgacttcc

SEQ ID NO: 455769 - DNA, 16 bp, M. musculus
ttgacctctgatctcc

SEQ ID NO: 455770 - DNA, 16 bp, M. musculus
ttgacctgcctctgcc

SEQ ID NO: 455771 - DNA, 23 bp, M. musculus
ttgacctgcttgagttccagtcc

SEQ ID NO: 455772 - DNA, 16 bp, M. musculus
ttgaccttctcctaaa

SEQ ID NO: 455773 - DNA, 17 bp, M. musculus
ttgaccttgctgccact

SEQ ID NO: 455774 - DNA, 16 bp, M. musculus
ttgacctttctaattc

SEQ ID NO: 455775 - DNA, 16 bp, M. musculus
ttgacctttgacctct

SEQ ID NO: 455776 - DNA, 16 bp, M. musculus
ttgaccttttctcctt

SEQ ID NO: 455777 - DNA, 16 bp, M. musculus
ttgacgtttttatcat

SEQ ID NO: 455778 - DNA, 16 bp, M. musculus
ttgactctagctgcct

SEQ ID NO: 455779 - DNA, 17 bp, M. musculus
ttgactctgttgatctt

SEQ ID NO: 455780 - DNA, 16 bp, M. musculus
ttgactgcctctgcct

SEQ ID NO: 455781 - DNA, 16 bp, M. musculus
ttgactgctcttccaa

SEQ ID NO: 455782 - DNA, 16 bp, M. musculus
ttgactggagaccaga

SEQ ID NO: 455783 - DNA, 16 bp, M. musculus
ttgactggtcttaaag

SEQ ID NO: 455784 - DNA, 16 bp, M. musculus
ttgactggtttgagtt

SEQ ID NO: 455785 - DNA, 16 bp, M. musculus
ttgactgtgagtctct

SEQ ID NO: 455786 - DNA, 16 bp, M. musculus
ttgacttcagccctga

SEQ ID NO: 455787 - DNA, 16 bp, M. musculus
ttgacttccaactcaa

SEQ ID NO: 455788 - DNA, 16 bp, M. musculus
ttgacttctacctttc

SEQ ID NO: 455789 - DNA, 16 bp, M. musculus
ttgacttctgcctttc

SEQ ID NO: 455790 - DNA, 16 bp, M. musculus
ttgacttgaaaaaaaa

SEQ ID NO: 455791 - DNA, 16 bp, M. musculus
ttgacttgcaaagaaa

SEQ ID NO: 455792 - DNA, 16 bp, M. musculus
ttgactttatttaatc

SEQ ID NO: 455793 - DNA, 16 bp, M. musculus
ttgactttatttaatt

SEQ ID NO: 455794 - DNA, 16 bp, M. musculus
ttgactttcatttccc

SEQ ID NO: 455795 - DNA, 16 bp, M. musculus
ttgactttgaactcag

SEQ ID NO: 455796 - DNA, 16 bp, M. musculus
ttgactttgggctagg

SEQ ID NO: 455797 - DNA, 16 bp, M. musculus
ttgactttggtgacta

SEQ ID NO: 455798 - DNA, 16 bp, M. musculus
ttgagaaaaagcctta

SEQ ID NO: 455799 - DNA, 16 bp, M. musculus
ttgagaaaaattattt

SEQ ID NO: 455800 - DNA, 16 bp, M. musculus
ttgagaaaatattttt

SEQ ID NO: 455801 - DNA, 17 bp, M. musculus
ttgagaaaatcaacaag

SEQ ID NO: 455802 - DNA, 17 bp, M. musculus
ttgagaaaatcagcaag

SEQ ID NO: 455803 - DNA, 16 bp, M. musculus
ttgagaaacatctggg

SEQ ID NO: 455804 - DNA, 16 bp, M. musculus
ttgagaaagaacttaa

SEQ ID NO: 455805 - DNA, 16 bp, M. musculus
ttgagaaagagagaca

SEQ ID NO: 455806 - DNA, 16 bp, M. musculus
ttgagaaagggtctca

SEQ ID NO: 455807 - DNA, 16 bp, M. musculus
ttgagaaataaccctc

SEQ ID NO: 455808 - DNA, 16 bp, M. musculus
ttgagaaatcaacaag

SEQ ID NO: 455809 - DNA, 16 bp, M. musculus
ttgagaaatgttttta

SEQ ID NO: 455810 - DNA, 16 bp, M. musculus
ttgagaacagcctggg

SEQ ID NO: 455811 - DNA, 16 bp, M. musculus
ttgagaacattttttt

SEQ ID NO: 455812 - DNA, 16 bp, M. musculus
ttgagaaccacagcat

SEQ ID NO: 455813 - DNA, 16 bp, M. musculus
ttgagaaccactgatg

SEQ ID NO: 455814 - DNA, 16 bp, M. musculus
ttgagaaccactggct

SEQ ID NO: 455815 - DNA, 16 bp, M. musculus
ttgagaaccactgttt

SEQ ID NO: 455816 - DNA, 16 bp, M. musculus
ttgagaagaatctgac

SEQ ID NO: 455817 - DNA, 16 bp, M. musculus
ttgagaagagtgttat

SEQ ID NO: 455818 - DNA, 16 bp, M. musculus
ttgagaaggattaaga

SEQ ID NO: 455819 - DNA, 16 bp, M. musculus
ttgagaagggtgctgt

SEQ ID NO: 455820 - DNA, 16 bp, M. musculus
ttgagaatagcaggag

SEQ ID NO: 455821 - DNA, 16 bp, M. musculus
ttgagaatcctctgtt

SEQ ID NO: 455822 - DNA, 16 bp, M. musculus
ttgagaatcctttgtt

SEQ ID NO: 455823 - DNA, 16 bp, M. musculus
ttgagaatgtgacctt

SEQ ID NO: 455824 - DNA, 16 bp, M. musculus
ttgagaattcatcttg

SEQ ID NO: 455825 - DNA, 16 bp, M. musculus
ttgagaattctctttt

SEQ ID NO: 455826 - DNA, 16 bp, M. musculus
ttgagaatttcataca

SEQ ID NO: 455827 - DNA, 16 bp, M. musculus
ttgagacaaagtctcc

SEQ ID NO: 455828 - DNA, 16 bp, M. musculus
ttgagacaacaatttg

SEQ ID NO: 455829 - DNA, 16 bp, M. musculus
ttgagacaaggtctca

SEQ ID NO: 455830 - DNA, 16 bp, M. musculus
ttgagacacagtctca

SEQ ID NO: 455831 - DNA, 17 bp, M. musculus
ttgagacactgtctcaa

SEQ ID NO: 455832 - DNA, 16 bp, M. musculus
ttgagacagactctct

SEQ ID NO: 455833 - DNA, 16 bp, M. musculus
ttgagacagagcctca

SEQ ID NO: 455834 - DNA, 16 bp, M. musculus
ttgagacagaggctca

SEQ ID NO: 455835 - DNA, 16 bp, M. musculus
ttgagacagaggctct

SEQ ID NO: 455836 - DNA, 16 bp, M. musculus
ttgagacagagtctta

SEQ ID NO: 455837 - DNA, 16 bp, M. musculus
ttgagacagcatctca

SEQ ID NO: 455838 - DNA, 16 bp, M. musculus
ttgagacaggctcttg

SEQ ID NO: 455839 - DNA, 16 bp, M. musculus
ttgagacagggtctgc

SEQ ID NO: 455840 - DNA, 16 bp, M. musculus
ttgagacagggtcttt

SEQ ID NO: 455841 - DNA, 16 bp, M. musculus
ttgagacagggttact

SEQ ID NO: 455842 - DNA, 16 bp, M. musculus
ttgagacagggttttg

SEQ ID NO: 455843 - DNA, 16 bp, M. musculus
ttgagacagtatctct

SEQ ID NO: 455844 - DNA, 16 bp, M. musculus
ttgagacagtctcaca

SEQ ID NO: 455845 - DNA, 16 bp, M. musculus
ttgagacagtctcatt

SEQ ID NO: 455846 - DNA, 16 bp, M. musculus
ttgagacagtctctca

SEQ ID NO: 455847 - DNA, 16 bp, M. musculus
ttgagacattgtctca

SEQ ID NO: 455848 - DNA, 16 bp, M. musculus
ttgagacattttctca

SEQ ID NO: 455849 - DNA, 16 bp, M. musculus
ttgagaccagcctaga

SEQ ID NO: 455850 - DNA, 16 bp, M. musculus
ttgagaccagcctgga

SEQ ID NO: 455851 - DNA, 16 bp, M. musculus
ttgagaccagcctggg

SEQ ID NO: 455852 - DNA, 16 bp, M. musculus
ttgagactcttcccca

SEQ ID NO: 455853 - DNA, 16 bp, M. musculus
ttgagactggatctca

SEQ ID NO: 455854 - DNA, 16 bp, M. musculus
ttgagagaaatgcaga

SEQ ID NO: 455855 - DNA, 16 bp, M. musculus
ttgagagaacagattt

SEQ ID NO: 455856 - DNA, 16 bp, M. musculus
ttgagagaagccaagg

SEQ ID NO: 455857 - DNA, 16 bp, M. musculus
ttgagagacttgagac

SEQ ID NO: 455858 - DNA, 16 bp, M. musculus
ttgagagagagagaga

SEQ ID NO: 455859 - DNA, 16 bp, M. musculus
ttgagagatggctcag

SEQ ID NO: 455860 - DNA, 16 bp, M. musculus
ttgagagcttcctcct

SEQ ID NO: 455861 - DNA, 16 bp, M. musculus
ttgagaggcacaggca

SEQ ID NO: 455862 - DNA, 16 bp, M. musculus
ttgagaggcagagaca

SEQ ID NO: 455863 - DNA, 16 bp, M. musculus
ttgagaggcagagtca

SEQ ID NO: 455864 - DNA, 16 bp, M. musculus
ttgagagtttcataca

SEQ ID NO: 455865 - DNA, 16 bp, M. musculus
ttgagagttttgttga

SEQ ID NO: 455866 - DNA, 16 bp, M. musculus
ttgagataaggtctca

SEQ ID NO: 455867 - DNA, 16 bp, M. musculus
ttgagataatcaaatg

SEQ ID NO: 455868 - DNA, 16 bp, M. musculus
ttgagatagggtctca

SEQ ID NO: 455869 - DNA, 16 bp, M. musculus
ttgagatagtgtctca

SEQ ID NO: 455870 - DNA, 16 bp, M. musculus
ttgagatatttttgaa

SEQ ID NO: 455871 - DNA, 16 bp, M. musculus
ttgagatctttgatct

SEQ ID NO: 455872 - DNA, 16 bp, M. musculus
ttgagatgagagctgt

SEQ ID NO: 455873 - DNA, 16 bp, M. musculus
ttgagatggagtctct

SEQ ID NO: 455874 - DNA, 16 bp, M. musculus
ttgagattataattta

SEQ ID NO: 455875 - DNA, 16 bp, M. musculus
ttgagattccctcctc

SEQ ID NO: 455876 - DNA, 16 bp, M. musculus
ttgagcacttactatg

SEQ ID NO: 455877 - DNA, 16 bp, M. musculus
ttgagcagcagcatct

SEQ ID NO: 455878 - DNA, 16 bp, M. musculus
ttgagccaccatgtgg

SEQ ID NO: 455879 - DNA, 16 bp, M. musculus
ttgagccagagtctct

SEQ ID NO: 455880 - DNA, 16 bp, M. musculus
ttgagccatctctcca

SEQ ID NO: 455881 - DNA, 16 bp, M. musculus
ttgagccatcttgctg

SEQ ID NO: 455882 - DNA, 16 bp, M. musculus
ttgagccatttcttca

SEQ ID NO: 455883 - DNA, 16 bp, M. musculus
ttgagctcacagagat

SEQ ID NO: 455884 - DNA, 16 bp, M. musculus
ttgagctcctgtcctg

SEQ ID NO: 455885 - DNA, 16 bp, M. musculus
ttgagctggaccccac

SEQ ID NO: 455886 - DNA, 16 bp, M. musculus
ttgagctggatcctac

SEQ ID NO: 455887 - DNA, 16 bp, M. musculus
ttgagctgggtgtggt

SEQ ID NO: 455888 - DNA, 16 bp, M. musculus
ttgagctgtatcccac

SEQ ID NO: 455889 - DNA, 16 bp, M. musculus
ttgagctttgtacagg

SEQ ID NO: 455890 - DNA, 16 bp, M. musculus
ttgaggaaaatacaaa

SEQ ID NO: 455891 - DNA, 16 bp, M. musculus
ttgaggaaatgtctct

SEQ ID NO: 455892 - DNA, 16 bp, M. musculus
ttgaggaacatctgag

SEQ ID NO: 455893 - DNA, 16 bp, M. musculus
ttgaggaagacatctg

SEQ ID NO: 455894 - DNA, 16 bp, M. musculus
ttgaggaagatctcag

SEQ ID NO: 455895 - DNA, 16 bp, M. musculus
ttgaggacaagaacag

SEQ ID NO: 455896 - DNA, 16 bp, M. musculus
ttgaggacagcctgga

SEQ ID NO: 455897 - DNA, 16 bp, M. musculus
ttgaggacagggatgg

SEQ ID NO: 455898 - DNA, 16 bp, M. musculus
ttgaggagagagagag

SEQ ID NO: 455899 - DNA, 16 bp, M. musculus
ttgaggagcatctagg

SEQ ID NO: 455900 - DNA, 16 bp, M. musculus
ttgaggaggaagagga

SEQ ID NO: 455901 - DNA, 16 bp, M. musculus
ttgaggaggaggaaga

SEQ ID NO: 455902 - DNA, 22 bp, M. musculus
ttgaggaggctaaggagattgc

SEQ ID NO: 455903 - DNA, 35 bp, M. musculus
ttgaggaggctaaggagattgcttctcaggctagc

SEQ ID NO: 455904 - DNA, 16 bp, M. musculus
ttgaggaggtcagaag

SEQ ID NO: 455905 - DNA, 16 bp, M. musculus
ttgaggatatatatat

SEQ ID NO: 455906 - DNA, 16 bp, M. musculus
ttgaggatgagactga

SEQ ID NO: 455907 - DNA, 16 bp, M. musculus
ttgaggcagaggagga

SEQ ID NO: 455908 - DNA, 16 bp, M. musculus
ttgaggcagcctggtc

SEQ ID NO: 455909 - DNA, 16 bp, M. musculus
ttgaggcaggaggatt

SEQ ID NO: 455910 - DNA, 16 bp, M. musculus
ttgaggcagggtctca

SEQ ID NO: 455911 - DNA, 16 bp, M. musculus
ttgaggcagggtctct

SEQ ID NO: 455912 - DNA, 16 bp, M. musculus
ttgaggcagggtcttt

SEQ ID NO: 455913 - DNA, 16 bp, M. musculus
ttgaggccagactggt

SEQ ID NO: 455914 - DNA, 16 bp, M. musculus
ttgaggccagccaagg

SEQ ID NO: 455915 - DNA, 16 bp, M. musculus
ttgaggccagcctgca

SEQ ID NO: 455916 - DNA, 16 bp, M. musculus
ttgaggccagccttgg

SEQ ID NO: 455917 - DNA, 17 bp, M. musculus
ttgaggcctgttttgtg

SEQ ID NO: 455918 - DNA, 16 bp, M. musculus
ttgaggctagcccagg

SEQ ID NO: 455919 - DNA, 16 bp, M. musculus
ttgagggatcctctgg

SEQ ID NO: 455920 - DNA, 16 bp, M. musculus
ttgagggatgaggcca

SEQ ID NO: 455921 - DNA, 17 bp, M. musculus
ttgagggatgtctgggt

SEQ ID NO: 455922 - DNA, 16 bp, M. musculus
ttgagggcagcctgga

SEQ ID NO: 455923 - DNA, 16 bp, M. musculus
ttgagggcagcctggg

SEQ ID NO: 455924 - DNA, 16 bp, M. musculus
ttgaggggcatctaga

SEQ ID NO: 455925 - DNA, 16 bp, M. musculus
ttgaggggctagagag

SEQ ID NO: 455926 - DNA, 16 bp, M. musculus
ttgaggtagggtctct

SEQ ID NO: 455927 - DNA, 16 bp, M. musculus
ttgaggtgggaagaca

SEQ ID NO: 455928 - DNA, 16 bp, M. musculus
ttgaggttggctactg

SEQ ID NO: 455929 - DNA, 16 bp, M. musculus
ttgaggtttcagaaga

SEQ ID NO: 455930 - DNA, 16 bp, M. musculus
ttgaggtttctccagg

SEQ ID NO: 455931 - DNA, 21 bp, M. musculus
ttgaggtttgcagaggaacag

SEQ ID NO: 455932 - DNA, 16 bp, M. musculus
ttgagtactgggatta

SEQ ID NO: 455933 - DNA, 16 bp, M. musculus
ttgagtactttgtata

SEQ ID NO: 455934 - DNA, 16 bp, M. musculus
ttgagtatctgcatct

SEQ ID NO: 455935 - DNA, 16 bp, M. musculus
ttgagtattctgaact

SEQ ID NO: 455936 - DNA, 16 bp, M. musculus
ttgagtatttatttca

SEQ ID NO: 455937 - DNA, 16 bp, M. musculus
ttgagtatttttttca

SEQ ID NO: 455938 - DNA, 16 bp, M. musculus
ttgagtcctgaaagtc

SEQ ID NO: 455939 - DNA, 16 bp, M. musculus
ttgagtctgtggagtg

SEQ ID NO: 455940 - DNA, 16 bp, M. musculus
ttgagtcttatttata

SEQ ID NO: 455941 - DNA, 17 bp, M. musculus
ttgagtcttgatcagaa

SEQ ID NO: 455942 - DNA, 17 bp, M. musculus
ttgagtgaggtaaccca

SEQ ID NO: 455943 - DNA, 16 bp, M. musculus
ttgagtgagtgagtga

SEQ ID NO: 455944 - DNA, 16 bp, M. musculus
ttgagtgctgggatta

SEQ ID NO: 455945 - DNA, 16 bp, M. musculus
ttgagtggaaagaaga

SEQ ID NO: 455946 - DNA, 16 bp, M. musculus
ttgagtggcatctggg

SEQ ID NO: 455947 - DNA, 16 bp, M. musculus
ttgagtgtgaggccag

SEQ ID NO: 455948 - DNA, 16 bp, M. musculus
ttgagtgttttgcctg

SEQ ID NO: 455949 - DNA, 16 bp, M. musculus
ttgagttacagacagt

SEQ ID NO: 455950 - DNA, 16 bp, M. musculus
ttgagttcaaagccag

SEQ ID NO: 455951 - DNA, 16 bp, M. musculus
ttgagttcaagcccag

SEQ ID NO: 455952 - DNA, 16 bp, M. musculus
ttgagttcaaggctag

SEQ ID NO: 455953 - DNA, 16 bp, M. musculus
ttgagttccagccctg

SEQ ID NO: 455954 - DNA, 16 bp, M. musculus
ttgagttccaggacag

SEQ ID NO: 455955 - DNA, 16 bp, M. musculus
ttgagttccaggccag

SEQ ID NO: 455956 - DNA, 16 bp, M. musculus
ttgagttccagtcttg

SEQ ID NO: 455957 - DNA, 16 bp, M. musculus
ttgagttcttgtcctg

SEQ ID NO: 455958 - DNA, 16 bp, M. musculus
ttgagttctttgatcc

SEQ ID NO: 455959 - DNA, 16 bp, M. musculus
ttgagttggacttttg

SEQ ID NO: 455960 - DNA, 16 bp, M. musculus
ttgagttggaggccag

SEQ ID NO: 455961 - DNA, 16 bp, M. musculus
ttgagtttctctctgt

SEQ ID NO: 455962 - DNA, 16 bp, M. musculus
ttgagtttctgccctg

SEQ ID NO: 455963 - DNA, 16 bp, M. musculus
ttgagtttgagatcag

SEQ ID NO: 455964 - DNA, 16 bp, M. musculus
ttgagtttgaggctag

SEQ ID NO: 455965 - DNA, 16 bp, M. musculus
ttgagttttcctcttc

SEQ ID NO: 455966 - DNA, 16 bp, M. musculus
ttgataaatgcaagtt

SEQ ID NO: 455967 - DNA, 16 bp, M. musculus
ttgataattgatgtgg

SEQ ID NO: 455968 - DNA, 16 bp, M. musculus
ttgatacataaatctg

SEQ ID NO: 455969 - DNA, 16 bp, M. musculus
ttgatactaaaaattt

SEQ ID NO: 455970 - DNA, 16 bp, M. musculus
ttgatagtcattaaag

SEQ ID NO: 455971 - DNA, 16 bp, M. musculus
ttgatattagagcctg

SEQ ID NO: 455972 - DNA, 16 bp, M. musculus
ttgatatttgacaagg

SEQ ID NO: 455973 - DNA, 21 bp, M. musculus
ttgatcactaattgagaaaat

SEQ ID NO: 455974 - DNA, 17 bp, M. musculus
ttgatcactaattgagg

SEQ ID NO: 455975 - DNA, 16 bp, M. musculus
ttgatcaggatggatg

SEQ ID NO: 455976 - DNA, 16 bp, M. musculus
ttgatcagggaagaaa

SEQ ID NO: 455977 - DNA, 16 bp, M. musculus
ttgatcatgtgatttt

SEQ ID NO: 455978 - DNA, 16 bp, M. musculus
ttgatccactcacaaa

SEQ ID NO: 455979 - DNA, 16 bp, M. musculus
ttgatcccagcactca

SEQ ID NO: 455980 - DNA, 16 bp, M. musculus
ttgatcccaggactca

SEQ ID NO: 455981 - DNA, 16 bp, M. musculus
ttgatccccagaacac

SEQ ID NO: 455982 - DNA, 16 bp, M. musculus
ttgatccccagtactg

SEQ ID NO: 455983 - DNA, 16 bp, M. musculus
ttgatcctcagcactg

SEQ ID NO: 455984 - DNA, 16 bp, M. musculus
ttgatcctcctgcctc

SEQ ID NO: 455985 - DNA, 16 bp, M. musculus
ttgatcctttttagaa

SEQ ID NO: 455986 - DNA, 16 bp, M. musculus
ttgatctacacagtga

SEQ ID NO: 455987 - DNA, 16 bp, M. musculus
ttgatctacctatctg

SEQ ID NO: 455988 - DNA, 16 bp, M. musculus
ttgatctccttttttg

SEQ ID NO: 455989 - DNA, 16 bp, M. musculus
ttgatctctgacctct

SEQ ID NO: 455990 - DNA, 16 bp, M. musculus
ttgatctgcattcatt

SEQ ID NO: 455991 - DNA, 16 bp, M. musculus
ttgatgaaaagagaca

SEQ ID NO: 455992 - DNA, 16 bp, M. musculus
ttgatgaaggagacag

SEQ ID NO: 455993 - DNA, 16 bp, M. musculus
ttgatgatgaactgtg

SEQ ID NO: 455994 - DNA, 16 bp, M. musculus
ttgatgatgataatga

SEQ ID NO: 455995 - DNA, 16 bp, M. musculus
ttgatgatgatgatgg

SEQ ID NO: 455996 - DNA, 16 bp, M. musculus
ttgatgatgtaaagaa

SEQ ID NO: 455997 - DNA, 16 bp, M. musculus
ttgatgcaaaaatact

SEQ ID NO: 455998 - DNA, 16 bp, M. musculus
ttgatgcaaaaatcct

SEQ ID NO: 455999 - DNA, 16 bp, M. musculus
ttgatgcaaaattact

SEQ ID NO: 456000 - DNA, 16 bp, M. musculus
ttgatgcagaggccat

SEQ ID NO: 456001 - DNA, 16 bp, M. musculus
ttgatgccctcttctg

SEQ ID NO: 456002 - DNA, 16 bp, M. musculus
ttgatgctagataagg

SEQ ID NO: 456003 - DNA, 17 bp, M. musculus
ttgatgctgctgctgct

SEQ ID NO: 456004 - DNA, 16 bp, M. musculus
ttgatgctggacaagg

SEQ ID NO: 456005 - DNA, 31 bp, M. musculus
ttgatgctggttagctggagctaagaaatta

SEQ ID NO: 456006 - DNA, 16 bp, M. musculus
ttgatgctgttgttgt

SEQ ID NO: 456007 - DNA, 16 bp, M. musculus
ttgatggatttcttta

SEQ ID NO: 456008 - DNA, 16 bp, M. musculus
ttgatggattttctta

SEQ ID NO: 456009 - DNA, 16 bp, M. musculus
ttgatggcacatgcct

SEQ ID NO: 456010 - DNA, 16 bp, M. musculus
ttgatggcatccacaa

SEQ ID NO: 456011 - DNA, 16 bp, M. musculus
ttgatggtctggtaga

SEQ ID NO: 456012 - DNA, 16 bp, M. musculus
ttgatggtgtcttttt

SEQ ID NO: 456013 - DNA, 16 bp, M. musculus
ttgatgtaacaatgca

SEQ ID NO: 456014 - DNA, 16 bp, M. musculus
ttgatgtaggaaggcc

SEQ ID NO: 456015 - DNA, 16 bp, M. musculus
ttgatgtccagttttt

SEQ ID NO: 456016 - DNA, 16 bp, M. musculus
ttgatgtcctctgcca

SEQ ID NO: 456017 - DNA, 16 bp, M. musculus
ttgatgtgagggtttg

SEQ ID NO: 456018 - DNA, 16 bp, M. musculus
ttgatgtgggagggca

SEQ ID NO: 456019 - DNA, 16 bp, M. musculus
ttgatgtgtacttgga

SEQ ID NO: 456020 - DNA, 16 bp, M. musculus
ttgatgttactcagaa

SEQ ID NO: 456021 - DNA, 16 bp, M. musculus
ttgatgttcctcctat

SEQ ID NO: 456022 - DNA, 16 bp, M. musculus
ttgatgttcttccaga

SEQ ID NO: 456023 - DNA, 16 bp, M. musculus
ttgatgttcttgtcat

SEQ ID NO: 456024 - DNA, 16 bp, M. musculus
ttgatgttgaatttgt

SEQ ID NO: 456025 - DNA, 16 bp, M. musculus
ttgatgtttctcctat

SEQ ID NO: 456026 - DNA, 16 bp, M. musculus
ttgatgttttaaaata

SEQ ID NO: 456027 - DNA, 16 bp, M. musculus
ttgatgttttgcctgt

SEQ ID NO: 456028 - DNA, 16 bp, M. musculus
ttgatgtttttacact

SEQ ID NO: 456029 - DNA, 16 bp, M. musculus
ttgattaaataaatct

SEQ ID NO: 456030 - DNA, 16 bp, M. musculus
ttgattagaagttaca

SEQ ID NO: 456031 - DNA, 16 bp, M. musculus
ttgattagtatgaagt

SEQ ID NO: 456032 - DNA, 16 bp, M. musculus
ttgattatattttcct

SEQ ID NO: 456033 - DNA, 16 bp, M. musculus
ttgattcaggactcct

SEQ ID NO: 456034 - DNA, 16 bp, M. musculus
ttgattccagcactca

SEQ ID NO: 456035 - DNA, 16 bp, M. musculus
ttgattcccagttggt

SEQ ID NO: 456036 - DNA, 16 bp, M. musculus
ttgattccctgtcttt

SEQ ID NO: 456037 - DNA, 16 bp, M. musculus
ttgattcctcaagaaa

SEQ ID NO: 456038 - DNA, 16 bp, M. musculus
ttgattctaaggtgat

SEQ ID NO: 456039 - DNA, 16 bp, M. musculus
ttgattctttgtgttg

SEQ ID NO: 456040 - DNA, 16 bp, M. musculus
ttgattctttttaata

SEQ ID NO: 456041 - DNA, 16 bp, M. musculus
ttgattctttttatag

SEQ ID NO: 456042 - DNA, 16 bp, M. musculus
ttgattgacaggtgat

SEQ ID NO: 456043 - DNA, 16 bp, M. musculus
ttgattgacctgcttg

SEQ ID NO: 456044 - DNA, 16 bp, M. musculus
ttgattgactgactga

SEQ ID NO: 456045 - DNA, 16 bp, M. musculus
ttgattgctgtgccca

SEQ ID NO: 456046 - DNA, 16 bp, M. musculus
ttgattgtcaacttga

SEQ ID NO: 456047 - DNA, 16 bp, M. musculus
ttgattgtgaagattc

SEQ ID NO: 456048 - DNA, 16 bp, M. musculus
ttgatttcaaccctaa

SEQ ID NO: 456049 - DNA, 16 bp, M. musculus
ttgatttccagagtgc

SEQ ID NO: 456050 - DNA, 16 bp, M. musculus
ttgatttcctggagtc

SEQ ID NO: 456051 - DNA, 16 bp, M. musculus
ttgatttctgggtctt

SEQ ID NO: 456052 - DNA, 16 bp, M. musculus
ttgatttctgttggta

SEQ ID NO: 456053 - DNA, 16 bp, M. musculus
ttgatttcttaaaaaa

SEQ ID NO: 456054 - DNA, 16 bp, M. musculus
ttgatttcttctctct

SEQ ID NO: 456055 - DNA, 16 bp, M. musculus
ttgatttctttcatca

SEQ ID NO: 456056 - DNA, 16 bp, M. musculus
ttgatttctttcttaa

SEQ ID NO: 456057 - DNA, 16 bp, M. musculus
ttgatttctttcttca

SEQ ID NO: 456058 - DNA, 16 bp, M. musculus
ttgatttctttcttga

SEQ ID NO: 456059 - DNA, 16 bp, M. musculus
ttgatttctttgagtt

SEQ ID NO: 456060 - DNA, 16 bp, M. musculus
ttgatttgattttcat

SEQ ID NO: 456061 - DNA, 16 bp, M. musculus
ttgatttgtattcttc

SEQ ID NO: 456062 - DNA, 16 bp, M. musculus
ttgatttgtgtgtctt

SEQ ID NO: 456063 - DNA, 16 bp, M. musculus
ttgattttagtgcctg

SEQ ID NO: 456064 - DNA, 17 bp, M. musculus
ttgattttcatttccct

SEQ ID NO: 456065 - DNA, 16 bp, M. musculus
ttgattttctgtgtga

SEQ ID NO: 456066 - DNA, 16 bp, M. musculus
ttgattttcttaaaaa

SEQ ID NO: 456067 - DNA, 16 bp, M. musculus
ttgattttgcccatga

SEQ ID NO: 456068 - DNA, 16 bp, M. musculus
ttgattttgcttctgc

SEQ ID NO: 456069 - DNA, 16 bp, M. musculus
ttgatttttttcccct

SEQ ID NO: 456070 - DNA, 16 bp, M. musculus
ttgcaaaaattatatg

SEQ ID NO: 456071 - DNA, 16 bp, M. musculus
ttgcaaaagctttgca

SEQ ID NO: 456072 - DNA, 16 bp, M. musculus
ttgcaaaaggaacaca

SEQ ID NO: 456073 - DNA, 16 bp, M. musculus
ttgcaaaccaaatcca

SEQ ID NO: 456074 - DNA, 16 bp, M. musculus
ttgcaaacctcttcaa

SEQ ID NO: 456075 - DNA, 16 bp, M. musculus
ttgcaaactggcacaa

SEQ ID NO: 456076 - DNA, 25 bp, M. musculus
ttgcaaagaaactaggagagatgtg

SEQ ID NO: 456077 - DNA, 16 bp, M. musculus
ttgcaaagaaatattt

SEQ ID NO: 456078 - DNA, 16 bp, M. musculus
ttgcaaagacaaagtt

SEQ ID NO: 456079 - DNA, 16 bp, M. musculus
ttgcaaagcaaggtca

SEQ ID NO: 456080 - DNA, 16 bp, M. musculus
ttgcaaagcacatgaa

SEQ ID NO: 456081 - DNA, 16 bp, M. musculus
ttgcaaagccattttc

SEQ ID NO: 456082 - DNA, 16 bp, M. musculus
ttgcaaaggaagaagt

SEQ ID NO: 456083 - DNA, 16 bp, M. musculus
ttgcaaataaaaataa

SEQ ID NO: 456084 - DNA, 16 bp, M. musculus
ttgcaaatatatatat

SEQ ID NO: 456085 - DNA, 16 bp, M. musculus
ttgcaaatctctttag

SEQ ID NO: 456086 - DNA, 16 bp, M. musculus
ttgcaaatgtttattg

SEQ ID NO: 456087 - DNA, 16 bp, M. musculus
ttgcaacagatgaaga

SEQ ID NO: 456088 - DNA, 16 bp, M. musculus
ttgcaagaaaatggat

SEQ ID NO: 456089 - DNA, 16 bp, M. musculus
ttgcaagagccagagg

SEQ ID NO: 456090 - DNA, 16 bp, M. musculus
ttgcaagaggattttt

SEQ ID NO: 456091 - DNA, 16 bp, M. musculus
ttgcaagcaaatgaat

SEQ ID NO: 456092 - DNA, 16 bp, M. musculus
ttgcaaggcaagccct

SEQ ID NO: 456093 - DNA, 19 bp, M. musculus
ttgcaatactaacttgaaa

SEQ ID NO: 456094 - DNA, 16 bp, M. musculus
ttgcaatgaaaataaa

SEQ ID NO: 456095 - DNA, 16 bp, M. musculus
ttgcaatgaacatctg

SEQ ID NO: 456096 - DNA, 16 bp, M. musculus
ttgcaatgccaccagc

SEQ ID NO: 456097 - DNA, 16 bp, M. musculus
ttgcaatgtgtgtttt

SEQ ID NO: 456098 - DNA, 16 bp, M. musculus
ttgcaattctgaaaat

SEQ ID NO: 456099 - DNA, 16 bp, M. musculus
ttgcacaaagaaataa

SEQ ID NO: 456100 - DNA, 16 bp, M. musculus
ttgcacacacacacat

SEQ ID NO: 456101 - DNA, 16 bp, M. musculus
ttgcacagctagctct

SEQ ID NO: 456102 - DNA, 16 bp, M. musculus
ttgcacatgctaggca

SEQ ID NO: 456103 - DNA, 16 bp, M. musculus
ttgcacccccagccat

SEQ ID NO: 456104 - DNA, 16 bp, M. musculus
ttgcacctcacagaat

SEQ ID NO: 456105 - DNA, 17 bp, M. musculus
ttgcacctcacagaata

SEQ ID NO: 456106 - DNA, 16 bp, M. musculus
ttgcacggcaagcact

SEQ ID NO: 456107 - DNA, 16 bp, M. musculus
ttgcactcaggacctc

SEQ ID NO: 456108 - DNA, 16 bp, M. musculus
ttgcactcctgctcct

SEQ ID NO: 456109 - DNA, 16 bp, M. musculus
ttgcactgagctcaga

SEQ ID NO: 456110 - DNA, 16 bp, M. musculus
ttgcactgctgactgg

SEQ ID NO: 456111 - DNA, 17 bp, M. musculus
ttgcacttgctaggcaa

SEQ ID NO: 456112 - DNA, 16 bp, M. musculus
ttgcagaacaaggcac

SEQ ID NO: 456113 - DNA, 16 bp, M. musculus
ttgcagaagagctgag

SEQ ID NO: 456114 - DNA, 16 bp, M. musculus
ttgcagaagatccaag

SEQ ID NO: 456115 - DNA, 16 bp, M. musculus
ttgcagacaaatgaat

SEQ ID NO: 456116 - DNA, 16 bp, M. musculus
ttgcagacagcagcct

SEQ ID NO: 456117 - DNA, 16 bp, M. musculus
ttgcagacccctttag

SEQ ID NO: 456118 - DNA, 16 bp, M. musculus
ttgcagagacttgatg

SEQ ID NO: 456119 - DNA, 16 bp, M. musculus
ttgcagaggacccaag

SEQ ID NO: 456120 - DNA, 16 bp, M. musculus
ttgcagaggaccctag

SEQ ID NO: 456121 - DNA, 16 bp, M. musculus
ttgcagaggacctgga

SEQ ID NO: 456122 - DNA, 16 bp, M. musculus
ttgcagaggatggcct

SEQ ID NO: 456123 - DNA, 16 bp, M. musculus
ttgcagaggggaaaca

SEQ ID NO: 456124 - DNA, 16 bp, M. musculus
ttgcagatccctccag

SEQ ID NO: 456125 - DNA, 16 bp, M. musculus
ttgcagatcctttcag

SEQ ID NO: 456126 - DNA, 16 bp, M. musculus
ttgcagatgctaagaa

SEQ ID NO: 456127 - DNA, 16 bp, M. musculus
ttgcagattcccccag

SEQ ID NO: 456128 - DNA, 43 bp, M. musculus
ttgcagctgtccttttgggccgtaaggaccggaggactgtggt

SEQ ID NO: 456129 - DNA, 16 bp, M. musculus
ttgcaggacagccagg

SEQ ID NO: 456130 - DNA, 16 bp, M. musculus
ttgcaggagttgattc

SEQ ID NO: 456131 - DNA, 16 bp, M. musculus
ttgcaggcatgtacca

SEQ ID NO: 456132 - DNA, 16 bp, M. musculus
ttgcaggccagccagg

SEQ ID NO: 456133 - DNA, 16 bp, M. musculus
ttgcagggaagatgcc

SEQ ID NO: 456134 - DNA, 16 bp, M. musculus
ttgcaggtgagcaagg

SEQ ID NO: 456135 - DNA, 17 bp, M. musculus
ttgcagtccactaccat

SEQ ID NO: 456136 - DNA, 17 bp, M. musculus
ttgcagtcccaccagca

SEQ ID NO: 456137 - DNA, 16 bp, M. musculus
ttgcagtctctgactg

SEQ ID NO: 456138 - DNA, 16 bp, M. musculus
ttgcagtgatgaccga

SEQ ID NO: 456139 - DNA, 22 bp, M. musculus
ttgcagtgtacgcgcaaattgc

SEQ ID NO: 456140 - DNA, 16 bp, M. musculus
ttgcagtttgcagcaa

SEQ ID NO: 456141 - DNA, 16 bp, M. musculus
ttgcagtttgtcaagt

SEQ ID NO: 456142 - DNA, 16 bp, M. musculus
ttgcataacaagcact

SEQ ID NO: 456143 - DNA, 16 bp, M. musculus
ttgcatacaggagcct

SEQ ID NO: 456144 - DNA, 16 bp, M. musculus
ttgcatatgtagcaga

SEQ ID NO: 456145 - DNA, 22 bp, M. musculus
ttgcatcaggtgtggttttctc

SEQ ID NO: 456146 - DNA, 16 bp, M. musculus
ttgcatcttctttctg

SEQ ID NO: 456147 - DNA, 16 bp, M. musculus
ttgcatcttgggtatt

SEQ ID NO: 456148 - DNA, 16 bp, M. musculus
ttgcatgtatgtatgt

SEQ ID NO: 456149 - DNA, 16 bp, M. musculus
ttgcatgtgcatgtgt

SEQ ID NO: 456150 - DNA, 16 bp, M. musculus
ttgcatgtttgtattt

SEQ ID NO: 456151 - DNA, 16 bp, M. musculus
ttgcattcttctgcat

SEQ ID NO: 456152 - DNA, 16 bp, M. musculus
ttgcattgagtctata

SEQ ID NO: 456153 - DNA, 16 bp, M. musculus
ttgcattgcatctgta

SEQ ID NO: 456154 - DNA, 16 bp, M. musculus
ttgcatttattcttat

SEQ ID NO: 456155 - DNA, 16 bp, M. musculus
ttgcatttcaagtgtt

SEQ ID NO: 456156 - DNA, 16 bp, M. musculus
ttgcatttcgctgatg

SEQ ID NO: 456157 - DNA, 16 bp, M. musculus
ttgcatttctttaatg

SEQ ID NO: 456158 - DNA, 16 bp, M. musculus
ttgcatttgttgttct

SEQ ID NO: 456159 - DNA, 16 bp, M. musculus
ttgcattttctttgct

SEQ ID NO: 456160 - DNA, 16 bp, M. musculus
ttgcatttttctacaa

SEQ ID NO: 456161 - DNA, 16 bp, M. musculus
ttgcattttttaaaaa

SEQ ID NO: 456162 - DNA, 16 bp, M. musculus
ttgccaaaggcttttt

SEQ ID NO: 456163 - DNA, 16 bp, M. musculus
ttgccaaatgggacct

SEQ ID NO: 456164 - DNA, 16 bp, M. musculus
ttgccaagaagcacaa

SEQ ID NO: 456165 - DNA, 16 bp, M. musculus
ttgccaccaagcctga

SEQ ID NO: 456166 - DNA, 16 bp, M. musculus
ttgccaccaagtctga

SEQ ID NO: 456167 - DNA, 16 bp, M. musculus
ttgccaccaatcctga

SEQ ID NO: 456168 - DNA, 16 bp, M. musculus
ttgccactaagcctga

SEQ ID NO: 456169 - DNA, 16 bp, M. musculus
ttgccactgaggtggg

SEQ ID NO: 456170 - DNA, 16 bp, M. musculus
ttgccagagcagccat

SEQ ID NO: 456171 - DNA, 27 bp, M. musculus
ttgccagattgcaggaagcagctgaga

SEQ ID NO: 456172 - DNA, 35 bp, M. musculus
ttgccagatttgactaagccctttgaactctttgt

SEQ ID NO: 456173 - DNA, 16 bp, M. musculus
ttgccagcaagagtga

SEQ ID NO: 456174 - DNA, 16 bp, M. musculus
ttgccagcaagcaggc

SEQ ID NO: 456175 - DNA, 16 bp, M. musculus
ttgccagcacatctgt

SEQ ID NO: 456176 - DNA, 16 bp, M. musculus
ttgccagcacccacat

SEQ ID NO: 456177 - DNA, 16 bp, M. musculus
ttgccagcagctttct

SEQ ID NO: 456178 - DNA, 16 bp, M. musculus
ttgccagcaggaacag

SEQ ID NO: 456179 - DNA, 16 bp, M. musculus
ttgccagcatttgttg

SEQ ID NO: 456180 - DNA, 16 bp, M. musculus
ttgccagccagccagc

SEQ ID NO: 456181 - DNA, 16 bp, M. musculus
ttgccagcggagtcgc

SEQ ID NO: 456182 - DNA, 16 bp, M. musculus
ttgccaggaaaaaaaa

SEQ ID NO: 456183 - DNA, 16 bp, M. musculus
ttgccaggcactgaca

SEQ ID NO: 456184 - DNA, 16 bp, M. musculus
ttgccaggcatggtag

SEQ ID NO: 456185 - DNA, 16 bp, M. musculus
ttgccaggccaggagg

SEQ ID NO: 456186 - DNA, 16 bp, M. musculus
ttgccaggtaactggg

SEQ ID NO: 456187 - DNA, 16 bp, M. musculus
ttgccagtcagttcca

SEQ ID NO: 456188 - DNA, 16 bp, M. musculus
ttgccagtgtgtgtgt

SEQ ID NO: 456189 - DNA, 16 bp, M. musculus
ttgccagttgtgccag

SEQ ID NO: 456190 - DNA, 16 bp, M. musculus
ttgccatagaaggatc

SEQ ID NO: 456191 - DNA, 16 bp, M. musculus
ttgccatagatggaga

SEQ ID NO: 456192 - DNA, 16 bp, M. musculus
ttgccatatccaggga

SEQ ID NO: 456193 - DNA, 16 bp, M. musculus
ttgccatcaagcctga

SEQ ID NO: 456194 - DNA, 16 bp, M. musculus
ttgccatgactccata

SEQ ID NO: 456195 - DNA, 16 bp, M. musculus
ttgccatgcaagcctg

SEQ ID NO: 456196 - DNA, 16 bp, M. musculus
ttgccatggtcaagag

SEQ ID NO: 456197 - DNA, 16 bp, M. musculus
ttgccattccttgggg

SEQ ID NO: 456198 - DNA, 16 bp, M. musculus
ttgccatttatatgtc

SEQ ID NO: 456199 - DNA, 16 bp, M. musculus
ttgcccacagtgggct

SEQ ID NO: 456200 - DNA, 16 bp, M. musculus
ttgcccagcctgcttt

SEQ ID NO: 456201 - DNA, 16 bp, M. musculus
ttgcccaggctgccct

SEQ ID NO: 456202 - DNA, 16 bp, M. musculus
ttgcccaggctggcct

SEQ ID NO: 456203 - DNA, 16 bp, M. musculus
ttgcccccttcctggt

SEQ ID NO: 456204 - DNA, 16 bp, M. musculus
ttgcccctgcctcctg

SEQ ID NO: 456205 - DNA, 16 bp, M. musculus
ttgcccgagcttttgt

SEQ ID NO: 456206 - DNA, 16 bp, M. musculus
ttgccctaattcatct

SEQ ID NO: 456207 - DNA, 17 bp, M. musculus
ttgccctaggtagaagc

SEQ ID NO: 456208 - DNA, 16 bp, M. musculus
ttgccctgcctctctg

SEQ ID NO: 456209 - DNA, 16 bp, M. musculus
ttgccctggctgttgt

SEQ ID NO: 456210 - DNA, 16 bp, M. musculus
ttgccctgtgtcatga

SEQ ID NO: 456211 - DNA, 16 bp, M. musculus
ttgcccttggccacca

SEQ ID NO: 456212 - DNA, 16 bp, M. musculus
ttgccctttgacctcc

SEQ ID NO: 456213 - DNA, 16 bp, M. musculus
ttgccctttgtcatgg

SEQ ID NO: 456214 - DNA, 16 bp, M. musculus
ttgccgggcggtggtg

SEQ ID NO: 456215 - DNA, 16 bp, M. musculus
ttgcctaacatgcatg

SEQ ID NO: 456216 - DNA, 16 bp, M. musculus
ttgcctaatttccaat

SEQ ID NO: 456217 - DNA, 16 bp, M. musculus
ttgcctaccatgtgca

SEQ ID NO: 456218 - DNA, 16 bp, M. musculus
ttgcctagcaagcaca

SEQ ID NO: 456219 - DNA, 16 bp, M. musculus
ttgcctagcatgaaca

SEQ ID NO: 456220 - DNA, 16 bp, M. musculus
ttgcctaggtcatggt

SEQ ID NO: 456221 - DNA, 16 bp, M. musculus
ttgcctataatcccag

SEQ ID NO: 456222 - DNA, 16 bp, M. musculus
ttgcctcaaaaacaaa

SEQ ID NO: 456223 - DNA, 16 bp, M. musculus
ttgcctcactcaggat

SEQ ID NO: 456224 - DNA, 16 bp, M. musculus
ttgcctcagaatttca

SEQ ID NO: 456225 - DNA, 16 bp, M. musculus
ttgcctcagcaaaaca

SEQ ID NO: 456226 - DNA, 16 bp, M. musculus
ttgcctcagcatgtgc

SEQ ID NO: 456227 - DNA, 16 bp, M. musculus
ttgcctcagtttcctg

SEQ ID NO: 456228 - DNA, 16 bp, M. musculus
ttgcctcatgactgct

SEQ ID NO: 456229 - DNA, 16 bp, M. musculus
ttgcctccatttgtga

SEQ ID NO: 456230 - DNA, 16 bp, M. musculus
ttgcctcccaccatct

SEQ ID NO: 456231 - DNA, 16 bp, M. musculus
ttgcctccccagtgct

SEQ ID NO: 456232 - DNA, 16 bp, M. musculus
ttgcctcctgagtgct

SEQ ID NO: 456233 - DNA, 16 bp, M. musculus
ttgcctcctgccatct

SEQ ID NO: 456234 - DNA, 16 bp, M. musculus
ttgcctctacctccta

SEQ ID NO: 456235 - DNA, 16 bp, M. musculus
ttgcctctgaggttcc

SEQ ID NO: 456236 - DNA, 16 bp, M. musculus
ttgcctctgcctccag

SEQ ID NO: 456237 - DNA, 16 bp, M. musculus
ttgcctctgcctcctg

SEQ ID NO: 456238 - DNA, 19 bp, M. musculus
ttgcctctgtctcctgagt

SEQ ID NO: 456239 - DNA, 16 bp, M. musculus
ttgcctctgtgggcac

SEQ ID NO: 456240 - DNA, 16 bp, M. musculus
ttgcctcttgctccct

SEQ ID NO: 456241 - DNA, 16 bp, M. musculus
ttgcctgaaaaattca

SEQ ID NO: 456242 - DNA, 16 bp, M. musculus
ttgcctgcccctgcct

SEQ ID NO: 456243 - DNA, 16 bp, M. musculus
ttgcctgcctgctgcc

SEQ ID NO: 456244 - DNA, 16 bp, M. musculus
ttgcctgccttccttc

SEQ ID NO: 456245 - DNA, 16 bp, M. musculus
ttgcctgcttgccttc

SEQ ID NO: 456246 - DNA, 16 bp, M. musculus
ttgcctggaactggag

SEQ ID NO: 456247 - DNA, 16 bp, M. musculus
ttgcctggacactgcc

SEQ ID NO: 456248 - DNA, 16 bp, M. musculus
ttgcctggcatgcaca

SEQ ID NO: 456249 - DNA, 16 bp, M. musculus
ttgcctgggtcatggt

SEQ ID NO: 456250 - DNA, 16 bp, M. musculus
ttgcctggtgtggtgg

SEQ ID NO: 456251 - DNA, 16 bp, M. musculus
ttgcctggtttcttgt

SEQ ID NO: 456252 - DNA, 16 bp, M. musculus
ttgcctgtatgtggga

SEQ ID NO: 456253 - DNA, 16 bp, M. musculus
ttgcctgtcccagaaa

SEQ ID NO: 456254 - DNA, 16 bp, M. musculus
ttgcctgtctgtggaa

SEQ ID NO: 456255 - DNA, 16 bp, M. musculus
ttgcctgtggatcctg

SEQ ID NO: 456256 - DNA, 16 bp, M. musculus
ttgcctgttcctccac

SEQ ID NO: 456257 - DNA, 16 bp, M. musculus
ttgccttatttacttt

SEQ ID NO: 456258 - DNA, 16 bp, M. musculus
ttgccttcattttcat

SEQ ID NO: 456259 - DNA, 16 bp, M. musculus
ttgccttcctctgcct

SEQ ID NO: 456260 - DNA, 16 bp, M. musculus
ttgccttcttcactga

SEQ ID NO: 456261 - DNA, 17 bp, M. musculus
ttgccttgccttgcctt

SEQ ID NO: 456262 - DNA, 16 bp, M. musculus
ttgccttgctgaagct

SEQ ID NO: 456263 - DNA, 16 bp, M. musculus
ttgccttgctttgggt

SEQ ID NO: 456264 - DNA, 16 bp, M. musculus
ttgccttggagatccc

SEQ ID NO: 456265 - DNA, 16 bp, M. musculus
ttgccttggtcatggt

SEQ ID NO: 456266 - DNA, 16 bp, M. musculus
ttgccttgttcatggt

SEQ ID NO: 456267 - DNA, 16 bp, M. musculus
ttgcctttagttcttt

SEQ ID NO: 456268 - DNA, 16 bp, M. musculus
ttgcctttataagagt

SEQ ID NO: 456269 - DNA, 16 bp, M. musculus
ttgcctttctccatct

SEQ ID NO: 456270 - DNA, 16 bp, M. musculus
ttgcctttgccttcca

SEQ ID NO: 456271 - DNA, 16 bp, M. musculus
ttgcctttgcctttgc

SEQ ID NO: 456272 - DNA, 16 bp, M. musculus
ttgcctttgtttttga

SEQ ID NO: 456273 - DNA, 16 bp, M. musculus
ttgccttttggcttct

SEQ ID NO: 456274 - DNA, 16 bp, M. musculus
ttgccttttgtagaag

SEQ ID NO: 456275 - DNA, 16 bp, M. musculus
ttgcgccaccacgccc

SEQ ID NO: 456276 - DNA, 16 bp, M. musculus
ttgcgctctgcgctct

SEQ ID NO: 456277 - DNA, 16 bp, M. musculus
ttgctaaagtttcttt

SEQ ID NO: 456278 - DNA, 19 bp, M. musculus
ttgctaaatctgaggttga

SEQ ID NO: 456279 - DNA, 16 bp, M. musculus
ttgctaaccttttcat

SEQ ID NO: 456280 - DNA, 16 bp, M. musculus
ttgctaatagaaaaaa

SEQ ID NO: 456281 - DNA, 16 bp, M. musculus
ttgctaatatctgaaa

SEQ ID NO: 456282 - DNA, 16 bp, M. musculus
ttgctacacaactctg

SEQ ID NO: 456283 - DNA, 16 bp, M. musculus
ttgctaccaagcctga

SEQ ID NO: 456284 - DNA, 16 bp, M. musculus
ttgctactcttacaga

SEQ ID NO: 456285 - DNA, 16 bp, M. musculus
ttgctacttcataaca

SEQ ID NO: 456286 - DNA, 16 bp, M. musculus
ttgctacttcataact

SEQ ID NO: 456287 - DNA, 16 bp, M. musculus
ttgctacttcataatt

SEQ ID NO: 456288 - DNA, 16 bp, M. musculus
ttgctacttcatagct

SEQ ID NO: 456289 - DNA, 16 bp, M. musculus
ttgctactttctcatt

SEQ ID NO: 456290 - DNA, 16 bp, M. musculus
ttgctaggctccagca

SEQ ID NO: 456291 - DNA, 16 bp, M. musculus
ttgctagtatgtgcaa

SEQ ID NO: 456292 - DNA, 17 bp, M. musculus
ttgctatcttctttggg

SEQ ID NO: 456293 - DNA, 16 bp, M. musculus
ttgctatgaacatagt

SEQ ID NO: 456294 - DNA, 16 bp, M. musculus
ttgctatgacaaaata

SEQ ID NO: 456295 - DNA, 16 bp, M. musculus
ttgctatgaccaaata

SEQ ID NO: 456296 - DNA, 16 bp, M. musculus
ttgctatgggcatgga

SEQ ID NO: 456297 - DNA, 16 bp, M. musculus
ttgctatggtgggaga

SEQ ID NO: 456298 - DNA, 16 bp, M. musculus
ttgctatggttatgaa

SEQ ID NO: 456299 - DNA, 16 bp, M. musculus
ttgctatgtagcctag

SEQ ID NO: 456300 - DNA, 16 bp, M. musculus
ttgctatgtagcttag

SEQ ID NO: 456301 - DNA, 16 bp, M. musculus
ttgctattattattgg

SEQ ID NO: 456302 - DNA, 16 bp, M. musculus
ttgctattgctgtgat

SEQ ID NO: 456303 - DNA, 16 bp, M. musculus
ttgctatttaaaaaca

SEQ ID NO: 456304 - DNA, 16 bp, M. musculus
ttgctatttcataact

SEQ ID NO: 456305 - DNA, 16 bp, M. musculus
ttgctcagcatgcaca

SEQ ID NO: 456306 - DNA, 16 bp, M. musculus
ttgctcagcctggtct

SEQ ID NO: 456307 - DNA, 16 bp, M. musculus
ttgctcaggctggctt

SEQ ID NO: 456308 - DNA, 16 bp, M. musculus
ttgctcagtcccacaa

SEQ ID NO: 456309 - DNA, 16 bp, M. musculus
ttgctcagtccctgct

SEQ ID NO: 456310 - DNA, 16 bp, M. musculus
ttgctcagttgattta

SEQ ID NO: 456311 - DNA, 16 bp, M. musculus
ttgctcattcattcat

SEQ ID NO: 456312 - DNA, 16 bp, M. musculus
ttgctccagcccaaag

SEQ ID NO: 456313 - DNA, 16 bp, M. musculus
ttgctccctctggctt

SEQ ID NO: 456314 - DNA, 22 bp, M. musculus
ttgctccctggtatgcctgttc

SEQ ID NO: 456315 - DNA, 16 bp, M. musculus
ttgctcctcatgactt

SEQ ID NO: 456316 - DNA, 16 bp, M. musculus
ttgctcctgctccttc

SEQ ID NO: 456317 - DNA, 16 bp, M. musculus
ttgctcctgctgtcac

SEQ ID NO: 456318 - DNA, 16 bp, M. musculus
ttgctcctttgtcaaa

SEQ ID NO: 456319 - DNA, 16 bp, M. musculus
ttgctccttttcatta

SEQ ID NO: 456320 - DNA, 16 bp, M. musculus
ttgctctctgaaaact

SEQ ID NO: 456321 - DNA, 16 bp, M. musculus
ttgctctctgcatttt

SEQ ID NO: 456322 - DNA, 16 bp, M. musculus
ttgctctcttctcagt

SEQ ID NO: 456323 - DNA, 16 bp, M. musculus
ttgctctcttgctcct

SEQ ID NO: 456324 - DNA, 16 bp, M. musculus
ttgctctctttgcctg

SEQ ID NO: 456325 - DNA, 16 bp, M. musculus
ttgctctgaagaaaca

SEQ ID NO: 456326 - DNA, 16 bp, M. musculus
ttgctctgaagtacag

SEQ ID NO: 456327 - DNA, 16 bp, M. musculus
ttgctctgcttggctt

SEQ ID NO: 456328 - DNA, 16 bp, M. musculus
ttgctctggtcagccg

SEQ ID NO: 456329 - DNA, 16 bp, M. musculus
ttgctctggtcatggt

SEQ ID NO: 456330 - DNA, 16 bp, M. musculus
ttgctctgtagttcag

SEQ ID NO: 456331 - DNA, 16 bp, M. musculus
ttgctctgtctcctga

SEQ ID NO: 456332 - DNA, 16 bp, M. musculus
ttgctctgttgctatg

SEQ ID NO: 456333 - DNA, 16 bp, M. musculus
ttgctctgttgtacag

SEQ ID NO: 456334 - DNA, 16 bp, M. musculus
ttgctcttccacagga

SEQ ID NO: 456335 - DNA, 16 bp, M. musculus
ttgctcttccagagaa

SEQ ID NO: 456336 - DNA, 16 bp, M. musculus
ttgctcttccagagga

SEQ ID NO: 456337 - DNA, 16 bp, M. musculus
ttgctcttgaagagga

SEQ ID NO: 456338 - DNA, 16 bp, M. musculus
ttgctcttggagagga

SEQ ID NO: 456339 - DNA, 16 bp, M. musculus
ttgctgaaattattga

SEQ ID NO: 456340 - DNA, 16 bp, M. musculus
ttgctgaagccaagaa

SEQ ID NO: 456341 - DNA, 16 bp, M. musculus
ttgctgaatacagtga

SEQ ID NO: 456342 - DNA, 16 bp, M. musculus
ttgctgacaagagcct

SEQ ID NO: 456343 - DNA, 16 bp, M. musculus
ttgctgagagtgtggt

SEQ ID NO: 456344 - DNA, 16 bp, M. musculus
ttgctgagctctgctt

SEQ ID NO: 456345 - DNA, 16 bp, M. musculus
ttgctgaggaagtagc

SEQ ID NO: 456346 - DNA, 16 bp, M. musculus
ttgctgatgccaaaaa

SEQ ID NO: 456347 - DNA, 16 bp, M. musculus
ttgctgatggcaagaa

SEQ ID NO: 456348 - DNA, 16 bp, M. musculus
ttgctgcacaaacatc

SEQ ID NO: 456349 - DNA, 16 bp, M. musculus
ttgctgcacaagcctg

SEQ ID NO: 456350 - DNA, 16 bp, M. musculus
ttgctgcagaaggatc

SEQ ID NO: 456351 - DNA, 16 bp, M. musculus
ttgctgcaggaggaag

SEQ ID NO: 456352 - DNA, 16 bp, M. musculus
ttgctgccaagccaga

SEQ ID NO: 456353 - DNA, 16 bp, M. musculus
ttgctgccaagtctga

SEQ ID NO: 456354 - DNA, 16 bp, M. musculus
ttgctgccaagtttga

SEQ ID NO: 456355 - DNA, 16 bp, M. musculus
ttgctgcccagcctga

SEQ ID NO: 456356 - DNA, 16 bp, M. musculus
ttgctgcccttgcaga

SEQ ID NO: 456357 - DNA, 16 bp, M. musculus
ttgctgcctgccaatc

SEQ ID NO: 456358 - DNA, 16 bp, M. musculus
ttgctgctaagcctga

SEQ ID NO: 456359 - DNA, 16 bp, M. musculus
ttgctgctactgctgc

SEQ ID NO: 456360 - DNA, 16 bp, M. musculus
ttgctgctcccagaca

SEQ ID NO: 456361 - DNA, 16 bp, M. musculus
ttgctgctctaaaaga

SEQ ID NO: 456362 - DNA, 16 bp, M. musculus
ttgctgctcttccaga

SEQ ID NO: 456363 - DNA, 16 bp, M. musculus
ttgctgctgctactgc

SEQ ID NO: 456364 - DNA, 16 bp, M. musculus
ttgctgctgctcttgg

SEQ ID NO: 456365 - DNA, 17 bp, M. musculus
ttgctgctgctgctgca

SEQ ID NO: 456366 - DNA, 16 bp, M. musculus
ttgctgctgctgctgt

SEQ ID NO: 456367 - DNA, 18 bp, M. musculus
ttgctgctgctgctgttg

SEQ ID NO: 456368 - DNA, 16 bp, M. musculus
ttgctgctgctgttct

SEQ ID NO: 456369 - DNA, 16 bp, M. musculus
ttgctgctgctgttgt

SEQ ID NO: 456370 - DNA, 16 bp, M. musculus
ttgctgctgctgtttc

SEQ ID NO: 456371 - DNA, 16 bp, M. musculus
ttgctgctgctgtttt

SEQ ID NO: 456372 - DNA, 16 bp, M. musculus
ttgctgctgcttcttc

SEQ ID NO: 456373 - DNA, 16 bp, M. musculus
ttgctgctgggattgc

SEQ ID NO: 456374 - DNA, 16 bp, M. musculus
ttgctgctgttccaga

SEQ ID NO: 456375 - DNA, 16 bp, M. musculus
ttgctgcttcataact

SEQ ID NO: 456376 - DNA, 16 bp, M. musculus
ttgctgctttattcac

SEQ ID NO: 456377 - DNA, 16 bp, M. musculus
ttgctgcttttccaga

SEQ ID NO: 456378 - DNA, 16 bp, M. musculus
ttgctggaaaaaaaaa

SEQ ID NO: 456379 - DNA, 16 bp, M. musculus
ttgctggagcacacag

SEQ ID NO: 456380 - DNA, 16 bp, M. musculus
ttgctggagcagatgc

SEQ ID NO: 456381 - DNA, 16 bp, M. musculus
ttgctggatcctcctg

SEQ ID NO: 456382 - DNA, 16 bp, M. musculus
ttgctggatcttcctg

SEQ ID NO: 456383 - DNA, 16 bp, M. musculus
ttgctggatcttttgg

SEQ ID NO: 456384 - DNA, 16 bp, M. musculus
ttgctggattaaaatt

SEQ ID NO: 456385 - DNA, 16 bp, M. musculus
ttgctggctggacctc

SEQ ID NO: 456386 - DNA, 16 bp, M. musculus
ttgctggcttgctctc

SEQ ID NO: 456387 - DNA, 16 bp, M. musculus
ttgctgggacaaacac

SEQ ID NO: 456388 - DNA, 20 bp, M. musculus
ttgctgggattaaaggcgtg

SEQ ID NO: 456389 - DNA, 16 bp, M. musculus
ttgctgggatttaaac

SEQ ID NO: 456390 - DNA, 22 bp, M. musculus
ttgctgggatttgaactcatga

SEQ ID NO: 456391 - DNA, 16 bp, M. musculus
ttgctgggcagtggtg

SEQ ID NO: 456392 - DNA, 16 bp, M. musculus
ttgctggggaaaaaaa

SEQ ID NO: 456393 - DNA, 16 bp, M. musculus
ttgctggggctagaac

SEQ ID NO: 456394 - DNA, 16 bp, M. musculus
ttgctgggtcctctgg

SEQ ID NO: 456395 - DNA, 16 bp, M. musculus
ttgctgtacagaagct

SEQ ID NO: 456396 - DNA, 16 bp, M. musculus
ttgctgtagatggctt

SEQ ID NO: 456397 - DNA, 16 bp, M. musculus
ttgctgtagccactgt

SEQ ID NO: 456398 - DNA, 16 bp, M. musculus
ttgctgtataataaaa

SEQ ID NO: 456399 - DNA, 16 bp, M. musculus
ttgctgtatattgatt

SEQ ID NO: 456400 - DNA, 16 bp, M. musculus
ttgctgtatattgttt

SEQ ID NO: 456401 - DNA, 16 bp, M. musculus
ttgctgtctcctaaga

SEQ ID NO: 456402 - DNA, 16 bp, M. musculus
ttgctgtctctgactg

SEQ ID NO: 456403 - DNA, 16 bp, M. musculus
ttgctgtgaacagaca

SEQ ID NO: 456404 - DNA, 16 bp, M. musculus
ttgctgtgacaaaaca

SEQ ID NO: 456405 - DNA, 16 bp, M. musculus
ttgctgtgacaaaata

SEQ ID NO: 456406 - DNA, 16 bp, M. musculus
ttgctgtgagaaaata

SEQ ID NO: 456407 - DNA, 16 bp, M. musculus
ttgctgtgagcagaca

SEQ ID NO: 456408 - DNA, 16 bp, M. musculus
ttgctgtgataaaaat

SEQ ID NO: 456409 - DNA, 16 bp, M. musculus
ttgctgtgataaaaca

SEQ ID NO: 456410 - DNA, 16 bp, M. musculus
ttgctgtgataaaata

SEQ ID NO: 456411 - DNA, 16 bp, M. musculus
ttgctgtgatgaagca

SEQ ID NO: 456412 - DNA, 16 bp, M. musculus
ttgctgtgcagagaca

SEQ ID NO: 456413 - DNA, 16 bp, M. musculus
ttgctgtggccatggt

SEQ ID NO: 456414 - DNA, 16 bp, M. musculus
ttgctgtgggtctctg

SEQ ID NO: 456415 - DNA, 16 bp, M. musculus
ttgctgtggtcatggt

SEQ ID NO: 456416 - DNA, 16 bp, M. musculus
ttgctgtggtgaaaca

SEQ ID NO: 456417 - DNA, 16 bp, M. musculus
ttgctgtgtagctgag

SEQ ID NO: 456418 - DNA, 16 bp, M. musculus
ttgctgtgtagtccag

SEQ ID NO: 456419 - DNA, 16 bp, M. musculus
ttgctgttcctgcaga

SEQ ID NO: 456420 - DNA, 16 bp, M. musculus
ttgctgttctattctg

SEQ ID NO: 456421 - DNA, 16 bp, M. musculus
ttgctgttctgattat

SEQ ID NO: 456422 - DNA, 16 bp, M. musculus
ttgctgttcttctaga

SEQ ID NO: 456423 - DNA, 16 bp, M. musculus
ttgctgttcttgcaga

SEQ ID NO: 456424 - DNA, 16 bp, M. musculus
ttgctgttgcccttgg

SEQ ID NO: 456425 - DNA, 17 bp, M. musculus
ttgctgttgctgctgct

SEQ ID NO: 456426 - DNA, 16 bp, M. musculus
ttgctgtttctgactg

SEQ ID NO: 456427 - DNA, 16 bp, M. musculus
ttgctgtttcttctgg

SEQ ID NO: 456428 - DNA, 16 bp, M. musculus
ttgctgttttgattgt

SEQ ID NO: 456429 - DNA, 16 bp, M. musculus
ttgcttacattttcag

SEQ ID NO: 456430 - DNA, 16 bp, M. musculus
ttgcttatattcttat

SEQ ID NO: 456431 - DNA, 16 bp, M. musculus
ttgcttatttttaaaa

SEQ ID NO: 456432 - DNA, 16 bp, M. musculus
ttgcttattttttaaa

SEQ ID NO: 456433 - DNA, 16 bp, M. musculus
ttgcttcaagattctc

SEQ ID NO: 456434 - DNA, 16 bp, M. musculus
ttgcttcaagcttttc

SEQ ID NO: 456435 - DNA, 16 bp, M. musculus
ttgcttcagaaaaaaa

SEQ ID NO: 456436 - DNA, 16 bp, M. musculus
ttgcttcaggtttcct

SEQ ID NO: 456437 - DNA, 16 bp, M. musculus
ttgcttcagtctctgt

SEQ ID NO: 456438 - DNA, 16 bp, M. musculus
ttgcttccaacttctc

SEQ ID NO: 456439 - DNA, 16 bp, M. musculus
ttgcttccagcctctc

SEQ ID NO: 456440 - DNA, 16 bp, M. musculus
ttgcttccagctcctc

SEQ ID NO: 456441 - DNA, 16 bp, M. musculus
ttgcttcccatgactt

SEQ ID NO: 456442 - DNA, 16 bp, M. musculus
ttgcttcccctagctt

SEQ ID NO: 456443 - DNA, 16 bp, M. musculus
ttgcttccctctcttg

SEQ ID NO: 456444 - DNA, 16 bp, M. musculus
ttgcttccctcttgct

SEQ ID NO: 456445 - DNA, 16 bp, M. musculus
ttgcttcctctggctt

SEQ ID NO: 456446 - DNA, 16 bp, M. musculus
ttgcttcctttcattt

SEQ ID NO: 456447 - DNA, 16 bp, M. musculus
ttgcttcgtggtcatg

SEQ ID NO: 456448 - DNA, 16 bp, M. musculus
ttgcttctcttgttaa

SEQ ID NO: 456449 - DNA, 16 bp, M. musculus
ttgcttctgctgcctg

SEQ ID NO: 456450 - DNA, 16 bp, M. musculus
ttgcttcttgctcctg

SEQ ID NO: 456451 - DNA, 16 bp, M. musculus
ttgcttcttggccttt

SEQ ID NO: 456452 - DNA, 16 bp, M. musculus
ttgcttcttgggcatg

SEQ ID NO: 456453 - DNA, 16 bp, M. musculus
ttgcttcttggtaatg

SEQ ID NO: 456454 - DNA, 17 bp, M. musculus
ttgcttcttggtcatgt

SEQ ID NO: 456455 - DNA, 16 bp, M. musculus
ttgcttgcatgtatgc

SEQ ID NO: 456456 - DNA, 16 bp, M. musculus
ttgcttgcatgtatgt

SEQ ID NO: 456457 - DNA, 16 bp, M. musculus
ttgcttgctattctaa

SEQ ID NO: 456458 - DNA, 16 bp, M. musculus
ttgcttgcttatactt

SEQ ID NO: 456459 - DNA, 16 bp, M. musculus
ttgcttgcttgtttga

SEQ ID NO: 456460 - DNA, 16 bp, M. musculus
ttgcttggaaaacatt

SEQ ID NO: 456461 - DNA, 16 bp, M. musculus
ttgcttggaaaatgtt

SEQ ID NO: 456462 - DNA, 16 bp, M. musculus
ttgcttggcttgcttt

SEQ ID NO: 456463 - DNA, 16 bp, M. musculus
ttgcttgtatgtttgt

SEQ ID NO: 456464 - DNA, 16 bp, M. musculus
ttgctttaaaaaaaat

SEQ ID NO: 456465 - DNA, 16 bp, M. musculus
ttgctttagcagaaca

SEQ ID NO: 456466 - DNA, 16 bp, M. musculus
ttgctttagtcggtga

SEQ ID NO: 456467 - DNA, 16 bp, M. musculus
ttgctttcagaacaag

SEQ ID NO: 456468 - DNA, 16 bp, M. musculus
ttgctttcctggtgtc

SEQ ID NO: 456469 - DNA, 16 bp, M. musculus
ttgctttcttaaaaaa

SEQ ID NO: 456470 - DNA, 16 bp, M. musculus
ttgctttctttgcctg

SEQ ID NO: 456471 - DNA, 16 bp, M. musculus
ttgctttcttttaaaa

SEQ ID NO: 456472 - DNA, 23 bp, M. musculus
ttgctttgccagtttggggttgg

SEQ ID NO: 456473 - DNA, 16 bp, M. musculus
ttgctttgctttttaa

SEQ ID NO: 456474 - DNA, 16 bp, M. musculus
ttgctttgctttttga

SEQ ID NO: 456475 - DNA, 16 bp, M. musculus
ttgctttggagcatgg

SEQ ID NO: 456476 - DNA, 16 bp, M. musculus
ttgctttggtcacggt

SEQ ID NO: 456477 - DNA, 16 bp, M. musculus
ttgctttggtcatggt

SEQ ID NO: 456478 - DNA, 16 bp, M. musculus
ttgctttgtagccaag

SEQ ID NO: 456479 - DNA, 16 bp, M. musculus
ttgctttgtatggctg

SEQ ID NO: 456480 - DNA, 16 bp, M. musculus
ttgctttgtgcatttg

SEQ ID NO: 456481 - DNA, 16 bp, M. musculus
ttgctttgttttaaaa

SEQ ID NO: 456482 - DNA, 16 bp, M. musculus
ttgcttttaatatgtt

SEQ ID NO: 456483 - DNA, 16 bp, M. musculus
ttgcttttactgtgtt

SEQ ID NO: 456484 - DNA, 16 bp, M. musculus
ttgcttttataaagaa

SEQ ID NO: 456485 - DNA, 16 bp, M. musculus
ttgcttttccagagga

SEQ ID NO: 456486 - DNA, 16 bp, M. musculus
ttgcttttgacaagat

SEQ ID NO: 456487 - DNA, 16 bp, M. musculus
ttgcttttgctctgga

SEQ ID NO: 456488 - DNA, 16 bp, M. musculus
ttgcttttgtcagagt

SEQ ID NO: 456489 - DNA, 16 bp, M. musculus
ttgcttttgttaagat

SEQ ID NO: 456490 - DNA, 16 bp, M. musculus
ttgcttttgtttaaaa

SEQ ID NO: 456491 - DNA, 16 bp, M. musculus
ttgcttttgtttgaga

SEQ ID NO: 456492 - DNA, 16 bp, M. musculus
ttgctttttaaatgtt

SEQ ID NO: 456493 - DNA, 16 bp, M. musculus
ttgctttttaaattat

SEQ ID NO: 456494 - DNA, 16 bp, M. musculus
ttgcttttttggtcat

SEQ ID NO: 456495 - DNA, 16 bp, M. musculus
ttgctttttttaaaaa

SEQ ID NO: 456496 - DNA, 16 bp, M. musculus
ttggaaaaaaaaatca

SEQ ID NO: 456497 - DNA, 16 bp, M. musculus
ttggaaaaaaaaatgt

SEQ ID NO: 456498 - DNA, 16 bp, M. musculus
ttggaaaaaaaatcaa

SEQ ID NO: 456499 - DNA, 16 bp, M. musculus
ttggaaaaacaagaac

SEQ ID NO: 456500 - DNA, 16 bp, M. musculus
ttggaaaaatgactca

SEQ ID NO: 456501 - DNA, 16 bp, M. musculus
ttggaaaacagaaagc

SEQ ID NO: 456502 - DNA, 16 bp, M. musculus
ttggaaaagaacacat

SEQ ID NO: 456503 - DNA, 16 bp, M. musculus
ttggaaaagatgaagt

SEQ ID NO: 456504 - DNA, 16 bp, M. musculus
ttggaaaataccaaag

SEQ ID NO: 456505 - DNA, 16 bp, M. musculus
ttggaaaatggaaaac

SEQ ID NO: 456506 - DNA, 16 bp, M. musculus
ttggaaaattccacca

SEQ ID NO: 456507 - DNA, 16 bp, M. musculus
ttggaaagaaaatgaa

SEQ ID NO: 456508 - DNA, 16 bp, M. musculus
ttggaaagaaaggccc

SEQ ID NO: 456509 - DNA, 16 bp, M. musculus
ttggaaagaagaagtc

SEQ ID NO: 456510 - DNA, 16 bp, M. musculus
ttggaaagataaggaa

SEQ ID NO: 456511 - DNA, 16 bp, M. musculus
ttggaaagatttattt

SEQ ID NO: 456512 - DNA, 16 bp, M. musculus
ttggaaaggaaaaata

SEQ ID NO: 456513 - DNA, 16 bp, M. musculus
ttggaaaggaaagagt

SEQ ID NO: 456514 - DNA, 16 bp, M. musculus
ttggaaaggaagaaag

SEQ ID NO: 456515 - DNA, 16 bp, M. musculus
ttggaaaggaagaaat

SEQ ID NO: 456516 - DNA, 16 bp, M. musculus
ttggaaaggaagaact

SEQ ID NO: 456517 - DNA, 16 bp, M. musculus
ttggaaaggaagaagc

SEQ ID NO: 456518 - DNA, 16 bp, M. musculus
ttggaaagggcaatct

SEQ ID NO: 456519 - DNA, 16 bp, M. musculus
ttggaaataaatctac

SEQ ID NO: 456520 - DNA, 16 bp, M. musculus
ttggaaatataaatga

SEQ ID NO: 456521 - DNA, 16 bp, M. musculus
ttggaaatgaaattga

SEQ ID NO: 456522 - DNA, 16 bp, M. musculus
ttggaaatggaaaacc

SEQ ID NO: 456523 - DNA, 16 bp, M. musculus
ttggaaatgtaaaaga

SEQ ID NO: 456524 - DNA, 16 bp, M. musculus
ttggaaatgtaagcca

SEQ ID NO: 456525 - DNA, 16 bp, M. musculus
ttggaaatgtgattga

SEQ ID NO: 456526 - DNA, 16 bp, M. musculus
ttggaaatgttattga

SEQ ID NO: 456527 - DNA, 16 bp, M. musculus
ttggaaattgttttgt

SEQ ID NO: 456528 - DNA, 16 bp, M. musculus
ttggaacatcttctgg

SEQ ID NO: 456529 - DNA, 16 bp, M. musculus
ttggaactcttttttt

SEQ ID NO: 456530 - DNA, 16 bp, M. musculus
ttggaactgaagttat

SEQ ID NO: 456531 - DNA, 16 bp, M. musculus
ttggaactggagtcac

SEQ ID NO: 456532 - DNA, 16 bp, M. musculus
ttggaagaagggagtc

SEQ ID NO: 456533 - DNA, 16 bp, M. musculus
ttggaagacagaggca

SEQ ID NO: 456534 - DNA, 16 bp, M. musculus
ttggaagagcagccag

SEQ ID NO: 456535 - DNA, 16 bp, M. musculus
ttggaagagcagctag

SEQ ID NO: 456536 - DNA, 16 bp, M. musculus
ttggaagagcagctgg

SEQ ID NO: 456537 - DNA, 16 bp, M. musculus
ttggaagagcagtcaa

SEQ ID NO: 456538 - DNA, 16 bp, M. musculus
ttggaagagggaactt

SEQ ID NO: 456539 - DNA, 16 bp, M. musculus
ttggaagcaggagctg

SEQ ID NO: 456540 - DNA, 16 bp, M. musculus
ttggaaggaaggagaa

SEQ ID NO: 456541 - DNA, 16 bp, M. musculus
ttggaaggagagaacc

SEQ ID NO: 456542 - DNA, 16 bp, M. musculus
ttggaaggattagaag

SEQ ID NO: 456543 - DNA, 16 bp, M. musculus
ttggaaggctgaagca

SEQ ID NO: 456544 - DNA, 16 bp, M. musculus
ttggaaggtagaggca

SEQ ID NO: 456545 - DNA, 16 bp, M. musculus
ttggaaggtggaagca

SEQ ID NO: 456546 - DNA, 16 bp, M. musculus
ttggaagtattcaaag

SEQ ID NO: 456547 - DNA, 16 bp, M. musculus
ttggaagtcagaggca

SEQ ID NO: 456548 - DNA, 16 bp, M. musculus
ttggaagtggagttac

SEQ ID NO: 456549 - DNA, 16 bp, M. musculus
ttggaagtgtgatgaa

SEQ ID NO: 456550 - DNA, 16 bp, M. musculus
ttggaatactttggtt

SEQ ID NO: 456551 - DNA, 16 bp, M. musculus
ttggaatagatgtgtc

SEQ ID NO: 456552 - DNA, 16 bp, M. musculus
ttggaatcttcctgcc

SEQ ID NO: 456553 - DNA, 16 bp, M. musculus
ttggaatttaagacca

SEQ ID NO: 456554 - DNA, 16 bp, M. musculus
ttggaatttgatttta

SEQ ID NO: 456555 - DNA, 16 bp, M. musculus
ttggaatttgtcaaat

SEQ ID NO: 456556 - DNA, 16 bp, M. musculus
ttggaattttgttggg

SEQ ID NO: 456557 - DNA, 16 bp, M. musculus
ttggaatttttatggg

SEQ ID NO: 456558 - DNA, 16 bp, M. musculus
ttggaatttttcttct

SEQ ID NO: 456559 - DNA, 16 bp, M. musculus
ttggacaaaatacatt

SEQ ID NO: 456560 - DNA, 16 bp, M. musculus
ttggacaaagctcaag

SEQ ID NO: 456561 - DNA, 16 bp, M. musculus
ttggacaagcttttta

SEQ ID NO: 456562 - DNA, 16 bp, M. musculus
ttggacagatgtcata

SEQ ID NO: 456563 - DNA, 33 bp, M. musculus
ttggacagatgttatacagacactaagagaaca

SEQ ID NO: 456564 - DNA, 16 bp, M. musculus
ttggacatcaatggga

SEQ ID NO: 456565 - DNA, 16 bp, M. musculus
ttggacatcagacatg

SEQ ID NO: 456566 - DNA, 16 bp, M. musculus
ttggacatgagctttg

SEQ ID NO: 456567 - DNA, 16 bp, M. musculus
ttggacatggtgtctg

SEQ ID NO: 456568 - DNA, 16 bp, M. musculus
ttggacattagtcccc

SEQ ID NO: 456569 - DNA, 16 bp, M. musculus
ttggacattttttcag

SEQ ID NO: 456570 - DNA, 16 bp, M. musculus
ttggaccacagcctgt

SEQ ID NO: 456571 - DNA, 16 bp, M. musculus
ttggaccagaaatgaa

SEQ ID NO: 456572 - DNA, 16 bp, M. musculus
ttggaccagcccatgt

SEQ ID NO: 456573 - DNA, 16 bp, M. musculus
ttggacccagtccttc

SEQ ID NO: 456574 - DNA, 17 bp, M. musculus
ttggacctggagggcat

SEQ ID NO: 456575 - DNA, 16 bp, M. musculus
ttggactgagcaaagg

SEQ ID NO: 456576 - DNA, 16 bp, M. musculus
ttggacttcagaaaat

SEQ ID NO: 456577 - DNA, 16 bp, M. musculus
ttggacttgagtttgt

SEQ ID NO: 456578 - DNA, 16 bp, M. musculus
ttggagaaagaggaac

SEQ ID NO: 456579 - DNA, 16 bp, M. musculus
ttggagaaagtgtgcc

SEQ ID NO: 456580 - DNA, 16 bp, M. musculus
ttggagaagataccat

SEQ ID NO: 456581 - DNA, 16 bp, M. musculus
ttggagaaggagctga

SEQ ID NO: 456582 - DNA, 16 bp, M. musculus
ttggagacagggattc

SEQ ID NO: 456583 - DNA, 16 bp, M. musculus
ttggagaccactgtga

SEQ ID NO: 456584 - DNA, 16 bp, M. musculus
ttggagaccagaagag

SEQ ID NO: 456585 - DNA, 16 bp, M. musculus
ttggagaccccaagat

SEQ ID NO: 456586 - DNA, 16 bp, M. musculus
ttggagagatggctga

SEQ ID NO: 456587 - DNA, 16 bp, M. musculus
ttggagaggaaaggat

SEQ ID NO: 456588 - DNA, 16 bp, M. musculus
ttggagaggagtttaa

SEQ ID NO: 456589 - DNA, 16 bp, M. musculus
ttggagaggcagaggc

SEQ ID NO: 456590 - DNA, 16 bp, M. musculus
ttggagatcaccacaa

SEQ ID NO: 456591 - DNA, 16 bp, M. musculus
ttggagatgccagcac

SEQ ID NO: 456592 - DNA, 16 bp, M. musculus
ttggagatgccaggac

SEQ ID NO: 456593 - DNA, 18 bp, M. musculus
ttggagatgccagtacca

SEQ ID NO: 456594 - DNA, 16 bp, M. musculus
ttggagatgcctgata

SEQ ID NO: 456595 - DNA, 16 bp, M. musculus
ttggagatgctgctgc

SEQ ID NO: 456596 - DNA, 16 bp, M. musculus
ttggagcagcagctgt

SEQ ID NO: 456597 - DNA, 26 bp, M. musculus
ttggagcagttagtatttgcttcctg

SEQ ID NO: 456598 - DNA, 16 bp, M. musculus
ttggagcatcttctga

SEQ ID NO: 456599 - DNA, 16 bp, M. musculus
ttggagcatcttctgt

SEQ ID NO: 456600 - DNA, 16 bp, M. musculus
ttggagcatctttggg

SEQ ID NO: 456601 - DNA, 16 bp, M. musculus
ttggagcccagcctgg

SEQ ID NO: 456602 - DNA, 16 bp, M. musculus
ttggagctaaaacaaa

SEQ ID NO: 456603 - DNA, 16 bp, M. musculus
ttggagctccatggaa

SEQ ID NO: 456604 - DNA, 16 bp, M. musculus
ttggagctctcagaga

SEQ ID NO: 456605 - DNA, 16 bp, M. musculus
ttggaggacagccatg

SEQ ID NO: 456606 - DNA, 16 bp, M. musculus
ttggaggacagcctgg

SEQ ID NO: 456607 - DNA, 16 bp, M. musculus
ttggaggaccagcagt

SEQ ID NO: 456608 - DNA, 16 bp, M. musculus
ttggaggagagcagtg

SEQ ID NO: 456609 - DNA, 16 bp, M. musculus
ttggaggagcagccag

SEQ ID NO: 456610 - DNA, 16 bp, M. musculus
ttggaggaggagagac

SEQ ID NO: 456611 - DNA, 16 bp, M. musculus
ttggaggcagaggaag

SEQ ID NO: 456612 - DNA, 16 bp, M. musculus
ttggaggcagaggcag

SEQ ID NO: 456613 - DNA, 16 bp, M. musculus
ttggaggcagattatg

SEQ ID NO: 456614 - DNA, 16 bp, M. musculus
ttggaggcctgttctt

SEQ ID NO: 456615 - DNA, 16 bp, M. musculus
ttggaggctaacctgg

SEQ ID NO: 456616 - DNA, 16 bp, M. musculus
ttggaggctctgtgtt

SEQ ID NO: 456617 - DNA, 16 bp, M. musculus
ttggagggaaagtgga

SEQ ID NO: 456618 - DNA, 16 bp, M. musculus
ttggagggaggaaatg

SEQ ID NO: 456619 - DNA, 16 bp, M. musculus
ttggaggggaagccag

SEQ ID NO: 456620 - DNA, 16 bp, M. musculus
ttggaggtcagcctgg

SEQ ID NO: 456621 - DNA, 16 bp, M. musculus
ttggaggtggatggag

SEQ ID NO: 456622 - DNA, 16 bp, M. musculus
ttggaggttttgaaaa

SEQ ID NO: 456623 - DNA, 16 bp, M. musculus
ttggagtctaccttct

SEQ ID NO: 456624 - DNA, 16 bp, M. musculus
ttggagtgtctgaaga

SEQ ID NO: 456625 - DNA, 16 bp, M. musculus
ttggagttctttttag

SEQ ID NO: 456626 - DNA, 16 bp, M. musculus
ttggagtttgcccaga

SEQ ID NO: 456627 - DNA, 16 bp, M. musculus
ttggagtttgcccagt

SEQ ID NO: 456628 - DNA, 16 bp, M. musculus
ttggagttttccatct

SEQ ID NO: 456629 - DNA, 16 bp, M. musculus
ttggagttttctcttt

SEQ ID NO: 456630 - DNA, 16 bp, M. musculus
ttggagtttttccttt

SEQ ID NO: 456631 - DNA, 18 bp, M. musculus
ttggatattagtccccta

SEQ ID NO: 456632 - DNA, 16 bp, M. musculus
ttggatcccagaaccc

SEQ ID NO: 456633 - DNA, 16 bp, M. musculus
ttggatcccctaaaac

SEQ ID NO: 456634 - DNA, 16 bp, M. musculus
ttggatcctctggaat

SEQ ID NO: 456635 - DNA, 16 bp, M. musculus
ttggatctcctcagca

SEQ ID NO: 456636 - DNA, 16 bp, M. musculus
ttggatcttccagtag

SEQ ID NO: 456637 - DNA, 16 bp, M. musculus
ttggatgaagcacagg

SEQ ID NO: 456638 - DNA, 16 bp, M. musculus
ttggatgccagcctgg

SEQ ID NO: 456639 - DNA, 17 bp, M. musculus
ttggatgggtcacacag

SEQ ID NO: 456640 - DNA, 16 bp, M. musculus
ttggatgtagtactac

SEQ ID NO: 456641 - DNA, 16 bp, M. musculus
ttggattagttggact

SEQ ID NO: 456642 - DNA, 16 bp, M. musculus
ttggattatttcctgc

SEQ ID NO: 456643 - DNA, 16 bp, M. musculus
ttggattatttggatt

SEQ ID NO: 456644 - DNA, 16 bp, M. musculus
ttggattcagtttaca

SEQ ID NO: 456645 - DNA, 16 bp, M. musculus
ttggattctgtttgtg

SEQ ID NO: 456646 - DNA, 16 bp, M. musculus
ttggattcttctcaac

SEQ ID NO: 456647 - DNA, 16 bp, M. musculus
ttggattggcctgtgg

SEQ ID NO: 456648 - DNA, 17 bp, M. musculus
ttggatttctcaatgtt

SEQ ID NO: 456649 - DNA, 16 bp, M. musculus
ttggatttctgattct

SEQ ID NO: 456650 - DNA, 16 bp, M. musculus
ttggattttagaagat

SEQ ID NO: 456651 - DNA, 16 bp, M. musculus
ttggattttatcaaag

SEQ ID NO: 456652 - DNA, 16 bp, M. musculus
ttggattttgtcaaag

SEQ ID NO: 456653 - DNA, 16 bp, M. musculus
ttggatttttaaaaag

SEQ ID NO: 456654 - DNA, 16 bp, M. musculus
ttggatttttcaaatg

SEQ ID NO: 456655 - DNA, 16 bp, M. musculus
ttggcaaagatccttt

SEQ ID NO: 456656 - DNA, 18 bp, M. musculus
ttggcaagagagccattt

SEQ ID NO: 456657 - DNA, 16 bp, M. musculus
ttggcaatacatctgg

SEQ ID NO: 456658 - DNA, 16 bp, M. musculus
ttggcacagtttcaca

SEQ ID NO: 456659 - DNA, 16 bp, M. musculus
ttggcacatagtagga

SEQ ID NO: 456660 - DNA, 16 bp, M. musculus
ttggcacatgccttta

SEQ ID NO: 456661 - DNA, 16 bp, M. musculus
ttggcactgagggcag

SEQ ID NO: 456662 - DNA, 17 bp, M. musculus
ttggcagaatgatgtca

SEQ ID NO: 456663 - DNA, 16 bp, M. musculus
ttggcagagagaatgt

SEQ ID NO: 456664 - DNA, 16 bp, M. musculus
ttggcagcaaacacct

SEQ ID NO: 456665 - DNA, 16 bp, M. musculus
ttggcagcaagcatcc

SEQ ID NO: 456666 - DNA, 16 bp, M. musculus
ttggcagcaagcccct

SEQ ID NO: 456667 - DNA, 16 bp, M. musculus
ttggcagcaagtacct

SEQ ID NO: 456668 - DNA, 16 bp, M. musculus
ttggcagcaagtgcct

SEQ ID NO: 456669 - DNA, 22 bp, M. musculus
ttggcagcagatggcattgtaa

SEQ ID NO: 456670 - DNA, 16 bp, M. musculus
ttggcagcaggctcct

SEQ ID NO: 456671 - DNA, 16 bp, M. musculus
ttggcagtttcttttt

SEQ ID NO: 456672 - DNA, 16 bp, M. musculus
ttggcagtttttcaga

SEQ ID NO: 456673 - DNA, 16 bp, M. musculus
ttggcatccacaatgg

SEQ ID NO: 456674 - DNA, 16 bp, M. musculus
ttggcatcttcaatag

SEQ ID NO: 456675 - DNA, 16 bp, M. musculus
ttggcatgaaactgca

SEQ ID NO: 456676 - DNA, 16 bp, M. musculus
ttggcattgctgggtt

SEQ ID NO: 456677 - DNA, 16 bp, M. musculus
ttggcatttttattta

SEQ ID NO: 456678 - DNA, 16 bp, M. musculus
ttggccaaggaaggaa

SEQ ID NO: 456679 - DNA, 16 bp, M. musculus
ttggccaatgggctgc

SEQ ID NO: 456680 - DNA, 16 bp, M. musculus
ttggccactcccataa

SEQ ID NO: 456681 - DNA, 16 bp, M. musculus
ttggccactggcaact

SEQ ID NO: 456682 - DNA, 16 bp, M. musculus
ttggccaggagggagg

SEQ ID NO: 456683 - DNA, 16 bp, M. musculus
ttggccaggctggcct

SEQ ID NO: 456684 - DNA, 16 bp, M. musculus
ttggccagtcagctcc

SEQ ID NO: 456685 - DNA, 16 bp, M. musculus
ttggccagtccttaaa

SEQ ID NO: 456686 - DNA, 16 bp, M. musculus
ttggccattgaatctt

SEQ ID NO: 456687 - DNA, 16 bp, M. musculus
ttggcccatgggaagt

SEQ ID NO: 456688 - DNA, 16 bp, M. musculus
ttggccctggaattcc

SEQ ID NO: 456689 - DNA, 16 bp, M. musculus
ttggccctggggtttc

SEQ ID NO: 456690 - DNA, 16 bp, M. musculus
ttggccctggtgctcc

SEQ ID NO: 456691 - DNA, 16 bp, M. musculus
ttggcctcctggctgc

SEQ ID NO: 456692 - DNA, 16 bp, M. musculus
ttggcctgcctctgcc

SEQ ID NO: 456693 - DNA, 16 bp, M. musculus
ttggcctggaaataaa

SEQ ID NO: 456694 - DNA, 16 bp, M. musculus
ttggcctggaactcac

SEQ ID NO: 456695 - DNA, 16 bp, M. musculus
ttggcctgtcacagaa

SEQ ID NO: 456696 - DNA, 16 bp, M. musculus
ttggcctgtggccatg

SEQ ID NO: 456697 - DNA, 16 bp, M. musculus
ttggcctgtgggcaaa

SEQ ID NO: 456698 - DNA, 16 bp, M. musculus
ttggccttggctttcc

SEQ ID NO: 456699 - DNA, 16 bp, M. musculus
ttggccttgttcagac

SEQ ID NO: 456700 - DNA, 16 bp, M. musculus
ttggcctttttgaaga

SEQ ID NO: 456701 - DNA, 16 bp, M. musculus
ttggctaaactggctg

SEQ ID NO: 456702 - DNA, 16 bp, M. musculus
ttggctacacacacac

SEQ ID NO: 456703 - DNA, 16 bp, M. musculus
ttggctactctctctc

SEQ ID NO: 456704 - DNA, 16 bp, M. musculus
ttggctatctactgct

SEQ ID NO: 456705 - DNA, 16 bp, M. musculus
ttggctatgaatttca

SEQ ID NO: 456706 - DNA, 16 bp, M. musculus
ttggctattataaata

SEQ ID NO: 456707 - DNA, 16 bp, M. musculus
ttggctattccctcag

SEQ ID NO: 456708 - DNA, 16 bp, M. musculus
ttggctcacagtttga

SEQ ID NO: 456709 - DNA, 16 bp, M. musculus
ttggctcagcaggtaa

SEQ ID NO: 456710 - DNA, 16 bp, M. musculus
ttggctcagctgttaa

SEQ ID NO: 456711 - DNA, 16 bp, M. musculus
ttggctcatggtttca

SEQ ID NO: 456712 - DNA, 16 bp, M. musculus
ttggctcccagcacca

SEQ ID NO: 456713 - DNA, 16 bp, M. musculus
ttggctctctcacatg

SEQ ID NO: 456714 - DNA, 16 bp, M. musculus
ttggctctggaacagc

SEQ ID NO: 456715 - DNA, 16 bp, M. musculus
ttggctgaaaggaccc

SEQ ID NO: 456716 - DNA, 16 bp, M. musculus
ttggctgaagttgttt

SEQ ID NO: 456717 - DNA, 16 bp, M. musculus
ttggctgacctggaac

SEQ ID NO: 456718 - DNA, 16 bp, M. musculus
ttggctgagagcatct

SEQ ID NO: 456719 - DNA, 16 bp, M. musculus
ttggctgctctcccag

SEQ ID NO: 456720 - DNA, 16 bp, M. musculus
ttggctggcccagaac

SEQ ID NO: 456721 - DNA, 16 bp, M. musculus
ttggctggcttctttt

SEQ ID NO: 456722 - DNA, 16 bp, M. musculus
ttggctgggagactgt

SEQ ID NO: 456723 - DNA, 16 bp, M. musculus
ttggctgggagacttt

SEQ ID NO: 456724 - DNA, 16 bp, M. musculus
ttggctggttggctgg

SEQ ID NO: 456725 - DNA, 16 bp, M. musculus
ttggctgtcttggaac

SEQ ID NO: 456726 - DNA, 16 bp, M. musculus
ttggctgtgaacatct

SEQ ID NO: 456727 - DNA, 16 bp, M. musculus
ttggctgtgagtcttt

SEQ ID NO: 456728 - DNA, 16 bp, M. musculus
ttggctgtgagtgtct

SEQ ID NO: 456729 - DNA, 16 bp, M. musculus
ttggctgtgggcatct

SEQ ID NO: 456730 - DNA, 75 bp, M. musculus
ttggcttaaaggaaataggtggggttggcgagtatacattccactaagagatcctgggttcattttcacgatcag

SEQ ID NO: 456731 - DNA, 16 bp, M. musculus
ttggcttctcttccag

SEQ ID NO: 456732 - DNA, 16 bp, M. musculus
ttggcttgatcttgtg

SEQ ID NO: 456733 - DNA, 16 bp, M. musculus
ttggcttgcctcccct

SEQ ID NO: 456734 - DNA, 16 bp, M. musculus
ttggcttggcttggct

SEQ ID NO: 456735 - DNA, 16 bp, M. musculus
ttggcttgtaggcaag

SEQ ID NO: 456736 - DNA, 16 bp, M. musculus
ttggcttttcaagaca

SEQ ID NO: 456737 - DNA, 16 bp, M. musculus
ttggctttttaaaatg

SEQ ID NO: 456738 - DNA, 16 bp, M. musculus
ttgggaaaaaaaaatc

SEQ ID NO: 456739 - DNA, 16 bp, M. musculus
ttgggaaaaaaaaatg

SEQ ID NO: 456740 - DNA, 16 bp, M. musculus
ttgggaaaaaaacaaa

SEQ ID NO: 456741 - DNA, 16 bp, M. musculus
ttgggaaaaagatctt

SEQ ID NO: 456742 - DNA, 16 bp, M. musculus
ttgggaaaatgcctcc

SEQ ID NO: 456743 - DNA, 17 bp, M. musculus
ttgggaaacagaggcag

SEQ ID NO: 456744 - DNA, 16 bp, M. musculus
ttgggaaactgaggca

SEQ ID NO: 456745 - DNA, 16 bp, M. musculus
ttgggaaaggattttt

SEQ ID NO: 456746 - DNA, 16 bp, M. musculus
ttgggaaattttcttc

SEQ ID NO: 456747 - DNA, 16 bp, M. musculus
ttgggaacaaaactcc

SEQ ID NO: 456748 - DNA, 30 bp, M. musculus
ttgggaagaacatacaattgaagaccattt

SEQ ID NO: 456749 - DNA, 16 bp, M. musculus
ttgggaagaagaagaa

SEQ ID NO: 456750 - DNA, 16 bp, M. musculus
ttgggaagattctgtg

SEQ ID NO: 456751 - DNA, 16 bp, M. musculus
ttgggaagctaaggca

SEQ ID NO: 456752 - DNA, 16 bp, M. musculus
ttgggaagctgaggta

SEQ ID NO: 456753 - DNA, 16 bp, M. musculus
ttgggaaggaaaaggt

SEQ ID NO: 456754 - DNA, 16 bp, M. musculus
ttgggaaggctgtgga

SEQ ID NO: 456755 - DNA, 16 bp, M. musculus
ttgggaagttttcttt

SEQ ID NO: 456756 - DNA, 16 bp, M. musculus
ttgggaataatttgtt

SEQ ID NO: 456757 - DNA, 16 bp, M. musculus
ttgggaatctctcaca

SEQ ID NO: 456758 - DNA, 18 bp, M. musculus
ttgggaatgtggcctttg

SEQ ID NO: 456759 - DNA, 16 bp, M. musculus
ttgggaattgaactct

SEQ ID NO: 456760 - DNA, 16 bp, M. musculus
ttgggaatttcagcta

SEQ ID NO: 456761 - DNA, 16 bp, M. musculus
ttgggaatttttttct

SEQ ID NO: 456762 - DNA, 16 bp, M. musculus
ttgggacaatagccag

SEQ ID NO: 456763 - DNA, 24 bp, M. musculus
ttgggactcagaatggtctcccct

SEQ ID NO: 456764 - DNA, 16 bp, M. musculus
ttgggagacaaaggca

SEQ ID NO: 456765 - DNA, 16 bp, M. musculus
ttgggagacagaagca

SEQ ID NO: 456766 - DNA, 16 bp, M. musculus
ttgggagacagaggtg

SEQ ID NO: 456767 - DNA, 16 bp, M. musculus
ttgggagacaggcagg

SEQ ID NO: 456768 - DNA, 16 bp, M. musculus
ttgggagacagggtct

SEQ ID NO: 456769 - DNA, 16 bp, M. musculus
ttgggagagagaagga

SEQ ID NO: 456770 - DNA, 16 bp, M. musculus
ttgggaggaagagaag

SEQ ID NO: 456771 - DNA, 16 bp, M. musculus
ttgggaggacttacta

SEQ ID NO: 456772 - DNA, 16 bp, M. musculus
ttgggaggagttggga

SEQ ID NO: 456773 - DNA, 16 bp, M. musculus
ttgggaggcaggagga

SEQ ID NO: 456774 - DNA, 16 bp, M. musculus
ttgggaggctgaagca

SEQ ID NO: 456775 - DNA, 16 bp, M. musculus
ttgggaggctgaagga

SEQ ID NO: 456776 - DNA, 16 bp, M. musculus
ttgggaggctgaggta

SEQ ID NO: 456777 - DNA, 16 bp, M. musculus
ttgggagggaaaaaaa

SEQ ID NO: 456778 - DNA, 16 bp, M. musculus
ttgggagggagaagca

SEQ ID NO: 456779 - DNA, 16 bp, M. musculus
ttgggaggtagatgca

SEQ ID NO: 456780 - DNA, 16 bp, M. musculus
ttgggagtgaggatgt

SEQ ID NO: 456781 - DNA, 16 bp, M. musculus
ttgggatagcaatgga

SEQ ID NO: 456782 - DNA, 16 bp, M. musculus
ttgggatcaaaggcat

SEQ ID NO: 456783 - DNA, 16 bp, M. musculus
ttgggatggaagtcga

SEQ ID NO: 456784 - DNA, 18 bp, M. musculus
ttgggattaaaggtgtgc

SEQ ID NO: 456785 - DNA, 18 bp, M. musculus
ttgggattaaaggtgtgt

SEQ ID NO: 456786 - DNA, 72 bp, M. musculus
ttgggattacaccactacagaaggtaggaaccacctagtcctctatcgccagttgctcttagcgggtctcca

SEQ ID NO: 456787 - DNA, 16 bp, M. musculus
ttgggattacaggcat

SEQ ID NO: 456788 - DNA, 16 bp, M. musculus
ttgggattccagcata

SEQ ID NO: 456789 - DNA, 16 bp, M. musculus
ttgggattgaacccag

SEQ ID NO: 456790 - DNA, 16 bp, M. musculus
ttgggcaagaatccac

SEQ ID NO: 456791 - DNA, 16 bp, M. musculus
ttgggcaagtcactta

SEQ ID NO: 456792 - DNA, 16 bp, M. musculus
ttgggcacttcatcta

SEQ ID NO: 456793 - DNA, 16 bp, M. musculus
ttgggcagcagttcag

SEQ ID NO: 456794 - DNA, 16 bp, M. musculus
ttgggcagctcacaac

SEQ ID NO: 456795 - DNA, 16 bp, M. musculus
ttgggcatggtggtgc

SEQ ID NO: 456796 - DNA, 16 bp, M. musculus
ttgggcatggtgtctg

SEQ ID NO: 456797 - DNA, 16 bp, M. musculus
ttgggccagagagagc

SEQ ID NO: 456798 - DNA, 16 bp, M. musculus
ttgggccaggtctgca

SEQ ID NO: 456799 - DNA, 16 bp, M. musculus
ttgggccaggtgtggt

SEQ ID NO: 456800 - DNA, 16 bp, M. musculus
ttgggcctctcagagg

SEQ ID NO: 456801 - DNA, 16 bp, M. musculus
ttgggcctgaggatgt

SEQ ID NO: 456802 - DNA, 16 bp, M. musculus
ttgggcctgtccctgg

SEQ ID NO: 456803 - DNA, 16 bp, M. musculus
ttgggcctgttgctag

SEQ ID NO: 456804 - DNA, 16 bp, M. musculus
ttgggccttcttcttt

SEQ ID NO: 456805 - DNA, 16 bp, M. musculus
ttgggctggtcattgg

SEQ ID NO: 456806 - DNA, 17 bp, M. musculus
ttgggcttgctaggcaa

SEQ ID NO: 456807 - DNA, 16 bp, M. musculus
ttgggcttggaattca

SEQ ID NO: 456808 - DNA, 16 bp, M. musculus
ttggggaaaaaaatga

SEQ ID NO: 456809 - DNA, 16 bp, M. musculus
ttggggaaattttctt

SEQ ID NO: 456810 - DNA, 16 bp, M. musculus
ttggggaatccaggac

SEQ ID NO: 456811 - DNA, 16 bp, M. musculus
ttggggaatgccaggg

SEQ ID NO: 456812 - DNA, 16 bp, M. musculus
ttggggaccctatgct

SEQ ID NO: 456813 - DNA, 16 bp, M. musculus
ttggggaccctgtggt

SEQ ID NO: 456814 - DNA, 16 bp, M. musculus
ttggggactccatgct

SEQ ID NO: 456815 - DNA, 16 bp, M. musculus
ttggggactttgtgct

SEQ ID NO: 456816 - DNA, 17 bp, M. musculus
ttggggagatgcctcca

SEQ ID NO: 456817 - DNA, 16 bp, M. musculus
ttggggagcagaggga

SEQ ID NO: 456818 - DNA, 16 bp, M. musculus
ttggggagcaggggga

SEQ ID NO: 456819 - DNA, 16 bp, M. musculus
ttggggatcctgagaa

SEQ ID NO: 456820 - DNA, 16 bp, M. musculus
ttggggatgtagctca

SEQ ID NO: 456821 - DNA, 16 bp, M. musculus
ttggggattgaattca

SEQ ID NO: 456822 - DNA, 16 bp, M. musculus
ttggggcaaaaaagct

SEQ ID NO: 456823 - DNA, 16 bp, M. musculus
ttggggcaggagctgt

SEQ ID NO: 456824 - DNA, 16 bp, M. musculus
ttggggcctccctttg

SEQ ID NO: 456825 - DNA, 16 bp, M. musculus
ttggggcctgttttgt

SEQ ID NO: 456826 - DNA, 16 bp, M. musculus
ttggggctgacttaca

SEQ ID NO: 456827 - DNA, 16 bp, M. musculus
ttggggctggggagca

SEQ ID NO: 456828 - DNA, 16 bp, M. musculus
ttgggggccctgtgct

SEQ ID NO: 456829 - DNA, 16 bp, M. musculus
ttgggggctgaggcag

SEQ ID NO: 456830 - DNA, 20 bp, M. musculus
ttgggggctggagagatggc

SEQ ID NO: 456831 - DNA, 16 bp, M. musculus
ttgggggctggggaga

SEQ ID NO: 456832 - DNA, 16 bp, M. musculus
ttgggggctgtgtgat

SEQ ID NO: 456833 - DNA, 16 bp, M. musculus
ttgggggcttcatatc

SEQ ID NO: 456834 - DNA, 16 bp, M. musculus
ttggggggaggggcat

SEQ ID NO: 456835 - DNA, 16 bp, M. musculus
ttggggggcagagaca

SEQ ID NO: 456836 - DNA, 16 bp, M. musculus
ttggggggcagaggca

SEQ ID NO: 456837 - DNA, 16 bp, M. musculus
ttgggggtcaaatgac

SEQ ID NO: 456838 - DNA, 16 bp, M. musculus
ttggggtacatgatgt

SEQ ID NO: 456839 - DNA, 16 bp, M. musculus
ttggggtggggacatc

SEQ ID NO: 456840 - DNA, 16 bp, M. musculus
ttggggtgtagctcag

SEQ ID NO: 456841 - DNA, 16 bp, M. musculus
ttggggtgttgcctct

SEQ ID NO: 456842 - DNA, 16 bp, M. musculus
ttgggtaaattttctt

SEQ ID NO: 456843 - DNA, 16 bp, M. musculus
ttgggtaccaccccac

SEQ ID NO: 456844 - DNA, 16 bp, M. musculus
ttgggtatatttgctt

SEQ ID NO: 456845 - DNA, 16 bp, M. musculus
ttgggtcctcaggctt

SEQ ID NO: 456846 - DNA, 16 bp, M. musculus
ttgggtctgagttcct

SEQ ID NO: 456847 - DNA, 16 bp, M. musculus
ttgggtctggagagat

SEQ ID NO: 456848 - DNA, 16 bp, M. musculus
ttgggtctgggatgac

SEQ ID NO: 456849 - DNA, 16 bp, M. musculus
ttgggtctgggttgcc

SEQ ID NO: 456850 - DNA, 16 bp, M. musculus
ttgggtctttctgagg

SEQ ID NO: 456851 - DNA, 16 bp, M. musculus
ttgggtcttttggaag

SEQ ID NO: 456852 - DNA, 16 bp, M. musculus
ttgggtgtaagtatct

SEQ ID NO: 456853 - DNA, 16 bp, M. musculus
ttgggtgtctggttat

SEQ ID NO: 456854 - DNA, 16 bp, M. musculus
ttgggtgtgaactcag

SEQ ID NO: 456855 - DNA, 16 bp, M. musculus
ttgggttcctgccttg

SEQ ID NO: 456856 - DNA, 16 bp, M. musculus
ttggtaaaagtccttt

SEQ ID NO: 456857 - DNA, 16 bp, M. musculus
ttggtaaagatctttt

SEQ ID NO: 456858 - DNA, 16 bp, M. musculus
ttggtaaggtagagca

SEQ ID NO: 456859 - DNA, 16 bp, M. musculus
ttggtaagtgatatct

SEQ ID NO: 456860 - DNA, 16 bp, M. musculus
ttggtaatgggagaaa

SEQ ID NO: 456861 - DNA, 16 bp, M. musculus
ttggtaccaggagtgg

SEQ ID NO: 456862 - DNA, 16 bp, M. musculus
ttggtagatagatact

SEQ ID NO: 456863 - DNA, 23 bp, M. musculus
ttggtatctagttccagttacaa

SEQ ID NO: 456864 - DNA, 16 bp, M. musculus
ttggtattgttttcct

SEQ ID NO: 456865 - DNA, 16 bp, M. musculus
ttggtcaaaaaacagg

SEQ ID NO: 456866 - DNA, 17 bp, M. musculus
ttggtcaagatggatga

SEQ ID NO: 456867 - DNA, 16 bp, M. musculus
ttggtcaaggaaagaa

SEQ ID NO: 456868 - DNA, 16 bp, M. musculus
ttggtcaagtaagaaa

SEQ ID NO: 456869 - DNA, 16 bp, M. musculus
ttggtcacagctccaa

SEQ ID NO: 456870 - DNA, 16 bp, M. musculus
ttggtcaccactgtca

SEQ ID NO: 456871 - DNA, 16 bp, M. musculus
ttggtcagaatgtttt

SEQ ID NO: 456872 - DNA, 16 bp, M. musculus
ttggtcagcccaccag

SEQ ID NO: 456873 - DNA, 16 bp, M. musculus
ttggtcaggatagatg

SEQ ID NO: 456874 - DNA, 16 bp, M. musculus
ttggtcatgatatttg

SEQ ID NO: 456875 - DNA, 16 bp, M. musculus
ttggtcatgatgttta

SEQ ID NO: 456876 - DNA, 16 bp, M. musculus
ttggtcatgatgtttt

SEQ ID NO: 456877 - DNA, 16 bp, M. musculus
ttggtcatggtatttt

SEQ ID NO: 456878 - DNA, 16 bp, M. musculus
ttggtccccagttagt

SEQ ID NO: 456879 - DNA, 16 bp, M. musculus
ttggtcccttgtctgt

SEQ ID NO: 456880 - DNA, 16 bp, M. musculus
ttggtcctcctgtggg

SEQ ID NO: 456881 - DNA, 16 bp, M. musculus
ttggtcgtgcaaacat

SEQ ID NO: 456882 - DNA, 16 bp, M. musculus
ttggtctacacagcaa

SEQ ID NO: 456883 - DNA, 16 bp, M. musculus
ttggtctctgtaactc

SEQ ID NO: 456884 - DNA, 16 bp, M. musculus
ttggtctctgtgagtt

SEQ ID NO: 456885 - DNA, 16 bp, M. musculus
ttggtctgaattggga

SEQ ID NO: 456886 - DNA, 16 bp, M. musculus
ttggtctggtttgagg

SEQ ID NO: 456887 - DNA, 16 bp, M. musculus
ttggtcttcctgcctc

SEQ ID NO: 456888 - DNA, 16 bp, M. musculus
ttggtcttccttattc

SEQ ID NO: 456889 - DNA, 16 bp, M. musculus
ttggtcttccttcctc

SEQ ID NO: 456890 - DNA, 16 bp, M. musculus
ttggtcttgcagagga

SEQ ID NO: 456891 - DNA, 16 bp, M. musculus
ttggtcttgtgaaggt

SEQ ID NO: 456892 - DNA, 16 bp, M. musculus
ttggtgaaagtggtgt

SEQ ID NO: 456893 - DNA, 16 bp, M. musculus
ttggtgaagaacagca

SEQ ID NO: 456894 - DNA, 16 bp, M. musculus
ttggtgaagaatatgg

SEQ ID NO: 456895 - DNA, 16 bp, M. musculus
ttggtgaagcctagtt

SEQ ID NO: 456896 - DNA, 16 bp, M. musculus
ttggtgaagtgtttgc

SEQ ID NO: 456897 - DNA, 16 bp, M. musculus
ttggtgactccattta

SEQ ID NO: 456898 - DNA, 16 bp, M. musculus
ttggtgactgtatata

SEQ ID NO: 456899 - DNA, 16 bp, M. musculus
ttggtgagatggctca

SEQ ID NO: 456900 - DNA, 16 bp, M. musculus
ttggtgagttctaggt

SEQ ID NO: 456901 - DNA, 16 bp, M. musculus
ttggtgatacagctgt

SEQ ID NO: 456902 - DNA, 16 bp, M. musculus
ttggtgatatatatat

SEQ ID NO: 456903 - DNA, 16 bp, M. musculus
ttggtgatgaacagca

SEQ ID NO: 456904 - DNA, 16 bp, M. musculus
ttggtgatgaagagca

SEQ ID NO: 456905 - DNA, 16 bp, M. musculus
ttggtgatgagcagca

SEQ ID NO: 456906 - DNA, 16 bp, M. musculus
ttggtgatgcttacat

SEQ ID NO: 456907 - DNA, 16 bp, M. musculus
ttggtgatgtttgcat

SEQ ID NO: 456908 - DNA, 16 bp, M. musculus
ttggtgattttttaaa

SEQ ID NO: 456909 - DNA, 16 bp, M. musculus
ttggtgccatctctgg

SEQ ID NO: 456910 - DNA, 16 bp, M. musculus
ttggtggagacgtgcc

SEQ ID NO: 456911 - DNA, 16 bp, M. musculus
ttggtggagggggtaa

SEQ ID NO: 456912 - DNA, 16 bp, M. musculus
ttggtggcacatgcct

SEQ ID NO: 456913 - DNA, 16 bp, M. musculus
ttggtggcaggcacct

SEQ ID NO: 456914 - DNA, 16 bp, M. musculus
ttggtgggcaggacat

SEQ ID NO: 456915 - DNA, 16 bp, M. musculus
ttggtgggtttgcaag

SEQ ID NO: 456916 - DNA, 16 bp, M. musculus
ttggtggtccagtttt

SEQ ID NO: 456917 - DNA, 16 bp, M. musculus
ttggtggtgcacacct

SEQ ID NO: 456918 - DNA, 16 bp, M. musculus
ttggtggtttagtccc

SEQ ID NO: 456919 - DNA, 16 bp, M. musculus
ttggtggtttagtcct

SEQ ID NO: 456920 - DNA, 16 bp, M. musculus
ttggtgtacatgagga

SEQ ID NO: 456921 - DNA, 16 bp, M. musculus
ttggtgtcatccttgt

SEQ ID NO: 456922 - DNA, 16 bp, M. musculus
ttggtgtctgaagatg

SEQ ID NO: 456923 - DNA, 16 bp, M. musculus
ttggtgtgtctgaaga

SEQ ID NO: 456924 - DNA, 16 bp, M. musculus
ttggtgtgttcttgga

SEQ ID NO: 456925 - DNA, 16 bp, M. musculus
ttggtgttaagtgctc

SEQ ID NO: 456926 - DNA, 16 bp, M. musculus
ttggttaaggctctgg

SEQ ID NO: 456927 - DNA, 16 bp, M. musculus
ttggttacccccataa

SEQ ID NO: 456928 - DNA, 26 bp, M. musculus
ttggttatctatgctcaagaattagt

SEQ ID NO: 456929 - DNA, 16 bp, M. musculus
ttggttatttcctgcc

SEQ ID NO: 456930 - DNA, 16 bp, M. musculus
ttggttatttcctgct

SEQ ID NO: 456931 - DNA, 16 bp, M. musculus
ttggttcaatatatgg

SEQ ID NO: 456932 - DNA, 16 bp, M. musculus
ttggttcagtttggtt

SEQ ID NO: 456933 - DNA, 16 bp, M. musculus
ttggttcattgagaaa

SEQ ID NO: 456934 - DNA, 16 bp, M. musculus
ttggttcccagcacct

SEQ ID NO: 456935 - DNA, 16 bp, M. musculus
ttggttcccagcatcc

SEQ ID NO: 456936 - DNA, 16 bp, M. musculus
ttggttcccggatcct

SEQ ID NO: 456937 - DNA, 16 bp, M. musculus
ttggttccttgagaaa

SEQ ID NO: 456938 - DNA, 16 bp, M. musculus
ttggttgccttccaga

SEQ ID NO: 456939 - DNA, 16 bp, M. musculus
ttggttgctgagaaag

SEQ ID NO: 456940 - DNA, 16 bp, M. musculus
ttggttgtgagtctct

SEQ ID NO: 456941 - DNA, 16 bp, M. musculus
ttggtttaaaaagaaa

SEQ ID NO: 456942 - DNA, 16 bp, M. musculus
ttggtttctgttggta

SEQ ID NO: 456943 - DNA, 16 bp, M. musculus
ttggtttctgtttgta

SEQ ID NO: 456944 - DNA, 16 bp, M. musculus
ttggtttggtttttca

SEQ ID NO: 456945 - DNA, 16 bp, M. musculus
ttggttttacctctca

SEQ ID NO: 456946 - DNA, 16 bp, M. musculus
ttggttttatgagaca

SEQ ID NO: 456947 - DNA, 16 bp, M. musculus
ttggttttcaacttga

SEQ ID NO: 456948 - DNA, 16 bp, M. musculus
ttggttttctgaagtc

SEQ ID NO: 456949 - DNA, 16 bp, M. musculus
ttggtttttcaaggca

SEQ ID NO: 456950 - DNA, 16 bp, M. musculus
ttggtttttgaggcag

SEQ ID NO: 456951 - DNA, 16 bp, M. musculus
ttgtaaaactttaaaa

SEQ ID NO: 456952 - DNA, 45 bp, M. musculus
ttgtaaaagccgctctccctagtatgggcaaatatatggaatgga

SEQ ID NO: 456953 - DNA, 16 bp, M. musculus
ttgtaaaattacattc

SEQ ID NO: 456954 - DNA, 16 bp, M. musculus
ttgtaaacattttatt

SEQ ID NO: 456955 - DNA, 17 bp, M. musculus
ttgtaaagactttggat

SEQ ID NO: 456956 - DNA, 16 bp, M. musculus
ttgtaaagtgaataaa

SEQ ID NO: 456957 - DNA, 16 bp, M. musculus
ttgtaaatacattttg

SEQ ID NO: 456958 - DNA, 16 bp, M. musculus
ttgtaaatgtgtgtgt

SEQ ID NO: 456959 - DNA, 16 bp, M. musculus
ttgtaaatgttcattg

SEQ ID NO: 456960 - DNA, 28 bp, M. musculus
ttgtaaattggcatggaaatttaaagca

SEQ ID NO: 456961 - DNA, 16 bp, M. musculus
ttgtaaatttctgtat

SEQ ID NO: 456962 - DNA, 16 bp, M. musculus
ttgtaaattttatctt

SEQ ID NO: 456963 - DNA, 16 bp, M. musculus
ttgtaaccaaataaaa

SEQ ID NO: 456964 - DNA, 16 bp, M. musculus
ttgtaaccccagcact

SEQ ID NO: 456965 - DNA, 17 bp, M. musculus
ttgtaactcctgttcca

SEQ ID NO: 456966 - DNA, 16 bp, M. musculus
ttgtaactttacactt

SEQ ID NO: 456967 - DNA, 16 bp, M. musculus
ttgtaagaattgcctt

SEQ ID NO: 456968 - DNA, 16 bp, M. musculus
ttgtaagagttgcctt

SEQ ID NO: 456969 - DNA, 16 bp, M. musculus
ttgtaagccaccatat

SEQ ID NO: 456970 - DNA, 16 bp, M. musculus
ttgtaagccaccatgt

SEQ ID NO: 456971 - DNA, 16 bp, M. musculus
ttgtaagctgccatgt

SEQ ID NO: 456972 - DNA, 16 bp, M. musculus
ttgtaagctgctgtgt

SEQ ID NO: 456973 - DNA, 16 bp, M. musculus
ttgtaaggaatttggt

SEQ ID NO: 456974 - DNA, 16 bp, M. musculus
ttgtaagtcacagtta

SEQ ID NO: 456975 - DNA, 16 bp, M. musculus
ttgtaagtcaccatgt

SEQ ID NO: 456976 - DNA, 16 bp, M. musculus
ttgtaatcccagcact

SEQ ID NO: 456977 - DNA, 16 bp, M. musculus
ttgtaatcctagcact

SEQ ID NO: 456978 - DNA, 22 bp, M. musculus
ttgtaatgcctaattagtttca

SEQ ID NO: 456979 - DNA, 16 bp, M. musculus
ttgtaattctttaagg

SEQ ID NO: 456980 - DNA, 16 bp, M. musculus
ttgtaatttttttcaa

SEQ ID NO: 456981 - DNA, 16 bp, M. musculus
ttgtacaaaagagtca

SEQ ID NO: 456982 - DNA, 16 bp, M. musculus
ttgtacaagaagataa

SEQ ID NO: 456983 - DNA, 16 bp, M. musculus
ttgtacaaggagagaa

SEQ ID NO: 456984 - DNA, 16 bp, M. musculus
ttgtacaaggagatga

SEQ ID NO: 456985 - DNA, 16 bp, M. musculus
ttgtacacacacacat

SEQ ID NO: 456986 - DNA, 16 bp, M. musculus
ttgtacacacacatgc

SEQ ID NO: 456987 - DNA, 16 bp, M. musculus
ttgtacacctttaatc

SEQ ID NO: 456988 - DNA, 16 bp, M. musculus
ttgtacatgttaggca

SEQ ID NO: 456989 - DNA, 16 bp, M. musculus
ttgtaccagcttgcag

SEQ ID NO: 456990 - DNA, 16 bp, M. musculus
ttgtactaaggacaaa

SEQ ID NO: 456991 - DNA, 16 bp, M. musculus
ttgtactaaggtccaa

SEQ ID NO: 456992 - DNA, 16 bp, M. musculus
ttgtactggctagttt

SEQ ID NO: 456993 - DNA, 16 bp, M. musculus
ttgtacttgagctttg

SEQ ID NO: 456994 - DNA, 16 bp, M. musculus
ttgtactttaagtcct

SEQ ID NO: 456995 - DNA, 16 bp, M. musculus
ttgtagaaaatattta

SEQ ID NO: 456996 - DNA, 16 bp, M. musculus
ttgtagaactttaaaa

SEQ ID NO: 456997 - DNA, 16 bp, M. musculus
ttgtagacaagataaa

SEQ ID NO: 456998 - DNA, 16 bp, M. musculus
ttgtagaccagctggc

SEQ ID NO: 456999 - DNA, 16 bp, M. musculus
ttgtagaccaggctga

SEQ ID NO: 457000 - DNA, 16 bp, M. musculus
ttgtagaccagtctgg

SEQ ID NO: 457001 - DNA, 16 bp, M. musculus
ttgtagagcagcccca

SEQ ID NO: 457002 - DNA, 16 bp, M. musculus
ttgtagagtttaatga

SEQ ID NO: 457003 - DNA, 16 bp, M. musculus
ttgtagcagaagatgg

SEQ ID NO: 457004 - DNA, 16 bp, M. musculus
ttgtagcccagactgg

SEQ ID NO: 457005 - DNA, 16 bp, M. musculus
ttgtagcccaggctga

SEQ ID NO: 457006 - DNA, 16 bp, M. musculus
ttgtagctggtctttg

SEQ ID NO: 457007 - DNA, 16 bp, M. musculus
ttgtagcttgttatgc

SEQ ID NO: 457008 - DNA, 16 bp, M. musculus
ttgtagcttttaatat

SEQ ID NO: 457009 - DNA, 16 bp, M. musculus
ttgtaggaaaatagat

SEQ ID NO: 457010 - DNA, 16 bp, M. musculus
ttgtaggcaggacaca

SEQ ID NO: 457011 - DNA, 16 bp, M. musculus
ttgtaggccaggctag

SEQ ID NO: 457012 - DNA, 16 bp, M. musculus
ttgtagggatggattt

SEQ ID NO: 457013 - DNA, 16 bp, M. musculus
ttgtaggtcaggctgg

SEQ ID NO: 457014 - DNA, 16 bp, M. musculus
ttgtagttttaaaaat

SEQ ID NO: 457015 - DNA, 16 bp, M. musculus
ttgtataagaaagaaa

SEQ ID NO: 457016 - DNA, 16 bp, M. musculus
ttgtataagaaagcag

SEQ ID NO: 457017 - DNA, 16 bp, M. musculus
ttgtatacatttattt

SEQ ID NO: 457018 - DNA, 16 bp, M. musculus
ttgtatagccagtttg

SEQ ID NO: 457019 - DNA, 16 bp, M. musculus
ttgtatatagtggata

SEQ ID NO: 457020 - DNA, 16 bp, M. musculus
ttgtatatgtatatgt

SEQ ID NO: 457021 - DNA, 16 bp, M. musculus
ttgtatattaatagaa

SEQ ID NO: 457022 - DNA, 16 bp, M. musculus
ttgtatattctagata

SEQ ID NO: 457023 - DNA, 16 bp, M. musculus
ttgtatattgtatctt

SEQ ID NO: 457024 - DNA, 16 bp, M. musculus
ttgtatattttagaaa

SEQ ID NO: 457025 - DNA, 16 bp, M. musculus
ttgtatcaaaaacaaa

SEQ ID NO: 457026 - DNA, 16 bp, M. musculus
ttgtatcaatattcat

SEQ ID NO: 457027 - DNA, 16 bp, M. musculus
ttgtatcttatctctt

SEQ ID NO: 457028 - DNA, 16 bp, M. musculus
ttgtatgaaaatttca

SEQ ID NO: 457029 - DNA, 16 bp, M. musculus
ttgtatgagtgtgtgt

SEQ ID NO: 457030 - DNA, 16 bp, M. musculus
ttgtatggaattctca

SEQ ID NO: 457031 - DNA, 16 bp, M. musculus
ttgtatggatcacagg

SEQ ID NO: 457032 - DNA, 16 bp, M. musculus
ttgtatgtctgtatgt

SEQ ID NO: 457033 - DNA, 16 bp, M. musculus
ttgtatgtcttcccta

SEQ ID NO: 457034 - DNA, 16 bp, M. musculus
ttgtatgtgagtgtgt

SEQ ID NO: 457035 - DNA, 16 bp, M. musculus
ttgtatgtgtatgggt

SEQ ID NO: 457036 - DNA, 16 bp, M. musculus
ttgtatgtgtatgtat

SEQ ID NO: 457037 - DNA, 16 bp, M. musculus
ttgtatgtgtgcacat

SEQ ID NO: 457038 - DNA, 17 bp, M. musculus
ttgtatgttacttgacc

SEQ ID NO: 457039 - DNA, 16 bp, M. musculus
ttgtattacaaatgtg

SEQ ID NO: 457040 - DNA, 16 bp, M. musculus
ttgtattagtcagagt

SEQ ID NO: 457041 - DNA, 16 bp, M. musculus
ttgtattctgtttgtg

SEQ ID NO: 457042 - DNA, 16 bp, M. musculus
ttgtattctttttaaa

SEQ ID NO: 457043 - DNA, 16 bp, M. musculus
ttgtatttagaaatat

SEQ ID NO: 457044 - DNA, 16 bp, M. musculus
ttgtatttatatcaat

SEQ ID NO: 457045 - DNA, 16 bp, M. musculus
ttgtatttctttaagt

SEQ ID NO: 457046 - DNA, 16 bp, M. musculus
ttgtatttgctgaaaa

SEQ ID NO: 457047 - DNA, 16 bp, M. musculus
ttgtattttaattaca

SEQ ID NO: 457048 - DNA, 16 bp, M. musculus
ttgtattttatgtaca

SEQ ID NO: 457049 - DNA, 16 bp, M. musculus
ttgtattttccaggca

SEQ ID NO: 457050 - DNA, 16 bp, M. musculus
ttgtattttctgtaaa

SEQ ID NO: 457051 - DNA, 16 bp, M. musculus
ttgtattttctgtact

SEQ ID NO: 457052 - DNA, 16 bp, M. musculus
ttgtattttgcaaatt

SEQ ID NO: 457053 - DNA, 16 bp, M. musculus
ttgtcaaaaatcaagt

SEQ ID NO: 457054 - DNA, 16 bp, M. musculus
ttgtcaaacgctttct

SEQ ID NO: 457055 - DNA, 16 bp, M. musculus
ttgtcaaagaatttca

SEQ ID NO: 457056 - DNA, 16 bp, M. musculus
ttgtcaaagacatttt

SEQ ID NO: 457057 - DNA, 16 bp, M. musculus
ttgtcaaattactctg

SEQ ID NO: 457058 - DNA, 16 bp, M. musculus
ttgtcaacctgacagg

SEQ ID NO: 457059 - DNA, 16 bp, M. musculus
ttgtcaacttgacaca

SEQ ID NO: 457060 - DNA, 16 bp, M. musculus
ttgtcaactttacaca

SEQ ID NO: 457061 - DNA, 16 bp, M. musculus
ttgtcaagtattttgt

SEQ ID NO: 457062 - DNA, 16 bp, M. musculus
ttgtcaatttgacaca

SEQ ID NO: 457063 - DNA, 16 bp, M. musculus
ttgtcacacagatctt

SEQ ID NO: 457064 - DNA, 16 bp, M. musculus
ttgtcacagcaacaga

SEQ ID NO: 457065 - DNA, 16 bp, M. musculus
ttgtcacagcaatggg

SEQ ID NO: 457066 - DNA, 16 bp, M. musculus
ttgtcaccaccaccac

SEQ ID NO: 457067 - DNA, 16 bp, M. musculus
ttgtcacctgcagctg

SEQ ID NO: 457068 - DNA, 16 bp, M. musculus
ttgtcactgttaagag

SEQ ID NO: 457069 - DNA, 16 bp, M. musculus
ttgtcagatattaaaa

SEQ ID NO: 457070 - DNA, 16 bp, M. musculus
ttgtcagcaagtactt

SEQ ID NO: 457071 - DNA, 16 bp, M. musculus
ttgtcagcatctgctg

SEQ ID NO: 457072 - DNA, 16 bp, M. musculus
ttgtcaggataccagc

SEQ ID NO: 457073 - DNA, 16 bp, M. musculus
ttgtcaggctctggca

SEQ ID NO: 457074 - DNA, 16 bp, M. musculus
ttgtcaggctggagag

SEQ ID NO: 457075 - DNA, 16 bp, M. musculus
ttgtcaggcttggcaa

SEQ ID NO: 457076 - DNA, 16 bp, M. musculus
ttgtcaggcttggcag

SEQ ID NO: 457077 - DNA, 16 bp, M. musculus
ttgtcaggtttggtag

SEQ ID NO: 457078 - DNA, 16 bp, M. musculus
ttgtcagtgtcctttg

SEQ ID NO: 457079 - DNA, 16 bp, M. musculus
ttgtcatacagacctt

SEQ ID NO: 457080 - DNA, 16 bp, M. musculus
ttgtcatagcaacaca

SEQ ID NO: 457081 - DNA, 16 bp, M. musculus
ttgtcatcagagagac

SEQ ID NO: 457082 - DNA, 16 bp, M. musculus
ttgtcatcatcatcac

SEQ ID NO: 457083 - DNA, 16 bp, M. musculus
ttgtcatctaaaaata

SEQ ID NO: 457084 - DNA, 16 bp, M. musculus
ttgtcatctggcctga

SEQ ID NO: 457085 - DNA, 16 bp, M. musculus
ttgtcatggcaggaag

SEQ ID NO: 457086 - DNA, 16 bp, M. musculus
ttgtcatggtgtctct

SEQ ID NO: 457087 - DNA, 16 bp, M. musculus
ttgtcattattattat

SEQ ID NO: 457088 - DNA, 16 bp, M. musculus
ttgtcattccagatga

SEQ ID NO: 457089 - DNA, 16 bp, M. musculus
ttgtcattgtcatcat

SEQ ID NO: 457090 - DNA, 16 bp, M. musculus
ttgtcattttctttga

SEQ ID NO: 457091 - DNA, 16 bp, M. musculus
ttgtccatctcatcca

SEQ ID NO: 457092 - DNA, 16 bp, M. musculus
ttgtccatctgtctgt

SEQ ID NO: 457093 - DNA, 16 bp, M. musculus
ttgtccatttctttta

SEQ ID NO: 457094 - DNA, 16 bp, M. musculus
ttgtcccagcactcag

SEQ ID NO: 457095 - DNA, 16 bp, M. musculus
ttgtcccatgtattct

SEQ ID NO: 457096 - DNA, 16 bp, M. musculus
ttgtccctgtagttct

SEQ ID NO: 457097 - DNA, 17 bp, M. musculus
ttgtccctgtgcccttt

SEQ ID NO: 457098 - DNA, 16 bp, M. musculus
ttgtcctctaacctct

SEQ ID NO: 457099 - DNA, 16 bp, M. musculus
ttgtcctctgacccca

SEQ ID NO: 457100 - DNA, 16 bp, M. musculus
ttgtcctctgacctgc

SEQ ID NO: 457101 - DNA, 16 bp, M. musculus
ttgtcctctgacttgc

SEQ ID NO: 457102 - DNA, 16 bp, M. musculus
ttgtcctctggcctct

SEQ ID NO: 457103 - DNA, 16 bp, M. musculus
ttgtcctctgtcctct

SEQ ID NO: 457104 - DNA, 16 bp, M. musculus
ttgtcctgcctgcaag

SEQ ID NO: 457105 - DNA, 16 bp, M. musculus
ttgtcctgtgtcatgg

SEQ ID NO: 457106 - DNA, 17 bp, M. musculus
ttgtccttgagtttgtt

SEQ ID NO: 457107 - DNA, 16 bp, M. musculus
ttgtccttggcaatgg

SEQ ID NO: 457108 - DNA, 16 bp, M. musculus
ttgtcctttacaagag

SEQ ID NO: 457109 - DNA, 16 bp, M. musculus
ttgtcctttataagac

SEQ ID NO: 457110 - DNA, 16 bp, M. musculus
ttgtcctttataagag

SEQ ID NO: 457111 - DNA, 16 bp, M. musculus
ttgtcctttctggaca

SEQ ID NO: 457112 - DNA, 16 bp, M. musculus
ttgtcctttgaccctg

SEQ ID NO: 457113 - DNA, 16 bp, M. musculus
ttgtcctttgatttcc

SEQ ID NO: 457114 - DNA, 17 bp, M. musculus
ttgtctacagcaatact

SEQ ID NO: 457115 - DNA, 16 bp, M. musculus
ttgtctagactggctg

SEQ ID NO: 457116 - DNA, 16 bp, M. musculus
ttgtctaggaaaaaaa

SEQ ID NO: 457117 - DNA, 16 bp, M. musculus
ttgtctcaaaaaaatt

SEQ ID NO: 457118 - DNA, 17 bp, M. musculus
ttgtctcaaaacaaaac

SEQ ID NO: 457119 - DNA, 16 bp, M. musculus
ttgtctcaaaataaat

SEQ ID NO: 457120 - DNA, 16 bp, M. musculus
ttgtctcaaagaaaaa

SEQ ID NO: 457121 - DNA, 16 bp, M. musculus
ttgtctcaaaggaaaa

SEQ ID NO: 457122 - DNA, 16 bp, M. musculus
ttgtctcacagtttga

SEQ ID NO: 457123 - DNA, 16 bp, M. musculus
ttgtctcccttcccag

SEQ ID NO: 457124 - DNA, 16 bp, M. musculus
ttgtctcctgtgtcaa

SEQ ID NO: 457125 - DNA, 16 bp, M. musculus
ttgtctccttctacca

SEQ ID NO: 457126 - DNA, 16 bp, M. musculus
ttgtctctagcttcat

SEQ ID NO: 457127 - DNA, 18 bp, M. musculus
ttgtctctataactcctt

SEQ ID NO: 457128 - DNA, 16 bp, M. musculus
ttgtctctcccagtat

SEQ ID NO: 457129 - DNA, 16 bp, M. musculus
ttgtctctctgggtct

SEQ ID NO: 457130 - DNA, 16 bp, M. musculus
ttgtctctgacctcca

SEQ ID NO: 457131 - DNA, 16 bp, M. musculus
ttgtctctgagtttgt

SEQ ID NO: 457132 - DNA, 16 bp, M. musculus
ttgtctctgcctccca

SEQ ID NO: 457133 - DNA, 16 bp, M. musculus
ttgtctctgcctcctg

SEQ ID NO: 457134 - DNA, 16 bp, M. musculus
ttgtctctgcctctgt

SEQ ID NO: 457135 - DNA, 16 bp, M. musculus
ttgtctctgtaacgcc

SEQ ID NO: 457136 - DNA, 17 bp, M. musculus
ttgtctctgtacctcct

SEQ ID NO: 457137 - DNA, 16 bp, M. musculus
ttgtctctgtccttcc

SEQ ID NO: 457138 - DNA, 16 bp, M. musculus
ttgtctcttcaggttc

SEQ ID NO: 457139 - DNA, 16 bp, M. musculus
ttgtctcttttgataa

SEQ ID NO: 457140 - DNA, 16 bp, M. musculus
ttgtctgacctcagta

SEQ ID NO: 457141 - DNA, 16 bp, M. musculus
ttgtctgcactgtttt

SEQ ID NO: 457142 - DNA, 16 bp, M. musculus
ttgtctggcttcagtg

SEQ ID NO: 457143 - DNA, 16 bp, M. musculus
ttgtctggcttgagtt

SEQ ID NO: 457144 - DNA, 16 bp, M. musculus
ttgtctgtctctgtct

SEQ ID NO: 457145 - DNA, 16 bp, M. musculus
ttgtcttactgtattt

SEQ ID NO: 457146 - DNA, 26 bp, M. musculus
ttgtcttagtcagggtttctattcct

SEQ ID NO: 457147 - DNA, 16 bp, M. musculus
ttgtcttagttccttt

SEQ ID NO: 457148 - DNA, 16 bp, M. musculus
ttgtcttcaaatttaa

SEQ ID NO: 457149 - DNA, 16 bp, M. musculus
ttgtcttcagacacac

SEQ ID NO: 457150 - DNA, 16 bp, M. musculus
ttgtcttcagacgcac

SEQ ID NO: 457151 - DNA, 16 bp, M. musculus
ttgtcttcagtgtcct

SEQ ID NO: 457152 - DNA, 16 bp, M. musculus
ttgtcttcctcatcaa

SEQ ID NO: 457153 - DNA, 16 bp, M. musculus
ttgtcttcctgagtct

SEQ ID NO: 457154 - DNA, 16 bp, M. musculus
ttgtcttcctgctgga

SEQ ID NO: 457155 - DNA, 16 bp, M. musculus
ttgtcttctgacacac

SEQ ID NO: 457156 - DNA, 16 bp, M. musculus
ttgtcttctgactttc

SEQ ID NO: 457157 - DNA, 16 bp, M. musculus
ttgtcttctggcctcc

SEQ ID NO: 457158 - DNA, 16 bp, M. musculus
ttgtcttcttgcagtt

SEQ ID NO: 457159 - DNA, 18 bp, M. musculus
ttgtcttggaactcactt

SEQ ID NO: 457160 - DNA, 16 bp, M. musculus
ttgtcttggaattttg

SEQ ID NO: 457161 - DNA, 16 bp, M. musculus
ttgtcttggcctcatt

SEQ ID NO: 457162 - DNA, 16 bp, M. musculus
ttgtcttgttcctggt

SEQ ID NO: 457163 - DNA, 16 bp, M. musculus
ttgtctttaaaaatat

SEQ ID NO: 457164 - DNA, 16 bp, M. musculus
ttgtctttaaatatat

SEQ ID NO: 457165 - DNA, 16 bp, M. musculus
ttgtctttaatcacaa

SEQ ID NO: 457166 - DNA, 16 bp, M. musculus
ttgtctttcattttaa

SEQ ID NO: 457167 - DNA, 16 bp, M. musculus
ttgtctttctaggtct

SEQ ID NO: 457168 - DNA, 16 bp, M. musculus
ttgtctttctgtgact

SEQ ID NO: 457169 - DNA, 16 bp, M. musculus
ttgtctttctgtgcct

SEQ ID NO: 457170 - DNA, 16 bp, M. musculus
ttgtctttcttgataa

SEQ ID NO: 457171 - DNA, 16 bp, M. musculus
ttgtctttgagacagg

SEQ ID NO: 457172 - DNA, 16 bp, M. musculus
ttgtctttgatttcat

SEQ ID NO: 457173 - DNA, 16 bp, M. musculus
ttgtctttgtaagagt

SEQ ID NO: 457174 - DNA, 16 bp, M. musculus
ttgtcttttaaaaagt

SEQ ID NO: 457175 - DNA, 16 bp, M. musculus
ttgtcttttctgataa

SEQ ID NO: 457176 - DNA, 16 bp, M. musculus
ttgtcttttgccttgc

SEQ ID NO: 457177 - DNA, 16 bp, M. musculus
ttgtctttttataaaa

SEQ ID NO: 457178 - DNA, 16 bp, M. musculus
ttgtcttttttgatga

SEQ ID NO: 457179 - DNA, 16 bp, M. musculus
ttgtgaaacacacaca

SEQ ID NO: 457180 - DNA, 16 bp, M. musculus
ttgtgaaataatttaa

SEQ ID NO: 457181 - DNA, 16 bp, M. musculus
ttgtgaaatagtttgt

SEQ ID NO: 457182 - DNA, 16 bp, M. musculus
ttgtgaaccaacatgt

SEQ ID NO: 457183 - DNA, 16 bp, M. musculus
ttgtgaagaactagga

SEQ ID NO: 457184 - DNA, 16 bp, M. musculus
ttgtgaagaattggaa

SEQ ID NO: 457185 - DNA, 16 bp, M. musculus
ttgtgaagagaggccc

SEQ ID NO: 457186 - DNA, 16 bp, M. musculus
ttgtgaagagatacca

SEQ ID NO: 457187 - DNA, 16 bp, M. musculus
ttgtgaagagtgttgt

SEQ ID NO: 457188 - DNA, 16 bp, M. musculus
ttgtgaagattaaata

SEQ ID NO: 457189 - DNA, 16 bp, M. musculus
ttgtgaagggccccag

SEQ ID NO: 457190 - DNA, 16 bp, M. musculus
ttgtgaagggtgtttt

SEQ ID NO: 457191 - DNA, 16 bp, M. musculus
ttgtgaagttgtcaga

SEQ ID NO: 457192 - DNA, 16 bp, M. musculus
ttgtgaatcaccatgt

SEQ ID NO: 457193 - DNA, 16 bp, M. musculus
ttgtgaattgctcttt

SEQ ID NO: 457194 - DNA, 16 bp, M. musculus
ttgtgaccaagtatat

SEQ ID NO: 457195 - DNA, 16 bp, M. musculus
ttgtgaccaataatat

SEQ ID NO: 457196 - DNA, 16 bp, M. musculus
ttgtgaccctttaata

SEQ ID NO: 457197 - DNA, 16 bp, M. musculus
ttgtgacctattatgt

SEQ ID NO: 457198 - DNA, 16 bp, M. musculus
ttgtgactggcttaca

SEQ ID NO: 457199 - DNA, 16 bp, M. musculus
ttgtgagaccctgtct

SEQ ID NO: 457200 - DNA, 16 bp, M. musculus
ttgtgagagccagagg

SEQ ID NO: 457201 - DNA, 16 bp, M. musculus
ttgtgagccaccatat

SEQ ID NO: 457202 - DNA, 16 bp, M. musculus
ttgtgagccaccatgg

SEQ ID NO: 457203 - DNA, 16 bp, M. musculus
ttgtgagccatcttgt

SEQ ID NO: 457204 - DNA, 16 bp, M. musculus
ttgtgagccattgtgt

SEQ ID NO: 457205 - DNA, 16 bp, M. musculus
ttgtgagccctgtgat

SEQ ID NO: 457206 - DNA, 19 bp, M. musculus
ttgtgagcctagcctttaa

SEQ ID NO: 457207 - DNA, 16 bp, M. musculus
ttgtgagctaacatgt

SEQ ID NO: 457208 - DNA, 16 bp, M. musculus
ttgtgagctaccatgt

SEQ ID NO: 457209 - DNA, 16 bp, M. musculus
ttgtgagctacctgac

SEQ ID NO: 457210 - DNA, 16 bp, M. musculus
ttgtgagtcaccatgt

SEQ ID NO: 457211 - DNA, 16 bp, M. musculus
ttgtgagttccaggcc

SEQ ID NO: 457212 - DNA, 16 bp, M. musculus
ttgtgatcaaggaaaa

SEQ ID NO: 457213 - DNA, 16 bp, M. musculus
ttgtgatcccagcact

SEQ ID NO: 457214 - DNA, 16 bp, M. musculus
ttgtgatctgccatgt

SEQ ID NO: 457215 - DNA, 16 bp, M. musculus
ttgtgattaaaaaaat

SEQ ID NO: 457216 - DNA, 25 bp, M. musculus
ttgtgattcatgtaaaagagttgtc

SEQ ID NO: 457217 - DNA, 16 bp, M. musculus
ttgtgatttaaaaaaa

SEQ ID NO: 457218 - DNA, 16 bp, M. musculus
ttgtgattttaaaaaa

SEQ ID NO: 457219 - DNA, 16 bp, M. musculus
ttgtgattttctgtaa

SEQ ID NO: 457220 - DNA, 16 bp, M. musculus
ttgtgcaaagcaaaat

SEQ ID NO: 457221 - DNA, 16 bp, M. musculus
ttgtgcaaatgaacca

SEQ ID NO: 457222 - DNA, 16 bp, M. musculus
ttgtgcaagcatgagg

SEQ ID NO: 457223 - DNA, 16 bp, M. musculus
ttgtgcaccttgagta

SEQ ID NO: 457224 - DNA, 16 bp, M. musculus
ttgtgcactgtgtatt

SEQ ID NO: 457225 - DNA, 16 bp, M. musculus
ttgtgcagacctggcc

SEQ ID NO: 457226 - DNA, 16 bp, M. musculus
ttgtgcatatatgtgt

SEQ ID NO: 457227 - DNA, 16 bp, M. musculus
ttgtgcatgctgccac

SEQ ID NO: 457228 - DNA, 16 bp, M. musculus
ttgtgcatgtatgtat

SEQ ID NO: 457229 - DNA, 16 bp, M. musculus
ttgtgcattctgtaag

SEQ ID NO: 457230 - DNA, 16 bp, M. musculus
ttgtgcatttccactg

SEQ ID NO: 457231 - DNA, 16 bp, M. musculus
ttgtgccaccacaccc

SEQ ID NO: 457232 - DNA, 16 bp, M. musculus
ttgtgcccctgctcag

SEQ ID NO: 457233 - DNA, 16 bp, M. musculus
ttgtgcccttaaagct

SEQ ID NO: 457234 - DNA, 16 bp, M. musculus
ttgtgcccttccccca

SEQ ID NO: 457235 - DNA, 16 bp, M. musculus
ttgtgcccttgccata

SEQ ID NO: 457236 - DNA, 16 bp, M. musculus
ttgtgcctttaatccc

SEQ ID NO: 457237 - DNA, 21 bp, M. musculus
ttgtgcgcagctgcgagagca

SEQ ID NO: 457238 - DNA, 17 bp, M. musculus
ttgtgcgtgcgtgtgtg

SEQ ID NO: 457239 - DNA, 16 bp, M. musculus
ttgtgctgagaacttg

SEQ ID NO: 457240 - DNA, 17 bp, M. musculus
ttgtgctgtagctgaag

SEQ ID NO: 457241 - DNA, 18 bp, M. musculus
ttgtgctgtggctggact

SEQ ID NO: 457242 - DNA, 16 bp, M. musculus
ttgtggaagagtggga

SEQ ID NO: 457243 - DNA, 16 bp, M. musculus
ttgtggaatggtttgt

SEQ ID NO: 457244 - DNA, 16 bp, M. musculus
ttgtggagaaagagga

SEQ ID NO: 457245 - DNA, 16 bp, M. musculus
ttgtggagagcaacct

SEQ ID NO: 457246 - DNA, 16 bp, M. musculus
ttgtggaggcatttcc

SEQ ID NO: 457247 - DNA, 16 bp, M. musculus
ttgtggaggcatttct

SEQ ID NO: 457248 - DNA, 16 bp, M. musculus
ttgtggatgccatcaa

SEQ ID NO: 457249 - DNA, 16 bp, M. musculus
ttgtggatgccatgaa

SEQ ID NO: 457250 - DNA, 16 bp, M. musculus
ttgtggcaaaaaaaaa

SEQ ID NO: 457251 - DNA, 16 bp, M. musculus
ttgtggcagagatgat

SEQ ID NO: 457252 - DNA, 16 bp, M. musculus
ttgtggccaagaagat

SEQ ID NO: 457253 - DNA, 16 bp, M. musculus
ttgtggctgacactga

SEQ ID NO: 457254 - DNA, 16 bp, M. musculus
ttgtggcttaatagtg

SEQ ID NO: 457255 - DNA, 16 bp, M. musculus
ttgtggcttcattctc

SEQ ID NO: 457256 - DNA, 25 bp, M. musculus
ttgtggcttcattttcattaaactc

SEQ ID NO: 457257 - DNA, 16 bp, M. musculus
ttgtggctttgttgga

SEQ ID NO: 457258 - DNA, 16 bp, M. musculus
ttgtgggaaaaaaaaa

SEQ ID NO: 457259 - DNA, 16 bp, M. musculus
ttgtgggaggtgccat

SEQ ID NO: 457260 - DNA, 16 bp, M. musculus
ttgtgggcacatttaa

SEQ ID NO: 457261 - DNA, 16 bp, M. musculus
ttgtggggcattgggc

SEQ ID NO: 457262 - DNA, 16 bp, M. musculus
ttgtggggctggagag

SEQ ID NO: 457263 - DNA, 16 bp, M. musculus
ttgtgggtcctgggga

SEQ ID NO: 457264 - DNA, 16 bp, M. musculus
ttgtgggtctttcaga

SEQ ID NO: 457265 - DNA, 16 bp, M. musculus
ttgtgggtgctggaaa

SEQ ID NO: 457266 - DNA, 16 bp, M. musculus
ttgtgggtgctgggaa

SEQ ID NO: 457267 - DNA, 16 bp, M. musculus
ttgtgggtggaaccat

SEQ ID NO: 457268 - DNA, 16 bp, M. musculus
ttgtggtaatttgtta

SEQ ID NO: 457269 - DNA, 16 bp, M. musculus
ttgtggtacagaaaat

SEQ ID NO: 457270 - DNA, 16 bp, M. musculus
ttgtggtagtttgaat

SEQ ID NO: 457271 - DNA, 16 bp, M. musculus
ttgtggtctttctcag

SEQ ID NO: 457272 - DNA, 16 bp, M. musculus
ttgtggtgacacccaa

SEQ ID NO: 457273 - DNA, 16 bp, M. musculus
ttgtggtgctggggat

SEQ ID NO: 457274 - DNA, 16 bp, M. musculus
ttgtggtggcacacac

SEQ ID NO: 457275 - DNA, 16 bp, M. musculus
ttgtggtgttaataaa

SEQ ID NO: 457276 - DNA, 16 bp, M. musculus
ttgtggttgctgggaa

SEQ ID NO: 457277 - DNA, 19 bp, M. musculus
ttgtggttgctgggatttg

SEQ ID NO: 457278 - DNA, 16 bp, M. musculus
ttgtgtaagaaagcaa

SEQ ID NO: 457279 - DNA, 16 bp, M. musculus
ttgtgtactgtgtaaa

SEQ ID NO: 457280 - DNA, 16 bp, M. musculus
ttgtgtagcccttgct

SEQ ID NO: 457281 - DNA, 16 bp, M. musculus
ttgtgtaggcttcttg

SEQ ID NO: 457282 - DNA, 16 bp, M. musculus
ttgtgtatacacacat

SEQ ID NO: 457283 - DNA, 17 bp, M. musculus
ttgtgtatccaatgggc

SEQ ID NO: 457284 - DNA, 16 bp, M. musculus
ttgtgtatgtgtgcat

SEQ ID NO: 457285 - DNA, 16 bp, M. musculus
ttgtgtatgtgtgtct

SEQ ID NO: 457286 - DNA, 16 bp, M. musculus
ttgtgtcaagctgaca

SEQ ID NO: 457287 - DNA, 16 bp, M. musculus
ttgtgtcaagtggaca

SEQ ID NO: 457288 - DNA, 16 bp, M. musculus
ttgtgtcaagttgata

SEQ ID NO: 457289 - DNA, 16 bp, M. musculus
ttgtgtcatgtgatat

SEQ ID NO: 457290 - DNA, 16 bp, M. musculus
ttgtgtcatgttgaca

SEQ ID NO: 457291 - DNA, 16 bp, M. musculus
ttgtgtccagttgaca

SEQ ID NO: 457292 - DNA, 16 bp, M. musculus
ttgtgtcctctgggaa

SEQ ID NO: 457293 - DNA, 16 bp, M. musculus
ttgtgtctctgtgtct

SEQ ID NO: 457294 - DNA, 16 bp, M. musculus
ttgtgtctttccacag

SEQ ID NO: 457295 - DNA, 16 bp, M. musculus
ttgtgtgaatatatat

SEQ ID NO: 457296 - DNA, 16 bp, M. musculus
ttgtgtgatttccttt

SEQ ID NO: 457297 - DNA, 16 bp, M. musculus
ttgtgtgcacatgtat

SEQ ID NO: 457298 - DNA, 16 bp, M. musculus
ttgtgtgcaggaacag

SEQ ID NO: 457299 - DNA, 16 bp, M. musculus
ttgtgtgccaccatgc

SEQ ID NO: 457300 - DNA, 16 bp, M. musculus
ttgtgtgctttttaaa

SEQ ID NO: 457301 - DNA, 16 bp, M. musculus
ttgtgtggattctggg

SEQ ID NO: 457302 - DNA, 16 bp, M. musculus
ttgtgtggtttaggaa

SEQ ID NO: 457303 - DNA, 16 bp, M. musculus
ttgtgtgtacacacat

SEQ ID NO: 457304 - DNA, 16 bp, M. musculus
ttgtgtgtacatatat

SEQ ID NO: 457305 - DNA, 16 bp, M. musculus
ttgtgtgtacgtgtgt

SEQ ID NO: 457306 - DNA, 16 bp, M. musculus
ttgtgtgtatatatac

SEQ ID NO: 457307 - DNA, 17 bp, M. musculus
ttgtgtgtatctgtgtg

SEQ ID NO: 457308 - DNA, 16 bp, M. musculus
ttgtgtgtctatgtct

SEQ ID NO: 457309 - DNA, 16 bp, M. musculus
ttgtgtgtctgtgtat

SEQ ID NO: 457310 - DNA, 16 bp, M. musculus
ttgtgtgtgcatctgt

SEQ ID NO: 457311 - DNA, 16 bp, M. musculus
ttgtgtgtgcatgcat

SEQ ID NO: 457312 - DNA, 16 bp, M. musculus
ttgtgtgtgcatgtgt

SEQ ID NO: 457313 - DNA, 16 bp, M. musculus
ttgtgtgtgtatgagt

SEQ ID NO: 457314 - DNA, 16 bp, M. musculus
ttgtgtgtgtgtgaga

SEQ ID NO: 457315 - DNA, 16 bp, M. musculus
ttgtgtgtgtgtgcat

SEQ ID NO: 457316 - DNA, 16 bp, M. musculus
ttgtgttaaagcttta

SEQ ID NO: 457317 - DNA, 16 bp, M. musculus
ttgtgttaagttgaca

SEQ ID NO: 457318 - DNA, 16 bp, M. musculus
ttgtgttattcaaatg

SEQ ID NO: 457319 - DNA, 24 bp, M. musculus
ttgtgttccacctgtgtcctgagt

SEQ ID NO: 457320 - DNA, 16 bp, M. musculus
ttgtgttccataaatt

SEQ ID NO: 457321 - DNA, 16 bp, M. musculus
ttgtgttcccagaaaa

SEQ ID NO: 457322 - DNA, 16 bp, M. musculus
ttgtgttcctggattt

SEQ ID NO: 457323 - DNA, 16 bp, M. musculus
ttgtgttctgttagtg

SEQ ID NO: 457324 - DNA, 16 bp, M. musculus
ttgtgttgaagttttc

SEQ ID NO: 457325 - DNA, 16 bp, M. musculus
ttgtgttggagttttc

SEQ ID NO: 457326 - DNA, 16 bp, M. musculus
ttgtgtttatctatct

SEQ ID NO: 457327 - DNA, 16 bp, M. musculus
ttgtgtttatttgcac

SEQ ID NO: 457328 - DNA, 16 bp, M. musculus
ttgtgtttctgtgtat

SEQ ID NO: 457329 - DNA, 16 bp, M. musculus
ttgtgtttcttcctta

SEQ ID NO: 457330 - DNA, 16 bp, M. musculus
ttgtgtttgaggccag

SEQ ID NO: 457331 - DNA, 16 bp, M. musculus
ttgtgttttataaaaa

SEQ ID NO: 457332 - DNA, 16 bp, M. musculus
ttgtgttttcagatga

SEQ ID NO: 457333 - DNA, 16 bp, M. musculus
ttgtgttttccttcat

SEQ ID NO: 457334 - DNA, 16 bp, M. musculus
ttgtgttttctgtaat

SEQ ID NO: 457335 - DNA, 16 bp, M. musculus
ttgtgttttcttgtaa

SEQ ID NO: 457336 - DNA, 16 bp, M. musculus
ttgtgttttgcaaatg

SEQ ID NO: 457337 - DNA, 16 bp, M. musculus
ttgtgttttggatttc

SEQ ID NO: 457338 - DNA, 16 bp, M. musculus
ttgttaaaaacaacaa

SEQ ID NO: 457339 - DNA, 16 bp, M. musculus
ttgttaacatgtagaa

SEQ ID NO: 457340 - DNA, 16 bp, M. musculus
ttgttaacattgagtt

SEQ ID NO: 457341 - DNA, 16 bp, M. musculus
ttgttaaccacagctg

SEQ ID NO: 457342 - DNA, 16 bp, M. musculus
ttgttaaccctcagag

SEQ ID NO: 457343 - DNA, 16 bp, M. musculus
ttgttaagctctctgc

SEQ ID NO: 457344 - DNA, 16 bp, M. musculus
ttgttaaggaggtgga

SEQ ID NO: 457345 - DNA, 16 bp, M. musculus
ttgttacacttcttac

SEQ ID NO: 457346 - DNA, 16 bp, M. musculus
ttgttactgttataaa

SEQ ID NO: 457347 - DNA, 16 bp, M. musculus
ttgttactttaaaaaa

SEQ ID NO: 457348 - DNA, 16 bp, M. musculus
ttgttactttgattgt

SEQ ID NO: 457349 - DNA, 16 bp, M. musculus
ttgttactttgttact

SEQ ID NO: 457350 - DNA, 16 bp, M. musculus
ttgttatagccagaag

SEQ ID NO: 457351 - DNA, 16 bp, M. musculus
ttgttatcatttttaa

SEQ ID NO: 457352 - DNA, 16 bp, M. musculus
ttgttatggaatactt

SEQ ID NO: 457353 - DNA, 16 bp, M. musculus
ttgttatgtagctgag

SEQ ID NO: 457354 - DNA, 16 bp, M. musculus
ttgttattaattggta

SEQ ID NO: 457355 - DNA, 16 bp, M. musculus
ttgttattattattac

SEQ ID NO: 457356 - DNA, 16 bp, M. musculus
ttgttattgaacatca

SEQ ID NO: 457357 - DNA, 17 bp, M. musculus
ttgttattgaagatcag

SEQ ID NO: 457358 - DNA, 16 bp, M. musculus
ttgttattgaagatga

SEQ ID NO: 457359 - DNA, 16 bp, M. musculus
ttgttattttgagaca

SEQ ID NO: 457360 - DNA, 16 bp, M. musculus
ttgttatttttcaaga

SEQ ID NO: 457361 - DNA, 16 bp, M. musculus
ttgttcaaaaacatga

SEQ ID NO: 457362 - DNA, 16 bp, M. musculus
ttgttcaaacttctct

SEQ ID NO: 457363 - DNA, 16 bp, M. musculus
ttgttcaagagctttc

SEQ ID NO: 457364 - DNA, 16 bp, M. musculus
ttgttcactctgcttt

SEQ ID NO: 457365 - DNA, 16 bp, M. musculus
ttgttcacttccttca

SEQ ID NO: 457366 - DNA, 16 bp, M. musculus
ttgttcaggattgctt

SEQ ID NO: 457367 - DNA, 16 bp, M. musculus
ttgttcagtctccatg

SEQ ID NO: 457368 - DNA, 16 bp, M. musculus
ttgttcagtttccatg

SEQ ID NO: 457369 - DNA, 16 bp, M. musculus
ttgttcagttttcatg

SEQ ID NO: 457370 - DNA, 23 bp, M. musculus
ttgttccacctatagggttgcag

SEQ ID NO: 457371 - DNA, 17 bp, M. musculus
ttgttccagcaccattt

SEQ ID NO: 457372 - DNA, 21 bp, M. musculus
ttgttccagtgcactggggtc

SEQ ID NO: 457373 - DNA, 16 bp, M. musculus
ttgttcccatctgttg

SEQ ID NO: 457374 - DNA, 16 bp, M. musculus
ttgttcccattttaca

SEQ ID NO: 457375 - DNA, 16 bp, M. musculus
ttgttccccttcctgg

SEQ ID NO: 457376 - DNA, 16 bp, M. musculus
ttgttcctctgggaca

SEQ ID NO: 457377 - DNA, 16 bp, M. musculus
ttgttcctcttcccag

SEQ ID NO: 457378 - DNA, 16 bp, M. musculus
ttgttccttttgtgat

SEQ ID NO: 457379 - DNA, 19 bp, M. musculus
ttgttctcctgtatttctt

SEQ ID NO: 457380 - DNA, 16 bp, M. musculus
ttgttctctgacctct

SEQ ID NO: 457381 - DNA, 16 bp, M. musculus
ttgttctcttacaagc

SEQ ID NO: 457382 - DNA, 16 bp, M. musculus
ttgttctgaaagcaaa

SEQ ID NO: 457383 - DNA, 16 bp, M. musculus
ttgttctgaggacaat

SEQ ID NO: 457384 - DNA, 16 bp, M. musculus
ttgttctgcagagcaa

SEQ ID NO: 457385 - DNA, 16 bp, M. musculus
ttgttctgtctgtctg

SEQ ID NO: 457386 - DNA, 16 bp, M. musculus
ttgttcttccagagga

SEQ ID NO: 457387 - DNA, 16 bp, M. musculus
ttgttcttccagtggg

SEQ ID NO: 457388 - DNA, 16 bp, M. musculus
ttgttcttcctatggg

SEQ ID NO: 457389 - DNA, 16 bp, M. musculus
ttgttcttggatttct

SEQ ID NO: 457390 - DNA, 16 bp, M. musculus
ttgttcttgttccctg

SEQ ID NO: 457391 - DNA, 16 bp, M. musculus
ttgttcttgttttaaa

SEQ ID NO: 457392 - DNA, 16 bp, M. musculus
ttgttctttctctggg

SEQ ID NO: 457393 - DNA, 16 bp, M. musculus
ttgttctttgccagtt

SEQ ID NO: 457394 - DNA, 16 bp, M. musculus
ttgttctttgtatggg

SEQ ID NO: 457395 - DNA, 16 bp, M. musculus
ttgttcttttaaaaaa

SEQ ID NO: 457396 - DNA, 16 bp, M. musculus
ttgttgaaaatagttt

SEQ ID NO: 457397 - DNA, 16 bp, M. musculus
ttgttgaaaatctttt

SEQ ID NO: 457398 - DNA, 16 bp, M. musculus
ttgttgaaaatgctgt

SEQ ID NO: 457399 - DNA, 19 bp, M. musculus
ttgttgaaaatgctgtctt

SEQ ID NO: 457400 - DNA, 20 bp, M. musculus
ttgttgaaaatgctgtcttt

SEQ ID NO: 457401 - DNA, 16 bp, M. musculus
ttgttgaaactgctgt

SEQ ID NO: 457402 - DNA, 16 bp, M. musculus
ttgttgaacatttctt

SEQ ID NO: 457403 - DNA, 16 bp, M. musculus
ttgttgaagatgctct

SEQ ID NO: 457404 - DNA, 16 bp, M. musculus
ttgttgactacaacac

SEQ ID NO: 457405 - DNA, 16 bp, M. musculus
ttgttgactgtgttct

SEQ ID NO: 457406 - DNA, 16 bp, M. musculus
ttgttgagagttcatg

SEQ ID NO: 457407 - DNA, 16 bp, M. musculus
ttgttgatatccagct

SEQ ID NO: 457408 - DNA, 16 bp, M. musculus
ttgttgatctttttga

SEQ ID NO: 457409 - DNA, 16 bp, M. musculus
ttgttgatgatgatgt

SEQ ID NO: 457410 - DNA, 16 bp, M. musculus
ttgttgattttctcta

SEQ ID NO: 457411 - DNA, 16 bp, M. musculus
ttgttgcgcgcgctca

SEQ ID NO: 457412 - DNA, 16 bp, M. musculus
ttgttgcgtctttcct

SEQ ID NO: 457413 - DNA, 16 bp, M. musculus
ttgttgctatgacaaa

SEQ ID NO: 457414 - DNA, 16 bp, M. musculus
ttgttgctcttacaaa

SEQ ID NO: 457415 - DNA, 16 bp, M. musculus
ttgttgctcttgcaga

SEQ ID NO: 457416 - DNA, 16 bp, M. musculus
ttgttgctgagatgtg

SEQ ID NO: 457417 - DNA, 16 bp, M. musculus
ttgttgctgctgctgt

SEQ ID NO: 457418 - DNA, 16 bp, M. musculus
ttgttgctgtcttcag

SEQ ID NO: 457419 - DNA, 16 bp, M. musculus
ttgttgctgttactgt

SEQ ID NO: 457420 - DNA, 16 bp, M. musculus
ttgttgcttctgcaga

SEQ ID NO: 457421 - DNA, 16 bp, M. musculus
ttgttggaaaaggtgt

SEQ ID NO: 457422 - DNA, 16 bp, M. musculus
ttgttggaaatatttt

SEQ ID NO: 457423 - DNA, 16 bp, M. musculus
ttgttggaggagatgt

SEQ ID NO: 457424 - DNA, 17 bp, M. musculus
ttgttggaggaggtgta

SEQ ID NO: 457425 - DNA, 16 bp, M. musculus
ttgttggcatcagtgg

SEQ ID NO: 457426 - DNA, 16 bp, M. musculus
ttgttggcatccacaa

SEQ ID NO: 457427 - DNA, 16 bp, M. musculus
ttgttgggattaaagg

SEQ ID NO: 457428 - DNA, 16 bp, M. musculus
ttgttgggggactcac

SEQ ID NO: 457429 - DNA, 16 bp, M. musculus
ttgttgggtctcttgg

SEQ ID NO: 457430 - DNA, 16 bp, M. musculus
ttgttgggtgtttcag

SEQ ID NO: 457431 - DNA, 16 bp, M. musculus
ttgttgtcatacagat

SEQ ID NO: 457432 - DNA, 16 bp, M. musculus
ttgttgtcatccacaa

SEQ ID NO: 457433 - DNA, 16 bp, M. musculus
ttgttgtcattgtttg

SEQ ID NO: 457434 - DNA, 16 bp, M. musculus
ttgttgtgagccacca

SEQ ID NO: 457435 - DNA, 16 bp, M. musculus
ttgttgttattgaaga

SEQ ID NO: 457436 - DNA, 16 bp, M. musculus
ttgttgttccagatga

SEQ ID NO: 457437 - DNA, 16 bp, M. musculus
ttgttgttcctcctag

SEQ ID NO: 457438 - DNA, 16 bp, M. musculus
ttgttgttctttcaga

SEQ ID NO: 457439 - DNA, 16 bp, M. musculus
ttgttgttgttactgt

SEQ ID NO: 457440 - DNA, 16 bp, M. musculus
ttgttgttgttgaagg

SEQ ID NO: 457441 - DNA, 16 bp, M. musculus
ttgttgttgttgttac

SEQ ID NO: 457442 - DNA, 16 bp, M. musculus
ttgttgttgtttcaag

SEQ ID NO: 457443 - DNA, 16 bp, M. musculus
ttgttgtttaaataaa

SEQ ID NO: 457444 - DNA, 16 bp, M. musculus
ttgttgtttctttaaa

SEQ ID NO: 457445 - DNA, 16 bp, M. musculus
ttgttgttttaagaca

SEQ ID NO: 457446 - DNA, 16 bp, M. musculus
ttgttgttttgagata

SEQ ID NO: 457447 - DNA, 16 bp, M. musculus
ttgttgtttttaaaga

SEQ ID NO: 457448 - DNA, 16 bp, M. musculus
ttgttgtttttaagaa

SEQ ID NO: 457449 - DNA, 16 bp, M. musculus
ttgtttaaaaaacaaa

SEQ ID NO: 457450 - DNA, 16 bp, M. musculus
ttgtttaaaacatttt

SEQ ID NO: 457451 - DNA, 16 bp, M. musculus
ttgtttaagtgagtta

SEQ ID NO: 457452 - DNA, 16 bp, M. musculus
ttgtttacagtaaaca

SEQ ID NO: 457453 - DNA, 16 bp, M. musculus
ttgtttacagtttctg

SEQ ID NO: 457454 - DNA, 16 bp, M. musculus
ttgtttaccagttaga

SEQ ID NO: 457455 - DNA, 16 bp, M. musculus
ttgtttagaaatagtt

SEQ ID NO: 457456 - DNA, 16 bp, M. musculus
ttgtttataatagcca

SEQ ID NO: 457457 - DNA, 16 bp, M. musculus
ttgtttatatttcaaa

SEQ ID NO: 457458 - DNA, 16 bp, M. musculus
ttgtttatgggctgga

SEQ ID NO: 457459 - DNA, 16 bp, M. musculus
ttgtttatgtagccag

SEQ ID NO: 457460 - DNA, 16 bp, M. musculus
ttgtttattcagacca

SEQ ID NO: 457461 - DNA, 16 bp, M. musculus
ttgtttatttacattc

SEQ ID NO: 457462 - DNA, 16 bp, M. musculus
ttgtttcaaaaaaaaa

SEQ ID NO: 457463 - DNA, 16 bp, M. musculus
ttgtttcaaaaaccaa

SEQ ID NO: 457464 - DNA, 16 bp, M. musculus
ttgtttcagctggatt

SEQ ID NO: 457465 - DNA, 16 bp, M. musculus
ttgtttcatcatttct

SEQ ID NO: 457466 - DNA, 16 bp, M. musculus
ttgtttcattgtctga

SEQ ID NO: 457467 - DNA, 16 bp, M. musculus
ttgtttcattgtttga

SEQ ID NO: 457468 - DNA, 16 bp, M. musculus
ttgtttcatttaaaaa

SEQ ID NO: 457469 - DNA, 16 bp, M. musculus
ttgtttccagtctctg

SEQ ID NO: 457470 - DNA, 16 bp, M. musculus
ttgtttccatggcaac

SEQ ID NO: 457471 - DNA, 16 bp, M. musculus
ttgtttctacttgatt

SEQ ID NO: 457472 - DNA, 16 bp, M. musculus
ttgtttctatttccat

SEQ ID NO: 457473 - DNA, 16 bp, M. musculus
ttgtttctcttcccaa

SEQ ID NO: 457474 - DNA, 17 bp, M. musculus
ttgtttctgaaactgct

SEQ ID NO: 457475 - DNA, 16 bp, M. musculus
ttgtttctgagctttg

SEQ ID NO: 457476 - DNA, 16 bp, M. musculus
ttgtttctgtgacaaa

SEQ ID NO: 457477 - DNA, 16 bp, M. musculus
ttgtttctgtttccag

SEQ ID NO: 457478 - DNA, 16 bp, M. musculus
ttgtttcttctgacca

SEQ ID NO: 457479 - DNA, 16 bp, M. musculus
ttgtttcttcttagaa

SEQ ID NO: 457480 - DNA, 16 bp, M. musculus
ttgtttcttgagacca

SEQ ID NO: 457481 - DNA, 16 bp, M. musculus
ttgtttcttggaacca

SEQ ID NO: 457482 - DNA, 16 bp, M. musculus
ttgtttcttttaaaga

SEQ ID NO: 457483 - DNA, 16 bp, M. musculus
ttgtttcttttaataa

SEQ ID NO: 457484 - DNA, 16 bp, M. musculus
ttgtttgaaaacaaaa

SEQ ID NO: 457485 - DNA, 16 bp, M. musculus
ttgtttgagaatttca

SEQ ID NO: 457486 - DNA, 16 bp, M. musculus
ttgtttgagacaggat

SEQ ID NO: 457487 - DNA, 16 bp, M. musculus
ttgtttgagatagggt

SEQ ID NO: 457488 - DNA, 16 bp, M. musculus
ttgtttgagttcattt

SEQ ID NO: 457489 - DNA, 16 bp, M. musculus
ttgtttgattctttga

SEQ ID NO: 457490 - DNA, 16 bp, M. musculus
ttgtttgctgagacag

SEQ ID NO: 457491 - DNA, 16 bp, M. musculus
ttgtttgcttgcttga

SEQ ID NO: 457492 - DNA, 16 bp, M. musculus
ttgtttgctttttaag

SEQ ID NO: 457493 - DNA, 16 bp, M. musculus
ttgtttggagacaagg

SEQ ID NO: 457494 - DNA, 16 bp, M. musculus
ttgtttggtttaaatg

SEQ ID NO: 457495 - DNA, 17 bp, M. musculus
ttgtttgtgagctttaa

SEQ ID NO: 457496 - DNA, 16 bp, M. musculus
ttgtttgtgcaggaat

SEQ ID NO: 457497 - DNA, 16 bp, M. musculus
ttgtttgtgtacatgt

SEQ ID NO: 457498 - DNA, 16 bp, M. musculus
ttgtttgttcatttcc

SEQ ID NO: 457499 - DNA, 16 bp, M. musculus
ttgtttgttggagaca

SEQ ID NO: 457500 - DNA, 16 bp, M. musculus
ttgtttgtttccaaga

SEQ ID NO: 457501 - DNA, 16 bp, M. musculus
ttgtttgtttctgaaa

SEQ ID NO: 457502 - DNA, 16 bp, M. musculus
ttgtttgttttaaact

SEQ ID NO: 457503 - DNA, 16 bp, M. musculus
ttgtttgttttaaatc

SEQ ID NO: 457504 - DNA, 16 bp, M. musculus
ttgtttgttttaatgc

SEQ ID NO: 457505 - DNA, 16 bp, M. musculus
ttgtttgttttcataa

SEQ ID NO: 457506 - DNA, 16 bp, M. musculus
ttgttttaaaaacaat

SEQ ID NO: 457507 - DNA, 16 bp, M. musculus
ttgttttaaaaagcca

SEQ ID NO: 457508 - DNA, 16 bp, M. musculus
ttgttttaaaaaggaa

SEQ ID NO: 457509 - DNA, 16 bp, M. musculus
ttgttttaaaaatatg

SEQ ID NO: 457510 - DNA, 16 bp, M. musculus
ttgttttaaaagaaaa

SEQ ID NO: 457511 - DNA, 16 bp, M. musculus
ttgttttaaagcatac

SEQ ID NO: 457512 - DNA, 16 bp, M. musculus
ttgttttaaattatca

SEQ ID NO: 457513 - DNA, 16 bp, M. musculus
ttgttttaaattctat

SEQ ID NO: 457514 - DNA, 16 bp, M. musculus
ttgttttaaatttcaa

SEQ ID NO: 457515 - DNA, 16 bp, M. musculus
ttgttttaaattttca

SEQ ID NO: 457516 - DNA, 16 bp, M. musculus
ttgttttaagacagaa

SEQ ID NO: 457517 - DNA, 16 bp, M. musculus
ttgttttaattcctct

SEQ ID NO: 457518 - DNA, 16 bp, M. musculus
ttgttttacagccttt

SEQ ID NO: 457519 - DNA, 16 bp, M. musculus
ttgttttactttaaaa

SEQ ID NO: 457520 - DNA, 16 bp, M. musculus
ttgttttattaagact

SEQ ID NO: 457521 - DNA, 16 bp, M. musculus
ttgttttcaagacaga

SEQ ID NO: 457522 - DNA, 16 bp, M. musculus
ttgttttcagagacag

SEQ ID NO: 457523 - DNA, 16 bp, M. musculus
ttgttttcagcttttg

SEQ ID NO: 457524 - DNA, 16 bp, M. musculus
ttgttttccatatgaa

SEQ ID NO: 457525 - DNA, 16 bp, M. musculus
ttgttttccatttctg

SEQ ID NO: 457526 - DNA, 16 bp, M. musculus
ttgttttcctgtaatt

SEQ ID NO: 457527 - DNA, 16 bp, M. musculus
ttgttttctaaagaga

SEQ ID NO: 457528 - DNA, 16 bp, M. musculus
ttgttttctaataaaa

SEQ ID NO: 457529 - DNA, 16 bp, M. musculus
ttgttttctgaaaatt

SEQ ID NO: 457530 - DNA, 16 bp, M. musculus
ttgttttcttaaaata

SEQ ID NO: 457531 - DNA, 16 bp, M. musculus
ttgttttcttctgtaa

SEQ ID NO: 457532 - DNA, 16 bp, M. musculus
ttgttttcttgatata

SEQ ID NO: 457533 - DNA, 16 bp, M. musculus
ttgttttctttcaaaa

SEQ ID NO: 457534 - DNA, 16 bp, M. musculus
ttgttttctttgaaaa

SEQ ID NO: 457535 - DNA, 16 bp, M. musculus
ttgttttgaaaaaaaa

SEQ ID NO: 457536 - DNA, 16 bp, M. musculus
ttgttttgaaacaaaa

SEQ ID NO: 457537 - DNA, 16 bp, M. musculus
ttgttttgaaataaaa

SEQ ID NO: 457538 - DNA, 16 bp, M. musculus
ttgttttgagaaaagg

SEQ ID NO: 457539 - DNA, 16 bp, M. musculus
ttgttttgagaaaatc

SEQ ID NO: 457540 - DNA, 16 bp, M. musculus
ttgttttgctttggat

SEQ ID NO: 457541 - DNA, 16 bp, M. musculus
ttgttttgttctgtga

SEQ ID NO: 457542 - DNA, 16 bp, M. musculus
ttgttttgttttaagc

SEQ ID NO: 457543 - DNA, 16 bp, M. musculus
ttgttttgttttcaaa

SEQ ID NO: 457544 - DNA, 16 bp, M. musculus
ttgtttttaaaaagta

SEQ ID NO: 457545 - DNA, 16 bp, M. musculus
ttgtttttaaaacaaa

SEQ ID NO: 457546 - DNA, 16 bp, M. musculus
ttgtttttaaaacaac

SEQ ID NO: 457547 - DNA, 16 bp, M. musculus
ttgtttttaaaacatt

SEQ ID NO: 457548 - DNA, 16 bp, M. musculus
ttgtttttaaacagaa

SEQ ID NO: 457549 - DNA, 16 bp, M. musculus
ttgtttttaaagaata

SEQ ID NO: 457550 - DNA, 16 bp, M. musculus
ttgtttttaaattctg

SEQ ID NO: 457551 - DNA, 16 bp, M. musculus
ttgtttttaacaaaaa

SEQ ID NO: 457552 - DNA, 16 bp, M. musculus
ttgtttttaagacatg

SEQ ID NO: 457553 - DNA, 16 bp, M. musculus
ttgtttttaagtaaaa

SEQ ID NO: 457554 - DNA, 16 bp, M. musculus
ttgtttttaatagctg

SEQ ID NO: 457555 - DNA, 16 bp, M. musculus
ttgtttttaatcaaaa

SEQ ID NO: 457556 - DNA, 16 bp, M. musculus
ttgtttttaatcacag

SEQ ID NO: 457557 - DNA, 16 bp, M. musculus
ttgtttttaatcactg

SEQ ID NO: 457558 - DNA, 16 bp, M. musculus
ttgtttttaatctctg

SEQ ID NO: 457559 - DNA, 16 bp, M. musculus
ttgtttttagagacaa

SEQ ID NO: 457560 - DNA, 16 bp, M. musculus
ttgtttttcctaaaaa

SEQ ID NO: 457561 - DNA, 16 bp, M. musculus
ttgtttttccttaaaa

SEQ ID NO: 457562 - DNA, 16 bp, M. musculus
ttgtttttcgagacag

SEQ ID NO: 457563 - DNA, 16 bp, M. musculus
ttgtttttctggatct

SEQ ID NO: 457564 - DNA, 16 bp, M. musculus
ttgtttttcttaaaat

SEQ ID NO: 457565 - DNA, 16 bp, M. musculus
ttgtttttcttaacta

SEQ ID NO: 457566 - DNA, 16 bp, M. musculus
ttgtttttgaaaataa

SEQ ID NO: 457567 - DNA, 16 bp, M. musculus
ttgtttttgacaactg

SEQ ID NO: 457568 - DNA, 16 bp, M. musculus
ttgtttttgagacggg

SEQ ID NO: 457569 - DNA, 16 bp, M. musculus
ttgtttttgaggcagg

SEQ ID NO: 457570 - DNA, 16 bp, M. musculus
ttgttttttaaacatt

SEQ ID NO: 457571 - DNA, 16 bp, M. musculus
ttgttttttaaagagt

SEQ ID NO: 457572 - DNA, 16 bp, M. musculus
ttgttttttaaagcaa

SEQ ID NO: 457573 - DNA, 16 bp, M. musculus
ttgttttttaacaaaa

SEQ ID NO: 457574 - DNA, 16 bp, M. musculus
ttgttttttaagacag

SEQ ID NO: 457575 - DNA, 16 bp, M. musculus
ttgttttttaagagaa

SEQ ID NO: 457576 - DNA, 16 bp, M. musculus
ttgttttttataagac

SEQ ID NO: 457577 - DNA, 16 bp, M. musculus
ttgttttttcaggaca

SEQ ID NO: 457578 - DNA, 16 bp, M. musculus
ttgttttttctagagc

SEQ ID NO: 457579 - DNA, 16 bp, M. musculus
ttgttttttgagccag

SEQ ID NO: 457580 - DNA, 16 bp, M. musculus
ttgtttttttagagac

SEQ ID NO: 457581 - DNA, 16 bp, M. musculus
ttgttttttttaagac

SEQ ID NO: 457582 - DNA, 16 bp, M. musculus
tttaaaaaaaaagtgc

SEQ ID NO: 457583 - DNA, 16 bp, M. musculus
tttaaaaaaaatgtgg

SEQ ID NO: 457584 - DNA, 16 bp, M. musculus
tttaaaaaaaattctg

SEQ ID NO: 457585 - DNA, 16 bp, M. musculus
tttaaaaaaagagaca

SEQ ID NO: 457586 - DNA, 16 bp, M. musculus
tttaaaaaaagcattt

SEQ ID NO: 457587 - DNA, 16 bp, M. musculus
tttaaaaaaagttttg

SEQ ID NO: 457588 - DNA, 16 bp, M. musculus
tttaaaaaaatcaaag

SEQ ID NO: 457589 - DNA, 16 bp, M. musculus
tttaaaaaaatcagta

SEQ ID NO: 457590 - DNA, 16 bp, M. musculus
tttaaaaaaatctgtc

SEQ ID NO: 457591 - DNA, 16 bp, M. musculus
tttaaaaaaatgccaa

SEQ ID NO: 457592 - DNA, 16 bp, M. musculus
tttaaaaaaatgtaca

SEQ ID NO: 457593 - DNA, 16 bp, M. musculus
tttaaaaaacaagcaa

SEQ ID NO: 457594 - DNA, 16 bp, M. musculus
tttaaaaaacatttca

SEQ ID NO: 457595 - DNA, 16 bp, M. musculus
tttaaaaaaccttttt

SEQ ID NO: 457596 - DNA, 16 bp, M. musculus
tttaaaaaagattttc

SEQ ID NO: 457597 - DNA, 16 bp, M. musculus
tttaaaaaagcaattt

SEQ ID NO: 457598 - DNA, 16 bp, M. musculus
tttaaaaaagtatctt

SEQ ID NO: 457599 - DNA, 16 bp, M. musculus
tttaaaaaataagaca

SEQ ID NO: 457600 - DNA, 16 bp, M. musculus
tttaaaaaatacttag

SEQ ID NO: 457601 - DNA, 16 bp, M. musculus
tttaaaaaatactttc

SEQ ID NO: 457602 - DNA, 16 bp, M. musculus
tttaaaaaatcaaagt

SEQ ID NO: 457603 - DNA, 16 bp, M. musculus
tttaaaaaatcctttc

SEQ ID NO: 457604 - DNA, 16 bp, M. musculus
tttaaaaaatgaaaca

SEQ ID NO: 457605 - DNA, 16 bp, M. musculus
tttaaaaaatgaaatc

SEQ ID NO: 457606 - DNA, 16 bp, M. musculus
tttaaaaaatgactta

SEQ ID NO: 457607 - DNA, 16 bp, M. musculus
tttaaaaaatgctttt

SEQ ID NO: 457608 - DNA, 16 bp, M. musculus
tttaaaaaatggcttt

SEQ ID NO: 457609 - DNA, 16 bp, M. musculus
tttaaaaaatggtgtg

SEQ ID NO: 457610 - DNA, 16 bp, M. musculus
tttaaaaaatgttagt

SEQ ID NO: 457611 - DNA, 16 bp, M. musculus
tttaaaaacaaggaaa

SEQ ID NO: 457612 - DNA, 16 bp, M. musculus
tttaaaaacaagtttt

SEQ ID NO: 457613 - DNA, 16 bp, M. musculus
tttaaaaacaattctt

SEQ ID NO: 457614 - DNA, 16 bp, M. musculus
tttaaaaacacattta

SEQ ID NO: 457615 - DNA, 16 bp, M. musculus
tttaaaaacagaaaag

SEQ ID NO: 457616 - DNA, 16 bp, M. musculus
tttaaaaacagccttt

SEQ ID NO: 457617 - DNA, 16 bp, M. musculus
tttaaaaacagggtct

SEQ ID NO: 457618 - DNA, 16 bp, M. musculus
tttaaaaacatacttt

SEQ ID NO: 457619 - DNA, 16 bp, M. musculus
tttaaaaacatggaaa

SEQ ID NO: 457620 - DNA, 16 bp, M. musculus
tttaaaaacattgaaa

SEQ ID NO: 457621 - DNA, 16 bp, M. musculus
tttaaaaacatttttc

SEQ ID NO: 457622 - DNA, 16 bp, M. musculus
tttaaaaacctcacag

SEQ ID NO: 457623 - DNA, 16 bp, M. musculus
tttaaaaactctatct

SEQ ID NO: 457624 - DNA, 16 bp, M. musculus
tttaaaaactgttctt

SEQ ID NO: 457625 - DNA, 16 bp, M. musculus
tttaaaaactgtttta

SEQ ID NO: 457626 - DNA, 16 bp, M. musculus
tttaaaaacttgaaat

SEQ ID NO: 457627 - DNA, 16 bp, M. musculus
tttaaaaagaaaacca

SEQ ID NO: 457628 - DNA, 16 bp, M. musculus
tttaaaaagaaaagca

SEQ ID NO: 457629 - DNA, 16 bp, M. musculus
tttaaaaagaaaagtc

SEQ ID NO: 457630 - DNA, 16 bp, M. musculus
tttaaaaagaaaccaa

SEQ ID NO: 457631 - DNA, 16 bp, M. musculus
tttaaaaagaaattac

SEQ ID NO: 457632 - DNA, 16 bp, M. musculus
tttaaaaagaaccaaa

SEQ ID NO: 457633 - DNA, 16 bp, M. musculus
tttaaaaagacatttt

SEQ ID NO: 457634 - DNA, 16 bp, M. musculus
tttaaaaagagaagtt

SEQ ID NO: 457635 - DNA, 16 bp, M. musculus
tttaaaaagagagaga

SEQ ID NO: 457636 - DNA, 16 bp, M. musculus
tttaaaaagaggaaga

SEQ ID NO: 457637 - DNA, 16 bp, M. musculus
tttaaaaagatacaaa

SEQ ID NO: 457638 - DNA, 16 bp, M. musculus
tttaaaaagatctttt

SEQ ID NO: 457639 - DNA, 16 bp, M. musculus
tttaaaaagattcatt

SEQ ID NO: 457640 - DNA, 16 bp, M. musculus
tttaaaaagcaaaaga

SEQ ID NO: 457641 - DNA, 16 bp, M. musculus
tttaaaaagcaaacaa

SEQ ID NO: 457642 - DNA, 16 bp, M. musculus
tttaaaaagcaaataa

SEQ ID NO: 457643 - DNA, 16 bp, M. musculus
tttaaaaagcaaatat

SEQ ID NO: 457644 - DNA, 16 bp, M. musculus
tttaaaaaggaaacaa

SEQ ID NO: 457645 - DNA, 16 bp, M. musculus
tttaaaaaggaaacta

SEQ ID NO: 457646 - DNA, 16 bp, M. musculus
tttaaaaaggtatttt

SEQ ID NO: 457647 - DNA, 16 bp, M. musculus
tttaaaaagtaaagca

SEQ ID NO: 457648 - DNA, 16 bp, M. musculus
tttaaaaagtaacagt

SEQ ID NO: 457649 - DNA, 16 bp, M. musculus
tttaaaaagtcaatga

SEQ ID NO: 457650 - DNA, 16 bp, M. musculus
tttaaaaagtctttaa

SEQ ID NO: 457651 - DNA, 16 bp, M. musculus
tttaaaaagtgaaaga

SEQ ID NO: 457652 - DNA, 16 bp, M. musculus
tttaaaaagttctcca

SEQ ID NO: 457653 - DNA, 16 bp, M. musculus
tttaaaaagttgtttc

SEQ ID NO: 457654 - DNA, 16 bp, M. musculus
tttaaaaagtttaaag

SEQ ID NO: 457655 - DNA, 16 bp, M. musculus
tttaaaaagtttcaaa

SEQ ID NO: 457656 - DNA, 16 bp, M. musculus
tttaaaaataaagaca

SEQ ID NO: 457657 - DNA, 16 bp, M. musculus
tttaaaaataaagcta

SEQ ID NO: 457658 - DNA, 16 bp, M. musculus
tttaaaaataaagttc

SEQ ID NO: 457659 - DNA, 16 bp, M. musculus
tttaaaaataagctaa

SEQ ID NO: 457660 - DNA, 16 bp, M. musculus
tttaaaaataattgga

SEQ ID NO: 457661 - DNA, 16 bp, M. musculus
tttaaaaatactagaa

SEQ ID NO: 457662 - DNA, 16 bp, M. musculus
tttaaaaatacttgtt

SEQ ID NO: 457663 - DNA, 16 bp, M. musculus
tttaaaaatatatgtg

SEQ ID NO: 457664 - DNA, 16 bp, M. musculus
tttaaaaatatgacat

SEQ ID NO: 457665 - DNA, 16 bp, M. musculus
tttaaaaatatgactt

SEQ ID NO: 457666 - DNA, 16 bp, M. musculus
tttaaaaatcaagaaa

SEQ ID NO: 457667 - DNA, 16 bp, M. musculus
tttaaaaatcacaatt

SEQ ID NO: 457668 - DNA, 16 bp, M. musculus
tttaaaaatcactctt

SEQ ID NO: 457669 - DNA, 16 bp, M. musculus
tttaaaaatcagtatt

SEQ ID NO: 457670 - DNA, 16 bp, M. musculus
tttaaaaatcatcttt

SEQ ID NO: 457671 - DNA, 16 bp, M. musculus
tttaaaaatccaaagt

SEQ ID NO: 457672 - DNA, 16 bp, M. musculus
tttaaaaatctcatct

SEQ ID NO: 457673 - DNA, 16 bp, M. musculus
tttaaaaatctcattt

SEQ ID NO: 457674 - DNA, 16 bp, M. musculus
tttaaaaatgaaaact

SEQ ID NO: 457675 - DNA, 16 bp, M. musculus
tttaaaaatgaagtga

SEQ ID NO: 457676 - DNA, 16 bp, M. musculus
tttaaaaatgaataca

SEQ ID NO: 457677 - DNA, 16 bp, M. musculus
tttaaaaatgacaaaa

SEQ ID NO: 457678 - DNA, 16 bp, M. musculus
tttaaaaatgcattta

SEQ ID NO: 457679 - DNA, 16 bp, M. musculus
tttaaaaatgtaacaa

SEQ ID NO: 457680 - DNA, 16 bp, M. musculus
tttaaaaatgtgtata

SEQ ID NO: 457681 - DNA, 16 bp, M. musculus
tttaaaaatgtgtttg

SEQ ID NO: 457682 - DNA, 16 bp, M. musculus
tttaaaaatgttcaac

SEQ ID NO: 457683 - DNA, 16 bp, M. musculus
tttaaaaattctcaaa

SEQ ID NO: 457684 - DNA, 16 bp, M. musculus
tttaaaaattctgtaa

SEQ ID NO: 457685 - DNA, 16 bp, M. musculus
tttaaaaattctgtgt

SEQ ID NO: 457686 - DNA, 16 bp, M. musculus
tttaaaaattgcaaaa

SEQ ID NO: 457687 - DNA, 16 bp, M. musculus
tttaaaaattgcattt

SEQ ID NO: 457688 - DNA, 16 bp, M. musculus
tttaaaaatttcagaa

SEQ ID NO: 457689 - DNA, 16 bp, M. musculus
tttaaaacaaaagagg

SEQ ID NO: 457690 - DNA, 16 bp, M. musculus
tttaaaacaaaagcaa

SEQ ID NO: 457691 - DNA, 16 bp, M. musculus
tttaaaacaacatttt

SEQ ID NO: 457692 - DNA, 16 bp, M. musculus
tttaaaacaatgtttt

SEQ ID NO: 457693 - DNA, 16 bp, M. musculus
tttaaaacaatttcaa

SEQ ID NO: 457694 - DNA, 16 bp, M. musculus
tttaaaacaggagaaa

SEQ ID NO: 457695 - DNA, 16 bp, M. musculus
tttaaaacagggtctc

SEQ ID NO: 457696 - DNA, 16 bp, M. musculus
tttaaaacagttcctc

SEQ ID NO: 457697 - DNA, 16 bp, M. musculus
tttaaaacatacattt

SEQ ID NO: 457698 - DNA, 16 bp, M. musculus
tttaaaacatattttg

SEQ ID NO: 457699 - DNA, 16 bp, M. musculus
tttaaaacatttcctt

SEQ ID NO: 457700 - DNA, 16 bp, M. musculus
tttaaaaccattttta

SEQ ID NO: 457701 - DNA, 16 bp, M. musculus
tttaaaacctaatgtt

SEQ ID NO: 457702 - DNA, 16 bp, M. musculus
tttaaaacctttaaaa

SEQ ID NO: 457703 - DNA, 16 bp, M. musculus
tttaaaactagaagca

SEQ ID NO: 457704 - DNA, 16 bp, M. musculus
tttaaaactattggtt

SEQ ID NO: 457705 - DNA, 16 bp, M. musculus
tttaaaactgattttt

SEQ ID NO: 457706 - DNA, 16 bp, M. musculus
tttaaaagaaaacttt

SEQ ID NO: 457707 - DNA, 16 bp, M. musculus
tttaaaagaaaagtct

SEQ ID NO: 457708 - DNA, 16 bp, M. musculus
tttaaaagaaagattt

SEQ ID NO: 457709 - DNA, 16 bp, M. musculus
tttaaaagaagacaaa

SEQ ID NO: 457710 - DNA, 16 bp, M. musculus
tttaaaagaagatatt

SEQ ID NO: 457711 - DNA, 16 bp, M. musculus
tttaaaagaagatttt

SEQ ID NO: 457712 - DNA, 16 bp, M. musculus
tttaaaagaagcaaaa

SEQ ID NO: 457713 - DNA, 16 bp, M. musculus
tttaaaagaattcaaa

SEQ ID NO: 457714 - DNA, 16 bp, M. musculus
tttaaaagacaaaatt

SEQ ID NO: 457715 - DNA, 16 bp, M. musculus
tttaaaagacacagaa

SEQ ID NO: 457716 - DNA, 16 bp, M. musculus
tttaaaagacttgcct

SEQ ID NO: 457717 - DNA, 16 bp, M. musculus
tttaaaagagaaggaa

SEQ ID NO: 457718 - DNA, 16 bp, M. musculus
tttaaaagagagcaag

SEQ ID NO: 457719 - DNA, 16 bp, M. musculus
tttaaaagagttgcct

SEQ ID NO: 457720 - DNA, 16 bp, M. musculus
tttaaaagatgcattt

SEQ ID NO: 457721 - DNA, 16 bp, M. musculus
tttaaaagattcattt

SEQ ID NO: 457722 - DNA, 16 bp, M. musculus
tttaaaagattctttt

SEQ ID NO: 457723 - DNA, 16 bp, M. musculus
tttaaaagcacagaaa

SEQ ID NO: 457724 - DNA, 16 bp, M. musculus
tttaaaagcacattta

SEQ ID NO: 457725 - DNA, 16 bp, M. musculus
tttaaaagcataaaaa

SEQ ID NO: 457726 - DNA, 16 bp, M. musculus
tttaaaagcattttaa

SEQ ID NO: 457727 - DNA, 16 bp, M. musculus
tttaaaagcatttttg

SEQ ID NO: 457728 - DNA, 16 bp, M. musculus
tttaaaagcttgtttt

SEQ ID NO: 457729 - DNA, 16 bp, M. musculus
tttaaaaggaaaattt

SEQ ID NO: 457730 - DNA, 16 bp, M. musculus
tttaaaaggaaagaga

SEQ ID NO: 457731 - DNA, 16 bp, M. musculus
tttaaaaggaaatttt

SEQ ID NO: 457732 - DNA, 16 bp, M. musculus
tttaaaaggaagaaag

SEQ ID NO: 457733 - DNA, 16 bp, M. musculus
tttaaaagggaagaaa

SEQ ID NO: 457734 - DNA, 16 bp, M. musculus
tttaaaaggggggggg

SEQ ID NO: 457735 - DNA, 16 bp, M. musculus
tttaaaagtaaataca

SEQ ID NO: 457736 - DNA, 16 bp, M. musculus
tttaaaagtagagaaa

SEQ ID NO: 457737 - DNA, 16 bp, M. musculus
tttaaaagtatcttta

SEQ ID NO: 457738 - DNA, 16 bp, M. musculus
tttaaaagtccaaagt

SEQ ID NO: 457739 - DNA, 16 bp, M. musculus
tttaaaagtgaaatat

SEQ ID NO: 457740 - DNA, 16 bp, M. musculus
tttaaaagtgtgtgtg

SEQ ID NO: 457741 - DNA, 16 bp, M. musculus
tttaaaagttattttc

SEQ ID NO: 457742 - DNA, 16 bp, M. musculus
tttaaaagttcatttt

SEQ ID NO: 457743 - DNA, 16 bp, M. musculus
tttaaaagtttatgaa

SEQ ID NO: 457744 - DNA, 16 bp, M. musculus
tttaaaataaaatgct

SEQ ID NO: 457745 - DNA, 16 bp, M. musculus
tttaaaataaacaaga

SEQ ID NO: 457746 - DNA, 16 bp, M. musculus
tttaaaataaagcttt

SEQ ID NO: 457747 - DNA, 16 bp, M. musculus
tttaaaataacccatt

SEQ ID NO: 457748 - DNA, 16 bp, M. musculus
tttaaaataagcaaaa

SEQ ID NO: 457749 - DNA, 16 bp, M. musculus
tttaaaatagtttctt

SEQ ID NO: 457750 - DNA, 16 bp, M. musculus
tttaaaatatattggt

SEQ ID NO: 457751 - DNA, 16 bp, M. musculus
tttaaaatatatttcc

SEQ ID NO: 457752 - DNA, 16 bp, M. musculus
tttaaaatattcagaa

SEQ ID NO: 457753 - DNA, 16 bp, M. musculus
tttaaaatattttcag

SEQ ID NO: 457754 - DNA, 16 bp, M. musculus
tttaaaatattttgct

SEQ ID NO: 457755 - DNA, 16 bp, M. musculus
tttaaaatcacttctc

SEQ ID NO: 457756 - DNA, 16 bp, M. musculus
tttaaaatcatgttta

SEQ ID NO: 457757 - DNA, 16 bp, M. musculus
tttaaaatccatgaaa

SEQ ID NO: 457758 - DNA, 16 bp, M. musculus
tttaaaatcctctacc

SEQ ID NO: 457759 - DNA, 16 bp, M. musculus
tttaaaatgaaaagtt

SEQ ID NO: 457760 - DNA, 16 bp, M. musculus
tttaaaatgaagatat

SEQ ID NO: 457761 - DNA, 16 bp, M. musculus
tttaaaatgactattt

SEQ ID NO: 457762 - DNA, 16 bp, M. musculus
tttaaaatgctgaaaa

SEQ ID NO: 457763 - DNA, 16 bp, M. musculus
tttaaaatgcttttaa

SEQ ID NO: 457764 - DNA, 16 bp, M. musculus
tttaaaatggaaatga

SEQ ID NO: 457765 - DNA, 16 bp, M. musculus
tttaaaatgtaaacaa

SEQ ID NO: 457766 - DNA, 16 bp, M. musculus
tttaaaatgtaaatct

SEQ ID NO: 457767 - DNA, 16 bp, M. musculus
tttaaaatgtaatttc

SEQ ID NO: 457768 - DNA, 16 bp, M. musculus
tttaaaatgtatgtaa

SEQ ID NO: 457769 - DNA, 16 bp, M. musculus
tttaaaatgtatttga

SEQ ID NO: 457770 - DNA, 16 bp, M. musculus
tttaaaatgtattttc

SEQ ID NO: 457771 - DNA, 16 bp, M. musculus
tttaaaatgtcttttt

SEQ ID NO: 457772 - DNA, 16 bp, M. musculus
tttaaaatgtgcttat

SEQ ID NO: 457773 - DNA, 16 bp, M. musculus
tttaaaatgtgtatat

SEQ ID NO: 457774 - DNA, 16 bp, M. musculus
tttaaaatgtgtgtgt

SEQ ID NO: 457775 - DNA, 16 bp, M. musculus
tttaaaatgttgaaat

SEQ ID NO: 457776 - DNA, 16 bp, M. musculus
tttaaaatgttttaca

SEQ ID NO: 457777 - DNA, 16 bp, M. musculus
tttaaaatgttttctt

SEQ ID NO: 457778 - DNA, 16 bp, M. musculus
tttaaaatgtttttca

SEQ ID NO: 457779 - DNA, 16 bp, M. musculus
tttaaaattacatttg

SEQ ID NO: 457780 - DNA, 16 bp, M. musculus
tttaaaattaccttta

SEQ ID NO: 457781 - DNA, 16 bp, M. musculus
tttaaaattcagatat

SEQ ID NO: 457782 - DNA, 16 bp, M. musculus
tttaaaattcagattt

SEQ ID NO: 457783 - DNA, 16 bp, M. musculus
tttaaaattcagtttt

SEQ ID NO: 457784 - DNA, 16 bp, M. musculus
tttaaaattcttcaaa

SEQ ID NO: 457785 - DNA, 16 bp, M. musculus
tttaaaattgcttttc

SEQ ID NO: 457786 - DNA, 16 bp, M. musculus
tttaaaattggattta

SEQ ID NO: 457787 - DNA, 16 bp, M. musculus
tttaaaatttgcattt

SEQ ID NO: 457788 - DNA, 16 bp, M. musculus
tttaaaatttggatat

SEQ ID NO: 457789 - DNA, 16 bp, M. musculus
tttaaaatttgttttc

SEQ ID NO: 457790 - DNA, 16 bp, M. musculus
tttaaacaaactcaaa

SEQ ID NO: 457791 - DNA, 16 bp, M. musculus
tttaaacagtatcttt

SEQ ID NO: 457792 - DNA, 16 bp, M. musculus
tttaaacatgtattta

SEQ ID NO: 457793 - DNA, 16 bp, M. musculus
tttaaactcctgatcc

SEQ ID NO: 457794 - DNA, 16 bp, M. musculus
tttaaactctgataaa

SEQ ID NO: 457795 - DNA, 16 bp, M. musculus
tttaaactgattggtc

SEQ ID NO: 457796 - DNA, 16 bp, M. musculus
tttaaactgttttatt

SEQ ID NO: 457797 - DNA, 16 bp, M. musculus
tttaaacttacagcat

SEQ ID NO: 457798 - DNA, 16 bp, M. musculus
tttaaagaaaaacgaa

SEQ ID NO: 457799 - DNA, 16 bp, M. musculus
tttaaagaaaagaaca

SEQ ID NO: 457800 - DNA, 16 bp, M. musculus
tttaaagaaaagcaaa

SEQ ID NO: 457801 - DNA, 16 bp, M. musculus
tttaaagaaaagcttt

SEQ ID NO: 457802 - DNA, 16 bp, M. musculus
tttaaagaaaatacag

SEQ ID NO: 457803 - DNA, 16 bp, M. musculus
tttaaagaaagcaaaa

SEQ ID NO: 457804 - DNA, 16 bp, M. musculus
tttaaagaaagtattt

SEQ ID NO: 457805 - DNA, 16 bp, M. musculus
tttaaagaaatacaga

SEQ ID NO: 457806 - DNA, 16 bp, M. musculus
tttaaagaacaaaatt

SEQ ID NO: 457807 - DNA, 16 bp, M. musculus
tttaaagaacaaacaa

SEQ ID NO: 457808 - DNA, 16 bp, M. musculus
tttaaagaagaactaa

SEQ ID NO: 457809 - DNA, 16 bp, M. musculus
tttaaagaagacctaa

SEQ ID NO: 457810 - DNA, 16 bp, M. musculus
tttaaagaagagctaa

SEQ ID NO: 457811 - DNA, 16 bp, M. musculus
tttaaagaaggaagaa

SEQ ID NO: 457812 - DNA, 16 bp, M. musculus
tttaaagacagagtct

SEQ ID NO: 457813 - DNA, 16 bp, M. musculus
tttaaagacagcatct

SEQ ID NO: 457814 - DNA, 16 bp, M. musculus
tttaaagacaggttct

SEQ ID NO: 457815 - DNA, 16 bp, M. musculus
tttaaagacctctacc

SEQ ID NO: 457816 - DNA, 16 bp, M. musculus
tttaaagatagaaact

SEQ ID NO: 457817 - DNA, 16 bp, M. musculus
tttaaagatgttttaa

SEQ ID NO: 457818 - DNA, 16 bp, M. musculus
tttaaagattgaattt

SEQ ID NO: 457819 - DNA, 16 bp, M. musculus
tttaaagcaatatttt

SEQ ID NO: 457820 - DNA, 16 bp, M. musculus
tttaaagcaatgtctt

SEQ ID NO: 457821 - DNA, 16 bp, M. musculus
tttaaagcattttttt

SEQ ID NO: 457822 - DNA, 16 bp, M. musculus
tttaaagccacatgga

SEQ ID NO: 457823 - DNA, 16 bp, M. musculus
tttaaagccaggcatg

SEQ ID NO: 457824 - DNA, 16 bp, M. musculus
tttaaagcctttaaaa

SEQ ID NO: 457825 - DNA, 16 bp, M. musculus
tttaaagcttttgttt

SEQ ID NO: 457826 - DNA, 16 bp, M. musculus
tttaaagctttttaaa

SEQ ID NO: 457827 - DNA, 16 bp, M. musculus
tttaaaggaaattcaa

SEQ ID NO: 457828 - DNA, 16 bp, M. musculus
tttaaaggaagaaaac

SEQ ID NO: 457829 - DNA, 16 bp, M. musculus
tttaaaggaagaaact

SEQ ID NO: 457830 - DNA, 16 bp, M. musculus
tttaaaggaaggaaaa

SEQ ID NO: 457831 - DNA, 16 bp, M. musculus
tttaaaggaattattt

SEQ ID NO: 457832 - DNA, 16 bp, M. musculus
tttaaaggatttttgt

SEQ ID NO: 457833 - DNA, 16 bp, M. musculus
tttaaaggcagggttt

SEQ ID NO: 457834 - DNA, 16 bp, M. musculus
tttaaaggcatgcacc

SEQ ID NO: 457835 - DNA, 16 bp, M. musculus
tttaaagggccaggca

SEQ ID NO: 457836 - DNA, 16 bp, M. musculus
tttaaagtatgcaagg

SEQ ID NO: 457837 - DNA, 16 bp, M. musculus
tttaaagtattttctt

SEQ ID NO: 457838 - DNA, 16 bp, M. musculus
tttaaagtatttttct

SEQ ID NO: 457839 - DNA, 16 bp, M. musculus
tttaaagtcttatttt

SEQ ID NO: 457840 - DNA, 16 bp, M. musculus
tttaaagttacattta

SEQ ID NO: 457841 - DNA, 16 bp, M. musculus
tttaaagttatttttc

SEQ ID NO: 457842 - DNA, 16 bp, M. musculus
tttaaagtttatttca

SEQ ID NO: 457843 - DNA, 16 bp, M. musculus
tttaaagtttcatttt

SEQ ID NO: 457844 - DNA, 16 bp, M. musculus
tttaaataaaagcaaa

SEQ ID NO: 457845 - DNA, 16 bp, M. musculus
tttaaataaagaagca

SEQ ID NO: 457846 - DNA, 16 bp, M. musculus
tttaaataagccaata

SEQ ID NO: 457847 - DNA, 16 bp, M. musculus
tttaaatacagaaaat

SEQ ID NO: 457848 - DNA, 16 bp, M. musculus
tttaaatacatttcaa

SEQ ID NO: 457849 - DNA, 16 bp, M. musculus
tttaaatactatattg

SEQ ID NO: 457850 - DNA, 16 bp, M. musculus
tttaaatagcctttgt

SEQ ID NO: 457851 - DNA, 16 bp, M. musculus
tttaaataggattatt

SEQ ID NO: 457852 - DNA, 16 bp, M. musculus
tttaaatagttctttt

SEQ ID NO: 457853 - DNA, 16 bp, M. musculus
tttaaatagttgagta

SEQ ID NO: 457854 - DNA, 16 bp, M. musculus
tttaaatatgaatctt

SEQ ID NO: 457855 - DNA, 16 bp, M. musculus
tttaaatattttgttc

SEQ ID NO: 457856 - DNA, 16 bp, M. musculus
tttaaatcagagtctt

SEQ ID NO: 457857 - DNA, 16 bp, M. musculus
tttaaatcatgtgtat

SEQ ID NO: 457858 - DNA, 16 bp, M. musculus
tttaaatccacatctt

SEQ ID NO: 457859 - DNA, 16 bp, M. musculus
tttaaatcccagcacc

SEQ ID NO: 457860 - DNA, 16 bp, M. musculus
tttaaatctctctctc

SEQ ID NO: 457861 - DNA, 16 bp, M. musculus
tttaaatgacaatttt

SEQ ID NO: 457862 - DNA, 16 bp, M. musculus
tttaaatgcattttta

SEQ ID NO: 457863 - DNA, 16 bp, M. musculus
tttaaatgggacttaa

SEQ ID NO: 457864 - DNA, 16 bp, M. musculus
tttaaatgtcttaaaa

SEQ ID NO: 457865 - DNA, 16 bp, M. musculus
tttaaatgtgaaaaat

SEQ ID NO: 457866 - DNA, 16 bp, M. musculus
tttaaatgtgtcattt

SEQ ID NO: 457867 - DNA, 16 bp, M. musculus
tttaaatgtgtgaaga

SEQ ID NO: 457868 - DNA, 16 bp, M. musculus
tttaaatgtttaaatg

SEQ ID NO: 457869 - DNA, 16 bp, M. musculus
tttaaatgtttcattt

SEQ ID NO: 457870 - DNA, 16 bp, M. musculus
tttaaatgtttctcag

SEQ ID NO: 457871 - DNA, 16 bp, M. musculus
tttaaattaaagagca

SEQ ID NO: 457872 - DNA, 16 bp, M. musculus
tttaaattgtgtgtgt

SEQ ID NO: 457873 - DNA, 16 bp, M. musculus
tttaaattgtttactt

SEQ ID NO: 457874 - DNA, 16 bp, M. musculus
tttaaatttctatcaa

SEQ ID NO: 457875 - DNA, 16 bp, M. musculus
tttaaatttctctcca

SEQ ID NO: 457876 - DNA, 16 bp, M. musculus
tttaaatttctcttca

SEQ ID NO: 457877 - DNA, 16 bp, M. musculus
tttaaatttgcatttt

SEQ ID NO: 457878 - DNA, 16 bp, M. musculus
tttaaatttgttttca

SEQ ID NO: 457879 - DNA, 16 bp, M. musculus
tttaaattttaagaca

SEQ ID NO: 457880 - DNA, 16 bp, M. musculus
tttaaattttattgca

SEQ ID NO: 457881 - DNA, 16 bp, M. musculus
tttaaattttgaaaca

SEQ ID NO: 457882 - DNA, 16 bp, M. musculus
tttaaattttgctttg

SEQ ID NO: 457883 - DNA, 16 bp, M. musculus
tttaaatttttcagta

SEQ ID NO: 457884 - DNA, 16 bp, M. musculus
tttaaatttttcatgt

SEQ ID NO: 457885 - DNA, 16 bp, M. musculus
tttaacaaattacatt

SEQ ID NO: 457886 - DNA, 16 bp, M. musculus
tttaacaacatcaaca

SEQ ID NO: 457887 - DNA, 16 bp, M. musculus
tttaacacagggtctc

SEQ ID NO: 457888 - DNA, 16 bp, M. musculus
tttaacacatttttaa

SEQ ID NO: 457889 - DNA, 16 bp, M. musculus
tttaacagtttctttt

SEQ ID NO: 457890 - DNA, 16 bp, M. musculus
tttaacatgaaggtgt

SEQ ID NO: 457891 - DNA, 16 bp, M. musculus
tttaacatttgtttta

SEQ ID NO: 457892 - DNA, 16 bp, M. musculus
tttaacattttcattg

SEQ ID NO: 457893 - DNA, 16 bp, M. musculus
tttaaccagtcctgta

SEQ ID NO: 457894 - DNA, 16 bp, M. musculus
tttaaccccagaactt

SEQ ID NO: 457895 - DNA, 16 bp, M. musculus
tttaacctctgagcca

SEQ ID NO: 457896 - DNA, 16 bp, M. musculus
tttaacctctgagtca

SEQ ID NO: 457897 - DNA, 16 bp, M. musculus
tttaacctttgagcca

SEQ ID NO: 457898 - DNA, 16 bp, M. musculus
tttaactcagagatcc

SEQ ID NO: 457899 - DNA, 16 bp, M. musculus
tttaactctagttcca

SEQ ID NO: 457900 - DNA, 16 bp, M. musculus
tttaactgaggctggc

SEQ ID NO: 457901 - DNA, 16 bp, M. musculus
tttaactggagaaact

SEQ ID NO: 457902 - DNA, 16 bp, M. musculus
tttaacttgtaaaata

SEQ ID NO: 457903 - DNA, 16 bp, M. musculus
tttaactttcaatgaa

SEQ ID NO: 457904 - DNA, 16 bp, M. musculus
tttaactttgaaaaaa

SEQ ID NO: 457905 - DNA, 16 bp, M. musculus
tttaactttggtgcct

SEQ ID NO: 457906 - DNA, 16 bp, M. musculus
tttaactttgttttgg

SEQ ID NO: 457907 - DNA, 16 bp, M. musculus
tttaagaaaacaattt

SEQ ID NO: 457908 - DNA, 16 bp, M. musculus
tttaagaagaaatttg

SEQ ID NO: 457909 - DNA, 16 bp, M. musculus
tttaagaagatttatt

SEQ ID NO: 457910 - DNA, 16 bp, M. musculus
tttaagaatgaagacc

SEQ ID NO: 457911 - DNA, 16 bp, M. musculus
tttaagaatgtgtgtg

SEQ ID NO: 457912 - DNA, 16 bp, M. musculus
tttaagacatggtttc

SEQ ID NO: 457913 - DNA, 16 bp, M. musculus
tttaagaccttcatcc

SEQ ID NO: 457914 - DNA, 16 bp, M. musculus
tttaagactttttatt

SEQ ID NO: 457915 - DNA, 16 bp, M. musculus
tttaagagaaaagaca

SEQ ID NO: 457916 - DNA, 16 bp, M. musculus
tttaagagaaggaaaa

SEQ ID NO: 457917 - DNA, 16 bp, M. musculus
tttaagagatttttgt

SEQ ID NO: 457918 - DNA, 16 bp, M. musculus
tttaagagcatttgct

SEQ ID NO: 457919 - DNA, 16 bp, M. musculus
tttaagagctttatta

SEQ ID NO: 457920 - DNA, 16 bp, M. musculus
tttaagataaggtttc

SEQ ID NO: 457921 - DNA, 16 bp, M. musculus
tttaagatcaaaagcc

SEQ ID NO: 457922 - DNA, 16 bp, M. musculus
tttaagatctttaatt

SEQ ID NO: 457923 - DNA, 16 bp, M. musculus
tttaagcacacacaca

SEQ ID NO: 457924 - DNA, 16 bp, M. musculus
tttaagcttttaaaaa

SEQ ID NO: 457925 - DNA, 16 bp, M. musculus
tttaagcttttcttca

SEQ ID NO: 457926 - DNA, 16 bp, M. musculus
tttaagctttttaaaa

SEQ ID NO: 457927 - DNA, 16 bp, M. musculus
tttaaggccagcctga

SEQ ID NO: 457928 - DNA, 16 bp, M. musculus
tttaaggcctgcctgg

SEQ ID NO: 457929 - DNA, 16 bp, M. musculus
tttaaggctagcctag

SEQ ID NO: 457930 - DNA, 16 bp, M. musculus
tttaaggctggcctgg

SEQ ID NO: 457931 - DNA, 16 bp, M. musculus
tttaagggtgtggtcc

SEQ ID NO: 457932 - DNA, 16 bp, M. musculus
tttaaggtaaacttcc

SEQ ID NO: 457933 - DNA, 16 bp, M. musculus
tttaaggtggatcttc

SEQ ID NO: 457934 - DNA, 16 bp, M. musculus
tttaagtaaaaggaaa

SEQ ID NO: 457935 - DNA, 16 bp, M. musculus
tttaagtaaggataga

SEQ ID NO: 457936 - DNA, 16 bp, M. musculus
tttaagtataaatcat

SEQ ID NO: 457937 - DNA, 16 bp, M. musculus
tttaagtgtgtgtgta

SEQ ID NO: 457938 - DNA, 16 bp, M. musculus
tttaagttcattttat

SEQ ID NO: 457939 - DNA, 16 bp, M. musculus
tttaagttcctgtcct

SEQ ID NO: 457940 - DNA, 16 bp, M. musculus
tttaagttgaaaattt

SEQ ID NO: 457941 - DNA, 16 bp, M. musculus
tttaagttggatattt

SEQ ID NO: 457942 - DNA, 16 bp, M. musculus
tttaagttgggaattt

SEQ ID NO: 457943 - DNA, 16 bp, M. musculus
tttaagtttggtacct

SEQ ID NO: 457944 - DNA, 16 bp, M. musculus
tttaagttttattgca

SEQ ID NO: 457945 - DNA, 16 bp, M. musculus
tttaataaaaacatgg

SEQ ID NO: 457946 - DNA, 17 bp, M. musculus
tttaataaaatgaggct

SEQ ID NO: 457947 - DNA, 16 bp, M. musculus
tttaataaatgtggct

SEQ ID NO: 457948 - DNA, 16 bp, M. musculus
tttaataaatgttcaa

SEQ ID NO: 457949 - DNA, 16 bp, M. musculus
tttaataacaacaaca

SEQ ID NO: 457950 - DNA, 16 bp, M. musculus
tttaataacagcataa

SEQ ID NO: 457951 - DNA, 16 bp, M. musculus
tttaataagagttcaa

SEQ ID NO: 457952 - DNA, 16 bp, M. musculus
tttaataagatccagg

SEQ ID NO: 457953 - DNA, 17 bp, M. musculus
tttaataagtccccttg

SEQ ID NO: 457954 - DNA, 16 bp, M. musculus
tttaatacacttcctc

SEQ ID NO: 457955 - DNA, 16 bp, M. musculus
tttaataccccactct

SEQ ID NO: 457956 - DNA, 16 bp, M. musculus
tttaatactatgtcca

SEQ ID NO: 457957 - DNA, 31 bp, M. musculus
tttaatagctgagtagtactccattgtgtaa

SEQ ID NO: 457958 - DNA, 16 bp, M. musculus
tttaatagtctctggt

SEQ ID NO: 457959 - DNA, 16 bp, M. musculus
tttaatatagggaaat

SEQ ID NO: 457960 - DNA, 16 bp, M. musculus
tttaatatagtttctt

SEQ ID NO: 457961 - DNA, 16 bp, M. musculus
tttaatatatgtgagt

SEQ ID NO: 457962 - DNA, 16 bp, M. musculus
tttaatatgctttctt

SEQ ID NO: 457963 - DNA, 16 bp, M. musculus
tttaatatttcatgct

SEQ ID NO: 457964 - DNA, 16 bp, M. musculus
tttaatatttcctttg

SEQ ID NO: 457965 - DNA, 16 bp, M. musculus
tttaatattttcagct

SEQ ID NO: 457966 - DNA, 16 bp, M. musculus
tttaatccaagagcta

SEQ ID NO: 457967 - DNA, 16 bp, M. musculus
tttaatccagcagcat

SEQ ID NO: 457968 - DNA, 16 bp, M. musculus
tttaatcccagaactt

SEQ ID NO: 457969 - DNA, 16 bp, M. musculus
tttaatcccagaattt

SEQ ID NO: 457970 - DNA, 16 bp, M. musculus
tttaatcccagcactt

SEQ ID NO: 457971 - DNA, 16 bp, M. musculus
tttaatcccagcatgg

SEQ ID NO: 457972 - DNA, 16 bp, M. musculus
tttaatctcaacactg

SEQ ID NO: 457973 - DNA, 16 bp, M. musculus
tttaatctcaacactt

SEQ ID NO: 457974 - DNA, 16 bp, M. musculus
tttaatctcagcagag

SEQ ID NO: 457975 - DNA, 16 bp, M. musculus
tttaatctccagcact

SEQ ID NO: 457976 - DNA, 16 bp, M. musculus
tttaatctgagtaact

SEQ ID NO: 457977 - DNA, 16 bp, M. musculus
tttaatgaaaaaaatc

SEQ ID NO: 457978 - DNA, 16 bp, M. musculus
tttaatgaaaatgaag

SEQ ID NO: 457979 - DNA, 16 bp, M. musculus
tttaatgaagatattt

SEQ ID NO: 457980 - DNA, 16 bp, M. musculus
tttaatgaagatgaag

SEQ ID NO: 457981 - DNA, 16 bp, M. musculus
tttaatgactgctttt

SEQ ID NO: 457982 - DNA, 16 bp, M. musculus
tttaatgataatgaag

SEQ ID NO: 457983 - DNA, 16 bp, M. musculus
tttaatgatggttctt

SEQ ID NO: 457984 - DNA, 17 bp, M. musculus
tttaatggcacacaaac

SEQ ID NO: 457985 - DNA, 16 bp, M. musculus
tttaatggggttattt

SEQ ID NO: 457986 - DNA, 16 bp, M. musculus
tttaatgtataaaatc

SEQ ID NO: 457987 - DNA, 16 bp, M. musculus
tttaatgtgctcagaa

SEQ ID NO: 457988 - DNA, 16 bp, M. musculus
tttaatgtgtttgaat

SEQ ID NO: 457989 - DNA, 16 bp, M. musculus
tttaattaaaagcaaa

SEQ ID NO: 457990 - DNA, 16 bp, M. musculus
tttaattccagtactc

SEQ ID NO: 457991 - DNA, 16 bp, M. musculus
tttaattcccagcaac

SEQ ID NO: 457992 - DNA, 16 bp, M. musculus
tttaattctttcacct

SEQ ID NO: 457993 - DNA, 16 bp, M. musculus
tttaattgaagctggc

SEQ ID NO: 457994 - DNA, 16 bp, M. musculus
tttaattggcttattg

SEQ ID NO: 457995 - DNA, 16 bp, M. musculus
tttaattgtgttttcc

SEQ ID NO: 457996 - DNA, 16 bp, M. musculus
tttaattgttgagaat

SEQ ID NO: 457997 - DNA, 16 bp, M. musculus
tttaatttcaaaatgt

SEQ ID NO: 457998 - DNA, 16 bp, M. musculus
tttaatttcagtattt

SEQ ID NO: 457999 - DNA, 16 bp, M. musculus
tttaatttcctcaatt

SEQ ID NO: 458000 - DNA, 16 bp, M. musculus
tttaatttgcttttaa

SEQ ID NO: 458001 - DNA, 16 bp, M. musculus
tttaattttctcagtg

SEQ ID NO: 458002 - DNA, 16 bp, M. musculus
tttaattttgaaacag

SEQ ID NO: 458003 - DNA, 16 bp, M. musculus
tttacaaaaacagcac

SEQ ID NO: 458004 - DNA, 16 bp, M. musculus
tttacaaaaagaaaat

SEQ ID NO: 458005 - DNA, 16 bp, M. musculus
tttacaaaacagaaaa

SEQ ID NO: 458006 - DNA, 16 bp, M. musculus
tttacaaaacatattt

SEQ ID NO: 458007 - DNA, 16 bp, M. musculus
tttacaaaacatttca

SEQ ID NO: 458008 - DNA, 16 bp, M. musculus
tttacaaaagaaaaga

SEQ ID NO: 458009 - DNA, 16 bp, M. musculus
tttacaaaatgaaaat

SEQ ID NO: 458010 - DNA, 16 bp, M. musculus
tttacaaagaaaatgc

SEQ ID NO: 458011 - DNA, 16 bp, M. musculus
tttacaaagagtttca

SEQ ID NO: 458012 - DNA, 16 bp, M. musculus
tttacaaataaacttg

SEQ ID NO: 458013 - DNA, 16 bp, M. musculus
tttacaaataaagctg

SEQ ID NO: 458014 - DNA, 16 bp, M. musculus
tttacaaataaatgaa

SEQ ID NO: 458015 - DNA, 16 bp, M. musculus
tttacaaatgagaaaa

SEQ ID NO: 458016 - DNA, 16 bp, M. musculus
tttacaaatgtgtgtg

SEQ ID NO: 458017 - DNA, 16 bp, M. musculus
tttacaaatttacaaa

SEQ ID NO: 458018 - DNA, 16 bp, M. musculus
tttacaagaattttat

SEQ ID NO: 458019 - DNA, 16 bp, M. musculus
tttacaagtaaagatg

SEQ ID NO: 458020 - DNA, 16 bp, M. musculus
tttacaagtttgcact

SEQ ID NO: 458021 - DNA, 16 bp, M. musculus
tttacaataaagataa

SEQ ID NO: 458022 - DNA, 16 bp, M. musculus
tttacacaaaacaaag

SEQ ID NO: 458023 - DNA, 16 bp, M. musculus
tttacacaatatattt

SEQ ID NO: 458024 - DNA, 16 bp, M. musculus
tttacacaatgaaatg

SEQ ID NO: 458025 - DNA, 16 bp, M. musculus
tttacacaatggaata

SEQ ID NO: 458026 - DNA, 16 bp, M. musculus
tttacacagtgctggg

SEQ ID NO: 458027 - DNA, 16 bp, M. musculus
tttacacatacacaca

SEQ ID NO: 458028 - DNA, 16 bp, M. musculus
tttacacatttaaaaa

SEQ ID NO: 458029 - DNA, 16 bp, M. musculus
tttacacattttaaaa

SEQ ID NO: 458030 - DNA, 16 bp, M. musculus
tttacaccaagatatt

SEQ ID NO: 458031 - DNA, 16 bp, M. musculus
tttacagaaacagaaa

SEQ ID NO: 458032 - DNA, 16 bp, M. musculus
tttacagaaggaaaaa

SEQ ID NO: 458033 - DNA, 18 bp, M. musculus
tttacagagtgagttcca

SEQ ID NO: 458034 - DNA, 16 bp, M. musculus
tttacagagttagaaa

SEQ ID NO: 458035 - DNA, 16 bp, M. musculus
tttacagatagccaca

SEQ ID NO: 458036 - DNA, 16 bp, M. musculus
tttacagatgagaaca

SEQ ID NO: 458037 - DNA, 16 bp, M. musculus
tttacagatttaaaaa

SEQ ID NO: 458038 - DNA, 17 bp, M. musculus
tttacagccaagtattt

SEQ ID NO: 458039 - DNA, 16 bp, M. musculus
tttacagggtttctct

SEQ ID NO: 458040 - DNA, 16 bp, M. musculus
tttacaggtgagaaaa

SEQ ID NO: 458041 - DNA, 16 bp, M. musculus
tttacaggtgtgtgtg

SEQ ID NO: 458042 - DNA, 16 bp, M. musculus
tttacagtttcagaag

SEQ ID NO: 458043 - DNA, 16 bp, M. musculus
tttacatacacatata

SEQ ID NO: 458044 - DNA, 16 bp, M. musculus
tttacatacataaaag

SEQ ID NO: 458045 - DNA, 16 bp, M. musculus
tttacatatatgtata

SEQ ID NO: 458046 - DNA, 16 bp, M. musculus
tttacatcaagacagt

SEQ ID NO: 458047 - DNA, 16 bp, M. musculus
tttacatgaaaaaaaa

SEQ ID NO: 458048 - DNA, 16 bp, M. musculus
tttacatgggctctgg

SEQ ID NO: 458049 - DNA, 16 bp, M. musculus
tttacatgtaataaat

SEQ ID NO: 458050 - DNA, 16 bp, M. musculus
tttacatgtatatata

SEQ ID NO: 458051 - DNA, 16 bp, M. musculus
tttacattagggataa

SEQ ID NO: 458052 - DNA, 16 bp, M. musculus
tttacatttaattttg

SEQ ID NO: 458053 - DNA, 16 bp, M. musculus
tttacatttatttagt

SEQ ID NO: 458054 - DNA, 16 bp, M. musculus
tttacatttcaagttt

SEQ ID NO: 458055 - DNA, 16 bp, M. musculus
tttacatttctgcttt

SEQ ID NO: 458056 - DNA, 16 bp, M. musculus
tttacatttgaaatgt

SEQ ID NO: 458057 - DNA, 16 bp, M. musculus
tttacatttgtttagt

SEQ ID NO: 458058 - DNA, 16 bp, M. musculus
tttacattttaaaagt

SEQ ID NO: 458059 - DNA, 16 bp, M. musculus
tttacattttaaatgt

SEQ ID NO: 458060 - DNA, 25 bp, M. musculus
tttacattttcaatgctatcccaaa

SEQ ID NO: 458061 - DNA, 16 bp, M. musculus
tttacattttcctgat

SEQ ID NO: 458062 - DNA, 16 bp, M. musculus
tttacatttttaaaag

SEQ ID NO: 458063 - DNA, 16 bp, M. musculus
tttaccaaaagcaatc

SEQ ID NO: 458064 - DNA, 16 bp, M. musculus
tttaccaacagagcca

SEQ ID NO: 458065 - DNA, 16 bp, M. musculus
tttaccaactccacat

SEQ ID NO: 458066 - DNA, 16 bp, M. musculus
tttaccaactgagaca

SEQ ID NO: 458067 - DNA, 16 bp, M. musculus
tttaccaagttatcat

SEQ ID NO: 458068 - DNA, 16 bp, M. musculus
tttaccaatctcacat

SEQ ID NO: 458069 - DNA, 16 bp, M. musculus
tttaccactgagctgt

SEQ ID NO: 458070 - DNA, 19 bp, M. musculus
tttaccacttagaacacag

SEQ ID NO: 458071 - DNA, 16 bp, M. musculus
tttaccagagaactcc

SEQ ID NO: 458072 - DNA, 16 bp, M. musculus
tttaccagagactatg

SEQ ID NO: 458073 - DNA, 16 bp, M. musculus
tttacccaagaggagt

SEQ ID NO: 458074 - DNA, 16 bp, M. musculus
tttacccaatggaata

SEQ ID NO: 458075 - DNA, 16 bp, M. musculus
tttacccacggagcca

SEQ ID NO: 458076 - DNA, 16 bp, M. musculus
tttacccactgagata

SEQ ID NO: 458077 - DNA, 16 bp, M. musculus
tttacccactgagcca

SEQ ID NO: 458078 - DNA, 16 bp, M. musculus
tttacccactgatcca

SEQ ID NO: 458079 - DNA, 16 bp, M. musculus
tttacctaaaaagttt

SEQ ID NO: 458080 - DNA, 16 bp, M. musculus
tttacctactgagcca

SEQ ID NO: 458081 - DNA, 16 bp, M. musculus
tttacctcccaagtgt

SEQ ID NO: 458082 - DNA, 23 bp, M. musculus
tttacctcttggcttacctctgc

SEQ ID NO: 458083 - DNA, 16 bp, M. musculus
tttacctgcatatatg

SEQ ID NO: 458084 - DNA, 16 bp, M. musculus
tttacctgcatgtgtg

SEQ ID NO: 458085 - DNA, 16 bp, M. musculus
tttacctgctcagcca

SEQ ID NO: 458086 - DNA, 16 bp, M. musculus
tttaccttcattgttt

SEQ ID NO: 458087 - DNA, 16 bp, M. musculus
tttacctttaaaaaaa

SEQ ID NO: 458088 - DNA, 16 bp, M. musculus
tttacctttggtacct

SEQ ID NO: 458089 - DNA, 16 bp, M. musculus
tttactagaaaaaaaa

SEQ ID NO: 458090 - DNA, 16 bp, M. musculus
tttactaggatagaaa

SEQ ID NO: 458091 - DNA, 16 bp, M. musculus
tttactatgtagacca

SEQ ID NO: 458092 - DNA, 16 bp, M. musculus
tttactcactgagtca

SEQ ID NO: 458093 - DNA, 16 bp, M. musculus
tttactctttgagaat

SEQ ID NO: 458094 - DNA, 16 bp, M. musculus
tttactgaaaaacaaa

SEQ ID NO: 458095 - DNA, 16 bp, M. musculus
tttactgaaaataaaa

SEQ ID NO: 458096 - DNA, 16 bp, M. musculus
tttactgaaaatattt

SEQ ID NO: 458097 - DNA, 16 bp, M. musculus
tttactgaaaatgaag

SEQ ID NO: 458098 - DNA, 16 bp, M. musculus
tttactgaatattttc

SEQ ID NO: 458099 - DNA, 16 bp, M. musculus
tttactgatggctcct

SEQ ID NO: 458100 - DNA, 23 bp, M. musculus
tttactgatggctcctctaaagg

SEQ ID NO: 458101 - DNA, 18 bp, M. musculus
tttactgctgtgaacaga

SEQ ID NO: 458102 - DNA, 16 bp, M. musculus
tttactgctgtgaatg

SEQ ID NO: 458103 - DNA, 16 bp, M. musculus
tttactgcttttaata

SEQ ID NO: 458104 - DNA, 16 bp, M. musculus
tttactggaattgctt

SEQ ID NO: 458105 - DNA, 16 bp, M. musculus
tttactggctttcttc

SEQ ID NO: 458106 - DNA, 16 bp, M. musculus
tttactggggttactt

SEQ ID NO: 458107 - DNA, 16 bp, M. musculus
tttactggggttattt

SEQ ID NO: 458108 - DNA, 16 bp, M. musculus
tttactggttatttta

SEQ ID NO: 458109 - DNA, 16 bp, M. musculus
tttactgtaaaaaaaa

SEQ ID NO: 458110 - DNA, 16 bp, M. musculus
tttactgtcaccctca

SEQ ID NO: 458111 - DNA, 16 bp, M. musculus
tttactgtgtagctct

SEQ ID NO: 458112 - DNA, 18 bp, M. musculus
tttactgttctgcacgca

SEQ ID NO: 458113 - DNA, 16 bp, M. musculus
tttactgttgtgaaca

SEQ ID NO: 458114 - DNA, 16 bp, M. musculus
tttactgttgtgaaga

SEQ ID NO: 458115 - DNA, 16 bp, M. musculus
tttacttatgcagcta

SEQ ID NO: 458116 - DNA, 16 bp, M. musculus
tttacttctgaaaaaa

SEQ ID NO: 458117 - DNA, 16 bp, M. musculus
tttacttctgtgtctt

SEQ ID NO: 458118 - DNA, 16 bp, M. musculus
tttacttgcaaatgtt

SEQ ID NO: 458119 - DNA, 16 bp, M. musculus
tttacttgtttacatt

SEQ ID NO: 458120 - DNA, 16 bp, M. musculus
tttactttagtggttc

SEQ ID NO: 458121 - DNA, 16 bp, M. musculus
tttactttcattttag

SEQ ID NO: 458122 - DNA, 16 bp, M. musculus
tttacttttaaaatgt

SEQ ID NO: 458123 - DNA, 16 bp, M. musculus
tttacttttgtaaaaa

SEQ ID NO: 458124 - DNA, 16 bp, M. musculus
tttactttttaaatgt

SEQ ID NO: 458125 - DNA, 16 bp, M. musculus
tttagaaaaacaacaa

SEQ ID NO: 458126 - DNA, 16 bp, M. musculus
tttagaaaacaatttt

SEQ ID NO: 458127 - DNA, 16 bp, M. musculus
tttagaaaacattttt

SEQ ID NO: 458128 - DNA, 16 bp, M. musculus
tttagaaaactaaaat

SEQ ID NO: 458129 - DNA, 16 bp, M. musculus
tttagaaagaacaaaa

SEQ ID NO: 458130 - DNA, 16 bp, M. musculus
tttagaaatacacaca

SEQ ID NO: 458131 - DNA, 16 bp, M. musculus
tttagaaattactttt

SEQ ID NO: 458132 - DNA, 16 bp, M. musculus
tttagaactagaaata

SEQ ID NO: 458133 - DNA, 16 bp, M. musculus
tttagaagagagaaaa

SEQ ID NO: 458134 - DNA, 16 bp, M. musculus
tttagaagagcagttg

SEQ ID NO: 458135 - DNA, 16 bp, M. musculus
tttagaagatttagaa

SEQ ID NO: 458136 - DNA, 16 bp, M. musculus
tttagaataattttct

SEQ ID NO: 458137 - DNA, 16 bp, M. musculus
tttagaatttaacaaa

SEQ ID NO: 458138 - DNA, 16 bp, M. musculus
tttagacagggtttct

SEQ ID NO: 458139 - DNA, 16 bp, M. musculus
tttagacataacagtt

SEQ ID NO: 458140 - DNA, 16 bp, M. musculus
tttagagaaacaatat

SEQ ID NO: 458141 - DNA, 16 bp, M. musculus
tttagagagagagaga

SEQ ID NO: 458142 - DNA, 16 bp, M. musculus
tttagagatttgaagt

SEQ ID NO: 458143 - DNA, 16 bp, M. musculus
tttagaggcattcaga

SEQ ID NO: 458144 - DNA, 16 bp, M. musculus
tttagagggaaaaaaa

SEQ ID NO: 458145 - DNA, 16 bp, M. musculus
tttagagttttatgaa

SEQ ID NO: 458146 - DNA, 16 bp, M. musculus
tttagataagagaacc

SEQ ID NO: 458147 - DNA, 16 bp, M. musculus
tttagataaggaattt

SEQ ID NO: 458148 - DNA, 16 bp, M. musculus
tttagatagttaactt

SEQ ID NO: 458149 - DNA, 16 bp, M. musculus
tttagatccatgtctt

SEQ ID NO: 458150 - DNA, 16 bp, M. musculus
tttagatcctggaagg

SEQ ID NO: 458151 - DNA, 16 bp, M. musculus
tttagatgaattaatg

SEQ ID NO: 458152 - DNA, 16 bp, M. musculus
tttagatgatttatct

SEQ ID NO: 458153 - DNA, 16 bp, M. musculus
tttagatttaatatgg

SEQ ID NO: 458154 - DNA, 16 bp, M. musculus
tttagattttaaaaga

SEQ ID NO: 458155 - DNA, 16 bp, M. musculus
tttagatttttcaaaa

SEQ ID NO: 458156 - DNA, 16 bp, M. musculus
tttagatttttttcag

SEQ ID NO: 458157 - DNA, 16 bp, M. musculus
tttagcaaagtttctt

SEQ ID NO: 458158 - DNA, 26 bp, M. musculus
tttagcaaattgtatcttatatcttg

SEQ ID NO: 458159 - DNA, 16 bp, M. musculus
tttagcagtgttttcc

SEQ ID NO: 458160 - DNA, 16 bp, M. musculus
tttagcattttttaaa

SEQ ID NO: 458161 - DNA, 16 bp, M. musculus
tttagccacagcatct

SEQ ID NO: 458162 - DNA, 16 bp, M. musculus
tttagcctttgagtag

SEQ ID NO: 458163 - DNA, 16 bp, M. musculus
tttagctcagtagtag

SEQ ID NO: 458164 - DNA, 19 bp, M. musculus
tttagctcatttacatttg

SEQ ID NO: 458165 - DNA, 16 bp, M. musculus
tttagctcctctgtca

SEQ ID NO: 458166 - DNA, 16 bp, M. musculus
tttagctcctttgaca

SEQ ID NO: 458167 - DNA, 16 bp, M. musculus
tttagctctcaccttt

SEQ ID NO: 458168 - DNA, 16 bp, M. musculus
tttagctctctacccc

SEQ ID NO: 458169 - DNA, 16 bp, M. musculus
tttagctgaaggcaat

SEQ ID NO: 458170 - DNA, 16 bp, M. musculus
tttagctgtaaataga

SEQ ID NO: 458171 - DNA, 16 bp, M. musculus
tttagcttcttggata

SEQ ID NO: 458172 - DNA, 16 bp, M. musculus
tttagcttctttggta

SEQ ID NO: 458173 - DNA, 16 bp, M. musculus
tttagcttctttgtca

SEQ ID NO: 458174 - DNA, 16 bp, M. musculus
tttagcttgtgttaag

SEQ ID NO: 458175 - DNA, 16 bp, M. musculus
tttagcttttgtcaag

SEQ ID NO: 458176 - DNA, 16 bp, M. musculus
tttaggaaaatatatt

SEQ ID NO: 458177 - DNA, 16 bp, M. musculus
tttaggaaattttccc

SEQ ID NO: 458178 - DNA, 16 bp, M. musculus
tttaggaaggattagg

SEQ ID NO: 458179 - DNA, 16 bp, M. musculus
tttaggaaggttgaga

SEQ ID NO: 458180 - DNA, 16 bp, M. musculus
tttaggaatgctttca

SEQ ID NO: 458181 - DNA, 16 bp, M. musculus
tttaggacctctgctc

SEQ ID NO: 458182 - DNA, 16 bp, M. musculus
tttaggacctctgctg

SEQ ID NO: 458183 - DNA, 16 bp, M. musculus
tttaggacctctgttc

SEQ ID NO: 458184 - DNA, 16 bp, M. musculus
tttaggacttctgctc

SEQ ID NO: 458185 - DNA, 16 bp, M. musculus
tttaggagaaggtccc

SEQ ID NO: 458186 - DNA, 16 bp, M. musculus
tttaggaggctgaggc

SEQ ID NO: 458187 - DNA, 16 bp, M. musculus
tttaggaggtgtgacc

SEQ ID NO: 458188 - DNA, 16 bp, M. musculus
tttaggataaactgtt

SEQ ID NO: 458189 - DNA, 16 bp, M. musculus
tttagggaaggtgcac

SEQ ID NO: 458190 - DNA, 16 bp, M. musculus
tttagggaataatgac

SEQ ID NO: 458191 - DNA, 16 bp, M. musculus
tttaggggaaaaaaaa

SEQ ID NO: 458192 - DNA, 16 bp, M. musculus
tttaggtatcagtaat

SEQ ID NO: 458193 - DNA, 16 bp, M. musculus
tttaggtccttctcag

SEQ ID NO: 458194 - DNA, 16 bp, M. musculus
tttaggtctgtggatt

SEQ ID NO: 458195 - DNA, 16 bp, M. musculus
tttaggtgtttttcag

SEQ ID NO: 458196 - DNA, 16 bp, M. musculus
tttaggtttgttgaaa

SEQ ID NO: 458197 - DNA, 16 bp, M. musculus
tttagtaaaaatggct

SEQ ID NO: 458198 - DNA, 16 bp, M. musculus
tttagtaaattagtgg

SEQ ID NO: 458199 - DNA, 16 bp, M. musculus
tttagtaaattttctt

SEQ ID NO: 458200 - DNA, 16 bp, M. musculus
tttagtcatggtgttt

SEQ ID NO: 458201 - DNA, 19 bp, M. musculus
tttagtcccagggagctct

SEQ ID NO: 458202 - DNA, 16 bp, M. musculus
tttagtcctttctcta

SEQ ID NO: 458203 - DNA, 16 bp, M. musculus
tttagtgcaaaattct

SEQ ID NO: 458204 - DNA, 16 bp, M. musculus
tttagtgcagaattct

SEQ ID NO: 458205 - DNA, 16 bp, M. musculus
tttagtgggtttgctt

SEQ ID NO: 458206 - DNA, 16 bp, M. musculus
tttagttcattatctt

SEQ ID NO: 458207 - DNA, 16 bp, M. musculus
tttagttcctgggaac

SEQ ID NO: 458208 - DNA, 16 bp, M. musculus
tttagttctagagttt

SEQ ID NO: 458209 - DNA, 16 bp, M. musculus
tttagttcttttgtga

SEQ ID NO: 458210 - DNA, 16 bp, M. musculus
tttagtttcctccaag

SEQ ID NO: 458211 - DNA, 16 bp, M. musculus
tttagtttctccatct

SEQ ID NO: 458212 - DNA, 16 bp, M. musculus
tttagttttaaaatga

SEQ ID NO: 458213 - DNA, 16 bp, M. musculus
tttagttttaaagaaa

SEQ ID NO: 458214 - DNA, 16 bp, M. musculus
tttataaaacaaagaa

SEQ ID NO: 458215 - DNA, 16 bp, M. musculus
tttataaaacacatca

SEQ ID NO: 458216 - DNA, 16 bp, M. musculus
tttataaaagaaacat

SEQ ID NO: 458217 - DNA, 16 bp, M. musculus
tttataaaagttgcct

SEQ ID NO: 458218 - DNA, 16 bp, M. musculus
tttataaaatgtgtat

SEQ ID NO: 458219 - DNA, 16 bp, M. musculus
tttataaacaatagaa

SEQ ID NO: 458220 - DNA, 16 bp, M. musculus
tttataaagaaatgtt

SEQ ID NO: 458221 - DNA, 16 bp, M. musculus
tttataaagaagagag

SEQ ID NO: 458222 - DNA, 16 bp, M. musculus
tttataaagagaaaag

SEQ ID NO: 458223 - DNA, 16 bp, M. musculus
tttataacatctgtcc

SEQ ID NO: 458224 - DNA, 16 bp, M. musculus
tttataactgtaagtt

SEQ ID NO: 458225 - DNA, 16 bp, M. musculus
tttataagatttgtgt

SEQ ID NO: 458226 - DNA, 16 bp, M. musculus
tttataagcacagaca

SEQ ID NO: 458227 - DNA, 16 bp, M. musculus
tttataagtctagttt

SEQ ID NO: 458228 - DNA, 16 bp, M. musculus
tttataataaacctta

SEQ ID NO: 458229 - DNA, 27 bp, M. musculus
tttataatagccagaagctggaaagag

SEQ ID NO: 458230 - DNA, 16 bp, M. musculus
tttataatagccggaa

SEQ ID NO: 458231 - DNA, 16 bp, M. musculus
tttataataggactgc

SEQ ID NO: 458232 - DNA, 16 bp, M. musculus
tttataattgttatca

SEQ ID NO: 458233 - DNA, 16 bp, M. musculus
tttataatttctgtta

SEQ ID NO: 458234 - DNA, 16 bp, M. musculus
tttatacagaagacca

SEQ ID NO: 458235 - DNA, 16 bp, M. musculus
tttatacaggctgcca

SEQ ID NO: 458236 - DNA, 16 bp, M. musculus
tttatacagtgctggg

SEQ ID NO: 458237 - DNA, 16 bp, M. musculus
tttatacagtggatta

SEQ ID NO: 458238 - DNA, 16 bp, M. musculus
tttatacagttcagga

SEQ ID NO: 458239 - DNA, 16 bp, M. musculus
tttatacatacataca

SEQ ID NO: 458240 - DNA, 16 bp, M. musculus
tttatacatctgtttc

SEQ ID NO: 458241 - DNA, 16 bp, M. musculus
tttataccatctttaa

SEQ ID NO: 458242 - DNA, 16 bp, M. musculus
tttataccccattttt

SEQ ID NO: 458243 - DNA, 16 bp, M. musculus
tttatacttaaaacat

SEQ ID NO: 458244 - DNA, 16 bp, M. musculus
tttatagaattcctga

SEQ ID NO: 458245 - DNA, 16 bp, M. musculus
tttatagagaagaaag

SEQ ID NO: 458246 - DNA, 16 bp, M. musculus
tttatagagaaggaaa

SEQ ID NO: 458247 - DNA, 16 bp, M. musculus
tttatagatgaagaaa

SEQ ID NO: 458248 - DNA, 16 bp, M. musculus
tttatagattttggat

SEQ ID NO: 458249 - DNA, 16 bp, M. musculus
tttatagcaaccttat

SEQ ID NO: 458250 - DNA, 16 bp, M. musculus
tttatagctgtaattt

SEQ ID NO: 458251 - DNA, 16 bp, M. musculus
tttatatacacacata

SEQ ID NO: 458252 - DNA, 16 bp, M. musculus
tttatatactctctga

SEQ ID NO: 458253 - DNA, 16 bp, M. musculus
tttatatagagaaagg

SEQ ID NO: 458254 - DNA, 16 bp, M. musculus
tttatatagtttggat

SEQ ID NO: 458255 - DNA, 16 bp, M. musculus
tttatatatacataca

SEQ ID NO: 458256 - DNA, 16 bp, M. musculus
tttatatatgtgagca

SEQ ID NO: 458257 - DNA, 16 bp, M. musculus
tttatatatgtgtgtg

SEQ ID NO: 458258 - DNA, 16 bp, M. musculus
tttatatattttgcat

SEQ ID NO: 458259 - DNA, 16 bp, M. musculus
tttatatccagccagt

SEQ ID NO: 458260 - DNA, 16 bp, M. musculus
tttatatcctcttccc

SEQ ID NO: 458261 - DNA, 16 bp, M. musculus
tttatatcctgattgc

SEQ ID NO: 458262 - DNA, 16 bp, M. musculus
tttatatctcagacag

SEQ ID NO: 458263 - DNA, 34 bp, M. musculus
tttatatctcccccgaaccctgggcctctcactc

SEQ ID NO: 458264 - DNA, 16 bp, M. musculus
tttatatctgggtctt

SEQ ID NO: 458265 - DNA, 16 bp, M. musculus
tttatatctgtaattt

SEQ ID NO: 458266 - DNA, 16 bp, M. musculus
tttatatgagtacatt

SEQ ID NO: 458267 - DNA, 16 bp, M. musculus
tttatatggaaataca

SEQ ID NO: 458268 - DNA, 16 bp, M. musculus
tttatatggtgctggg

SEQ ID NO: 458269 - DNA, 16 bp, M. musculus
tttatatgtaaatatg

SEQ ID NO: 458270 - DNA, 16 bp, M. musculus
tttatatgtaagtata

SEQ ID NO: 458271 - DNA, 16 bp, M. musculus
tttatatgtatatgca

SEQ ID NO: 458272 - DNA, 16 bp, M. musculus
tttatatgtgagtaca

SEQ ID NO: 458273 - DNA, 16 bp, M. musculus
tttatatgtgtaaata

SEQ ID NO: 458274 - DNA, 16 bp, M. musculus
tttatatgttgcttga

SEQ ID NO: 458275 - DNA, 16 bp, M. musculus
tttatattacgattca

SEQ ID NO: 458276 - DNA, 16 bp, M. musculus
tttatattatttgtca

SEQ ID NO: 458277 - DNA, 16 bp, M. musculus
tttatatttgagacag

SEQ ID NO: 458278 - DNA, 16 bp, M. musculus
tttatattttacaaag

SEQ ID NO: 458279 - DNA, 16 bp, M. musculus
tttatattttgatgct

SEQ ID NO: 458280 - DNA, 16 bp, M. musculus
tttatattttggaaaa

SEQ ID NO: 458281 - DNA, 16 bp, M. musculus
tttatcacagtaacaa

SEQ ID NO: 458282 - DNA, 16 bp, M. musculus
tttatcagatattttc

SEQ ID NO: 458283 - DNA, 16 bp, M. musculus
tttatcagctgtagaa

SEQ ID NO: 458284 - DNA, 16 bp, M. musculus
tttatcatttatcaaa

SEQ ID NO: 458285 - DNA, 16 bp, M. musculus
tttatcatttgtacaa

SEQ ID NO: 458286 - DNA, 16 bp, M. musculus
tttatcccagagatgc

SEQ ID NO: 458287 - DNA, 35 bp, M. musculus
tttatcctatccatgacttggaggccttagagatt

SEQ ID NO: 458288 - DNA, 16 bp, M. musculus
tttatctatctggttg

SEQ ID NO: 458289 - DNA, 16 bp, M. musculus
tttatctattatgtat

SEQ ID NO: 458290 - DNA, 16 bp, M. musculus
tttatctattgagcca

SEQ ID NO: 458291 - DNA, 16 bp, M. musculus
tttatctctgtgtcct

SEQ ID NO: 458292 - DNA, 16 bp, M. musculus
tttatctgtatgtatg

SEQ ID NO: 458293 - DNA, 16 bp, M. musculus
tttatctgtgtgtctg

SEQ ID NO: 458294 - DNA, 16 bp, M. musculus
tttatctgtgtgtgtg

SEQ ID NO: 458295 - DNA, 16 bp, M. musculus
tttatcttaaaacaaa

SEQ ID NO: 458296 - DNA, 16 bp, M. musculus
tttatcttactccatc

SEQ ID NO: 458297 - DNA, 16 bp, M. musculus
tttatctttgacaagg

SEQ ID NO: 458298 - DNA, 16 bp, M. musculus
tttatctttgagaaga

SEQ ID NO: 458299 - DNA, 16 bp, M. musculus
tttatcttttaaaatg

SEQ ID NO: 458300 - DNA, 16 bp, M. musculus
tttatctttttaaaag

SEQ ID NO: 458301 - DNA, 16 bp, M. musculus
tttatgaaattcataa

SEQ ID NO: 458302 - DNA, 16 bp, M. musculus
tttatgaaattcttaa

SEQ ID NO: 458303 - DNA, 16 bp, M. musculus
tttatgaaattcttcg

SEQ ID NO: 458304 - DNA, 16 bp, M. musculus
tttatgaatagcaaat

SEQ ID NO: 458305 - DNA, 16 bp, M. musculus
tttatgaatatgatag

SEQ ID NO: 458306 - DNA, 16 bp, M. musculus
tttatgaccaattatg

SEQ ID NO: 458307 - DNA, 16 bp, M. musculus
tttatgactattgtga

SEQ ID NO: 458308 - DNA, 16 bp, M. musculus
tttatgactgaataaa

SEQ ID NO: 458309 - DNA, 17 bp, M. musculus
tttatgagatcccattt

SEQ ID NO: 458310 - DNA, 17 bp, M. musculus
tttatgaggtcccattt

SEQ ID NO: 458311 - DNA, 16 bp, M. musculus
tttatgataaaaatgt

SEQ ID NO: 458312 - DNA, 16 bp, M. musculus
tttatgatgatcctat

SEQ ID NO: 458313 - DNA, 16 bp, M. musculus
tttatgattcataaca

SEQ ID NO: 458314 - DNA, 16 bp, M. musculus
tttatgcacatgcatg

SEQ ID NO: 458315 - DNA, 16 bp, M. musculus
tttatgcatttatgca

SEQ ID NO: 458316 - DNA, 16 bp, M. musculus
tttatgcgtatgggtg

SEQ ID NO: 458317 - DNA, 16 bp, M. musculus
tttatgctgtgctggg

SEQ ID NO: 458318 - DNA, 16 bp, M. musculus
tttatgcttggcccag

SEQ ID NO: 458319 - DNA, 16 bp, M. musculus
tttatggagacatttt

SEQ ID NO: 458320 - DNA, 16 bp, M. musculus
tttatggccagtttga

SEQ ID NO: 458321 - DNA, 16 bp, M. musculus
tttatggctaataacc

SEQ ID NO: 458322 - DNA, 16 bp, M. musculus
tttatggctgaataaa

SEQ ID NO: 458323 - DNA, 16 bp, M. musculus
tttatggggaagagat

SEQ ID NO: 458324 - DNA, 16 bp, M. musculus
tttatgggggaaaaaa

SEQ ID NO: 458325 - DNA, 16 bp, M. musculus
tttatggttggagtca

SEQ ID NO: 458326 - DNA, 16 bp, M. musculus
tttatggttgggggtc

SEQ ID NO: 458327 - DNA, 16 bp, M. musculus
tttatgtaacatttta

SEQ ID NO: 458328 - DNA, 16 bp, M. musculus
tttatgtatatgagtg

SEQ ID NO: 458329 - DNA, 16 bp, M. musculus
tttatgtatatgggta

SEQ ID NO: 458330 - DNA, 16 bp, M. musculus
tttatgtatgtaagta

SEQ ID NO: 458331 - DNA, 16 bp, M. musculus
tttatgtatttactta

SEQ ID NO: 458332 - DNA, 16 bp, M. musculus
tttatgtcatttttaa

SEQ ID NO: 458333 - DNA, 16 bp, M. musculus
tttatgtcctctatca

SEQ ID NO: 458334 - DNA, 16 bp, M. musculus
tttatgtcttattgac

SEQ ID NO: 458335 - DNA, 16 bp, M. musculus
tttatgtctttaaaat

SEQ ID NO: 458336 - DNA, 16 bp, M. musculus
tttatgtgcatgagta

SEQ ID NO: 458337 - DNA, 16 bp, M. musculus
tttatgtggtgctggg

SEQ ID NO: 458338 - DNA, 16 bp, M. musculus
tttatgtgtataagtg

SEQ ID NO: 458339 - DNA, 16 bp, M. musculus
tttatgtgtatataaa

SEQ ID NO: 458340 - DNA, 16 bp, M. musculus
tttatgttacttgacc

SEQ ID NO: 458341 - DNA, 24 bp, M. musculus
tttatgtttgccctggtcagggtc

SEQ ID NO: 458342 - DNA, 16 bp, M. musculus
tttatgttttccaaat

SEQ ID NO: 458343 - DNA, 17 bp, M. musculus
tttattaaaatgaggct

SEQ ID NO: 458344 - DNA, 16 bp, M. musculus
tttattaagttctttg

SEQ ID NO: 458345 - DNA, 16 bp, M. musculus
tttattagaacaaaaa

SEQ ID NO: 458346 - DNA, 16 bp, M. musculus
tttattagagtggctt

SEQ ID NO: 458347 - DNA, 16 bp, M. musculus
tttattagtttaagtg

SEQ ID NO: 458348 - DNA, 16 bp, M. musculus
tttattataagtaagt

SEQ ID NO: 458349 - DNA, 16 bp, M. musculus
tttattatacgtaagt

SEQ ID NO: 458350 - DNA, 16 bp, M. musculus
tttattatagaaatgc

SEQ ID NO: 458351 - DNA, 16 bp, M. musculus
tttattatctgtaagt

SEQ ID NO: 458352 - DNA, 21 bp, M. musculus
tttattatgctgaggtgcctt

SEQ ID NO: 458353 - DNA, 16 bp, M. musculus
tttattatgtatacat

SEQ ID NO: 458354 - DNA, 16 bp, M. musculus
tttattatgttaattc

SEQ ID NO: 458355 - DNA, 16 bp, M. musculus
tttattattcagtatt

SEQ ID NO: 458356 - DNA, 16 bp, M. musculus
tttattatttatgctg

SEQ ID NO: 458357 - DNA, 16 bp, M. musculus
tttattatttcaaaga

SEQ ID NO: 458358 - DNA, 16 bp, M. musculus
tttattatttgagaca

SEQ ID NO: 458359 - DNA, 16 bp, M. musculus
tttattcaaacattat

SEQ ID NO: 458360 - DNA, 20 bp, M. musculus
tttattcaagagatgaaggg

SEQ ID NO: 458361 - DNA, 16 bp, M. musculus
tttattcaagccacca

SEQ ID NO: 458362 - DNA, 16 bp, M. musculus
tttattcagcttaaaa

SEQ ID NO: 458363 - DNA, 16 bp, M. musculus
tttattcaggattttt

SEQ ID NO: 458364 - DNA, 16 bp, M. musculus
tttattcagtgcattt

SEQ ID NO: 458365 - DNA, 16 bp, M. musculus
tttattcattcatgca

SEQ ID NO: 458366 - DNA, 16 bp, M. musculus
tttattcatttaacaa

SEQ ID NO: 458367 - DNA, 16 bp, M. musculus
tttattccagatgaat

SEQ ID NO: 458368 - DNA, 16 bp, M. musculus
tttattcctctcctgg

SEQ ID NO: 458369 - DNA, 16 bp, M. musculus
tttattcctgtgaaga

SEQ ID NO: 458370 - DNA, 16 bp, M. musculus
tttattccttacttga

SEQ ID NO: 458371 - DNA, 16 bp, M. musculus
tttattccttccttga

SEQ ID NO: 458372 - DNA, 16 bp, M. musculus
tttattccttggtttc

SEQ ID NO: 458373 - DNA, 16 bp, M. musculus
tttattctaaaatttg

SEQ ID NO: 458374 - DNA, 16 bp, M. musculus
tttattctatttcctg

SEQ ID NO: 458375 - DNA, 16 bp, M. musculus
tttattctctgagaat

SEQ ID NO: 458376 - DNA, 16 bp, M. musculus
tttattctctgcattt

SEQ ID NO: 458377 - DNA, 16 bp, M. musculus
tttattctgagccaaa

SEQ ID NO: 458378 - DNA, 16 bp, M. musculus
tttattctgtagccca

SEQ ID NO: 458379 - DNA, 16 bp, M. musculus
tttattctgtgtgtat

SEQ ID NO: 458380 - DNA, 16 bp, M. musculus
tttattctttaagaaa

SEQ ID NO: 458381 - DNA, 16 bp, M. musculus
tttattctttctgaaa

SEQ ID NO: 458382 - DNA, 16 bp, M. musculus
tttattcttttaagat

SEQ ID NO: 458383 - DNA, 16 bp, M. musculus
tttattgaaaatgaag

SEQ ID NO: 458384 - DNA, 16 bp, M. musculus
tttattgaaagaagat

SEQ ID NO: 458385 - DNA, 16 bp, M. musculus
tttattgaagaaaaat

SEQ ID NO: 458386 - DNA, 16 bp, M. musculus
tttattgaagatgctt

SEQ ID NO: 458387 - DNA, 16 bp, M. musculus
tttattgaattctaga

SEQ ID NO: 458388 - DNA, 16 bp, M. musculus
tttattgacaagtcaa

SEQ ID NO: 458389 - DNA, 16 bp, M. musculus
tttattgacaggtgat

SEQ ID NO: 458390 - DNA, 16 bp, M. musculus
tttattgactgagcca

SEQ ID NO: 458391 - DNA, 16 bp, M. musculus
tttattgacttattta

SEQ ID NO: 458392 - DNA, 16 bp, M. musculus
tttattgagagggaga

SEQ ID NO: 458393 - DNA, 16 bp, M. musculus
tttattgagcacttac

SEQ ID NO: 458394 - DNA, 16 bp, M. musculus
tttattgaggaatttt

SEQ ID NO: 458395 - DNA, 18 bp, M. musculus
tttattgatggtattcaa

SEQ ID NO: 458396 - DNA, 17 bp, M. musculus
tttattgcctcaagtca

SEQ ID NO: 458397 - DNA, 16 bp, M. musculus
tttattgctgggaaga

SEQ ID NO: 458398 - DNA, 16 bp, M. musculus
tttattgcttctactt

SEQ ID NO: 458399 - DNA, 16 bp, M. musculus
tttattgtatgtaagt

SEQ ID NO: 458400 - DNA, 16 bp, M. musculus
tttattgtgtctacct

SEQ ID NO: 458401 - DNA, 16 bp, M. musculus
tttattgtttactctg

SEQ ID NO: 458402 - DNA, 16 bp, M. musculus
tttatttaaaactgca

SEQ ID NO: 458403 - DNA, 16 bp, M. musculus
tttatttaaaagagaa

SEQ ID NO: 458404 - DNA, 16 bp, M. musculus
tttatttaagacattt

SEQ ID NO: 458405 - DNA, 16 bp, M. musculus
tttatttaatgtgagt

SEQ ID NO: 458406 - DNA, 16 bp, M. musculus
tttatttacagtttaa

SEQ ID NO: 458407 - DNA, 16 bp, M. musculus
tttatttacattacaa

SEQ ID NO: 458408 - DNA, 16 bp, M. musculus
tttatttatgagtgtg

SEQ ID NO: 458409 - DNA, 18 bp, M. musculus
tttatttattaactagaa

SEQ ID NO: 458410 - DNA, 16 bp, M. musculus
tttatttatttcagct

SEQ ID NO: 458411 - DNA, 16 bp, M. musculus
tttatttattttacag

SEQ ID NO: 458412 - DNA, 16 bp, M. musculus
tttatttcacatgcat

SEQ ID NO: 458413 - DNA, 16 bp, M. musculus
tttatttcagaatttt

SEQ ID NO: 458414 - DNA, 16 bp, M. musculus
tttatttcagctcatg

SEQ ID NO: 458415 - DNA, 16 bp, M. musculus
tttatttcatgtatgt

SEQ ID NO: 458416 - DNA, 16 bp, M. musculus
tttatttcatgtgcat

SEQ ID NO: 458417 - DNA, 16 bp, M. musculus
tttatttccaaataaa

SEQ ID NO: 458418 - DNA, 16 bp, M. musculus
tttatttcctgctgtc

SEQ ID NO: 458419 - DNA, 16 bp, M. musculus
tttatttctaaacata

SEQ ID NO: 458420 - DNA, 16 bp, M. musculus
tttatttctagatctt

SEQ ID NO: 458421 - DNA, 16 bp, M. musculus
tttatttctatgtgta

SEQ ID NO: 458422 - DNA, 16 bp, M. musculus
tttatttctgaatatt

SEQ ID NO: 458423 - DNA, 16 bp, M. musculus
tttatttctgagtctt

SEQ ID NO: 458424 - DNA, 16 bp, M. musculus
tttatttctgtatgta

SEQ ID NO: 458425 - DNA, 16 bp, M. musculus
tttatttctgtgaaca

SEQ ID NO: 458426 - DNA, 16 bp, M. musculus
tttatttcttcaatgt

SEQ ID NO: 458427 - DNA, 16 bp, M. musculus
tttatttcttctgtga

SEQ ID NO: 458428 - DNA, 16 bp, M. musculus
tttatttctttaagtg

SEQ ID NO: 458429 - DNA, 16 bp, M. musculus
tttatttcttttgaaa

SEQ ID NO: 458430 - DNA, 16 bp, M. musculus
tttatttgacctctaa

SEQ ID NO: 458431 - DNA, 16 bp, M. musculus
tttatttgagacaagg

SEQ ID NO: 458432 - DNA, 16 bp, M. musculus
tttatttgcatttcat

SEQ ID NO: 458433 - DNA, 16 bp, M. musculus
tttatttgctttacat

SEQ ID NO: 458434 - DNA, 16 bp, M. musculus
tttatttggaaaataa

SEQ ID NO: 458435 - DNA, 16 bp, M. musculus
tttatttggcttacaa

SEQ ID NO: 458436 - DNA, 16 bp, M. musculus
tttatttggcttatag

SEQ ID NO: 458437 - DNA, 16 bp, M. musculus
tttatttggtgcattt

SEQ ID NO: 458438 - DNA, 16 bp, M. musculus
tttatttgtgtttcaa

SEQ ID NO: 458439 - DNA, 16 bp, M. musculus
tttattttaaaaagca

SEQ ID NO: 458440 - DNA, 16 bp, M. musculus
tttattttaaaacaca

SEQ ID NO: 458441 - DNA, 16 bp, M. musculus
tttattttaaaagatg

SEQ ID NO: 458442 - DNA, 16 bp, M. musculus
tttattttaaaagcac

SEQ ID NO: 458443 - DNA, 16 bp, M. musculus
tttattttaaaagtca

SEQ ID NO: 458444 - DNA, 16 bp, M. musculus
tttattttaaaagtct

SEQ ID NO: 458445 - DNA, 16 bp, M. musculus
tttattttaaagtcat

SEQ ID NO: 458446 - DNA, 16 bp, M. musculus
tttattttaaggaaaa

SEQ ID NO: 458447 - DNA, 16 bp, M. musculus
tttattttacatgtgt

SEQ ID NO: 458448 - DNA, 16 bp, M. musculus
tttattttatggagct

SEQ ID NO: 458449 - DNA, 16 bp, M. musculus
tttattttatgtacat

SEQ ID NO: 458450 - DNA, 16 bp, M. musculus
tttattttatgtgcat

SEQ ID NO: 458451 - DNA, 16 bp, M. musculus
tttattttattctgaa

SEQ ID NO: 458452 - DNA, 16 bp, M. musculus
tttattttcaaaacct

SEQ ID NO: 458453 - DNA, 16 bp, M. musculus
tttattttcaaacata

SEQ ID NO: 458454 - DNA, 16 bp, M. musculus
tttattttcaaatatg

SEQ ID NO: 458455 - DNA, 16 bp, M. musculus
tttattttcaaatgtt

SEQ ID NO: 458456 - DNA, 16 bp, M. musculus
tttattttcattgcta

SEQ ID NO: 458457 - DNA, 16 bp, M. musculus
tttattttcccttaaa

SEQ ID NO: 458458 - DNA, 16 bp, M. musculus
tttattttctaaagat

SEQ ID NO: 458459 - DNA, 16 bp, M. musculus
tttattttctcaaatg

SEQ ID NO: 458460 - DNA, 16 bp, M. musculus
tttattttcttcactg

SEQ ID NO: 458461 - DNA, 16 bp, M. musculus
tttattttgagaaagg

SEQ ID NO: 458462 - DNA, 16 bp, M. musculus
tttattttgaggcagg

SEQ ID NO: 458463 - DNA, 16 bp, M. musculus
tttattttgcacaaac

SEQ ID NO: 458464 - DNA, 16 bp, M. musculus
tttattttggaaaaat

SEQ ID NO: 458465 - DNA, 16 bp, M. musculus
tttattttggcttatg

SEQ ID NO: 458466 - DNA, 16 bp, M. musculus
tttattttggcttcca

SEQ ID NO: 458467 - DNA, 16 bp, M. musculus
tttattttggcttgca

SEQ ID NO: 458468 - DNA, 16 bp, M. musculus
tttattttgtaaagaa

SEQ ID NO: 458469 - DNA, 16 bp, M. musculus
tttatttttaacttag

SEQ ID NO: 458470 - DNA, 16 bp, M. musculus
tttatttttaaggcat

SEQ ID NO: 458471 - DNA, 16 bp, M. musculus
tttatttttacagatt

SEQ ID NO: 458472 - DNA, 16 bp, M. musculus
tttatttttagaaaag

SEQ ID NO: 458473 - DNA, 16 bp, M. musculus
tttatttttatgtaca

SEQ ID NO: 458474 - DNA, 16 bp, M. musculus
tttatttttcaaaatg

SEQ ID NO: 458475 - DNA, 16 bp, M. musculus
tttatttttcaagaaa

SEQ ID NO: 458476 - DNA, 16 bp, M. musculus
tttatttttcagaaat

SEQ ID NO: 458477 - DNA, 16 bp, M. musculus
tttatttttcattgaa

SEQ ID NO: 458478 - DNA, 16 bp, M. musculus
tttatttttcccacac

SEQ ID NO: 458479 - DNA, 16 bp, M. musculus
tttatttttccttgac

SEQ ID NO: 458480 - DNA, 16 bp, M. musculus
tttatttttctatgaa

SEQ ID NO: 458481 - DNA, 16 bp, M. musculus
tttatttttctccaaa

SEQ ID NO: 458482 - DNA, 16 bp, M. musculus
tttatttttctgaaat

SEQ ID NO: 458483 - DNA, 16 bp, M. musculus
tttatttttctgtaaa

SEQ ID NO: 458484 - DNA, 16 bp, M. musculus
tttatttttcttaaag

SEQ ID NO: 458485 - DNA, 16 bp, M. musculus
tttatttttgaaatgg

SEQ ID NO: 458486 - DNA, 16 bp, M. musculus
tttatttttgagaaga

SEQ ID NO: 458487 - DNA, 16 bp, M. musculus
tttatttttgagacag

SEQ ID NO: 458488 - DNA, 16 bp, M. musculus
tttatttttgtgtgca

SEQ ID NO: 458489 - DNA, 16 bp, M. musculus
tttattttttaagtca

SEQ ID NO: 458490 - DNA, 16 bp, M. musculus
tttatttttttaacag

SEQ ID NO: 458491 - DNA, 16 bp, M. musculus
tttcaaaaaaaaaagt

SEQ ID NO: 458492 - DNA, 16 bp, M. musculus
tttcaaaaaacccaaa

SEQ ID NO: 458493 - DNA, 16 bp, M. musculus
tttcaaaaactgaaaa

SEQ ID NO: 458494 - DNA, 16 bp, M. musculus
tttcaaaaagaaattt

SEQ ID NO: 458495 - DNA, 16 bp, M. musculus
tttcaaaaagcaaaac

SEQ ID NO: 458496 - DNA, 16 bp, M. musculus
tttcaaaaataaaaga

SEQ ID NO: 458497 - DNA, 16 bp, M. musculus
tttcaaaaatactttt

SEQ ID NO: 458498 - DNA, 16 bp, M. musculus
tttcaaaacaaatgaa

SEQ ID NO: 458499 - DNA, 16 bp, M. musculus
tttcaaaacacagaag

SEQ ID NO: 458500 - DNA, 16 bp, M. musculus
tttcaaaacatatttt

SEQ ID NO: 458501 - DNA, 16 bp, M. musculus
tttcaaaactaatttt

SEQ ID NO: 458502 - DNA, 16 bp, M. musculus
tttcaaaacttacttt

SEQ ID NO: 458503 - DNA, 16 bp, M. musculus
tttcaaaagaaaaaga

SEQ ID NO: 458504 - DNA, 16 bp, M. musculus
tttcaaaagaaaacaa

SEQ ID NO: 458505 - DNA, 16 bp, M. musculus
tttcaaaagaaacaaa

SEQ ID NO: 458506 - DNA, 16 bp, M. musculus
tttcaaaagaaagaaa

SEQ ID NO: 458507 - DNA, 16 bp, M. musculus
tttcaaaagaaataaa

SEQ ID NO: 458508 - DNA, 16 bp, M. musculus
tttcaaaagaagaata

SEQ ID NO: 458509 - DNA, 16 bp, M. musculus
tttcaaaagacaaaaa

SEQ ID NO: 458510 - DNA, 16 bp, M. musculus
tttcaaaagagaaaaa

SEQ ID NO: 458511 - DNA, 16 bp, M. musculus
tttcaaaagcccatgc

SEQ ID NO: 458512 - DNA, 16 bp, M. musculus
tttcaaaagcttccag

SEQ ID NO: 458513 - DNA, 16 bp, M. musculus
tttcaaaaggaaaaga

SEQ ID NO: 458514 - DNA, 16 bp, M. musculus
tttcaaaaggaagaaa

SEQ ID NO: 458515 - DNA, 16 bp, M. musculus
tttcaaaagtaaaaaa

SEQ ID NO: 458516 - DNA, 16 bp, M. musculus
tttcaaaagtattttt

SEQ ID NO: 458517 - DNA, 16 bp, M. musculus
tttcaaaagttttttt

SEQ ID NO: 458518 - DNA, 16 bp, M. musculus
tttcaaaataaaaagt

SEQ ID NO: 458519 - DNA, 16 bp, M. musculus
tttcaaaatcaaaatt

SEQ ID NO: 458520 - DNA, 16 bp, M. musculus
tttcaaaatgaaaaca

SEQ ID NO: 458521 - DNA, 16 bp, M. musculus
tttcaaaattcaaaat

SEQ ID NO: 458522 - DNA, 16 bp, M. musculus
tttcaaacactggact

SEQ ID NO: 458523 - DNA, 16 bp, M. musculus
tttcaaagaaaaggaa

SEQ ID NO: 458524 - DNA, 16 bp, M. musculus
tttcaaagaaaccaaa

SEQ ID NO: 458525 - DNA, 16 bp, M. musculus
tttcaaagaaataatt

SEQ ID NO: 458526 - DNA, 16 bp, M. musculus
tttcaaagaacagaaa

SEQ ID NO: 458527 - DNA, 16 bp, M. musculus
tttcaaagaactaata

SEQ ID NO: 458528 - DNA, 16 bp, M. musculus
tttcaaagaatagaaa

SEQ ID NO: 458529 - DNA, 16 bp, M. musculus
tttcaaagaatatttt

SEQ ID NO: 458530 - DNA, 16 bp, M. musculus
tttcaaagacaaagaa

SEQ ID NO: 458531 - DNA, 16 bp, M. musculus
tttcaaagctcagaaa

SEQ ID NO: 458532 - DNA, 16 bp, M. musculus
tttcaaaggaaataaa

SEQ ID NO: 458533 - DNA, 16 bp, M. musculus
tttcaaaggaaatgaa

SEQ ID NO: 458534 - DNA, 16 bp, M. musculus
tttcaaaggaagaaaa

SEQ ID NO: 458535 - DNA, 16 bp, M. musculus
tttcaaaggttatccc

SEQ ID NO: 458536 - DNA, 16 bp, M. musculus
tttcaaagtctataaa

SEQ ID NO: 458537 - DNA, 16 bp, M. musculus
tttcaaagttttcttt

SEQ ID NO: 458538 - DNA, 16 bp, M. musculus
tttcaaataaggaaaa

SEQ ID NO: 458539 - DNA, 16 bp, M. musculus
tttcaaatacatattt

SEQ ID NO: 458540 - DNA, 16 bp, M. musculus
tttcaaatatattttg

SEQ ID NO: 458541 - DNA, 16 bp, M. musculus
tttcaaatatgggtgc

SEQ ID NO: 458542 - DNA, 16 bp, M. musculus
tttcaaatattttgaa

SEQ ID NO: 458543 - DNA, 16 bp, M. musculus
tttcaaatgaaaacaa

SEQ ID NO: 458544 - DNA, 16 bp, M. musculus
tttcaaatgaaatatt

SEQ ID NO: 458545 - DNA, 17 bp, M. musculus
tttcaaatgctattccg

SEQ ID NO: 458546 - DNA, 16 bp, M. musculus
tttcaaatgtattttt

SEQ ID NO: 458547 - DNA, 21 bp, M. musculus
tttcaaatgttatcccctttt

SEQ ID NO: 458548 - DNA, 16 bp, M. musculus
tttcaaatgttatttc

SEQ ID NO: 458549 - DNA, 16 bp, M. musculus
tttcaaatgtttcttt

SEQ ID NO: 458550 - DNA, 16 bp, M. musculus
tttcaaattagaaaaa

SEQ ID NO: 458551 - DNA, 16 bp, M. musculus
tttcaaattcaaaata

SEQ ID NO: 458552 - DNA, 16 bp, M. musculus
tttcaaattgttgttt

SEQ ID NO: 458553 - DNA, 16 bp, M. musculus
tttcaacaaaaggaaa

SEQ ID NO: 458554 - DNA, 16 bp, M. musculus
tttcaacaacaacaaa

SEQ ID NO: 458555 - DNA, 16 bp, M. musculus
tttcaacattttaaaa

SEQ ID NO: 458556 - DNA, 16 bp, M. musculus
tttcaaccccaaattt

SEQ ID NO: 458557 - DNA, 16 bp, M. musculus
tttcaactcttgttta

SEQ ID NO: 458558 - DNA, 16 bp, M. musculus
tttcaagacagccaag

SEQ ID NO: 458559 - DNA, 16 bp, M. musculus
tttcaagacaggatct

SEQ ID NO: 458560 - DNA, 16 bp, M. musculus
tttcaagacagggttt

SEQ ID NO: 458561 - DNA, 16 bp, M. musculus
tttcaagagaggagca

SEQ ID NO: 458562 - DNA, 16 bp, M. musculus
tttcaagcacccacat

SEQ ID NO: 458563 - DNA, 16 bp, M. musculus
tttcaaggcagggttt

SEQ ID NO: 458564 - DNA, 18 bp, M. musculus
tttcaaggccagcctggg

SEQ ID NO: 458565 - DNA, 16 bp, M. musculus
tttcaagtgcttctca

SEQ ID NO: 458566 - DNA, 16 bp, M. musculus
tttcaagttcatggcc

SEQ ID NO: 458567 - DNA, 16 bp, M. musculus
tttcaagtttttaaaa

SEQ ID NO: 458568 - DNA, 16 bp, M. musculus
tttcaataaaaagaaa

SEQ ID NO: 458569 - DNA, 16 bp, M. musculus
tttcaataaaatattg

SEQ ID NO: 458570 - DNA, 16 bp, M. musculus
tttcaataaaatcatg

SEQ ID NO: 458571 - DNA, 16 bp, M. musculus
tttcaatatttgtgta

SEQ ID NO: 458572 - DNA, 16 bp, M. musculus
tttcaatcataaaatt

SEQ ID NO: 458573 - DNA, 16 bp, M. musculus
tttcaatgaaaaataa

SEQ ID NO: 458574 - DNA, 16 bp, M. musculus
tttcaatgaaagaaaa

SEQ ID NO: 458575 - DNA, 16 bp, M. musculus
tttcaattactgtaga

SEQ ID NO: 458576 - DNA, 16 bp, M. musculus
tttcaattctttctgc

SEQ ID NO: 458577 - DNA, 16 bp, M. musculus
tttcaattttaaaaga

SEQ ID NO: 458578 - DNA, 16 bp, M. musculus
tttcaattttgtggaa

SEQ ID NO: 458579 - DNA, 16 bp, M. musculus
tttcacaaaatggaaa

SEQ ID NO: 458580 - DNA, 16 bp, M. musculus
tttcacaagccaggcc

SEQ ID NO: 458581 - DNA, 16 bp, M. musculus
tttcacacacacacaa

SEQ ID NO: 458582 - DNA, 16 bp, M. musculus
tttcacactttgtctc

SEQ ID NO: 458583 - DNA, 16 bp, M. musculus
tttcacagaaatggaa

SEQ ID NO: 458584 - DNA, 16 bp, M. musculus
tttcacagatgatgtt

SEQ ID NO: 458585 - DNA, 16 bp, M. musculus
tttcacagattttttt

SEQ ID NO: 458586 - DNA, 16 bp, M. musculus
tttcacatcatgcacc

SEQ ID NO: 458587 - DNA, 16 bp, M. musculus
tttcacatcatgtacc

SEQ ID NO: 458588 - DNA, 16 bp, M. musculus
tttcacatccaaacca

SEQ ID NO: 458589 - DNA, 16 bp, M. musculus
tttcacatggatgctg

SEQ ID NO: 458590 - DNA, 16 bp, M. musculus
tttcacatgtgccaat

SEQ ID NO: 458591 - DNA, 16 bp, M. musculus
tttcaccactgagcca

SEQ ID NO: 458592 - DNA, 16 bp, M. musculus
tttcaccatttacttt

SEQ ID NO: 458593 - DNA, 16 bp, M. musculus
tttcaccctgagtttg

SEQ ID NO: 458594 - DNA, 19 bp, M. musculus
tttcacccttgctgttact

SEQ ID NO: 458595 - DNA, 16 bp, M. musculus
tttcacctgtgcagac

SEQ ID NO: 458596 - DNA, 17 bp, M. musculus
tttcacctgtggtttgg

SEQ ID NO: 458597 - DNA, 16 bp, M. musculus
tttcactacctctggt

SEQ ID NO: 458598 - DNA, 16 bp, M. musculus
tttcactatcctggat

SEQ ID NO: 458599 - DNA, 16 bp, M. musculus
tttcactatgtagccc

SEQ ID NO: 458600 - DNA, 16 bp, M. musculus
tttcactgctgagcca

SEQ ID NO: 458601 - DNA, 16 bp, M. musculus
tttcactggtggagaa

SEQ ID NO: 458602 - DNA, 16 bp, M. musculus
tttcactgtgcagccc

SEQ ID NO: 458603 - DNA, 16 bp, M. musculus
tttcactgtgtctctt

SEQ ID NO: 458604 - DNA, 16 bp, M. musculus
tttcactgtgttccat

SEQ ID NO: 458605 - DNA, 16 bp, M. musculus
tttcacttcctcagtt

SEQ ID NO: 458606 - DNA, 16 bp, M. musculus
tttcacttgcttggtt

SEQ ID NO: 458607 - DNA, 16 bp, M. musculus
tttcacttgtttagtt

SEQ ID NO: 458608 - DNA, 16 bp, M. musculus
tttcactttgcatttt

SEQ ID NO: 458609 - DNA, 16 bp, M. musculus
tttcacttttaaaatg

SEQ ID NO: 458610 - DNA, 16 bp, M. musculus
tttcagaaaaagaaaa

SEQ ID NO: 458611 - DNA, 16 bp, M. musculus
tttcagaaaaataaaa

SEQ ID NO: 458612 - DNA, 16 bp, M. musculus
tttcagaaaacagaca

SEQ ID NO: 458613 - DNA, 16 bp, M. musculus
tttcagaaaacatctg

SEQ ID NO: 458614 - DNA, 16 bp, M. musculus
tttcagaaaatgtttt

SEQ ID NO: 458615 - DNA, 16 bp, M. musculus
tttcagaaactgttgg

SEQ ID NO: 458616 - DNA, 16 bp, M. musculus
tttcagaaataaaata

SEQ ID NO: 458617 - DNA, 16 bp, M. musculus
tttcagaaataatttt

SEQ ID NO: 458618 - DNA, 16 bp, M. musculus
tttcagaagagaaaca

SEQ ID NO: 458619 - DNA, 16 bp, M. musculus
tttcagaagatgaaaa

SEQ ID NO: 458620 - DNA, 16 bp, M. musculus
tttcagaagcaaaggg

SEQ ID NO: 458621 - DNA, 16 bp, M. musculus
tttcagaagcccaagc

SEQ ID NO: 458622 - DNA, 16 bp, M. musculus
tttcagaattttaaaa

SEQ ID NO: 458623 - DNA, 16 bp, M. musculus
tttcagacaaaaaaaa

SEQ ID NO: 458624 - DNA, 16 bp, M. musculus
tttcagacaggagtct

SEQ ID NO: 458625 - DNA, 16 bp, M. musculus
tttcagacagggtctc

SEQ ID NO: 458626 - DNA, 16 bp, M. musculus
tttcagaccaaaggag

SEQ ID NO: 458627 - DNA, 16 bp, M. musculus
tttcagaccagaagga

SEQ ID NO: 458628 - DNA, 16 bp, M. musculus
tttcagactttcatct

SEQ ID NO: 458629 - DNA, 16 bp, M. musculus
tttcagagaaaaatat

SEQ ID NO: 458630 - DNA, 16 bp, M. musculus
tttcagagaaagaaaa

SEQ ID NO: 458631 - DNA, 16 bp, M. musculus
tttcagagagagaaag

SEQ ID NO: 458632 - DNA, 16 bp, M. musculus
tttcagagaggaaact

SEQ ID NO: 458633 - DNA, 16 bp, M. musculus
tttcagaggaaaaaaa

SEQ ID NO: 458634 - DNA, 16 bp, M. musculus
tttcagaggagaagaa

SEQ ID NO: 458635 - DNA, 16 bp, M. musculus
tttcagagggctagtc

SEQ ID NO: 458636 - DNA, 16 bp, M. musculus
tttcagagtggttgta

SEQ ID NO: 458637 - DNA, 16 bp, M. musculus
tttcagatatttattt

SEQ ID NO: 458638 - DNA, 16 bp, M. musculus
tttcagatattttaaa

SEQ ID NO: 458639 - DNA, 16 bp, M. musculus
tttcagatgaatttga

SEQ ID NO: 458640 - DNA, 16 bp, M. musculus
tttcagatgccaacaa

SEQ ID NO: 458641 - DNA, 16 bp, M. musculus
tttcagatggcattca

SEQ ID NO: 458642 - DNA, 16 bp, M. musculus
tttcagatttcaaaag

SEQ ID NO: 458643 - DNA, 16 bp, M. musculus
tttcagcaaaatggta

SEQ ID NO: 458644 - DNA, 16 bp, M. musculus
tttcagcaagatgacc

SEQ ID NO: 458645 - DNA, 16 bp, M. musculus
tttcagcaagatggct

SEQ ID NO: 458646 - DNA, 16 bp, M. musculus
tttcagcaagcagaca

SEQ ID NO: 458647 - DNA, 16 bp, M. musculus
tttcagcactcaggaa

SEQ ID NO: 458648 - DNA, 16 bp, M. musculus
tttcagcagcagcagc

SEQ ID NO: 458649 - DNA, 16 bp, M. musculus
tttcagccagtttctc

SEQ ID NO: 458650 - DNA, 19 bp, M. musculus
tttcagcccactctccctg

SEQ ID NO: 458651 - DNA, 19 bp, M. musculus
tttcagccccagcctgcct

SEQ ID NO: 458652 - DNA, 16 bp, M. musculus
tttcagccttccccaa

SEQ ID NO: 458653 - DNA, 16 bp, M. musculus
tttcagctaatgtcat

SEQ ID NO: 458654 - DNA, 16 bp, M. musculus
tttcagctctgagttt

SEQ ID NO: 458655 - DNA, 16 bp, M. musculus
tttcagctctgtgttt

SEQ ID NO: 458656 - DNA, 16 bp, M. musculus
tttcagctgcttgttg

SEQ ID NO: 458657 - DNA, 16 bp, M. musculus
tttcagctttttaaaa

SEQ ID NO: 458658 - DNA, 16 bp, M. musculus
tttcaggaagttcctg

SEQ ID NO: 458659 - DNA, 16 bp, M. musculus
tttcaggacagccaga

SEQ ID NO: 458660 - DNA, 16 bp, M. musculus
tttcaggactgccagg

SEQ ID NO: 458661 - DNA, 16 bp, M. musculus
tttcaggagttggttt

SEQ ID NO: 458662 - DNA, 16 bp, M. musculus
tttcaggatagcattt

SEQ ID NO: 458663 - DNA, 16 bp, M. musculus
tttcaggatatcattt

SEQ ID NO: 458664 - DNA, 16 bp, M. musculus
tttcaggccaccctgg

SEQ ID NO: 458665 - DNA, 16 bp, M. musculus
tttcaggccagccagg

SEQ ID NO: 458666 - DNA, 16 bp, M. musculus
tttcaggccatcctgg

SEQ ID NO: 458667 - DNA, 16 bp, M. musculus
tttcagggacttcctg

SEQ ID NO: 458668 - DNA, 16 bp, M. musculus
tttcagggaggtgcac

SEQ ID NO: 458669 - DNA, 16 bp, M. musculus
tttcagggccattgat

SEQ ID NO: 458670 - DNA, 16 bp, M. musculus
tttcagggcttctgtg

SEQ ID NO: 458671 - DNA, 16 bp, M. musculus
tttcaggggaaaaaaa

SEQ ID NO: 458672 - DNA, 16 bp, M. musculus
tttcaggggaacccag

SEQ ID NO: 458673 - DNA, 16 bp, M. musculus
tttcagggtcttcaat

SEQ ID NO: 458674 - DNA, 16 bp, M. musculus
tttcagggtcttttga

SEQ ID NO: 458675 - DNA, 16 bp, M. musculus
tttcaggtgcttgttg

SEQ ID NO: 458676 - DNA, 16 bp, M. musculus
tttcaggtgtgatcat

SEQ ID NO: 458677 - DNA, 16 bp, M. musculus
tttcaggttccatatc

SEQ ID NO: 458678 - DNA, 16 bp, M. musculus
tttcaggtttcagtta

SEQ ID NO: 458679 - DNA, 16 bp, M. musculus
tttcagtatttaaaaa

SEQ ID NO: 458680 - DNA, 16 bp, M. musculus
tttcagtccatggtca

SEQ ID NO: 458681 - DNA, 16 bp, M. musculus
tttcagtctgttttct

SEQ ID NO: 458682 - DNA, 16 bp, M. musculus
tttcagtgcaggagtg

SEQ ID NO: 458683 - DNA, 16 bp, M. musculus
tttcagtgcccatgat

SEQ ID NO: 458684 - DNA, 16 bp, M. musculus
tttcagtgctgggaat

SEQ ID NO: 458685 - DNA, 16 bp, M. musculus
tttcagtgtctctggc

SEQ ID NO: 458686 - DNA, 16 bp, M. musculus
tttcagtgtctctgtt

SEQ ID NO: 458687 - DNA, 16 bp, M. musculus
tttcagtgtctggttt

SEQ ID NO: 458688 - DNA, 16 bp, M. musculus
tttcagtgtgtgtatg

SEQ ID NO: 458689 - DNA, 16 bp, M. musculus
tttcagtgttagagag

SEQ ID NO: 458690 - DNA, 16 bp, M. musculus
tttcagtgttcagaat

SEQ ID NO: 458691 - DNA, 16 bp, M. musculus
tttcagttaaaaaaaa

SEQ ID NO: 458692 - DNA, 16 bp, M. musculus
tttcagttggatctca

SEQ ID NO: 458693 - DNA, 16 bp, M. musculus
tttcagtttctgtgaa

SEQ ID NO: 458694 - DNA, 16 bp, M. musculus
tttcagtttctttata

SEQ ID NO: 458695 - DNA, 16 bp, M. musculus
tttcagttttaaaatg

SEQ ID NO: 458696 - DNA, 16 bp, M. musculus
tttcagtttttaaata

SEQ ID NO: 458697 - DNA, 16 bp, M. musculus
tttcagtttttcaaaa

SEQ ID NO: 458698 - DNA, 16 bp, M. musculus
tttcataaaacatttt

SEQ ID NO: 458699 - DNA, 16 bp, M. musculus
tttcataaagaaattg

SEQ ID NO: 458700 - DNA, 16 bp, M. musculus
tttcataaatggacag

SEQ ID NO: 458701 - DNA, 18 bp, M. musculus
tttcataactgtaatttt

SEQ ID NO: 458702 - DNA, 16 bp, M. musculus
tttcataacttatgtt

SEQ ID NO: 458703 - DNA, 16 bp, M. musculus
tttcatacaatatatt

SEQ ID NO: 458704 - DNA, 16 bp, M. musculus
tttcatacatgtacat

SEQ ID NO: 458705 - DNA, 16 bp, M. musculus
tttcatagtaccagaa

SEQ ID NO: 458706 - DNA, 16 bp, M. musculus
tttcatagtctctatt

SEQ ID NO: 458707 - DNA, 16 bp, M. musculus
tttcatagttttaaaa

SEQ ID NO: 458708 - DNA, 16 bp, M. musculus
tttcatatgtgtatgt

SEQ ID NO: 458709 - DNA, 16 bp, M. musculus
tttcatatgttttgtg

SEQ ID NO: 458710 - DNA, 16 bp, M. musculus
tttcatattatttatg

SEQ ID NO: 458711 - DNA, 16 bp, M. musculus
tttcatattgacttcc

SEQ ID NO: 458712 - DNA, 16 bp, M. musculus
tttcatattttaatgt

SEQ ID NO: 458713 - DNA, 16 bp, M. musculus
tttcatcacagcagca

SEQ ID NO: 458714 - DNA, 16 bp, M. musculus
tttcatccaggaacat

SEQ ID NO: 458715 - DNA, 16 bp, M. musculus
tttcatccccagctct

SEQ ID NO: 458716 - DNA, 16 bp, M. musculus
tttcatctcaaagaaa

SEQ ID NO: 458717 - DNA, 16 bp, M. musculus
tttcatctctgttgct

SEQ ID NO: 458718 - DNA, 16 bp, M. musculus
tttcatctcttctgtt

SEQ ID NO: 458719 - DNA, 16 bp, M. musculus
tttcatcttacacctg

SEQ ID NO: 458720 - DNA, 16 bp, M. musculus
tttcatcttctgaaat

SEQ ID NO: 458721 - DNA, 16 bp, M. musculus
tttcatctttcttgac

SEQ ID NO: 458722 - DNA, 16 bp, M. musculus
tttcatcttttgaaaa

SEQ ID NO: 458723 - DNA, 18 bp, M. musculus
tttcatgaccttcccaaa

SEQ ID NO: 458724 - DNA, 18 bp, M. musculus
tttcatgaggtcccattt

SEQ ID NO: 458725 - DNA, 16 bp, M. musculus
tttcatgatgatgata

SEQ ID NO: 458726 - DNA, 16 bp, M. musculus
tttcatgatgatgatg

SEQ ID NO: 458727 - DNA, 16 bp, M. musculus
tttcatgctttcattt

SEQ ID NO: 458728 - DNA, 16 bp, M. musculus
tttcatgtagcccagg

SEQ ID NO: 458729 - DNA, 16 bp, M. musculus
tttcatgtatgtgggt

SEQ ID NO: 458730 - DNA, 16 bp, M. musculus
tttcatgtattcattt

SEQ ID NO: 458731 - DNA, 16 bp, M. musculus
tttcatgtcttgaaca

SEQ ID NO: 458732 - DNA, 16 bp, M. musculus
tttcatgtgcttgctt

SEQ ID NO: 458733 - DNA, 16 bp, M. musculus
tttcatgtgtgtgagt

SEQ ID NO: 458734 - DNA, 16 bp, M. musculus
tttcatgtgtttacca

SEQ ID NO: 458735 - DNA, 16 bp, M. musculus
tttcatgttacaaagt

SEQ ID NO: 458736 - DNA, 16 bp, M. musculus
tttcatgtttcctttg

SEQ ID NO: 458737 - DNA, 16 bp, M. musculus
tttcatgttttattaa

SEQ ID NO: 458738 - DNA, 16 bp, M. musculus
tttcattaaaatttca

SEQ ID NO: 458739 - DNA, 16 bp, M. musculus
tttcattaaattctca

SEQ ID NO: 458740 - DNA, 16 bp, M. musculus
tttcattaatggacag

SEQ ID NO: 458741 - DNA, 16 bp, M. musculus
tttcattattccagat

SEQ ID NO: 458742 - DNA, 16 bp, M. musculus
tttcattattttgaaa

SEQ ID NO: 458743 - DNA, 16 bp, M. musculus
tttcattcctacttca

SEQ ID NO: 458744 - DNA, 16 bp, M. musculus
tttcattcctgatttt

SEQ ID NO: 458745 - DNA, 16 bp, M. musculus
tttcattcttctatgt

SEQ ID NO: 458746 - DNA, 16 bp, M. musculus
tttcattgaaaataaa

SEQ ID NO: 458747 - DNA, 16 bp, M. musculus
tttcattgagaagagt

SEQ ID NO: 458748 - DNA, 16 bp, M. musculus
tttcattgctgtgaag

SEQ ID NO: 458749 - DNA, 16 bp, M. musculus
tttcattgttttcaaa

SEQ ID NO: 458750 - DNA, 16 bp, M. musculus
tttcatttaaaacatt

SEQ ID NO: 458751 - DNA, 16 bp, M. musculus
tttcatttaaagaaaa

SEQ ID NO: 458752 - DNA, 16 bp, M. musculus
tttcatttaaagcatt

SEQ ID NO: 458753 - DNA, 16 bp, M. musculus
tttcatttaattctag

SEQ ID NO: 458754 - DNA, 16 bp, M. musculus
tttcatttagcataat

SEQ ID NO: 458755 - DNA, 16 bp, M. musculus
tttcatttatatgtat

SEQ ID NO: 458756 - DNA, 16 bp, M. musculus
tttcatttcagatttt

SEQ ID NO: 458757 - DNA, 16 bp, M. musculus
tttcatttcctttgaa

SEQ ID NO: 458758 - DNA, 16 bp, M. musculus
tttcatttctacttca

SEQ ID NO: 458759 - DNA, 16 bp, M. musculus
tttcatttctgaattt

SEQ ID NO: 458760 - DNA, 16 bp, M. musculus
tttcatttctgggtct

SEQ ID NO: 458761 - DNA, 16 bp, M. musculus
tttcatttctgttcct

SEQ ID NO: 458762 - DNA, 16 bp, M. musculus
tttcatttcttcttga

SEQ ID NO: 458763 - DNA, 16 bp, M. musculus
tttcatttgcattttc

SEQ ID NO: 458764 - DNA, 16 bp, M. musculus
tttcatttggctgttt

SEQ ID NO: 458765 - DNA, 16 bp, M. musculus
tttcatttggttggtt

SEQ ID NO: 458766 - DNA, 16 bp, M. musculus
tttcatttgtaattaa

SEQ ID NO: 458767 - DNA, 16 bp, M. musculus
tttcatttgttcattc

SEQ ID NO: 458768 - DNA, 16 bp, M. musculus
tttcattttaaaaaca

SEQ ID NO: 458769 - DNA, 16 bp, M. musculus
tttcattttaaaacta

SEQ ID NO: 458770 - DNA, 16 bp, M. musculus
tttcattttaaaagaa

SEQ ID NO: 458771 - DNA, 16 bp, M. musculus
tttcattttaaaatga

SEQ ID NO: 458772 - DNA, 16 bp, M. musculus
tttcattttagaaatg

SEQ ID NO: 458773 - DNA, 16 bp, M. musculus
tttcattttaggaaag

SEQ ID NO: 458774 - DNA, 16 bp, M. musculus
tttcattttcagcctc

SEQ ID NO: 458775 - DNA, 16 bp, M. musculus
tttcattttctttgca

SEQ ID NO: 458776 - DNA, 16 bp, M. musculus
tttcattttgaaattt

SEQ ID NO: 458777 - DNA, 16 bp, M. musculus
tttcattttgctttaa

SEQ ID NO: 458778 - DNA, 16 bp, M. musculus
tttcattttggtgcat

SEQ ID NO: 458779 - DNA, 16 bp, M. musculus
tttcattttgtcctgg

SEQ ID NO: 458780 - DNA, 16 bp, M. musculus
tttcattttgtctcat

SEQ ID NO: 458781 - DNA, 16 bp, M. musculus
tttcattttgttgaga

SEQ ID NO: 458782 - DNA, 16 bp, M. musculus
tttcatttttaaagat

SEQ ID NO: 458783 - DNA, 16 bp, M. musculus
tttcatttttaaagtt

SEQ ID NO: 458784 - DNA, 16 bp, M. musculus
tttcatttttaacatc

SEQ ID NO: 458785 - DNA, 16 bp, M. musculus
tttcatttttagaaaa

SEQ ID NO: 458786 - DNA, 16 bp, M. musculus
tttcatttttagaaat

SEQ ID NO: 458787 - DNA, 16 bp, M. musculus
tttcatttttgaaaaa

SEQ ID NO: 458788 - DNA, 16 bp, M. musculus
tttcatttttgagaaa

SEQ ID NO: 458789 - DNA, 16 bp, M. musculus
tttccaaaatactttc

SEQ ID NO: 458790 - DNA, 16 bp, M. musculus
tttccaaacaaaacaa

SEQ ID NO: 458791 - DNA, 16 bp, M. musculus
tttccaaacagttcca

SEQ ID NO: 458792 - DNA, 16 bp, M. musculus
tttccaaagaaactag

SEQ ID NO: 458793 - DNA, 16 bp, M. musculus
tttccaaaggacctga

SEQ ID NO: 458794 - DNA, 16 bp, M. musculus
tttccaaaggacctgg

SEQ ID NO: 458795 - DNA, 16 bp, M. musculus
tttccaaaggggaaac

SEQ ID NO: 458796 - DNA, 16 bp, M. musculus
tttccaaattcaaagt

SEQ ID NO: 458797 - DNA, 16 bp, M. musculus
tttccaaattctttct

SEQ ID NO: 458798 - DNA, 16 bp, M. musculus
tttccaaattttaaaa

SEQ ID NO: 458799 - DNA, 16 bp, M. musculus
tttccaacatcacttg

SEQ ID NO: 458800 - DNA, 16 bp, M. musculus
tttccaacatgaaaca

SEQ ID NO: 458801 - DNA, 16 bp, M. musculus
tttccaacatgtgttg

SEQ ID NO: 458802 - DNA, 16 bp, M. musculus
tttccaagaaaaaaat

SEQ ID NO: 458803 - DNA, 16 bp, M. musculus
tttccaagaagctctg

SEQ ID NO: 458804 - DNA, 16 bp, M. musculus
tttccaagaggatgtc

SEQ ID NO: 458805 - DNA, 16 bp, M. musculus
tttccaagatgccttt

SEQ ID NO: 458806 - DNA, 16 bp, M. musculus
tttccaagcaaatggc

SEQ ID NO: 458807 - DNA, 16 bp, M. musculus
tttccaagcaaatgtt

SEQ ID NO: 458808 - DNA, 16 bp, M. musculus
tttccaagcagaacaa

SEQ ID NO: 458809 - DNA, 16 bp, M. musculus
tttccaagcagatggt

SEQ ID NO: 458810 - DNA, 16 bp, M. musculus
tttccaagctgactga

SEQ ID NO: 458811 - DNA, 16 bp, M. musculus
tttccaagttgttttt

SEQ ID NO: 458812 - DNA, 16 bp, M. musculus
tttccaatgctaaccc

SEQ ID NO: 458813 - DNA, 16 bp, M. musculus
tttccaatggtctcag

SEQ ID NO: 458814 - DNA, 29 bp, M. musculus
tttccacagctgcagaggggactttgcct

SEQ ID NO: 458815 - DNA, 16 bp, M. musculus
tttccacatcactgtt

SEQ ID NO: 458816 - DNA, 16 bp, M. musculus
tttccacatttaaaaa

SEQ ID NO: 458817 - DNA, 16 bp, M. musculus
tttccaccatgacaat

SEQ ID NO: 458818 - DNA, 16 bp, M. musculus
tttccacccaaaattt

SEQ ID NO: 458819 - DNA, 16 bp, M. musculus
tttccacccttgctgt

SEQ ID NO: 458820 - DNA, 16 bp, M. musculus
tttccactttctttga

SEQ ID NO: 458821 - DNA, 16 bp, M. musculus
tttccagaacccacat

SEQ ID NO: 458822 - DNA, 16 bp, M. musculus
tttccagaagccatca

SEQ ID NO: 458823 - DNA, 16 bp, M. musculus
tttccagaagggaaac

SEQ ID NO: 458824 - DNA, 16 bp, M. musculus
tttccagacttttatt

SEQ ID NO: 458825 - DNA, 16 bp, M. musculus
tttccagagccatggg

SEQ ID NO: 458826 - DNA, 16 bp, M. musculus
tttccagaggttctga

SEQ ID NO: 458827 - DNA, 16 bp, M. musculus
tttccagataaatttg

SEQ ID NO: 458828 - DNA, 16 bp, M. musculus
tttccagataactcta

SEQ ID NO: 458829 - DNA, 16 bp, M. musculus
tttccagatttctttc

SEQ ID NO: 458830 - DNA, 16 bp, M. musculus
tttccagcaaccacag

SEQ ID NO: 458831 - DNA, 16 bp, M. musculus
tttccagcaccatgcc

SEQ ID NO: 458832 - DNA, 16 bp, M. musculus
tttccagcacccacat

SEQ ID NO: 458833 - DNA, 16 bp, M. musculus
tttccagcatccacac

SEQ ID NO: 458834 - DNA, 16 bp, M. musculus
tttccagcccttcatt

SEQ ID NO: 458835 - DNA, 16 bp, M. musculus
tttccagcctctgaga

SEQ ID NO: 458836 - DNA, 16 bp, M. musculus
tttccagccttccttt

SEQ ID NO: 458837 - DNA, 16 bp, M. musculus
tttccagcttttggct

SEQ ID NO: 458838 - DNA, 16 bp, M. musculus
tttccaggccagccag

SEQ ID NO: 458839 - DNA, 16 bp, M. musculus
tttccagggatccatc

SEQ ID NO: 458840 - DNA, 16 bp, M. musculus
tttccagggtggggat

SEQ ID NO: 458841 - DNA, 16 bp, M. musculus
tttccaggtcagccag

SEQ ID NO: 458842 - DNA, 16 bp, M. musculus
tttccaggtctcccct

SEQ ID NO: 458843 - DNA, 16 bp, M. musculus
tttccaggtgaatttg

SEQ ID NO: 458844 - DNA, 16 bp, M. musculus
tttccagtaccaggaa

SEQ ID NO: 458845 - DNA, 16 bp, M. musculus
tttccagtacccacat

SEQ ID NO: 458846 - DNA, 16 bp, M. musculus
tttccagtatgtattt

SEQ ID NO: 458847 - DNA, 16 bp, M. musculus
tttccagtctgttggt

SEQ ID NO: 458848 - DNA, 16 bp, M. musculus
tttccagtgtgttggg

SEQ ID NO: 458849 - DNA, 16 bp, M. musculus
tttccagtgtttctgt

SEQ ID NO: 458850 - DNA, 16 bp, M. musculus
tttccagttctaagaa

SEQ ID NO: 458851 - DNA, 16 bp, M. musculus
tttccagtttggacaa

SEQ ID NO: 458852 - DNA, 16 bp, M. musculus
tttccagtttttaaaa

SEQ ID NO: 458853 - DNA, 16 bp, M. musculus
tttccatactgctgtt

SEQ ID NO: 458854 - DNA, 16 bp, M. musculus
tttccatatcactgtt

SEQ ID NO: 458855 - DNA, 16 bp, M. musculus
tttccatatgaaattg

SEQ ID NO: 458856 - DNA, 16 bp, M. musculus
tttccatcacccacat

SEQ ID NO: 458857 - DNA, 16 bp, M. musculus
tttccatcacctcttt

SEQ ID NO: 458858 - DNA, 16 bp, M. musculus
tttccatccttgtact

SEQ ID NO: 458859 - DNA, 16 bp, M. musculus
tttccatgctcatgga

SEQ ID NO: 458860 - DNA, 16 bp, M. musculus
tttccatggggtcaaa

SEQ ID NO: 458861 - DNA, 16 bp, M. musculus
tttccatgtctgtaaa

SEQ ID NO: 458862 - DNA, 16 bp, M. musculus
tttccatgtgaaagtt

SEQ ID NO: 458863 - DNA, 16 bp, M. musculus
tttccatgtgaatatt

SEQ ID NO: 458864 - DNA, 16 bp, M. musculus
tttccatgttctttct

SEQ ID NO: 458865 - DNA, 16 bp, M. musculus
tttccattaaaaataa

SEQ ID NO: 458866 - DNA, 16 bp, M. musculus
tttccattcactctcc

SEQ ID NO: 458867 - DNA, 16 bp, M. musculus
tttccattcttgtatt

SEQ ID NO: 458868 - DNA, 16 bp, M. musculus
tttccattctttctgc

SEQ ID NO: 458869 - DNA, 16 bp, M. musculus
tttccattgctgtaaa

SEQ ID NO: 458870 - DNA, 16 bp, M. musculus
tttccattgctgtgaa

SEQ ID NO: 458871 - DNA, 16 bp, M. musculus
tttccattggctgttg

SEQ ID NO: 458872 - DNA, 16 bp, M. musculus
tttccattgttgtgat

SEQ ID NO: 458873 - DNA, 16 bp, M. musculus
tttccatttcctggct

SEQ ID NO: 458874 - DNA, 16 bp, M. musculus
tttccattttacaaat

SEQ ID NO: 458875 - DNA, 16 bp, M. musculus
tttccattttgtttga

SEQ ID NO: 458876 - DNA, 16 bp, M. musculus
tttcccaaggcctggg

SEQ ID NO: 458877 - DNA, 16 bp, M. musculus
tttcccaagtgctggg

SEQ ID NO: 458878 - DNA, 16 bp, M. musculus
tttcccaagttgcttt

SEQ ID NO: 458879 - DNA, 16 bp, M. musculus
tttcccaataaacctg

SEQ ID NO: 458880 - DNA, 16 bp, M. musculus
tttcccaatctgtaag

SEQ ID NO: 458881 - DNA, 16 bp, M. musculus
tttcccaccctttatc

SEQ ID NO: 458882 - DNA, 16 bp, M. musculus
tttcccactctgtagg

SEQ ID NO: 458883 - DNA, 16 bp, M. musculus
tttcccactgaggcca

SEQ ID NO: 458884 - DNA, 16 bp, M. musculus
tttcccagaatcccct

SEQ ID NO: 458885 - DNA, 16 bp, M. musculus
tttcccagagttccta

SEQ ID NO: 458886 - DNA, 16 bp, M. musculus
tttcccagcatgccct

SEQ ID NO: 458887 - DNA, 16 bp, M. musculus
tttcccagcatgctct

SEQ ID NO: 458888 - DNA, 16 bp, M. musculus
tttcccagcatgcttt

SEQ ID NO: 458889 - DNA, 16 bp, M. musculus
tttcccagcttccctt

SEQ ID NO: 458890 - DNA, 16 bp, M. musculus
tttcccaggtgattct

SEQ ID NO: 458891 - DNA, 16 bp, M. musculus
tttcccagtaaaaaga

SEQ ID NO: 458892 - DNA, 16 bp, M. musculus
tttcccatccaaaacc

SEQ ID NO: 458893 - DNA, 16 bp, M. musculus
tttcccattctgtggg

SEQ ID NO: 458894 - DNA, 16 bp, M. musculus
tttccccaaagtcaca

SEQ ID NO: 458895 - DNA, 16 bp, M. musculus
tttccccaggcctggg

SEQ ID NO: 458896 - DNA, 16 bp, M. musculus
tttccccagtgcccat

SEQ ID NO: 458897 - DNA, 16 bp, M. musculus
tttccccattctgtag

SEQ ID NO: 458898 - DNA, 16 bp, M. musculus
tttcccccaaagaaat

SEQ ID NO: 458899 - DNA, 16 bp, M. musculus
tttcccccactgcttc

SEQ ID NO: 458900 - DNA, 17 bp, M. musculus
tttccccctgtgcccat

SEQ ID NO: 458901 - DNA, 16 bp, M. musculus
tttcccccttccatgt

SEQ ID NO: 458902 - DNA, 16 bp, M. musculus
tttcccctcagaaaag

SEQ ID NO: 458903 - DNA, 16 bp, M. musculus
tttcccctggatggtt

SEQ ID NO: 458904 - DNA, 16 bp, M. musculus
tttccccttcagaaac

SEQ ID NO: 458905 - DNA, 16 bp, M. musculus
tttcccgcagtctcag

SEQ ID NO: 458906 - DNA, 16 bp, M. musculus
tttccctagagcatgg

SEQ ID NO: 458907 - DNA, 16 bp, M. musculus
tttccctccacaagcc

SEQ ID NO: 458908 - DNA, 16 bp, M. musculus
tttccctcctactggg

SEQ ID NO: 458909 - DNA, 16 bp, M. musculus
tttccctcctttcaga

SEQ ID NO: 458910 - DNA, 16 bp, M. musculus
tttccctctgaaacct

SEQ ID NO: 458911 - DNA, 16 bp, M. musculus
tttccctcttagaaat

SEQ ID NO: 458912 - DNA, 16 bp, M. musculus
tttccctgaactggga

SEQ ID NO: 458913 - DNA, 16 bp, M. musculus
tttccctgacatgggt

SEQ ID NO: 458914 - DNA, 16 bp, M. musculus
tttccctgactgcttt

SEQ ID NO: 458915 - DNA, 16 bp, M. musculus
tttccctgataatttt

SEQ ID NO: 458916 - DNA, 16 bp, M. musculus
tttccctgcctctact

SEQ ID NO: 458917 - DNA, 16 bp, M. musculus
tttccctgcctgccac

SEQ ID NO: 458918 - DNA, 16 bp, M. musculus
tttccctggtgctggg

SEQ ID NO: 458919 - DNA, 16 bp, M. musculus
tttccctggttcctgt

SEQ ID NO: 458920 - DNA, 16 bp, M. musculus
tttccctgtacaaagc

SEQ ID NO: 458921 - DNA, 16 bp, M. musculus
tttccctgtccaatca

SEQ ID NO: 458922 - DNA, 16 bp, M. musculus
tttccctgtgccctct

SEQ ID NO: 458923 - DNA, 16 bp, M. musculus
tttcccttatgaatat

SEQ ID NO: 458924 - DNA, 16 bp, M. musculus
tttcccttccaaaaat

SEQ ID NO: 458925 - DNA, 16 bp, M. musculus
tttcccttctataact

SEQ ID NO: 458926 - DNA, 16 bp, M. musculus
tttcccttctgaatat

SEQ ID NO: 458927 - DNA, 16 bp, M. musculus
tttcccttgctgtcct

SEQ ID NO: 458928 - DNA, 17 bp, M. musculus
tttcccttgctgtcctt

SEQ ID NO: 458929 - DNA, 16 bp, M. musculus
tttccctttgagtttg

SEQ ID NO: 458930 - DNA, 16 bp, M. musculus
tttccctttgtgattt

SEQ ID NO: 458931 - DNA, 20 bp, M. musculus
tttccgctgccccatccctc

SEQ ID NO: 458932 - DNA, 16 bp, M. musculus
tttcctaacctaaaga

SEQ ID NO: 458933 - DNA, 16 bp, M. musculus
tttcctacatgtatat

SEQ ID NO: 458934 - DNA, 16 bp, M. musculus
tttcctaccatctact

SEQ ID NO: 458935 - DNA, 16 bp, M. musculus
tttcctaggccttgct

SEQ ID NO: 458936 - DNA, 16 bp, M. musculus
tttcctaggctttcta

SEQ ID NO: 458937 - DNA, 16 bp, M. musculus
tttcctatcacaaagc

SEQ ID NO: 458938 - DNA, 16 bp, M. musculus
tttcctatgtgtgtgt

SEQ ID NO: 458939 - DNA, 16 bp, M. musculus
tttcctattaaccttt

SEQ ID NO: 458940 - DNA, 16 bp, M. musculus
tttcctcaaaaaaaaa

SEQ ID NO: 458941 - DNA, 16 bp, M. musculus
tttcctcaagggagga

SEQ ID NO: 458942 - DNA, 16 bp, M. musculus
tttcctcacctgtaaa

SEQ ID NO: 458943 - DNA, 16 bp, M. musculus
tttcctcactttgggt

SEQ ID NO: 458944 - DNA, 16 bp, M. musculus
tttcctcagactcttc

SEQ ID NO: 458945 - DNA, 16 bp, M. musculus
tttcctcagagaaagg

SEQ ID NO: 458946 - DNA, 16 bp, M. musculus
tttcctcagaggagct

SEQ ID NO: 458947 - DNA, 16 bp, M. musculus
tttcctcaggcccctc

SEQ ID NO: 458948 - DNA, 16 bp, M. musculus
tttcctcaggcttttc

SEQ ID NO: 458949 - DNA, 16 bp, M. musculus
tttcctcagtgatgga

SEQ ID NO: 458950 - DNA, 16 bp, M. musculus
tttcctcatctgcaaa

SEQ ID NO: 458951 - DNA, 16 bp, M. musculus
tttcctcatgagaaag

SEQ ID NO: 458952 - DNA, 16 bp, M. musculus
tttcctccccagcttg

SEQ ID NO: 458953 - DNA, 16 bp, M. musculus
tttcctccccatcttg

SEQ ID NO: 458954 - DNA, 16 bp, M. musculus
tttcctcctcaactgc

SEQ ID NO: 458955 - DNA, 16 bp, M. musculus
tttcctcctctgactt

SEQ ID NO: 458956 - DNA, 16 bp, M. musculus
tttcctcctctgatct

SEQ ID NO: 458957 - DNA, 16 bp, M. musculus
tttcctccttgtgttg

SEQ ID NO: 458958 - DNA, 16 bp, M. musculus
tttcctccttttaaat

SEQ ID NO: 458959 - DNA, 16 bp, M. musculus
tttcctctaatatctt

SEQ ID NO: 458960 - DNA, 16 bp, M. musculus
tttcctctataaattt

SEQ ID NO: 458961 - DNA, 16 bp, M. musculus
tttcctctcattgatg

SEQ ID NO: 458962 - DNA, 16 bp, M. musculus
tttcctctccatgttg

SEQ ID NO: 458963 - DNA, 16 bp, M. musculus
tttcctctctgctctg

SEQ ID NO: 458964 - DNA, 16 bp, M. musculus
tttcctctgacctcca

SEQ ID NO: 458965 - DNA, 16 bp, M. musculus
tttcctctgccttctg

SEQ ID NO: 458966 - DNA, 16 bp, M. musculus
tttcctctgtctccca

SEQ ID NO: 458967 - DNA, 16 bp, M. musculus
tttcctcttaaaaatg

SEQ ID NO: 458968 - DNA, 16 bp, M. musculus
tttcctcttactgctt

SEQ ID NO: 458969 - DNA, 16 bp, M. musculus
tttcctcttagctctg

SEQ ID NO: 458970 - DNA, 16 bp, M. musculus
tttcctcttataaatg

SEQ ID NO: 458971 - DNA, 16 bp, M. musculus
tttcctcttcaacttg

SEQ ID NO: 458972 - DNA, 16 bp, M. musculus
tttcctcttcttgcta

SEQ ID NO: 458973 - DNA, 16 bp, M. musculus
tttcctcttgaaggaa

SEQ ID NO: 458974 - DNA, 16 bp, M. musculus
tttcctctttaaagaa

SEQ ID NO: 458975 - DNA, 16 bp, M. musculus
tttcctctttaaaggc

SEQ ID NO: 458976 - DNA, 16 bp, M. musculus
tttcctgaaagtgttt

SEQ ID NO: 458977 - DNA, 16 bp, M. musculus
tttcctgaagcagaca

SEQ ID NO: 458978 - DNA, 16 bp, M. musculus
tttcctgaagggaaat

SEQ ID NO: 458979 - DNA, 16 bp, M. musculus
tttcctgaatgcagca

SEQ ID NO: 458980 - DNA, 16 bp, M. musculus
tttcctgagacagagt

SEQ ID NO: 458981 - DNA, 16 bp, M. musculus
tttcctgagccctgag

SEQ ID NO: 458982 - DNA, 16 bp, M. musculus
tttcctgatctctttc

SEQ ID NO: 458983 - DNA, 16 bp, M. musculus
tttcctgcctgcctgc

SEQ ID NO: 458984 - DNA, 16 bp, M. musculus
tttcctgctgcctgcc

SEQ ID NO: 458985 - DNA, 16 bp, M. musculus
tttcctgctgcctgct

SEQ ID NO: 458986 - DNA, 16 bp, M. musculus
tttcctgctgtttact

SEQ ID NO: 458987 - DNA, 16 bp, M. musculus
tttcctgctttctatt

SEQ ID NO: 458988 - DNA, 16 bp, M. musculus
tttcctggcctgctga

SEQ ID NO: 458989 - DNA, 16 bp, M. musculus
tttcctggggagaagg

SEQ ID NO: 458990 - DNA, 16 bp, M. musculus
tttcctggtgtctggg

SEQ ID NO: 458991 - DNA, 16 bp, M. musculus
tttcctggtttctgct

SEQ ID NO: 458992 - DNA, 19 bp, M. musculus
tttcctgtaactctctaag

SEQ ID NO: 458993 - DNA, 16 bp, M. musculus
tttcctgtaatttttc

SEQ ID NO: 458994 - DNA, 16 bp, M. musculus
tttcctgtatgcagca

SEQ ID NO: 458995 - DNA, 18 bp, M. musculus
tttcctgtatgcagcaaa

SEQ ID NO: 458996 - DNA, 16 bp, M. musculus
tttcctgtatttcttc

SEQ ID NO: 458997 - DNA, 16 bp, M. musculus
tttcctgtcactgtga

SEQ ID NO: 458998 - DNA, 16 bp, M. musculus
tttcctgtctcacaga

SEQ ID NO: 458999 - DNA, 16 bp, M. musculus
tttcctgtgctgttct

SEQ ID NO: 459000 - DNA, 16 bp, M. musculus
tttcctgtggaaatat

SEQ ID NO: 459001 - DNA, 16 bp, M. musculus
tttcctgtgtgtgtgc

SEQ ID NO: 459002 - DNA, 16 bp, M. musculus
tttcctgtgttttcat

SEQ ID NO: 459003 - DNA, 16 bp, M. musculus
tttcctgttagcagca

SEQ ID NO: 459004 - DNA, 16 bp, M. musculus
tttccttaattacatt

SEQ ID NO: 459005 - DNA, 16 bp, M. musculus
tttccttaggttttgt

SEQ ID NO: 459006 - DNA, 16 bp, M. musculus
tttccttccatctctg

SEQ ID NO: 459007 - DNA, 16 bp, M. musculus
tttccttcctgcctgc

SEQ ID NO: 459008 - DNA, 16 bp, M. musculus
tttccttccttaaaaa

SEQ ID NO: 459009 - DNA, 16 bp, M. musculus
tttccttctacaaact

SEQ ID NO: 459010 - DNA, 16 bp, M. musculus
tttccttctactgggt

SEQ ID NO: 459011 - DNA, 16 bp, M. musculus
tttccttctcaacttg

SEQ ID NO: 459012 - DNA, 16 bp, M. musculus
tttccttctcagcctg

SEQ ID NO: 459013 - DNA, 16 bp, M. musculus
tttccttcttagaaat

SEQ ID NO: 459014 - DNA, 16 bp, M. musculus
tttccttctttaaaaa

SEQ ID NO: 459015 - DNA, 16 bp, M. musculus
tttccttctttgtaaa

SEQ ID NO: 459016 - DNA, 16 bp, M. musculus
tttccttgcagctttt

SEQ ID NO: 459017 - DNA, 16 bp, M. musculus
tttccttgctgtccag

SEQ ID NO: 459018 - DNA, 16 bp, M. musculus
tttccttggttttcca

SEQ ID NO: 459019 - DNA, 16 bp, M. musculus
tttccttgtctgtaaa

SEQ ID NO: 459020 - DNA, 16 bp, M. musculus
tttcctttaaaaacaa

SEQ ID NO: 459021 - DNA, 16 bp, M. musculus
tttcctttaaaacaaa

SEQ ID NO: 459022 - DNA, 16 bp, M. musculus
tttcctttaaaagctt

SEQ ID NO: 459023 - DNA, 16 bp, M. musculus
tttcctttaaattaaa

SEQ ID NO: 459024 - DNA, 16 bp, M. musculus
tttcctttataagaat

SEQ ID NO: 459025 - DNA, 16 bp, M. musculus
tttcctttataagggt

SEQ ID NO: 459026 - DNA, 16 bp, M. musculus
tttcctttattgtgtc

SEQ ID NO: 459027 - DNA, 16 bp, M. musculus
tttcctttcagaaaag

SEQ ID NO: 459028 - DNA, 16 bp, M. musculus
tttcctttccaagttt

SEQ ID NO: 459029 - DNA, 16 bp, M. musculus
tttcctttccattttg

SEQ ID NO: 459030 - DNA, 16 bp, M. musculus
tttcctttctcctcag

SEQ ID NO: 459031 - DNA, 16 bp, M. musculus
tttcctttctctgtga

SEQ ID NO: 459032 - DNA, 16 bp, M. musculus
tttcctttctgaattt

SEQ ID NO: 459033 - DNA, 16 bp, M. musculus
tttcctttggaaatca

SEQ ID NO: 459034 - DNA, 16 bp, M. musculus
tttcctttgggcatct

SEQ ID NO: 459035 - DNA, 16 bp, M. musculus
tttcctttgtgagcag

SEQ ID NO: 459036 - DNA, 16 bp, M. musculus
tttcctttttaaaaca

SEQ ID NO: 459037 - DNA, 16 bp, M. musculus
tttcctttttaaaagg

SEQ ID NO: 459038 - DNA, 16 bp, M. musculus
tttcctttttgaaaat

SEQ ID NO: 459039 - DNA, 16 bp, M. musculus
tttccttttttaaaga

SEQ ID NO: 459040 - DNA, 16 bp, M. musculus
tttcgagacagggtct

SEQ ID NO: 459041 - DNA, 18 bp, M. musculus
tttcgagccagggtttct

SEQ ID NO: 459042 - DNA, 17 bp, M. musculus
tttcgtatcagctccaa

SEQ ID NO: 459043 - DNA, 16 bp, M. musculus
tttctaaaaagaaata

SEQ ID NO: 459044 - DNA, 16 bp, M. musculus
tttctaaaagaaaaag

SEQ ID NO: 459045 - DNA, 16 bp, M. musculus
tttctaaaagttaaaa

SEQ ID NO: 459046 - DNA, 16 bp, M. musculus
tttctaaaatctttct

SEQ ID NO: 459047 - DNA, 16 bp, M. musculus
tttctaaaatgtatat

SEQ ID NO: 459048 - DNA, 16 bp, M. musculus
tttctaaaatgtattt

SEQ ID NO: 459049 - DNA, 16 bp, M. musculus
tttctaaaatgtgttt

SEQ ID NO: 459050 - DNA, 16 bp, M. musculus
tttctaaaattcacat

SEQ ID NO: 459051 - DNA, 16 bp, M. musculus
tttctaaagtttcttt

SEQ ID NO: 459052 - DNA, 16 bp, M. musculus
tttctaaataaacttt

SEQ ID NO: 459053 - DNA, 16 bp, M. musculus
tttctaaatataacct

SEQ ID NO: 459054 - DNA, 16 bp, M. musculus
tttctaaatattttgt

SEQ ID NO: 459055 - DNA, 16 bp, M. musculus
tttctaaatgttttat

SEQ ID NO: 459056 - DNA, 16 bp, M. musculus
tttctaaatttagaaa

SEQ ID NO: 459057 - DNA, 16 bp, M. musculus
tttctaacctaaagaa

SEQ ID NO: 459058 - DNA, 16 bp, M. musculus
tttctaaccttttact

SEQ ID NO: 459059 - DNA, 16 bp, M. musculus
tttctaactccagggt

SEQ ID NO: 459060 - DNA, 16 bp, M. musculus
tttctaactcggtgaa

SEQ ID NO: 459061 - DNA, 16 bp, M. musculus
tttctaagaatcaagg

SEQ ID NO: 459062 - DNA, 16 bp, M. musculus
tttctaagaggaaagc

SEQ ID NO: 459063 - DNA, 16 bp, M. musculus
tttctaagtatatttt

SEQ ID NO: 459064 - DNA, 16 bp, M. musculus
tttctaagtctgtgaa

SEQ ID NO: 459065 - DNA, 16 bp, M. musculus
tttctaagtttggtgc

SEQ ID NO: 459066 - DNA, 16 bp, M. musculus
tttctaagttttaaaa

SEQ ID NO: 459067 - DNA, 16 bp, M. musculus
tttctaataagaaaaa

SEQ ID NO: 459068 - DNA, 16 bp, M. musculus
tttctaatgagagaca

SEQ ID NO: 459069 - DNA, 16 bp, M. musculus
tttctaattggatatt

SEQ ID NO: 459070 - DNA, 16 bp, M. musculus
tttctaattttgttga

SEQ ID NO: 459071 - DNA, 16 bp, M. musculus
tttctaatttttaaag

SEQ ID NO: 459072 - DNA, 16 bp, M. musculus
tttctacaaatggtgc

SEQ ID NO: 459073 - DNA, 22 bp, M. musculus
tttctacaacaaggaggcttat

SEQ ID NO: 459074 - DNA, 16 bp, M. musculus
tttctacaataaaact

SEQ ID NO: 459075 - DNA, 21 bp, M. musculus
tttctacaataaagctctaaa

SEQ ID NO: 459076 - DNA, 16 bp, M. musculus
tttctacacagatacc

SEQ ID NO: 459077 - DNA, 16 bp, M. musculus
tttctacagacattct

SEQ ID NO: 459078 - DNA, 16 bp, M. musculus
tttctacagttttctt

SEQ ID NO: 459079 - DNA, 16 bp, M. musculus
tttctacatctgtttc

SEQ ID NO: 459080 - DNA, 16 bp, M. musculus
tttctacattgctgtt

SEQ ID NO: 459081 - DNA, 16 bp, M. musculus
tttctaccaaaaaaaa

SEQ ID NO: 459082 - DNA, 16 bp, M. musculus
tttctaccctgacttc

SEQ ID NO: 459083 - DNA, 16 bp, M. musculus
tttctaccttttaaaa

SEQ ID NO: 459084 - DNA, 16 bp, M. musculus
tttctactggccctca

SEQ ID NO: 459085 - DNA, 16 bp, M. musculus
tttctactgtatggtt

SEQ ID NO: 459086 - DNA, 16 bp, M. musculus
tttctagaaaaggaaa

SEQ ID NO: 459087 - DNA, 16 bp, M. musculus
tttctagaaagttctt

SEQ ID NO: 459088 - DNA, 16 bp, M. musculus
tttctagaacccacat

SEQ ID NO: 459089 - DNA, 16 bp, M. musculus
tttctagaactttcca

SEQ ID NO: 459090 - DNA, 16 bp, M. musculus
tttctagaagtttcct

SEQ ID NO: 459091 - DNA, 16 bp, M. musculus
tttctagaatattctt

SEQ ID NO: 459092 - DNA, 16 bp, M. musculus
tttctagatctttctg

SEQ ID NO: 459093 - DNA, 16 bp, M. musculus
tttctagatggtccat

SEQ ID NO: 459094 - DNA, 16 bp, M. musculus
tttctagcacccacat

SEQ ID NO: 459095 - DNA, 16 bp, M. musculus
tttctagcacccatat

SEQ ID NO: 459096 - DNA, 16 bp, M. musculus
tttctagcactcacat

SEQ ID NO: 459097 - DNA, 19 bp, M. musculus
tttctagcttacataaaca

SEQ ID NO: 459098 - DNA, 16 bp, M. musculus
tttctagctttaaaat

SEQ ID NO: 459099 - DNA, 16 bp, M. musculus
tttctagtatttacat

SEQ ID NO: 459100 - DNA, 16 bp, M. musculus
tttctataagaaagca

SEQ ID NO: 459101 - DNA, 16 bp, M. musculus
tttctataataaagtt

SEQ ID NO: 459102 - DNA, 17 bp, M. musculus
tttctatacacaaagga

SEQ ID NO: 459103 - DNA, 16 bp, M. musculus
tttctatatttagaaa

SEQ ID NO: 459104 - DNA, 16 bp, M. musculus
tttctatattttggat

SEQ ID NO: 459105 - DNA, 18 bp, M. musculus
tttctatctccagcattg

SEQ ID NO: 459106 - DNA, 17 bp, M. musculus
tttctatctccagcttt

SEQ ID NO: 459107 - DNA, 16 bp, M. musculus
tttctatctctttctg

SEQ ID NO: 459108 - DNA, 16 bp, M. musculus
tttctatgaaatattt

SEQ ID NO: 459109 - DNA, 16 bp, M. musculus
tttctatggaattttc

SEQ ID NO: 459110 - DNA, 16 bp, M. musculus
tttctattactgtaac

SEQ ID NO: 459111 - DNA, 16 bp, M. musculus
tttctattactgtgct

SEQ ID NO: 459112 - DNA, 33 bp, M. musculus
tttctattcctgcacaaacatcatgaccaagaa

SEQ ID NO: 459113 - DNA, 16 bp, M. musculus
tttctattgcagtgaa

SEQ ID NO: 459114 - DNA, 16 bp, M. musculus
tttctattgctgggaa

SEQ ID NO: 459115 - DNA, 16 bp, M. musculus
tttctattgctgtgat

SEQ ID NO: 459116 - DNA, 16 bp, M. musculus
tttctattggtgtgat

SEQ ID NO: 459117 - DNA, 16 bp, M. musculus
tttctatttgtgtgtg

SEQ ID NO: 459118 - DNA, 16 bp, M. musculus
tttctattttcagagt

SEQ ID NO: 459119 - DNA, 16 bp, M. musculus
tttctatttttagatc

SEQ ID NO: 459120 - DNA, 16 bp, M. musculus
tttctatttttgtgga

SEQ ID NO: 459121 - DNA, 16 bp, M. musculus
tttctcaaaaaacaaa

SEQ ID NO: 459122 - DNA, 16 bp, M. musculus
tttctcaaaaacaaaa

SEQ ID NO: 459123 - DNA, 16 bp, M. musculus
tttctcaaaaagaaaa

SEQ ID NO: 459124 - DNA, 16 bp, M. musculus
tttctcaaaaatatat

SEQ ID NO: 459125 - DNA, 16 bp, M. musculus
tttctcaaaacaaaaa

SEQ ID NO: 459126 - DNA, 16 bp, M. musculus
tttctcaaaactaaaa

SEQ ID NO: 459127 - DNA, 16 bp, M. musculus
tttctcaaacaaacaa

SEQ ID NO: 459128 - DNA, 16 bp, M. musculus
tttctcaaagaagcaa

SEQ ID NO: 459129 - DNA, 16 bp, M. musculus
tttctcaaatagaaaa

SEQ ID NO: 459130 - DNA, 16 bp, M. musculus
tttctcaaatgaggtt

SEQ ID NO: 459131 - DNA, 16 bp, M. musculus
tttctcaacctgcttt

SEQ ID NO: 459132 - DNA, 16 bp, M. musculus
tttctcaactgaggtt

SEQ ID NO: 459133 - DNA, 16 bp, M. musculus
tttctcaagaaccagc

SEQ ID NO: 459134 - DNA, 16 bp, M. musculus
tttctcaataaaatac

SEQ ID NO: 459135 - DNA, 16 bp, M. musculus
tttctcacataaaaat

SEQ ID NO: 459136 - DNA, 16 bp, M. musculus
tttctcacctgctcct

SEQ ID NO: 459137 - DNA, 16 bp, M. musculus
tttctcactctctgca

SEQ ID NO: 459138 - DNA, 16 bp, M. musculus
tttctcactgagacca

SEQ ID NO: 459139 - DNA, 16 bp, M. musculus
tttctcacttgaggtt

SEQ ID NO: 459140 - DNA, 16 bp, M. musculus
tttctcactttaaaaa

SEQ ID NO: 459141 - DNA, 16 bp, M. musculus
tttctcagaaaaatgg

SEQ ID NO: 459142 - DNA, 16 bp, M. musculus
tttctcagaaaagaaa

SEQ ID NO: 459143 - DNA, 16 bp, M. musculus
tttctcagaaagggaa

SEQ ID NO: 459144 - DNA, 16 bp, M. musculus
tttctcagactgagta

SEQ ID NO: 459145 - DNA, 16 bp, M. musculus
tttctcagcagccatt

SEQ ID NO: 459146 - DNA, 16 bp, M. musculus
tttctcagccattcgg

SEQ ID NO: 459147 - DNA, 16 bp, M. musculus
tttctcaggaaattgg

SEQ ID NO: 459148 - DNA, 16 bp, M. musculus
tttctcagttgaggct

SEQ ID NO: 459149 - DNA, 16 bp, M. musculus
tttctcagtttaaaaa

SEQ ID NO: 459150 - DNA, 16 bp, M. musculus
tttctcatcagaaaag

SEQ ID NO: 459151 - DNA, 16 bp, M. musculus
tttctcatctatgaaa

SEQ ID NO: 459152 - DNA, 16 bp, M. musculus
tttctcatctgtaaaa

SEQ ID NO: 459153 - DNA, 16 bp, M. musculus
tttctcatctgtgaaa

SEQ ID NO: 459154 - DNA, 16 bp, M. musculus
tttctcatgaggaaaa

SEQ ID NO: 459155 - DNA, 16 bp, M. musculus
tttctcattactgtga

SEQ ID NO: 459156 - DNA, 16 bp, M. musculus
tttctcattcaaacca

SEQ ID NO: 459157 - DNA, 16 bp, M. musculus
tttctcattgctgtgg

SEQ ID NO: 459158 - DNA, 16 bp, M. musculus
tttctccacaacctct

SEQ ID NO: 459159 - DNA, 16 bp, M. musculus
tttctccacaccctct

SEQ ID NO: 459160 - DNA, 16 bp, M. musculus
tttctccacccaccca

SEQ ID NO: 459161 - DNA, 16 bp, M. musculus
tttctccacctcctcg

SEQ ID NO: 459162 - DNA, 16 bp, M. musculus
tttctccagccctctt

SEQ ID NO: 459163 - DNA, 16 bp, M. musculus
tttctccagctccttc

SEQ ID NO: 459164 - DNA, 16 bp, M. musculus
tttctccaggttttcc

SEQ ID NO: 459165 - DNA, 16 bp, M. musculus
tttctccatatttgct

SEQ ID NO: 459166 - DNA, 28 bp, M. musculus
tttctccatctatggtaattgagagttt

SEQ ID NO: 459167 - DNA, 16 bp, M. musculus
tttctccatctatgtt

SEQ ID NO: 459168 - DNA, 16 bp, M. musculus
tttctccatgttctct

SEQ ID NO: 459169 - DNA, 16 bp, M. musculus
tttctccatttagttt

SEQ ID NO: 459170 - DNA, 16 bp, M. musculus
tttctcccaaccccca

SEQ ID NO: 459171 - DNA, 16 bp, M. musculus
tttctcccactctcag

SEQ ID NO: 459172 - DNA, 16 bp, M. musculus
tttctcccttactgtt

SEQ ID NO: 459173 - DNA, 16 bp, M. musculus
tttctcccttttggaa

SEQ ID NO: 459174 - DNA, 16 bp, M. musculus
tttctcctcatcctca

SEQ ID NO: 459175 - DNA, 16 bp, M. musculus
tttctcctccacaaac

SEQ ID NO: 459176 - DNA, 16 bp, M. musculus
tttctcctgagagttg

SEQ ID NO: 459177 - DNA, 16 bp, M. musculus
tttctcctgagctggt

SEQ ID NO: 459178 - DNA, 16 bp, M. musculus
tttctcctggccctca

SEQ ID NO: 459179 - DNA, 16 bp, M. musculus
tttctcctgtcacata

SEQ ID NO: 459180 - DNA, 16 bp, M. musculus
tttctcctgtgcccat

SEQ ID NO: 459181 - DNA, 16 bp, M. musculus
tttctcctgttttcag

SEQ ID NO: 459182 - DNA, 16 bp, M. musculus
tttctccttccaccat

SEQ ID NO: 459183 - DNA, 16 bp, M. musculus
tttctccttctatgat

SEQ ID NO: 459184 - DNA, 16 bp, M. musculus
tttctccttctccaca

SEQ ID NO: 459185 - DNA, 16 bp, M. musculus
tttctccttcttagaa

SEQ ID NO: 459186 - DNA, 16 bp, M. musculus
tttctcctttgaaaat

SEQ ID NO: 459187 - DNA, 16 bp, M. musculus
tttctcctttgtattc

SEQ ID NO: 459188 - DNA, 16 bp, M. musculus
tttctcctttgtctca

SEQ ID NO: 459189 - DNA, 16 bp, M. musculus
tttctctacaccaaga

SEQ ID NO: 459190 - DNA, 16 bp, M. musculus
tttctctacagaaaga

SEQ ID NO: 459191 - DNA, 22 bp, M. musculus
tttctctagctcctccattgga

SEQ ID NO: 459192 - DNA, 22 bp, M. musculus
tttctctagctcctccattggg

SEQ ID NO: 459193 - DNA, 16 bp, M. musculus
tttctctagctccttc

SEQ ID NO: 459194 - DNA, 17 bp, M. musculus
tttctctagcttctcca

SEQ ID NO: 459195 - DNA, 16 bp, M. musculus
tttctctatggaatct

SEQ ID NO: 459196 - DNA, 16 bp, M. musculus
tttctctatggagtcc

SEQ ID NO: 459197 - DNA, 16 bp, M. musculus
tttctctatgtaataa

SEQ ID NO: 459198 - DNA, 16 bp, M. musculus
tttctctatgtagcct

SEQ ID NO: 459199 - DNA, 16 bp, M. musculus
tttctctattgggtca

SEQ ID NO: 459200 - DNA, 16 bp, M. musculus
tttctctatttaaaaa

SEQ ID NO: 459201 - DNA, 16 bp, M. musculus
tttctctcattaaaaa

SEQ ID NO: 459202 - DNA, 16 bp, M. musculus
tttctctcctcttggc

SEQ ID NO: 459203 - DNA, 16 bp, M. musculus
tttctctcctgtatgt

SEQ ID NO: 459204 - DNA, 16 bp, M. musculus
tttctctcctgtgtgt

SEQ ID NO: 459205 - DNA, 16 bp, M. musculus
tttctctctatggagt

SEQ ID NO: 459206 - DNA, 16 bp, M. musculus
tttctctctctgattt

SEQ ID NO: 459207 - DNA, 16 bp, M. musculus
tttctctctctttaaa

SEQ ID NO: 459208 - DNA, 16 bp, M. musculus
tttctctctgataact

SEQ ID NO: 459209 - DNA, 16 bp, M. musculus
tttctctctgtagcct

SEQ ID NO: 459210 - DNA, 16 bp, M. musculus
tttctctctgtagtcc

SEQ ID NO: 459211 - DNA, 16 bp, M. musculus
tttctctcttaaaaaa

SEQ ID NO: 459212 - DNA, 16 bp, M. musculus
tttctctctttagaaa

SEQ ID NO: 459213 - DNA, 16 bp, M. musculus
tttctctcttttaaaa

SEQ ID NO: 459214 - DNA, 16 bp, M. musculus
tttctctcttttgaaa

SEQ ID NO: 459215 - DNA, 16 bp, M. musculus
tttctctgacatttct

SEQ ID NO: 459216 - DNA, 16 bp, M. musculus
tttctctgacctctgt

SEQ ID NO: 459217 - DNA, 16 bp, M. musculus
tttctctgaggagaaa

SEQ ID NO: 459218 - DNA, 16 bp, M. musculus
tttctctgattcatca

SEQ ID NO: 459219 - DNA, 16 bp, M. musculus
tttctctgcatctaac

SEQ ID NO: 459220 - DNA, 16 bp, M. musculus
tttctctgccattcgg

SEQ ID NO: 459221 - DNA, 16 bp, M. musculus
tttctctgccctggct

SEQ ID NO: 459222 - DNA, 16 bp, M. musculus
tttctctgcctctgcc

SEQ ID NO: 459223 - DNA, 16 bp, M. musculus
tttctctgcctctggg

SEQ ID NO: 459224 - DNA, 16 bp, M. musculus
tttctctgcctttact

SEQ ID NO: 459225 - DNA, 16 bp, M. musculus
tttctctgcttctact

SEQ ID NO: 459226 - DNA, 16 bp, M. musculus
tttctctggtgtttat

SEQ ID NO: 459227 - DNA, 16 bp, M. musculus
tttctctgtagctcag

SEQ ID NO: 459228 - DNA, 18 bp, M. musculus
tttctctgtagtaaagct

SEQ ID NO: 459229 - DNA, 19 bp, M. musculus
tttctctgtataaccctgg

SEQ ID NO: 459230 - DNA, 16 bp, M. musculus
tttctctgtatagttc

SEQ ID NO: 459231 - DNA, 16 bp, M. musculus
tttctctgtatatgtg

SEQ ID NO: 459232 - DNA, 16 bp, M. musculus
tttctctgtctatagt

SEQ ID NO: 459233 - DNA, 16 bp, M. musculus
tttctctgtctccatc

SEQ ID NO: 459234 - DNA, 16 bp, M. musculus
tttctctgtctctgcc

SEQ ID NO: 459235 - DNA, 16 bp, M. musculus
tttctctgtgaagccc

SEQ ID NO: 459236 - DNA, 16 bp, M. musculus
tttctctgtgatttct

SEQ ID NO: 459237 - DNA, 16 bp, M. musculus
tttctctgtgcagtct

SEQ ID NO: 459238 - DNA, 16 bp, M. musculus
tttctctgtggagccc

SEQ ID NO: 459239 - DNA, 16 bp, M. musculus
tttctctgtgtagcct

SEQ ID NO: 459240 - DNA, 16 bp, M. musculus
tttctctgtgtagctt

SEQ ID NO: 459241 - DNA, 16 bp, M. musculus
tttctctgtgtctgtg

SEQ ID NO: 459242 - DNA, 16 bp, M. musculus
tttctctgtgtgacag

SEQ ID NO: 459243 - DNA, 16 bp, M. musculus
tttctcttattgaaaa

SEQ ID NO: 459244 - DNA, 16 bp, M. musculus
tttctcttcagaaaaa

SEQ ID NO: 459245 - DNA, 16 bp, M. musculus
tttctcttcagaaaag

SEQ ID NO: 459246 - DNA, 16 bp, M. musculus
tttctcttctcttaga

SEQ ID NO: 459247 - DNA, 16 bp, M. musculus
tttctcttgtgaggct

SEQ ID NO: 459248 - DNA, 16 bp, M. musculus
tttctctttaaaaaaa

SEQ ID NO: 459249 - DNA, 16 bp, M. musculus
tttctctttaaaacaa

SEQ ID NO: 459250 - DNA, 16 bp, M. musculus
tttctctttaaagatt

SEQ ID NO: 459251 - DNA, 16 bp, M. musculus
tttctctttaaaggtc

SEQ ID NO: 459252 - DNA, 16 bp, M. musculus
tttctctttctcacca

SEQ ID NO: 459253 - DNA, 16 bp, M. musculus
tttctctttgagtttg

SEQ ID NO: 459254 - DNA, 16 bp, M. musculus
tttctcttttaaagaa

SEQ ID NO: 459255 - DNA, 16 bp, M. musculus
tttctcttttgaaaca

SEQ ID NO: 459256 - DNA, 16 bp, M. musculus
tttctgaaaaaaaatt

SEQ ID NO: 459257 - DNA, 16 bp, M. musculus
tttctgaaaaaagaaa

SEQ ID NO: 459258 - DNA, 16 bp, M. musculus
tttctgaaaacaaaaa

SEQ ID NO: 459259 - DNA, 16 bp, M. musculus
tttctgaaaacacaaa

SEQ ID NO: 459260 - DNA, 16 bp, M. musculus
tttctgaaaagaaaaa

SEQ ID NO: 459261 - DNA, 16 bp, M. musculus
tttctgaaaaggaaat

SEQ ID NO: 459262 - DNA, 16 bp, M. musculus
tttctgaaaatgaaaa

SEQ ID NO: 459263 - DNA, 16 bp, M. musculus
tttctgaaaatgtttt

SEQ ID NO: 459264 - DNA, 16 bp, M. musculus
tttctgaaactgctga

SEQ ID NO: 459265 - DNA, 16 bp, M. musculus
tttctgaaagaaaaca

SEQ ID NO: 459266 - DNA, 19 bp, M. musculus
tttctgaaagtacagtgag

SEQ ID NO: 459267 - DNA, 16 bp, M. musculus
tttctgaaatattttt

SEQ ID NO: 459268 - DNA, 16 bp, M. musculus
tttctgaaatgcccaa

SEQ ID NO: 459269 - DNA, 16 bp, M. musculus
tttctgaactctggat

SEQ ID NO: 459270 - DNA, 16 bp, M. musculus
tttctgaagaagaaat

SEQ ID NO: 459271 - DNA, 16 bp, M. musculus
tttctgaagagaaaat

SEQ ID NO: 459272 - DNA, 16 bp, M. musculus
tttctgaagagaaatg

SEQ ID NO: 459273 - DNA, 16 bp, M. musculus
tttctgaagttcagct

SEQ ID NO: 459274 - DNA, 16 bp, M. musculus
tttctgaatgaagaaa

SEQ ID NO: 459275 - DNA, 16 bp, M. musculus
tttctgacatatttac

SEQ ID NO: 459276 - DNA, 16 bp, M. musculus
tttctgacctccacag

SEQ ID NO: 459277 - DNA, 16 bp, M. musculus
tttctgactgtggatg

SEQ ID NO: 459278 - DNA, 16 bp, M. musculus
tttctgactttaaaaa

SEQ ID NO: 459279 - DNA, 16 bp, M. musculus
tttctgactttttaaa

SEQ ID NO: 459280 - DNA, 16 bp, M. musculus
tttctgagaaaaataa

SEQ ID NO: 459281 - DNA, 17 bp, M. musculus
tttctgagaaacctcca

SEQ ID NO: 459282 - DNA, 16 bp, M. musculus
tttctgagaatttcat

SEQ ID NO: 459283 - DNA, 16 bp, M. musculus
tttctgagacagggtc

SEQ ID NO: 459284 - DNA, 16 bp, M. musculus
tttctgagacaggttc

SEQ ID NO: 459285 - DNA, 16 bp, M. musculus
tttctgagcatgctca

SEQ ID NO: 459286 - DNA, 17 bp, M. musculus
tttctgaggaacaacca

SEQ ID NO: 459287 - DNA, 16 bp, M. musculus
tttctgaggaaccagc

SEQ ID NO: 459288 - DNA, 16 bp, M. musculus
tttctgagtcacttgg

SEQ ID NO: 459289 - DNA, 16 bp, M. musculus
tttctgagtgctgaga

SEQ ID NO: 459290 - DNA, 16 bp, M. musculus
tttctgagttagaagc

SEQ ID NO: 459291 - DNA, 16 bp, M. musculus
tttctgagttcatggc

SEQ ID NO: 459292 - DNA, 16 bp, M. musculus
tttctgagttccaagc

SEQ ID NO: 459293 - DNA, 16 bp, M. musculus
tttctgagtttgggtt

SEQ ID NO: 459294 - DNA, 16 bp, M. musculus
tttctgatagtcttag

SEQ ID NO: 459295 - DNA, 16 bp, M. musculus
tttctgatggtcttag

SEQ ID NO: 459296 - DNA, 16 bp, M. musculus
tttctgatgtcctggg

SEQ ID NO: 459297 - DNA, 16 bp, M. musculus
tttctgattttgtaaa

SEQ ID NO: 459298 - DNA, 16 bp, M. musculus
tttctgatttttaaaa

SEQ ID NO: 459299 - DNA, 16 bp, M. musculus
tttctgattttttaaa

SEQ ID NO: 459300 - DNA, 16 bp, M. musculus
tttctgcaagtgtgtg

SEQ ID NO: 459301 - DNA, 16 bp, M. musculus
tttctgcacaaacatc

SEQ ID NO: 459302 - DNA, 16 bp, M. musculus
tttctgcaggctctgg

SEQ ID NO: 459303 - DNA, 16 bp, M. musculus
tttctgcatctaagga

SEQ ID NO: 459304 - DNA, 16 bp, M. musculus
tttctgcatctgacat

SEQ ID NO: 459305 - DNA, 16 bp, M. musculus
tttctgcatttccttt

SEQ ID NO: 459306 - DNA, 16 bp, M. musculus
tttctgcccagtggcc

SEQ ID NO: 459307 - DNA, 20 bp, M. musculus
tttctgccctaagaagcagt

SEQ ID NO: 459308 - DNA, 16 bp, M. musculus
tttctgccctgtttga

SEQ ID NO: 459309 - DNA, 16 bp, M. musculus
tttctgcctcaggctc

SEQ ID NO: 459310 - DNA, 16 bp, M. musculus
tttctgcctcattttt

SEQ ID NO: 459311 - DNA, 16 bp, M. musculus
tttctgcctccatctt

SEQ ID NO: 459312 - DNA, 16 bp, M. musculus
tttctgcctccatgtt

SEQ ID NO: 459313 - DNA, 16 bp, M. musculus
tttctgcctccccagc

SEQ ID NO: 459314 - DNA, 16 bp, M. musculus
tttctgcctctcaagt

SEQ ID NO: 459315 - DNA, 16 bp, M. musculus
tttctgcctctgtctc

SEQ ID NO: 459316 - DNA, 16 bp, M. musculus
tttctgcctctgtgtg

SEQ ID NO: 459317 - DNA, 16 bp, M. musculus
tttctgctcttccaga

SEQ ID NO: 459318 - DNA, 16 bp, M. musculus
tttctgctgcctgctg

SEQ ID NO: 459319 - DNA, 16 bp, M. musculus
tttctgctgggacaga

SEQ ID NO: 459320 - DNA, 16 bp, M. musculus
tttctgctggtcagaa

SEQ ID NO: 459321 - DNA, 16 bp, M. musculus
tttctgcttacaggaa

SEQ ID NO: 459322 - DNA, 16 bp, M. musculus
tttctgcttcatcttc

SEQ ID NO: 459323 - DNA, 16 bp, M. musculus
tttctgcttccacctc

SEQ ID NO: 459324 - DNA, 16 bp, M. musculus
tttctgcttcctgacc

SEQ ID NO: 459325 - DNA, 16 bp, M. musculus
tttctgcttcctgagt

SEQ ID NO: 459326 - DNA, 16 bp, M. musculus
tttctgcttcctggcc

SEQ ID NO: 459327 - DNA, 16 bp, M. musculus
tttctgcttctctaag

SEQ ID NO: 459328 - DNA, 16 bp, M. musculus
tttctgcttcttccag

SEQ ID NO: 459329 - DNA, 16 bp, M. musculus
tttctggaaacaccct

SEQ ID NO: 459330 - DNA, 16 bp, M. musculus
tttctggaaacactct

SEQ ID NO: 459331 - DNA, 16 bp, M. musculus
tttctggaaacatcct

SEQ ID NO: 459332 - DNA, 16 bp, M. musculus
tttctggaaatatttt

SEQ ID NO: 459333 - DNA, 16 bp, M. musculus
tttctggaaccatgga

SEQ ID NO: 459334 - DNA, 18 bp, M. musculus
tttctggacaatgccagc

SEQ ID NO: 459335 - DNA, 16 bp, M. musculus
tttctggagctggagt

SEQ ID NO: 459336 - DNA, 16 bp, M. musculus
tttctggaggagaaac

SEQ ID NO: 459337 - DNA, 16 bp, M. musculus
tttctggatattttgt

SEQ ID NO: 459338 - DNA, 16 bp, M. musculus
tttctggatgttttga

SEQ ID NO: 459339 - DNA, 16 bp, M. musculus
tttctggatgttttgg

SEQ ID NO: 459340 - DNA, 16 bp, M. musculus
tttctggattctttat

SEQ ID NO: 459341 - DNA, 16 bp, M. musculus
tttctggatttttaaa

SEQ ID NO: 459342 - DNA, 16 bp, M. musculus
tttctggcctacaaca

SEQ ID NO: 459343 - DNA, 16 bp, M. musculus
tttctggcctctatgg

SEQ ID NO: 459344 - DNA, 16 bp, M. musculus
tttctggcttccatgg

SEQ ID NO: 459345 - DNA, 16 bp, M. musculus
tttctggctttaaaaa

SEQ ID NO: 459346 - DNA, 16 bp, M. musculus
tttctgggaaacagaa

SEQ ID NO: 459347 - DNA, 16 bp, M. musculus
tttctgggaattgaac

SEQ ID NO: 459348 - DNA, 16 bp, M. musculus
tttctgggacagacga

SEQ ID NO: 459349 - DNA, 16 bp, M. musculus
tttctgggactttcta

SEQ ID NO: 459350 - DNA, 16 bp, M. musculus
tttctgggctaatttc

SEQ ID NO: 459351 - DNA, 16 bp, M. musculus
tttctgggggaggggg

SEQ ID NO: 459352 - DNA, 16 bp, M. musculus
tttctgggtctgggct

SEQ ID NO: 459353 - DNA, 16 bp, M. musculus
tttctgggtggccttt

SEQ ID NO: 459354 - DNA, 16 bp, M. musculus
tttctgggttttcaat

SEQ ID NO: 459355 - DNA, 19 bp, M. musculus
tttctggtacagtctattt

SEQ ID NO: 459356 - DNA, 16 bp, M. musculus
tttctggtctctgtgg

SEQ ID NO: 459357 - DNA, 16 bp, M. musculus
tttctggtgcttctca

SEQ ID NO: 459358 - DNA, 16 bp, M. musculus
tttctggttttgataa

SEQ ID NO: 459359 - DNA, 16 bp, M. musculus
tttctggttttgttaa

SEQ ID NO: 459360 - DNA, 16 bp, M. musculus
tttctgtaagtttgag

SEQ ID NO: 459361 - DNA, 16 bp, M. musculus
tttctgtaattatcct

SEQ ID NO: 459362 - DNA, 16 bp, M. musculus
tttctgtaattgtctc

SEQ ID NO: 459363 - DNA, 16 bp, M. musculus
tttctgtacttttaaa

SEQ ID NO: 459364 - DNA, 16 bp, M. musculus
tttctgtatccatcct

SEQ ID NO: 459365 - DNA, 17 bp, M. musculus
tttctgtatccattctt

SEQ ID NO: 459366 - DNA, 16 bp, M. musculus
tttctgtatgcagcaa

SEQ ID NO: 459367 - DNA, 17 bp, M. musculus
tttctgtccaattaaaa

SEQ ID NO: 459368 - DNA, 16 bp, M. musculus
tttctgtccctgtctc

SEQ ID NO: 459369 - DNA, 16 bp, M. musculus
tttctgtccttgtact

SEQ ID NO: 459370 - DNA, 16 bp, M. musculus
tttctgtcgctgtgat

SEQ ID NO: 459371 - DNA, 16 bp, M. musculus
tttctgtctagaaaat

SEQ ID NO: 459372 - DNA, 16 bp, M. musculus
tttctgtctaggctgt

SEQ ID NO: 459373 - DNA, 16 bp, M. musculus
tttctgtctcaatgga

SEQ ID NO: 459374 - DNA, 16 bp, M. musculus
tttctgtctccattct

SEQ ID NO: 459375 - DNA, 16 bp, M. musculus
tttctgtctcctgaga

SEQ ID NO: 459376 - DNA, 16 bp, M. musculus
tttctgtctgtgtctg

SEQ ID NO: 459377 - DNA, 16 bp, M. musculus
tttctgtgaaacttca

SEQ ID NO: 459378 - DNA, 16 bp, M. musculus
tttctgtgaattcaag

SEQ ID NO: 459379 - DNA, 16 bp, M. musculus
tttctgtgtaccatgt

SEQ ID NO: 459380 - DNA, 16 bp, M. musculus
tttctgtgtagtccta

SEQ ID NO: 459381 - DNA, 16 bp, M. musculus
tttctgtgtctctggt

SEQ ID NO: 459382 - DNA, 16 bp, M. musculus
tttctgtgtctgtgtc

SEQ ID NO: 459383 - DNA, 16 bp, M. musculus
tttctgtgtgtgcatg

SEQ ID NO: 459384 - DNA, 16 bp, M. musculus
tttctgtgtttttaaa

SEQ ID NO: 459385 - DNA, 16 bp, M. musculus
tttctgttaaaaaaat

SEQ ID NO: 459386 - DNA, 16 bp, M. musculus
tttctgttaattctca

SEQ ID NO: 459387 - DNA, 16 bp, M. musculus
tttctgttagtaaaat

SEQ ID NO: 459388 - DNA, 16 bp, M. musculus
tttctgttattatcat

SEQ ID NO: 459389 - DNA, 16 bp, M. musculus
tttctgttattccaaa

SEQ ID NO: 459390 - DNA, 16 bp, M. musculus
tttctgttcaatttcc

SEQ ID NO: 459391 - DNA, 16 bp, M. musculus
tttctgttctttgaaa

SEQ ID NO: 459392 - DNA, 16 bp, M. musculus
tttctgttcttttaaa

SEQ ID NO: 459393 - DNA, 16 bp, M. musculus
tttctgttgattatgt

SEQ ID NO: 459394 - DNA, 16 bp, M. musculus
tttctgttgctgctgt

SEQ ID NO: 459395 - DNA, 16 bp, M. musculus
tttctgttgctgggat

SEQ ID NO: 459396 - DNA, 16 bp, M. musculus
tttctgttgctgtgat

SEQ ID NO: 459397 - DNA, 16 bp, M. musculus
tttctgttgttgctga

SEQ ID NO: 459398 - DNA, 16 bp, M. musculus
tttctgtttaaaaaaa

SEQ ID NO: 459399 - DNA, 16 bp, M. musculus
tttctgtttcaataac

SEQ ID NO: 459400 - DNA, 16 bp, M. musculus
tttctgtttccatcat

SEQ ID NO: 459401 - DNA, 16 bp, M. musculus
tttctgtttcctggct

SEQ ID NO: 459402 - DNA, 16 bp, M. musculus
tttctgtttctacttg

SEQ ID NO: 459403 - DNA, 16 bp, M. musculus
tttctgtttctcagaa

SEQ ID NO: 459404 - DNA, 16 bp, M. musculus
tttctgtttctcctta

SEQ ID NO: 459405 - DNA, 16 bp, M. musculus
tttctgtttgaaagaa

SEQ ID NO: 459406 - DNA, 16 bp, M. musculus
tttctgttttataaat

SEQ ID NO: 459407 - DNA, 16 bp, M. musculus
tttctgttttccagct

SEQ ID NO: 459408 - DNA, 16 bp, M. musculus
tttctgttttccttca

SEQ ID NO: 459409 - DNA, 16 bp, M. musculus
tttctgttttctgaaa

SEQ ID NO: 459410 - DNA, 16 bp, M. musculus
tttctgttttcttcag

SEQ ID NO: 459411 - DNA, 16 bp, M. musculus
tttctgtttttaaatg

SEQ ID NO: 459412 - DNA, 16 bp, M. musculus
tttctgtttttcaaat

SEQ ID NO: 459413 - DNA, 16 bp, M. musculus
tttcttaaaagaaaaa

SEQ ID NO: 459414 - DNA, 16 bp, M. musculus
tttcttaaagctttta

SEQ ID NO: 459415 - DNA, 16 bp, M. musculus
tttcttaactccagct

SEQ ID NO: 459416 - DNA, 16 bp, M. musculus
tttcttaattagtgac

SEQ ID NO: 459417 - DNA, 16 bp, M. musculus
tttcttaattgaggct

SEQ ID NO: 459418 - DNA, 16 bp, M. musculus
tttcttaatttctgtc

SEQ ID NO: 459419 - DNA, 16 bp, M. musculus
tttcttaatttttgaa

SEQ ID NO: 459420 - DNA, 16 bp, M. musculus
tttcttacaaagtttt

SEQ ID NO: 459421 - DNA, 16 bp, M. musculus
tttcttacatatgcat

SEQ ID NO: 459422 - DNA, 16 bp, M. musculus
tttcttactgctttta

SEQ ID NO: 459423 - DNA, 16 bp, M. musculus
tttcttagaaaaaaaa

SEQ ID NO: 459424 - DNA, 16 bp, M. musculus
tttcttagaaatattt

SEQ ID NO: 459425 - DNA, 16 bp, M. musculus
tttcttagaaggagaa

SEQ ID NO: 459426 - DNA, 16 bp, M. musculus
tttcttagaaggggaa

SEQ ID NO: 459427 - DNA, 16 bp, M. musculus
tttcttagaattattt

SEQ ID NO: 459428 - DNA, 16 bp, M. musculus
tttcttagccttttta

SEQ ID NO: 459429 - DNA, 16 bp, M. musculus
tttcttaggaactgcc

SEQ ID NO: 459430 - DNA, 16 bp, M. musculus
tttcttaggattaaat

SEQ ID NO: 459431 - DNA, 16 bp, M. musculus
tttcttagtcatttca

SEQ ID NO: 459432 - DNA, 16 bp, M. musculus
tttcttagtgtgtgtg

SEQ ID NO: 459433 - DNA, 16 bp, M. musculus
tttcttataagacttg

SEQ ID NO: 459434 - DNA, 16 bp, M. musculus
tttcttatagaaccca

SEQ ID NO: 459435 - DNA, 16 bp, M. musculus
tttcttatgaaaaaaa

SEQ ID NO: 459436 - DNA, 17 bp, M. musculus
tttcttatggtaaactg

SEQ ID NO: 459437 - DNA, 16 bp, M. musculus
tttcttattagatatt

SEQ ID NO: 459438 - DNA, 16 bp, M. musculus
tttcttattccaaatg

SEQ ID NO: 459439 - DNA, 16 bp, M. musculus
tttcttattctctgca

SEQ ID NO: 459440 - DNA, 16 bp, M. musculus
tttcttatttaatgat

SEQ ID NO: 459441 - DNA, 16 bp, M. musculus
tttcttcaaaacacag

SEQ ID NO: 459442 - DNA, 16 bp, M. musculus
tttcttcaaggacaca

SEQ ID NO: 459443 - DNA, 16 bp, M. musculus
tttcttcaatgatttt

SEQ ID NO: 459444 - DNA, 16 bp, M. musculus
tttcttcagaaacttg

SEQ ID NO: 459445 - DNA, 16 bp, M. musculus
tttcttcagaaatttg

SEQ ID NO: 459446 - DNA, 16 bp, M. musculus
tttcttcagagcattt

SEQ ID NO: 459447 - DNA, 16 bp, M. musculus
tttcttcaggatctat

SEQ ID NO: 459448 - DNA, 16 bp, M. musculus
tttcttcaggattgaa

SEQ ID NO: 459449 - DNA, 16 bp, M. musculus
tttcttcaggttccat

SEQ ID NO: 459450 - DNA, 16 bp, M. musculus
tttcttcaggttctat

SEQ ID NO: 459451 - DNA, 16 bp, M. musculus
tttcttcagttccttt

SEQ ID NO: 459452 - DNA, 16 bp, M. musculus
tttcttcagttgagaa

SEQ ID NO: 459453 - DNA, 16 bp, M. musculus
tttcttcataccattt

SEQ ID NO: 459454 - DNA, 16 bp, M. musculus
tttcttcatctatgtt

SEQ ID NO: 459455 - DNA, 16 bp, M. musculus
tttcttcatttgaaat

SEQ ID NO: 459456 - DNA, 16 bp, M. musculus
tttcttcattttgaaa

SEQ ID NO: 459457 - DNA, 16 bp, M. musculus
tttcttccactgaatg

SEQ ID NO: 459458 - DNA, 16 bp, M. musculus
tttcttccagaggtcc

SEQ ID NO: 459459 - DNA, 16 bp, M. musculus
tttcttccagcttttc

SEQ ID NO: 459460 - DNA, 16 bp, M. musculus
tttcttcccaagtgct

SEQ ID NO: 459461 - DNA, 16 bp, M. musculus
tttcttcccatctact

SEQ ID NO: 459462 - DNA, 16 bp, M. musculus
tttcttcccccaaatt

SEQ ID NO: 459463 - DNA, 16 bp, M. musculus
tttcttcctgctggag

SEQ ID NO: 459464 - DNA, 16 bp, M. musculus
tttcttccttcaaaag

SEQ ID NO: 459465 - DNA, 16 bp, M. musculus
tttcttccttcagtgt

SEQ ID NO: 459466 - DNA, 16 bp, M. musculus
tttcttccttccatgt

SEQ ID NO: 459467 - DNA, 16 bp, M. musculus
tttcttcctttagaaa

SEQ ID NO: 459468 - DNA, 16 bp, M. musculus
tttcttccttttaaaa

SEQ ID NO: 459469 - DNA, 16 bp, M. musculus
tttcttcggaccattt

SEQ ID NO: 459470 - DNA, 16 bp, M. musculus
tttcttctaaaaaaaa

SEQ ID NO: 459471 - DNA, 16 bp, M. musculus
tttcttctaaaatctt

SEQ ID NO: 459472 - DNA, 16 bp, M. musculus
tttcttctaaggtccc

SEQ ID NO: 459473 - DNA, 16 bp, M. musculus
tttcttctaggctctg

SEQ ID NO: 459474 - DNA, 16 bp, M. musculus
tttcttctaggttttc

SEQ ID NO: 459475 - DNA, 16 bp, M. musculus
tttcttctcccaccca

SEQ ID NO: 459476 - DNA, 16 bp, M. musculus
tttcttctgattatta

SEQ ID NO: 459477 - DNA, 16 bp, M. musculus
tttcttctggaaaaaa

SEQ ID NO: 459478 - DNA, 16 bp, M. musculus
tttcttctgtgatctt

SEQ ID NO: 459479 - DNA, 16 bp, M. musculus
tttcttctgtgcattt

SEQ ID NO: 459480 - DNA, 16 bp, M. musculus
tttcttctgttttgca

SEQ ID NO: 459481 - DNA, 16 bp, M. musculus
tttcttcttaaaaata

SEQ ID NO: 459482 - DNA, 16 bp, M. musculus
tttcttcttaaagttt

SEQ ID NO: 459483 - DNA, 16 bp, M. musculus
tttcttcttatgaaat

SEQ ID NO: 459484 - DNA, 16 bp, M. musculus
tttcttcttcagagac

SEQ ID NO: 459485 - DNA, 16 bp, M. musculus
tttcttcttcccaagt

SEQ ID NO: 459486 - DNA, 16 bp, M. musculus
tttcttcttccctgaa

SEQ ID NO: 459487 - DNA, 16 bp, M. musculus
tttcttcttctgagaa

SEQ ID NO: 459488 - DNA, 16 bp, M. musculus
tttcttcttgagttct

SEQ ID NO: 459489 - DNA, 16 bp, M. musculus
tttcttcttgggcttc

SEQ ID NO: 459490 - DNA, 16 bp, M. musculus
tttcttctttaaggat

SEQ ID NO: 459491 - DNA, 16 bp, M. musculus
tttcttcttttgagaa

SEQ ID NO: 459492 - DNA, 16 bp, M. musculus
tttcttcttttggaaa

SEQ ID NO: 459493 - DNA, 16 bp, M. musculus
tttcttgaaatatttt

SEQ ID NO: 459494 - DNA, 16 bp, M. musculus
tttcttgaagacattt

SEQ ID NO: 459495 - DNA, 16 bp, M. musculus
tttcttgagacaggtt

SEQ ID NO: 459496 - DNA, 16 bp, M. musculus
tttcttggaaaaaaaa

SEQ ID NO: 459497 - DNA, 16 bp, M. musculus
tttcttggagacaggg

SEQ ID NO: 459498 - DNA, 16 bp, M. musculus
tttcttggccaggaat

SEQ ID NO: 459499 - DNA, 16 bp, M. musculus
tttcttggccattaga

SEQ ID NO: 459500 - DNA, 17 bp, M. musculus
tttcttggggctatggc

SEQ ID NO: 459501 - DNA, 16 bp, M. musculus
tttcttggttaatgat

SEQ ID NO: 459502 - DNA, 16 bp, M. musculus
tttcttgtagacagaa

SEQ ID NO: 459503 - DNA, 16 bp, M. musculus
tttcttgtagatagga

SEQ ID NO: 459504 - DNA, 16 bp, M. musculus
tttcttgtatctattg

SEQ ID NO: 459505 - DNA, 16 bp, M. musculus
tttcttgtattttaaa

SEQ ID NO: 459506 - DNA, 16 bp, M. musculus
tttcttgtcaccaaat

SEQ ID NO: 459507 - DNA, 16 bp, M. musculus
tttcttgttttaaaat

SEQ ID NO: 459508 - DNA, 16 bp, M. musculus
tttcttgttttgaaaa

SEQ ID NO: 459509 - DNA, 16 bp, M. musculus
tttcttgtttttaaaa

SEQ ID NO: 459510 - DNA, 16 bp, M. musculus
tttctttaaaaaagaa

SEQ ID NO: 459511 - DNA, 16 bp, M. musculus
tttctttaaaaacatg

SEQ ID NO: 459512 - DNA, 16 bp, M. musculus
tttctttaaaaactca

SEQ ID NO: 459513 - DNA, 16 bp, M. musculus
tttctttaaaaactgt

SEQ ID NO: 459514 - DNA, 16 bp, M. musculus
tttctttaaaaagtaa

SEQ ID NO: 459515 - DNA, 16 bp, M. musculus
tttctttaaaactaaa

SEQ ID NO: 459516 - DNA, 16 bp, M. musculus
tttctttaaaatgtat

SEQ ID NO: 459517 - DNA, 16 bp, M. musculus
tttctttaaagaaaaa

SEQ ID NO: 459518 - DNA, 16 bp, M. musculus
tttctttaaagattta

SEQ ID NO: 459519 - DNA, 16 bp, M. musculus
tttctttaagaaaaaa

SEQ ID NO: 459520 - DNA, 16 bp, M. musculus
tttctttaagaatttt

SEQ ID NO: 459521 - DNA, 16 bp, M. musculus
tttctttaagtgtttc

SEQ ID NO: 459522 - DNA, 16 bp, M. musculus
tttctttaataaaatg

SEQ ID NO: 459523 - DNA, 16 bp, M. musculus
tttctttaatcctcac

SEQ ID NO: 459524 - DNA, 16 bp, M. musculus
tttctttaatggagtt

SEQ ID NO: 459525 - DNA, 16 bp, M. musculus
tttctttacgtgcttc

SEQ ID NO: 459526 - DNA, 16 bp, M. musculus
tttctttagaaaacaa

SEQ ID NO: 459527 - DNA, 16 bp, M. musculus
tttctttagggatgtg

SEQ ID NO: 459528 - DNA, 16 bp, M. musculus
tttctttaggggtgtg

SEQ ID NO: 459529 - DNA, 16 bp, M. musculus
tttctttaggtatggg

SEQ ID NO: 459530 - DNA, 16 bp, M. musculus
tttctttatatgaaaa

SEQ ID NO: 459531 - DNA, 16 bp, M. musculus
tttctttatccatttg

SEQ ID NO: 459532 - DNA, 16 bp, M. musculus
tttctttatggaaaat

SEQ ID NO: 459533 - DNA, 16 bp, M. musculus
tttctttatgtacatt

SEQ ID NO: 459534 - DNA, 16 bp, M. musculus
tttctttattaggtat

SEQ ID NO: 459535 - DNA, 16 bp, M. musculus
tttctttattcattag

SEQ ID NO: 459536 - DNA, 16 bp, M. musculus
tttctttattgtgcct

SEQ ID NO: 459537 - DNA, 16 bp, M. musculus
tttctttcactgttgt

SEQ ID NO: 459538 - DNA, 16 bp, M. musculus
tttctttcactgtttg

SEQ ID NO: 459539 - DNA, 16 bp, M. musculus
tttctttccactacct

SEQ ID NO: 459540 - DNA, 16 bp, M. musculus
tttctttccctgtagc

SEQ ID NO: 459541 - DNA, 16 bp, M. musculus
tttctttcctagaatt

SEQ ID NO: 459542 - DNA, 16 bp, M. musculus
tttctttcctatctag

SEQ ID NO: 459543 - DNA, 16 bp, M. musculus
tttctttctcaaaaat

SEQ ID NO: 459544 - DNA, 16 bp, M. musculus
tttctttctcaccctg

SEQ ID NO: 459545 - DNA, 16 bp, M. musculus
tttctttctcactgcc

SEQ ID NO: 459546 - DNA, 16 bp, M. musculus
tttctttctcagtctg

SEQ ID NO: 459547 - DNA, 16 bp, M. musculus
tttctttctccagttt

SEQ ID NO: 459548 - DNA, 16 bp, M. musculus
tttctttctctttgag

SEQ ID NO: 459549 - DNA, 16 bp, M. musculus
tttctttcttaaaatg

SEQ ID NO: 459550 - DNA, 16 bp, M. musculus
tttctttcttagcttg

SEQ ID NO: 459551 - DNA, 16 bp, M. musculus
tttctttcttcagagt

SEQ ID NO: 459552 - DNA, 16 bp, M. musculus
tttctttcttctctga

SEQ ID NO: 459553 - DNA, 16 bp, M. musculus
tttctttcttctgaga

SEQ ID NO: 459554 - DNA, 16 bp, M. musculus
tttctttcttgaaaga

SEQ ID NO: 459555 - DNA, 16 bp, M. musculus
tttctttcttgagaaa

SEQ ID NO: 459556 - DNA, 16 bp, M. musculus
tttctttctttgaaat

SEQ ID NO: 459557 - DNA, 16 bp, M. musculus
tttctttgaaaaacaa

SEQ ID NO: 459558 - DNA, 16 bp, M. musculus
tttctttgaaaaatgt

SEQ ID NO: 459559 - DNA, 16 bp, M. musculus
tttctttgaaaagaaa

SEQ ID NO: 459560 - DNA, 16 bp, M. musculus
tttctttgaattttaa

SEQ ID NO: 459561 - DNA, 16 bp, M. musculus
tttctttgacagttgt

SEQ ID NO: 459562 - DNA, 16 bp, M. musculus
tttctttgagaaaata

SEQ ID NO: 459563 - DNA, 16 bp, M. musculus
tttctttgagaagaaa

SEQ ID NO: 459564 - DNA, 16 bp, M. musculus
tttctttgagacaaag

SEQ ID NO: 459565 - DNA, 16 bp, M. musculus
tttctttgagacctaa

SEQ ID NO: 459566 - DNA, 16 bp, M. musculus
tttctttgagtctgta

SEQ ID NO: 459567 - DNA, 16 bp, M. musculus
tttctttggaagaaaa

SEQ ID NO: 459568 - DNA, 16 bp, M. musculus
tttctttggaccattt

SEQ ID NO: 459569 - DNA, 16 bp, M. musculus
tttctttggatcattt

SEQ ID NO: 459570 - DNA, 16 bp, M. musculus
tttctttggctcacag

SEQ ID NO: 459571 - DNA, 16 bp, M. musculus
tttctttggtgatgaa

SEQ ID NO: 459572 - DNA, 16 bp, M. musculus
tttctttgtaaatgtg

SEQ ID NO: 459573 - DNA, 16 bp, M. musculus
tttctttgtaaccaca

SEQ ID NO: 459574 - DNA, 16 bp, M. musculus
tttctttgttaaatat

SEQ ID NO: 459575 - DNA, 16 bp, M. musculus
tttctttgttcagtct

SEQ ID NO: 459576 - DNA, 16 bp, M. musculus
tttctttgttttcaaa

SEQ ID NO: 459577 - DNA, 16 bp, M. musculus
tttcttttaaaaattg

SEQ ID NO: 459578 - DNA, 16 bp, M. musculus
tttcttttaaaagaaa

SEQ ID NO: 459579 - DNA, 16 bp, M. musculus
tttcttttaaatatgt

SEQ ID NO: 459580 - DNA, 16 bp, M. musculus
tttcttttaaatttga

SEQ ID NO: 459581 - DNA, 16 bp, M. musculus
tttcttttaataagag

SEQ ID NO: 459582 - DNA, 16 bp, M. musculus
tttcttttagaaatgt

SEQ ID NO: 459583 - DNA, 16 bp, M. musculus
tttcttttataagaaa

SEQ ID NO: 459584 - DNA, 16 bp, M. musculus
tttcttttataagact

SEQ ID NO: 459585 - DNA, 16 bp, M. musculus
tttcttttataagctg

SEQ ID NO: 459586 - DNA, 16 bp, M. musculus
tttcttttatccttga

SEQ ID NO: 459587 - DNA, 16 bp, M. musculus
tttcttttatgaatgt

SEQ ID NO: 459588 - DNA, 16 bp, M. musculus
tttcttttattagata

SEQ ID NO: 459589 - DNA, 16 bp, M. musculus
tttcttttcaagattt

SEQ ID NO: 459590 - DNA, 16 bp, M. musculus
tttcttttcctataaa

SEQ ID NO: 459591 - DNA, 16 bp, M. musculus
tttcttttctaagaaa

SEQ ID NO: 459592 - DNA, 16 bp, M. musculus
tttcttttctcataaa

SEQ ID NO: 459593 - DNA, 16 bp, M. musculus
tttcttttctcgtcca

SEQ ID NO: 459594 - DNA, 16 bp, M. musculus
tttcttttctgaaaat

SEQ ID NO: 459595 - DNA, 16 bp, M. musculus
tttcttttctgttcca

SEQ ID NO: 459596 - DNA, 16 bp, M. musculus
tttcttttcttcatga

SEQ ID NO: 459597 - DNA, 16 bp, M. musculus
tttcttttcttctaga

SEQ ID NO: 459598 - DNA, 16 bp, M. musculus
tttcttttgaaaaaat

SEQ ID NO: 459599 - DNA, 16 bp, M. musculus
tttcttttgaaaattt

SEQ ID NO: 459600 - DNA, 16 bp, M. musculus
tttcttttgaaagaaa

SEQ ID NO: 459601 - DNA, 16 bp, M. musculus
tttcttttgaaattaa

SEQ ID NO: 459602 - DNA, 16 bp, M. musculus
tttcttttgatgagta

SEQ ID NO: 459603 - DNA, 16 bp, M. musculus
tttcttttggctcaca

SEQ ID NO: 459604 - DNA, 16 bp, M. musculus
tttcttttgtaaaatg

SEQ ID NO: 459605 - DNA, 16 bp, M. musculus
tttcttttgtaaataa

SEQ ID NO: 459606 - DNA, 16 bp, M. musculus
tttcttttgtcttgca

SEQ ID NO: 459607 - DNA, 16 bp, M. musculus
tttctttttaaaaggt

SEQ ID NO: 459608 - DNA, 16 bp, M. musculus
tttctttttaaaatgt

SEQ ID NO: 459609 - DNA, 16 bp, M. musculus
tttctttttaaactgt

SEQ ID NO: 459610 - DNA, 16 bp, M. musculus
tttctttttaaaggaa

SEQ ID NO: 459611 - DNA, 16 bp, M. musculus
tttctttttaaaggca

SEQ ID NO: 459612 - DNA, 16 bp, M. musculus
tttctttttaaatgtg

SEQ ID NO: 459613 - DNA, 16 bp, M. musculus
tttctttttaaattgg

SEQ ID NO: 459614 - DNA, 16 bp, M. musculus
tttctttttaatagct

SEQ ID NO: 459615 - DNA, 16 bp, M. musculus
tttctttttagaaata

SEQ ID NO: 459616 - DNA, 16 bp, M. musculus
tttctttttcctgtga

SEQ ID NO: 459617 - DNA, 16 bp, M. musculus
tttctttttgaaagaa

SEQ ID NO: 459618 - DNA, 16 bp, M. musculus
tttctttttgagacag

SEQ ID NO: 459619 - DNA, 16 bp, M. musculus
tttctttttgagatta

SEQ ID NO: 459620 - DNA, 16 bp, M. musculus
tttctttttggagaca

SEQ ID NO: 459621 - DNA, 16 bp, M. musculus
tttcttttttaaaaag

SEQ ID NO: 459622 - DNA, 16 bp, M. musculus
tttcttttttaaatga

SEQ ID NO: 459623 - DNA, 16 bp, M. musculus
tttcttttttaagaat

SEQ ID NO: 459624 - DNA, 16 bp, M. musculus
tttcttttttgaaaca

SEQ ID NO: 459625 - DNA, 16 bp, M. musculus
tttcttttttgaaact

SEQ ID NO: 459626 - DNA, 16 bp, M. musculus
tttctttttttaaaga

SEQ ID NO: 459627 - DNA, 16 bp, M. musculus
tttgaaaaaaaattct

SEQ ID NO: 459628 - DNA, 16 bp, M. musculus
tttgaaaaacaaaaac

SEQ ID NO: 459629 - DNA, 16 bp, M. musculus
tttgaaaaagaaacaa

SEQ ID NO: 459630 - DNA, 16 bp, M. musculus
tttgaaaaagaaatgt

SEQ ID NO: 459631 - DNA, 16 bp, M. musculus
tttgaaaaagaagcca

SEQ ID NO: 459632 - DNA, 16 bp, M. musculus
tttgaaaaattaaaca

SEQ ID NO: 459633 - DNA, 16 bp, M. musculus
tttgaaaaattacatt

SEQ ID NO: 459634 - DNA, 16 bp, M. musculus
tttgaaaacaaaacca

SEQ ID NO: 459635 - DNA, 16 bp, M. musculus
tttgaaaacatgtttt

SEQ ID NO: 459636 - DNA, 16 bp, M. musculus
tttgaaaacattgaat

SEQ ID NO: 459637 - DNA, 16 bp, M. musculus
tttgaaaactacattt

SEQ ID NO: 459638 - DNA, 16 bp, M. musculus
tttgaaaactattttt

SEQ ID NO: 459639 - DNA, 16 bp, M. musculus
tttgaaaagaactgta

SEQ ID NO: 459640 - DNA, 16 bp, M. musculus
tttgaaaagaagaaat

SEQ ID NO: 459641 - DNA, 16 bp, M. musculus
tttgaaaaggagaaag

SEQ ID NO: 459642 - DNA, 16 bp, M. musculus
tttgaaaatatgaaat

SEQ ID NO: 459643 - DNA, 16 bp, M. musculus
tttgaaaatattttct

SEQ ID NO: 459644 - DNA, 16 bp, M. musculus
tttgaaaatgaaatgt

SEQ ID NO: 459645 - DNA, 16 bp, M. musculus
tttgaaaatgaagaaa

SEQ ID NO: 459646 - DNA, 16 bp, M. musculus
tttgaaaatgaagaag

SEQ ID NO: 459647 - DNA, 16 bp, M. musculus
tttgaaaatgatgtct

SEQ ID NO: 459648 - DNA, 16 bp, M. musculus
tttgaaaatgcaaatg

SEQ ID NO: 459649 - DNA, 16 bp, M. musculus
tttgaaaattaatgaa

SEQ ID NO: 459650 - DNA, 16 bp, M. musculus
tttgaaaattcttttt

SEQ ID NO: 459651 - DNA, 16 bp, M. musculus
tttgaaacaagttctc

SEQ ID NO: 459652 - DNA, 16 bp, M. musculus
tttgaaacagagtctt

SEQ ID NO: 459653 - DNA, 16 bp, M. musculus
tttgaaacagagtttt

SEQ ID NO: 459654 - DNA, 16 bp, M. musculus
tttgaaacagggtctc

SEQ ID NO: 459655 - DNA, 16 bp, M. musculus
tttgaaacattttttt

SEQ ID NO: 459656 - DNA, 16 bp, M. musculus
tttgaaaccccaaagc

SEQ ID NO: 459657 - DNA, 16 bp, M. musculus
tttgaaacctcaaaac

SEQ ID NO: 459658 - DNA, 16 bp, M. musculus
tttgaaactttttaaa

SEQ ID NO: 459659 - DNA, 16 bp, M. musculus
tttgaaagaaaatggc

SEQ ID NO: 459660 - DNA, 16 bp, M. musculus
tttgaaagaaagaaag

SEQ ID NO: 459661 - DNA, 16 bp, M. musculus
tttgaaagacagcaag

SEQ ID NO: 459662 - DNA, 16 bp, M. musculus
tttgaaagagaaaata

SEQ ID NO: 459663 - DNA, 16 bp, M. musculus
tttgaaagagaggaag

SEQ ID NO: 459664 - DNA, 16 bp, M. musculus
tttgaaagatatattt

SEQ ID NO: 459665 - DNA, 16 bp, M. musculus
tttgaaagatcaggaa

SEQ ID NO: 459666 - DNA, 16 bp, M. musculus
tttgaaaggaaataaa

SEQ ID NO: 459667 - DNA, 16 bp, M. musculus
tttgaaagtgatgtct

SEQ ID NO: 459668 - DNA, 16 bp, M. musculus
tttgaaataaaaacaa

SEQ ID NO: 459669 - DNA, 16 bp, M. musculus
tttgaaataaaagttt

SEQ ID NO: 459670 - DNA, 16 bp, M. musculus
tttgaaataaattact

SEQ ID NO: 459671 - DNA, 16 bp, M. musculus
tttgaaataacatttt

SEQ ID NO: 459672 - DNA, 16 bp, M. musculus
tttgaaatacacttta

SEQ ID NO: 459673 - DNA, 16 bp, M. musculus
tttgaaatactatttt

SEQ ID NO: 459674 - DNA, 16 bp, M. musculus
tttgaaatattaaaag

SEQ ID NO: 459675 - DNA, 16 bp, M. musculus
tttgaaatatttaaca

SEQ ID NO: 459676 - DNA, 16 bp, M. musculus
tttgaaatcatgtttt

SEQ ID NO: 459677 - DNA, 16 bp, M. musculus
tttgaaatctattttg

SEQ ID NO: 459678 - DNA, 16 bp, M. musculus
tttgaaatgaaaagaa

SEQ ID NO: 459679 - DNA, 16 bp, M. musculus
tttgaaatgaacattt

SEQ ID NO: 459680 - DNA, 16 bp, M. musculus
tttgaaatgcaaatga

SEQ ID NO: 459681 - DNA, 16 bp, M. musculus
tttgaaatgtaaagga

SEQ ID NO: 459682 - DNA, 16 bp, M. musculus
tttgaaatgtaaatta

SEQ ID NO: 459683 - DNA, 17 bp, M. musculus
tttgaaatgtatatgaa

SEQ ID NO: 459684 - DNA, 16 bp, M. musculus
tttgaaattcagccaa

SEQ ID NO: 459685 - DNA, 16 bp, M. musculus
tttgaaattcctcagt

SEQ ID NO: 459686 - DNA, 16 bp, M. musculus
tttgaaatttatttct

SEQ ID NO: 459687 - DNA, 16 bp, M. musculus
tttgaaatttcacaag

SEQ ID NO: 459688 - DNA, 16 bp, M. musculus
tttgaaatttcctttg

SEQ ID NO: 459689 - DNA, 16 bp, M. musculus
tttgaacagaccagac

SEQ ID NO: 459690 - DNA, 16 bp, M. musculus
tttgaacatttggttc

SEQ ID NO: 459691 - DNA, 16 bp, M. musculus
tttgaacccagggctt

SEQ ID NO: 459692 - DNA, 16 bp, M. musculus
tttgaactcactctgt

SEQ ID NO: 459693 - DNA, 16 bp, M. musculus
tttgaactcagaacct

SEQ ID NO: 459694 - DNA, 16 bp, M. musculus
tttgaactcatgtcct

SEQ ID NO: 459695 - DNA, 17 bp, M. musculus
tttgaactccagacctt

SEQ ID NO: 459696 - DNA, 17 bp, M. musculus
tttgaactccggacctt

SEQ ID NO: 459697 - DNA, 16 bp, M. musculus
tttgaactctcagaga

SEQ ID NO: 459698 - DNA, 17 bp, M. musculus
tttgaactctggacctt

SEQ ID NO: 459699 - DNA, 20 bp, M. musculus
tttgaactctggaccttcag

SEQ ID NO: 459700 - DNA, 16 bp, M. musculus
tttgaactgctgagcc

SEQ ID NO: 459701 - DNA, 16 bp, M. musculus
tttgaactggactgtt

SEQ ID NO: 459702 - DNA, 16 bp, M. musculus
tttgaacttgggacct

SEQ ID NO: 459703 - DNA, 16 bp, M. musculus
tttgaacttgtgatcc

SEQ ID NO: 459704 - DNA, 17 bp, M. musculus
tttgaactttggacctt

SEQ ID NO: 459705 - DNA, 16 bp, M. musculus
tttgaacttttaaaag

SEQ ID NO: 459706 - DNA, 16 bp, M. musculus
tttgaagaaaataaag

SEQ ID NO: 459707 - DNA, 16 bp, M. musculus
tttgaagaaactgagg

SEQ ID NO: 459708 - DNA, 16 bp, M. musculus
tttgaagaaagaaatc

SEQ ID NO: 459709 - DNA, 16 bp, M. musculus
tttgaagaaagagaaa

SEQ ID NO: 459710 - DNA, 16 bp, M. musculus
tttgaagaagatatca

SEQ ID NO: 459711 - DNA, 16 bp, M. musculus
tttgaagaattgaatt

SEQ ID NO: 459712 - DNA, 16 bp, M. musculus
tttgaagaattgtttt

SEQ ID NO: 459713 - DNA, 16 bp, M. musculus
tttgaagacagtgaca

SEQ ID NO: 459714 - DNA, 16 bp, M. musculus
tttgaagagagaagct

SEQ ID NO: 459715 - DNA, 16 bp, M. musculus
tttgaagaggaaacta

SEQ ID NO: 459716 - DNA, 16 bp, M. musculus
tttgaagatgttttct

SEQ ID NO: 459717 - DNA, 16 bp, M. musculus
tttgaagattccttcc

SEQ ID NO: 459718 - DNA, 16 bp, M. musculus
tttgaagcaagcttta

SEQ ID NO: 459719 - DNA, 16 bp, M. musculus
tttgaagcaaggtttc

SEQ ID NO: 459720 - DNA, 16 bp, M. musculus
tttgaagccaacctag

SEQ ID NO: 459721 - DNA, 16 bp, M. musculus
tttgaagctagcctga

SEQ ID NO: 459722 - DNA, 16 bp, M. musculus
tttgaagctatcctgg

SEQ ID NO: 459723 - DNA, 16 bp, M. musculus
tttgaagctgactggg

SEQ ID NO: 459724 - DNA, 16 bp, M. musculus
tttgaagctggcctgg

SEQ ID NO: 459725 - DNA, 16 bp, M. musculus
tttgaaggaatgaagg

SEQ ID NO: 459726 - DNA, 17 bp, M. musculus
tttgaaggactgataga

SEQ ID NO: 459727 - DNA, 16 bp, M. musculus
tttgaaggactggatt

SEQ ID NO: 459728 - DNA, 17 bp, M. musculus
tttgaaggattaataga

SEQ ID NO: 459729 - DNA, 17 bp, M. musculus
tttgaaggattgataga

SEQ ID NO: 459730 - DNA, 16 bp, M. musculus
tttgaaggcatgaggg

SEQ ID NO: 459731 - DNA, 16 bp, M. musculus
tttgaaggccagaaga

SEQ ID NO: 459732 - DNA, 17 bp, M. musculus
tttgaaggtctaataga

SEQ ID NO: 459733 - DNA, 16 bp, M. musculus
tttgaagtggaaattt

SEQ ID NO: 459734 - DNA, 16 bp, M. musculus
tttgaagttaaataaa

SEQ ID NO: 459735 - DNA, 16 bp, M. musculus
tttgaagtttcagaaa

SEQ ID NO: 459736 - DNA, 16 bp, M. musculus
tttgaataaaaatggt

SEQ ID NO: 459737 - DNA, 16 bp, M. musculus
tttgaatacttggtcc

SEQ ID NO: 459738 - DNA, 16 bp, M. musculus
tttgaatagatttggc

SEQ ID NO: 459739 - DNA, 16 bp, M. musculus
tttgaataggaatggc

SEQ ID NO: 459740 - DNA, 17 bp, M. musculus
tttgaatagtttttctt

SEQ ID NO: 459741 - DNA, 16 bp, M. musculus
tttgaatattaaatgt

SEQ ID NO: 459742 - DNA, 16 bp, M. musculus
tttgaatattatttct

SEQ ID NO: 459743 - DNA, 16 bp, M. musculus
tttgaatattctttct

SEQ ID NO: 459744 - DNA, 16 bp, M. musculus
tttgaatcttgctttt

SEQ ID NO: 459745 - DNA, 16 bp, M. musculus
tttgaatgagatgttc

SEQ ID NO: 459746 - DNA, 16 bp, M. musculus
tttgaatgcttgaccc

SEQ ID NO: 459747 - DNA, 16 bp, M. musculus
tttgaatgtaaacaaa

SEQ ID NO: 459748 - DNA, 16 bp, M. musculus
tttgaattaattttct

SEQ ID NO: 459749 - DNA, 26 bp, M. musculus
tttgaattacttacaggtcagggaca

SEQ ID NO: 459750 - DNA, 16 bp, M. musculus
tttgaattatattttc

SEQ ID NO: 459751 - DNA, 16 bp, M. musculus
tttgaattctgtgaac

SEQ ID NO: 459752 - DNA, 16 bp, M. musculus
tttgaattcttggtcc

SEQ ID NO: 459753 - DNA, 16 bp, M. musculus
tttgaattcttggtct

SEQ ID NO: 459754 - DNA, 16 bp, M. musculus
tttgaatttcatgaag

SEQ ID NO: 459755 - DNA, 16 bp, M. musculus
tttgaatttccctgat

SEQ ID NO: 459756 - DNA, 16 bp, M. musculus
tttgaatttctggaat

SEQ ID NO: 459757 - DNA, 16 bp, M. musculus
tttgaatttgcttggc

SEQ ID NO: 459758 - DNA, 16 bp, M. musculus
tttgaattttaaaaga

SEQ ID NO: 459759 - DNA, 16 bp, M. musculus
tttgaattttaaacat

SEQ ID NO: 459760 - DNA, 16 bp, M. musculus
tttgaattttcctctt

SEQ ID NO: 459761 - DNA, 16 bp, M. musculus
tttgaattttctttga

SEQ ID NO: 459762 - DNA, 16 bp, M. musculus
tttgaatttttctaca

SEQ ID NO: 459763 - DNA, 16 bp, M. musculus
tttgaattttttgaga

SEQ ID NO: 459764 - DNA, 16 bp, M. musculus
tttgacaaaatccaaa

SEQ ID NO: 459765 - DNA, 16 bp, M. musculus
tttgacaaaatctaac

SEQ ID NO: 459766 - DNA, 16 bp, M. musculus
tttgacaaaattacat

SEQ ID NO: 459767 - DNA, 16 bp, M. musculus
tttgacaaagaagata

SEQ ID NO: 459768 - DNA, 16 bp, M. musculus
tttgacaagctggcag

SEQ ID NO: 459769 - DNA, 16 bp, M. musculus
tttgacaatttcatac

SEQ ID NO: 459770 - DNA, 16 bp, M. musculus
tttgacaatttcctgc

SEQ ID NO: 459771 - DNA, 16 bp, M. musculus
tttgacactgaggtac

SEQ ID NO: 459772 - DNA, 16 bp, M. musculus
tttgacatctaaattt

SEQ ID NO: 459773 - DNA, 16 bp, M. musculus
tttgacatctgatcag

SEQ ID NO: 459774 - DNA, 16 bp, M. musculus
tttgacatttatttta

SEQ ID NO: 459775 - DNA, 16 bp, M. musculus
tttgaccagaaaagaa

SEQ ID NO: 459776 - DNA, 16 bp, M. musculus
tttgaccatggtgttt

SEQ ID NO: 459777 - DNA, 16 bp, M. musculus
tttgacctccacaggc

SEQ ID NO: 459778 - DNA, 16 bp, M. musculus
tttgacctttgacctt

SEQ ID NO: 459779 - DNA, 16 bp, M. musculus
tttgactcacagttca

SEQ ID NO: 459780 - DNA, 17 bp, M. musculus
tttgactcctctggtgt

SEQ ID NO: 459781 - DNA, 16 bp, M. musculus
tttgactgcaaatttc

SEQ ID NO: 459782 - DNA, 16 bp, M. musculus
tttgactgggttgttt

SEQ ID NO: 459783 - DNA, 16 bp, M. musculus
tttgactgtgggatga

SEQ ID NO: 459784 - DNA, 16 bp, M. musculus
tttgactgtgtgatgg

SEQ ID NO: 459785 - DNA, 16 bp, M. musculus
tttgactgttgtgtca

SEQ ID NO: 459786 - DNA, 17 bp, M. musculus
tttgacttcctcttttc

SEQ ID NO: 459787 - DNA, 16 bp, M. musculus
tttgacttcttcattt

SEQ ID NO: 459788 - DNA, 16 bp, M. musculus
tttgacttttaaaata

SEQ ID NO: 459789 - DNA, 16 bp, M. musculus
tttgactttttaaaat

SEQ ID NO: 459790 - DNA, 16 bp, M. musculus
tttgactttttgagac

SEQ ID NO: 459791 - DNA, 16 bp, M. musculus
tttgagaaaaccaaca

SEQ ID NO: 459792 - DNA, 16 bp, M. musculus
tttgagaaaatcaaaa

SEQ ID NO: 459793 - DNA, 16 bp, M. musculus
tttgagaaaatcaaga

SEQ ID NO: 459794 - DNA, 17 bp, M. musculus
tttgagaaaatcagcaa

SEQ ID NO: 459795 - DNA, 16 bp, M. musculus
tttgagaaactgggaa

SEQ ID NO: 459796 - DNA, 16 bp, M. musculus
tttgagaagaattagg

SEQ ID NO: 459797 - DNA, 16 bp, M. musculus
tttgagaagataaaca

SEQ ID NO: 459798 - DNA, 16 bp, M. musculus
tttgagaagtattgat

SEQ ID NO: 459799 - DNA, 16 bp, M. musculus
tttgagaattataaaa

SEQ ID NO: 459800 - DNA, 16 bp, M. musculus
tttgagaattttgtat

SEQ ID NO: 459801 - DNA, 16 bp, M. musculus
tttgagacaagatctc

SEQ ID NO: 459802 - DNA, 16 bp, M. musculus
tttgagacaagctttc

SEQ ID NO: 459803 - DNA, 16 bp, M. musculus
tttgagacaaggtttt

SEQ ID NO: 459804 - DNA, 16 bp, M. musculus
tttgagacagagtcta

SEQ ID NO: 459805 - DNA, 16 bp, M. musculus
tttgagacagagtctc

SEQ ID NO: 459806 - DNA, 16 bp, M. musculus
tttgagacagagtttt

SEQ ID NO: 459807 - DNA, 16 bp, M. musculus
tttgagacagggactc

SEQ ID NO: 459808 - DNA, 16 bp, M. musculus
tttgagacagggtatc

SEQ ID NO: 459809 - DNA, 16 bp, M. musculus
tttgagacagggtcct

SEQ ID NO: 459810 - DNA, 16 bp, M. musculus
tttgagacagggtctc

SEQ ID NO: 459811 - DNA, 16 bp, M. musculus
tttgagacaggtctct

SEQ ID NO: 459812 - DNA, 16 bp, M. musculus
tttgagacaggttctt

SEQ ID NO: 459813 - DNA, 16 bp, M. musculus
tttgagacagtttctt

SEQ ID NO: 459814 - DNA, 16 bp, M. musculus
tttgagacatggtctc

SEQ ID NO: 459815 - DNA, 16 bp, M. musculus
tttgagaccctgtctc

SEQ ID NO: 459816 - DNA, 16 bp, M. musculus
tttgagacggggtctc

SEQ ID NO: 459817 - DNA, 16 bp, M. musculus
tttgagacggggtctt

SEQ ID NO: 459818 - DNA, 16 bp, M. musculus
tttgagactgggtctc

SEQ ID NO: 459819 - DNA, 16 bp, M. musculus
tttgagactttcccag

SEQ ID NO: 459820 - DNA, 16 bp, M. musculus
tttgagagaaaaagaa

SEQ ID NO: 459821 - DNA, 16 bp, M. musculus
tttgagagaaataaat

SEQ ID NO: 459822 - DNA, 16 bp, M. musculus
tttgagagaaggtctc

SEQ ID NO: 459823 - DNA, 16 bp, M. musculus
tttgagagagagagag

SEQ ID NO: 459824 - DNA, 16 bp, M. musculus
tttgagatgggtgggt

SEQ ID NO: 459825 - DNA, 16 bp, M. musculus
tttgagatggtctcat

SEQ ID NO: 459826 - DNA, 16 bp, M. musculus
tttgagatgttttgtc

SEQ ID NO: 459827 - DNA, 16 bp, M. musculus
tttgagattaaaatat

SEQ ID NO: 459828 - DNA, 16 bp, M. musculus
tttgagatttcaaaat

SEQ ID NO: 459829 - DNA, 16 bp, M. musculus
tttgagattttctttg

SEQ ID NO: 459830 - DNA, 30 bp, M. musculus
tttgagcaggtgaatcagattgccataagg

SEQ ID NO: 459831 - DNA, 16 bp, M. musculus
tttgagccaatcccaa

SEQ ID NO: 459832 - DNA, 16 bp, M. musculus
tttgagccagaacagt

SEQ ID NO: 459833 - DNA, 16 bp, M. musculus
tttgagccagggtctc

SEQ ID NO: 459834 - DNA, 16 bp, M. musculus
tttgagcccagcctgg

SEQ ID NO: 459835 - DNA, 16 bp, M. musculus
tttgagctttagtgaa

SEQ ID NO: 459836 - DNA, 18 bp, M. musculus
tttgagcttttctaaagt

SEQ ID NO: 459837 - DNA, 16 bp, M. musculus
tttgaggaaaattgga

SEQ ID NO: 459838 - DNA, 16 bp, M. musculus
tttgaggaaataaaag

SEQ ID NO: 459839 - DNA, 16 bp, M. musculus
tttgaggacagcctga

SEQ ID NO: 459840 - DNA, 16 bp, M. musculus
tttgaggacagccttg

SEQ ID NO: 459841 - DNA, 16 bp, M. musculus
tttgaggagaaaagaa

SEQ ID NO: 459842 - DNA, 16 bp, M. musculus
tttgaggagtgttgga

SEQ ID NO: 459843 - DNA, 16 bp, M. musculus
tttgaggatagcattt

SEQ ID NO: 459844 - DNA, 16 bp, M. musculus
tttgaggatagccagg

SEQ ID NO: 459845 - DNA, 27 bp, M. musculus
tttgaggatcttaaaccccactctaac

SEQ ID NO: 459846 - DNA, 16 bp, M. musculus
tttgaggatttctcct

SEQ ID NO: 459847 - DNA, 16 bp, M. musculus
tttgaggatttttaaa

SEQ ID NO: 459848 - DNA, 16 bp, M. musculus
tttgaggcaagatctc

SEQ ID NO: 459849 - DNA, 16 bp, M. musculus
tttgaggcagagtctc

SEQ ID NO: 459850 - DNA, 16 bp, M. musculus
tttgaggcagcctggg

SEQ ID NO: 459851 - DNA, 16 bp, M. musculus
tttgaggcaggctctc

SEQ ID NO: 459852 - DNA, 16 bp, M. musculus
tttgaggcagggtctc

SEQ ID NO: 459853 - DNA, 16 bp, M. musculus
tttgaggcagtgtctc

SEQ ID NO: 459854 - DNA, 16 bp, M. musculus
tttgaggccaacctgt

SEQ ID NO: 459855 - DNA, 16 bp, M. musculus
tttgaggccaccctag

SEQ ID NO: 459856 - DNA, 16 bp, M. musculus
tttgaggccagactgg

SEQ ID NO: 459857 - DNA, 16 bp, M. musculus
tttgaggccagcctgt

SEQ ID NO: 459858 - DNA, 16 bp, M. musculus
tttgaggccagcttga

SEQ ID NO: 459859 - DNA, 16 bp, M. musculus
tttgaggccaggctag

SEQ ID NO: 459860 - DNA, 16 bp, M. musculus
tttgaggcccgcctgg

SEQ ID NO: 459861 - DNA, 16 bp, M. musculus
tttgaggctagcctgt

SEQ ID NO: 459862 - DNA, 16 bp, M. musculus
tttgaggcttggcacc

SEQ ID NO: 459863 - DNA, 16 bp, M. musculus
tttgaggggctggatt

SEQ ID NO: 459864 - DNA, 16 bp, M. musculus
tttgaggtcaccctgg

SEQ ID NO: 459865 - DNA, 16 bp, M. musculus
tttgaggtctcatata

SEQ ID NO: 459866 - DNA, 16 bp, M. musculus
tttgaggtgagcctgg

SEQ ID NO: 459867 - DNA, 16 bp, M. musculus
tttgaggttttaaatg

SEQ ID NO: 459868 - DNA, 16 bp, M. musculus
tttgagtcatttctac

SEQ ID NO: 459869 - DNA, 16 bp, M. musculus
tttgagtctgtggagt

SEQ ID NO: 459870 - DNA, 16 bp, M. musculus
tttgagtctttgtgtg

SEQ ID NO: 459871 - DNA, 16 bp, M. musculus
tttgagtgaaatgttt

SEQ ID NO: 459872 - DNA, 16 bp, M. musculus
tttgagtgctgggatt

SEQ ID NO: 459873 - DNA, 16 bp, M. musculus
tttgagtgtatatgtg

SEQ ID NO: 459874 - DNA, 16 bp, M. musculus
tttgagtgtgtatgtg

SEQ ID NO: 459875 - DNA, 18 bp, M. musculus
tttgagttaggagctttt

SEQ ID NO: 459876 - DNA, 16 bp, M. musculus
tttgagttcaaggaca

SEQ ID NO: 459877 - DNA, 16 bp, M. musculus
tttgagttcaaggcca

SEQ ID NO: 459878 - DNA, 16 bp, M. musculus
tttgagttcctgtcca

SEQ ID NO: 459879 - DNA, 16 bp, M. musculus
tttgagtttgaagcca

SEQ ID NO: 459880 - DNA, 16 bp, M. musculus
tttgataaactttttt

SEQ ID NO: 459881 - DNA, 16 bp, M. musculus
tttgataagatggcca

SEQ ID NO: 459882 - DNA, 16 bp, M. musculus
tttgatacaaggtctt

SEQ ID NO: 459883 - DNA, 16 bp, M. musculus
tttgatactgttgttc

SEQ ID NO: 459884 - DNA, 16 bp, M. musculus
tttgatagaaggaaga

SEQ ID NO: 459885 - DNA, 16 bp, M. musculus
tttgatagtctctggt

SEQ ID NO: 459886 - DNA, 16 bp, M. musculus
tttgatatgtatgaag

SEQ ID NO: 459887 - DNA, 16 bp, M. musculus
tttgatatgttaagta

SEQ ID NO: 459888 - DNA, 16 bp, M. musculus
tttgatattagaatag

SEQ ID NO: 459889 - DNA, 17 bp, M. musculus
tttgatattcctcaggt

SEQ ID NO: 459890 - DNA, 16 bp, M. musculus
tttgatatttgaatgg

SEQ ID NO: 459891 - DNA, 16 bp, M. musculus
tttgatcatttctcta

SEQ ID NO: 459892 - DNA, 16 bp, M. musculus
tttgatccacttggac

SEQ ID NO: 459893 - DNA, 16 bp, M. musculus
tttgatcccaacactt

SEQ ID NO: 459894 - DNA, 16 bp, M. musculus
tttgatcccagcattc

SEQ ID NO: 459895 - DNA, 16 bp, M. musculus
tttgatcccagccctt

SEQ ID NO: 459896 - DNA, 16 bp, M. musculus
tttgatccccagcacc

SEQ ID NO: 459897 - DNA, 16 bp, M. musculus
tttgatccctagaacc

SEQ ID NO: 459898 - DNA, 16 bp, M. musculus
tttgatcctcagcaca

SEQ ID NO: 459899 - DNA, 16 bp, M. musculus
tttgatcctcagcact

SEQ ID NO: 459900 - DNA, 16 bp, M. musculus
tttgatccttagaacc

SEQ ID NO: 459901 - DNA, 16 bp, M. musculus
tttgatccttggaacc

SEQ ID NO: 459902 - DNA, 16 bp, M. musculus
tttgatctccttgatg

SEQ ID NO: 459903 - DNA, 16 bp, M. musculus
tttgatctctttgtct

SEQ ID NO: 459904 - DNA, 16 bp, M. musculus
tttgatcttttcattg

SEQ ID NO: 459905 - DNA, 16 bp, M. musculus
tttgatgaaaatgaag

SEQ ID NO: 459906 - DNA, 16 bp, M. musculus
tttgatgaatatgaaa

SEQ ID NO: 459907 - DNA, 16 bp, M. musculus
tttgatgacaagagat

SEQ ID NO: 459908 - DNA, 16 bp, M. musculus
tttgatgagaacgaag

SEQ ID NO: 459909 - DNA, 16 bp, M. musculus
tttgatgagcatgaag

SEQ ID NO: 459910 - DNA, 16 bp, M. musculus
tttgatgagtatgaag

SEQ ID NO: 459911 - DNA, 20 bp, M. musculus
tttgatgataatggactgaa

SEQ ID NO: 459912 - DNA, 16 bp, M. musculus
tttgatgatgaactgt

SEQ ID NO: 459913 - DNA, 17 bp, M. musculus
tttgatgcatacaggaa

SEQ ID NO: 459914 - DNA, 16 bp, M. musculus
tttgatgccactgaac

SEQ ID NO: 459915 - DNA, 16 bp, M. musculus
tttgatgccagtctgg

SEQ ID NO: 459916 - DNA, 16 bp, M. musculus
tttgatgcccagaacc

SEQ ID NO: 459917 - DNA, 16 bp, M. musculus
tttgatggatttctgt

SEQ ID NO: 459918 - DNA, 24 bp, M. musculus
tttgatggggattgcattgaatct

SEQ ID NO: 459919 - DNA, 16 bp, M. musculus
tttgatgtcttccttt

SEQ ID NO: 459920 - DNA, 16 bp, M. musculus
tttgatgtgacactgc

SEQ ID NO: 459921 - DNA, 16 bp, M. musculus
tttgatgtgatcttgg

SEQ ID NO: 459922 - DNA, 16 bp, M. musculus
tttgatgtggtcttgg

SEQ ID NO: 459923 - DNA, 16 bp, M. musculus
tttgatgttaattcag

SEQ ID NO: 459924 - DNA, 16 bp, M. musculus
tttgatgttaattctg

SEQ ID NO: 459925 - DNA, 16 bp, M. musculus
tttgatgttggctttt

SEQ ID NO: 459926 - DNA, 16 bp, M. musculus
tttgatgttggtgatg

SEQ ID NO: 459927 - DNA, 16 bp, M. musculus
tttgatgtttcaaaag

SEQ ID NO: 459928 - DNA, 16 bp, M. musculus
tttgattccaagcacc

SEQ ID NO: 459929 - DNA, 16 bp, M. musculus
tttgattcccagcacc

SEQ ID NO: 459930 - DNA, 16 bp, M. musculus
tttgattcccagcagc

SEQ ID NO: 459931 - DNA, 16 bp, M. musculus
tttgattcctagtact

SEQ ID NO: 459932 - DNA, 19 bp, M. musculus
tttgattctctggaatcta

SEQ ID NO: 459933 - DNA, 16 bp, M. musculus
tttgattcttttaaaa

SEQ ID NO: 459934 - DNA, 16 bp, M. musculus
tttgattgctgtgtcc

SEQ ID NO: 459935 - DNA, 16 bp, M. musculus
tttgattgtgtcccat

SEQ ID NO: 459936 - DNA, 16 bp, M. musculus
tttgatttaaaatcac

SEQ ID NO: 459937 - DNA, 16 bp, M. musculus
tttgatttctccatct

SEQ ID NO: 459938 - DNA, 16 bp, M. musculus
tttgatttctttcctc

SEQ ID NO: 459939 - DNA, 23 bp, M. musculus
tttgatttgcatttccctgatgt

SEQ ID NO: 459940 - DNA, 18 bp, M. musculus
tttgatttgcatttctct

SEQ ID NO: 459941 - DNA, 16 bp, M. musculus
tttgatttgtatttca

SEQ ID NO: 459942 - DNA, 16 bp, M. musculus
tttgatttttaaaact

SEQ ID NO: 459943 - DNA, 16 bp, M. musculus
tttgatttttaagaca

SEQ ID NO: 459944 - DNA, 16 bp, M. musculus
tttgatttttctgaag

SEQ ID NO: 459945 - DNA, 16 bp, M. musculus
tttgatttttctggag

SEQ ID NO: 459946 - DNA, 16 bp, M. musculus
tttgattttttccccc

SEQ ID NO: 459947 - DNA, 16 bp, M. musculus
tttgatttttttcccc

SEQ ID NO: 459948 - DNA, 16 bp, M. musculus
tttgcaaaaaaagaaa

SEQ ID NO: 459949 - DNA, 16 bp, M. musculus
tttgcaaaaaacaaag

SEQ ID NO: 459950 - DNA, 16 bp, M. musculus
tttgcaaactgtatat

SEQ ID NO: 459951 - DNA, 16 bp, M. musculus
tttgcaaactttattt

SEQ ID NO: 459952 - DNA, 16 bp, M. musculus
tttgcaaagcttctgt

SEQ ID NO: 459953 - DNA, 17 bp, M. musculus
tttgcaaaggaatgttt

SEQ ID NO: 459954 - DNA, 16 bp, M. musculus
tttgcaaatgaaaaaa

SEQ ID NO: 459955 - DNA, 16 bp, M. musculus
tttgcaaattcttaca

SEQ ID NO: 459956 - DNA, 16 bp, M. musculus
tttgcaaattgtatat

SEQ ID NO: 459957 - DNA, 16 bp, M. musculus
tttgcaaattgtatca

SEQ ID NO: 459958 - DNA, 16 bp, M. musculus
tttgcaaattgttctt

SEQ ID NO: 459959 - DNA, 17 bp, M. musculus
tttgcaaattttatctt

SEQ ID NO: 459960 - DNA, 16 bp, M. musculus
tttgcaagaccaaagg

SEQ ID NO: 459961 - DNA, 16 bp, M. musculus
tttgcaagaccaacgg

SEQ ID NO: 459962 - DNA, 16 bp, M. musculus
tttgcaagactgatgg

SEQ ID NO: 459963 - DNA, 16 bp, M. musculus
tttgcaagagcagcaa

SEQ ID NO: 459964 - DNA, 16 bp, M. musculus
tttgcaagtattttct

SEQ ID NO: 459965 - DNA, 16 bp, M. musculus
tttgcaataaattgct

SEQ ID NO: 459966 - DNA, 35 bp, M. musculus
tttgcacaacaacagacaggatatccagtgcaggt

SEQ ID NO: 459967 - DNA, 16 bp, M. musculus
tttgcacaatatcttt

SEQ ID NO: 459968 - DNA, 16 bp, M. musculus
tttgcacagcagaaac

SEQ ID NO: 459969 - DNA, 16 bp, M. musculus
tttgcagaaagtagag

SEQ ID NO: 459970 - DNA, 16 bp, M. musculus
tttgcagaatttggaa

SEQ ID NO: 459971 - DNA, 16 bp, M. musculus
tttgcagaggacctgg

SEQ ID NO: 459972 - DNA, 16 bp, M. musculus
tttgcagaggacttga

SEQ ID NO: 459973 - DNA, 16 bp, M. musculus
tttgcagaggatccaa

SEQ ID NO: 459974 - DNA, 16 bp, M. musculus
tttgcagataaggaaa

SEQ ID NO: 459975 - DNA, 16 bp, M. musculus
tttgcagatggctata

SEQ ID NO: 459976 - DNA, 16 bp, M. musculus
tttgcagatttttctt

SEQ ID NO: 459977 - DNA, 20 bp, M. musculus
tttgcagcaagaccgtttct

SEQ ID NO: 459978 - DNA, 16 bp, M. musculus
tttgcagctggagcca

SEQ ID NO: 459979 - DNA, 16 bp, M. musculus
tttgcagctggcaaaa

SEQ ID NO: 459980 - DNA, 16 bp, M. musculus
tttgcaggaaggaatg

SEQ ID NO: 459981 - DNA, 16 bp, M. musculus
tttgcaggaaggagtg

SEQ ID NO: 459982 - DNA, 16 bp, M. musculus
tttgcaggcaaatgga

SEQ ID NO: 459983 - DNA, 17 bp, M. musculus
tttgcaggcatgaaaga

SEQ ID NO: 459984 - DNA, 16 bp, M. musculus
tttgcagggaggaatg

SEQ ID NO: 459985 - DNA, 16 bp, M. musculus
tttgcagtgctgagga

SEQ ID NO: 459986 - DNA, 16 bp, M. musculus
tttgcagtgctgggaa

SEQ ID NO: 459987 - DNA, 16 bp, M. musculus
tttgcagttccatgag

SEQ ID NO: 459988 - DNA, 16 bp, M. musculus
tttgcagtttttaaaa

SEQ ID NO: 459989 - DNA, 16 bp, M. musculus
tttgcatacacacaca

SEQ ID NO: 459990 - DNA, 16 bp, M. musculus
tttgcatatattttat

SEQ ID NO: 459991 - DNA, 16 bp, M. musculus
tttgcatatgtgtgtg

SEQ ID NO: 459992 - DNA, 16 bp, M. musculus
tttgcatcaagaccat

SEQ ID NO: 459993 - DNA, 16 bp, M. musculus
tttgcatcagctcctg

SEQ ID NO: 459994 - DNA, 16 bp, M. musculus
tttgcatgcacacaca

SEQ ID NO: 459995 - DNA, 16 bp, M. musculus
tttgcatgtatgcctg

SEQ ID NO: 459996 - DNA, 16 bp, M. musculus
tttgcatgtccagtgg

SEQ ID NO: 459997 - DNA, 18 bp, M. musculus
tttgcattactgggacta

SEQ ID NO: 459998 - DNA, 16 bp, M. musculus
tttgcattctgataat

SEQ ID NO: 459999 - DNA, 16 bp, M. musculus
tttgcattcttctaca

SEQ ID NO: 460000 - DNA, 16 bp, M. musculus
tttgcattcttgtaca

SEQ ID NO: 460001 - DNA, 16 bp, M. musculus
tttgcatttctgagtt

SEQ ID NO: 460002 - DNA, 16 bp, M. musculus
tttgcatttgtttata

SEQ ID NO: 460003 - DNA, 16 bp, M. musculus
tttgcattttaaattt

SEQ ID NO: 460004 - DNA, 16 bp, M. musculus
tttgcattttatttaa

SEQ ID NO: 460005 - DNA, 16 bp, M. musculus
tttgcattttcattga

SEQ ID NO: 460006 - DNA, 16 bp, M. musculus
tttgcattttctttaa

SEQ ID NO: 460007 - DNA, 16 bp, M. musculus
tttgcattttgccttt

SEQ ID NO: 460008 - DNA, 16 bp, M. musculus
tttgcatttttaaaaa

SEQ ID NO: 460009 - DNA, 16 bp, M. musculus
tttgcattttttaaaa

SEQ ID NO: 460010 - DNA, 16 bp, M. musculus
tttgccaaaaaaaaaa

SEQ ID NO: 460011 - DNA, 17 bp, M. musculus
tttgccaactgctgtgt

SEQ ID NO: 460012 - DNA, 16 bp, M. musculus
tttgccacagtggaag

SEQ ID NO: 460013 - DNA, 16 bp, M. musculus
tttgccaccaagcctg

SEQ ID NO: 460014 - DNA, 16 bp, M. musculus
tttgccaccatacctt

SEQ ID NO: 460015 - DNA, 16 bp, M. musculus
tttgccaccatgccca

SEQ ID NO: 460016 - DNA, 16 bp, M. musculus
tttgccactcaattag

SEQ ID NO: 460017 - DNA, 16 bp, M. musculus
tttgccagcaggaaca

SEQ ID NO: 460018 - DNA, 17 bp, M. musculus
tttgccaggcactggca

SEQ ID NO: 460019 - DNA, 16 bp, M. musculus
tttgccaggcactggg

SEQ ID NO: 460020 - DNA, 16 bp, M. musculus
tttgccaggcattggc

SEQ ID NO: 460021 - DNA, 16 bp, M. musculus
tttgcccaagaatttt

SEQ ID NO: 460022 - DNA, 16 bp, M. musculus
tttgcccacctacaac

SEQ ID NO: 460023 - DNA, 16 bp, M. musculus
tttgcccagctggttt

SEQ ID NO: 460024 - DNA, 16 bp, M. musculus
tttgcccatctgctgc

SEQ ID NO: 460025 - DNA, 16 bp, M. musculus
tttgccctctgacctc

SEQ ID NO: 460026 - DNA, 17 bp, M. musculus
tttgccgcagaagattc

SEQ ID NO: 460027 - DNA, 16 bp, M. musculus
tttgcctacacatatg

SEQ ID NO: 460028 - DNA, 16 bp, M. musculus
tttgcctacatgtatg

SEQ ID NO: 460029 - DNA, 16 bp, M. musculus
tttgcctcagtttccc

SEQ ID NO: 460030 - DNA, 16 bp, M. musculus
tttgcctcccaagtgt

SEQ ID NO: 460031 - DNA, 16 bp, M. musculus
tttgcctctgcctccc

SEQ ID NO: 460032 - DNA, 16 bp, M. musculus
tttgcctgatgattaa

SEQ ID NO: 460033 - DNA, 16 bp, M. musculus
tttgcctgcaaaatcc

SEQ ID NO: 460034 - DNA, 16 bp, M. musculus
tttgcctgcatatatg

SEQ ID NO: 460035 - DNA, 16 bp, M. musculus
tttgcctgcctggctg

SEQ ID NO: 460036 - DNA, 16 bp, M. musculus
tttgcctgcctgtatg

SEQ ID NO: 460037 - DNA, 16 bp, M. musculus
tttgcctgcttgttct

SEQ ID NO: 460038 - DNA, 16 bp, M. musculus
tttgcctgcttttggg

SEQ ID NO: 460039 - DNA, 16 bp, M. musculus
tttgcctggaaaattg

SEQ ID NO: 460040 - DNA, 16 bp, M. musculus
tttgcctgtctgtctg

SEQ ID NO: 460041 - DNA, 16 bp, M. musculus
tttgcctgtgcatatg

SEQ ID NO: 460042 - DNA, 16 bp, M. musculus
tttgcctgtgtgtatg

SEQ ID NO: 460043 - DNA, 19 bp, M. musculus
tttgccttacagaagcttt

SEQ ID NO: 460044 - DNA, 16 bp, M. musculus
tttgccttctgagtgc

SEQ ID NO: 460045 - DNA, 16 bp, M. musculus
tttgccttgcagaagt

SEQ ID NO: 460046 - DNA, 16 bp, M. musculus
tttgccttggagaagc

SEQ ID NO: 460047 - DNA, 16 bp, M. musculus
tttgcggcttcccaca

SEQ ID NO: 460048 - DNA, 16 bp, M. musculus
tttgctaaagccacca

SEQ ID NO: 460049 - DNA, 16 bp, M. musculus
tttgctaaaggcatga

SEQ ID NO: 460050 - DNA, 16 bp, M. musculus
tttgctaaggcaaaca

SEQ ID NO: 460051 - DNA, 16 bp, M. musculus
tttgctactgttatga

SEQ ID NO: 460052 - DNA, 17 bp, M. musculus
tttgctaggcctggcat

SEQ ID NO: 460053 - DNA, 16 bp, M. musculus
tttgctatgaaaaagg

SEQ ID NO: 460054 - DNA, 16 bp, M. musculus
tttgctatgattttta

SEQ ID NO: 460055 - DNA, 16 bp, M. musculus
tttgctatgcaagcat

SEQ ID NO: 460056 - DNA, 16 bp, M. musculus
tttgctatgtattgta

SEQ ID NO: 460057 - DNA, 17 bp, M. musculus
tttgctccatttcactt

SEQ ID NO: 460058 - DNA, 16 bp, M. musculus
tttgctctcttttata

SEQ ID NO: 460059 - DNA, 16 bp, M. musculus
tttgctctgccttgct

SEQ ID NO: 460060 - DNA, 16 bp, M. musculus
tttgctctgtgcattt

SEQ ID NO: 460061 - DNA, 16 bp, M. musculus
tttgctgaaaaaaaaa

SEQ ID NO: 460062 - DNA, 16 bp, M. musculus
tttgctgaaaggagcc

SEQ ID NO: 460063 - DNA, 16 bp, M. musculus
tttgctgaagcagacc

SEQ ID NO: 460064 - DNA, 17 bp, M. musculus
tttgctgaaggaaccct

SEQ ID NO: 460065 - DNA, 16 bp, M. musculus
tttgctgaaggtgttt

SEQ ID NO: 460066 - DNA, 16 bp, M. musculus
tttgctgacaggaccc

SEQ ID NO: 460067 - DNA, 16 bp, M. musculus
tttgctgagttaaaga

SEQ ID NO: 460068 - DNA, 16 bp, M. musculus
tttgctgatgctcaca

SEQ ID NO: 460069 - DNA, 16 bp, M. musculus
tttgctgcacatgctt

SEQ ID NO: 460070 - DNA, 16 bp, M. musculus
tttgctgcctcctcct

SEQ ID NO: 460071 - DNA, 16 bp, M. musculus
tttgctgctacttcat

SEQ ID NO: 460072 - DNA, 16 bp, M. musculus
tttgctgctgctgttg

SEQ ID NO: 460073 - DNA, 16 bp, M. musculus
tttgctgctgttatga

SEQ ID NO: 460074 - DNA, 16 bp, M. musculus
tttgctggcagtatgt

SEQ ID NO: 460075 - DNA, 16 bp, M. musculus
tttgctggcccttcaa

SEQ ID NO: 460076 - DNA, 34 bp, M. musculus
tttgctggctatagagaacaaagagcttctttct

SEQ ID NO: 460077 - DNA, 16 bp, M. musculus
tttgctgggcagtggt

SEQ ID NO: 460078 - DNA, 16 bp, M. musculus
tttgctgggcgtggtg

SEQ ID NO: 460079 - DNA, 16 bp, M. musculus
tttgctgggtctttct

SEQ ID NO: 460080 - DNA, 16 bp, M. musculus
tttgctggtcttcatt

SEQ ID NO: 460081 - DNA, 16 bp, M. musculus
tttgctgtaaagagag

SEQ ID NO: 460082 - DNA, 16 bp, M. musculus
tttgctgtagttgttt

SEQ ID NO: 460083 - DNA, 16 bp, M. musculus
tttgctgtcctggaat

SEQ ID NO: 460084 - DNA, 16 bp, M. musculus
tttgctgtggtcatgg

SEQ ID NO: 460085 - DNA, 16 bp, M. musculus
tttgctgttatgattt

SEQ ID NO: 460086 - DNA, 16 bp, M. musculus
tttgctgttattgaaa

SEQ ID NO: 460087 - DNA, 16 bp, M. musculus
tttgctgttcttccag

SEQ ID NO: 460088 - DNA, 16 bp, M. musculus
tttgctgttggctact

SEQ ID NO: 460089 - DNA, 16 bp, M. musculus
tttgctgtttctcctg

SEQ ID NO: 460090 - DNA, 16 bp, M. musculus
tttgctgttttgagac

SEQ ID NO: 460091 - DNA, 16 bp, M. musculus
tttgcttacaaatgtt

SEQ ID NO: 460092 - DNA, 16 bp, M. musculus
tttgcttcattttaaa

SEQ ID NO: 460093 - DNA, 16 bp, M. musculus
tttgcttcccagcatc

SEQ ID NO: 460094 - DNA, 16 bp, M. musculus
tttgcttcctgactgc

SEQ ID NO: 460095 - DNA, 16 bp, M. musculus
tttgcttcctgttgct

SEQ ID NO: 460096 - DNA, 16 bp, M. musculus
tttgcttctgctttta

SEQ ID NO: 460097 - DNA, 16 bp, M. musculus
tttgcttctgttgctg

SEQ ID NO: 460098 - DNA, 16 bp, M. musculus
tttgcttctgtttgag

SEQ ID NO: 460099 - DNA, 16 bp, M. musculus
tttgcttgcatatatg

SEQ ID NO: 460100 - DNA, 16 bp, M. musculus
tttgcttggaaaatat

SEQ ID NO: 460101 - DNA, 18 bp, M. musculus
tttgcttggaagaccttt

SEQ ID NO: 460102 - DNA, 16 bp, M. musculus
tttgcttgtctgtctg

SEQ ID NO: 460103 - DNA, 17 bp, M. musculus
tttgcttgtgcatttaa

SEQ ID NO: 460104 - DNA, 16 bp, M. musculus
tttgcttgtgcatttc

SEQ ID NO: 460105 - DNA, 16 bp, M. musculus
tttgcttgtgtgcatg

SEQ ID NO: 460106 - DNA, 16 bp, M. musculus
tttgcttgtttgagac

SEQ ID NO: 460107 - DNA, 16 bp, M. musculus
tttgctttaaaagaaa

SEQ ID NO: 460108 - DNA, 16 bp, M. musculus
tttgctttaattaaaa

SEQ ID NO: 460109 - DNA, 16 bp, M. musculus
tttgctttacagaaga

SEQ ID NO: 460110 - DNA, 16 bp, M. musculus
tttgctttcattttaa

SEQ ID NO: 460111 - DNA, 16 bp, M. musculus
tttgctttctttaaaa

SEQ ID NO: 460112 - DNA, 16 bp, M. musculus
tttgctttcttttaaa

SEQ ID NO: 460113 - DNA, 16 bp, M. musculus
tttgctttgaaatttt

SEQ ID NO: 460114 - DNA, 16 bp, M. musculus
tttgctttgcatttcc

SEQ ID NO: 460115 - DNA, 16 bp, M. musculus
tttgctttgcattttc

SEQ ID NO: 460116 - DNA, 16 bp, M. musculus
tttgctttgctttaaa

SEQ ID NO: 460117 - DNA, 16 bp, M. musculus
tttgctttgtgtatgt

SEQ ID NO: 460118 - DNA, 16 bp, M. musculus
tttgctttgtttaaaa

SEQ ID NO: 460119 - DNA, 16 bp, M. musculus
tttgctttgttttaca

SEQ ID NO: 460120 - DNA, 16 bp, M. musculus
tttgcttttaaaaaca

SEQ ID NO: 460121 - DNA, 16 bp, M. musculus
tttgcttttaaagaaa

SEQ ID NO: 460122 - DNA, 16 bp, M. musculus
tttgcttttaaagatt

SEQ ID NO: 460123 - DNA, 16 bp, M. musculus
tttgcttttcaaattt

SEQ ID NO: 460124 - DNA, 16 bp, M. musculus
tttgcttttgaaataa

SEQ ID NO: 460125 - DNA, 16 bp, M. musculus
tttgctttttaaatat

SEQ ID NO: 460126 - DNA, 16 bp, M. musculus
tttgctttttttcaaa

SEQ ID NO: 460127 - DNA, 16 bp, M. musculus
tttggaaaaaaaatct

SEQ ID NO: 460128 - DNA, 16 bp, M. musculus
tttggaaaaaaaatga

SEQ ID NO: 460129 - DNA, 16 bp, M. musculus
tttggaaaaaagtttc

SEQ ID NO: 460130 - DNA, 16 bp, M. musculus
tttggaaaaagctgaa

SEQ ID NO: 460131 - DNA, 16 bp, M. musculus
tttggaaaaataaatt

SEQ ID NO: 460132 - DNA, 16 bp, M. musculus
tttggaaaaatcagga

SEQ ID NO: 460133 - DNA, 16 bp, M. musculus
tttggaaaagaaaata

SEQ ID NO: 460134 - DNA, 16 bp, M. musculus
tttggaaaagaaagaa

SEQ ID NO: 460135 - DNA, 16 bp, M. musculus
tttggaaaagaagaaa

SEQ ID NO: 460136 - DNA, 16 bp, M. musculus
tttggaaacagagtct

SEQ ID NO: 460137 - DNA, 16 bp, M. musculus
tttggaaacagggtct

SEQ ID NO: 460138 - DNA, 16 bp, M. musculus
tttggaaagcaatgga

SEQ ID NO: 460139 - DNA, 16 bp, M. musculus
tttggaaaggaaaaag

SEQ ID NO: 460140 - DNA, 16 bp, M. musculus
tttggaaataaaattt

SEQ ID NO: 460141 - DNA, 16 bp, M. musculus
tttggaaatataaata

SEQ ID NO: 460142 - DNA, 16 bp, M. musculus
tttggaaatgagtttt

SEQ ID NO: 460143 - DNA, 16 bp, M. musculus
tttggaacaggaaaaa

SEQ ID NO: 460144 - DNA, 16 bp, M. musculus
tttggaagaaaataaa

SEQ ID NO: 460145 - DNA, 16 bp, M. musculus
tttggaagaagaaatg

SEQ ID NO: 460146 - DNA, 16 bp, M. musculus
tttggaagaatagcca

SEQ ID NO: 460147 - DNA, 16 bp, M. musculus
tttggaagaatgtgaa

SEQ ID NO: 460148 - DNA, 16 bp, M. musculus
tttggaagagcaacaa

SEQ ID NO: 460149 - DNA, 16 bp, M. musculus
tttggaagagcagcca

SEQ ID NO: 460150 - DNA, 16 bp, M. musculus
tttggaagagcagtca

SEQ ID NO: 460151 - DNA, 16 bp, M. musculus
tttggaagaggcactg

SEQ ID NO: 460152 - DNA, 19 bp, M. musculus
tttggaagctgattatggg

SEQ ID NO: 460153 - DNA, 16 bp, M. musculus
tttggaaggaagaaag

SEQ ID NO: 460154 - DNA, 16 bp, M. musculus
tttggaaggagaaaag

SEQ ID NO: 460155 - DNA, 16 bp, M. musculus
tttggaagttttaaaa

SEQ ID NO: 460156 - DNA, 16 bp, M. musculus
tttggaataatagaaa

SEQ ID NO: 460157 - DNA, 16 bp, M. musculus
tttggaattctgggga

SEQ ID NO: 460158 - DNA, 16 bp, M. musculus
tttggaattgagtttt

SEQ ID NO: 460159 - DNA, 16 bp, M. musculus
tttggaattttatgag

SEQ ID NO: 460160 - DNA, 16 bp, M. musculus
tttggacagttaagaa

SEQ ID NO: 460161 - DNA, 19 bp, M. musculus
tttggaccactacctgtag

SEQ ID NO: 460162 - DNA, 17 bp, M. musculus
tttggacctcctcctgg

SEQ ID NO: 460163 - DNA, 16 bp, M. musculus
tttggacctctacctg

SEQ ID NO: 460164 - DNA, 16 bp, M. musculus
tttggacttttaacat

SEQ ID NO: 460165 - DNA, 17 bp, M. musculus
tttggactttttctgtg

SEQ ID NO: 460166 - DNA, 16 bp, M. musculus
tttggagaaaaagaaa

SEQ ID NO: 460167 - DNA, 16 bp, M. musculus
tttggagaaaatattt

SEQ ID NO: 460168 - DNA, 16 bp, M. musculus
tttggagaaactgctg

SEQ ID NO: 460169 - DNA, 16 bp, M. musculus
tttggagaaagaaatt

SEQ ID NO: 460170 - DNA, 16 bp, M. musculus
tttggagaaagcattt

SEQ ID NO: 460171 - DNA, 16 bp, M. musculus
tttggagaaatgtgga

SEQ ID NO: 460172 - DNA, 16 bp, M. musculus
tttggagaagaaacta

SEQ ID NO: 460173 - DNA, 16 bp, M. musculus
tttggagaaggtatca

SEQ ID NO: 460174 - DNA, 16 bp, M. musculus
tttggagaagttacca

SEQ ID NO: 460175 - DNA, 16 bp, M. musculus
tttggagacaagatct

SEQ ID NO: 460176 - DNA, 16 bp, M. musculus
tttggagacagagtct

SEQ ID NO: 460177 - DNA, 16 bp, M. musculus
tttggagacagggtct

SEQ ID NO: 460178 - DNA, 16 bp, M. musculus
tttggagacaggtttt

SEQ ID NO: 460179 - DNA, 16 bp, M. musculus
tttggagagagattag

SEQ ID NO: 460180 - DNA, 16 bp, M. musculus
tttggagatatttgcc

SEQ ID NO: 460181 - DNA, 16 bp, M. musculus
tttggagcaaatccaa

SEQ ID NO: 460182 - DNA, 16 bp, M. musculus
tttggagcagagactg

SEQ ID NO: 460183 - DNA, 16 bp, M. musculus
tttggagctagcctgg

SEQ ID NO: 460184 - DNA, 16 bp, M. musculus
tttggagctgtgacaa

SEQ ID NO: 460185 - DNA, 16 bp, M. musculus
tttggaggaaggaaag

SEQ ID NO: 460186 - DNA, 16 bp, M. musculus
tttggaggaatgtggg

SEQ ID NO: 460187 - DNA, 16 bp, M. musculus
tttggaggcaggagct

SEQ ID NO: 460188 - DNA, 16 bp, M. musculus
tttggaggcctgggca

SEQ ID NO: 460189 - DNA, 17 bp, M. musculus
tttggaggcctgggcag

SEQ ID NO: 460190 - DNA, 16 bp, M. musculus
tttggaggctgatgat

SEQ ID NO: 460191 - DNA, 16 bp, M. musculus
tttggagggactcaga

SEQ ID NO: 460192 - DNA, 16 bp, M. musculus
tttggagggagaaagg

SEQ ID NO: 460193 - DNA, 16 bp, M. musculus
tttggagtcattttct

SEQ ID NO: 460194 - DNA, 16 bp, M. musculus
tttggagttcagtagg

SEQ ID NO: 460195 - DNA, 16 bp, M. musculus
tttggagttcattttt

SEQ ID NO: 460196 - DNA, 16 bp, M. musculus
tttggataaaggtttg

SEQ ID NO: 460197 - DNA, 16 bp, M. musculus
tttggataatgattat

SEQ ID NO: 460198 - DNA, 21 bp, M. musculus
tttggatacagatttcctgct

SEQ ID NO: 460199 - DNA, 16 bp, M. musculus
tttggatagtgtctct

SEQ ID NO: 460200 - DNA, 16 bp, M. musculus
tttggatcagcaggac

SEQ ID NO: 460201 - DNA, 16 bp, M. musculus
tttggatcccagcatc

SEQ ID NO: 460202 - DNA, 16 bp, M. musculus
tttggatccccagaac

SEQ ID NO: 460203 - DNA, 16 bp, M. musculus
tttggatccctttcct

SEQ ID NO: 460204 - DNA, 16 bp, M. musculus
tttggatcttaaatgt

SEQ ID NO: 460205 - DNA, 16 bp, M. musculus
tttggatgaagatgta

SEQ ID NO: 460206 - DNA, 16 bp, M. musculus
tttggatgagaatggc

SEQ ID NO: 460207 - DNA, 16 bp, M. musculus
tttggatgatgattat

SEQ ID NO: 460208 - DNA, 16 bp, M. musculus
tttggatggtcattcc

SEQ ID NO: 460209 - DNA, 17 bp, M. musculus
tttggattggaagtcaa

SEQ ID NO: 460210 - DNA, 16 bp, M. musculus
tttggatttcaagttg

SEQ ID NO: 460211 - DNA, 16 bp, M. musculus
tttggatttggaaagc

SEQ ID NO: 460212 - DNA, 16 bp, M. musculus
tttggattttaaaaaa

SEQ ID NO: 460213 - DNA, 16 bp, M. musculus
tttggatttttgtcaa

SEQ ID NO: 460214 - DNA, 16 bp, M. musculus
tttggattttttgaga

SEQ ID NO: 460215 - DNA, 16 bp, M. musculus
tttggcagagagaatg

SEQ ID NO: 460216 - DNA, 16 bp, M. musculus
tttggcatttctgcct

SEQ ID NO: 460217 - DNA, 17 bp, M. musculus
tttggccaggaggaggt

SEQ ID NO: 460218 - DNA, 16 bp, M. musculus
tttggcccagagagtg

SEQ ID NO: 460219 - DNA, 16 bp, M. musculus
tttggccctgagtttg

SEQ ID NO: 460220 - DNA, 16 bp, M. musculus
tttggcctcaaactca

SEQ ID NO: 460221 - DNA, 16 bp, M. musculus
tttggcctcagtgaga

SEQ ID NO: 460222 - DNA, 16 bp, M. musculus
tttggcctctgtggac

SEQ ID NO: 460223 - DNA, 19 bp, M. musculus
tttggcgttctcattaacc

SEQ ID NO: 460224 - DNA, 16 bp, M. musculus
tttggctactttgtgg

SEQ ID NO: 460225 - DNA, 16 bp, M. musculus
tttggctcacagtttg

SEQ ID NO: 460226 - DNA, 16 bp, M. musculus
tttggctcagaataaa

SEQ ID NO: 460227 - DNA, 16 bp, M. musculus
tttggctcctggtttg

SEQ ID NO: 460228 - DNA, 121 bp, M. musculus
tttggctggcctcttttgcagagttcgccctaggtcatttagcagttattgtcacacagcactgcggtatccagagacgggcaactttcctcgtgcacagtccaacctaagacatggggcc

SEQ ID NO: 460229 - DNA, 16 bp, M. musculus
tttggctggcctgaaa

SEQ ID NO: 460230 - DNA, 16 bp, M. musculus
tttggctggcctggaa

SEQ ID NO: 460231 - DNA, 16 bp, M. musculus
tttggctggctgtgct

SEQ ID NO: 460232 - DNA, 16 bp, M. musculus
tttggctgggagactt

SEQ ID NO: 460233 - DNA, 16 bp, M. musculus
tttggcttctctgtca

SEQ ID NO: 460234 - DNA, 16 bp, M. musculus
tttggcttctgtagtt

SEQ ID NO: 460235 - DNA, 16 bp, M. musculus
tttggcttggggagct

SEQ ID NO: 460236 - DNA, 16 bp, M. musculus
tttggctttgttgtga

SEQ ID NO: 460237 - DNA, 16 bp, M. musculus
tttggcttttaaaaat

SEQ ID NO: 460238 - DNA, 16 bp, M. musculus
tttgggaaaaggtttc

SEQ ID NO: 460239 - DNA, 16 bp, M. musculus
tttgggaacaggtgca

SEQ ID NO: 460240 - DNA, 16 bp, M. musculus
tttgggaacccaatta

SEQ ID NO: 460241 - DNA, 16 bp, M. musculus
tttgggaacttttctt

SEQ ID NO: 460242 - DNA, 16 bp, M. musculus
tttgggaagaattagg

SEQ ID NO: 460243 - DNA, 16 bp, M. musculus
tttgggaagaggaaac

SEQ ID NO: 460244 - DNA, 16 bp, M. musculus
tttgggaaggattaag

SEQ ID NO: 460245 - DNA, 16 bp, M. musculus
tttgggaaggatttgg

SEQ ID NO: 460246 - DNA, 16 bp, M. musculus
tttgggaattggttct

SEQ ID NO: 460247 - DNA, 20 bp, M. musculus
tttgggacaagttaaggttc

SEQ ID NO: 460248 - DNA, 17 bp, M. musculus
tttgggacaagttgcac

SEQ ID NO: 460249 - DNA, 16 bp, M. musculus
tttgggacagggtctc

SEQ ID NO: 460250 - DNA, 16 bp, M. musculus
tttgggacatcttctg

SEQ ID NO: 460251 - DNA, 16 bp, M. musculus
tttgggagaactgggt

SEQ ID NO: 460252 - DNA, 16 bp, M. musculus
tttgggagactattaa

SEQ ID NO: 460253 - DNA, 16 bp, M. musculus
tttgggagagaaaggg

SEQ ID NO: 460254 - DNA, 16 bp, M. musculus
tttgggaggttttctt

SEQ ID NO: 460255 - DNA, 16 bp, M. musculus
tttgggagttggttct

SEQ ID NO: 460256 - DNA, 23 bp, M. musculus
tttgggatagcatttgaaatgta

SEQ ID NO: 460257 - DNA, 16 bp, M. musculus
tttgggatggagattt

SEQ ID NO: 460258 - DNA, 16 bp, M. musculus
tttgggatgttttctt

SEQ ID NO: 460259 - DNA, 16 bp, M. musculus
tttgggattaaaggtg

SEQ ID NO: 460260 - DNA, 16 bp, M. musculus
tttgggattgtgttac

SEQ ID NO: 460261 - DNA, 16 bp, M. musculus
tttgggccggagcaag

SEQ ID NO: 460262 - DNA, 16 bp, M. musculus
tttgggcctcagtttc

SEQ ID NO: 460263 - DNA, 16 bp, M. musculus
tttgggcctgtcactg

SEQ ID NO: 460264 - DNA, 16 bp, M. musculus
tttgggcctgtcgctg

SEQ ID NO: 460265 - DNA, 16 bp, M. musculus
tttgggcctttatctt

SEQ ID NO: 460266 - DNA, 16 bp, M. musculus
tttgggctcacagttt

SEQ ID NO: 460267 - DNA, 16 bp, M. musculus
tttgggctcatagttt

SEQ ID NO: 460268 - DNA, 16 bp, M. musculus
tttggggagaaaaaaa

SEQ ID NO: 460269 - DNA, 17 bp, M. musculus
tttggggaggactgtgg

SEQ ID NO: 460270 - DNA, 16 bp, M. musculus
tttggggaggtgaggc

SEQ ID NO: 460271 - DNA, 18 bp, M. musculus
tttggggattacagttaa

SEQ ID NO: 460272 - DNA, 16 bp, M. musculus
tttggggctggagaga

SEQ ID NO: 460273 - DNA, 16 bp, M. musculus
tttgggggaaaaaaaa

SEQ ID NO: 460274 - DNA, 16 bp, M. musculus
tttgggggaaaaaaag

SEQ ID NO: 460275 - DNA, 16 bp, M. musculus
tttgggggtcaccaca

SEQ ID NO: 460276 - DNA, 16 bp, M. musculus
tttgggggttcccatg

SEQ ID NO: 460277 - DNA, 16 bp, M. musculus
tttgggggtttctacc

SEQ ID NO: 460278 - DNA, 16 bp, M. musculus
tttggggttaaatcct

SEQ ID NO: 460279 - DNA, 16 bp, M. musculus
tttggggttgcttatg

SEQ ID NO: 460280 - DNA, 16 bp, M. musculus
tttgggtcccagcacc

SEQ ID NO: 460281 - DNA, 16 bp, M. musculus
tttgggtctctctctc

SEQ ID NO: 460282 - DNA, 16 bp, M. musculus
tttgggtctgtggact

SEQ ID NO: 460283 - DNA, 16 bp, M. musculus
tttgggtcttctttat

SEQ ID NO: 460284 - DNA, 16 bp, M. musculus
tttgggttctctctct

SEQ ID NO: 460285 - DNA, 16 bp, M. musculus
tttgggtttggtaact

SEQ ID NO: 460286 - DNA, 16 bp, M. musculus
tttgggttttccagac

SEQ ID NO: 460287 - DNA, 16 bp, M. musculus
tttggtaactgtatat

SEQ ID NO: 460288 - DNA, 16 bp, M. musculus
tttggtagcatgcaga

SEQ ID NO: 460289 - DNA, 16 bp, M. musculus
tttggtattttcattg

SEQ ID NO: 460290 - DNA, 18 bp, M. musculus
tttggtattttccaacaa

SEQ ID NO: 460291 - DNA, 16 bp, M. musculus
tttggtcaaggaagaa

SEQ ID NO: 460292 - DNA, 16 bp, M. musculus
tttggtcagcaaagca

SEQ ID NO: 460293 - DNA, 16 bp, M. musculus
tttggtcagtatttta

SEQ ID NO: 460294 - DNA, 16 bp, M. musculus
tttggtcatattattt

SEQ ID NO: 460295 - DNA, 16 bp, M. musculus
tttggtcatggtgttt

SEQ ID NO: 460296 - DNA, 16 bp, M. musculus
tttggtcatgttattt

SEQ ID NO: 460297 - DNA, 16 bp, M. musculus
tttggtccataatttc

SEQ ID NO: 460298 - DNA, 16 bp, M. musculus
tttggtccccagcact

SEQ ID NO: 460299 - DNA, 16 bp, M. musculus
tttggtctctgtgagc

SEQ ID NO: 460300 - DNA, 16 bp, M. musculus
tttggtctgaaacttc

SEQ ID NO: 460301 - DNA, 17 bp, M. musculus
tttggtcttctcattgt

SEQ ID NO: 460302 - DNA, 16 bp, M. musculus
tttggtcttttcatgg

SEQ ID NO: 460303 - DNA, 17 bp, M. musculus
tttggtcttttcattgt

SEQ ID NO: 460304 - DNA, 16 bp, M. musculus
tttggtgactgtttat

SEQ ID NO: 460305 - DNA, 28 bp, M. musculus
tttggtgagcatttacatgggacacaaa

SEQ ID NO: 460306 - DNA, 16 bp, M. musculus
tttggtgatgcagctg

SEQ ID NO: 460307 - DNA, 16 bp, M. musculus
tttggtgctggagaga

SEQ ID NO: 460308 - DNA, 16 bp, M. musculus
tttggtggcccagtgt

SEQ ID NO: 460309 - DNA, 16 bp, M. musculus
tttggtgtttgctatt

SEQ ID NO: 460310 - DNA, 16 bp, M. musculus
tttggtgttttgactg

SEQ ID NO: 460311 - DNA, 16 bp, M. musculus
tttggttcagtttggt

SEQ ID NO: 460312 - DNA, 16 bp, M. musculus
tttggttcccagcacc

SEQ ID NO: 460313 - DNA, 16 bp, M. musculus
tttggttcccagtacc

SEQ ID NO: 460314 - DNA, 16 bp, M. musculus
tttggttcctggcacc

SEQ ID NO: 460315 - DNA, 16 bp, M. musculus
tttggttctcagcacc

SEQ ID NO: 460316 - DNA, 16 bp, M. musculus
tttggttctcttgagt

SEQ ID NO: 460317 - DNA, 16 bp, M. musculus
tttggttgatattcct

SEQ ID NO: 460318 - DNA, 16 bp, M. musculus
tttggttgggagactg

SEQ ID NO: 460319 - DNA, 16 bp, M. musculus
tttggttggtttttca

SEQ ID NO: 460320 - DNA, 16 bp, M. musculus
tttggttgtgagccta

SEQ ID NO: 460321 - DNA, 16 bp, M. musculus
tttggttgtgggtctc

SEQ ID NO: 460322 - DNA, 29 bp, M. musculus
tttggtttaaggactggccaaaaggatgg

SEQ ID NO: 460323 - DNA, 16 bp, M. musculus
tttggtttccagcaca

SEQ ID NO: 460324 - DNA, 16 bp, M. musculus
tttggtttccagcacc

SEQ ID NO: 460325 - DNA, 16 bp, M. musculus
tttggtttctttggaa

SEQ ID NO: 460326 - DNA, 16 bp, M. musculus
tttggtttcttttaaa

SEQ ID NO: 460327 - DNA, 16 bp, M. musculus
tttggtttgttttcaa

SEQ ID NO: 460328 - DNA, 16 bp, M. musculus
tttggttttcaaagta

SEQ ID NO: 460329 - DNA, 16 bp, M. musculus
tttggttttcgagaca

SEQ ID NO: 460330 - DNA, 16 bp, M. musculus
tttggttttgctgatg

SEQ ID NO: 460331 - DNA, 16 bp, M. musculus
tttggtttttcaaaaa

SEQ ID NO: 460332 - DNA, 16 bp, M. musculus
tttggtttttctgaga

SEQ ID NO: 460333 - DNA, 16 bp, M. musculus
tttggttttttcatgg

SEQ ID NO: 460334 - DNA, 16 bp, M. musculus
tttgtaaaaacaaaaa

SEQ ID NO: 460335 - DNA, 16 bp, M. musculus
tttgtaaacaaaatga

SEQ ID NO: 460336 - DNA, 16 bp, M. musculus
tttgtaaagtttcttt

SEQ ID NO: 460337 - DNA, 16 bp, M. musculus
tttgtaaatttcacat

SEQ ID NO: 460338 - DNA, 16 bp, M. musculus
tttgtaacatttaaaa

SEQ ID NO: 460339 - DNA, 16 bp, M. musculus
tttgtaactattttga

SEQ ID NO: 460340 - DNA, 16 bp, M. musculus
tttgtaactttaaaaa

SEQ ID NO: 460341 - DNA, 16 bp, M. musculus
tttgtaagaaagcagg

SEQ ID NO: 460342 - DNA, 16 bp, M. musculus
tttgtaagagttgctt

SEQ ID NO: 460343 - DNA, 16 bp, M. musculus
tttgtaaggcaaatga

SEQ ID NO: 460344 - DNA, 16 bp, M. musculus
tttgtaatagccagaa

SEQ ID NO: 460345 - DNA, 16 bp, M. musculus
tttgtaatgtatataa

SEQ ID NO: 460346 - DNA, 16 bp, M. musculus
tttgtaattccagatg

SEQ ID NO: 460347 - DNA, 16 bp, M. musculus
tttgtacaaaaaaaaa

SEQ ID NO: 460348 - DNA, 16 bp, M. musculus
tttgtacaccaggctg

SEQ ID NO: 460349 - DNA, 16 bp, M. musculus
tttgtacagagacaga

SEQ ID NO: 460350 - DNA, 16 bp, M. musculus
tttgtacatattttat

SEQ ID NO: 460351 - DNA, 16 bp, M. musculus
tttgtacatgtatata

SEQ ID NO: 460352 - DNA, 16 bp, M. musculus
tttgtacatgtatgta

SEQ ID NO: 460353 - DNA, 16 bp, M. musculus
tttgtacatttttaaa

SEQ ID NO: 460354 - DNA, 16 bp, M. musculus
tttgtactatgtattt

SEQ ID NO: 460355 - DNA, 16 bp, M. musculus
tttgtacttttaaaaa

SEQ ID NO: 460356 - DNA, 16 bp, M. musculus
tttgtagaaagaaaca

SEQ ID NO: 460357 - DNA, 16 bp, M. musculus
tttgtagaccagattg

SEQ ID NO: 460358 - DNA, 16 bp, M. musculus
tttgtagacgaggctg

SEQ ID NO: 460359 - DNA, 16 bp, M. musculus
tttgtagacttggctg

SEQ ID NO: 460360 - DNA, 16 bp, M. musculus
tttgtagactttctgt

SEQ ID NO: 460361 - DNA, 16 bp, M. musculus
tttgtagcatttttat

SEQ ID NO: 460362 - DNA, 16 bp, M. musculus
tttgtagctaaggatg

SEQ ID NO: 460363 - DNA, 16 bp, M. musculus
tttgtaggactcctaa

SEQ ID NO: 460364 - DNA, 16 bp, M. musculus
tttgtataaaaatgaa

SEQ ID NO: 460365 - DNA, 16 bp, M. musculus
tttgtataaaggaaag

SEQ ID NO: 460366 - DNA, 16 bp, M. musculus
tttgtatagataaact

SEQ ID NO: 460367 - DNA, 16 bp, M. musculus
tttgtatagttcattt

SEQ ID NO: 460368 - DNA, 16 bp, M. musculus
tttgtatatatacata

SEQ ID NO: 460369 - DNA, 16 bp, M. musculus
tttgtatatgctcagc

SEQ ID NO: 460370 - DNA, 16 bp, M. musculus
tttgtatatgcttggc

SEQ ID NO: 460371 - DNA, 16 bp, M. musculus
tttgtatattctggat

SEQ ID NO: 460372 - DNA, 16 bp, M. musculus
tttgtatattctttaa

SEQ ID NO: 460373 - DNA, 16 bp, M. musculus
tttgtatatttgtaca

SEQ ID NO: 460374 - DNA, 16 bp, M. musculus
tttgtatcctgccact

SEQ ID NO: 460375 - DNA, 16 bp, M. musculus
tttgtatctatgttca

SEQ ID NO: 460376 - DNA, 16 bp, M. musculus
tttgtatctcaaatct

SEQ ID NO: 460377 - DNA, 16 bp, M. musculus
tttgtatcttatatat

SEQ ID NO: 460378 - DNA, 16 bp, M. musculus
tttgtatgcatatgta

SEQ ID NO: 460379 - DNA, 16 bp, M. musculus
tttgtatgcttcttgt

SEQ ID NO: 460380 - DNA, 16 bp, M. musculus
tttgtatgtacatgtg

SEQ ID NO: 460381 - DNA, 16 bp, M. musculus
tttgtatgtatatatg

SEQ ID NO: 460382 - DNA, 16 bp, M. musculus
tttgtatgtatctgtg

SEQ ID NO: 460383 - DNA, 16 bp, M. musculus
tttgtatgtctgtctg

SEQ ID NO: 460384 - DNA, 16 bp, M. musculus
tttgtatgtgtataca

SEQ ID NO: 460385 - DNA, 16 bp, M. musculus
tttgtattctaatgag

SEQ ID NO: 460386 - DNA, 16 bp, M. musculus
tttgtatttcaaatgc

SEQ ID NO: 460387 - DNA, 16 bp, M. musculus
tttgtatttgagacag

SEQ ID NO: 460388 - DNA, 16 bp, M. musculus
tttgtatttgcttggc

SEQ ID NO: 460389 - DNA, 16 bp, M. musculus
tttgtattttcccaca

SEQ ID NO: 460390 - DNA, 16 bp, M. musculus
tttgtattttctaaat

SEQ ID NO: 460391 - DNA, 16 bp, M. musculus
tttgtattttctctga

SEQ ID NO: 460392 - DNA, 16 bp, M. musculus
tttgtcaaaaaataaa

SEQ ID NO: 460393 - DNA, 16 bp, M. musculus
tttgtcaaaataaaaa

SEQ ID NO: 460394 - DNA, 16 bp, M. musculus
tttgtcaaagaccaag

SEQ ID NO: 460395 - DNA, 16 bp, M. musculus
tttgtcaagcactggt

SEQ ID NO: 460396 - DNA, 16 bp, M. musculus
tttgtcaagctctggc

SEQ ID NO: 460397 - DNA, 16 bp, M. musculus
tttgtcaagttgacaa

SEQ ID NO: 460398 - DNA, 16 bp, M. musculus
tttgtcaataaagttt

SEQ ID NO: 460399 - DNA, 16 bp, M. musculus
tttgtcacagtaacag

SEQ ID NO: 460400 - DNA, 16 bp, M. musculus
tttgtcacctctaagt

SEQ ID NO: 460401 - DNA, 16 bp, M. musculus
tttgtcagcttcaagg

SEQ ID NO: 460402 - DNA, 16 bp, M. musculus
tttgtcaggatctcat

SEQ ID NO: 460403 - DNA, 16 bp, M. musculus
tttgtcatagcaacag

SEQ ID NO: 460404 - DNA, 16 bp, M. musculus
tttgtcatagcaataa

SEQ ID NO: 460405 - DNA, 16 bp, M. musculus
tttgtcatcaatggga

SEQ ID NO: 460406 - DNA, 16 bp, M. musculus
tttgtcatggagtact

SEQ ID NO: 460407 - DNA, 16 bp, M. musculus
tttgtcatggtgtttt

SEQ ID NO: 460408 - DNA, 16 bp, M. musculus
tttgtcattatatgga

SEQ ID NO: 460409 - DNA, 16 bp, M. musculus
tttgtcattgttgttg

SEQ ID NO: 460410 - DNA, 16 bp, M. musculus
tttgtcatttaaaaaa

SEQ ID NO: 460411 - DNA, 16 bp, M. musculus
tttgtcccgtggcccc

SEQ ID NO: 460412 - DNA, 16 bp, M. musculus
tttgtccctacatttc

SEQ ID NO: 460413 - DNA, 16 bp, M. musculus
tttgtccctggcattc

SEQ ID NO: 460414 - DNA, 16 bp, M. musculus
tttgtccctttatttc

SEQ ID NO: 460415 - DNA, 17 bp, M. musculus
tttgtcctacagaagct

SEQ ID NO: 460416 - DNA, 16 bp, M. musculus
tttgtcctatttacag

SEQ ID NO: 460417 - DNA, 16 bp, M. musculus
tttgtccttccataaa

SEQ ID NO: 460418 - DNA, 16 bp, M. musculus
tttgtcgaatgctttt

SEQ ID NO: 460419 - DNA, 16 bp, M. musculus
tttgtctaagaaggta

SEQ ID NO: 460420 - DNA, 16 bp, M. musculus
tttgtctaatttctta

SEQ ID NO: 460421 - DNA, 16 bp, M. musculus
tttgtctacatagtga

SEQ ID NO: 460422 - DNA, 16 bp, M. musculus
tttgtctagaaaattg

SEQ ID NO: 460423 - DNA, 16 bp, M. musculus
tttgtctaggctctgc

SEQ ID NO: 460424 - DNA, 16 bp, M. musculus
tttgtctatcttgttg

SEQ ID NO: 460425 - DNA, 16 bp, M. musculus
tttgtctcaactccaa

SEQ ID NO: 460426 - DNA, 16 bp, M. musculus
tttgtctcagaaaaca

SEQ ID NO: 460427 - DNA, 16 bp, M. musculus
tttgtctcccaaggac

SEQ ID NO: 460428 - DNA, 16 bp, M. musculus
tttgtctccctttggg

SEQ ID NO: 460429 - DNA, 16 bp, M. musculus
tttgtctctctgtgtg

SEQ ID NO: 460430 - DNA, 16 bp, M. musculus
tttgtctctgaggtgg

SEQ ID NO: 460431 - DNA, 16 bp, M. musculus
tttgtctctgcctcct

SEQ ID NO: 460432 - DNA, 19 bp, M. musculus
tttgtctctgtaactcctt

SEQ ID NO: 460433 - DNA, 16 bp, M. musculus
tttgtctctgtgactc

SEQ ID NO: 460434 - DNA, 16 bp, M. musculus
tttgtctgcatgtaca

SEQ ID NO: 460435 - DNA, 16 bp, M. musculus
tttgtctgctcttggg

SEQ ID NO: 460436 - DNA, 16 bp, M. musculus
tttgtctgtccatctg

SEQ ID NO: 460437 - DNA, 16 bp, M. musculus
tttgtctgtctctgta

SEQ ID NO: 460438 - DNA, 16 bp, M. musculus
tttgtctgtctgtctg

SEQ ID NO: 460439 - DNA, 16 bp, M. musculus
tttgtctgtttttaaa

SEQ ID NO: 460440 - DNA, 16 bp, M. musculus
tttgtcttattcacag

SEQ ID NO: 460441 - DNA, 16 bp, M. musculus
tttgtcttattggtct

SEQ ID NO: 460442 - DNA, 16 bp, M. musculus
tttgtcttcagacaca

SEQ ID NO: 460443 - DNA, 16 bp, M. musculus
tttgtcttctcattgt

SEQ ID NO: 460444 - DNA, 16 bp, M. musculus
tttgtctttaaaatta

SEQ ID NO: 460445 - DNA, 16 bp, M. musculus
tttgtctttactataa

SEQ ID NO: 460446 - DNA, 16 bp, M. musculus
tttgtctttggaacaa

SEQ ID NO: 460447 - DNA, 16 bp, M. musculus
tttgtcttttaagaag

SEQ ID NO: 460448 - DNA, 16 bp, M. musculus
tttgtctttttaaaaa

SEQ ID NO: 460449 - DNA, 16 bp, M. musculus
tttgtgaaagaaaaaa

SEQ ID NO: 460450 - DNA, 16 bp, M. musculus
tttgtgaaataaaatg

SEQ ID NO: 460451 - DNA, 17 bp, M. musculus
tttgtgaaatagtttga

SEQ ID NO: 460452 - DNA, 16 bp, M. musculus
tttgtgaagagaaagg

SEQ ID NO: 460453 - DNA, 16 bp, M. musculus
tttgtgaatttcccat

SEQ ID NO: 460454 - DNA, 16 bp, M. musculus
tttgtgacaggatctt

SEQ ID NO: 460455 - DNA, 16 bp, M. musculus
tttgtgacagggtctc

SEQ ID NO: 460456 - DNA, 16 bp, M. musculus
tttgtgaccaactatg

SEQ ID NO: 460457 - DNA, 16 bp, M. musculus
tttgtgaccctggtca

SEQ ID NO: 460458 - DNA, 16 bp, M. musculus
tttgtgactaatgaga

SEQ ID NO: 460459 - DNA, 16 bp, M. musculus
tttgtgagaattttat

SEQ ID NO: 460460 - DNA, 16 bp, M. musculus
tttgtgagactcctaa

SEQ ID NO: 460461 - DNA, 16 bp, M. musculus
tttgtgagagtggggt

SEQ ID NO: 460462 - DNA, 16 bp, M. musculus
tttgtgagcattttat

SEQ ID NO: 460463 - DNA, 16 bp, M. musculus
tttgtgaggaaccacc

SEQ ID NO: 460464 - DNA, 16 bp, M. musculus
tttgtgaggcagggtc

SEQ ID NO: 460465 - DNA, 16 bp, M. musculus
tttgtgagtctctgtg

SEQ ID NO: 460466 - DNA, 16 bp, M. musculus
tttgtgatcaaggaaa

SEQ ID NO: 460467 - DNA, 16 bp, M. musculus
tttgtgattattgaga

SEQ ID NO: 460468 - DNA, 16 bp, M. musculus
tttgtgattgggttac

SEQ ID NO: 460469 - DNA, 22 bp, M. musculus
tttgtgattgggttacctcact

SEQ ID NO: 460470 - DNA, 32 bp, M. musculus
tttgtgcaggaatagaaaccctgactaagaca

SEQ ID NO: 460471 - DNA, 16 bp, M. musculus
tttgtgcagtgctggg

SEQ ID NO: 460472 - DNA, 16 bp, M. musculus
tttgtgcatgagtgtg

SEQ ID NO: 460473 - DNA, 16 bp, M. musculus
tttgtgcatgtttgtg

SEQ ID NO: 460474 - DNA, 16 bp, M. musculus
tttgtgcatttgctgt

SEQ ID NO: 460475 - DNA, 16 bp, M. musculus
tttgtgcctcaggccc

SEQ ID NO: 460476 - DNA, 16 bp, M. musculus
tttgtgctcttaacca

SEQ ID NO: 460477 - DNA, 16 bp, M. musculus
tttgtgctttcagaaa

SEQ ID NO: 460478 - DNA, 16 bp, M. musculus
tttgtgctttttaaaa

SEQ ID NO: 460479 - DNA, 16 bp, M. musculus
tttgtggaagagacag

SEQ ID NO: 460480 - DNA, 16 bp, M. musculus
tttgtggaatagtttt

SEQ ID NO: 460481 - DNA, 16 bp, M. musculus
tttgtggacaagagat

SEQ ID NO: 460482 - DNA, 16 bp, M. musculus
tttgtggacagatatt

SEQ ID NO: 460483 - DNA, 16 bp, M. musculus
tttgtggagttctttg

SEQ ID NO: 460484 - DNA, 17 bp, M. musculus
tttgtggataggctatt

SEQ ID NO: 460485 - DNA, 16 bp, M. musculus
tttgtggctgtcttct

SEQ ID NO: 460486 - DNA, 16 bp, M. musculus
tttgtgggtggattga

SEQ ID NO: 460487 - DNA, 16 bp, M. musculus
tttgtggtctgtgctg

SEQ ID NO: 460488 - DNA, 16 bp, M. musculus
tttgtggttttctgta

SEQ ID NO: 460489 - DNA, 16 bp, M. musculus
tttgtggtttttcaag

SEQ ID NO: 460490 - DNA, 16 bp, M. musculus
tttgtgtaaagatatt

SEQ ID NO: 460491 - DNA, 16 bp, M. musculus
tttgtgtaagataaaa

SEQ ID NO: 460492 - DNA, 16 bp, M. musculus
tttgtgtaccatgtgt

SEQ ID NO: 460493 - DNA, 16 bp, M. musculus
tttgtgtacctgtgtg

SEQ ID NO: 460494 - DNA, 16 bp, M. musculus
tttgtgtacggctcct

SEQ ID NO: 460495 - DNA, 16 bp, M. musculus
tttgtgtatatatgtg

SEQ ID NO: 460496 - DNA, 16 bp, M. musculus
tttgtgtatcaagttg

SEQ ID NO: 460497 - DNA, 16 bp, M. musculus
tttgtgtatgtctgtg

SEQ ID NO: 460498 - DNA, 16 bp, M. musculus
tttgtgtccattcctc

SEQ ID NO: 460499 - DNA, 16 bp, M. musculus
tttgtgtgcatgaatg

SEQ ID NO: 460500 - DNA, 16 bp, M. musculus
tttgtgtgcatgtgca

SEQ ID NO: 460501 - DNA, 16 bp, M. musculus
tttgtgtgcatgtgtg

SEQ ID NO: 460502 - DNA, 16 bp, M. musculus
tttgtgtggctatctt

SEQ ID NO: 460503 - DNA, 16 bp, M. musculus
tttgtgtggtttagct

SEQ ID NO: 460504 - DNA, 16 bp, M. musculus
tttgtgtgtacataca

SEQ ID NO: 460505 - DNA, 16 bp, M. musculus
tttgtgtgtctctctc

SEQ ID NO: 460506 - DNA, 16 bp, M. musculus
tttgtgtgtgcatgtg

SEQ ID NO: 460507 - DNA, 16 bp, M. musculus
tttgtgtgtgtacatg

SEQ ID NO: 460508 - DNA, 16 bp, M. musculus
tttgtgtgtgtgagca

SEQ ID NO: 460509 - DNA, 16 bp, M. musculus
tttgtgtgtgtgtaaa

SEQ ID NO: 460510 - DNA, 16 bp, M. musculus
tttgtgtgtgtgtgca

SEQ ID NO: 460511 - DNA, 16 bp, M. musculus
tttgtgttagaaactt

SEQ ID NO: 460512 - DNA, 16 bp, M. musculus
tttgtgttattccaga

SEQ ID NO: 460513 - DNA, 16 bp, M. musculus
tttgtgttcatatgtg

SEQ ID NO: 460514 - DNA, 16 bp, M. musculus
tttgtgttgaccatct

SEQ ID NO: 460515 - DNA, 16 bp, M. musculus
tttgtgttgtccatat

SEQ ID NO: 460516 - DNA, 16 bp, M. musculus
tttgtgtttaaaaaaa

SEQ ID NO: 460517 - DNA, 16 bp, M. musculus
tttgtgtttccttgat

SEQ ID NO: 460518 - DNA, 16 bp, M. musculus
tttgtgtttgagacag

SEQ ID NO: 460519 - DNA, 16 bp, M. musculus
tttgtgtttgagtgaa

SEQ ID NO: 460520 - DNA, 16 bp, M. musculus
tttgtgttttgagaaa

SEQ ID NO: 460521 - DNA, 16 bp, M. musculus
tttgtgtttttacaaa

SEQ ID NO: 460522 - DNA, 16 bp, M. musculus
tttgttaaaaaaacaa

SEQ ID NO: 460523 - DNA, 16 bp, M. musculus
tttgttaaaaacaaaa

SEQ ID NO: 460524 - DNA, 16 bp, M. musculus
tttgttaaatccattt

SEQ ID NO: 460525 - DNA, 16 bp, M. musculus
tttgttaactttgggt

SEQ ID NO: 460526 - DNA, 31 bp, M. musculus
tttgttaagtcacagattgaagctgctttaa

SEQ ID NO: 460527 - DNA, 16 bp, M. musculus
tttgttaatgcaatta

SEQ ID NO: 460528 - DNA, 16 bp, M. musculus
tttgttactttgtctg

SEQ ID NO: 460529 - DNA, 16 bp, M. musculus
tttgttagtagccatg

SEQ ID NO: 460530 - DNA, 16 bp, M. musculus
tttgttatcaaattgc

SEQ ID NO: 460531 - DNA, 16 bp, M. musculus
tttgttattcctcagt

SEQ ID NO: 460532 - DNA, 16 bp, M. musculus
tttgttatttatacaa

SEQ ID NO: 460533 - DNA, 16 bp, M. musculus
tttgttcacttctgag

SEQ ID NO: 460534 - DNA, 16 bp, M. musculus
tttgttcaggaaaatt

SEQ ID NO: 460535 - DNA, 16 bp, M. musculus
tttgttcatgttttcc

SEQ ID NO: 460536 - DNA, 16 bp, M. musculus
tttgttcatttaaaaa

SEQ ID NO: 460537 - DNA, 16 bp, M. musculus
tttgttccacatcctc

SEQ ID NO: 460538 - DNA, 24 bp, M. musculus
tttgttccacctatagggttgcag

SEQ ID NO: 460539 - DNA, 16 bp, M. musculus
tttgttccatttcact

SEQ ID NO: 460540 - DNA, 16 bp, M. musculus
tttgttcctgtgtcct

SEQ ID NO: 460541 - DNA, 16 bp, M. musculus
tttgttcctgttcctg

SEQ ID NO: 460542 - DNA, 16 bp, M. musculus
tttgttctaaagcttt

SEQ ID NO: 460543 - DNA, 16 bp, M. musculus
tttgttctcagctctt

SEQ ID NO: 460544 - DNA, 16 bp, M. musculus
tttgttctctggttta

SEQ ID NO: 460545 - DNA, 16 bp, M. musculus
tttgttctcttagggt

SEQ ID NO: 460546 - DNA, 16 bp, M. musculus
tttgttctgatgatgc

SEQ ID NO: 460547 - DNA, 16 bp, M. musculus
tttgttctgccttcta

SEQ ID NO: 460548 - DNA, 16 bp, M. musculus
tttgttctgtgcattt

SEQ ID NO: 460549 - DNA, 16 bp, M. musculus
tttgttcttatagaaa

SEQ ID NO: 460550 - DNA, 16 bp, M. musculus
tttgttcttccagagg

SEQ ID NO: 460551 - DNA, 16 bp, M. musculus
tttgttctttgctcta

SEQ ID NO: 460552 - DNA, 16 bp, M. musculus
tttgttcttttaaaaa

SEQ ID NO: 460553 - DNA, 16 bp, M. musculus
tttgttcttttccatc

SEQ ID NO: 460554 - DNA, 16 bp, M. musculus
tttgttcttttgtgac

SEQ ID NO: 460555 - DNA, 16 bp, M. musculus
tttgttgaaaaatatt

SEQ ID NO: 460556 - DNA, 16 bp, M. musculus
tttgttgaaaataaaa

SEQ ID NO: 460557 - DNA, 16 bp, M. musculus
tttgttgaaaataatt

SEQ ID NO: 460558 - DNA, 16 bp, M. musculus
tttgttgaagacactt

SEQ ID NO: 460559 - DNA, 32 bp, M. musculus
tttgttgacattctgaatgcttctaagtaaat

SEQ ID NO: 460560 - DNA, 16 bp, M. musculus
tttgttgctgctgctg

SEQ ID NO: 460561 - DNA, 16 bp, M. musculus
tttgttgctgggagta

SEQ ID NO: 460562 - DNA, 16 bp, M. musculus
tttgttgctgtgaaga

SEQ ID NO: 460563 - DNA, 16 bp, M. musculus
tttgttgctgttattg

SEQ ID NO: 460564 - DNA, 16 bp, M. musculus
tttgttggaatttaag

SEQ ID NO: 460565 - DNA, 16 bp, M. musculus
tttgttggagacaggg

SEQ ID NO: 460566 - DNA, 16 bp, M. musculus
tttgttggaggaagtg

SEQ ID NO: 460567 - DNA, 16 bp, M. musculus
tttgttggaggaattg

SEQ ID NO: 460568 - DNA, 16 bp, M. musculus
tttgttgggggcctca

SEQ ID NO: 460569 - DNA, 16 bp, M. musculus
tttgttgtaaatgctg

SEQ ID NO: 460570 - DNA, 16 bp, M. musculus
tttgttgtatattgct

SEQ ID NO: 460571 - DNA, 17 bp, M. musculus
tttgttgtgcaaacctt

SEQ ID NO: 460572 - DNA, 16 bp, M. musculus
tttgttgttacagttg

SEQ ID NO: 460573 - DNA, 16 bp, M. musculus
tttgttgttctgaata

SEQ ID NO: 460574 - DNA, 16 bp, M. musculus
tttgtttaaaaacaaa

SEQ ID NO: 460575 - DNA, 16 bp, M. musculus
tttgtttaaaaagaat

SEQ ID NO: 460576 - DNA, 16 bp, M. musculus
tttgtttaagaaaaaa

SEQ ID NO: 460577 - DNA, 16 bp, M. musculus
tttgtttagaaaaaaa

SEQ ID NO: 460578 - DNA, 16 bp, M. musculus
tttgtttagctctgta

SEQ ID NO: 460579 - DNA, 16 bp, M. musculus
tttgtttatatacttg

SEQ ID NO: 460580 - DNA, 16 bp, M. musculus
tttgtttatatcatgg

SEQ ID NO: 460581 - DNA, 16 bp, M. musculus
tttgtttatccattta

SEQ ID NO: 460582 - DNA, 16 bp, M. musculus
tttgtttattcattca

SEQ ID NO: 460583 - DNA, 16 bp, M. musculus
tttgtttattgccttg

SEQ ID NO: 460584 - DNA, 16 bp, M. musculus
tttgtttatttcaaga

SEQ ID NO: 460585 - DNA, 16 bp, M. musculus
tttgtttcaaaaggtt

SEQ ID NO: 460586 - DNA, 16 bp, M. musculus
tttgtttcaagaaaca

SEQ ID NO: 460587 - DNA, 16 bp, M. musculus
tttgtttccaccactg

SEQ ID NO: 460588 - DNA, 16 bp, M. musculus
tttgtttcctgtaata

SEQ ID NO: 460589 - DNA, 16 bp, M. musculus
tttgtttccttttgaa

SEQ ID NO: 460590 - DNA, 16 bp, M. musculus
tttgtttctacttcca

SEQ ID NO: 460591 - DNA, 16 bp, M. musculus
tttgtttctatgtgtg

SEQ ID NO: 460592 - DNA, 16 bp, M. musculus
tttgtttctctgtgta

SEQ ID NO: 460593 - DNA, 16 bp, M. musculus
tttgtttctgagacag

SEQ ID NO: 460594 - DNA, 16 bp, M. musculus
tttgtttctgggggaa

SEQ ID NO: 460595 - DNA, 16 bp, M. musculus
tttgtttcttccctga

SEQ ID NO: 460596 - DNA, 16 bp, M. musculus
tttgtttcttgagaca

SEQ ID NO: 460597 - DNA, 16 bp, M. musculus
tttgtttctttaaaga

SEQ ID NO: 460598 - DNA, 16 bp, M. musculus
tttgtttcttttcaaa

SEQ ID NO: 460599 - DNA, 16 bp, M. musculus
tttgtttgaaaaagaa

SEQ ID NO: 460600 - DNA, 16 bp, M. musculus
tttgtttgaaacagga

SEQ ID NO: 460601 - DNA, 16 bp, M. musculus
tttgtttgagaaaagg

SEQ ID NO: 460602 - DNA, 16 bp, M. musculus
tttgtttgagacagag

SEQ ID NO: 460603 - DNA, 16 bp, M. musculus
tttgtttgcatgtatg

SEQ ID NO: 460604 - DNA, 16 bp, M. musculus
tttgtttgcattcaaa

SEQ ID NO: 460605 - DNA, 16 bp, M. musculus
tttgtttgcttttaaa

SEQ ID NO: 460606 - DNA, 16 bp, M. musculus
tttgtttgtcaagaca

SEQ ID NO: 460607 - DNA, 16 bp, M. musculus
tttgtttgtttaagac

SEQ ID NO: 460608 - DNA, 16 bp, M. musculus
tttgtttgtttatcaa

SEQ ID NO: 460609 - DNA, 16 bp, M. musculus
tttgtttgtttcaatg

SEQ ID NO: 460610 - DNA, 16 bp, M. musculus
tttgtttgtttctaag

SEQ ID NO: 460611 - DNA, 16 bp, M. musculus
tttgtttgtttgagaa

SEQ ID NO: 460612 - DNA, 16 bp, M. musculus
tttgtttgttttaaac

SEQ ID NO: 460613 - DNA, 16 bp, M. musculus
tttgttttaaaattct

SEQ ID NO: 460614 - DNA, 16 bp, M. musculus
tttgttttaattaaac

SEQ ID NO: 460615 - DNA, 16 bp, M. musculus
tttgttttagagaaaa

SEQ ID NO: 460616 - DNA, 16 bp, M. musculus
tttgttttaggatgaa

SEQ ID NO: 460617 - DNA, 16 bp, M. musculus
tttgttttataaagaa

SEQ ID NO: 460618 - DNA, 16 bp, M. musculus
tttgttttcaataaaa

SEQ ID NO: 460619 - DNA, 16 bp, M. musculus
tttgttttcagagtct

SEQ ID NO: 460620 - DNA, 16 bp, M. musculus
tttgttttcatgaaaa

SEQ ID NO: 460621 - DNA, 16 bp, M. musculus
tttgttttcatttcaa

SEQ ID NO: 460622 - DNA, 16 bp, M. musculus
tttgttttccagcctt

SEQ ID NO: 460623 - DNA, 16 bp, M. musculus
tttgttttctagaaat

SEQ ID NO: 460624 - DNA, 16 bp, M. musculus
tttgttttcttaatga

SEQ ID NO: 460625 - DNA, 16 bp, M. musculus
tttgttttctttgaaa

SEQ ID NO: 460626 - DNA, 16 bp, M. musculus
tttgttttctttgaga

SEQ ID NO: 460627 - DNA, 16 bp, M. musculus
tttgttttgaaacaaa

SEQ ID NO: 460628 - DNA, 16 bp, M. musculus
tttgttttgaaagaga

SEQ ID NO: 460629 - DNA, 16 bp, M. musculus
tttgttttgagaaaat

SEQ ID NO: 460630 - DNA, 16 bp, M. musculus
tttgttttgagacaga

SEQ ID NO: 460631 - DNA, 16 bp, M. musculus
tttgttttgagacagc

SEQ ID NO: 460632 - DNA, 16 bp, M. musculus
tttgttttgagacagg

SEQ ID NO: 460633 - DNA, 16 bp, M. musculus
tttgttttgagatggg

SEQ ID NO: 460634 - DNA, 16 bp, M. musculus
tttgttttgatttcca

SEQ ID NO: 460635 - DNA, 16 bp, M. musculus
tttgttttgctttaaa

SEQ ID NO: 460636 - DNA, 16 bp, M. musculus
tttgttttgctttaag

SEQ ID NO: 460637 - DNA, 16 bp, M. musculus
tttgttttgtaaaact

SEQ ID NO: 460638 - DNA, 16 bp, M. musculus
tttgttttgtgtctga

SEQ ID NO: 460639 - DNA, 16 bp, M. musculus
tttgtttttaaaaaga

SEQ ID NO: 460640 - DNA, 16 bp, M. musculus
tttgtttttaaaaatc

SEQ ID NO: 460641 - DNA, 16 bp, M. musculus
tttgtttttaaaacag

SEQ ID NO: 460642 - DNA, 16 bp, M. musculus
tttgtttttaaacatt

SEQ ID NO: 460643 - DNA, 16 bp, M. musculus
tttgtttttaaacctt

SEQ ID NO: 460644 - DNA, 16 bp, M. musculus
tttgtttttaaactgt

SEQ ID NO: 460645 - DNA, 16 bp, M. musculus
tttgtttttaaagagt

SEQ ID NO: 460646 - DNA, 16 bp, M. musculus
tttgtttttaacatgg

SEQ ID NO: 460647 - DNA, 16 bp, M. musculus
tttgtttttaagaaaa

SEQ ID NO: 460648 - DNA, 16 bp, M. musculus
tttgtttttaagagag

SEQ ID NO: 460649 - DNA, 16 bp, M. musculus
tttgtttttaatgctg

SEQ ID NO: 460650 - DNA, 16 bp, M. musculus
tttgtttttacattaa

SEQ ID NO: 460651 - DNA, 16 bp, M. musculus
tttgtttttataaaac

SEQ ID NO: 460652 - DNA, 16 bp, M. musculus
tttgtttttataaaca

SEQ ID NO: 460653 - DNA, 16 bp, M. musculus
tttgtttttcaaacag

SEQ ID NO: 460654 - DNA, 16 bp, M. musculus
tttgtttttcaaatgt

SEQ ID NO: 460655 - DNA, 16 bp, M. musculus
tttgtttttcatgaca

SEQ ID NO: 460656 - DNA, 16 bp, M. musculus
tttgtttttccagaaa

SEQ ID NO: 460657 - DNA, 16 bp, M. musculus
tttgtttttctagaca

SEQ ID NO: 460658 - DNA, 16 bp, M. musculus
tttgtttttctgaaga

SEQ ID NO: 460659 - DNA, 16 bp, M. musculus
tttgtttttctggaaa

SEQ ID NO: 460660 - DNA, 16 bp, M. musculus
tttgtttttgaaaaaa

SEQ ID NO: 460661 - DNA, 16 bp, M. musculus
tttgtttttgagaaag

SEQ ID NO: 460662 - DNA, 16 bp, M. musculus
tttgtttttgagtcag

SEQ ID NO: 460663 - DNA, 16 bp, M. musculus
tttgttttttaactga

SEQ ID NO: 460664 - DNA, 16 bp, M. musculus
tttgttttttaatgac

SEQ ID NO: 460665 - DNA, 16 bp, M. musculus
tttgttttttcaaaat

SEQ ID NO: 460666 - DNA, 17 bp, M. musculus
tttgttttttcgaaaca

SEQ ID NO: 460667 - DNA, 16 bp, M. musculus
tttgttttttctgaga

SEQ ID NO: 460668 - DNA, 16 bp, M. musculus
tttgttttttgagaaa

SEQ ID NO: 460669 - DNA, 16 bp, M. musculus
tttgttttttgagtca

SEQ ID NO: 460670 - DNA, 16 bp, M. musculus
tttgttttttggagac

SEQ ID NO: 460671 - DNA, 16 bp, M. musculus
tttgtttttttaaaca

SEQ ID NO: 460672 - DNA, 16 bp, M. musculus
tttgtttttttcaaag

SEQ ID NO: 460673 - DNA, 16 bp, M. musculus
tttgtttttttcccag

SEQ ID NO: 460674 - DNA, 16 bp, M. musculus
tttgtttttttcccca

SEQ ID NO: 460675 - DNA, 16 bp, M. musculus
ttttaaaaaaaagtgt

SEQ ID NO: 460676 - DNA, 16 bp, M. musculus
ttttaaaaaaaattcc

SEQ ID NO: 460677 - DNA, 16 bp, M. musculus
ttttaaaaaaagaaca

SEQ ID NO: 460678 - DNA, 16 bp, M. musculus
ttttaaaaaaagacac

SEQ ID NO: 460679 - DNA, 16 bp, M. musculus
ttttaaaaaaagcaac

SEQ ID NO: 460680 - DNA, 16 bp, M. musculus
ttttaaaaaaaggtca

SEQ ID NO: 460681 - DNA, 16 bp, M. musculus
ttttaaaaaaagtctt

SEQ ID NO: 460682 - DNA, 16 bp, M. musculus
ttttaaaaaaagtgta

SEQ ID NO: 460683 - DNA, 16 bp, M. musculus
ttttaaaaaaatcaga

SEQ ID NO: 460684 - DNA, 16 bp, M. musculus
ttttaaaaaaatccat

SEQ ID NO: 460685 - DNA, 16 bp, M. musculus
ttttaaaaaaatggct

SEQ ID NO: 460686 - DNA, 16 bp, M. musculus
ttttaaaaaaccttaa

SEQ ID NO: 460687 - DNA, 16 bp, M. musculus
ttttaaaaaactgaaa

SEQ ID NO: 460688 - DNA, 16 bp, M. musculus
ttttaaaaaactgttt

SEQ ID NO: 460689 - DNA, 16 bp, M. musculus
ttttaaaaaagaacta

SEQ ID NO: 460690 - DNA, 16 bp, M. musculus
ttttaaaaaagaatca

SEQ ID NO: 460691 - DNA, 16 bp, M. musculus
ttttaaaaaagatgta

SEQ ID NO: 460692 - DNA, 16 bp, M. musculus
ttttaaaaaagattca

SEQ ID NO: 460693 - DNA, 16 bp, M. musculus
ttttaaaaaagcaaaa

SEQ ID NO: 460694 - DNA, 16 bp, M. musculus
ttttaaaaaagcattt

SEQ ID NO: 460695 - DNA, 16 bp, M. musculus
ttttaaaaaaggaaag

SEQ ID NO: 460696 - DNA, 16 bp, M. musculus
ttttaaaaaagggaaa

SEQ ID NO: 460697 - DNA, 16 bp, M. musculus
ttttaaaaaagggttt

SEQ ID NO: 460698 - DNA, 16 bp, M. musculus
ttttaaaaaagtcatt

SEQ ID NO: 460699 - DNA, 16 bp, M. musculus
ttttaaaaaatagcaa

SEQ ID NO: 460700 - DNA, 16 bp, M. musculus
ttttaaaaaatcagta

SEQ ID NO: 460701 - DNA, 16 bp, M. musculus
ttttaaaaaatctagt

SEQ ID NO: 460702 - DNA, 16 bp, M. musculus
ttttaaaaaatctgaa

SEQ ID NO: 460703 - DNA, 16 bp, M. musculus
ttttaaaaaatcttag

SEQ ID NO: 460704 - DNA, 16 bp, M. musculus
ttttaaaaaatgagtt

SEQ ID NO: 460705 - DNA, 16 bp, M. musculus
ttttaaaaaatgcaaa

SEQ ID NO: 460706 - DNA, 16 bp, M. musculus
ttttaaaaaatgcata

SEQ ID NO: 460707 - DNA, 16 bp, M. musculus
ttttaaaaaatgcatt

SEQ ID NO: 460708 - DNA, 16 bp, M. musculus
ttttaaaaaatggctg

SEQ ID NO: 460709 - DNA, 16 bp, M. musculus
ttttaaaaaatgtatc

SEQ ID NO: 460710 - DNA, 16 bp, M. musculus
ttttaaaaaatgtgta

SEQ ID NO: 460711 - DNA, 16 bp, M. musculus
ttttaaaaaatgtgtt

SEQ ID NO: 460712 - DNA, 16 bp, M. musculus
ttttaaaaaatgttca

SEQ ID NO: 460713 - DNA, 16 bp, M. musculus
ttttaaaaaatgttcc

SEQ ID NO: 460714 - DNA, 16 bp, M. musculus
ttttaaaaaattaacc

SEQ ID NO: 460715 - DNA, 16 bp, M. musculus
ttttaaaaacaaactt

SEQ ID NO: 460716 - DNA, 16 bp, M. musculus
ttttaaaaacaaatga

SEQ ID NO: 460717 - DNA, 16 bp, M. musculus
ttttaaaaacacagaa

SEQ ID NO: 460718 - DNA, 16 bp, M. musculus
ttttaaaaacactgaa

SEQ ID NO: 460719 - DNA, 16 bp, M. musculus
ttttaaaaacatagaa

SEQ ID NO: 460720 - DNA, 16 bp, M. musculus
ttttaaaaacatcttt

SEQ ID NO: 460721 - DNA, 16 bp, M. musculus
ttttaaaaacatgact

SEQ ID NO: 460722 - DNA, 16 bp, M. musculus
ttttaaaaacattcaa

SEQ ID NO: 460723 - DNA, 16 bp, M. musculus
ttttaaaaactaactt

SEQ ID NO: 460724 - DNA, 16 bp, M. musculus
ttttaaaaactacatt

SEQ ID NO: 460725 - DNA, 16 bp, M. musculus
ttttaaaaactagtat

SEQ ID NO: 460726 - DNA, 16 bp, M. musculus
ttttaaaaactgaaaa

SEQ ID NO: 460727 - DNA, 16 bp, M. musculus
ttttaaaaactgtaaa

SEQ ID NO: 460728 - DNA, 16 bp, M. musculus
ttttaaaaactgtttt

SEQ ID NO: 460729 - DNA, 16 bp, M. musculus
ttttaaaaacttgctt

SEQ ID NO: 460730 - DNA, 16 bp, M. musculus
ttttaaaaacttgttt

SEQ ID NO: 460731 - DNA, 16 bp, M. musculus
ttttaaaaactttgtt

SEQ ID NO: 460732 - DNA, 16 bp, M. musculus
ttttaaaaagaaaaac

SEQ ID NO: 460733 - DNA, 16 bp, M. musculus
ttttaaaaagaaaaca

SEQ ID NO: 460734 - DNA, 16 bp, M. musculus
ttttaaaaagaaacag

SEQ ID NO: 460735 - DNA, 16 bp, M. musculus
ttttaaaaagaatttg

SEQ ID NO: 460736 - DNA, 16 bp, M. musculus
ttttaaaaagacagaa

SEQ ID NO: 460737 - DNA, 16 bp, M. musculus
ttttaaaaagacagat

SEQ ID NO: 460738 - DNA, 16 bp, M. musculus
ttttaaaaagacattt

SEQ ID NO: 460739 - DNA, 16 bp, M. musculus
ttttaaaaagatcttt

SEQ ID NO: 460740 - DNA, 16 bp, M. musculus
ttttaaaaagcagttt

SEQ ID NO: 460741 - DNA, 16 bp, M. musculus
ttttaaaaagccttaa

SEQ ID NO: 460742 - DNA, 16 bp, M. musculus
ttttaaaaagctaaaa

SEQ ID NO: 460743 - DNA, 16 bp, M. musculus
ttttaaaaagctactt

SEQ ID NO: 460744 - DNA, 16 bp, M. musculus
ttttaaaaaggaaagc

SEQ ID NO: 460745 - DNA, 16 bp, M. musculus
ttttaaaaaggaattt

SEQ ID NO: 460746 - DNA, 16 bp, M. musculus
ttttaaaaaggtgaaa

SEQ ID NO: 460747 - DNA, 16 bp, M. musculus
ttttaaaaaggtgttt

SEQ ID NO: 460748 - DNA, 16 bp, M. musculus
ttttaaaaagtaagtt

SEQ ID NO: 460749 - DNA, 16 bp, M. musculus
ttttaaaaagtagaca

SEQ ID NO: 460750 - DNA, 16 bp, M. musculus
ttttaaaaagtcaaat

SEQ ID NO: 460751 - DNA, 16 bp, M. musculus
ttttaaaaagtcaata

SEQ ID NO: 460752 - DNA, 16 bp, M. musculus
ttttaaaaagtcatca

SEQ ID NO: 460753 - DNA, 16 bp, M. musculus
ttttaaaaagtctttt

SEQ ID NO: 460754 - DNA, 16 bp, M. musculus
ttttaaaaagtgattt

SEQ ID NO: 460755 - DNA, 16 bp, M. musculus
ttttaaaaagtgcttt

SEQ ID NO: 460756 - DNA, 16 bp, M. musculus
ttttaaaaagtggaaa

SEQ ID NO: 460757 - DNA, 16 bp, M. musculus
ttttaaaaagttagaa

SEQ ID NO: 460758 - DNA, 16 bp, M. musculus
ttttaaaaagttcaaa

SEQ ID NO: 460759 - DNA, 16 bp, M. musculus
ttttaaaaagttgaaa

SEQ ID NO: 460760 - DNA, 16 bp, M. musculus
ttttaaaaagttgatt

SEQ ID NO: 460761 - DNA, 16 bp, M. musculus
ttttaaaaagttttct

SEQ ID NO: 460762 - DNA, 16 bp, M. musculus
ttttaaaaataagaac

SEQ ID NO: 460763 - DNA, 16 bp, M. musculus
ttttaaaaataccttt

SEQ ID NO: 460764 - DNA, 16 bp, M. musculus
ttttaaaaatatgaac

SEQ ID NO: 460765 - DNA, 16 bp, M. musculus
ttttaaaaatcacata

SEQ ID NO: 460766 - DNA, 16 bp, M. musculus
ttttaaaaatcacatt

SEQ ID NO: 460767 - DNA, 16 bp, M. musculus
ttttaaaaatcactgt

SEQ ID NO: 460768 - DNA, 16 bp, M. musculus
ttttaaaaatcagttt

SEQ ID NO: 460769 - DNA, 16 bp, M. musculus
ttttaaaaatcattga

SEQ ID NO: 460770 - DNA, 16 bp, M. musculus
ttttaaaaatcccaaa

SEQ ID NO: 460771 - DNA, 16 bp, M. musculus
ttttaaaaatctgatt

SEQ ID NO: 460772 - DNA, 16 bp, M. musculus
ttttaaaaatctgctt

SEQ ID NO: 460773 - DNA, 16 bp, M. musculus
ttttaaaaatctgtga

SEQ ID NO: 460774 - DNA, 16 bp, M. musculus
ttttaaaaatgaaact

SEQ ID NO: 460775 - DNA, 16 bp, M. musculus
ttttaaaaatgattgt

SEQ ID NO: 460776 - DNA, 16 bp, M. musculus
ttttaaaaatgccaaa

SEQ ID NO: 460777 - DNA, 16 bp, M. musculus
ttttaaaaatgtaagt

SEQ ID NO: 460778 - DNA, 16 bp, M. musculus
ttttaaaaatgtactt

SEQ ID NO: 460779 - DNA, 16 bp, M. musculus
ttttaaaaatgtcttt

SEQ ID NO: 460780 - DNA, 16 bp, M. musculus
ttttaaaaatgtggta

SEQ ID NO: 460781 - DNA, 16 bp, M. musculus
ttttaaaaatgtgtct

SEQ ID NO: 460782 - DNA, 16 bp, M. musculus
ttttaaaaattaaagg

SEQ ID NO: 460783 - DNA, 16 bp, M. musculus
ttttaaaaattagctt

SEQ ID NO: 460784 - DNA, 16 bp, M. musculus
ttttaaaaattctact

SEQ ID NO: 460785 - DNA, 16 bp, M. musculus
ttttaaaaattgagaa

SEQ ID NO: 460786 - DNA, 16 bp, M. musculus
ttttaaaaattggata

SEQ ID NO: 460787 - DNA, 16 bp, M. musculus
ttttaaaacaaagaaa

SEQ ID NO: 460788 - DNA, 16 bp, M. musculus
ttttaaaacaagaaaa

SEQ ID NO: 460789 - DNA, 16 bp, M. musculus
ttttaaaacaatcttt

SEQ ID NO: 460790 - DNA, 16 bp, M. musculus
ttttaaaacaatttca

SEQ ID NO: 460791 - DNA, 16 bp, M. musculus
ttttaaaacactgaaa

SEQ ID NO: 460792 - DNA, 16 bp, M. musculus
ttttaaaacactttaa

SEQ ID NO: 460793 - DNA, 16 bp, M. musculus
ttttaaaacatcaatt

SEQ ID NO: 460794 - DNA, 16 bp, M. musculus
ttttaaaacatgaaaa

SEQ ID NO: 460795 - DNA, 16 bp, M. musculus
ttttaaaaccaaggat

SEQ ID NO: 460796 - DNA, 16 bp, M. musculus
ttttaaaaccacattt

SEQ ID NO: 460797 - DNA, 16 bp, M. musculus
ttttaaaaccagaaaa

SEQ ID NO: 460798 - DNA, 16 bp, M. musculus
ttttaaaaccagtcag

SEQ ID NO: 460799 - DNA, 16 bp, M. musculus
ttttaaaaccatgttt

SEQ ID NO: 460800 - DNA, 16 bp, M. musculus
ttttaaaaccccaaag

SEQ ID NO: 460801 - DNA, 16 bp, M. musculus
ttttaaaacctgaaaa

SEQ ID NO: 460802 - DNA, 16 bp, M. musculus
ttttaaaactaaagaa

SEQ ID NO: 460803 - DNA, 16 bp, M. musculus
ttttaaaactacattt

SEQ ID NO: 460804 - DNA, 16 bp, M. musculus
ttttaaaactatgaaa

SEQ ID NO: 460805 - DNA, 16 bp, M. musculus
ttttaaaactgtattt

SEQ ID NO: 460806 - DNA, 16 bp, M. musculus
ttttaaaactgttttt

SEQ ID NO: 460807 - DNA, 16 bp, M. musculus
ttttaaaacttaaaac

SEQ ID NO: 460808 - DNA, 16 bp, M. musculus
ttttaaaacttaaaag

SEQ ID NO: 460809 - DNA, 16 bp, M. musculus
ttttaaaacttgtttt

SEQ ID NO: 460810 - DNA, 16 bp, M. musculus
ttttaaaagaaaaaca

SEQ ID NO: 460811 - DNA, 16 bp, M. musculus
ttttaaaagaaaggaa

SEQ ID NO: 460812 - DNA, 16 bp, M. musculus
ttttaaaagaacaata

SEQ ID NO: 460813 - DNA, 16 bp, M. musculus
ttttaaaagaagaaac

SEQ ID NO: 460814 - DNA, 16 bp, M. musculus
ttttaaaagaagccaa

SEQ ID NO: 460815 - DNA, 16 bp, M. musculus
ttttaaaagaattcat

SEQ ID NO: 460816 - DNA, 16 bp, M. musculus
ttttaaaagacaaata

SEQ ID NO: 460817 - DNA, 16 bp, M. musculus
ttttaaaagacaaatt

SEQ ID NO: 460818 - DNA, 16 bp, M. musculus
ttttaaaagacatttt

SEQ ID NO: 460819 - DNA, 16 bp, M. musculus
ttttaaaagactaaat

SEQ ID NO: 460820 - DNA, 16 bp, M. musculus
ttttaaaagactgatt

SEQ ID NO: 460821 - DNA, 16 bp, M. musculus
ttttaaaagagagaga

SEQ ID NO: 460822 - DNA, 16 bp, M. musculus
ttttaaaagagagttt

SEQ ID NO: 460823 - DNA, 16 bp, M. musculus
ttttaaaagatataga

SEQ ID NO: 460824 - DNA, 16 bp, M. musculus
ttttaaaagatattgg

SEQ ID NO: 460825 - DNA, 16 bp, M. musculus
ttttaaaagatcattt

SEQ ID NO: 460826 - DNA, 16 bp, M. musculus
ttttaaaagcaatttt

SEQ ID NO: 460827 - DNA, 16 bp, M. musculus
ttttaaaagcatacat

SEQ ID NO: 460828 - DNA, 16 bp, M. musculus
ttttaaaagcatattt

SEQ ID NO: 460829 - DNA, 16 bp, M. musculus
ttttaaaagcatgttt

SEQ ID NO: 460830 - DNA, 16 bp, M. musculus
ttttaaaagcatttat

SEQ ID NO: 460831 - DNA, 16 bp, M. musculus
ttttaaaagctaaata

SEQ ID NO: 460832 - DNA, 16 bp, M. musculus
ttttaaaagctagaaa

SEQ ID NO: 460833 - DNA, 16 bp, M. musculus
ttttaaaagctatttt

SEQ ID NO: 460834 - DNA, 16 bp, M. musculus
ttttaaaaggaaaaca

SEQ ID NO: 460835 - DNA, 16 bp, M. musculus
ttttaaaaggaaggaa

SEQ ID NO: 460836 - DNA, 16 bp, M. musculus
ttttaaaaggaattta

SEQ ID NO: 460837 - DNA, 16 bp, M. musculus
ttttaaaaggctattt

SEQ ID NO: 460838 - DNA, 16 bp, M. musculus
ttttaaaagggaaaaa

SEQ ID NO: 460839 - DNA, 16 bp, M. musculus
ttttaaaagggaaatt

SEQ ID NO: 460840 - DNA, 16 bp, M. musculus
ttttaaaagtaaaact

SEQ ID NO: 460841 - DNA, 16 bp, M. musculus
ttttaaaagtaaagtt

SEQ ID NO: 460842 - DNA, 16 bp, M. musculus
ttttaaaagtagaatt

SEQ ID NO: 460843 - DNA, 16 bp, M. musculus
ttttaaaagtatcttt

SEQ ID NO: 460844 - DNA, 16 bp, M. musculus
ttttaaaagtcatttt

SEQ ID NO: 460845 - DNA, 16 bp, M. musculus
ttttaaaagtcttttt

SEQ ID NO: 460846 - DNA, 16 bp, M. musculus
ttttaaaagtgaaaag

SEQ ID NO: 460847 - DNA, 16 bp, M. musculus
ttttaaaagtgaattt

SEQ ID NO: 460848 - DNA, 16 bp, M. musculus
ttttaaaagtgtctta

SEQ ID NO: 460849 - DNA, 16 bp, M. musculus
ttttaaaagtgttcaa

SEQ ID NO: 460850 - DNA, 16 bp, M. musculus
ttttaaaagttaaaca

SEQ ID NO: 460851 - DNA, 16 bp, M. musculus
ttttaaaagttaaaga

SEQ ID NO: 460852 - DNA, 16 bp, M. musculus
ttttaaaagttaaagt

SEQ ID NO: 460853 - DNA, 16 bp, M. musculus
ttttaaaagttccttt

SEQ ID NO: 460854 - DNA, 16 bp, M. musculus
ttttaaaagtttcttt

SEQ ID NO: 460855 - DNA, 16 bp, M. musculus
ttttaaaataaatgca

SEQ ID NO: 460856 - DNA, 16 bp, M. musculus
ttttaaaataaatgtc

SEQ ID NO: 460857 - DNA, 16 bp, M. musculus
ttttaaaataacagaa

SEQ ID NO: 460858 - DNA, 16 bp, M. musculus
ttttaaaataattctg

SEQ ID NO: 460859 - DNA, 16 bp, M. musculus
ttttaaaatacagaat

SEQ ID NO: 460860 - DNA, 16 bp, M. musculus
ttttaaaataccaaat

SEQ ID NO: 460861 - DNA, 16 bp, M. musculus
ttttaaaatactgtat

SEQ ID NO: 460862 - DNA, 16 bp, M. musculus
ttttaaaatagacttt

SEQ ID NO: 460863 - DNA, 16 bp, M. musculus
ttttaaaatagcaaat

SEQ ID NO: 460864 - DNA, 16 bp, M. musculus
ttttaaaatatgcaaa

SEQ ID NO: 460865 - DNA, 16 bp, M. musculus
ttttaaaatatttccc

SEQ ID NO: 460866 - DNA, 16 bp, M. musculus
ttttaaaatcacatct

SEQ ID NO: 460867 - DNA, 16 bp, M. musculus
ttttaaaatcacattt

SEQ ID NO: 460868 - DNA, 16 bp, M. musculus
ttttaaaatcagaata

SEQ ID NO: 460869 - DNA, 16 bp, M. musculus
ttttaaaatcatgtta

SEQ ID NO: 460870 - DNA, 16 bp, M. musculus
ttttaaaatcatgttt

SEQ ID NO: 460871 - DNA, 16 bp, M. musculus
ttttaaaatctcaaaa

SEQ ID NO: 460872 - DNA, 16 bp, M. musculus
ttttaaaatgacaaat

SEQ ID NO: 460873 - DNA, 16 bp, M. musculus
ttttaaaatgacttta

SEQ ID NO: 460874 - DNA, 16 bp, M. musculus
ttttaaaatgactttt

SEQ ID NO: 460875 - DNA, 16 bp, M. musculus
ttttaaaatgagattt

SEQ ID NO: 460876 - DNA, 16 bp, M. musculus
ttttaaaatgataatg

SEQ ID NO: 460877 - DNA, 16 bp, M. musculus
ttttaaaatgctttct

SEQ ID NO: 460878 - DNA, 16 bp, M. musculus
ttttaaaatggaaatt

SEQ ID NO: 460879 - DNA, 16 bp, M. musculus
ttttaaaatggcatat

SEQ ID NO: 460880 - DNA, 16 bp, M. musculus
ttttaaaatggtttaa

SEQ ID NO: 460881 - DNA, 16 bp, M. musculus
ttttaaaatgtaatgt

SEQ ID NO: 460882 - DNA, 16 bp, M. musculus
ttttaaaatgtacatt

SEQ ID NO: 460883 - DNA, 16 bp, M. musculus
ttttaaaatgtataca

SEQ ID NO: 460884 - DNA, 16 bp, M. musculus
ttttaaaatgtatgta

SEQ ID NO: 460885 - DNA, 16 bp, M. musculus
ttttaaaatgtcatca

SEQ ID NO: 460886 - DNA, 16 bp, M. musculus
ttttaaaatgtcattt

SEQ ID NO: 460887 - DNA, 16 bp, M. musculus
ttttaaaatgtcttga

SEQ ID NO: 460888 - DNA, 16 bp, M. musculus
ttttaaaatgtgaaat

SEQ ID NO: 460889 - DNA, 16 bp, M. musculus
ttttaaaatgtggttt

SEQ ID NO: 460890 - DNA, 16 bp, M. musculus
ttttaaaatgttaaca

SEQ ID NO: 460891 - DNA, 16 bp, M. musculus
ttttaaaatgttggct

SEQ ID NO: 460892 - DNA, 16 bp, M. musculus
ttttaaaattagatgt

SEQ ID NO: 460893 - DNA, 16 bp, M. musculus
ttttaaaattcagtct

SEQ ID NO: 460894 - DNA, 16 bp, M. musculus
ttttaaaattccaaaa

SEQ ID NO: 460895 - DNA, 16 bp, M. musculus
ttttaaaattctttgt

SEQ ID NO: 460896 - DNA, 16 bp, M. musculus
ttttaaaattgtgtgt

SEQ ID NO: 460897 - DNA, 16 bp, M. musculus
ttttaaaatttcctcc

SEQ ID NO: 460898 - DNA, 16 bp, M. musculus
ttttaaaatttgcttt

SEQ ID NO: 460899 - DNA, 16 bp, M. musculus
ttttaaaatttggaaa

SEQ ID NO: 460900 - DNA, 16 bp, M. musculus
ttttaaaatttggata

SEQ ID NO: 460901 - DNA, 16 bp, M. musculus
ttttaaaatttggatg

SEQ ID NO: 460902 - DNA, 16 bp, M. musculus
ttttaaacaaaacaga

SEQ ID NO: 460903 - DNA, 16 bp, M. musculus
ttttaaacaaaatcat

SEQ ID NO: 460904 - DNA, 16 bp, M. musculus
ttttaaacaagtgtag

SEQ ID NO: 460905 - DNA, 16 bp, M. musculus
ttttaaacaattgttt

SEQ ID NO: 460906 - DNA, 16 bp, M. musculus
ttttaaacagaagaaa

SEQ ID NO: 460907 - DNA, 16 bp, M. musculus
ttttaaacagctgagt

SEQ ID NO: 460908 - DNA, 16 bp, M. musculus
ttttaaacatgaaatt

SEQ ID NO: 460909 - DNA, 16 bp, M. musculus
ttttaaactatgtgta

SEQ ID NO: 460910 - DNA, 16 bp, M. musculus
ttttaaactttcaaaa

SEQ ID NO: 460911 - DNA, 16 bp, M. musculus
ttttaaactttgaaaa

SEQ ID NO: 460912 - DNA, 16 bp, M. musculus
ttttaaagaaaaacag

SEQ ID NO: 460913 - DNA, 16 bp, M. musculus
ttttaaagaaaacaat

SEQ ID NO: 460914 - DNA, 16 bp, M. musculus
ttttaaagaaaagcaa

SEQ ID NO: 460915 - DNA, 16 bp, M. musculus
ttttaaagaaaatctt

SEQ ID NO: 460916 - DNA, 16 bp, M. musculus
ttttaaagaaaccaaa

SEQ ID NO: 460917 - DNA, 16 bp, M. musculus
ttttaaagaaagaaag

SEQ ID NO: 460918 - DNA, 16 bp, M. musculus
ttttaaagaaagaatt

SEQ ID NO: 460919 - DNA, 16 bp, M. musculus
ttttaaagaaaggaaa

SEQ ID NO: 460920 - DNA, 16 bp, M. musculus
ttttaaagaaatgatt

SEQ ID NO: 460921 - DNA, 16 bp, M. musculus
ttttaaagaaatgttt

SEQ ID NO: 460922 - DNA, 16 bp, M. musculus
ttttaaagaaattctt

SEQ ID NO: 460923 - DNA, 16 bp, M. musculus
ttttaaagaagaaaac

SEQ ID NO: 460924 - DNA, 16 bp, M. musculus
ttttaaagaagaaatt

SEQ ID NO: 460925 - DNA, 16 bp, M. musculus
ttttaaagaagaattt

SEQ ID NO: 460926 - DNA, 16 bp, M. musculus
ttttaaagaatatgta

SEQ ID NO: 460927 - DNA, 16 bp, M. musculus
ttttaaagaatgaaat

SEQ ID NO: 460928 - DNA, 16 bp, M. musculus
ttttaaagacacagtt

SEQ ID NO: 460929 - DNA, 16 bp, M. musculus
ttttaaagacaggctc

SEQ ID NO: 460930 - DNA, 16 bp, M. musculus
ttttaaagacatattt

SEQ ID NO: 460931 - DNA, 16 bp, M. musculus
ttttaaagactgtttt

SEQ ID NO: 460932 - DNA, 16 bp, M. musculus
ttttaaagagaaaaca

SEQ ID NO: 460933 - DNA, 16 bp, M. musculus
ttttaaagagacattt

SEQ ID NO: 460934 - DNA, 16 bp, M. musculus
ttttaaagagagagaa

SEQ ID NO: 460935 - DNA, 16 bp, M. musculus
ttttaaagagtttgaa

SEQ ID NO: 460936 - DNA, 16 bp, M. musculus
ttttaaagataacaaa

SEQ ID NO: 460937 - DNA, 16 bp, M. musculus
ttttaaagatctattt

SEQ ID NO: 460938 - DNA, 16 bp, M. musculus
ttttaaagatgaaatt

SEQ ID NO: 460939 - DNA, 16 bp, M. musculus
ttttaaagatggtata

SEQ ID NO: 460940 - DNA, 16 bp, M. musculus
ttttaaagatgtatgt

SEQ ID NO: 460941 - DNA, 16 bp, M. musculus
ttttaaagcaaaattt

SEQ ID NO: 460942 - DNA, 16 bp, M. musculus
ttttaaagcagtattt

SEQ ID NO: 460943 - DNA, 16 bp, M. musculus
ttttaaagcatatttt

SEQ ID NO: 460944 - DNA, 16 bp, M. musculus
ttttaaagcattattt

SEQ ID NO: 460945 - DNA, 16 bp, M. musculus
ttttaaagcatttact

SEQ ID NO: 460946 - DNA, 16 bp, M. musculus
ttttaaagcttatttt

SEQ ID NO: 460947 - DNA, 16 bp, M. musculus
ttttaaaggaaaaaga

SEQ ID NO: 460948 - DNA, 16 bp, M. musculus
ttttaaaggaaaaatt

SEQ ID NO: 460949 - DNA, 16 bp, M. musculus
ttttaaaggaataatt

SEQ ID NO: 460950 - DNA, 16 bp, M. musculus
ttttaaagggtgttgt

SEQ ID NO: 460951 - DNA, 16 bp, M. musculus
ttttaaaggttttaaa

SEQ ID NO: 460952 - DNA, 16 bp, M. musculus
ttttaaagtagaaata

SEQ ID NO: 460953 - DNA, 16 bp, M. musculus
ttttaaagtagctttt

SEQ ID NO: 460954 - DNA, 16 bp, M. musculus
ttttaaagtatttctt

SEQ ID NO: 460955 - DNA, 16 bp, M. musculus
ttttaaagtctacttt

SEQ ID NO: 460956 - DNA, 16 bp, M. musculus
ttttaaagtctccatt

SEQ ID NO: 460957 - DNA, 16 bp, M. musculus
ttttaaagtctctttt

SEQ ID NO: 460958 - DNA, 16 bp, M. musculus
ttttaaagtgtatgtg

SEQ ID NO: 460959 - DNA, 16 bp, M. musculus
ttttaaagtgtttctc

SEQ ID NO: 460960 - DNA, 16 bp, M. musculus
ttttaaagttattctt

SEQ ID NO: 460961 - DNA, 16 bp, M. musculus
ttttaaagttctataa

SEQ ID NO: 460962 - DNA, 16 bp, M. musculus
ttttaaagttgaaaaa

SEQ ID NO: 460963 - DNA, 16 bp, M. musculus
ttttaaagttgtgtgt

SEQ ID NO: 460964 - DNA, 16 bp, M. musculus
ttttaaagtttaactt

SEQ ID NO: 460965 - DNA, 16 bp, M. musculus
ttttaaagtttgaaaa

SEQ ID NO: 460966 - DNA, 16 bp, M. musculus
ttttaaagttttcaaa

SEQ ID NO: 460967 - DNA, 16 bp, M. musculus
ttttaaagttttgaaa

SEQ ID NO: 460968 - DNA, 16 bp, M. musculus
ttttaaataaatgaga

SEQ ID NO: 460969 - DNA, 16 bp, M. musculus
ttttaaataaatgttc

SEQ ID NO: 460970 - DNA, 16 bp, M. musculus
ttttaaataagcattt

SEQ ID NO: 460971 - DNA, 16 bp, M. musculus
ttttaaataccaaatt

SEQ ID NO: 460972 - DNA, 16 bp, M. musculus
ttttaaatactgaaaa

SEQ ID NO: 460973 - DNA, 16 bp, M. musculus
ttttaaatagcttttt

SEQ ID NO: 460974 - DNA, 16 bp, M. musculus
ttttaaatccaaatct

SEQ ID NO: 460975 - DNA, 16 bp, M. musculus
ttttaaatccaggtct

SEQ ID NO: 460976 - DNA, 16 bp, M. musculus
ttttaaatctgtttta

SEQ ID NO: 460977 - DNA, 16 bp, M. musculus
ttttaaatgaaaactt

SEQ ID NO: 460978 - DNA, 16 bp, M. musculus
ttttaaatgaaaatga

SEQ ID NO: 460979 - DNA, 16 bp, M. musculus
ttttaaatgaaagttt

SEQ ID NO: 460980 - DNA, 16 bp, M. musculus
ttttaaatgacttctt

SEQ ID NO: 460981 - DNA, 16 bp, M. musculus
ttttaaatgatgtgtg

SEQ ID NO: 460982 - DNA, 16 bp, M. musculus
ttttaaatgcagaaaa

SEQ ID NO: 460983 - DNA, 16 bp, M. musculus
ttttaaatgccatatt

SEQ ID NO: 460984 - DNA, 16 bp, M. musculus
ttttaaatgcttttta

SEQ ID NO: 460985 - DNA, 16 bp, M. musculus
ttttaaatgggatatt

SEQ ID NO: 460986 - DNA, 16 bp, M. musculus
ttttaaatggttttct

SEQ ID NO: 460987 - DNA, 16 bp, M. musculus
ttttaaatgtaaacat

SEQ ID NO: 460988 - DNA, 16 bp, M. musculus
ttttaaatgtatgagt

SEQ ID NO: 460989 - DNA, 16 bp, M. musculus
ttttaaatgtcaaaat

SEQ ID NO: 460990 - DNA, 16 bp, M. musculus
ttttaaatgtgtttct

SEQ ID NO: 460991 - DNA, 16 bp, M. musculus
ttttaaatgtttcaaa

SEQ ID NO: 460992 - DNA, 16 bp, M. musculus
ttttaaatgtttcatt

SEQ ID NO: 460993 - DNA, 16 bp, M. musculus
ttttaaattacatgta

SEQ ID NO: 460994 - DNA, 16 bp, M. musculus
ttttaaattatgttca

SEQ ID NO: 460995 - DNA, 16 bp, M. musculus
ttttaaattgtacttt

SEQ ID NO: 460996 - DNA, 16 bp, M. musculus
ttttaaatttcagatt

SEQ ID NO: 460997 - DNA, 16 bp, M. musculus
ttttaaatttctgtgt

SEQ ID NO: 460998 - DNA, 16 bp, M. musculus
ttttaaattttgtatc

SEQ ID NO: 460999 - DNA, 16 bp, M. musculus
ttttaacaatcctaaa

SEQ ID NO: 461000 - DNA, 16 bp, M. musculus
ttttaacattgtaaaa

SEQ ID NO: 461001 - DNA, 16 bp, M. musculus
ttttaaccactgagcc

SEQ ID NO: 461002 - DNA, 16 bp, M. musculus
ttttaactctatgaag

SEQ ID NO: 461003 - DNA, 16 bp, M. musculus
ttttaactgaatattt

SEQ ID NO: 461004 - DNA, 16 bp, M. musculus
ttttaactgccgagcc

SEQ ID NO: 461005 - DNA, 16 bp, M. musculus
ttttaacttacatttc

SEQ ID NO: 461006 - DNA, 16 bp, M. musculus
ttttaacttttaaaag

SEQ ID NO: 461007 - DNA, 16 bp, M. musculus
ttttaacttttaatga

SEQ ID NO: 461008 - DNA, 16 bp, M. musculus
ttttaagaaaaagatt

SEQ ID NO: 461009 - DNA, 16 bp, M. musculus
ttttaagaaaagattt

SEQ ID NO: 461010 - DNA, 16 bp, M. musculus
ttttaagaaaatgttt

SEQ ID NO: 461011 - DNA, 16 bp, M. musculus
ttttaagaaacatttt

SEQ ID NO: 461012 - DNA, 16 bp, M. musculus
ttttaagaaagatatt

SEQ ID NO: 461013 - DNA, 16 bp, M. musculus
ttttaagaaagattta

SEQ ID NO: 461014 - DNA, 16 bp, M. musculus
ttttaagaaagcaaaa

SEQ ID NO: 461015 - DNA, 16 bp, M. musculus
ttttaagaaaggaaaa

SEQ ID NO: 461016 - DNA, 16 bp, M. musculus
ttttaagaaatgaaag

SEQ ID NO: 461017 - DNA, 16 bp, M. musculus
ttttaagaatatgaaa

SEQ ID NO: 461018 - DNA, 16 bp, M. musculus
ttttaagacaaaaaca

SEQ ID NO: 461019 - DNA, 16 bp, M. musculus
ttttaagacaaagtct

SEQ ID NO: 461020 - DNA, 16 bp, M. musculus
ttttaagacagggcct

SEQ ID NO: 461021 - DNA, 16 bp, M. musculus
ttttaagacagggtct

SEQ ID NO: 461022 - DNA, 16 bp, M. musculus
ttttaagacatatttt

SEQ ID NO: 461023 - DNA, 16 bp, M. musculus
ttttaagacatggtct

SEQ ID NO: 461024 - DNA, 16 bp, M. musculus
ttttaagacattaaaa

SEQ ID NO: 461025 - DNA, 16 bp, M. musculus
ttttaagactttattt

SEQ ID NO: 461026 - DNA, 16 bp, M. musculus
ttttaagactttttaa

SEQ ID NO: 461027 - DNA, 16 bp, M. musculus
ttttaagagaaaagaa

SEQ ID NO: 461028 - DNA, 16 bp, M. musculus
ttttaagagaaatttt

SEQ ID NO: 461029 - DNA, 16 bp, M. musculus
ttttaagagagggtct

SEQ ID NO: 461030 - DNA, 16 bp, M. musculus
ttttaagagttacctt

SEQ ID NO: 461031 - DNA, 16 bp, M. musculus
ttttaagatagggtct

SEQ ID NO: 461032 - DNA, 16 bp, M. musculus
ttttaagatagggttt

SEQ ID NO: 461033 - DNA, 16 bp, M. musculus
ttttaagatatacttt

SEQ ID NO: 461034 - DNA, 16 bp, M. musculus
ttttaagatgagaaaa

SEQ ID NO: 461035 - DNA, 28 bp, M. musculus
ttttaagattgaattctgacatagctaa

SEQ ID NO: 461036 - DNA, 16 bp, M. musculus
ttttaagatttacttt

SEQ ID NO: 461037 - DNA, 16 bp, M. musculus
ttttaagattttaaga

SEQ ID NO: 461038 - DNA, 18 bp, M. musculus
ttttaagcatatgtaaag

SEQ ID NO: 461039 - DNA, 16 bp, M. musculus
ttttaaggaaaaatga

SEQ ID NO: 461040 - DNA, 16 bp, M. musculus
ttttaaggaaaaattt

SEQ ID NO: 461041 - DNA, 16 bp, M. musculus
ttttaaggaaaatatt

SEQ ID NO: 461042 - DNA, 16 bp, M. musculus
ttttaaggagaataaa

SEQ ID NO: 461043 - DNA, 16 bp, M. musculus
ttttaaggaggaaaaa

SEQ ID NO: 461044 - DNA, 16 bp, M. musculus
ttttaaggcagggttt

SEQ ID NO: 461045 - DNA, 16 bp, M. musculus
ttttaagggaaaaaaa

SEQ ID NO: 461046 - DNA, 16 bp, M. musculus
ttttaagggctggaga

SEQ ID NO: 461047 - DNA, 16 bp, M. musculus
ttttaaggttctgaga

SEQ ID NO: 461048 - DNA, 16 bp, M. musculus
ttttaagtaaaatgaa

SEQ ID NO: 461049 - DNA, 16 bp, M. musculus
ttttaagtgaaaaatt

SEQ ID NO: 461050 - DNA, 16 bp, M. musculus
ttttaagtgaaaataa

SEQ ID NO: 461051 - DNA, 16 bp, M. musculus
ttttaagtgaagaaaa

SEQ ID NO: 461052 - DNA, 16 bp, M. musculus
ttttaagttctgtgga

SEQ ID NO: 461053 - DNA, 16 bp, M. musculus
ttttaagttgccttgg

SEQ ID NO: 461054 - DNA, 16 bp, M. musculus
ttttaagtttaaaact

SEQ ID NO: 461055 - DNA, 16 bp, M. musculus
ttttaagtttacattt

SEQ ID NO: 461056 - DNA, 16 bp, M. musculus
ttttaagttttaaaac

SEQ ID NO: 461057 - DNA, 16 bp, M. musculus
ttttaataaaatggaa

SEQ ID NO: 461058 - DNA, 16 bp, M. musculus
ttttaataaacccttt

SEQ ID NO: 461059 - DNA, 16 bp, M. musculus
ttttaataactgcttc

SEQ ID NO: 461060 - DNA, 16 bp, M. musculus
ttttaatacagttcct

SEQ ID NO: 461061 - DNA, 16 bp, M. musculus
ttttaataccagcact

SEQ ID NO: 461062 - DNA, 16 bp, M. musculus
ttttaatagctccatt

SEQ ID NO: 461063 - DNA, 17 bp, M. musculus
ttttaatagctgagtag

SEQ ID NO: 461064 - DNA, 17 bp, M. musculus
ttttaatagggttattt

SEQ ID NO: 461065 - DNA, 16 bp, M. musculus
ttttaatagttgtgta

SEQ ID NO: 461066 - DNA, 16 bp, M. musculus
ttttaatattttgcat

SEQ ID NO: 461067 - DNA, 16 bp, M. musculus
ttttaatcccagcact

SEQ ID NO: 461068 - DNA, 16 bp, M. musculus
ttttaatcccaggtgt

SEQ ID NO: 461069 - DNA, 16 bp, M. musculus
ttttaatctcagcact

SEQ ID NO: 461070 - DNA, 16 bp, M. musculus
ttttaatctgaaaaaa

SEQ ID NO: 461071 - DNA, 16 bp, M. musculus
ttttaatgaaaatgtt

SEQ ID NO: 461072 - DNA, 16 bp, M. musculus
ttttaatgaaatttct

SEQ ID NO: 461073 - DNA, 16 bp, M. musculus
ttttaatgaacataaa

SEQ ID NO: 461074 - DNA, 16 bp, M. musculus
ttttaatgaagaaaat

SEQ ID NO: 461075 - DNA, 16 bp, M. musculus
ttttaatgaattcttt

SEQ ID NO: 461076 - DNA, 16 bp, M. musculus
ttttaatgactatttt

SEQ ID NO: 461077 - DNA, 16 bp, M. musculus
ttttaatgacttattt

SEQ ID NO: 461078 - DNA, 16 bp, M. musculus
ttttaatgagaaaata

SEQ ID NO: 461079 - DNA, 16 bp, M. musculus
ttttaatgagaaattt

SEQ ID NO: 461080 - DNA, 16 bp, M. musculus
ttttaatgcatttatt

SEQ ID NO: 461081 - DNA, 16 bp, M. musculus
ttttaatggagaaaaa

SEQ ID NO: 461082 - DNA, 16 bp, M. musculus
ttttaatggctgaata

SEQ ID NO: 461083 - DNA, 16 bp, M. musculus
ttttaatgtatatgag

SEQ ID NO: 461084 - DNA, 16 bp, M. musculus
ttttaatgtctaattt

SEQ ID NO: 461085 - DNA, 16 bp, M. musculus
ttttaattacatgcaa

SEQ ID NO: 461086 - DNA, 16 bp, M. musculus
ttttaattccagcact

SEQ ID NO: 461087 - DNA, 16 bp, M. musculus
ttttaattgcatttat

SEQ ID NO: 461088 - DNA, 16 bp, M. musculus
ttttaattggacaaaa

SEQ ID NO: 461089 - DNA, 16 bp, M. musculus
ttttaatttggaaaat

SEQ ID NO: 461090 - DNA, 16 bp, M. musculus
ttttaattttctgaga

SEQ ID NO: 461091 - DNA, 16 bp, M. musculus
ttttaattttgaaaca

SEQ ID NO: 461092 - DNA, 16 bp, M. musculus
ttttaattttgatgcc

SEQ ID NO: 461093 - DNA, 16 bp, M. musculus
ttttacaaagagaaaa

SEQ ID NO: 461094 - DNA, 16 bp, M. musculus
ttttacaaaggaaaac

SEQ ID NO: 461095 - DNA, 16 bp, M. musculus
ttttacaaatgaaaaa

SEQ ID NO: 461096 - DNA, 16 bp, M. musculus
ttttacaaatgataaa

SEQ ID NO: 461097 - DNA, 16 bp, M. musculus
ttttacaactccattg

SEQ ID NO: 461098 - DNA, 17 bp, M. musculus
ttttacaataccttgtc

SEQ ID NO: 461099 - DNA, 17 bp, M. musculus
ttttacacacacacaca

SEQ ID NO: 461100 - DNA, 16 bp, M. musculus
ttttacactcaatatt

SEQ ID NO: 461101 - DNA, 16 bp, M. musculus
ttttacactccatatt

SEQ ID NO: 461102 - DNA, 16 bp, M. musculus
ttttacactctgtatt

SEQ ID NO: 461103 - DNA, 16 bp, M. musculus
ttttacagaagagaaa

SEQ ID NO: 461104 - DNA, 16 bp, M. musculus
ttttacagagaagaaa

SEQ ID NO: 461105 - DNA, 16 bp, M. musculus
ttttacagaggaagaa

SEQ ID NO: 461106 - DNA, 16 bp, M. musculus
ttttacagataagaaa

SEQ ID NO: 461107 - DNA, 16 bp, M. musculus
ttttacaggcaatggg

SEQ ID NO: 461108 - DNA, 16 bp, M. musculus
ttttacatatatatgt

SEQ ID NO: 461109 - DNA, 16 bp, M. musculus
ttttacatatatgagt

SEQ ID NO: 461110 - DNA, 16 bp, M. musculus
ttttacatatatgcat

SEQ ID NO: 461111 - DNA, 16 bp, M. musculus
ttttacatcttcatcc

SEQ ID NO: 461112 - DNA, 16 bp, M. musculus
ttttacatgggtgctg

SEQ ID NO: 461113 - DNA, 16 bp, M. musculus
ttttacatgtatattt

SEQ ID NO: 461114 - DNA, 16 bp, M. musculus
ttttaccacaataaaa

SEQ ID NO: 461115 - DNA, 16 bp, M. musculus
ttttaccatgtgggtt

SEQ ID NO: 461116 - DNA, 17 bp, M. musculus
ttttacctactcctcat

SEQ ID NO: 461117 - DNA, 16 bp, M. musculus
ttttacctcaaggata

SEQ ID NO: 461118 - DNA, 16 bp, M. musculus
ttttacctttggtgag

SEQ ID NO: 461119 - DNA, 16 bp, M. musculus
ttttacgagacagggt

SEQ ID NO: 461120 - DNA, 16 bp, M. musculus
ttttacgtttgccttt

SEQ ID NO: 461121 - DNA, 16 bp, M. musculus
ttttactatgttgatc

SEQ ID NO: 461122 - DNA, 16 bp, M. musculus
ttttactcatccactt

SEQ ID NO: 461123 - DNA, 16 bp, M. musculus
ttttactctctgtcag

SEQ ID NO: 461124 - DNA, 16 bp, M. musculus
ttttactctgaggttg

SEQ ID NO: 461125 - DNA, 16 bp, M. musculus
ttttactgaagcagac

SEQ ID NO: 461126 - DNA, 16 bp, M. musculus
ttttactgggattgct

SEQ ID NO: 461127 - DNA, 16 bp, M. musculus
ttttactgtaattctt

SEQ ID NO: 461128 - DNA, 16 bp, M. musculus
ttttactgtgttaatc

SEQ ID NO: 461129 - DNA, 16 bp, M. musculus
ttttactgtgttaatt

SEQ ID NO: 461130 - DNA, 16 bp, M. musculus
ttttactgttaattct

SEQ ID NO: 461131 - DNA, 16 bp, M. musculus
ttttactgttgcccca

SEQ ID NO: 461132 - DNA, 16 bp, M. musculus
ttttacttagaaaata

SEQ ID NO: 461133 - DNA, 16 bp, M. musculus
ttttacttgaaaattg

SEQ ID NO: 461134 - DNA, 16 bp, M. musculus
ttttacttgcttagtt

SEQ ID NO: 461135 - DNA, 16 bp, M. musculus
ttttactttatgtatg

SEQ ID NO: 461136 - DNA, 16 bp, M. musculus
ttttacttttaaatgt

SEQ ID NO: 461137 - DNA, 16 bp, M. musculus
ttttacttttcaaatg

SEQ ID NO: 461138 - DNA, 16 bp, M. musculus
ttttacttttctgaga

SEQ ID NO: 461139 - DNA, 16 bp, M. musculus
ttttactttttgaaaa

SEQ ID NO: 461140 - DNA, 16 bp, M. musculus
ttttagaaaacaaaca

SEQ ID NO: 461141 - DNA, 16 bp, M. musculus
ttttagaaaacaaatg

SEQ ID NO: 461142 - DNA, 16 bp, M. musculus
ttttagaaacagtttt

SEQ ID NO: 461143 - DNA, 16 bp, M. musculus
ttttagaaagaaaatg

SEQ ID NO: 461144 - DNA, 16 bp, M. musculus
ttttagaaatgaagaa

SEQ ID NO: 461145 - DNA, 16 bp, M. musculus
ttttagaagaagaaaa

SEQ ID NO: 461146 - DNA, 16 bp, M. musculus
ttttagaagagtgttt

SEQ ID NO: 461147 - DNA, 16 bp, M. musculus
ttttagaatagcaaga

SEQ ID NO: 461148 - DNA, 16 bp, M. musculus
ttttagacagagtctc

SEQ ID NO: 461149 - DNA, 16 bp, M. musculus
ttttagacagagtctt

SEQ ID NO: 461150 - DNA, 16 bp, M. musculus
ttttagagatttaaaa

SEQ ID NO: 461151 - DNA, 16 bp, M. musculus
ttttagagggtatata

SEQ ID NO: 461152 - DNA, 16 bp, M. musculus
ttttagataaattctg

SEQ ID NO: 461153 - DNA, 16 bp, M. musculus
ttttagatagggtttc

SEQ ID NO: 461154 - DNA, 16 bp, M. musculus
ttttagatcttagatg

SEQ ID NO: 461155 - DNA, 16 bp, M. musculus
ttttagatgactctag

SEQ ID NO: 461156 - DNA, 16 bp, M. musculus
ttttagatgttttcat

SEQ ID NO: 461157 - DNA, 16 bp, M. musculus
ttttagatttatcatt

SEQ ID NO: 461158 - DNA, 16 bp, M. musculus
ttttagatttttctaa

SEQ ID NO: 461159 - DNA, 16 bp, M. musculus
ttttagccctgaattt

SEQ ID NO: 461160 - DNA, 16 bp, M. musculus
ttttagctttaaaaaa

SEQ ID NO: 461161 - DNA, 16 bp, M. musculus
ttttagctttgttaca

SEQ ID NO: 461162 - DNA, 16 bp, M. musculus
ttttaggaaaaaacaa

SEQ ID NO: 461163 - DNA, 16 bp, M. musculus
ttttaggaaagattcc

SEQ ID NO: 461164 - DNA, 16 bp, M. musculus
ttttaggaaataaaat

SEQ ID NO: 461165 - DNA, 16 bp, M. musculus
ttttaggatcaaatgt

SEQ ID NO: 461166 - DNA, 16 bp, M. musculus
ttttaggatttaaaaa

SEQ ID NO: 461167 - DNA, 16 bp, M. musculus
ttttaggctcacttat

SEQ ID NO: 461168 - DNA, 16 bp, M. musculus
ttttagggacttcctg

SEQ ID NO: 461169 - DNA, 16 bp, M. musculus
ttttagggttttctgg

SEQ ID NO: 461170 - DNA, 16 bp, M. musculus
ttttaggtctttgatg

SEQ ID NO: 461171 - DNA, 16 bp, M. musculus
ttttagtcagtgtttt

SEQ ID NO: 461172 - DNA, 16 bp, M. musculus
ttttagtgcagaattt

SEQ ID NO: 461173 - DNA, 16 bp, M. musculus
ttttagtggaattcct

SEQ ID NO: 461174 - DNA, 16 bp, M. musculus
ttttagttgtccccaa

SEQ ID NO: 461175 - DNA, 16 bp, M. musculus
ttttagttttgagaca

SEQ ID NO: 461176 - DNA, 16 bp, M. musculus
ttttagtttttcaaaa

SEQ ID NO: 461177 - DNA, 16 bp, M. musculus
ttttagtttttctgaa

SEQ ID NO: 461178 - DNA, 16 bp, M. musculus
ttttataaaaatcagt

SEQ ID NO: 461179 - DNA, 16 bp, M. musculus
ttttataaaacaaaga

SEQ ID NO: 461180 - DNA, 16 bp, M. musculus
ttttataaaagaaaca

SEQ ID NO: 461181 - DNA, 16 bp, M. musculus
ttttataaacaaactc

SEQ ID NO: 461182 - DNA, 16 bp, M. musculus
ttttataaagacattt

SEQ ID NO: 461183 - DNA, 16 bp, M. musculus
ttttataaagcatttt

SEQ ID NO: 461184 - DNA, 16 bp, M. musculus
ttttataaataaagct

SEQ ID NO: 461185 - DNA, 16 bp, M. musculus
ttttataaatgagaaa

SEQ ID NO: 461186 - DNA, 16 bp, M. musculus
ttttataacatttgaa

SEQ ID NO: 461187 - DNA, 16 bp, M. musculus
ttttataagaaagcag

SEQ ID NO: 461188 - DNA, 16 bp, M. musculus
ttttataagagttgtc

SEQ ID NO: 461189 - DNA, 16 bp, M. musculus
ttttataagtcacagt

SEQ ID NO: 461190 - DNA, 16 bp, M. musculus
ttttatacacatacac

SEQ ID NO: 461191 - DNA, 16 bp, M. musculus
ttttatacagttttca

SEQ ID NO: 461192 - DNA, 16 bp, M. musculus
ttttatacatgaaaaa

SEQ ID NO: 461193 - DNA, 16 bp, M. musculus
ttttataccactttaa

SEQ ID NO: 461194 - DNA, 16 bp, M. musculus
ttttatagttacattt

SEQ ID NO: 461195 - DNA, 16 bp, M. musculus
ttttatatctttgtaa

SEQ ID NO: 461196 - DNA, 16 bp, M. musculus
ttttatattacttatg

SEQ ID NO: 461197 - DNA, 16 bp, M. musculus
ttttatattgtggaat

SEQ ID NO: 461198 - DNA, 16 bp, M. musculus
ttttatcaaaagcaat

SEQ ID NO: 461199 - DNA, 16 bp, M. musculus
ttttatcaaaattgct

SEQ ID NO: 461200 - DNA, 16 bp, M. musculus
ttttatcaaaggcctt

SEQ ID NO: 461201 - DNA, 16 bp, M. musculus
ttttatcaaatgcttt

SEQ ID NO: 461202 - DNA, 16 bp, M. musculus
ttttatcaagttgaca

SEQ ID NO: 461203 - DNA, 17 bp, M. musculus
ttttatcaatggacaga

SEQ ID NO: 461204 - DNA, 16 bp, M. musculus
ttttatcacaaatgct

SEQ ID NO: 461205 - DNA, 16 bp, M. musculus
ttttatcacagcaaca

SEQ ID NO: 461206 - DNA, 16 bp, M. musculus
ttttatcagatatttt

SEQ ID NO: 461207 - DNA, 16 bp, M. musculus
ttttatcaggtcccat

SEQ ID NO: 461208 - DNA, 16 bp, M. musculus
ttttatcagttctgtt

SEQ ID NO: 461209 - DNA, 16 bp, M. musculus
ttttatcataaagggg

SEQ ID NO: 461210 - DNA, 16 bp, M. musculus
ttttatcatagcagct

SEQ ID NO: 461211 - DNA, 16 bp, M. musculus
ttttatccccttcctg

SEQ ID NO: 461212 - DNA, 16 bp, M. musculus
ttttatcgtaaacttt

SEQ ID NO: 461213 - DNA, 16 bp, M. musculus
ttttatctatatgtat

SEQ ID NO: 461214 - DNA, 17 bp, M. musculus
ttttatctgatattaaa

SEQ ID NO: 461215 - DNA, 16 bp, M. musculus
ttttatctggagctct

SEQ ID NO: 461216 - DNA, 16 bp, M. musculus
ttttatcttagctatt

SEQ ID NO: 461217 - DNA, 16 bp, M. musculus
ttttatctttgagaag

SEQ ID NO: 461218 - DNA, 16 bp, M. musculus
ttttatctttgctgcc

SEQ ID NO: 461219 - DNA, 16 bp, M. musculus
ttttatgaaaacaaac

SEQ ID NO: 461220 - DNA, 16 bp, M. musculus
ttttatgaagccacaa

SEQ ID NO: 461221 - DNA, 16 bp, M. musculus
ttttatgaatatcgat

SEQ ID NO: 461222 - DNA, 16 bp, M. musculus
ttttatgaatgtgagt

SEQ ID NO: 461223 - DNA, 25 bp, M. musculus
ttttatgagggcatagccttatttg

SEQ ID NO: 461224 - DNA, 16 bp, M. musculus
ttttatgatattggag

SEQ ID NO: 461225 - DNA, 16 bp, M. musculus
ttttatgattagcatg

SEQ ID NO: 461226 - DNA, 16 bp, M. musculus
ttttatgcaaatgagt

SEQ ID NO: 461227 - DNA, 16 bp, M. musculus
ttttatgctaaaacaa

SEQ ID NO: 461228 - DNA, 16 bp, M. musculus
ttttatgctatttgtg

SEQ ID NO: 461229 - DNA, 16 bp, M. musculus
ttttatggattctttg

SEQ ID NO: 461230 - DNA, 16 bp, M. musculus
ttttatgggctggaga

SEQ ID NO: 461231 - DNA, 16 bp, M. musculus
ttttatggttgggggc

SEQ ID NO: 461232 - DNA, 16 bp, M. musculus
ttttatggttttagaa

SEQ ID NO: 461233 - DNA, 16 bp, M. musculus
ttttatgtacattggt

SEQ ID NO: 461234 - DNA, 16 bp, M. musculus
ttttatgtatgggagt

SEQ ID NO: 461235 - DNA, 16 bp, M. musculus
ttttatgtcaaattga

SEQ ID NO: 461236 - DNA, 16 bp, M. musculus
ttttatgtctcccttt

SEQ ID NO: 461237 - DNA, 18 bp, M. musculus
ttttatgtgaagatcctt

SEQ ID NO: 461238 - DNA, 16 bp, M. musculus
ttttatgtgagaagca

SEQ ID NO: 461239 - DNA, 16 bp, M. musculus
ttttatgtgcatgggt

SEQ ID NO: 461240 - DNA, 16 bp, M. musculus
ttttatgtggagctct

SEQ ID NO: 461241 - DNA, 16 bp, M. musculus
ttttatgtggattctg

SEQ ID NO: 461242 - DNA, 16 bp, M. musculus
ttttatgtgtatgaat

SEQ ID NO: 461243 - DNA, 16 bp, M. musculus
ttttatgtgttcttgg

SEQ ID NO: 461244 - DNA, 16 bp, M. musculus
ttttatgttgctgtga

SEQ ID NO: 461245 - DNA, 16 bp, M. musculus
ttttattaaacatttg

SEQ ID NO: 461246 - DNA, 16 bp, M. musculus
ttttattaattggtca

SEQ ID NO: 461247 - DNA, 16 bp, M. musculus
ttttattacatgtatt

SEQ ID NO: 461248 - DNA, 16 bp, M. musculus
ttttattacatttgtg

SEQ ID NO: 461249 - DNA, 16 bp, M. musculus
ttttattatacaggat

SEQ ID NO: 461250 - DNA, 16 bp, M. musculus
ttttattatgacattt

SEQ ID NO: 461251 - DNA, 16 bp, M. musculus
ttttattatgctatgt

SEQ ID NO: 461252 - DNA, 16 bp, M. musculus
ttttattattgagaag

SEQ ID NO: 461253 - DNA, 18 bp, M. musculus
ttttattcaattccatca

SEQ ID NO: 461254 - DNA, 16 bp, M. musculus
ttttattcactggaat

SEQ ID NO: 461255 - DNA, 16 bp, M. musculus
ttttattcagaagaaa

SEQ ID NO: 461256 - DNA, 16 bp, M. musculus
ttttattcagaatttt

SEQ ID NO: 461257 - DNA, 16 bp, M. musculus
ttttattcagtttaca

SEQ ID NO: 461258 - DNA, 16 bp, M. musculus
ttttattccatggatg

SEQ ID NO: 461259 - DNA, 16 bp, M. musculus
ttttattccccacccc

SEQ ID NO: 461260 - DNA, 16 bp, M. musculus
ttttattctagagttt

SEQ ID NO: 461261 - DNA, 16 bp, M. musculus
ttttattctgagacag

SEQ ID NO: 461262 - DNA, 16 bp, M. musculus
ttttattgaaaataga

SEQ ID NO: 461263 - DNA, 16 bp, M. musculus
ttttattgaaaatgga

SEQ ID NO: 461264 - DNA, 16 bp, M. musculus
ttttattgacaagtga

SEQ ID NO: 461265 - DNA, 16 bp, M. musculus
ttttattgacaggtga

SEQ ID NO: 461266 - DNA, 16 bp, M. musculus
ttttattgctatgaag

SEQ ID NO: 461267 - DNA, 16 bp, M. musculus
ttttattgctgctgtt

SEQ ID NO: 461268 - DNA, 16 bp, M. musculus
ttttattggactaaaa

SEQ ID NO: 461269 - DNA, 16 bp, M. musculus
ttttattggagaattt

SEQ ID NO: 461270 - DNA, 16 bp, M. musculus
ttttattgggaaatta

SEQ ID NO: 461271 - DNA, 16 bp, M. musculus
ttttattgttacaata

SEQ ID NO: 461272 - DNA, 16 bp, M. musculus
ttttattgttgctgct

SEQ ID NO: 461273 - DNA, 16 bp, M. musculus
ttttatttaaagaaag

SEQ ID NO: 461274 - DNA, 16 bp, M. musculus
ttttatttacattcca

SEQ ID NO: 461275 - DNA, 16 bp, M. musculus
ttttatttataggagt

SEQ ID NO: 461276 - DNA, 16 bp, M. musculus
ttttatttcacatgta

SEQ ID NO: 461277 - DNA, 16 bp, M. musculus
ttttatttcaggaaca

SEQ ID NO: 461278 - DNA, 16 bp, M. musculus
ttttatttcataaatg

SEQ ID NO: 461279 - DNA, 16 bp, M. musculus
ttttatttcatgtgta

SEQ ID NO: 461280 - DNA, 16 bp, M. musculus
ttttatttccacttgg

SEQ ID NO: 461281 - DNA, 16 bp, M. musculus
ttttatttcctcagga

SEQ ID NO: 461282 - DNA, 16 bp, M. musculus
ttttatttggaaaata

SEQ ID NO: 461283 - DNA, 16 bp, M. musculus
ttttatttgggaacta

SEQ ID NO: 461284 - DNA, 18 bp, M. musculus
ttttatttgggtgggagg

SEQ ID NO: 461285 - DNA, 16 bp, M. musculus
ttttattttatgagca

SEQ ID NO: 461286 - DNA, 16 bp, M. musculus
ttttattttcaaaaac

SEQ ID NO: 461287 - DNA, 16 bp, M. musculus
ttttattttcaaatga

SEQ ID NO: 461288 - DNA, 16 bp, M. musculus
ttttattttcccaaat

SEQ ID NO: 461289 - DNA, 16 bp, M. musculus
ttttattttctctgca

SEQ ID NO: 461290 - DNA, 16 bp, M. musculus
ttttattttctgtgca

SEQ ID NO: 461291 - DNA, 16 bp, M. musculus
ttttattttcttgaaa

SEQ ID NO: 461292 - DNA, 16 bp, M. musculus
ttttattttgaagaca

SEQ ID NO: 461293 - DNA, 16 bp, M. musculus
ttttattttgagacag

SEQ ID NO: 461294 - DNA, 16 bp, M. musculus
ttttattttgatgcta

SEQ ID NO: 461295 - DNA, 16 bp, M. musculus
ttttattttgcaaatt

SEQ ID NO: 461296 - DNA, 16 bp, M. musculus
ttttattttggaaaaa

SEQ ID NO: 461297 - DNA, 16 bp, M. musculus
ttttatttttcaaagt

SEQ ID NO: 461298 - DNA, 16 bp, M. musculus
ttttatttttcaagaa

SEQ ID NO: 461299 - DNA, 16 bp, M. musculus
ttttatttttctggaa

SEQ ID NO: 461300 - DNA, 16 bp, M. musculus
ttttattttttcaaga

SEQ ID NO: 461301 - DNA, 16 bp, M. musculus
ttttcaaaaaaaatgt

SEQ ID NO: 461302 - DNA, 16 bp, M. musculus
ttttcaaaaaagaaat

SEQ ID NO: 461303 - DNA, 16 bp, M. musculus
ttttcaaaaacaattt

SEQ ID NO: 461304 - DNA, 16 bp, M. musculus
ttttcaaaaatgtatt

SEQ ID NO: 461305 - DNA, 16 bp, M. musculus
ttttcaaaaattcaaa

SEQ ID NO: 461306 - DNA, 16 bp, M. musculus
ttttcaaaacagaaaa

SEQ ID NO: 461307 - DNA, 16 bp, M. musculus
ttttcaaaacagagtt

SEQ ID NO: 461308 - DNA, 16 bp, M. musculus
ttttcaaaacagattt

SEQ ID NO: 461309 - DNA, 16 bp, M. musculus
ttttcaaaagaaaatt

SEQ ID NO: 461310 - DNA, 16 bp, M. musculus
ttttcaaaagaaacaa

SEQ ID NO: 461311 - DNA, 16 bp, M. musculus
ttttcaaaagaggaaa

SEQ ID NO: 461312 - DNA, 16 bp, M. musculus
ttttcaaaagtaaaaa

SEQ ID NO: 461313 - DNA, 16 bp, M. musculus
ttttcaaaatcagaaa

SEQ ID NO: 461314 - DNA, 16 bp, M. musculus
ttttcaaaattgtatt

SEQ ID NO: 461315 - DNA, 16 bp, M. musculus
ttttcaaacaaaattt

SEQ ID NO: 461316 - DNA, 16 bp, M. musculus
ttttcaaacaaatgaa

SEQ ID NO: 461317 - DNA, 16 bp, M. musculus
ttttcaaacatactct

SEQ ID NO: 461318 - DNA, 16 bp, M. musculus
ttttcaaactattcca

SEQ ID NO: 461319 - DNA, 16 bp, M. musculus
ttttcaaactttaaaa

SEQ ID NO: 461320 - DNA, 16 bp, M. musculus
ttttcaaagaaaaaat

SEQ ID NO: 461321 - DNA, 16 bp, M. musculus
ttttcaaagaaaaatt

SEQ ID NO: 461322 - DNA, 16 bp, M. musculus
ttttcaaagaaaattt

SEQ ID NO: 461323 - DNA, 16 bp, M. musculus
ttttcaaagaaccatc

SEQ ID NO: 461324 - DNA, 16 bp, M. musculus
ttttcaaagacatttt

SEQ ID NO: 461325 - DNA, 16 bp, M. musculus
ttttcaaagacttgaa

SEQ ID NO: 461326 - DNA, 16 bp, M. musculus
ttttcaaagatgaaat

SEQ ID NO: 461327 - DNA, 16 bp, M. musculus
ttttcaaagtaaaaat

SEQ ID NO: 461328 - DNA, 16 bp, M. musculus
ttttcaaagtttaaaa

SEQ ID NO: 461329 - DNA, 16 bp, M. musculus
ttttcaaatatcctta

SEQ ID NO: 461330 - DNA, 16 bp, M. musculus
ttttcaaatcaaaata

SEQ ID NO: 461331 - DNA, 16 bp, M. musculus
ttttcaaatgtaattt

SEQ ID NO: 461332 - DNA, 16 bp, M. musculus
ttttcaaatgtcttta

SEQ ID NO: 461333 - DNA, 16 bp, M. musculus
ttttcaaattctgaaa

SEQ ID NO: 461334 - DNA, 16 bp, M. musculus
ttttcaaattgtatct

SEQ ID NO: 461335 - DNA, 16 bp, M. musculus
ttttcaacaaagggtg

SEQ ID NO: 461336 - DNA, 16 bp, M. musculus
ttttcaacaattggtg

SEQ ID NO: 461337 - DNA, 16 bp, M. musculus
ttttcaacagaggaat

SEQ ID NO: 461338 - DNA, 16 bp, M. musculus
ttttcaacattatctt

SEQ ID NO: 461339 - DNA, 16 bp, M. musculus
ttttcaacctatgggt

SEQ ID NO: 461340 - DNA, 22 bp, M. musculus
ttttcaacctccccctggcttt

SEQ ID NO: 461341 - DNA, 16 bp, M. musculus
ttttcaacctgtgggt

SEQ ID NO: 461342 - DNA, 16 bp, M. musculus
ttttcaaccttcctaa

SEQ ID NO: 461343 - DNA, 16 bp, M. musculus
ttttcaacttaaagag

SEQ ID NO: 461344 - DNA, 16 bp, M. musculus
ttttcaacttctggct

SEQ ID NO: 461345 - DNA, 16 bp, M. musculus
ttttcaagaaaatgaa

SEQ ID NO: 461346 - DNA, 16 bp, M. musculus
ttttcaagaagaaaat

SEQ ID NO: 461347 - DNA, 17 bp, M. musculus
ttttcaagacagggtct

SEQ ID NO: 461348 - DNA, 16 bp, M. musculus
ttttcaagacaggttt

SEQ ID NO: 461349 - DNA, 16 bp, M. musculus
ttttcaagacagtttt

SEQ ID NO: 461350 - DNA, 16 bp, M. musculus
ttttcaagagaaataa

SEQ ID NO: 461351 - DNA, 16 bp, M. musculus
ttttcaagatagggtt

SEQ ID NO: 461352 - DNA, 16 bp, M. musculus
ttttcaaggaagaaaa

SEQ ID NO: 461353 - DNA, 16 bp, M. musculus
ttttcaaggcagagtt

SEQ ID NO: 461354 - DNA, 16 bp, M. musculus
ttttcaaggctgacca

SEQ ID NO: 461355 - DNA, 16 bp, M. musculus
ttttcaagtattttgt

SEQ ID NO: 461356 - DNA, 16 bp, M. musculus
ttttcaagttttaaaa

SEQ ID NO: 461357 - DNA, 16 bp, M. musculus
ttttcaagttttctgt

SEQ ID NO: 461358 - DNA, 16 bp, M. musculus
ttttcaagttttgttg

SEQ ID NO: 461359 - DNA, 16 bp, M. musculus
ttttcaataaaaagat

SEQ ID NO: 461360 - DNA, 16 bp, M. musculus
ttttcaataaaaagta

SEQ ID NO: 461361 - DNA, 16 bp, M. musculus
ttttcaataaaggaaa

SEQ ID NO: 461362 - DNA, 16 bp, M. musculus
ttttcaataaatgaaa

SEQ ID NO: 461363 - DNA, 16 bp, M. musculus
ttttcaatattttagt

SEQ ID NO: 461364 - DNA, 16 bp, M. musculus
ttttcaatggtttcct

SEQ ID NO: 461365 - DNA, 16 bp, M. musculus
ttttcaatgttttaat

SEQ ID NO: 461366 - DNA, 16 bp, M. musculus
ttttcacaaagcagtg

SEQ ID NO: 461367 - DNA, 16 bp, M. musculus
ttttcacacacaaaaa

SEQ ID NO: 461368 - DNA, 69 bp, M. musculus
ttttcaccagagactatgaaagccagaagagcctggacagatgttatacagacactaagagaacacaaa

SEQ ID NO: 461369 - DNA, 16 bp, M. musculus
ttttcaccttttaaaa

SEQ ID NO: 461370 - DNA, 16 bp, M. musculus
ttttcactattctggg

SEQ ID NO: 461371 - DNA, 16 bp, M. musculus
ttttcactcaaaccac

SEQ ID NO: 461372 - DNA, 16 bp, M. musculus
ttttcactgtgtcctg

SEQ ID NO: 461373 - DNA, 16 bp, M. musculus
ttttcagaaaaaaaaa

SEQ ID NO: 461374 - DNA, 16 bp, M. musculus
ttttcagaaaaaaatt

SEQ ID NO: 461375 - DNA, 16 bp, M. musculus
ttttcagaaaatttta

SEQ ID NO: 461376 - DNA, 16 bp, M. musculus
ttttcagaaacttgaa

SEQ ID NO: 461377 - DNA, 16 bp, M. musculus
ttttcagaagaaaaat

SEQ ID NO: 461378 - DNA, 16 bp, M. musculus
ttttcagaagaagaaa

SEQ ID NO: 461379 - DNA, 16 bp, M. musculus
ttttcagaagagaaaa

SEQ ID NO: 461380 - DNA, 16 bp, M. musculus
ttttcagaatttaatg

SEQ ID NO: 461381 - DNA, 16 bp, M. musculus
ttttcagaatttattt

SEQ ID NO: 461382 - DNA, 16 bp, M. musculus
ttttcagacaaagaac

SEQ ID NO: 461383 - DNA, 16 bp, M. musculus
ttttcagacaccccag

SEQ ID NO: 461384 - DNA, 16 bp, M. musculus
ttttcagacaggaaca

SEQ ID NO: 461385 - DNA, 16 bp, M. musculus
ttttcagacagggtct

SEQ ID NO: 461386 - DNA, 16 bp, M. musculus
ttttcagacagtgtct

SEQ ID NO: 461387 - DNA, 16 bp, M. musculus
ttttcagagagaaaaa

SEQ ID NO: 461388 - DNA, 17 bp, M. musculus
ttttcagagcttgatca

SEQ ID NO: 461389 - DNA, 16 bp, M. musculus
ttttcagagggaaaac

SEQ ID NO: 461390 - DNA, 16 bp, M. musculus
ttttcagaggggaaat

SEQ ID NO: 461391 - DNA, 16 bp, M. musculus
ttttcagagtggaaac

SEQ ID NO: 461392 - DNA, 16 bp, M. musculus
ttttcagagtggtttt

SEQ ID NO: 461393 - DNA, 16 bp, M. musculus
ttttcagagttctttt

SEQ ID NO: 461394 - DNA, 16 bp, M. musculus
ttttcagagttgatca

SEQ ID NO: 461395 - DNA, 16 bp, M. musculus
ttttcagatattttaa

SEQ ID NO: 461396 - DNA, 16 bp, M. musculus
ttttcagatcctggat

SEQ ID NO: 461397 - DNA, 16 bp, M. musculus
ttttcagatggcatac

SEQ ID NO: 461398 - DNA, 16 bp, M. musculus
ttttcagatgtgttgg

SEQ ID NO: 461399 - DNA, 16 bp, M. musculus
ttttcagattttaaaa

SEQ ID NO: 461400 - DNA, 16 bp, M. musculus
ttttcagcagatgctg

SEQ ID NO: 461401 - DNA, 16 bp, M. musculus
ttttcagcatccacat

SEQ ID NO: 461402 - DNA, 16 bp, M. musculus
ttttcagcctgtcaag

SEQ ID NO: 461403 - DNA, 16 bp, M. musculus
ttttcaggaaaaaaaa

SEQ ID NO: 461404 - DNA, 16 bp, M. musculus
ttttcaggaaaatgca

SEQ ID NO: 461405 - DNA, 16 bp, M. musculus
ttttcagggaaatgga

SEQ ID NO: 461406 - DNA, 16 bp, M. musculus
ttttcagggtatttta

SEQ ID NO: 461407 - DNA, 16 bp, M. musculus
ttttcagtattttaaa

SEQ ID NO: 461408 - DNA, 16 bp, M. musculus
ttttcagtgatggctg

SEQ ID NO: 461409 - DNA, 16 bp, M. musculus
ttttcagtgtttctgg

SEQ ID NO: 461410 - DNA, 16 bp, M. musculus
ttttcagttgcttctc

SEQ ID NO: 461411 - DNA, 16 bp, M. musculus
ttttcagttgtgttgg

SEQ ID NO: 461412 - DNA, 16 bp, M. musculus
ttttcagtttcatgaa

SEQ ID NO: 461413 - DNA, 16 bp, M. musculus
ttttcagtttcctgag

SEQ ID NO: 461414 - DNA, 16 bp, M. musculus
ttttcagtttctggct

SEQ ID NO: 461415 - DNA, 16 bp, M. musculus
ttttcagttttataag

SEQ ID NO: 461416 - DNA, 16 bp, M. musculus
ttttcagtttttaaaa

SEQ ID NO: 461417 - DNA, 16 bp, M. musculus
ttttcataattagtga

SEQ ID NO: 461418 - DNA, 16 bp, M. musculus
ttttcatagaaaaata

SEQ ID NO: 461419 - DNA, 16 bp, M. musculus
ttttcatagcaataaa

SEQ ID NO: 461420 - DNA, 16 bp, M. musculus
ttttcatagtgcccca

SEQ ID NO: 461421 - DNA, 16 bp, M. musculus
ttttcatattaagaga

SEQ ID NO: 461422 - DNA, 16 bp, M. musculus
ttttcatcataaaaat

SEQ ID NO: 461423 - DNA, 16 bp, M. musculus
ttttcatctgattcag

SEQ ID NO: 461424 - DNA, 16 bp, M. musculus
ttttcatgaaaataaa

SEQ ID NO: 461425 - DNA, 16 bp, M. musculus
ttttcatgcatgcatg

SEQ ID NO: 461426 - DNA, 16 bp, M. musculus
ttttcatgtctgtgaa

SEQ ID NO: 461427 - DNA, 16 bp, M. musculus
ttttcatgtgtgtgca

SEQ ID NO: 461428 - DNA, 16 bp, M. musculus
ttttcatgtgttttgc

SEQ ID NO: 461429 - DNA, 16 bp, M. musculus
ttttcatgtttaaaat

SEQ ID NO: 461430 - DNA, 16 bp, M. musculus
ttttcatgtttgtgtg

SEQ ID NO: 461431 - DNA, 16 bp, M. musculus
ttttcattaaaacatt

SEQ ID NO: 461432 - DNA, 16 bp, M. musculus
ttttcattaactgttg

SEQ ID NO: 461433 - DNA, 16 bp, M. musculus
ttttcattatgctatg

SEQ ID NO: 461434 - DNA, 16 bp, M. musculus
ttttcattattttgaa

SEQ ID NO: 461435 - DNA, 16 bp, M. musculus
ttttcattctgaaaat

SEQ ID NO: 461436 - DNA, 16 bp, M. musculus
ttttcattgtgactgt

SEQ ID NO: 461437 - DNA, 16 bp, M. musculus
ttttcattgtgtcttg

SEQ ID NO: 461438 - DNA, 16 bp, M. musculus
ttttcattgtgtgtgt

SEQ ID NO: 461439 - DNA, 16 bp, M. musculus
ttttcattgtgttctg

SEQ ID NO: 461440 - DNA, 16 bp, M. musculus
ttttcattgtttaaaa

SEQ ID NO: 461441 - DNA, 16 bp, M. musculus
ttttcattgttttaaa

SEQ ID NO: 461442 - DNA, 16 bp, M. musculus
ttttcatttaaatgaa

SEQ ID NO: 461443 - DNA, 16 bp, M. musculus
ttttcatttagaaaat

SEQ ID NO: 461444 - DNA, 16 bp, M. musculus
ttttcatttatatgag

SEQ ID NO: 461445 - DNA, 16 bp, M. musculus
ttttcatttccaggtt

SEQ ID NO: 461446 - DNA, 16 bp, M. musculus
ttttcatttctgaaaa

SEQ ID NO: 461447 - DNA, 16 bp, M. musculus
ttttcatttctgactt

SEQ ID NO: 461448 - DNA, 16 bp, M. musculus
ttttcatttctgtgaa

SEQ ID NO: 461449 - DNA, 16 bp, M. musculus
ttttcatttgcatttc

SEQ ID NO: 461450 - DNA, 16 bp, M. musculus
ttttcattttaaagaa

SEQ ID NO: 461451 - DNA, 16 bp, M. musculus
ttttcattttcaaaaa

SEQ ID NO: 461452 - DNA, 16 bp, M. musculus
ttttcattttgtgaaa

SEQ ID NO: 461453 - DNA, 16 bp, M. musculus
ttttcatttttagaaa

SEQ ID NO: 461454 - DNA, 16 bp, M. musculus
ttttcatttttagaat

SEQ ID NO: 461455 - DNA, 16 bp, M. musculus
ttttcatttttccaca

SEQ ID NO: 461456 - DNA, 16 bp, M. musculus
ttttcatttttgaaaa

SEQ ID NO: 461457 - DNA, 16 bp, M. musculus
ttttccaaaatataaa

SEQ ID NO: 461458 - DNA, 16 bp, M. musculus
ttttccaaatatttct

SEQ ID NO: 461459 - DNA, 16 bp, M. musculus
ttttccaacatacttt

SEQ ID NO: 461460 - DNA, 16 bp, M. musculus
ttttccaagacagggt

SEQ ID NO: 461461 - DNA, 16 bp, M. musculus
ttttccaatgtgtatt

SEQ ID NO: 461462 - DNA, 16 bp, M. musculus
ttttccaattaaaaat

SEQ ID NO: 461463 - DNA, 16 bp, M. musculus
ttttccaatttggtag

SEQ ID NO: 461464 - DNA, 16 bp, M. musculus
ttttccagaactttct

SEQ ID NO: 461465 - DNA, 16 bp, M. musculus
ttttccagaactttta

SEQ ID NO: 461466 - DNA, 22 bp, M. musculus
ttttccagagctgcaaatctgt

SEQ ID NO: 461467 - DNA, 16 bp, M. musculus
ttttccagatttattt

SEQ ID NO: 461468 - DNA, 16 bp, M. musculus
ttttccagcatttcat

SEQ ID NO: 461469 - DNA, 16 bp, M. musculus
ttttccagcttctgac

SEQ ID NO: 461470 - DNA, 16 bp, M. musculus
ttttccaggaaaaaaa

SEQ ID NO: 461471 - DNA, 16 bp, M. musculus
ttttccagtcccattt

SEQ ID NO: 461472 - DNA, 16 bp, M. musculus
ttttccataaaatata

SEQ ID NO: 461473 - DNA, 16 bp, M. musculus
ttttccataataaaaa

SEQ ID NO: 461474 - DNA, 16 bp, M. musculus
ttttccatataaataa

SEQ ID NO: 461475 - DNA, 16 bp, M. musculus
ttttccatcattactt

SEQ ID NO: 461476 - DNA, 16 bp, M. musculus
ttttccatgtattgtt

SEQ ID NO: 461477 - DNA, 16 bp, M. musculus
ttttccatgttaaaaa

SEQ ID NO: 461478 - DNA, 16 bp, M. musculus
ttttccatttgtgtgt

SEQ ID NO: 461479 - DNA, 16 bp, M. musculus
ttttccattttatcca

SEQ ID NO: 461480 - DNA, 16 bp, M. musculus
ttttcccaaaagttcc

SEQ ID NO: 461481 - DNA, 16 bp, M. musculus
ttttcccaactgaagc

SEQ ID NO: 461482 - DNA, 16 bp, M. musculus
ttttcccagagctacc

SEQ ID NO: 461483 - DNA, 16 bp, M. musculus
ttttcccagatgagaa

SEQ ID NO: 461484 - DNA, 16 bp, M. musculus
ttttcccattctctag

SEQ ID NO: 461485 - DNA, 16 bp, M. musculus
ttttccccaaaatttt

SEQ ID NO: 461486 - DNA, 16 bp, M. musculus
ttttcccccttttaaa

SEQ ID NO: 461487 - DNA, 16 bp, M. musculus
ttttcccctaaaatat

SEQ ID NO: 461488 - DNA, 16 bp, M. musculus
ttttcccctcaaaatt

SEQ ID NO: 461489 - DNA, 16 bp, M. musculus
ttttcccctgtgccta

SEQ ID NO: 461490 - DNA, 16 bp, M. musculus
ttttccccttacagct

SEQ ID NO: 461491 - DNA, 16 bp, M. musculus
ttttccccttgcagct

SEQ ID NO: 461492 - DNA, 16 bp, M. musculus
ttttccctctgcaaat

SEQ ID NO: 461493 - DNA, 16 bp, M. musculus
ttttccctcttgaagg

SEQ ID NO: 461494 - DNA, 16 bp, M. musculus
ttttccctgtactggg

SEQ ID NO: 461495 - DNA, 17 bp, M. musculus
ttttcccttattgcttt

SEQ ID NO: 461496 - DNA, 16 bp, M. musculus
ttttcccttcagattt

SEQ ID NO: 461497 - DNA, 16 bp, M. musculus
ttttccctttctcagc

SEQ ID NO: 461498 - DNA, 16 bp, M. musculus
ttttcctaattaatga

SEQ ID NO: 461499 - DNA, 16 bp, M. musculus
ttttcctaccactgtt

SEQ ID NO: 461500 - DNA, 16 bp, M. musculus
ttttcctatttctgtg

SEQ ID NO: 461501 - DNA, 16 bp, M. musculus
ttttcctcaatatctc

SEQ ID NO: 461502 - DNA, 18 bp, M. musculus
ttttcctcaggctcctct

SEQ ID NO: 461503 - DNA, 16 bp, M. musculus
ttttcctcaggctttt

SEQ ID NO: 461504 - DNA, 16 bp, M. musculus
ttttcctcaggtgaga

SEQ ID NO: 461505 - DNA, 16 bp, M. musculus
ttttcctccattacat

SEQ ID NO: 461506 - DNA, 16 bp, M. musculus
ttttcctccccaattt

SEQ ID NO: 461507 - DNA, 16 bp, M. musculus
ttttcctctgacttct

SEQ ID NO: 461508 - DNA, 16 bp, M. musculus
ttttcctctgcaagct

SEQ ID NO: 461509 - DNA, 16 bp, M. musculus
ttttcctcttaaaaaa

SEQ ID NO: 461510 - DNA, 16 bp, M. musculus
ttttcctctttaaaaa

SEQ ID NO: 461511 - DNA, 16 bp, M. musculus
ttttcctgaacagaaa

SEQ ID NO: 461512 - DNA, 16 bp, M. musculus
ttttcctgccatgtgt

SEQ ID NO: 461513 - DNA, 16 bp, M. musculus
ttttcctgcctctgtc

SEQ ID NO: 461514 - DNA, 16 bp, M. musculus
ttttcctggccctggc

SEQ ID NO: 461515 - DNA, 16 bp, M. musculus
ttttcctgtctccacc

SEQ ID NO: 461516 - DNA, 16 bp, M. musculus
ttttcctgtctgtctg

SEQ ID NO: 461517 - DNA, 16 bp, M. musculus
ttttcctgtgccaatg

SEQ ID NO: 461518 - DNA, 16 bp, M. musculus
ttttcctgttgcagtg

SEQ ID NO: 461519 - DNA, 16 bp, M. musculus
ttttcctgtttcaaat

SEQ ID NO: 461520 - DNA, 16 bp, M. musculus
ttttccttaaaaacaa

SEQ ID NO: 461521 - DNA, 16 bp, M. musculus
ttttccttaaaatctc

SEQ ID NO: 461522 - DNA, 16 bp, M. musculus
ttttccttaaggactt

SEQ ID NO: 461523 - DNA, 18 bp, M. musculus
ttttccttagtggccatt

SEQ ID NO: 461524 - DNA, 16 bp, M. musculus
ttttccttatggatat

SEQ ID NO: 461525 - DNA, 16 bp, M. musculus
ttttccttatttgaaa

SEQ ID NO: 461526 - DNA, 16 bp, M. musculus
ttttccttcagaaaaa

SEQ ID NO: 461527 - DNA, 16 bp, M. musculus
ttttccttcagtcttt

SEQ ID NO: 461528 - DNA, 16 bp, M. musculus
ttttccttccaaaatt

SEQ ID NO: 461529 - DNA, 16 bp, M. musculus
ttttccttcccagaat

SEQ ID NO: 461530 - DNA, 16 bp, M. musculus
ttttccttctaaaaat

SEQ ID NO: 461531 - DNA, 16 bp, M. musculus
ttttccttctcagttt

SEQ ID NO: 461532 - DNA, 16 bp, M. musculus
ttttccttgaaatttt

SEQ ID NO: 461533 - DNA, 16 bp, M. musculus
ttttccttgcatgtat

SEQ ID NO: 461534 - DNA, 16 bp, M. musculus
ttttcctttaaaagct

SEQ ID NO: 461535 - DNA, 16 bp, M. musculus
ttttcctttaataaaa

SEQ ID NO: 461536 - DNA, 16 bp, M. musculus
ttttcctttccagttt

SEQ ID NO: 461537 - DNA, 16 bp, M. musculus
ttttcctttctcagtt

SEQ ID NO: 461538 - DNA, 16 bp, M. musculus
ttttcctttgaaaaat

SEQ ID NO: 461539 - DNA, 16 bp, M. musculus
ttttcctttgaagagt

SEQ ID NO: 461540 - DNA, 16 bp, M. musculus
ttttcctttgagaatt

SEQ ID NO: 461541 - DNA, 16 bp, M. musculus
ttttcctttgagtttg

SEQ ID NO: 461542 - DNA, 16 bp, M. musculus
ttttcctttgcaagtg

SEQ ID NO: 461543 - DNA, 16 bp, M. musculus
ttttcctttgctgtga

SEQ ID NO: 461544 - DNA, 16 bp, M. musculus
ttttcctttggaaaaa

SEQ ID NO: 461545 - DNA, 16 bp, M. musculus
ttttccttttaagaaa

SEQ ID NO: 461546 - DNA, 16 bp, M. musculus
ttttccttttccagaa

SEQ ID NO: 461547 - DNA, 16 bp, M. musculus
ttttcctttttaaaga

SEQ ID NO: 461548 - DNA, 16 bp, M. musculus
ttttcgagaaagggtt

SEQ ID NO: 461549 - DNA, 16 bp, M. musculus
ttttcgagactgggtt

SEQ ID NO: 461550 - DNA, 16 bp, M. musculus
ttttcgtgggattgct

SEQ ID NO: 461551 - DNA, 16 bp, M. musculus
ttttctaaaatatatg

SEQ ID NO: 461552 - DNA, 16 bp, M. musculus
ttttctaaaatatttg

SEQ ID NO: 461553 - DNA, 16 bp, M. musculus
ttttctaaagatattt

SEQ ID NO: 461554 - DNA, 16 bp, M. musculus
ttttctacacaaagga

SEQ ID NO: 461555 - DNA, 16 bp, M. musculus
ttttctacatctaatg

SEQ ID NO: 461556 - DNA, 16 bp, M. musculus
ttttctaccttttgta

SEQ ID NO: 461557 - DNA, 16 bp, M. musculus
ttttctactgtatggt

SEQ ID NO: 461558 - DNA, 16 bp, M. musculus
ttttctagaaaaatat

SEQ ID NO: 461559 - DNA, 16 bp, M. musculus
ttttctagaaaataaa

SEQ ID NO: 461560 - DNA, 16 bp, M. musculus
ttttctagaaggttct

SEQ ID NO: 461561 - DNA, 16 bp, M. musculus
ttttctagaatatttt

SEQ ID NO: 461562 - DNA, 16 bp, M. musculus
ttttctagaatgtaat

SEQ ID NO: 461563 - DNA, 16 bp, M. musculus
ttttctagaattttaa

SEQ ID NO: 461564 - DNA, 16 bp, M. musculus
ttttctagatctttta

SEQ ID NO: 461565 - DNA, 16 bp, M. musculus
ttttctagattttaaa

SEQ ID NO: 461566 - DNA, 16 bp, M. musculus
ttttctagtttcatca

SEQ ID NO: 461567 - DNA, 16 bp, M. musculus
ttttctataaaacctt

SEQ ID NO: 461568 - DNA, 16 bp, M. musculus
ttttctatacctttgt

SEQ ID NO: 461569 - DNA, 16 bp, M. musculus
ttttctatcctaggtt

SEQ ID NO: 461570 - DNA, 17 bp, M. musculus
ttttctatctccagcat

SEQ ID NO: 461571 - DNA, 16 bp, M. musculus
ttttctatgaagattt

SEQ ID NO: 461572 - DNA, 16 bp, M. musculus
ttttctatgtagtcct

SEQ ID NO: 461573 - DNA, 16 bp, M. musculus
ttttctattgtgataa

SEQ ID NO: 461574 - DNA, 16 bp, M. musculus
ttttctatttccaggt

SEQ ID NO: 461575 - DNA, 16 bp, M. musculus
ttttctatttttagaa

SEQ ID NO: 461576 - DNA, 16 bp, M. musculus
ttttctcaaaaataaa

SEQ ID NO: 461577 - DNA, 16 bp, M. musculus
ttttctcaaaaatatt

SEQ ID NO: 461578 - DNA, 16 bp, M. musculus
ttttctcaaaaatttg

SEQ ID NO: 461579 - DNA, 16 bp, M. musculus
ttttctcaagtatttt

SEQ ID NO: 461580 - DNA, 16 bp, M. musculus
ttttctcaattaagtt

SEQ ID NO: 461581 - DNA, 21 bp, M. musculus
ttttctcaattagtgatcaaa

SEQ ID NO: 461582 - DNA, 20 bp, M. musculus
ttttctcaattagtgatcac

SEQ ID NO: 461583 - DNA, 16 bp, M. musculus
ttttctcaatttgtga

SEQ ID NO: 461584 - DNA, 16 bp, M. musculus
ttttctcacaagcact

SEQ ID NO: 461585 - DNA, 16 bp, M. musculus
ttttctcacctgtaaa

SEQ ID NO: 461586 - DNA, 16 bp, M. musculus
ttttctcactgagcca

SEQ ID NO: 461587 - DNA, 16 bp, M. musculus
ttttctcacttaaaaa

SEQ ID NO: 461588 - DNA, 16 bp, M. musculus
ttttctcagaattcag

SEQ ID NO: 461589 - DNA, 16 bp, M. musculus
ttttctcagacagggt

SEQ ID NO: 461590 - DNA, 16 bp, M. musculus
ttttctcagcttctca

SEQ ID NO: 461591 - DNA, 16 bp, M. musculus
ttttctcagtacctca

SEQ ID NO: 461592 - DNA, 16 bp, M. musculus
ttttctcagtgatgga

SEQ ID NO: 461593 - DNA, 16 bp, M. musculus
ttttctcatcataatg

SEQ ID NO: 461594 - DNA, 16 bp, M. musculus
ttttctcatctttaaa

SEQ ID NO: 461595 - DNA, 16 bp, M. musculus
ttttctcatttaaaaa

SEQ ID NO: 461596 - DNA, 16 bp, M. musculus
ttttctcatttcaaaa

SEQ ID NO: 461597 - DNA, 16 bp, M. musculus
ttttctcattttgaaa

SEQ ID NO: 461598 - DNA, 16 bp, M. musculus
ttttctcatttttaag

SEQ ID NO: 461599 - DNA, 16 bp, M. musculus
ttttctccaatgtgta

SEQ ID NO: 461600 - DNA, 16 bp, M. musculus
ttttctccagtctctg

SEQ ID NO: 461601 - DNA, 16 bp, M. musculus
ttttctccatctatgg

SEQ ID NO: 461602 - DNA, 16 bp, M. musculus
ttttctccatctgtgg

SEQ ID NO: 461603 - DNA, 16 bp, M. musculus
ttttctcccaaaacct

SEQ ID NO: 461604 - DNA, 16 bp, M. musculus
ttttctccctccaaat

SEQ ID NO: 461605 - DNA, 16 bp, M. musculus
ttttctcctaccactg

SEQ ID NO: 461606 - DNA, 16 bp, M. musculus
ttttctcctattgacc

SEQ ID NO: 461607 - DNA, 16 bp, M. musculus
ttttctcctctttaaa

SEQ ID NO: 461608 - DNA, 16 bp, M. musculus
ttttctcctgtgagta

SEQ ID NO: 461609 - DNA, 16 bp, M. musculus
ttttctcctgtgtcca

SEQ ID NO: 461610 - DNA, 35 bp, M. musculus
ttttctcgtcccggaattcggcaccaattgttatt

SEQ ID NO: 461611 - DNA, 16 bp, M. musculus
ttttctctagctcctc

SEQ ID NO: 461612 - DNA, 16 bp, M. musculus
ttttctctcagcctct

SEQ ID NO: 461613 - DNA, 16 bp, M. musculus
ttttctctcagctcca

SEQ ID NO: 461614 - DNA, 16 bp, M. musculus
ttttctctctctaaaa

SEQ ID NO: 461615 - DNA, 16 bp, M. musculus
ttttctctctgaaaat

SEQ ID NO: 461616 - DNA, 16 bp, M. musculus
ttttctctgcagagtt

SEQ ID NO: 461617 - DNA, 16 bp, M. musculus
ttttctctgccagtta

SEQ ID NO: 461618 - DNA, 16 bp, M. musculus
ttttctctgtatgtat

SEQ ID NO: 461619 - DNA, 16 bp, M. musculus
ttttctctgtgtagcc

SEQ ID NO: 461620 - DNA, 16 bp, M. musculus
ttttctcttacagctt

SEQ ID NO: 461621 - DNA, 16 bp, M. musculus
ttttctcttgctgtga

SEQ ID NO: 461622 - DNA, 16 bp, M. musculus
ttttctctttaaagaa

SEQ ID NO: 461623 - DNA, 16 bp, M. musculus
ttttctgaaaaagaaa

SEQ ID NO: 461624 - DNA, 16 bp, M. musculus
ttttctgaaagaacca

SEQ ID NO: 461625 - DNA, 16 bp, M. musculus
ttttctgaaataattt

SEQ ID NO: 461626 - DNA, 16 bp, M. musculus
ttttctgaagagaaac

SEQ ID NO: 461627 - DNA, 16 bp, M. musculus
ttttctgaagagaaag

SEQ ID NO: 461628 - DNA, 16 bp, M. musculus
ttttctgaagcagaca

SEQ ID NO: 461629 - DNA, 16 bp, M. musculus
ttttctgaaggtcctg

SEQ ID NO: 461630 - DNA, 16 bp, M. musculus
ttttctgaagttgttt

SEQ ID NO: 461631 - DNA, 16 bp, M. musculus
ttttctgaatgaaaat

SEQ ID NO: 461632 - DNA, 16 bp, M. musculus
ttttctgacctccaca

SEQ ID NO: 461633 - DNA, 16 bp, M. musculus
ttttctgacttttaaa

SEQ ID NO: 461634 - DNA, 16 bp, M. musculus
ttttctgagaaacctc

SEQ ID NO: 461635 - DNA, 16 bp, M. musculus
ttttctgagacagaat

SEQ ID NO: 461636 - DNA, 16 bp, M. musculus
ttttctgagacatggt

SEQ ID NO: 461637 - DNA, 19 bp, M. musculus
ttttctgaggaaccgccaa

SEQ ID NO: 461638 - DNA, 25 bp, M. musculus
ttttctgaggaaccgccagactgac

SEQ ID NO: 461639 - DNA, 16 bp, M. musculus
ttttctgaggaatcac

SEQ ID NO: 461640 - DNA, 16 bp, M. musculus
ttttctgatagtcaaa

SEQ ID NO: 461641 - DNA, 16 bp, M. musculus
ttttctgatctccaca

SEQ ID NO: 461642 - DNA, 16 bp, M. musculus
ttttctgcactgttct

SEQ ID NO: 461643 - DNA, 16 bp, M. musculus
ttttctgcaggatgct

SEQ ID NO: 461644 - DNA, 16 bp, M. musculus
ttttctgcatctactg

SEQ ID NO: 461645 - DNA, 16 bp, M. musculus
ttttctgcttccccac

SEQ ID NO: 461646 - DNA, 16 bp, M. musculus
ttttctgcttctttaa

SEQ ID NO: 461647 - DNA, 16 bp, M. musculus
ttttctgctttctact

SEQ ID NO: 461648 - DNA, 16 bp, M. musculus
ttttctgctttttaaa

SEQ ID NO: 461649 - DNA, 16 bp, M. musculus
ttttctggaacaacca

SEQ ID NO: 461650 - DNA, 16 bp, M. musculus
ttttctggaagtactt

SEQ ID NO: 461651 - DNA, 16 bp, M. musculus
ttttctggattaatga

SEQ ID NO: 461652 - DNA, 16 bp, M. musculus
ttttctggcttctgtg

SEQ ID NO: 461653 - DNA, 20 bp, M. musculus
ttttctggtccaaactattt

SEQ ID NO: 461654 - DNA, 16 bp, M. musculus
ttttctggtccagcct

SEQ ID NO: 461655 - DNA, 16 bp, M. musculus
ttttctggtgtgtatg

SEQ ID NO: 461656 - DNA, 16 bp, M. musculus
ttttctgtaagcagca

SEQ ID NO: 461657 - DNA, 16 bp, M. musculus
ttttctgtaatagttt

SEQ ID NO: 461658 - DNA, 16 bp, M. musculus
ttttctgtatccattt

SEQ ID NO: 461659 - DNA, 16 bp, M. musculus
ttttctgtatctatta

SEQ ID NO: 461660 - DNA, 16 bp, M. musculus
ttttctgtatgtgtgt

SEQ ID NO: 461661 - DNA, 16 bp, M. musculus
ttttctgtattatata

SEQ ID NO: 461662 - DNA, 16 bp, M. musculus
ttttctgtcatttcta

SEQ ID NO: 461663 - DNA, 16 bp, M. musculus
ttttctgtgattcacc

SEQ ID NO: 461664 - DNA, 16 bp, M. musculus
ttttctgtgcattggt

SEQ ID NO: 461665 - DNA, 16 bp, M. musculus
ttttctgtggctttaa

SEQ ID NO: 461666 - DNA, 16 bp, M. musculus
ttttctgttctaatta

SEQ ID NO: 461667 - DNA, 16 bp, M. musculus
ttttctgttgctataa

SEQ ID NO: 461668 - DNA, 16 bp, M. musculus
ttttctgtttagctct

SEQ ID NO: 461669 - DNA, 16 bp, M. musculus
ttttctgtttctataa

SEQ ID NO: 461670 - DNA, 16 bp, M. musculus
ttttctgttttaaaga

SEQ ID NO: 461671 - DNA, 16 bp, M. musculus
ttttctgttttcaaat

SEQ ID NO: 461672 - DNA, 16 bp, M. musculus
ttttctgtttttaaaa

SEQ ID NO: 461673 - DNA, 16 bp, M. musculus
ttttctgtttttaaca

SEQ ID NO: 461674 - DNA, 16 bp, M. musculus
ttttcttaaaatttgt

SEQ ID NO: 461675 - DNA, 16 bp, M. musculus
ttttcttaaggcaaaa

SEQ ID NO: 461676 - DNA, 16 bp, M. musculus
ttttcttaagtgattc

SEQ ID NO: 461677 - DNA, 16 bp, M. musculus
ttttcttaattagtga

SEQ ID NO: 461678 - DNA, 16 bp, M. musculus
ttttcttaattagtgg

SEQ ID NO: 461679 - DNA, 16 bp, M. musculus
ttttcttaattgaaaa

SEQ ID NO: 461680 - DNA, 16 bp, M. musculus
ttttcttacaaacatg

SEQ ID NO: 461681 - DNA, 16 bp, M. musculus
ttttcttacctgtaaa

SEQ ID NO: 461682 - DNA, 16 bp, M. musculus
ttttcttagttttaaa

SEQ ID NO: 461683 - DNA, 16 bp, M. musculus
ttttcttatctgaaaa

SEQ ID NO: 461684 - DNA, 16 bp, M. musculus
ttttcttatgttcact

SEQ ID NO: 461685 - DNA, 16 bp, M. musculus
ttttcttattaaaaga

SEQ ID NO: 461686 - DNA, 16 bp, M. musculus
ttttcttatttgtaaa

SEQ ID NO: 461687 - DNA, 16 bp, M. musculus
ttttcttcaatctctg

SEQ ID NO: 461688 - DNA, 16 bp, M. musculus
ttttcttcaatgattt

SEQ ID NO: 461689 - DNA, 16 bp, M. musculus
ttttcttcaatggagt

SEQ ID NO: 461690 - DNA, 16 bp, M. musculus
ttttcttcagcttcct

SEQ ID NO: 461691 - DNA, 16 bp, M. musculus
ttttcttcagggatat

SEQ ID NO: 461692 - DNA, 16 bp, M. musculus
ttttcttcagtctctt

SEQ ID NO: 461693 - DNA, 16 bp, M. musculus
ttttcttcagtgctgt

SEQ ID NO: 461694 - DNA, 16 bp, M. musculus
ttttcttcatctattg

SEQ ID NO: 461695 - DNA, 16 bp, M. musculus
ttttcttcatgtgtgt

SEQ ID NO: 461696 - DNA, 16 bp, M. musculus
ttttcttcccaagttg

SEQ ID NO: 461697 - DNA, 16 bp, M. musculus
ttttcttcctccaact

SEQ ID NO: 461698 - DNA, 16 bp, M. musculus
ttttcttcctctgata

SEQ ID NO: 461699 - DNA, 16 bp, M. musculus
ttttcttccttctaaa

SEQ ID NO: 461700 - DNA, 16 bp, M. musculus
ttttcttctaaaaata

SEQ ID NO: 461701 - DNA, 16 bp, M. musculus
ttttcttctaagaatt

SEQ ID NO: 461702 - DNA, 16 bp, M. musculus
ttttcttctagaaaat

SEQ ID NO: 461703 - DNA, 18 bp, M. musculus
ttttcttctagacctttt

SEQ ID NO: 461704 - DNA, 16 bp, M. musculus
ttttcttctctaaaat

SEQ ID NO: 461705 - DNA, 16 bp, M. musculus
ttttcttcttccatgg

SEQ ID NO: 461706 - DNA, 16 bp, M. musculus
ttttcttctttgtgaa

SEQ ID NO: 461707 - DNA, 16 bp, M. musculus
ttttcttgaaaacaaa

SEQ ID NO: 461708 - DNA, 16 bp, M. musculus
ttttcttgaaatttta

SEQ ID NO: 461709 - DNA, 16 bp, M. musculus
ttttcttgaaggaaaa

SEQ ID NO: 461710 - DNA, 16 bp, M. musculus
ttttcttgaatttcat

SEQ ID NO: 461711 - DNA, 16 bp, M. musculus
ttttcttgagattcat

SEQ ID NO: 461712 - DNA, 16 bp, M. musculus
ttttcttgattgatgt

SEQ ID NO: 461713 - DNA, 16 bp, M. musculus
ttttcttgtcactgtg

SEQ ID NO: 461714 - DNA, 16 bp, M. musculus
ttttcttgtttccact

SEQ ID NO: 461715 - DNA, 16 bp, M. musculus
ttttctttaaaatgaa

SEQ ID NO: 461716 - DNA, 16 bp, M. musculus
ttttctttaaagagaa

SEQ ID NO: 461717 - DNA, 16 bp, M. musculus
ttttctttaaatgtct

SEQ ID NO: 461718 - DNA, 16 bp, M. musculus
ttttctttacatacat

SEQ ID NO: 461719 - DNA, 16 bp, M. musculus
ttttctttacttggaa

SEQ ID NO: 461720 - DNA, 16 bp, M. musculus
ttttctttagctgcat

SEQ ID NO: 461721 - DNA, 16 bp, M. musculus
ttttctttatgaaaaa

SEQ ID NO: 461722 - DNA, 16 bp, M. musculus
ttttctttattgacat

SEQ ID NO: 461723 - DNA, 16 bp, M. musculus
ttttctttatttacag

SEQ ID NO: 461724 - DNA, 16 bp, M. musculus
ttttctttcaaaatct

SEQ ID NO: 461725 - DNA, 16 bp, M. musculus
ttttctttcacaaccc

SEQ ID NO: 461726 - DNA, 16 bp, M. musculus
ttttctttcagaaaat

SEQ ID NO: 461727 - DNA, 16 bp, M. musculus
ttttctttcatgtgta

SEQ ID NO: 461728 - DNA, 16 bp, M. musculus
ttttctttccaaaaaa

SEQ ID NO: 461729 - DNA, 16 bp, M. musculus
ttttctttccagaaaa

SEQ ID NO: 461730 - DNA, 16 bp, M. musculus
ttttctttccagatga

SEQ ID NO: 461731 - DNA, 16 bp, M. musculus
ttttctttcccagaat

SEQ ID NO: 461732 - DNA, 16 bp, M. musculus
ttttctttccttcaaa

SEQ ID NO: 461733 - DNA, 16 bp, M. musculus
ttttctttcctttgaa

SEQ ID NO: 461734 - DNA, 16 bp, M. musculus
ttttctttctctgaaa

SEQ ID NO: 461735 - DNA, 16 bp, M. musculus
ttttctttctgaaaat

SEQ ID NO: 461736 - DNA, 16 bp, M. musculus
ttttctttctgaaatg

SEQ ID NO: 461737 - DNA, 16 bp, M. musculus
ttttctttctgagatt

SEQ ID NO: 461738 - DNA, 16 bp, M. musculus
ttttctttctggaaat

SEQ ID NO: 461739 - DNA, 16 bp, M. musculus
ttttctttctgtaaat

SEQ ID NO: 461740 - DNA, 16 bp, M. musculus
ttttctttctgtagct

SEQ ID NO: 461741 - DNA, 16 bp, M. musculus
ttttctttctgtgaaa

SEQ ID NO: 461742 - DNA, 16 bp, M. musculus
ttttctttgaaaaaaa

SEQ ID NO: 461743 - DNA, 16 bp, M. musculus
ttttctttgaaaaaat

SEQ ID NO: 461744 - DNA, 16 bp, M. musculus
ttttctttgaaataaa

SEQ ID NO: 461745 - DNA, 16 bp, M. musculus
ttttctttgaaggttt

SEQ ID NO: 461746 - DNA, 16 bp, M. musculus
ttttctttgagaaaat

SEQ ID NO: 461747 - DNA, 16 bp, M. musculus
ttttctttgagaaagg

SEQ ID NO: 461748 - DNA, 16 bp, M. musculus
ttttctttgagaattt

SEQ ID NO: 461749 - DNA, 16 bp, M. musculus
ttttctttgagatggg

SEQ ID NO: 461750 - DNA, 16 bp, M. musculus
ttttctttgaggactt

SEQ ID NO: 461751 - DNA, 16 bp, M. musculus
ttttctttggcagagg

SEQ ID NO: 461752 - DNA, 16 bp, M. musculus
ttttctttgtaaaaca

SEQ ID NO: 461753 - DNA, 16 bp, M. musculus
ttttctttgtaaaata

SEQ ID NO: 461754 - DNA, 16 bp, M. musculus
ttttctttgtataaaa

SEQ ID NO: 461755 - DNA, 16 bp, M. musculus
ttttctttgtatacat

SEQ ID NO: 461756 - DNA, 16 bp, M. musculus
ttttcttttaaaatgt

SEQ ID NO: 461757 - DNA, 16 bp, M. musculus
ttttcttttaaagagt

SEQ ID NO: 461758 - DNA, 16 bp, M. musculus
ttttcttttaaaggaa

SEQ ID NO: 461759 - DNA, 16 bp, M. musculus
ttttcttttaaagtaa

SEQ ID NO: 461760 - DNA, 16 bp, M. musculus
ttttcttttagaaaat

SEQ ID NO: 461761 - DNA, 16 bp, M. musculus
ttttcttttatgaaat

SEQ ID NO: 461762 - DNA, 16 bp, M. musculus
ttttcttttatgacct

SEQ ID NO: 461763 - DNA, 16 bp, M. musculus
ttttcttttcaaatgt

SEQ ID NO: 461764 - DNA, 16 bp, M. musculus
ttttcttttcctgaga

SEQ ID NO: 461765 - DNA, 16 bp, M. musculus
ttttcttttctcagct

SEQ ID NO: 461766 - DNA, 16 bp, M. musculus
ttttcttttctgaaaa

SEQ ID NO: 461767 - DNA, 16 bp, M. musculus
ttttcttttctggaaa

SEQ ID NO: 461768 - DNA, 16 bp, M. musculus
ttttcttttgaaaaat

SEQ ID NO: 461769 - DNA, 16 bp, M. musculus
ttttcttttgaaactg

SEQ ID NO: 461770 - DNA, 16 bp, M. musculus
ttttcttttgagatgg

SEQ ID NO: 461771 - DNA, 16 bp, M. musculus
ttttcttttgtgggga

SEQ ID NO: 461772 - DNA, 16 bp, M. musculus
ttttctttttaaagta

SEQ ID NO: 461773 - DNA, 16 bp, M. musculus
ttttctttttaatgaa

SEQ ID NO: 461774 - DNA, 16 bp, M. musculus
ttttctttttagaaat

SEQ ID NO: 461775 - DNA, 16 bp, M. musculus
ttttctttttagacag

SEQ ID NO: 461776 - DNA, 16 bp, M. musculus
ttttctttttcagata

SEQ ID NO: 461777 - DNA, 16 bp, M. musculus
ttttctttttcagtag

SEQ ID NO: 461778 - DNA, 16 bp, M. musculus
ttttctttttccaaaa

SEQ ID NO: 461779 - DNA, 16 bp, M. musculus
ttttctttttctccag

SEQ ID NO: 461780 - DNA, 16 bp, M. musculus
ttttctttttctgcca

SEQ ID NO: 461781 - DNA, 16 bp, M. musculus
ttttctttttgaaaat

SEQ ID NO: 461782 - DNA, 16 bp, M. musculus
ttttctttttgaaaga

SEQ ID NO: 461783 - DNA, 16 bp, M. musculus
ttttctttttgagaca

SEQ ID NO: 461784 - DNA, 20 bp, M. musculus
ttttcttttttgagacaggg

SEQ ID NO: 461785 - DNA, 16 bp, M. musculus
ttttcttttttggaaa

SEQ ID NO: 461786 - DNA, 16 bp, M. musculus
ttttgaaaaaaaacaa

SEQ ID NO: 461787 - DNA, 16 bp, M. musculus
ttttgaaaaacaaaaa

SEQ ID NO: 461788 - DNA, 16 bp, M. musculus
ttttgaaaaacaattt

SEQ ID NO: 461789 - DNA, 16 bp, M. musculus
ttttgaaaaacatttt

SEQ ID NO: 461790 - DNA, 16 bp, M. musculus
ttttgaaaaagagaaa

SEQ ID NO: 461791 - DNA, 16 bp, M. musculus
ttttgaaaaataaact

SEQ ID NO: 461792 - DNA, 16 bp, M. musculus
ttttgaaaaatcaaaa

SEQ ID NO: 461793 - DNA, 16 bp, M. musculus
ttttgaaaaatctaaa

SEQ ID NO: 461794 - DNA, 16 bp, M. musculus
ttttgaaaaatgattt

SEQ ID NO: 461795 - DNA, 16 bp, M. musculus
ttttgaaaacattttt

SEQ ID NO: 461796 - DNA, 16 bp, M. musculus
ttttgaaaaccaacta

SEQ ID NO: 461797 - DNA, 16 bp, M. musculus
ttttgaaaactgtttt

SEQ ID NO: 461798 - DNA, 16 bp, M. musculus
ttttgaaaataaaact

SEQ ID NO: 461799 - DNA, 16 bp, M. musculus
ttttgaaaataaatga

SEQ ID NO: 461800 - DNA, 16 bp, M. musculus
ttttgaaaatcattca

SEQ ID NO: 461801 - DNA, 16 bp, M. musculus
ttttgaaaatgtgtat

SEQ ID NO: 461802 - DNA, 16 bp, M. musculus
ttttgaaaatgttctg

SEQ ID NO: 461803 - DNA, 16 bp, M. musculus
ttttgaaaattccatc

SEQ ID NO: 461804 - DNA, 16 bp, M. musculus
ttttgaaacaaatgga

SEQ ID NO: 461805 - DNA, 16 bp, M. musculus
ttttgaaacaagattt

SEQ ID NO: 461806 - DNA, 16 bp, M. musculus
ttttgaaacagaatct

SEQ ID NO: 461807 - DNA, 16 bp, M. musculus
ttttgaaacaggatct

SEQ ID NO: 461808 - DNA, 16 bp, M. musculus
ttttgaaacaggtttt

SEQ ID NO: 461809 - DNA, 16 bp, M. musculus
ttttgaaacagtctca

SEQ ID NO: 461810 - DNA, 16 bp, M. musculus
ttttgaaacctcaaag

SEQ ID NO: 461811 - DNA, 16 bp, M. musculus
ttttgaaactataatt

SEQ ID NO: 461812 - DNA, 16 bp, M. musculus
ttttgaaactgaaaga

SEQ ID NO: 461813 - DNA, 16 bp, M. musculus
ttttgaaacttcaaag

SEQ ID NO: 461814 - DNA, 16 bp, M. musculus
ttttgaaagaaaaatg

SEQ ID NO: 461815 - DNA, 16 bp, M. musculus
ttttgaaagaaaaatt

SEQ ID NO: 461816 - DNA, 16 bp, M. musculus
ttttgaaagaaaagaa

SEQ ID NO: 461817 - DNA, 16 bp, M. musculus
ttttgaaagaagaaaa

SEQ ID NO: 461818 - DNA, 16 bp, M. musculus
ttttgaaagagaaatt

SEQ ID NO: 461819 - DNA, 16 bp, M. musculus
ttttgaaagagagaga

SEQ ID NO: 461820 - DNA, 16 bp, M. musculus
ttttgaaagttgtatc

SEQ ID NO: 461821 - DNA, 16 bp, M. musculus
ttttgaaagttttaaa

SEQ ID NO: 461822 - DNA, 16 bp, M. musculus
ttttgaaataaaactt

SEQ ID NO: 461823 - DNA, 16 bp, M. musculus
ttttgaaataaacctt

SEQ ID NO: 461824 - DNA, 16 bp, M. musculus
ttttgaaataaatttc

SEQ ID NO: 461825 - DNA, 16 bp, M. musculus
ttttgaaatattttct

SEQ ID NO: 461826 - DNA, 16 bp, M. musculus
ttttgaaatctcaaag

SEQ ID NO: 461827 - DNA, 16 bp, M. musculus
ttttgaaatctgtttt

SEQ ID NO: 461828 - DNA, 16 bp, M. musculus
ttttgaaatgctgaaa

SEQ ID NO: 461829 - DNA, 16 bp, M. musculus
ttttgaaatgttcttg

SEQ ID NO: 461830 - DNA, 16 bp, M. musculus
ttttgaaatgtttaaa

SEQ ID NO: 461831 - DNA, 16 bp, M. musculus
ttttgaaatgttttca

SEQ ID NO: 461832 - DNA, 16 bp, M. musculus
ttttgaaattactttt

SEQ ID NO: 461833 - DNA, 16 bp, M. musculus
ttttgaaatttgaaaa

SEQ ID NO: 461834 - DNA, 16 bp, M. musculus
ttttgaaattttcaat

SEQ ID NO: 461835 - DNA, 16 bp, M. musculus
ttttgaaattttgaaa

SEQ ID NO: 461836 - DNA, 16 bp, M. musculus
ttttgaacattttatt

SEQ ID NO: 461837 - DNA, 16 bp, M. musculus
ttttgaagaactggaa

SEQ ID NO: 461838 - DNA, 16 bp, M. musculus
ttttgaagacccatgg

SEQ ID NO: 461839 - DNA, 16 bp, M. musculus
ttttgaagcagaatct

SEQ ID NO: 461840 - DNA, 18 bp, M. musculus
ttttgaaggagccgaggg

SEQ ID NO: 461841 - DNA, 16 bp, M. musculus
ttttgaatcagggtct

SEQ ID NO: 461842 - DNA, 16 bp, M. musculus
ttttgaatttcatttc

SEQ ID NO: 461843 - DNA, 16 bp, M. musculus
ttttgacaaggtttct

SEQ ID NO: 461844 - DNA, 16 bp, M. musculus
ttttgacatttaaaaa

SEQ ID NO: 461845 - DNA, 16 bp, M. musculus
ttttgaccagttgtgg

SEQ ID NO: 461846 - DNA, 16 bp, M. musculus
ttttgactatattgat

SEQ ID NO: 461847 - DNA, 16 bp, M. musculus
ttttgactcatggttt

SEQ ID NO: 461848 - DNA, 16 bp, M. musculus
ttttgagaaaacaaaa

SEQ ID NO: 461849 - DNA, 16 bp, M. musculus
ttttgagaaaaggtct

SEQ ID NO: 461850 - DNA, 16 bp, M. musculus
ttttgagaactgtcta

SEQ ID NO: 461851 - DNA, 16 bp, M. musculus
ttttgagaatattttc

SEQ ID NO: 461852 - DNA, 16 bp, M. musculus
ttttgagaattctcca

SEQ ID NO: 461853 - DNA, 16 bp, M. musculus
ttttgagaattttctt

SEQ ID NO: 461854 - DNA, 16 bp, M. musculus
ttttgagacaaagcct

SEQ ID NO: 461855 - DNA, 16 bp, M. musculus
ttttgagacaagatct

SEQ ID NO: 461856 - DNA, 16 bp, M. musculus
ttttgagacaagctct

SEQ ID NO: 461857 - DNA, 16 bp, M. musculus
ttttgagacaaggcct

SEQ ID NO: 461858 - DNA, 16 bp, M. musculus
ttttgagacaaggtct

SEQ ID NO: 461859 - DNA, 16 bp, M. musculus
ttttgagacaatgtct

SEQ ID NO: 461860 - DNA, 16 bp, M. musculus
ttttgagacacaatct

SEQ ID NO: 461861 - DNA, 16 bp, M. musculus
ttttgagacacagttt

SEQ ID NO: 461862 - DNA, 16 bp, M. musculus
ttttgagacagaatct

SEQ ID NO: 461863 - DNA, 16 bp, M. musculus
ttttgagacagaggct

SEQ ID NO: 461864 - DNA, 16 bp, M. musculus
ttttgagacagaggtt

SEQ ID NO: 461865 - DNA, 16 bp, M. musculus
ttttgagacaggatct

SEQ ID NO: 461866 - DNA, 16 bp, M. musculus
ttttgagacagggcat

SEQ ID NO: 461867 - DNA, 16 bp, M. musculus
ttttgagacagggtct

SEQ ID NO: 461868 - DNA, 16 bp, M. musculus
ttttgagacagggttt

SEQ ID NO: 461869 - DNA, 16 bp, M. musculus
ttttgagacagtatct

SEQ ID NO: 461870 - DNA, 16 bp, M. musculus
ttttgagacagtgtct

SEQ ID NO: 461871 - DNA, 16 bp, M. musculus
ttttgagacagtttca

SEQ ID NO: 461872 - DNA, 16 bp, M. musculus
ttttgagacataatct

SEQ ID NO: 461873 - DNA, 16 bp, M. musculus
ttttgagacattgtct

SEQ ID NO: 461874 - DNA, 16 bp, M. musculus
ttttgagacctcaaag

SEQ ID NO: 461875 - DNA, 16 bp, M. musculus
ttttgagactggatct

SEQ ID NO: 461876 - DNA, 16 bp, M. musculus
ttttgagactgggtct

SEQ ID NO: 461877 - DNA, 16 bp, M. musculus
ttttgagactgggttt

SEQ ID NO: 461878 - DNA, 16 bp, M. musculus
ttttgagactgtgtct

SEQ ID NO: 461879 - DNA, 16 bp, M. musculus
ttttgagagagaaaaa

SEQ ID NO: 461880 - DNA, 16 bp, M. musculus
ttttgagagaggatct

SEQ ID NO: 461881 - DNA, 16 bp, M. musculus
ttttgagagagggtct

SEQ ID NO: 461882 - DNA, 16 bp, M. musculus
ttttgagaggctctgc

SEQ ID NO: 461883 - DNA, 16 bp, M. musculus
ttttgagataaggttt

SEQ ID NO: 461884 - DNA, 16 bp, M. musculus
ttttgagatagcatct

SEQ ID NO: 461885 - DNA, 16 bp, M. musculus
ttttgagataggatct

SEQ ID NO: 461886 - DNA, 16 bp, M. musculus
ttttgagatagggtct

SEQ ID NO: 461887 - DNA, 16 bp, M. musculus
ttttgagataggtctc

SEQ ID NO: 461888 - DNA, 16 bp, M. musculus
ttttgagatagtatct

SEQ ID NO: 461889 - DNA, 16 bp, M. musculus
ttttgagatcttcttc

SEQ ID NO: 461890 - DNA, 16 bp, M. musculus
ttttgagatggagttt

SEQ ID NO: 461891 - DNA, 16 bp, M. musculus
ttttgagatgggatct

SEQ ID NO: 461892 - DNA, 16 bp, M. musculus
ttttgagatgggattt

SEQ ID NO: 461893 - DNA, 16 bp, M. musculus
ttttgagatggggttt

SEQ ID NO: 461894 - DNA, 16 bp, M. musculus
ttttgagatggtgtct

SEQ ID NO: 461895 - DNA, 16 bp, M. musculus
ttttgagcagatctct

SEQ ID NO: 461896 - DNA, 16 bp, M. musculus
ttttgagcagatttct

SEQ ID NO: 461897 - DNA, 16 bp, M. musculus
ttttgaggaactgcca

SEQ ID NO: 461898 - DNA, 16 bp, M. musculus
ttttgaggcaaggtct

SEQ ID NO: 461899 - DNA, 16 bp, M. musculus
ttttgaggcaggatct

SEQ ID NO: 461900 - DNA, 16 bp, M. musculus
ttttgaggcagggtct

SEQ ID NO: 461901 - DNA, 16 bp, M. musculus
ttttgagggaaaaaaa

SEQ ID NO: 461902 - DNA, 16 bp, M. musculus
ttttgaggtagggtct

SEQ ID NO: 461903 - DNA, 16 bp, M. musculus
ttttgaggtggagtct

SEQ ID NO: 461904 - DNA, 16 bp, M. musculus
ttttgagtcaggatct

SEQ ID NO: 461905 - DNA, 16 bp, M. musculus
ttttgagtcagggtct

SEQ ID NO: 461906 - DNA, 16 bp, M. musculus
ttttgagttagggtct

SEQ ID NO: 461907 - DNA, 16 bp, M. musculus
ttttgagttcaaggct

SEQ ID NO: 461908 - DNA, 16 bp, M. musculus
ttttgagtttctctcc

SEQ ID NO: 461909 - DNA, 16 bp, M. musculus
ttttgagtttcttcct

SEQ ID NO: 461910 - DNA, 16 bp, M. musculus
ttttgagttttaaaaa

SEQ ID NO: 461911 - DNA, 16 bp, M. musculus
ttttgataaaatcttg

SEQ ID NO: 461912 - DNA, 16 bp, M. musculus
ttttgataaagaaacc

SEQ ID NO: 461913 - DNA, 16 bp, M. musculus
ttttgataaagaatcc

SEQ ID NO: 461914 - DNA, 16 bp, M. musculus
ttttgataattatgtg

SEQ ID NO: 461915 - DNA, 16 bp, M. musculus
ttttgatacataagca

SEQ ID NO: 461916 - DNA, 16 bp, M. musculus
ttttgatagggtctca

SEQ ID NO: 461917 - DNA, 16 bp, M. musculus
ttttgatatgatgtgt

SEQ ID NO: 461918 - DNA, 16 bp, M. musculus
ttttgatcccagcact

SEQ ID NO: 461919 - DNA, 16 bp, M. musculus
ttttgatgaatttggg

SEQ ID NO: 461920 - DNA, 16 bp, M. musculus
ttttgatgactttgtg

SEQ ID NO: 461921 - DNA, 16 bp, M. musculus
ttttgatgtcctctac

SEQ ID NO: 461922 - DNA, 16 bp, M. musculus
ttttgatgttggctac

SEQ ID NO: 461923 - DNA, 16 bp, M. musculus
ttttgattatgaagat

SEQ ID NO: 461924 - DNA, 16 bp, M. musculus
ttttgattgtgaagat

SEQ ID NO: 461925 - DNA, 16 bp, M. musculus
ttttgatttgcagtcc

SEQ ID NO: 461926 - DNA, 16 bp, M. musculus
ttttgatttgtgtgtc

SEQ ID NO: 461927 - DNA, 16 bp, M. musculus
ttttgatttttggaga

SEQ ID NO: 461928 - DNA, 16 bp, M. musculus
ttttgcaaggaggaat

SEQ ID NO: 461929 - DNA, 16 bp, M. musculus
ttttgcaagtatttta

SEQ ID NO: 461930 - DNA, 16 bp, M. musculus
ttttgcagaagaccca

SEQ ID NO: 461931 - DNA, 16 bp, M. musculus
ttttgcagaggacttg

SEQ ID NO: 461932 - DNA, 16 bp, M. musculus
ttttgcagaggatctg

SEQ ID NO: 461933 - DNA, 16 bp, M. musculus
ttttgcagagtctgat

SEQ ID NO: 461934 - DNA, 16 bp, M. musculus
ttttgcagatgatgtg

SEQ ID NO: 461935 - DNA, 16 bp, M. musculus
ttttgcagtgtgtgtg

SEQ ID NO: 461936 - DNA, 16 bp, M. musculus
ttttgcagtgttgggg

SEQ ID NO: 461937 - DNA, 16 bp, M. musculus
ttttgcataatatttt

SEQ ID NO: 461938 - DNA, 16 bp, M. musculus
ttttgcatcgatattc

SEQ ID NO: 461939 - DNA, 16 bp, M. musculus
ttttgcatcttctttg

SEQ ID NO: 461940 - DNA, 16 bp, M. musculus
ttttgcatgctttctt

SEQ ID NO: 461941 - DNA, 16 bp, M. musculus
ttttgcatgtgtatat

SEQ ID NO: 461942 - DNA, 17 bp, M. musculus
ttttgcattttgcactt

SEQ ID NO: 461943 - DNA, 16 bp, M. musculus
ttttgccaaaggcttt

SEQ ID NO: 461944 - DNA, 16 bp, M. musculus
ttttgccaactgcaga

SEQ ID NO: 461945 - DNA, 16 bp, M. musculus
ttttgccagctacaga

SEQ ID NO: 461946 - DNA, 16 bp, M. musculus
ttttgccagctgcaga

SEQ ID NO: 461947 - DNA, 16 bp, M. musculus
ttttgccaggcagtgg

SEQ ID NO: 461948 - DNA, 16 bp, M. musculus
ttttgccatagcaaca

SEQ ID NO: 461949 - DNA, 16 bp, M. musculus
ttttgccatctttatt

SEQ ID NO: 461950 - DNA, 16 bp, M. musculus
ttttgccattctctct

SEQ ID NO: 461951 - DNA, 16 bp, M. musculus
ttttgcccagagctgg

SEQ ID NO: 461952 - DNA, 17 bp, M. musculus
ttttgcccttgtctgaa

SEQ ID NO: 461953 - DNA, 16 bp, M. musculus
ttttgcctacatgtat

SEQ ID NO: 461954 - DNA, 16 bp, M. musculus
ttttgcctacatgttt

SEQ ID NO: 461955 - DNA, 16 bp, M. musculus
ttttgcctcaaggaat

SEQ ID NO: 461956 - DNA, 16 bp, M. musculus
ttttgcctcagcttcc

SEQ ID NO: 461957 - DNA, 16 bp, M. musculus
ttttgcctgcacacat

SEQ ID NO: 461958 - DNA, 16 bp, M. musculus
ttttgcctgcatgtat

SEQ ID NO: 461959 - DNA, 16 bp, M. musculus
ttttgcctgcatgtgt

SEQ ID NO: 461960 - DNA, 16 bp, M. musculus
ttttgcctgcttgtat

SEQ ID NO: 461961 - DNA, 16 bp, M. musculus
ttttgcctggtcatgg

SEQ ID NO: 461962 - DNA, 16 bp, M. musculus
ttttgcctgtatgtat

SEQ ID NO: 461963 - DNA, 16 bp, M. musculus
ttttgcctttaaaaat

SEQ ID NO: 461964 - DNA, 18 bp, M. musculus
ttttgcctttctaagctt

SEQ ID NO: 461965 - DNA, 16 bp, M. musculus
ttttgccttttaaaaa

SEQ ID NO: 461966 - DNA, 16 bp, M. musculus
ttttgctagttatgaa

SEQ ID NO: 461967 - DNA, 16 bp, M. musculus
ttttgctcctgagttt

SEQ ID NO: 461968 - DNA, 16 bp, M. musculus
ttttgctgaaaacaga

SEQ ID NO: 461969 - DNA, 16 bp, M. musculus
ttttgctgaagcagac

SEQ ID NO: 461970 - DNA, 16 bp, M. musculus
ttttgctgacagtacc

SEQ ID NO: 461971 - DNA, 16 bp, M. musculus
ttttgctgagaacaga

SEQ ID NO: 461972 - DNA, 16 bp, M. musculus
ttttgctgctgtgaac

SEQ ID NO: 461973 - DNA, 16 bp, M. musculus
ttttgctgggtttagt

SEQ ID NO: 461974 - DNA, 16 bp, M. musculus
ttttgctggtcctcag

SEQ ID NO: 461975 - DNA, 16 bp, M. musculus
ttttgctgttttgaaa

SEQ ID NO: 461976 - DNA, 16 bp, M. musculus
ttttgctgtttttaaa

SEQ ID NO: 461977 - DNA, 16 bp, M. musculus
ttttgcttaaaaaaaa

SEQ ID NO: 461978 - DNA, 16 bp, M. musculus
ttttgcttctctgcat

SEQ ID NO: 461979 - DNA, 16 bp, M. musculus
ttttgctttaaaatat

SEQ ID NO: 461980 - DNA, 16 bp, M. musculus
ttttgcttttaaaata

SEQ ID NO: 461981 - DNA, 16 bp, M. musculus
ttttgcttttattaaa

SEQ ID NO: 461982 - DNA, 16 bp, M. musculus
ttttgctttttaaaaa

SEQ ID NO: 461983 - DNA, 16 bp, M. musculus
ttttgctttttaaaat

SEQ ID NO: 461984 - DNA, 16 bp, M. musculus
ttttgctttttccaga

SEQ ID NO: 461985 - DNA, 16 bp, M. musculus
ttttggaaaattaaaa

SEQ ID NO: 461986 - DNA, 16 bp, M. musculus
ttttggaaataaaaat

SEQ ID NO: 461987 - DNA, 16 bp, M. musculus
ttttggaaatgtaaat

SEQ ID NO: 461988 - DNA, 16 bp, M. musculus
ttttggaagcacttag

SEQ ID NO: 461989 - DNA, 16 bp, M. musculus
ttttggaagctgatta

SEQ ID NO: 461990 - DNA, 16 bp, M. musculus
ttttggaatatttgca

SEQ ID NO: 461991 - DNA, 22 bp, M. musculus
ttttggaatcacagctgccatt

SEQ ID NO: 461992 - DNA, 16 bp, M. musculus
ttttggaattcttcag

SEQ ID NO: 461993 - DNA, 16 bp, M. musculus
ttttggagaaagttct

SEQ ID NO: 461994 - DNA, 17 bp, M. musculus
ttttggagaaggtacca

SEQ ID NO: 461995 - DNA, 30 bp, M. musculus
ttttggagaaggtaccatgaggtgctgaga

SEQ ID NO: 461996 - DNA, 16 bp, M. musculus
ttttggagacacttag

SEQ ID NO: 461997 - DNA, 16 bp, M. musculus
ttttggagacaggttt

SEQ ID NO: 461998 - DNA, 16 bp, M. musculus
ttttggagacagtctt

SEQ ID NO: 461999 - DNA, 16 bp, M. musculus
ttttggagatagaagt

SEQ ID NO: 462000 - DNA, 16 bp, M. musculus
ttttggagatatttgc

SEQ ID NO: 462001 - DNA, 16 bp, M. musculus
ttttggagccactcag

SEQ ID NO: 462002 - DNA, 16 bp, M. musculus
ttttggaggaggtact

SEQ ID NO: 462003 - DNA, 16 bp, M. musculus
ttttggaggctaatta

SEQ ID NO: 462004 - DNA, 17 bp, M. musculus
ttttggaggggaaacca

SEQ ID NO: 462005 - DNA, 16 bp, M. musculus
ttttggagttttcctt

SEQ ID NO: 462006 - DNA, 16 bp, M. musculus
ttttggataaaatgtt

SEQ ID NO: 462007 - DNA, 16 bp, M. musculus
ttttggattaaaggtg

SEQ ID NO: 462008 - DNA, 16 bp, M. musculus
ttttggatttgttgaa

SEQ ID NO: 462009 - DNA, 16 bp, M. musculus
ttttggattttaaaag

SEQ ID NO: 462010 - DNA, 16 bp, M. musculus
ttttggattttctcag

SEQ ID NO: 462011 - DNA, 16 bp, M. musculus
ttttggcagatgatat

SEQ ID NO: 462012 - DNA, 16 bp, M. musculus
ttttggcagtcaagct

SEQ ID NO: 462013 - DNA, 16 bp, M. musculus
ttttggccacagtgtt

SEQ ID NO: 462014 - DNA, 16 bp, M. musculus
ttttggctactttgtg

SEQ ID NO: 462015 - DNA, 16 bp, M. musculus
ttttggctcatggttt

SEQ ID NO: 462016 - DNA, 16 bp, M. musculus
ttttggctcccttgtc

SEQ ID NO: 462017 - DNA, 16 bp, M. musculus
ttttgggaaaaaaaaa

SEQ ID NO: 462018 - DNA, 16 bp, M. musculus
ttttgggaaggactgt

SEQ ID NO: 462019 - DNA, 16 bp, M. musculus
ttttgggacagggttt

SEQ ID NO: 462020 - DNA, 16 bp, M. musculus
ttttgggactttggat

SEQ ID NO: 462021 - DNA, 25 bp, M. musculus
ttttgggatagcactggaaatgtaa

SEQ ID NO: 462022 - DNA, 16 bp, M. musculus
ttttgggattgggtta

SEQ ID NO: 462023 - DNA, 16 bp, M. musculus
ttttgggcagaaagag

SEQ ID NO: 462024 - DNA, 16 bp, M. musculus
ttttgggctccagaca

SEQ ID NO: 462025 - DNA, 16 bp, M. musculus
ttttgggggaatcatt

SEQ ID NO: 462026 - DNA, 16 bp, M. musculus
ttttgggggggggtca

SEQ ID NO: 462027 - DNA, 16 bp, M. musculus
ttttggggtcactcat

SEQ ID NO: 462028 - DNA, 16 bp, M. musculus
ttttgggtcttcagtt

SEQ ID NO: 462029 - DNA, 16 bp, M. musculus
ttttgggtgctctaaa

SEQ ID NO: 462030 - DNA, 16 bp, M. musculus
ttttgggttgaaattt

SEQ ID NO: 462031 - DNA, 16 bp, M. musculus
ttttgggttttcttca

SEQ ID NO: 462032 - DNA, 16 bp, M. musculus
ttttggtacagcattg

SEQ ID NO: 462033 - DNA, 16 bp, M. musculus
ttttggtagattttac

SEQ ID NO: 462034 - DNA, 16 bp, M. musculus
ttttggtagctgcagg

SEQ ID NO: 462035 - DNA, 16 bp, M. musculus
ttttggtcacagtgtt

SEQ ID NO: 462036 - DNA, 16 bp, M. musculus
ttttggtcacggtgtt

SEQ ID NO: 462037 - DNA, 16 bp, M. musculus
ttttggtgaagaatgt

SEQ ID NO: 462038 - DNA, 16 bp, M. musculus
ttttggtgcattggcc

SEQ ID NO: 462039 - DNA, 16 bp, M. musculus
ttttggtggatttttc

SEQ ID NO: 462040 - DNA, 16 bp, M. musculus
ttttggttaatatcta

SEQ ID NO: 462041 - DNA, 16 bp, M. musculus
ttttggttcagcttat

SEQ ID NO: 462042 - DNA, 16 bp, M. musculus
ttttggttgctacttc

SEQ ID NO: 462043 - DNA, 16 bp, M. musculus
ttttggttgtgagctt

SEQ ID NO: 462044 - DNA, 16 bp, M. musculus
ttttggttgtgagtct

SEQ ID NO: 462045 - DNA, 16 bp, M. musculus
ttttggtttcattgaa

SEQ ID NO: 462046 - DNA, 16 bp, M. musculus
ttttggtttgttaaaa

SEQ ID NO: 462047 - DNA, 16 bp, M. musculus
ttttggttttgagaca

SEQ ID NO: 462048 - DNA, 16 bp, M. musculus
ttttggtttttaaaag

SEQ ID NO: 462049 - DNA, 16 bp, M. musculus
ttttggtttttagaga

SEQ ID NO: 462050 - DNA, 16 bp, M. musculus
ttttggtttttcaaga

SEQ ID NO: 462051 - DNA, 16 bp, M. musculus
ttttgtaaagaaaata

SEQ ID NO: 462052 - DNA, 16 bp, M. musculus
ttttgtaacattttat

SEQ ID NO: 462053 - DNA, 16 bp, M. musculus
ttttgtaacttgtgat

SEQ ID NO: 462054 - DNA, 16 bp, M. musculus
ttttgtaatgttaaaa

SEQ ID NO: 462055 - DNA, 16 bp, M. musculus
ttttgtaccttttcta

SEQ ID NO: 462056 - DNA, 16 bp, M. musculus
ttttgtactttaaaat

SEQ ID NO: 462057 - DNA, 16 bp, M. musculus
ttttgtagctctggct

SEQ ID NO: 462058 - DNA, 16 bp, M. musculus
ttttgtcaaagccttt

SEQ ID NO: 462059 - DNA, 16 bp, M. musculus
ttttgtcaaatgtgtt

SEQ ID NO: 462060 - DNA, 16 bp, M. musculus
ttttgtcacacagcag

SEQ ID NO: 462061 - DNA, 16 bp, M. musculus
ttttgtcacagctcca

SEQ ID NO: 462062 - DNA, 16 bp, M. musculus
ttttgtcagggtgttt

SEQ ID NO: 462063 - DNA, 16 bp, M. musculus
ttttgtcagtttgaca

SEQ ID NO: 462064 - DNA, 16 bp, M. musculus
ttttgtcatagaatat

SEQ ID NO: 462065 - DNA, 16 bp, M. musculus
ttttgtcattcttcat

SEQ ID NO: 462066 - DNA, 16 bp, M. musculus
ttttgtcattgagttt

SEQ ID NO: 462067 - DNA, 16 bp, M. musculus
ttttgtcatttaaaat

SEQ ID NO: 462068 - DNA, 16 bp, M. musculus
ttttgtcattttacat

SEQ ID NO: 462069 - DNA, 16 bp, M. musculus
ttttgtcctggaactc

SEQ ID NO: 462070 - DNA, 16 bp, M. musculus
ttttgtcctggatttc

SEQ ID NO: 462071 - DNA, 16 bp, M. musculus
ttttgtctaatgcttt

SEQ ID NO: 462072 - DNA, 16 bp, M. musculus
ttttgtctacttccct

SEQ ID NO: 462073 - DNA, 16 bp, M. musculus
ttttgtctactttcct

SEQ ID NO: 462074 - DNA, 16 bp, M. musculus
ttttgtctcagcccca

SEQ ID NO: 462075 - DNA, 16 bp, M. musculus
ttttgtctctgaagtt

SEQ ID NO: 462076 - DNA, 16 bp, M. musculus
ttttgtctctgtgccc

SEQ ID NO: 462077 - DNA, 16 bp, M. musculus
ttttgtctctgttact

SEQ ID NO: 462078 - DNA, 16 bp, M. musculus
ttttgtctgcatttat

SEQ ID NO: 462079 - DNA, 16 bp, M. musculus
ttttgtctgtgagttt

SEQ ID NO: 462080 - DNA, 16 bp, M. musculus
ttttgtcttaaaaagc

SEQ ID NO: 462081 - DNA, 16 bp, M. musculus
ttttgtcttgttgatg

SEQ ID NO: 462082 - DNA, 16 bp, M. musculus
ttttgtcttttaaaat

SEQ ID NO: 462083 - DNA, 16 bp, M. musculus
ttttgtcttttgagat

SEQ ID NO: 462084 - DNA, 16 bp, M. musculus
ttttgtgaagtacagg

SEQ ID NO: 462085 - DNA, 16 bp, M. musculus
ttttgtgaagtcattg

SEQ ID NO: 462086 - DNA, 16 bp, M. musculus
ttttgtgacagggttt

SEQ ID NO: 462087 - DNA, 16 bp, M. musculus
ttttgtgactgaatta

SEQ ID NO: 462088 - DNA, 16 bp, M. musculus
ttttgtgctttactgt

SEQ ID NO: 462089 - DNA, 16 bp, M. musculus
ttttgtggaaaaaaaa

SEQ ID NO: 462090 - DNA, 16 bp, M. musculus
ttttgtggtgctgagg

SEQ ID NO: 462091 - DNA, 16 bp, M. musculus
ttttgtgtaaatttgg

SEQ ID NO: 462092 - DNA, 16 bp, M. musculus
ttttgtgtcaggaact

SEQ ID NO: 462093 - DNA, 16 bp, M. musculus
ttttgtgtctggcttc

SEQ ID NO: 462094 - DNA, 16 bp, M. musculus
ttttgtgtgtgaactt

SEQ ID NO: 462095 - DNA, 16 bp, M. musculus
ttttgtgtgtgcatgt

SEQ ID NO: 462096 - DNA, 16 bp, M. musculus
ttttgtgtgtgtgcat

SEQ ID NO: 462097 - DNA, 16 bp, M. musculus
ttttgtgttgggagat

SEQ ID NO: 462098 - DNA, 16 bp, M. musculus
ttttgttaaaacaaaa

SEQ ID NO: 462099 - DNA, 16 bp, M. musculus
ttttgttaaattggat

SEQ ID NO: 462100 - DNA, 16 bp, M. musculus
ttttgttaatctggat

SEQ ID NO: 462101 - DNA, 16 bp, M. musculus
ttttgttaatgatatg

SEQ ID NO: 462102 - DNA, 16 bp, M. musculus
ttttgttacagcagca

SEQ ID NO: 462103 - DNA, 16 bp, M. musculus
ttttgttacatatgca

SEQ ID NO: 462104 - DNA, 16 bp, M. musculus
ttttgttattcaagat

SEQ ID NO: 462105 - DNA, 16 bp, M. musculus
ttttgttattttcaaa

SEQ ID NO: 462106 - DNA, 16 bp, M. musculus
ttttgttcaattacat

SEQ ID NO: 462107 - DNA, 16 bp, M. musculus
ttttgttcatgtggct

SEQ ID NO: 462108 - DNA, 16 bp, M. musculus
ttttgttcattaaaaa

SEQ ID NO: 462109 - DNA, 16 bp, M. musculus
ttttgttccaatttct

SEQ ID NO: 462110 - DNA, 27 bp, M. musculus
ttttgttccttttcacatgttatcaag

SEQ ID NO: 462111 - DNA, 17 bp, M. musculus
ttttgttctagagcttt

SEQ ID NO: 462112 - DNA, 16 bp, M. musculus
ttttgttcttcagaga

SEQ ID NO: 462113 - DNA, 16 bp, M. musculus
ttttgttctttgccag

SEQ ID NO: 462114 - DNA, 16 bp, M. musculus
ttttgttcttttaaaa

SEQ ID NO: 462115 - DNA, 16 bp, M. musculus
ttttgttgaaaaaaat

SEQ ID NO: 462116 - DNA, 16 bp, M. musculus
ttttgttgaaaaatat

SEQ ID NO: 462117 - DNA, 16 bp, M. musculus
ttttgttgaagatgtt

SEQ ID NO: 462118 - DNA, 16 bp, M. musculus
ttttgttgaagcagac

SEQ ID NO: 462119 - DNA, 16 bp, M. musculus
ttttgttgctgatgtt

SEQ ID NO: 462120 - DNA, 16 bp, M. musculus
ttttgttggatatagt

SEQ ID NO: 462121 - DNA, 16 bp, M. musculus
ttttgttgtcagagtt

SEQ ID NO: 462122 - DNA, 16 bp, M. musculus
ttttgttgttagagat

SEQ ID NO: 462123 - DNA, 16 bp, M. musculus
ttttgttgttgaagat

SEQ ID NO: 462124 - DNA, 16 bp, M. musculus
ttttgtttccatgatc

SEQ ID NO: 462125 - DNA, 16 bp, M. musculus
ttttgtttctccatat

SEQ ID NO: 462126 - DNA, 16 bp, M. musculus
ttttgtttgagacaga

SEQ ID NO: 462127 - DNA, 16 bp, M. musculus
ttttgtttgcctttca

SEQ ID NO: 462128 - DNA, 16 bp, M. musculus
ttttgtttgctttgag

SEQ ID NO: 462129 - DNA, 16 bp, M. musculus
ttttgtttggagacag

SEQ ID NO: 462130 - DNA, 16 bp, M. musculus
ttttgtttggaggaat

SEQ ID NO: 462131 - DNA, 16 bp, M. musculus
ttttgtttgtgagaat

SEQ ID NO: 462132 - DNA, 16 bp, M. musculus
ttttgttttaaaaagc

SEQ ID NO: 462133 - DNA, 16 bp, M. musculus
ttttgttttaaacaaa

SEQ ID NO: 462134 - DNA, 16 bp, M. musculus
ttttgttttaaagaaa

SEQ ID NO: 462135 - DNA, 16 bp, M. musculus
ttttgttttaaagctt

SEQ ID NO: 462136 - DNA, 16 bp, M. musculus
ttttgttttaattcca

SEQ ID NO: 462137 - DNA, 16 bp, M. musculus
ttttgttttacaaaat

SEQ ID NO: 462138 - DNA, 16 bp, M. musculus
ttttgttttactgggt

SEQ ID NO: 462139 - DNA, 16 bp, M. musculus
ttttgttttaggataa

SEQ ID NO: 462140 - DNA, 16 bp, M. musculus
ttttgttttcaaaata

SEQ ID NO: 462141 - DNA, 16 bp, M. musculus
ttttgttttcaaacaa

SEQ ID NO: 462142 - DNA, 16 bp, M. musculus
ttttgttttcaaataa

SEQ ID NO: 462143 - DNA, 16 bp, M. musculus
ttttgttttcctaaaa

SEQ ID NO: 462144 - DNA, 16 bp, M. musculus
ttttgttttctaaatg

SEQ ID NO: 462145 - DNA, 16 bp, M. musculus
ttttgttttctctaaa

SEQ ID NO: 462146 - DNA, 16 bp, M. musculus
ttttgttttctgagac

SEQ ID NO: 462147 - DNA, 16 bp, M. musculus
ttttgttttcttgaga

SEQ ID NO: 462148 - DNA, 16 bp, M. musculus
ttttgttttgaagtct

SEQ ID NO: 462149 - DNA, 16 bp, M. musculus
ttttgttttgagacat

SEQ ID NO: 462150 - DNA, 16 bp, M. musculus
ttttgttttgctgtga

SEQ ID NO: 462151 - DNA, 16 bp, M. musculus
ttttgttttggagaca

SEQ ID NO: 462152 - DNA, 16 bp, M. musculus
ttttgttttggggaca

SEQ ID NO: 462153 - DNA, 16 bp, M. musculus
ttttgtttttaaagca

SEQ ID NO: 462154 - DNA, 16 bp, M. musculus
ttttgtttttaaatac

SEQ ID NO: 462155 - DNA, 16 bp, M. musculus
ttttgtttttaaatgc

SEQ ID NO: 462156 - DNA, 16 bp, M. musculus
ttttgtttttaagaga

SEQ ID NO: 462157 - DNA, 16 bp, M. musculus
ttttgtttttaaggca

SEQ ID NO: 462158 - DNA, 16 bp, M. musculus
ttttgtttttatcaca

SEQ ID NO: 462159 - DNA, 16 bp, M. musculus
ttttgtttttcaaaac

SEQ ID NO: 462160 - DNA, 16 bp, M. musculus
ttttgtttttcaagtc

SEQ ID NO: 462161 - DNA, 16 bp, M. musculus
ttttgtttttctggag

SEQ ID NO: 462162 - DNA, 16 bp, M. musculus
ttttgtttttgaaaca

SEQ ID NO: 462163 - DNA, 16 bp, M. musculus
ttttgtttttgaaact

SEQ ID NO: 462164 - DNA, 16 bp, M. musculus
ttttgtttttgaggca

SEQ ID NO: 462165 - DNA, 16 bp, M. musculus
ttttgtttttgataca

SEQ ID NO: 462166 - DNA, 16 bp, M. musculus
ttttgtttttgcaaat

SEQ ID NO: 462167 - DNA, 16 bp, M. musculus
ttttgttttttcaaaa

SEQ ID NO: 462168 - DNA, 24 bp, M. musculus
ttttgttttttcgagacagggttt

SEQ ID NO: 462169 - DNA, 16 bp, M. musculus
ttttgttttttgaaac

SEQ ID NO: 462170 - DNA, 16 bp, M. musculus
tttttaaaaaaaggtt

SEQ ID NO: 462171 - DNA, 16 bp, M. musculus
tttttaaaaaaatctg

SEQ ID NO: 462172 - DNA, 16 bp, M. musculus
tttttaaaaaaatgag

SEQ ID NO: 462173 - DNA, 16 bp, M. musculus
tttttaaaaaacagat

SEQ ID NO: 462174 - DNA, 16 bp, M. musculus
tttttaaaaaaccatt

SEQ ID NO: 462175 - DNA, 16 bp, M. musculus
tttttaaaaaagacaa

SEQ ID NO: 462176 - DNA, 16 bp, M. musculus
tttttaaaaaagactt

SEQ ID NO: 462177 - DNA, 16 bp, M. musculus
tttttaaaaaagccag

SEQ ID NO: 462178 - DNA, 16 bp, M. musculus
tttttaaaaaaggact

SEQ ID NO: 462179 - DNA, 16 bp, M. musculus
tttttaaaaaatcact

SEQ ID NO: 462180 - DNA, 16 bp, M. musculus
tttttaaaaaatctga

SEQ ID NO: 462181 - DNA, 16 bp, M. musculus
tttttaaaaaatgact

SEQ ID NO: 462182 - DNA, 16 bp, M. musculus
tttttaaaaaatgccc

SEQ ID NO: 462183 - DNA, 16 bp, M. musculus
tttttaaaaaatgtct

SEQ ID NO: 462184 - DNA, 16 bp, M. musculus
tttttaaaaaatgttg

SEQ ID NO: 462185 - DNA, 16 bp, M. musculus
tttttaaaaaattctc

SEQ ID NO: 462186 - DNA, 16 bp, M. musculus
tttttaaaaacaatgt

SEQ ID NO: 462187 - DNA, 16 bp, M. musculus
tttttaaaaacacttt

SEQ ID NO: 462188 - DNA, 16 bp, M. musculus
tttttaaaaacagttt

SEQ ID NO: 462189 - DNA, 16 bp, M. musculus
tttttaaaaacatgtt

SEQ ID NO: 462190 - DNA, 16 bp, M. musculus
tttttaaaaactgtga

SEQ ID NO: 462191 - DNA, 16 bp, M. musculus
tttttaaaaactgtta

SEQ ID NO: 462192 - DNA, 16 bp, M. musculus
tttttaaaaagaaagc

SEQ ID NO: 462193 - DNA, 16 bp, M. musculus
tttttaaaaagacaaa

SEQ ID NO: 462194 - DNA, 16 bp, M. musculus
tttttaaaaagatgct

SEQ ID NO: 462195 - DNA, 16 bp, M. musculus
tttttaaaaagatgta

SEQ ID NO: 462196 - DNA, 17 bp, M. musculus
tttttaaaaagcaaatt

SEQ ID NO: 462197 - DNA, 16 bp, M. musculus
tttttaaaaagcaaga

SEQ ID NO: 462198 - DNA, 16 bp, M. musculus
tttttaaaaagcatta

SEQ ID NO: 462199 - DNA, 16 bp, M. musculus
tttttaaaaagcattt

SEQ ID NO: 462200 - DNA, 16 bp, M. musculus
tttttaaaaagccttt

SEQ ID NO: 462201 - DNA, 16 bp, M. musculus
tttttaaaaagctgga

SEQ ID NO: 462202 - DNA, 16 bp, M. musculus
tttttaaaaagctttt

SEQ ID NO: 462203 - DNA, 16 bp, M. musculus
tttttaaaaaggaaat

SEQ ID NO: 462204 - DNA, 16 bp, M. musculus
tttttaaaaaggaact

SEQ ID NO: 462205 - DNA, 16 bp, M. musculus
tttttaaaaaggaagc

SEQ ID NO: 462206 - DNA, 16 bp, M. musculus
tttttaaaaaggaatt

SEQ ID NO: 462207 - DNA, 16 bp, M. musculus
tttttaaaaaggagtt

SEQ ID NO: 462208 - DNA, 16 bp, M. musculus
tttttaaaaagtaaca

SEQ ID NO: 462209 - DNA, 16 bp, M. musculus
tttttaaaaagtatct

SEQ ID NO: 462210 - DNA, 16 bp, M. musculus
tttttaaaaagtcagt

SEQ ID NO: 462211 - DNA, 16 bp, M. musculus
tttttaaaaagtcata

SEQ ID NO: 462212 - DNA, 16 bp, M. musculus
tttttaaaaagtgaaa

SEQ ID NO: 462213 - DNA, 16 bp, M. musculus
tttttaaaaagtgata

SEQ ID NO: 462214 - DNA, 16 bp, M. musculus
tttttaaaaagtgtgt

SEQ ID NO: 462215 - DNA, 16 bp, M. musculus
tttttaaaaatacaca

SEQ ID NO: 462216 - DNA, 16 bp, M. musculus
tttttaaaaatacagt

SEQ ID NO: 462217 - DNA, 16 bp, M. musculus
tttttaaaaatactgt

SEQ ID NO: 462218 - DNA, 16 bp, M. musculus
tttttaaaaataggat

SEQ ID NO: 462219 - DNA, 16 bp, M. musculus
tttttaaaaatcagaa

SEQ ID NO: 462220 - DNA, 16 bp, M. musculus
tttttaaaaatcagct

SEQ ID NO: 462221 - DNA, 16 bp, M. musculus
tttttaaaaatcagta

SEQ ID NO: 462222 - DNA, 16 bp, M. musculus
tttttaaaaatcatca

SEQ ID NO: 462223 - DNA, 16 bp, M. musculus
tttttaaaaatctgaa

SEQ ID NO: 462224 - DNA, 16 bp, M. musculus
tttttaaaaatctgtt

SEQ ID NO: 462225 - DNA, 16 bp, M. musculus
tttttaaaaatgaaga

SEQ ID NO: 462226 - DNA, 16 bp, M. musculus
tttttaaaaattccat

SEQ ID NO: 462227 - DNA, 16 bp, M. musculus
tttttaaaaattggaa

SEQ ID NO: 462228 - DNA, 16 bp, M. musculus
tttttaaaaatttcca

SEQ ID NO: 462229 - DNA, 16 bp, M. musculus
tttttaaaacaagaaa

SEQ ID NO: 462230 - DNA, 16 bp, M. musculus
tttttaaaacaggaaa

SEQ ID NO: 462231 - DNA, 16 bp, M. musculus
tttttaaaacagtttt

SEQ ID NO: 462232 - DNA, 16 bp, M. musculus
tttttaaaacccattt

SEQ ID NO: 462233 - DNA, 16 bp, M. musculus
tttttaaaactgaaaa

SEQ ID NO: 462234 - DNA, 16 bp, M. musculus
tttttaaaacttgaaa

SEQ ID NO: 462235 - DNA, 16 bp, M. musculus
tttttaaaactttaag

SEQ ID NO: 462236 - DNA, 16 bp, M. musculus
tttttaaaagaaaaac

SEQ ID NO: 462237 - DNA, 16 bp, M. musculus
tttttaaaagaagata

SEQ ID NO: 462238 - DNA, 16 bp, M. musculus
tttttaaaagaagcat

SEQ ID NO: 462239 - DNA, 16 bp, M. musculus
tttttaaaagaagttt

SEQ ID NO: 462240 - DNA, 16 bp, M. musculus
tttttaaaagacaaaa

SEQ ID NO: 462241 - DNA, 16 bp, M. musculus
tttttaaaagacttaa

SEQ ID NO: 462242 - DNA, 16 bp, M. musculus
tttttaaaagagaatt

SEQ ID NO: 462243 - DNA, 16 bp, M. musculus
tttttaaaagagatgg

SEQ ID NO: 462244 - DNA, 16 bp, M. musculus
tttttaaaagatacat

SEQ ID NO: 462245 - DNA, 16 bp, M. musculus
tttttaaaagatgaaa

SEQ ID NO: 462246 - DNA, 16 bp, M. musculus
tttttaaaagatgaat

SEQ ID NO: 462247 - DNA, 16 bp, M. musculus
tttttaaaagcatttt

SEQ ID NO: 462248 - DNA, 16 bp, M. musculus
tttttaaaaggaatta

SEQ ID NO: 462249 - DNA, 16 bp, M. musculus
tttttaaaaggataat

SEQ ID NO: 462250 - DNA, 16 bp, M. musculus
tttttaaaaggcaaaa

SEQ ID NO: 462251 - DNA, 16 bp, M. musculus
tttttaaaagtagtat

SEQ ID NO: 462252 - DNA, 16 bp, M. musculus
tttttaaaagtgaaat

SEQ ID NO: 462253 - DNA, 16 bp, M. musculus
tttttaaaagttcttt

SEQ ID NO: 462254 - DNA, 16 bp, M. musculus
tttttaaaatactgtt

SEQ ID NO: 462255 - DNA, 16 bp, M. musculus
tttttaaaatagaaga

SEQ ID NO: 462256 - DNA, 16 bp, M. musculus
tttttaaaatagactt

SEQ ID NO: 462257 - DNA, 16 bp, M. musculus
tttttaaaatagagaa

SEQ ID NO: 462258 - DNA, 16 bp, M. musculus
tttttaaaataggaaa

SEQ ID NO: 462259 - DNA, 16 bp, M. musculus
tttttaaaatcaaaca

SEQ ID NO: 462260 - DNA, 16 bp, M. musculus
tttttaaaatcaagaa

SEQ ID NO: 462261 - DNA, 16 bp, M. musculus
tttttaaaatcacaga

SEQ ID NO: 462262 - DNA, 16 bp, M. musculus
tttttaaaatcagaat

SEQ ID NO: 462263 - DNA, 16 bp, M. musculus
tttttaaaatgaagaa

SEQ ID NO: 462264 - DNA, 16 bp, M. musculus
tttttaaaatggaaaa

SEQ ID NO: 462265 - DNA, 16 bp, M. musculus
tttttaaaatgtagga

SEQ ID NO: 462266 - DNA, 16 bp, M. musculus
tttttaaaatgtgggt

SEQ ID NO: 462267 - DNA, 16 bp, M. musculus
tttttaaaattactgt

SEQ ID NO: 462268 - DNA, 16 bp, M. musculus
tttttaaaattaggat

SEQ ID NO: 462269 - DNA, 16 bp, M. musculus
tttttaaaattcagtt

SEQ ID NO: 462270 - DNA, 16 bp, M. musculus
tttttaaacaagaatt

SEQ ID NO: 462271 - DNA, 16 bp, M. musculus
tttttaaacagttttt

SEQ ID NO: 462272 - DNA, 16 bp, M. musculus
tttttaaacattttgt

SEQ ID NO: 462273 - DNA, 16 bp, M. musculus
tttttaaaccaaggat

SEQ ID NO: 462274 - DNA, 16 bp, M. musculus
tttttaaaccttaaaa

SEQ ID NO: 462275 - DNA, 16 bp, M. musculus
tttttaaactttcaaa

SEQ ID NO: 462276 - DNA, 16 bp, M. musculus
tttttaaactttgctt

SEQ ID NO: 462277 - DNA, 16 bp, M. musculus
tttttaaactttgtaa

SEQ ID NO: 462278 - DNA, 16 bp, M. musculus
tttttaaagaaaatca

SEQ ID NO: 462279 - DNA, 16 bp, M. musculus
tttttaaagaaatatg

SEQ ID NO: 462280 - DNA, 16 bp, M. musculus
tttttaaagaaatgaa

SEQ ID NO: 462281 - DNA, 16 bp, M. musculus
tttttaaagaaatgtt

SEQ ID NO: 462282 - DNA, 16 bp, M. musculus
tttttaaagaagagtt

SEQ ID NO: 462283 - DNA, 16 bp, M. musculus
tttttaaagaagcaaa

SEQ ID NO: 462284 - DNA, 16 bp, M. musculus
tttttaaagaaggaag

SEQ ID NO: 462285 - DNA, 16 bp, M. musculus
tttttaaagaataaac

SEQ ID NO: 462286 - DNA, 16 bp, M. musculus
tttttaaagacaatgt

SEQ ID NO: 462287 - DNA, 16 bp, M. musculus
tttttaaagactatga

SEQ ID NO: 462288 - DNA, 16 bp, M. musculus
tttttaaagatagaaa

SEQ ID NO: 462289 - DNA, 16 bp, M. musculus
tttttaaagatagaat

SEQ ID NO: 462290 - DNA, 16 bp, M. musculus
tttttaaagatgaaaa

SEQ ID NO: 462291 - DNA, 16 bp, M. musculus
tttttaaagatgaaat

SEQ ID NO: 462292 - DNA, 16 bp, M. musculus
tttttaaagatgtgtg

SEQ ID NO: 462293 - DNA, 16 bp, M. musculus
tttttaaagattgctt

SEQ ID NO: 462294 - DNA, 16 bp, M. musculus
tttttaaagcattttt

SEQ ID NO: 462295 - DNA, 16 bp, M. musculus
tttttaaagcttcatt

SEQ ID NO: 462296 - DNA, 16 bp, M. musculus
tttttaaagctttaat

SEQ ID NO: 462297 - DNA, 16 bp, M. musculus
tttttaaaggaaaaat

SEQ ID NO: 462298 - DNA, 16 bp, M. musculus
tttttaaaggaaaatt

SEQ ID NO: 462299 - DNA, 16 bp, M. musculus
tttttaaaggaaggaa

SEQ ID NO: 462300 - DNA, 16 bp, M. musculus
tttttaaaggcaaaaa

SEQ ID NO: 462301 - DNA, 16 bp, M. musculus
tttttaaaggggaaaa

SEQ ID NO: 462302 - DNA, 16 bp, M. musculus
tttttaaaggggggaa

SEQ ID NO: 462303 - DNA, 16 bp, M. musculus
tttttaaagtatgttc

SEQ ID NO: 462304 - DNA, 16 bp, M. musculus
tttttaaagtcaaaat

SEQ ID NO: 462305 - DNA, 16 bp, M. musculus
tttttaaagtcttctt

SEQ ID NO: 462306 - DNA, 16 bp, M. musculus
tttttaaagtgttaaa

SEQ ID NO: 462307 - DNA, 16 bp, M. musculus
tttttaaagtgttgaa

SEQ ID NO: 462308 - DNA, 16 bp, M. musculus
tttttaaagttgaaaa

SEQ ID NO: 462309 - DNA, 16 bp, M. musculus
tttttaaagtttcatt

SEQ ID NO: 462310 - DNA, 16 bp, M. musculus
tttttaaataaaagac

SEQ ID NO: 462311 - DNA, 16 bp, M. musculus
tttttaaataaagaga

SEQ ID NO: 462312 - DNA, 16 bp, M. musculus
tttttaaatagcattt

SEQ ID NO: 462313 - DNA, 16 bp, M. musculus
tttttaaatatttccc

SEQ ID NO: 462314 - DNA, 16 bp, M. musculus
tttttaaatcatgtgt

SEQ ID NO: 462315 - DNA, 16 bp, M. musculus
tttttaaatccagttt

SEQ ID NO: 462316 - DNA, 16 bp, M. musculus
tttttaaatctgaaaa

SEQ ID NO: 462317 - DNA, 16 bp, M. musculus
tttttaaatctgagaa

SEQ ID NO: 462318 - DNA, 16 bp, M. musculus
tttttaaatgaatgga

SEQ ID NO: 462319 - DNA, 16 bp, M. musculus
tttttaaatgaatgta

SEQ ID NO: 462320 - DNA, 16 bp, M. musculus
tttttaaatgacagaa

SEQ ID NO: 462321 - DNA, 16 bp, M. musculus
tttttaaatgactttt

SEQ ID NO: 462322 - DNA, 16 bp, M. musculus
tttttaaatgagaaaa

SEQ ID NO: 462323 - DNA, 16 bp, M. musculus
tttttaaatgattctt

SEQ ID NO: 462324 - DNA, 16 bp, M. musculus
tttttaaatgcttgtt

SEQ ID NO: 462325 - DNA, 16 bp, M. musculus
tttttaaatggaaatt

SEQ ID NO: 462326 - DNA, 16 bp, M. musculus
tttttaaatgtacaaa

SEQ ID NO: 462327 - DNA, 16 bp, M. musculus
tttttaaatgtacatt

SEQ ID NO: 462328 - DNA, 16 bp, M. musculus
tttttaaatgtgaaaa

SEQ ID NO: 462329 - DNA, 16 bp, M. musculus
tttttaaatgtggaaa

SEQ ID NO: 462330 - DNA, 16 bp, M. musculus
tttttaaatgtgtaaa

SEQ ID NO: 462331 - DNA, 16 bp, M. musculus
tttttaaatgtgtctt

SEQ ID NO: 462332 - DNA, 16 bp, M. musculus
tttttaaatgtgtgtg

SEQ ID NO: 462333 - DNA, 16 bp, M. musculus
tttttaaatgttctga

SEQ ID NO: 462334 - DNA, 16 bp, M. musculus
tttttaaatgttctta

SEQ ID NO: 462335 - DNA, 16 bp, M. musculus
tttttaaatgtttcat

SEQ ID NO: 462336 - DNA, 16 bp, M. musculus
tttttaaattatggaa

SEQ ID NO: 462337 - DNA, 16 bp, M. musculus
tttttaaattcagaaa

SEQ ID NO: 462338 - DNA, 16 bp, M. musculus
tttttaactctaactc

SEQ ID NO: 462339 - DNA, 16 bp, M. musculus
tttttaagaaaaggaa

SEQ ID NO: 462340 - DNA, 16 bp, M. musculus
tttttaagacttattt

SEQ ID NO: 462341 - DNA, 16 bp, M. musculus
tttttaagacttttta

SEQ ID NO: 462342 - DNA, 16 bp, M. musculus
tttttaagcaaacaaa

SEQ ID NO: 462343 - DNA, 16 bp, M. musculus
tttttaagcatttatt

SEQ ID NO: 462344 - DNA, 16 bp, M. musculus
tttttaataaaaagca

SEQ ID NO: 462345 - DNA, 16 bp, M. musculus
tttttaatagctaagt

SEQ ID NO: 462346 - DNA, 16 bp, M. musculus
tttttaataggcttat

SEQ ID NO: 462347 - DNA, 16 bp, M. musculus
tttttaatatttcccg

SEQ ID NO: 462348 - DNA, 16 bp, M. musculus
tttttaatcactattg

SEQ ID NO: 462349 - DNA, 16 bp, M. musculus
tttttaatccagaaat

SEQ ID NO: 462350 - DNA, 16 bp, M. musculus
tttttaatgaacattt

SEQ ID NO: 462351 - DNA, 16 bp, M. musculus
tttttaatgaaggaaa

SEQ ID NO: 462352 - DNA, 16 bp, M. musculus
tttttaatgaatgaaa

SEQ ID NO: 462353 - DNA, 16 bp, M. musculus
tttttaatgcaaaata

SEQ ID NO: 462354 - DNA, 16 bp, M. musculus
tttttaatggaaacaa

SEQ ID NO: 462355 - DNA, 16 bp, M. musculus
tttttaatgtttcaaa

SEQ ID NO: 462356 - DNA, 16 bp, M. musculus
tttttaattagaaaag

SEQ ID NO: 462357 - DNA, 16 bp, M. musculus
tttttaattcaagaaa

SEQ ID NO: 462358 - DNA, 16 bp, M. musculus
tttttaattcactgaa

SEQ ID NO: 462359 - DNA, 16 bp, M. musculus
tttttaattgctaatt

SEQ ID NO: 462360 - DNA, 16 bp, M. musculus
tttttaattgggaaaa

SEQ ID NO: 462361 - DNA, 16 bp, M. musculus
tttttaatttaggaaa

SEQ ID NO: 462362 - DNA, 16 bp, M. musculus
tttttaatttcatgag

SEQ ID NO: 462363 - DNA, 16 bp, M. musculus
tttttaattttgcaaa

SEQ ID NO: 462364 - DNA, 16 bp, M. musculus
tttttaatttttgcaa

SEQ ID NO: 462365 - DNA, 16 bp, M. musculus
tttttacaaaaagaaa

SEQ ID NO: 462366 - DNA, 16 bp, M. musculus
tttttacaaaagaaaa

SEQ ID NO: 462367 - DNA, 16 bp, M. musculus
tttttacaattaaaac

SEQ ID NO: 462368 - DNA, 16 bp, M. musculus
tttttacagaagaaaa

SEQ ID NO: 462369 - DNA, 16 bp, M. musculus
tttttacagatggttc

SEQ ID NO: 462370 - DNA, 16 bp, M. musculus
tttttacaggcttata

SEQ ID NO: 462371 - DNA, 16 bp, M. musculus
tttttacatacacaca

SEQ ID NO: 462372 - DNA, 16 bp, M. musculus
tttttacatggccttg

SEQ ID NO: 462373 - DNA, 16 bp, M. musculus
tttttacattttgaat

SEQ ID NO: 462374 - DNA, 16 bp, M. musculus
tttttactatgtcaat

SEQ ID NO: 462375 - DNA, 16 bp, M. musculus
tttttacttcacatca

SEQ ID NO: 462376 - DNA, 16 bp, M. musculus
tttttacttttgagat

SEQ ID NO: 462377 - DNA, 16 bp, M. musculus
tttttagaaaaatgaa

SEQ ID NO: 462378 - DNA, 16 bp, M. musculus
tttttagaaaagattt

SEQ ID NO: 462379 - DNA, 16 bp, M. musculus
tttttagacaggatct

SEQ ID NO: 462380 - DNA, 16 bp, M. musculus
tttttagaccagtagt

SEQ ID NO: 462381 - DNA, 16 bp, M. musculus
tttttagatcctggat

SEQ ID NO: 462382 - DNA, 16 bp, M. musculus
tttttagatcctgtat

SEQ ID NO: 462383 - DNA, 16 bp, M. musculus
tttttagcctgtttat

SEQ ID NO: 462384 - DNA, 16 bp, M. musculus
tttttagcttttaaaa

SEQ ID NO: 462385 - DNA, 16 bp, M. musculus
tttttaggtttgggaa

SEQ ID NO: 462386 - DNA, 16 bp, M. musculus
tttttagttccatcta

SEQ ID NO: 462387 - DNA, 16 bp, M. musculus
tttttagttgcttctc

SEQ ID NO: 462388 - DNA, 16 bp, M. musculus
tttttagtttcaagcc

SEQ ID NO: 462389 - DNA, 16 bp, M. musculus
tttttataaaaacaca

SEQ ID NO: 462390 - DNA, 16 bp, M. musculus
tttttataaaacagaa

SEQ ID NO: 462391 - DNA, 16 bp, M. musculus
tttttataaagagaaa

SEQ ID NO: 462392 - DNA, 16 bp, M. musculus
tttttataatggccag

SEQ ID NO: 462393 - DNA, 16 bp, M. musculus
tttttatacaatgtat

SEQ ID NO: 462394 - DNA, 16 bp, M. musculus
tttttatacagaagaa

SEQ ID NO: 462395 - DNA, 16 bp, M. musculus
tttttatagcagcctt

SEQ ID NO: 462396 - DNA, 16 bp, M. musculus
tttttatatatgcatt

SEQ ID NO: 462397 - DNA, 16 bp, M. musculus
tttttatatatgtgag

SEQ ID NO: 462398 - DNA, 16 bp, M. musculus
tttttatatatttgca

SEQ ID NO: 462399 - DNA, 16 bp, M. musculus
tttttatatgagaaaa

SEQ ID NO: 462400 - DNA, 16 bp, M. musculus
tttttatatgcatata

SEQ ID NO: 462401 - DNA, 17 bp, M. musculus
tttttatcacaattgct

SEQ ID NO: 462402 - DNA, 16 bp, M. musculus
tttttatcagaaataa

SEQ ID NO: 462403 - DNA, 16 bp, M. musculus
tttttatctgtaaaat

SEQ ID NO: 462404 - DNA, 16 bp, M. musculus
tttttatcttgaaatt

SEQ ID NO: 462405 - DNA, 16 bp, M. musculus
tttttatgaaaagaaa

SEQ ID NO: 462406 - DNA, 16 bp, M. musculus
tttttatgaagaaaaa

SEQ ID NO: 462407 - DNA, 16 bp, M. musculus
tttttatgaaggcact

SEQ ID NO: 462408 - DNA, 16 bp, M. musculus
tttttatgcatatgag

SEQ ID NO: 462409 - DNA, 16 bp, M. musculus
tttttatgtatatgag

SEQ ID NO: 462410 - DNA, 16 bp, M. musculus
tttttatgtgaaactt

SEQ ID NO: 462411 - DNA, 16 bp, M. musculus
tttttatgtgggtgct

SEQ ID NO: 462412 - DNA, 16 bp, M. musculus
tttttattcaaaccac

SEQ ID NO: 462413 - DNA, 16 bp, M. musculus
tttttattcctggtac

SEQ ID NO: 462414 - DNA, 16 bp, M. musculus
tttttattggagaatt

SEQ ID NO: 462415 - DNA, 16 bp, M. musculus
tttttatttaaagctt

SEQ ID NO: 462416 - DNA, 16 bp, M. musculus
tttttatttcaaatgt

SEQ ID NO: 462417 - DNA, 16 bp, M. musculus
tttttatttggaaaaa

SEQ ID NO: 462418 - DNA, 16 bp, M. musculus
tttttattttcagaat

SEQ ID NO: 462419 - DNA, 16 bp, M. musculus
tttttattttcataga

SEQ ID NO: 462420 - DNA, 16 bp, M. musculus
tttttattttcctgaa

SEQ ID NO: 462421 - DNA, 16 bp, M. musculus
tttttattttctgaaa

SEQ ID NO: 462422 - DNA, 16 bp, M. musculus
tttttcaaaacaaggt

SEQ ID NO: 462423 - DNA, 16 bp, M. musculus
tttttcaaaagaaaat

SEQ ID NO: 462424 - DNA, 16 bp, M. musculus
tttttcaaaaggaaaa

SEQ ID NO: 462425 - DNA, 16 bp, M. musculus
tttttcaaaagtattt

SEQ ID NO: 462426 - DNA, 16 bp, M. musculus
tttttcaaaataaaac

SEQ ID NO: 462427 - DNA, 16 bp, M. musculus
tttttcaaaatagaaa

SEQ ID NO: 462428 - DNA, 16 bp, M. musculus
tttttcaaaatgaaaa

SEQ ID NO: 462429 - DNA, 16 bp, M. musculus
tttttcaaaattgtat

SEQ ID NO: 462430 - DNA, 16 bp, M. musculus
tttttcaaagaaaaaa

SEQ ID NO: 462431 - DNA, 16 bp, M. musculus
tttttcaaataagaaa

SEQ ID NO: 462432 - DNA, 16 bp, M. musculus
tttttcaaatcctatt

SEQ ID NO: 462433 - DNA, 16 bp, M. musculus
tttttcaaatgtgtgt

SEQ ID NO: 462434 - DNA, 16 bp, M. musculus
tttttcaaattcactt

SEQ ID NO: 462435 - DNA, 16 bp, M. musculus
tttttcaagacagagt

SEQ ID NO: 462436 - DNA, 16 bp, M. musculus
tttttcaagacagatt

SEQ ID NO: 462437 - DNA, 16 bp, M. musculus
tttttcaagacagggc

SEQ ID NO: 462438 - DNA, 16 bp, M. musculus
tttttcaataaatgaa

SEQ ID NO: 462439 - DNA, 16 bp, M. musculus
tttttcacacacacac

SEQ ID NO: 462440 - DNA, 16 bp, M. musculus
tttttcactggatgat

SEQ ID NO: 462441 - DNA, 16 bp, M. musculus
tttttcagaaaaaaaa

SEQ ID NO: 462442 - DNA, 16 bp, M. musculus
tttttcagaaatattt

SEQ ID NO: 462443 - DNA, 16 bp, M. musculus
tttttcagaagtaaaa

SEQ ID NO: 462444 - DNA, 16 bp, M. musculus
tttttcagatataaaa

SEQ ID NO: 462445 - DNA, 16 bp, M. musculus
tttttcagcctttcac

SEQ ID NO: 462446 - DNA, 16 bp, M. musculus
tttttcaggaggaagg

SEQ ID NO: 462447 - DNA, 16 bp, M. musculus
tttttcagtaaataac

SEQ ID NO: 462448 - DNA, 16 bp, M. musculus
tttttcagtgtcttaa

SEQ ID NO: 462449 - DNA, 16 bp, M. musculus
tttttcagttctggga

SEQ ID NO: 462450 - DNA, 16 bp, M. musculus
tttttcagtttccaca

SEQ ID NO: 462451 - DNA, 16 bp, M. musculus
tttttcatagtaattc

SEQ ID NO: 462452 - DNA, 16 bp, M. musculus
tttttcatattggtat

SEQ ID NO: 462453 - DNA, 16 bp, M. musculus
tttttcatgatgatga

SEQ ID NO: 462454 - DNA, 16 bp, M. musculus
tttttcattgagtttg

SEQ ID NO: 462455 - DNA, 16 bp, M. musculus
tttttcattggtcctt

SEQ ID NO: 462456 - DNA, 16 bp, M. musculus
tttttcatttaagaaa

SEQ ID NO: 462457 - DNA, 16 bp, M. musculus
tttttcatttccagtt

SEQ ID NO: 462458 - DNA, 16 bp, M. musculus
tttttcatttcctgaa

SEQ ID NO: 462459 - DNA, 16 bp, M. musculus
tttttcattttagaaa

SEQ ID NO: 462460 - DNA, 16 bp, M. musculus
tttttccaaaaataaa

SEQ ID NO: 462461 - DNA, 16 bp, M. musculus
tttttccaatcctaaa

SEQ ID NO: 462462 - DNA, 16 bp, M. musculus
tttttccaatgtgatt

SEQ ID NO: 462463 - DNA, 16 bp, M. musculus
tttttccagacagtgt

SEQ ID NO: 462464 - DNA, 16 bp, M. musculus
tttttccagataaatt

SEQ ID NO: 462465 - DNA, 16 bp, M. musculus
tttttccagcaccatt

SEQ ID NO: 462466 - DNA, 16 bp, M. musculus
tttttccatgtgaaat

SEQ ID NO: 462467 - DNA, 16 bp, M. musculus
tttttccattgtatgc

SEQ ID NO: 462468 - DNA, 16 bp, M. musculus
tttttccattgtgtat

SEQ ID NO: 462469 - DNA, 16 bp, M. musculus
tttttccattttctga

SEQ ID NO: 462470 - DNA, 16 bp, M. musculus
tttttccccactggat

SEQ ID NO: 462471 - DNA, 16 bp, M. musculus
tttttcccccccttgg

SEQ ID NO: 462472 - DNA, 16 bp, M. musculus
tttttcccccctgtgg

SEQ ID NO: 462473 - DNA, 16 bp, M. musculus
tttttccccctctgtg

SEQ ID NO: 462474 - DNA, 16 bp, M. musculus
tttttccccctttgag

SEQ ID NO: 462475 - DNA, 16 bp, M. musculus
tttttcccctgagaca

SEQ ID NO: 462476 - DNA, 16 bp, M. musculus
tttttccctgatatgg

SEQ ID NO: 462477 - DNA, 16 bp, M. musculus
tttttcctctgtgccc

SEQ ID NO: 462478 - DNA, 16 bp, M. musculus
tttttcctctttggaa

SEQ ID NO: 462479 - DNA, 16 bp, M. musculus
tttttcctgaaaaaaa

SEQ ID NO: 462480 - DNA, 16 bp, M. musculus
tttttcctgcaattct

SEQ ID NO: 462481 - DNA, 16 bp, M. musculus
tttttcctgcatgttt

SEQ ID NO: 462482 - DNA, 16 bp, M. musculus
tttttcctggggaaag

SEQ ID NO: 462483 - DNA, 16 bp, M. musculus
tttttccttcaaaaaa

SEQ ID NO: 462484 - DNA, 16 bp, M. musculus
tttttccttcagtgct

SEQ ID NO: 462485 - DNA, 16 bp, M. musculus
tttttccttcttagat

SEQ ID NO: 462486 - DNA, 16 bp, M. musculus
tttttccttgaacaca

SEQ ID NO: 462487 - DNA, 16 bp, M. musculus
tttttcctttaaaagt

SEQ ID NO: 462488 - DNA, 16 bp, M. musculus
tttttcctttagaaaa

SEQ ID NO: 462489 - DNA, 16 bp, M. musculus
tttttcctttctaagc

SEQ ID NO: 462490 - DNA, 16 bp, M. musculus
tttttcctttgcagct

SEQ ID NO: 462491 - DNA, 16 bp, M. musculus
tttttccttttgagat

SEQ ID NO: 462492 - DNA, 16 bp, M. musculus
tttttccttttggaat

SEQ ID NO: 462493 - DNA, 16 bp, M. musculus
tttttcctttttgaaa

SEQ ID NO: 462494 - DNA, 16 bp, M. musculus
tttttctaaaaaagaa

SEQ ID NO: 462495 - DNA, 16 bp, M. musculus
tttttctaaaaagaaa

SEQ ID NO: 462496 - DNA, 16 bp, M. musculus
tttttctaactctgtg

SEQ ID NO: 462497 - DNA, 16 bp, M. musculus
tttttctagaaaaaaa

SEQ ID NO: 462498 - DNA, 16 bp, M. musculus
tttttctagacaaggt

SEQ ID NO: 462499 - DNA, 16 bp, M. musculus
tttttctagacctttt

SEQ ID NO: 462500 - DNA, 16 bp, M. musculus
tttttctaggtgcttc

SEQ ID NO: 462501 - DNA, 16 bp, M. musculus
tttttctagttccatt

SEQ ID NO: 462502 - DNA, 18 bp, M. musculus
tttttctataaggacttg

SEQ ID NO: 462503 - DNA, 16 bp, M. musculus
tttttctatgtagccc

SEQ ID NO: 462504 - DNA, 16 bp, M. musculus
tttttctattgaaaat

SEQ ID NO: 462505 - DNA, 16 bp, M. musculus
tttttctattgctgtg

SEQ ID NO: 462506 - DNA, 16 bp, M. musculus
tttttctattttgaga

SEQ ID NO: 462507 - DNA, 16 bp, M. musculus
tttttctcaaataaaa

SEQ ID NO: 462508 - DNA, 16 bp, M. musculus
tttttctcatttgtaa

SEQ ID NO: 462509 - DNA, 16 bp, M. musculus
tttttctcccattctg

SEQ ID NO: 462510 - DNA, 16 bp, M. musculus
tttttctccttttgga

SEQ ID NO: 462511 - DNA, 16 bp, M. musculus
tttttctctcttaaaa

SEQ ID NO: 462512 - DNA, 16 bp, M. musculus
tttttctctgaaaaat

SEQ ID NO: 462513 - DNA, 16 bp, M. musculus
tttttctctgttaaaa

SEQ ID NO: 462514 - DNA, 16 bp, M. musculus
tttttctcttaaagaa

SEQ ID NO: 462515 - DNA, 16 bp, M. musculus
tttttctcttcaaaga

SEQ ID NO: 462516 - DNA, 16 bp, M. musculus
tttttctcttctaaaa

SEQ ID NO: 462517 - DNA, 16 bp, M. musculus
tttttctgaagaaaaa

SEQ ID NO: 462518 - DNA, 16 bp, M. musculus
tttttctgaatataaa

SEQ ID NO: 462519 - DNA, 16 bp, M. musculus
tttttctgcttttcac

SEQ ID NO: 462520 - DNA, 16 bp, M. musculus
tttttctggaatattt

SEQ ID NO: 462521 - DNA, 16 bp, M. musculus
tttttctggtgtgatg

SEQ ID NO: 462522 - DNA, 16 bp, M. musculus
tttttctgtagaccag

SEQ ID NO: 462523 - DNA, 16 bp, M. musculus
tttttctgtatgtgtg

SEQ ID NO: 462524 - DNA, 16 bp, M. musculus
tttttcttaaaagatt

SEQ ID NO: 462525 - DNA, 16 bp, M. musculus
tttttcttaaagacaa

SEQ ID NO: 462526 - DNA, 16 bp, M. musculus
tttttcttaatgaaaa

SEQ ID NO: 462527 - DNA, 16 bp, M. musculus
tttttcttactagttg

SEQ ID NO: 462528 - DNA, 16 bp, M. musculus
tttttcttacttcaaa

SEQ ID NO: 462529 - DNA, 16 bp, M. musculus
tttttcttataaagga

SEQ ID NO: 462530 - DNA, 16 bp, M. musculus
tttttcttcaataaaa

SEQ ID NO: 462531 - DNA, 16 bp, M. musculus
tttttcttcagtaaat

SEQ ID NO: 462532 - DNA, 16 bp, M. musculus
tttttcttcccaaatt

SEQ ID NO: 462533 - DNA, 16 bp, M. musculus
tttttcttcctgtgac

SEQ ID NO: 462534 - DNA, 16 bp, M. musculus
tttttcttcttcagag

SEQ ID NO: 462535 - DNA, 16 bp, M. musculus
tttttcttgttaaagt

SEQ ID NO: 462536 - DNA, 16 bp, M. musculus
tttttctttaaaacag

SEQ ID NO: 462537 - DNA, 16 bp, M. musculus
tttttctttaacaaaa

SEQ ID NO: 462538 - DNA, 16 bp, M. musculus
tttttctttacaaaaa

SEQ ID NO: 462539 - DNA, 16 bp, M. musculus
tttttctttcagaatt

SEQ ID NO: 462540 - DNA, 16 bp, M. musculus
tttttctttcagagga

SEQ ID NO: 462541 - DNA, 16 bp, M. musculus
tttttctttccaaatg

SEQ ID NO: 462542 - DNA, 16 bp, M. musculus
tttttctttccatgat

SEQ ID NO: 462543 - DNA, 16 bp, M. musculus
tttttctttcttaaag

SEQ ID NO: 462544 - DNA, 16 bp, M. musculus
tttttctttgaaataa

SEQ ID NO: 462545 - DNA, 16 bp, M. musculus
tttttcttttgagaca

SEQ ID NO: 462546 - DNA, 16 bp, M. musculus
tttttcttttggctaa

SEQ ID NO: 462547 - DNA, 16 bp, M. musculus
tttttcttttgtaaaa

SEQ ID NO: 462548 - DNA, 16 bp, M. musculus
tttttctttttaaaga

SEQ ID NO: 462549 - DNA, 16 bp, M. musculus
tttttctttttggaaa

SEQ ID NO: 462550 - DNA, 16 bp, M. musculus
tttttctttttggaga

SEQ ID NO: 462551 - DNA, 16 bp, M. musculus
tttttgaaaaagaaag

SEQ ID NO: 462552 - DNA, 16 bp, M. musculus
tttttgaaaaaggaaa

SEQ ID NO: 462553 - DNA, 16 bp, M. musculus
tttttgaaacagtttt

SEQ ID NO: 462554 - DNA, 16 bp, M. musculus
tttttgaaacctcaaa

SEQ ID NO: 462555 - DNA, 16 bp, M. musculus
tttttgaaacttcctt

SEQ ID NO: 462556 - DNA, 16 bp, M. musculus
tttttgaaagaataaa

SEQ ID NO: 462557 - DNA, 16 bp, M. musculus
tttttgaaaggatttt

SEQ ID NO: 462558 - DNA, 16 bp, M. musculus
tttttgaaatagggtt

SEQ ID NO: 462559 - DNA, 16 bp, M. musculus
tttttgaacttgtcag

SEQ ID NO: 462560 - DNA, 16 bp, M. musculus
tttttgaagaaaattt

SEQ ID NO: 462561 - DNA, 16 bp, M. musculus
tttttgaagaagaaaa

SEQ ID NO: 462562 - DNA, 16 bp, M. musculus
tttttgaagaagaaga

SEQ ID NO: 462563 - DNA, 16 bp, M. musculus
tttttgaagatgcttt

SEQ ID NO: 462564 - DNA, 16 bp, M. musculus
tttttgacaaaataaa

SEQ ID NO: 462565 - DNA, 16 bp, M. musculus
tttttgacaaagaagc

SEQ ID NO: 462566 - DNA, 16 bp, M. musculus
tttttgagaatttcat

SEQ ID NO: 462567 - DNA, 16 bp, M. musculus
tttttgagaatttgat

SEQ ID NO: 462568 - DNA, 16 bp, M. musculus
tttttgagacaaagtc

SEQ ID NO: 462569 - DNA, 16 bp, M. musculus
tttttgagacaggttt

SEQ ID NO: 462570 - DNA, 16 bp, M. musculus
tttttgagacagtatt

SEQ ID NO: 462571 - DNA, 16 bp, M. musculus
tttttgagacagtctc

SEQ ID NO: 462572 - DNA, 16 bp, M. musculus
tttttgagacatagtt

SEQ ID NO: 462573 - DNA, 16 bp, M. musculus
tttttgagaccgggtt

SEQ ID NO: 462574 - DNA, 16 bp, M. musculus
tttttgagagtttcaa

SEQ ID NO: 462575 - DNA, 16 bp, M. musculus
tttttgagataggttt

SEQ ID NO: 462576 - DNA, 16 bp, M. musculus
tttttgaggctattgt

SEQ ID NO: 462577 - DNA, 16 bp, M. musculus
tttttgaggttataat

SEQ ID NO: 462578 - DNA, 16 bp, M. musculus
tttttgagtcatttct

SEQ ID NO: 462579 - DNA, 16 bp, M. musculus
tttttgagttctgtga

SEQ ID NO: 462580 - DNA, 16 bp, M. musculus
tttttgagttctgtgg

SEQ ID NO: 462581 - DNA, 16 bp, M. musculus
tttttgataaagaaac

SEQ ID NO: 462582 - DNA, 16 bp, M. musculus
tttttgatagctgagt

SEQ ID NO: 462583 - DNA, 16 bp, M. musculus
tttttgatcttagaaa

SEQ ID NO: 462584 - DNA, 16 bp, M. musculus
tttttgatcttagaac

SEQ ID NO: 462585 - DNA, 16 bp, M. musculus
tttttgatcttagcct

SEQ ID NO: 462586 - DNA, 16 bp, M. musculus
tttttgcactttgtat

SEQ ID NO: 462587 - DNA, 16 bp, M. musculus
tttttgcatgtgtgtg

SEQ ID NO: 462588 - DNA, 16 bp, M. musculus
tttttgccaaaaaata

SEQ ID NO: 462589 - DNA, 16 bp, M. musculus
tttttgctcacgtaaa

SEQ ID NO: 462590 - DNA, 16 bp, M. musculus
tttttgcttccattga

SEQ ID NO: 462591 - DNA, 76 bp, M. musculus
tttttgctttgggattctgaatggcgagacgccagtaagaaaactgctgcttctaacgctcaggctggtaattcag

SEQ ID NO: 462592 - DNA, 16 bp, M. musculus
tttttggaaaaaaaat

SEQ ID NO: 462593 - DNA, 16 bp, M. musculus
tttttggaagaaaaaa

SEQ ID NO: 462594 - DNA, 16 bp, M. musculus
tttttggacagggtct

SEQ ID NO: 462595 - DNA, 16 bp, M. musculus
tttttggagacaaagt

SEQ ID NO: 462596 - DNA, 16 bp, M. musculus
tttttggcagagagaa

SEQ ID NO: 462597 - DNA, 35 bp, M. musculus
tttttggccctggcgttcccctgtactggggcata

SEQ ID NO: 462598 - DNA, 16 bp, M. musculus
tttttggctttttcaa

SEQ ID NO: 462599 - DNA, 16 bp, M. musculus
tttttggggaaaaaaa

SEQ ID NO: 462600 - DNA, 16 bp, M. musculus
tttttggtccaaacta

SEQ ID NO: 462601 - DNA, 16 bp, M. musculus
tttttggttaaaaaaa

SEQ ID NO: 462602 - DNA, 16 bp, M. musculus
tttttggtttgggaga

SEQ ID NO: 462603 - DNA, 16 bp, M. musculus
tttttgtaaacttaaa

SEQ ID NO: 462604 - DNA, 16 bp, M. musculus
tttttgtaaagaaaaa

SEQ ID NO: 462605 - DNA, 16 bp, M. musculus
tttttgtaaataaagt

SEQ ID NO: 462606 - DNA, 16 bp, M. musculus
tttttgtaatttctgg

SEQ ID NO: 462607 - DNA, 16 bp, M. musculus
tttttgtacctgttga

SEQ ID NO: 462608 - DNA, 16 bp, M. musculus
tttttgtactaattct

SEQ ID NO: 462609 - DNA, 22 bp, M. musculus
tttttgtatagttaacacacta

SEQ ID NO: 462610 - DNA, 16 bp, M. musculus
tttttgtcacagcaat

SEQ ID NO: 462611 - DNA, 46 bp, M. musculus
tttttgtctcctatgaaacagagtttgaaaggctctttaatccttg

SEQ ID NO: 462612 - DNA, 16 bp, M. musculus
tttttgtctttaaaaa

SEQ ID NO: 462613 - DNA, 16 bp, M. musculus
tttttgtctttataaa

SEQ ID NO: 462614 - DNA, 16 bp, M. musculus
tttttgtgaagagaca

SEQ ID NO: 462615 - DNA, 16 bp, M. musculus
tttttgtgacagggtc

SEQ ID NO: 462616 - DNA, 16 bp, M. musculus
tttttgtgattccaga

SEQ ID NO: 462617 - DNA, 16 bp, M. musculus
tttttgtgtagagaaa

SEQ ID NO: 462618 - DNA, 16 bp, M. musculus
tttttgtgtgcatttg

SEQ ID NO: 462619 - DNA, 16 bp, M. musculus
tttttgtgtgtgaaaa

SEQ ID NO: 462620 - DNA, 21 bp, M. musculus
tttttgttattccagatgaat

SEQ ID NO: 462621 - DNA, 16 bp, M. musculus
tttttgttattgcaga

SEQ ID NO: 462622 - DNA, 16 bp, M. musculus
tttttgttcccatgtt

SEQ ID NO: 462623 - DNA, 16 bp, M. musculus
tttttgttcctacttg

SEQ ID NO: 462624 - DNA, 16 bp, M. musculus
tttttgtttctgagac

SEQ ID NO: 462625 - DNA, 16 bp, M. musculus
tttttgttttcaaaaa

SEQ ID NO: 462626 - DNA, 16 bp, M. musculus
tttttgttttccaaaa

SEQ ID NO: 462627 - DNA, 16 bp, M. musculus
tttttgttttctaaaa

SEQ ID NO: 462628 - DNA, 16 bp, M. musculus
tttttgtttttagaca

SEQ ID NO: 462629 - DNA, 16 bp, M. musculus
ttttttaaaaaaaagg

SEQ ID NO: 462630 - DNA, 16 bp, M. musculus
ttttttaaaaaaagag

SEQ ID NO: 462631 - DNA, 16 bp, M. musculus
ttttttaaaaaaaggt

SEQ ID NO: 462632 - DNA, 16 bp, M. musculus
ttttttaaaaaaccac

SEQ ID NO: 462633 - DNA, 16 bp, M. musculus
ttttttaaaaaagcta

SEQ ID NO: 462634 - DNA, 16 bp, M. musculus
ttttttaaaaaaggtc

SEQ ID NO: 462635 - DNA, 16 bp, M. musculus
ttttttaaaaaagtca

SEQ ID NO: 462636 - DNA, 16 bp, M. musculus
ttttttaaaaaatcag

SEQ ID NO: 462637 - DNA, 16 bp, M. musculus
ttttttaaaaaatggt

SEQ ID NO: 462638 - DNA, 16 bp, M. musculus
ttttttaaaaaattgg

SEQ ID NO: 462639 - DNA, 16 bp, M. musculus
ttttttaaaaacctaa

SEQ ID NO: 462640 - DNA, 16 bp, M. musculus
ttttttaaaaagaagg

SEQ ID NO: 462641 - DNA, 16 bp, M. musculus
ttttttaaaaagagaa

SEQ ID NO: 462642 - DNA, 16 bp, M. musculus
ttttttaaaaagagct

SEQ ID NO: 462643 - DNA, 16 bp, M. musculus
ttttttaaaaagcttt

SEQ ID NO: 462644 - DNA, 16 bp, M. musculus
ttttttaaaaaggcag

SEQ ID NO: 462645 - DNA, 16 bp, M. musculus
ttttttaaaaaggtta

SEQ ID NO: 462646 - DNA, 16 bp, M. musculus
ttttttaaaaatctca

SEQ ID NO: 462647 - DNA, 16 bp, M. musculus
ttttttaaaaatctgt

SEQ ID NO: 462648 - DNA, 16 bp, M. musculus
ttttttaaaactcaaa

SEQ ID NO: 462649 - DNA, 16 bp, M. musculus
ttttttaaaagaaaga

SEQ ID NO: 462650 - DNA, 16 bp, M. musculus
ttttttaaaagaacat

SEQ ID NO: 462651 - DNA, 16 bp, M. musculus
ttttttaaaagaagaa

SEQ ID NO: 462652 - DNA, 16 bp, M. musculus
ttttttaaaagatgca

SEQ ID NO: 462653 - DNA, 16 bp, M. musculus
ttttttaaaagcaaaa

SEQ ID NO: 462654 - DNA, 16 bp, M. musculus
ttttttaaaagtcaat

SEQ ID NO: 462655 - DNA, 16 bp, M. musculus
ttttttaaaagtctct

SEQ ID NO: 462656 - DNA, 16 bp, M. musculus
ttttttaaaccctgct

SEQ ID NO: 462657 - DNA, 16 bp, M. musculus
ttttttaaactggaaa

SEQ ID NO: 462658 - DNA, 16 bp, M. musculus
ttttttaaagaaatag

SEQ ID NO: 462659 - DNA, 16 bp, M. musculus
ttttttaaagaaatca

SEQ ID NO: 462660 - DNA, 16 bp, M. musculus
ttttttaaagaaatgt

SEQ ID NO: 462661 - DNA, 16 bp, M. musculus
ttttttaaagaagaaa

SEQ ID NO: 462662 - DNA, 16 bp, M. musculus
ttttttaaagaaggga

SEQ ID NO: 462663 - DNA, 16 bp, M. musculus
ttttttaaagcaaaat

SEQ ID NO: 462664 - DNA, 16 bp, M. musculus
ttttttaaaggaagat

SEQ ID NO: 462665 - DNA, 16 bp, M. musculus
ttttttaaaggacttt

SEQ ID NO: 462666 - DNA, 16 bp, M. musculus
ttttttaaaggagaaa

SEQ ID NO: 462667 - DNA, 16 bp, M. musculus
ttttttaaaggataaa

SEQ ID NO: 462668 - DNA, 16 bp, M. musculus
ttttttaaagggaaac

SEQ ID NO: 462669 - DNA, 16 bp, M. musculus
ttttttaaagtaatga

SEQ ID NO: 462670 - DNA, 16 bp, M. musculus
ttttttaaagtagaaa

SEQ ID NO: 462671 - DNA, 16 bp, M. musculus
ttttttaaagttgctt

SEQ ID NO: 462672 - DNA, 16 bp, M. musculus
ttttttaaataaactg

SEQ ID NO: 462673 - DNA, 16 bp, M. musculus
ttttttaaataaagga

SEQ ID NO: 462674 - DNA, 16 bp, M. musculus
ttttttaaatacaaag

SEQ ID NO: 462675 - DNA, 16 bp, M. musculus
ttttttaaatcaagaa

SEQ ID NO: 462676 - DNA, 16 bp, M. musculus
ttttttaaatcaagta

SEQ ID NO: 462677 - DNA, 16 bp, M. musculus
ttttttaaatcattgt

SEQ ID NO: 462678 - DNA, 16 bp, M. musculus
ttttttaaatcctaaa

SEQ ID NO: 462679 - DNA, 16 bp, M. musculus
ttttttaaatctcact

SEQ ID NO: 462680 - DNA, 16 bp, M. musculus
ttttttaaatctttga

SEQ ID NO: 462681 - DNA, 16 bp, M. musculus
ttttttaaatgatcaa

SEQ ID NO: 462682 - DNA, 16 bp, M. musculus
ttttttaaatgtctta

SEQ ID NO: 462683 - DNA, 16 bp, M. musculus
ttttttaaatgttgga

SEQ ID NO: 462684 - DNA, 16 bp, M. musculus
ttttttaaattcatga

SEQ ID NO: 462685 - DNA, 16 bp, M. musculus
ttttttaaattggaaa

SEQ ID NO: 462686 - DNA, 16 bp, M. musculus
ttttttaagaatttca

SEQ ID NO: 462687 - DNA, 16 bp, M. musculus
ttttttaagagaaaga

SEQ ID NO: 462688 - DNA, 16 bp, M. musculus
ttttttaagatagggt

SEQ ID NO: 462689 - DNA, 16 bp, M. musculus
ttttttaaggaaaaga

SEQ ID NO: 462690 - DNA, 16 bp, M. musculus
ttttttaatgaaagga

SEQ ID NO: 462691 - DNA, 16 bp, M. musculus
ttttttaatgtagaaa

SEQ ID NO: 462692 - DNA, 16 bp, M. musculus
ttttttacactccatg

SEQ ID NO: 462693 - DNA, 17 bp, M. musculus
ttttttaccattgagga

SEQ ID NO: 462694 - DNA, 16 bp, M. musculus
ttttttactagatatt

SEQ ID NO: 462695 - DNA, 16 bp, M. musculus
ttttttatactccaga

SEQ ID NO: 462696 - DNA, 16 bp, M. musculus
ttttttattaactggg

SEQ ID NO: 462697 - DNA, 16 bp, M. musculus
ttttttcaaaaaagaa

SEQ ID NO: 462698 - DNA, 16 bp, M. musculus
ttttttcaaaaacaaa

SEQ ID NO: 462699 - DNA, 16 bp, M. musculus
ttttttcaaatgaaaa

SEQ ID NO: 462700 - DNA, 16 bp, M. musculus
ttttttcacagcaaca

SEQ ID NO: 462701 - DNA, 16 bp, M. musculus
ttttttcagaaaatca

SEQ ID NO: 462702 - DNA, 18 bp, M. musculus
ttttttcagacagggttt

SEQ ID NO: 462703 - DNA, 16 bp, M. musculus
ttttttcagatgtaaa

SEQ ID NO: 462704 - DNA, 16 bp, M. musculus
ttttttccaagaccta

SEQ ID NO: 462705 - DNA, 16 bp, M. musculus
ttttttccaatggagt

SEQ ID NO: 462706 - DNA, 16 bp, M. musculus
ttttttccagtaaata

SEQ ID NO: 462707 - DNA, 16 bp, M. musculus
ttttttccccaacttg

SEQ ID NO: 462708 - DNA, 16 bp, M. musculus
ttttttcccccaagaa

SEQ ID NO: 462709 - DNA, 16 bp, M. musculus
ttttttcccccaagtt

SEQ ID NO: 462710 - DNA, 16 bp, M. musculus
ttttttcccccagctt

SEQ ID NO: 462711 - DNA, 16 bp, M. musculus
ttttttcccccctatg

SEQ ID NO: 462712 - DNA, 16 bp, M. musculus
ttttttcccccctcaa

SEQ ID NO: 462713 - DNA, 16 bp, M. musculus
ttttttcccccctgaa

SEQ ID NO: 462714 - DNA, 16 bp, M. musculus
ttttttccccccttgg

SEQ ID NO: 462715 - DNA, 16 bp, M. musculus
ttttttccccctccaa

SEQ ID NO: 462716 - DNA, 16 bp, M. musculus
ttttttccccctgaat

SEQ ID NO: 462717 - DNA, 16 bp, M. musculus
ttttttcccctagaaa

SEQ ID NO: 462718 - DNA, 16 bp, M. musculus
ttttttcccctgtacc

SEQ ID NO: 462719 - DNA, 16 bp, M. musculus
ttttttccctgtaatt

SEQ ID NO: 462720 - DNA, 16 bp, M. musculus
ttttttcccttactgc

SEQ ID NO: 462721 - DNA, 16 bp, M. musculus
ttttttcctccttaaa

SEQ ID NO: 462722 - DNA, 16 bp, M. musculus
ttttttcctctggatg

SEQ ID NO: 462723 - DNA, 16 bp, M. musculus
ttttttccttaaaaaa

SEQ ID NO: 462724 - DNA, 16 bp, M. musculus
ttttttccttttaaga

SEQ ID NO: 462725 - DNA, 16 bp, M. musculus
ttttttctaaaatgta

SEQ ID NO: 462726 - DNA, 19 bp, M. musculus
ttttttctcatcatcggcc

SEQ ID NO: 462727 - DNA, 16 bp, M. musculus
ttttttctcatttgaa

SEQ ID NO: 462728 - DNA, 16 bp, M. musculus
ttttttctcgtcccgg

SEQ ID NO: 462729 - DNA, 16 bp, M. musculus
ttttttctctgtaact

SEQ ID NO: 462730 - DNA, 16 bp, M. musculus
ttttttctctttaaga

SEQ ID NO: 462731 - DNA, 16 bp, M. musculus
ttttttctgaaaatga

SEQ ID NO: 462732 - DNA, 22 bp, M. musculus
ttttttctggtgttaggagccc

SEQ ID NO: 462733 - DNA, 16 bp, M. musculus
ttttttcttaaacttg

SEQ ID NO: 462734 - DNA, 16 bp, M. musculus
ttttttcttcaaagac

SEQ ID NO: 462735 - DNA, 16 bp, M. musculus
ttttttcttcttcaag

SEQ ID NO: 462736 - DNA, 16 bp, M. musculus
ttttttctttaaaagg

SEQ ID NO: 462737 - DNA, 16 bp, M. musculus
ttttttctttaaagat

SEQ ID NO: 462738 - DNA, 16 bp, M. musculus
ttttttctttgataaa

SEQ ID NO: 462739 - DNA, 16 bp, M. musculus
ttttttcttttgagaa

SEQ ID NO: 462740 - DNA, 16 bp, M. musculus
ttttttgaaacaaaat

SEQ ID NO: 462741 - DNA, 16 bp, M. musculus
ttttttgaaacatttt

SEQ ID NO: 462742 - DNA, 16 bp, M. musculus
ttttttgaaacttctt

SEQ ID NO: 462743 - DNA, 16 bp, M. musculus
ttttttgagacaaagt

SEQ ID NO: 462744 - DNA, 16 bp, M. musculus
ttttttgagacaggtt

SEQ ID NO: 462745 - DNA, 16 bp, M. musculus
ttttttgagacatggt

SEQ ID NO: 462746 - DNA, 16 bp, M. musculus
ttttttgagaccaagt

SEQ ID NO: 462747 - DNA, 16 bp, M. musculus
ttttttgagattaaaa

SEQ ID NO: 462748 - DNA, 16 bp, M. musculus
ttttttgaggggggag

SEQ ID NO: 462749 - DNA, 16 bp, M. musculus
ttttttgagtcagagt

SEQ ID NO: 462750 - DNA, 16 bp, M. musculus
ttttttgcatttaaaa

SEQ ID NO: 462751 - DNA, 17 bp, M. musculus
ttttttgctttagctga

SEQ ID NO: 462752 - DNA, 16 bp, M. musculus
ttttttggagggaggg

SEQ ID NO: 462753 - DNA, 16 bp, M. musculus
ttttttggagtccatc

SEQ ID NO: 462754 - DNA, 17 bp, M. musculus
ttttttggatgtgcctt

SEQ ID NO: 462755 - DNA, 16 bp, M. musculus
ttttttgggacaaggt

SEQ ID NO: 462756 - DNA, 16 bp, M. musculus
ttttttggggggagag

SEQ ID NO: 462757 - DNA, 16 bp, M. musculus
ttttttgtccctgtat

SEQ ID NO: 462758 - DNA, 16 bp, M. musculus
ttttttgttattccaa

SEQ ID NO: 462759 - DNA, 16 bp, M. musculus
ttttttgttgttccag

SEQ ID NO: 462760 - DNA, 16 bp, M. musculus
tttttttaaaaaaacc

SEQ ID NO: 462761 - DNA, 16 bp, M. musculus
tttttttaaaaaacct

SEQ ID NO: 462762 - DNA, 16 bp, M. musculus
tttttttaaaaaagca

SEQ ID NO: 462763 - DNA, 16 bp, M. musculus
tttttttaaaaaccaa

SEQ ID NO: 462764 - DNA, 16 bp, M. musculus
tttttttaaaaagcat

SEQ ID NO: 462765 - DNA, 16 bp, M. musculus
tttttttaaaactgtg

SEQ ID NO: 462766 - DNA, 16 bp, M. musculus
tttttttaaaagcaaa

SEQ ID NO: 462767 - DNA, 16 bp, M. musculus
tttttttaaaaggcca

SEQ ID NO: 462768 - DNA, 16 bp, M. musculus
tttttttaaaatgcat

SEQ ID NO: 462769 - DNA, 16 bp, M. musculus
tttttttaaaatgtca

SEQ ID NO: 462770 - DNA, 16 bp, M. musculus
tttttttaaaatgtgg

SEQ ID NO: 462771 - DNA, 16 bp, M. musculus
tttttttaaacaacaa

SEQ ID NO: 462772 - DNA, 16 bp, M. musculus
tttttttaaacaagag

SEQ ID NO: 462773 - DNA, 16 bp, M. musculus
tttttttaaacagtca

SEQ ID NO: 462774 - DNA, 16 bp, M. musculus
tttttttaaacatcaa

SEQ ID NO: 462775 - DNA, 16 bp, M. musculus
tttttttaaaccaagg

SEQ ID NO: 462776 - DNA, 16 bp, M. musculus
tttttttaaactaaag

SEQ ID NO: 462777 - DNA, 16 bp, M. musculus
tttttttaaactacag

SEQ ID NO: 462778 - DNA, 16 bp, M. musculus
tttttttaaactatag

SEQ ID NO: 462779 - DNA, 16 bp, M. musculus
tttttttaaacttctg

SEQ ID NO: 462780 - DNA, 16 bp, M. musculus
tttttttaaacttggt

SEQ ID NO: 462781 - DNA, 16 bp, M. musculus
tttttttaaagaatca

SEQ ID NO: 462782 - DNA, 16 bp, M. musculus
tttttttaaagaatga

SEQ ID NO: 462783 - DNA, 16 bp, M. musculus
tttttttaaagacaga

SEQ ID NO: 462784 - DNA, 16 bp, M. musculus
tttttttaaagcagag

SEQ ID NO: 462785 - DNA, 16 bp, M. musculus
tttttttaaagcataa

SEQ ID NO: 462786 - DNA, 16 bp, M. musculus
tttttttaaagcatgc

SEQ ID NO: 462787 - DNA, 16 bp, M. musculus
tttttttaaagctata

SEQ ID NO: 462788 - DNA, 16 bp, M. musculus
tttttttaaaggagaa

SEQ ID NO: 462789 - DNA, 16 bp, M. musculus
tttttttaaaggcaaa

SEQ ID NO: 462790 - DNA, 16 bp, M. musculus
tttttttaaagtaaca

SEQ ID NO: 462791 - DNA, 16 bp, M. musculus
tttttttaaatcaatg

SEQ ID NO: 462792 - DNA, 16 bp, M. musculus
tttttttaaatcacaa

SEQ ID NO: 462793 - DNA, 16 bp, M. musculus
tttttttaaatcacca

SEQ ID NO: 462794 - DNA, 16 bp, M. musculus
tttttttaaatcagca

SEQ ID NO: 462795 - DNA, 16 bp, M. musculus
tttttttaaatgacat

SEQ ID NO: 462796 - DNA, 16 bp, M. musculus
tttttttaaatggtga

SEQ ID NO: 462797 - DNA, 16 bp, M. musculus
tttttttaagaaaagc

SEQ ID NO: 462798 - DNA, 16 bp, M. musculus
tttttttaagaaacag

SEQ ID NO: 462799 - DNA, 16 bp, M. musculus
tttttttaagaaatgg

SEQ ID NO: 462800 - DNA, 16 bp, M. musculus
tttttttaagaagaaa

SEQ ID NO: 462801 - DNA, 16 bp, M. musculus
tttttttaagaaggaa

SEQ ID NO: 462802 - DNA, 16 bp, M. musculus
tttttttaagagaaga

SEQ ID NO: 462803 - DNA, 16 bp, M. musculus
tttttttaagtattca

SEQ ID NO: 462804 - DNA, 16 bp, M. musculus
tttttttaagtcaatt

SEQ ID NO: 462805 - DNA, 16 bp, M. musculus
tttttttaatcagata

SEQ ID NO: 462806 - DNA, 16 bp, M. musculus
tttttttaatctaaga

SEQ ID NO: 462807 - DNA, 16 bp, M. musculus
tttttttaatctcaca

SEQ ID NO: 462808 - DNA, 16 bp, M. musculus
tttttttaatgaaact

SEQ ID NO: 462809 - DNA, 16 bp, M. musculus
tttttttaatgagaag

SEQ ID NO: 462810 - DNA, 16 bp, M. musculus
tttttttaatggaaag

SEQ ID NO: 462811 - DNA, 16 bp, M. musculus
tttttttaattgaact

SEQ ID NO: 462812 - DNA, 16 bp, M. musculus
tttttttaatttagca

SEQ ID NO: 462813 - DNA, 16 bp, M. musculus
tttttttacatttgaa

SEQ ID NO: 462814 - DNA, 16 bp, M. musculus
tttttttagacagggt

SEQ ID NO: 462815 - DNA, 16 bp, M. musculus
tttttttcaaaaacta

SEQ ID NO: 462816 - DNA, 16 bp, M. musculus
tttttttcaaaattgt

SEQ ID NO: 462817 - DNA, 16 bp, M. musculus
tttttttcaacaaaat

SEQ ID NO: 462818 - DNA, 16 bp, M. musculus
tttttttcaagagctt

SEQ ID NO: 462819 - DNA, 16 bp, M. musculus
tttttttcaattgaaa

SEQ ID NO: 462820 - DNA, 16 bp, M. musculus
tttttttcaatttgaa

SEQ ID NO: 462821 - DNA, 16 bp, M. musculus
tttttttcagaaactt

SEQ ID NO: 462822 - DNA, 16 bp, M. musculus
tttttttcagaaataa

SEQ ID NO: 462823 - DNA, 16 bp, M. musculus
tttttttcagcaaaat

SEQ ID NO: 462824 - DNA, 16 bp, M. musculus
tttttttcataaaaga

SEQ ID NO: 462825 - DNA, 16 bp, M. musculus
tttttttcatgtaaaa

SEQ ID NO: 462826 - DNA, 16 bp, M. musculus
tttttttcatttaaga

SEQ ID NO: 462827 - DNA, 16 bp, M. musculus
tttttttccaaataac

SEQ ID NO: 462828 - DNA, 16 bp, M. musculus
tttttttccaaatgaa

SEQ ID NO: 462829 - DNA, 16 bp, M. musculus
tttttttccaagaaag

SEQ ID NO: 462830 - DNA, 16 bp, M. musculus
tttttttccacaggat

SEQ ID NO: 462831 - DNA, 16 bp, M. musculus
tttttttccagaaaat

SEQ ID NO: 462832 - DNA, 16 bp, M. musculus
tttttttccagaaatt

SEQ ID NO: 462833 - DNA, 16 bp, M. musculus
tttttttccagagctg

SEQ ID NO: 462834 - DNA, 16 bp, M. musculus
tttttttccagataaa

SEQ ID NO: 462835 - DNA, 16 bp, M. musculus
tttttttccagtgatg

SEQ ID NO: 462836 - DNA, 16 bp, M. musculus
tttttttccatctcag

SEQ ID NO: 462837 - DNA, 16 bp, M. musculus
tttttttcccagtgtg

SEQ ID NO: 462838 - DNA, 16 bp, M. musculus
tttttttccccaaaca

SEQ ID NO: 462839 - DNA, 16 bp, M. musculus
tttttttccccaaact

SEQ ID NO: 462840 - DNA, 16 bp, M. musculus
tttttttccccaagta

SEQ ID NO: 462841 - DNA, 16 bp, M. musculus
tttttttccccacaat

SEQ ID NO: 462842 - DNA, 16 bp, M. musculus
tttttttcccccaact

SEQ ID NO: 462843 - DNA, 16 bp, M. musculus
tttttttccccctgaa

SEQ ID NO: 462844 - DNA, 16 bp, M. musculus
tttttttccccctgca

SEQ ID NO: 462845 - DNA, 16 bp, M. musculus
tttttttcccctagag

SEQ ID NO: 462846 - DNA, 16 bp, M. musculus
tttttttcccctccag

SEQ ID NO: 462847 - DNA, 16 bp, M. musculus
tttttttcccctgtat

SEQ ID NO: 462848 - DNA, 16 bp, M. musculus
tttttttccccttggg

SEQ ID NO: 462849 - DNA, 16 bp, M. musculus
tttttttccctaagtt

SEQ ID NO: 462850 - DNA, 16 bp, M. musculus
tttttttccctctgaa

SEQ ID NO: 462851 - DNA, 16 bp, M. musculus
tttttttccctgaaag

SEQ ID NO: 462852 - DNA, 16 bp, M. musculus
tttttttccctgaatt

SEQ ID NO: 462853 - DNA, 16 bp, M. musculus
tttttttcctaaaaag

SEQ ID NO: 462854 - DNA, 16 bp, M. musculus
tttttttcctatgaaa

SEQ ID NO: 462855 - DNA, 16 bp, M. musculus
tttttttcctcctaaa

SEQ ID NO: 462856 - DNA, 16 bp, M. musculus
tttttttcctctaaga

SEQ ID NO: 462857 - DNA, 16 bp, M. musculus
tttttttcctgaaaac

SEQ ID NO: 462858 - DNA, 16 bp, M. musculus
tttttttcctgaaaat

SEQ ID NO: 462859 - DNA, 16 bp, M. musculus
tttttttcctgaaatg

SEQ ID NO: 462860 - DNA, 16 bp, M. musculus
tttttttcctgaaatt

SEQ ID NO: 462861 - DNA, 16 bp, M. musculus
tttttttcctggaact

SEQ ID NO: 462862 - DNA, 16 bp, M. musculus
tttttttccttaagat

SEQ ID NO: 462863 - DNA, 16 bp, M. musculus
tttttttccttcagaa

SEQ ID NO: 462864 - DNA, 16 bp, M. musculus
tttttttcctttgcaa

SEQ ID NO: 462865 - DNA, 16 bp, M. musculus
tttttttctaataaga

SEQ ID NO: 462866 - DNA, 16 bp, M. musculus
tttttttctcaagaaa

SEQ ID NO: 462867 - DNA, 16 bp, M. musculus
tttttttctcagttca

SEQ ID NO: 462868 - DNA, 16 bp, M. musculus
tttttttctgaaaatt

SEQ ID NO: 462869 - DNA, 16 bp, M. musculus
tttttttctgaaatac

SEQ ID NO: 462870 - DNA, 16 bp, M. musculus
tttttttctgaaatta

SEQ ID NO: 462871 - DNA, 16 bp, M. musculus
tttttttctgaactct

SEQ ID NO: 462872 - DNA, 16 bp, M. musculus
tttttttctggatgaa

SEQ ID NO: 462873 - DNA, 16 bp, M. musculus
tttttttcttcaaaag

SEQ ID NO: 462874 - DNA, 16 bp, M. musculus
tttttttcttccaaag

SEQ ID NO: 462875 - DNA, 16 bp, M. musculus
tttttttctttaaaga

SEQ ID NO: 462876 - DNA, 16 bp, M. musculus
tttttttctttcagaa

SEQ ID NO: 462877 - DNA, 16 bp, M. musculus
tttttttctttccaga

SEQ ID NO: 462878 - DNA, 16 bp, M. musculus
tttttttgaaaactaa

SEQ ID NO: 462879 - DNA, 16 bp, M. musculus
tttttttgaaacaaag

SEQ ID NO: 462880 - DNA, 16 bp, M. musculus
tttttttgagaaaata

SEQ ID NO: 462881 - DNA, 16 bp, M. musculus
tttttttgagaaagaa

SEQ ID NO: 462882 - DNA, 16 bp, M. musculus
tttttttgagacagtc

SEQ ID NO: 462883 - DNA, 16 bp, M. musculus
tttttttgaggcaaga

SEQ ID NO: 462884 - DNA, 16 bp, M. musculus
tttttttgcctttaaa

SEQ ID NO: 462885 - DNA, 16 bp, M. musculus
tttttttggagacagg

SEQ ID NO: 462886 - DNA, 16 bp, M. musculus
tttttttggaggggga

SEQ ID NO: 462887 - DNA, 16 bp, M. musculus
tttttttggctaatat

SEQ ID NO: 462888 - DNA, 16 bp, M. musculus
tttttttggtcaggtt

SEQ ID NO: 462889 - DNA, 16 bp, M. musculus
tttttttgtcttgaaa

SEQ ID NO: 462890 - DNA, 16 bp, M. musculus
ttttttttaaaacaag

SEQ ID NO: 462891 - DNA, 16 bp, M. musculus
ttttttttaaaacttg

SEQ ID NO: 462892 - DNA, 16 bp, M. musculus
ttttttttaaaagaag

SEQ ID NO: 462893 - DNA, 16 bp, M. musculus
ttttttttaaaagaga

SEQ ID NO: 462894 - DNA, 16 bp, M. musculus
ttttttttaaaatgtc

SEQ ID NO: 462895 - DNA, 16 bp, M. musculus
ttttttttaaacaagc

SEQ ID NO: 462896 - DNA, 16 bp, M. musculus
ttttttttaaacaggc

SEQ ID NO: 462897 - DNA, 16 bp, M. musculus
ttttttttaaacctgt

SEQ ID NO: 462898 - DNA, 16 bp, M. musculus
ttttttttaaagcaac

SEQ ID NO: 462899 - DNA, 16 bp, M. musculus
ttttttttaaagcagc

SEQ ID NO: 462900 - DNA, 16 bp, M. musculus
ttttttttaaagcctg

SEQ ID NO: 462901 - DNA, 16 bp, M. musculus
ttttttttaaagcctt

SEQ ID NO: 462902 - DNA, 16 bp, M. musculus
ttttttttaaagctgt

SEQ ID NO: 462903 - DNA, 16 bp, M. musculus
ttttttttaaagctta

SEQ ID NO: 462904 - DNA, 16 bp, M. musculus
ttttttttaaaggaag

SEQ ID NO: 462905 - DNA, 16 bp, M. musculus
ttttttttaaaggagg

SEQ ID NO: 462906 - DNA, 16 bp, M. musculus
ttttttttaaatgtcc

SEQ ID NO: 462907 - DNA, 16 bp, M. musculus
ttttttttaacaaagt

SEQ ID NO: 462908 - DNA, 16 bp, M. musculus
ttttttttaacatcac

SEQ ID NO: 462909 - DNA, 16 bp, M. musculus
ttttttttaaccaact

SEQ ID NO: 462910 - DNA, 16 bp, M. musculus
ttttttttaacctgtg

SEQ ID NO: 462911 - DNA, 16 bp, M. musculus
ttttttttaacttaga

SEQ ID NO: 462912 - DNA, 16 bp, M. musculus
ttttttttaagaaaac

SEQ ID NO: 462913 - DNA, 16 bp, M. musculus
ttttttttaagaaaga

SEQ ID NO: 462914 - DNA, 16 bp, M. musculus
ttttttttaagaagag

SEQ ID NO: 462915 - DNA, 16 bp, M. musculus
ttttttttaagaatac

SEQ ID NO: 462916 - DNA, 19 bp, M. musculus
ttttttttaagacagggtc

SEQ ID NO: 462917 - DNA, 16 bp, M. musculus
ttttttttaagtccag

SEQ ID NO: 462918 - DNA, 16 bp, M. musculus
ttttttttaagtgtca

SEQ ID NO: 462919 - DNA, 16 bp, M. musculus
ttttttttaatcacag

SEQ ID NO: 462920 - DNA, 16 bp, M. musculus
ttttttttaatcccca

SEQ ID NO: 462921 - DNA, 16 bp, M. musculus
ttttttttaatgaact

SEQ ID NO: 462922 - DNA, 16 bp, M. musculus
ttttttttaatgaagg

SEQ ID NO: 462923 - DNA, 16 bp, M. musculus
ttttttttaatgacaa

SEQ ID NO: 462924 - DNA, 16 bp, M. musculus
ttttttttaatgcaaa

SEQ ID NO: 462925 - DNA, 16 bp, M. musculus
ttttttttaatgcagg

SEQ ID NO: 462926 - DNA, 16 bp, M. musculus
ttttttttaatgctgg

SEQ ID NO: 462927 - DNA, 16 bp, M. musculus
ttttttttaatgtcaa

SEQ ID NO: 462928 - DNA, 16 bp, M. musculus
ttttttttacaaagca

SEQ ID NO: 462929 - DNA, 16 bp, M. musculus
ttttttttcaaaaaca

SEQ ID NO: 462930 - DNA, 16 bp, M. musculus
ttttttttcaaagaaa

SEQ ID NO: 462931 - DNA, 16 bp, M. musculus
ttttttttcaaagtta

SEQ ID NO: 462932 - DNA, 16 bp, M. musculus
ttttttttcaaatatg

SEQ ID NO: 462933 - DNA, 16 bp, M. musculus
ttttttttcaacttga

SEQ ID NO: 462934 - DNA, 16 bp, M. musculus
ttttttttcaagaaat

SEQ ID NO: 462935 - DNA, 16 bp, M. musculus
ttttttttcacagaaa

SEQ ID NO: 462936 - DNA, 16 bp, M. musculus
ttttttttcaggaaaa

SEQ ID NO: 462937 - DNA, 16 bp, M. musculus
ttttttttccaaacag

SEQ ID NO: 462938 - DNA, 16 bp, M. musculus
ttttttttccaaagaa

SEQ ID NO: 462939 - DNA, 16 bp, M. musculus
ttttttttccaaatga

SEQ ID NO: 462940 - DNA, 16 bp, M. musculus
ttttttttccaatcca

SEQ ID NO: 462941 - DNA, 16 bp, M. musculus
ttttttttccaatctg

SEQ ID NO: 462942 - DNA, 16 bp, M. musculus
ttttttttccactctg

SEQ ID NO: 462943 - DNA, 16 bp, M. musculus
ttttttttccagaaat

SEQ ID NO: 462944 - DNA, 16 bp, M. musculus
ttttttttccagccct

SEQ ID NO: 462945 - DNA, 16 bp, M. musculus
ttttttttccaggaga

SEQ ID NO: 462946 - DNA, 16 bp, M. musculus
ttttttttccataaag

SEQ ID NO: 462947 - DNA, 16 bp, M. musculus
ttttttttcccaaact

SEQ ID NO: 462948 - DNA, 16 bp, M. musculus
ttttttttcccagaca

SEQ ID NO: 462949 - DNA, 16 bp, M. musculus
ttttttttccccaaaa

SEQ ID NO: 462950 - DNA, 16 bp, M. musculus
ttttttttccccagac

SEQ ID NO: 462951 - DNA, 16 bp, M. musculus
ttttttttccccaggg

SEQ ID NO: 462952 - DNA, 16 bp, M. musculus
ttttttttcccccaca

SEQ ID NO: 462953 - DNA, 16 bp, M. musculus
ttttttttcccccagg

SEQ ID NO: 462954 - DNA, 16 bp, M. musculus
ttttttttccccccaa

SEQ ID NO: 462955 - DNA, 16 bp, M. musculus
ttttttttcccctagg

SEQ ID NO: 462956 - DNA, 16 bp, M. musculus
ttttttttcccctcag

SEQ ID NO: 462957 - DNA, 16 bp, M. musculus
ttttttttccctaaaa

SEQ ID NO: 462958 - DNA, 16 bp, M. musculus
ttttttttccctagca

SEQ ID NO: 462959 - DNA, 16 bp, M. musculus
ttttttttccctatag

SEQ ID NO: 462960 - DNA, 16 bp, M. musculus
ttttttttcctaaaag

SEQ ID NO: 462961 - DNA, 16 bp, M. musculus
ttttttttcctccaaa

SEQ ID NO: 462962 - DNA, 16 bp, M. musculus
ttttttttcctccaag

SEQ ID NO: 462963 - DNA, 16 bp, M. musculus
ttttttttcctcctga

SEQ ID NO: 462964 - DNA, 16 bp, M. musculus
ttttttttcctgaatg

SEQ ID NO: 462965 - DNA, 16 bp, M. musculus
ttttttttcctgagaa

SEQ ID NO: 462966 - DNA, 16 bp, M. musculus
ttttttttcctgccat

SEQ ID NO: 462967 - DNA, 16 bp, M. musculus
ttttttttccttaaga

SEQ ID NO: 462968 - DNA, 16 bp, M. musculus
ttttttttccttgaga

SEQ ID NO: 462969 - DNA, 16 bp, M. musculus
ttttttttctaccaaa

SEQ ID NO: 462970 - DNA, 16 bp, M. musculus
ttttttttctcaaagg

SEQ ID NO: 462971 - DNA, 16 bp, M. musculus
ttttttttctcatgga

SEQ ID NO: 462972 - DNA, 16 bp, M. musculus
ttttttttctgaaaaa

SEQ ID NO: 462973 - DNA, 16 bp, M. musculus
ttttttttctgaaata

SEQ ID NO: 462974 - DNA, 16 bp, M. musculus
ttttttttctgagtca

SEQ ID NO: 462975 - DNA, 16 bp, M. musculus
ttttttttctgcaaaa

SEQ ID NO: 462976 - DNA, 16 bp, M. musculus
ttttttttctgggaag

SEQ ID NO: 462977 - DNA, 16 bp, M. musculus
ttttttttctgtcaaa

SEQ ID NO: 462978 - DNA, 16 bp, M. musculus
ttttttttcttagaaa

SEQ ID NO: 462979 - DNA, 16 bp, M. musculus
ttttttttcttcaaag

SEQ ID NO: 462980 - DNA, 16 bp, M. musculus
ttttttttcttcaaga

SEQ ID NO: 462981 - DNA, 16 bp, M. musculus
ttttttttcttcaagc

SEQ ID NO: 462982 - DNA, 16 bp, M. musculus
ttttttttcttccaga

SEQ ID NO: 462983 - DNA, 16 bp, M. musculus
ttttttttgaagaaaa

SEQ ID NO: 462984 - DNA, 17 bp, M. musculus
ttttttttgagacagaa

SEQ ID NO: 462985 - DNA, 16 bp, M. musculus
ttttttttgaggcaag

SEQ ID NO: 462986 - DNA, 16 bp, M. musculus
ttttttttgtcatgga

SEQ ID NO: 462987 - DNA, 16 bp, M. musculus
tttttttttaaaagac

SEQ ID NO: 462988 - DNA, 16 bp, M. musculus
tttttttttaaactag

SEQ ID NO: 462989 - DNA, 16 bp, M. musculus
tttttttttaaactga

SEQ ID NO: 462990 - DNA, 16 bp, M. musculus
tttttttttaaagcta

SEQ ID NO: 462991 - DNA, 16 bp, M. musculus
tttttttttaaagctc

SEQ ID NO: 462992 - DNA, 16 bp, M. musculus
tttttttttaaagctg

SEQ ID NO: 462993 - DNA, 16 bp, M. musculus
tttttttttaacagaa

SEQ ID NO: 462994 - DNA, 16 bp, M. musculus
tttttttttaacagat

SEQ ID NO: 462995 - DNA, 16 bp, M. musculus
tttttttttaacatag

SEQ ID NO: 462996 - DNA, 16 bp, M. musculus
tttttttttaagaaca

SEQ ID NO: 462997 - DNA, 16 bp, M. musculus
tttttttttaagaagc

SEQ ID NO: 462998 - DNA, 16 bp, M. musculus
tttttttttaagtccc

SEQ ID NO: 462999 - DNA, 16 bp, M. musculus
tttttttttaatgcaa

SEQ ID NO: 463000 - DNA, 16 bp, M. musculus
tttttttttacagcaa

SEQ ID NO: 463001 - DNA, 16 bp, M. musculus
tttttttttacagtga

SEQ ID NO: 463002 - DNA, 16 bp, M. musculus
tttttttttacctcag

SEQ ID NO: 463003 - DNA, 16 bp, M. musculus
tttttttttatgagac

SEQ ID NO: 463004 - DNA, 16 bp, M. musculus
tttttttttcaaacca

SEQ ID NO: 463005 - DNA, 16 bp, M. musculus
tttttttttcaaagcc

SEQ ID NO: 463006 - DNA, 16 bp, M. musculus
tttttttttcaaatag

SEQ ID NO: 463007 - DNA, 16 bp, M. musculus
tttttttttcaaatga

SEQ ID NO: 463008 - DNA, 16 bp, M. musculus
tttttttttcacaaca

SEQ ID NO: 463009 - DNA, 16 bp, M. musculus
tttttttttcagaagg

SEQ ID NO: 463010 - DNA, 16 bp, M. musculus
tttttttttcagagaa

SEQ ID NO: 463011 - DNA, 16 bp, M. musculus
tttttttttccagagc

SEQ ID NO: 463012 - DNA, 16 bp, M. musculus
tttttttttccaggaa

SEQ ID NO: 463013 - DNA, 16 bp, M. musculus
tttttttttccagtga

SEQ ID NO: 463014 - DNA, 16 bp, M. musculus
tttttttttcccaaaa

SEQ ID NO: 463015 - DNA, 16 bp, M. musculus
tttttttttcccactg

SEQ ID NO: 463016 - DNA, 16 bp, M. musculus
tttttttttccccaag

SEQ ID NO: 463017 - DNA, 16 bp, M. musculus
tttttttttcccctga

SEQ ID NO: 463018 - DNA, 16 bp, M. musculus
tttttttttccctgaa

SEQ ID NO: 463019 - DNA, 16 bp, M. musculus
tttttttttcctaagg

SEQ ID NO: 463020 - DNA, 16 bp, M. musculus
tttttttttctacaag

SEQ ID NO: 463021 - DNA, 16 bp, M. musculus
tttttttttctcaaag

SEQ ID NO: 463022 - DNA, 16 bp, M. musculus
tttttttttctccaag

SEQ ID NO: 463023 - DNA, 16 bp, M. musculus
tttttttttctcccag

SEQ ID NO: 463024 - DNA, 16 bp, M. musculus
tttttttttctggaaa

SEQ ID NO: 463025 - DNA, 16 bp, M. musculus
tttttttttctggagc

SEQ ID NO: 463026 - DNA, 16 bp, M. musculus
tttttttttgagacag

SEQ ID NO: 463027 - DNA, 22 bp, M. musculus
tttttttttgagacagggtttt

SEQ ID NO: 463028 - DNA, 16 bp, M. musculus
tttttttttgagacat

SEQ ID NO: 463029 - DNA, 16 bp, M. musculus
tttttttttgagacca

SEQ ID NO: 463030 - DNA, 16 bp, M. musculus
tttttttttgagactg

SEQ ID NO: 463031 - DNA, 16 bp, M. musculus
tttttttttggacaaa

SEQ ID NO: 463032 - DNA, 16 bp, M. musculus
tttttttttgtaaaca

SEQ ID NO: 463033 - DNA, 16 bp, M. musculus
tttttttttgtaaagc

SEQ ID NO: 463034 - DNA, 16 bp, M. musculus
ttttttttttaaaacg

SEQ ID NO: 463035 - DNA, 16 bp, M. musculus
ttttttttttaaagcc

SEQ ID NO: 463036 - DNA, 16 bp, M. musculus
ttttttttttaacaag

SEQ ID NO: 463037 - DNA, 16 bp, M. musculus
ttttttttttaagagc

SEQ ID NO: 463038 - DNA, 16 bp, M. musculus
ttttttttttcagaaa

SEQ ID NO: 463039 - DNA, 16 bp, M. musculus
ttttttttttcaggag

SEQ ID NO: 463040 - DNA, 16 bp, M. musculus
ttttttttttccaaga

SEQ ID NO: 463041 - DNA, 16 bp, M. musculus
ttttttttttcccagc

SEQ ID NO: 463042 - DNA, 16 bp, M. musculus
ttttttttttgcaaaa

SEQ ID NO: 463043 - DNA, 16 bp, M. musculus
ttttttttttggaaac

SEQ ID NO: 463044 - DNA, 16 bp, M. musculus
ttttttttttggacag

SEQ ID NO: 463045 - DNA, 16 bp, R. norvegicus
aaaaaaaaaaccctgg

SEQ ID NO: 463046 - DNA, 16 bp, R. norvegicus
aaaaaaaaaatctgtg

SEQ ID NO: 463047 - DNA, 16 bp, R. norvegicus
aaaaaaaaaatggctt

SEQ ID NO: 463048 - DNA, 16 bp, R. norvegicus
aaaaaaaaaccctttt

SEQ ID NO: 463049 - DNA, 16 bp, R. norvegicus
aaaaaaaaacctctgt

SEQ ID NO: 463050 - DNA, 16 bp, R. norvegicus
aaaaaaaaactcttcc

SEQ ID NO: 463051 - DNA, 16 bp, R. norvegicus
aaaaaaaaagatgtcc

SEQ ID NO: 463052 - DNA, 16 bp, R. norvegicus
aaaaaaaaaggactgg

SEQ ID NO: 463053 - DNA, 16 bp, R. norvegicus
aaaaaaaaaggcattt

SEQ ID NO: 463054 - DNA, 16 bp, R. norvegicus
aaaaaaaaagtcagct

SEQ ID NO: 463055 - DNA, 16 bp, R. norvegicus
aaaaaaaaagtcctga

SEQ ID NO: 463056 - DNA, 16 bp, R. norvegicus
aaaaaaaaagtctatg

SEQ ID NO: 463057 - DNA, 16 bp, R. norvegicus
aaaaaaaaagtgccca

SEQ ID NO: 463058 - DNA, 16 bp, R. norvegicus
aaaaaaaaagtgttca

SEQ ID NO: 463059 - DNA, 16 bp, R. norvegicus
aaaaaaaaagttcttt

SEQ ID NO: 463060 - DNA, 16 bp, R. norvegicus
aaaaaaaaagttgctc

SEQ ID NO: 463061 - DNA, 16 bp, R. norvegicus
aaaaaaaaatccctgt

SEQ ID NO: 463062 - DNA, 16 bp, R. norvegicus
aaaaaaaaatcccttc

SEQ ID NO: 463063 - DNA, 16 bp, R. norvegicus
aaaaaaaaatcctgac

SEQ ID NO: 463064 - DNA, 16 bp, R. norvegicus
aaaaaaaaatctagct

SEQ ID NO: 463065 - DNA, 16 bp, R. norvegicus
aaaaaaaaatcttccc

SEQ ID NO: 463066 - DNA, 16 bp, R. norvegicus
aaaaaaaaatgccttt

SEQ ID NO: 463067 - DNA, 16 bp, R. norvegicus
aaaaaaaaatttcccc

SEQ ID NO: 463068 - DNA, 16 bp, R. norvegicus
aaaaaaaaccctgcaa

SEQ ID NO: 463069 - DNA, 16 bp, R. norvegicus
aaaaaaaacccttttc

SEQ ID NO: 463070 - DNA, 16 bp, R. norvegicus
aaaaaaaacctgacag

SEQ ID NO: 463071 - DNA, 16 bp, R. norvegicus
aaaaaaaactgtatag

SEQ ID NO: 463072 - DNA, 16 bp, R. norvegicus
aaaaaaaagaagcctt

SEQ ID NO: 463073 - DNA, 16 bp, R. norvegicus
aaaaaaaagacacgtg

SEQ ID NO: 463074 - DNA, 16 bp, R. norvegicus
aaaaaaaagacatctt

SEQ ID NO: 463075 - DNA, 16 bp, R. norvegicus
aaaaaaaagacatggg

SEQ ID NO: 463076 - DNA, 16 bp, R. norvegicus
aaaaaaaagacttcca

SEQ ID NO: 463077 - DNA, 16 bp, R. norvegicus
aaaaaaaagaggggct

SEQ ID NO: 463078 - DNA, 16 bp, R. norvegicus
aaaaaaaagagttgca

SEQ ID NO: 463079 - DNA, 16 bp, R. norvegicus
aaaaaaaagattcctc

SEQ ID NO: 463080 - DNA, 16 bp, R. norvegicus
aaaaaaaagcattttc

SEQ ID NO: 463081 - DNA, 16 bp, R. norvegicus
aaaaaaaagcctttga

SEQ ID NO: 463082 - DNA, 16 bp, R. norvegicus
aaaaaaaaggctgggg

SEQ ID NO: 463083 - DNA, 16 bp, R. norvegicus
aaaaaaaagtacattt

SEQ ID NO: 463084 - DNA, 16 bp, R. norvegicus
aaaaaaaagtatctgt

SEQ ID NO: 463085 - DNA, 16 bp, R. norvegicus
aaaaaaaagtcacatg

SEQ ID NO: 463086 - DNA, 16 bp, R. norvegicus
aaaaaaaagtcaggga

SEQ ID NO: 463087 - DNA, 16 bp, R. norvegicus
aaaaaaaagtcatcca

SEQ ID NO: 463088 - DNA, 16 bp, R. norvegicus
aaaaaaaagtcatgtg

SEQ ID NO: 463089 - DNA, 16 bp, R. norvegicus
aaaaaaaagtcctgga

SEQ ID NO: 463090 - DNA, 16 bp, R. norvegicus
aaaaaaaagtcttcta

SEQ ID NO: 463091 - DNA, 16 bp, R. norvegicus
aaaaaaaagttattca

SEQ ID NO: 463092 - DNA, 16 bp, R. norvegicus
aaaaaaaagttcaagg

SEQ ID NO: 463093 - DNA, 16 bp, R. norvegicus
aaaaaaaagttctata

SEQ ID NO: 463094 - DNA, 16 bp, R. norvegicus
aaaaaaaagttttcct

SEQ ID NO: 463095 - DNA, 16 bp, R. norvegicus
aaaaaaaataccttct

SEQ ID NO: 463096 - DNA, 16 bp, R. norvegicus
aaaaaaaatcacatgg

SEQ ID NO: 463097 - DNA, 16 bp, R. norvegicus
aaaaaaaatcatgtct

SEQ ID NO: 463098 - DNA, 16 bp, R. norvegicus
aaaaaaaatcattctg

SEQ ID NO: 463099 - DNA, 16 bp, R. norvegicus
aaaaaaaatccatggt

SEQ ID NO: 463100 - DNA, 16 bp, R. norvegicus
aaaaaaaatcttgttg

SEQ ID NO: 463101 - DNA, 16 bp, R. norvegicus
aaaaaaaatgctgtgt

SEQ ID NO: 463102 - DNA, 16 bp, R. norvegicus
aaaaaaaatgtctcca

SEQ ID NO: 463103 - DNA, 16 bp, R. norvegicus
aaaaaaaatgtctctg

SEQ ID NO: 463104 - DNA, 16 bp, R. norvegicus
aaaaaaaattctaagt

SEQ ID NO: 463105 - DNA, 16 bp, R. norvegicus
aaaaaaaattctgtaa

SEQ ID NO: 463106 - DNA, 16 bp, R. norvegicus
aaaaaaaattgtctta

SEQ ID NO: 463107 - DNA, 16 bp, R. norvegicus
aaaaaaacatcctgag

SEQ ID NO: 463108 - DNA, 16 bp, R. norvegicus
aaaaaaacatttcttt

SEQ ID NO: 463109 - DNA, 16 bp, R. norvegicus
aaaaaaaccctcaaga

SEQ ID NO: 463110 - DNA, 16 bp, R. norvegicus
aaaaaaacctgttttt

SEQ ID NO: 463111 - DNA, 16 bp, R. norvegicus
aaaaaaactgaaggag

SEQ ID NO: 463112 - DNA, 16 bp, R. norvegicus
aaaaaaagaaatgccc

SEQ ID NO: 463113 - DNA, 16 bp, R. norvegicus
aaaaaaagaatgctga

SEQ ID NO: 463114 - DNA, 16 bp, R. norvegicus
aaaaaaagactatttt

SEQ ID NO: 463115 - DNA, 16 bp, R. norvegicus
aaaaaaagagcactga

SEQ ID NO: 463116 - DNA, 16 bp, R. norvegicus
aaaaaaagatttcaga

SEQ ID NO: 463117 - DNA, 16 bp, R. norvegicus
aaaaaaagcacatgat

SEQ ID NO: 463118 - DNA, 16 bp, R. norvegicus
aaaaaaaggaccatag

SEQ ID NO: 463119 - DNA, 16 bp, R. norvegicus
aaaaaaagtgcatgct

SEQ ID NO: 463120 - DNA, 16 bp, R. norvegicus
aaaaaaatatttcctt

SEQ ID NO: 463121 - DNA, 16 bp, R. norvegicus
aaaaaaatcactggaa

SEQ ID NO: 463122 - DNA, 16 bp, R. norvegicus
aaaaaaatccccaaag

SEQ ID NO: 463123 - DNA, 16 bp, R. norvegicus
aaaaaaatccctttta

SEQ ID NO: 463124 - DNA, 16 bp, R. norvegicus
aaaaaaatcctgaaca

SEQ ID NO: 463125 - DNA, 16 bp, R. norvegicus
aaaaaaatctttttct

SEQ ID NO: 463126 - DNA, 16 bp, R. norvegicus
aaaaaaatgactttat

SEQ ID NO: 463127 - DNA, 16 bp, R. norvegicus
aaaaaaatgtattgtt

SEQ ID NO: 463128 - DNA, 16 bp, R. norvegicus
aaaaaaatgtattttc

SEQ ID NO: 463129 - DNA, 16 bp, R. norvegicus
aaaaaaatgtgatttt

SEQ ID NO: 463130 - DNA, 16 bp, R. norvegicus
aaaaaaatgtgtttat

SEQ ID NO: 463131 - DNA, 16 bp, R. norvegicus
aaaaaaatgtgttttt

SEQ ID NO: 463132 - DNA, 16 bp, R. norvegicus
aaaaaaatgtttttcc

SEQ ID NO: 463133 - DNA, 16 bp, R. norvegicus
aaaaaaattagtttct

SEQ ID NO: 463134 - DNA, 16 bp, R. norvegicus
aaaaaaattcaaagtt

SEQ ID NO: 463135 - DNA, 16 bp, R. norvegicus
aaaaaaattcttttct

SEQ ID NO: 463136 - DNA, 16 bp, R. norvegicus
aaaaaacagcattttc

SEQ ID NO: 463137 - DNA, 16 bp, R. norvegicus
aaaaaacccagcatag

SEQ ID NO: 463138 - DNA, 16 bp, R. norvegicus
aaaaaacccaggataa

SEQ ID NO: 463139 - DNA, 16 bp, R. norvegicus
aaaaaaccctgagatt

SEQ ID NO: 463140 - DNA, 16 bp, R. norvegicus
aaaaaactgcagggat

SEQ ID NO: 463141 - DNA, 16 bp, R. norvegicus
aaaaaactggaagagc

SEQ ID NO: 463142 - DNA, 16 bp, R. norvegicus
aaaaaacttgaaaatc

SEQ ID NO: 463143 - DNA, 16 bp, R. norvegicus
aaaaaagaaaatttcc

SEQ ID NO: 463144 - DNA, 16 bp, R. norvegicus
aaaaaagaaactgtct

SEQ ID NO: 463145 - DNA, 16 bp, R. norvegicus
aaaaaagaaagcatct

SEQ ID NO: 463146 - DNA, 16 bp, R. norvegicus
aaaaaagaaatctgac

SEQ ID NO: 463147 - DNA, 16 bp, R. norvegicus
aaaaaagaacttcaag

SEQ ID NO: 463148 - DNA, 16 bp, R. norvegicus
aaaaaagaatgtgttt

SEQ ID NO: 463149 - DNA, 16 bp, R. norvegicus
aaaaaagaattccagg

SEQ ID NO: 463150 - DNA, 16 bp, R. norvegicus
aaaaaagacttgcctt

SEQ ID NO: 463151 - DNA, 16 bp, R. norvegicus
aaaaaagagaacctca

SEQ ID NO: 463152 - DNA, 16 bp, R. norvegicus
aaaaaagagcccagga

SEQ ID NO: 463153 - DNA, 16 bp, R. norvegicus
aaaaaagagggctgga

SEQ ID NO: 463154 - DNA, 16 bp, R. norvegicus
aaaaaagagttgcctt

SEQ ID NO: 463155 - DNA, 16 bp, R. norvegicus
aaaaaagatatcattt

SEQ ID NO: 463156 - DNA, 16 bp, R. norvegicus
aaaaaagatgtatttt

SEQ ID NO: 463157 - DNA, 16 bp, R. norvegicus
aaaaaaggggttgggg

SEQ ID NO: 463158 - DNA, 16 bp, R. norvegicus
aaaaaagttttcaaaa

SEQ ID NO: 463159 - DNA, 16 bp, R. norvegicus
aaaaaatacatgatca

SEQ ID NO: 463160 - DNA, 16 bp, R. norvegicus
aaaaaataccttggtg

SEQ ID NO: 463161 - DNA, 16 bp, R. norvegicus
aaaaaatactgttttt

SEQ ID NO: 463162 - DNA, 16 bp, R. norvegicus
aaaaaatagacatttt

SEQ ID NO: 463163 - DNA, 16 bp, R. norvegicus
aaaaaatatttatgtg

SEQ ID NO: 463164 - DNA, 16 bp, R. norvegicus
aaaaaatattttccag

SEQ ID NO: 463165 - DNA, 16 bp, R. norvegicus
aaaaaatcaatgtttt

SEQ ID NO: 463166 - DNA, 16 bp, R. norvegicus
aaaaaatcatagctct

SEQ ID NO: 463167 - DNA, 16 bp, R. norvegicus
aaaaaatctcagaaga

SEQ ID NO: 463168 - DNA, 16 bp, R. norvegicus
aaaaaatctgtatttt

SEQ ID NO: 463169 - DNA, 16 bp, R. norvegicus
aaaaaatgacattttc

SEQ ID NO: 463170 - DNA, 16 bp, R. norvegicus
aaaaaatgcaggctga

SEQ ID NO: 463171 - DNA, 16 bp, R. norvegicus
aaaaaatggcatcatg

SEQ ID NO: 463172 - DNA, 16 bp, R. norvegicus
aaaaaatgttcatttt

SEQ ID NO: 463173 - DNA, 22 bp, R. norvegicus
aaaaaattaaagagctcaagga

SEQ ID NO: 463174 - DNA, 16 bp, R. norvegicus
aaaaaattctgaaaat

SEQ ID NO: 463175 - DNA, 16 bp, R. norvegicus
aaaaaattgttttctt

SEQ ID NO: 463176 - DNA, 16 bp, R. norvegicus
aaaaacaaaaccatgg

SEQ ID NO: 463177 - DNA, 16 bp, R. norvegicus
aaaaacaaattcagca

SEQ ID NO: 463178 - DNA, 16 bp, R. norvegicus
aaaaacaactttccaa

SEQ ID NO: 463179 - DNA, 16 bp, R. norvegicus
aaaaacaatgaattta

SEQ ID NO: 463180 - DNA, 16 bp, R. norvegicus
aaaaacaatgactttg

SEQ ID NO: 463181 - DNA, 16 bp, R. norvegicus
aaaaacaatgagttca

SEQ ID NO: 463182 - DNA, 16 bp, R. norvegicus
aaaaacaatggaggag

SEQ ID NO: 463183 - DNA, 16 bp, R. norvegicus
aaaaacaatggtttca

SEQ ID NO: 463184 - DNA, 16 bp, R. norvegicus
aaaaacacatggaaac

SEQ ID NO: 463185 - DNA, 16 bp, R. norvegicus
aaaaacacttattttt

SEQ ID NO: 463186 - DNA, 16 bp, R. norvegicus
aaaaacagaatctgaa

SEQ ID NO: 463187 - DNA, 16 bp, R. norvegicus
aaaaacagctttcaca

SEQ ID NO: 463188 - DNA, 16 bp, R. norvegicus
aaaaacagtgatttca

SEQ ID NO: 463189 - DNA, 16 bp, R. norvegicus
aaaaacataattccac

SEQ ID NO: 463190 - DNA, 16 bp, R. norvegicus
aaaaacatattcttca

SEQ ID NO: 463191 - DNA, 16 bp, R. norvegicus
aaaaacattgacttta

SEQ ID NO: 463192 - DNA, 16 bp, R. norvegicus
aaaaacatttatttca

SEQ ID NO: 463193 - DNA, 16 bp, R. norvegicus
aaaaacattttaaagg

SEQ ID NO: 463194 - DNA, 16 bp, R. norvegicus
aaaaacatttttcctt

SEQ ID NO: 463195 - DNA, 16 bp, R. norvegicus
aaaaaccacatgttca

SEQ ID NO: 463196 - DNA, 16 bp, R. norvegicus
aaaaaccacgtgatca

SEQ ID NO: 463197 - DNA, 16 bp, R. norvegicus
aaaaaccaggagctgg

SEQ ID NO: 463198 - DNA, 16 bp, R. norvegicus
aaaaaccatttattta

SEQ ID NO: 463199 - DNA, 16 bp, R. norvegicus
aaaaacccagaataat

SEQ ID NO: 463200 - DNA, 16 bp, R. norvegicus
aaaaaccccagtgcca

SEQ ID NO: 463201 - DNA, 16 bp, R. norvegicus
aaaaaccccttaaaga

SEQ ID NO: 463202 - DNA, 16 bp, R. norvegicus
aaaaaccctgtctcca

SEQ ID NO: 463203 - DNA, 16 bp, R. norvegicus
aaaaactaacagaagt

SEQ ID NO: 463204 - DNA, 16 bp, R. norvegicus
aaaaactacaggcatt

SEQ ID NO: 463205 - DNA, 16 bp, R. norvegicus
aaaaactcagatgaca

SEQ ID NO: 463206 - DNA, 16 bp, R. norvegicus
aaaaactctgtcttga

SEQ ID NO: 463207 - DNA, 16 bp, R. norvegicus
aaaaactgaaggagct

SEQ ID NO: 463208 - DNA, 120 bp, R. norvegicus
aaaaactgcatggtattggtacagagacagacagatagaccaatggaatagaattgaagacccagaaatgaacccacacacatatggtcacttgatttttgacaaaggagccaaaaccat

SEQ ID NO: 463209 - DNA, 16 bp, R. norvegicus
aaaaactggaaaggaa

SEQ ID NO: 463210 - DNA, 16 bp, R. norvegicus
aaaaacttgaagaaat

SEQ ID NO: 463211 - DNA, 16 bp, R. norvegicus
aaaaacttttaaaaag

SEQ ID NO: 463212 - DNA, 16 bp, R. norvegicus
aaaaactttttaaaag

SEQ ID NO: 463213 - DNA, 16 bp, R. norvegicus
aaaaagaaaaattctt

SEQ ID NO: 463214 - DNA, 16 bp, R. norvegicus
aaaaagaaaacctgtt

SEQ ID NO: 463215 - DNA, 16 bp, R. norvegicus
aaaaagaaaatctatg

SEQ ID NO: 463216 - DNA, 16 bp, R. norvegicus
aaaaagaaactgcaga

SEQ ID NO: 463217 - DNA, 16 bp, R. norvegicus
aaaaagaaaggtgggc

SEQ ID NO: 463218 - DNA, 16 bp, R. norvegicus
aaaaagaaagtgatgt

SEQ ID NO: 463219 - DNA, 16 bp, R. norvegicus
aaaaagaaatctgttt

SEQ ID NO: 463220 - DNA, 16 bp, R. norvegicus
aaaaagaaatgttctt

SEQ ID NO: 463221 - DNA, 16 bp, R. norvegicus
aaaaagaaatgtttct

SEQ ID NO: 463222 - DNA, 16 bp, R. norvegicus
aaaaagaaattgcttt

SEQ ID NO: 463223 - DNA, 16 bp, R. norvegicus
aaaaagaacttcagac

SEQ ID NO: 463224 - DNA, 16 bp, R. norvegicus
aaaaagaagaagctgg

SEQ ID NO: 463225 - DNA, 16 bp, R. norvegicus
aaaaagaagttcaaag

SEQ ID NO: 463226 - DNA, 16 bp, R. norvegicus
aaaaagaagttcaagg

SEQ ID NO: 463227 - DNA, 16 bp, R. norvegicus
aaaaagaagtttctct

SEQ ID NO: 463228 - DNA, 16 bp, R. norvegicus
aaaaagaatacacttg

SEQ ID NO: 463229 - DNA, 16 bp, R. norvegicus
aaaaagaatctttaaa

SEQ ID NO: 463230 - DNA, 16 bp, R. norvegicus
aaaaagaatgaggaca

SEQ ID NO: 463231 - DNA, 16 bp, R. norvegicus
aaaaagacacttttct

SEQ ID NO: 463232 - DNA, 16 bp, R. norvegicus
aaaaagaccttgtgtc

SEQ ID NO: 463233 - DNA, 25 bp, R. norvegicus
aaaaagacgtgaagaactcccttag

SEQ ID NO: 463234 - DNA, 16 bp, R. norvegicus
aaaaagactgaaggaa

SEQ ID NO: 463235 - DNA, 16 bp, R. norvegicus
aaaaagacttccaggg

SEQ ID NO: 463236 - DNA, 16 bp, R. norvegicus
aaaaagagaaatgttc

SEQ ID NO: 463237 - DNA, 48 bp, R. norvegicus
aaaaagagaacatgccagacacaaagtggttgtttaccaggctatgac

SEQ ID NO: 463238 - DNA, 16 bp, R. norvegicus
aaaaagagaatctcag

SEQ ID NO: 463239 - DNA, 16 bp, R. norvegicus
aaaaagagagagactg

SEQ ID NO: 463240 - DNA, 16 bp, R. norvegicus
aaaaagagcccagaac

SEQ ID NO: 463241 - DNA, 16 bp, R. norvegicus
aaaaagagtttatttt

SEQ ID NO: 463242 - DNA, 20 bp, R. norvegicus
aaaaagatagcattttcagg

SEQ ID NO: 463243 - DNA, 16 bp, R. norvegicus
aaaaagataggatttt

SEQ ID NO: 463244 - DNA, 16 bp, R. norvegicus
aaaaagatgaccataa

SEQ ID NO: 463245 - DNA, 16 bp, R. norvegicus
aaaaagatgatgatga

SEQ ID NO: 463246 - DNA, 16 bp, R. norvegicus
aaaaagattttccaag

SEQ ID NO: 463247 - DNA, 16 bp, R. norvegicus
aaaaagcactgactgc

SEQ ID NO: 463248 - DNA, 16 bp, R. norvegicus
aaaaagccaagtaaca

SEQ ID NO: 463249 - DNA, 81 bp, R. norvegicus
aaaaagctactggtccaaaacatacaggaaatccaggactcagtgagaagatcaaacctaaggataataggtatagaagag

SEQ ID NO: 463250 - DNA, 16 bp, R. norvegicus
aaaaagctgagaactg

SEQ ID NO: 463251 - DNA, 16 bp, R. norvegicus
aaaaagctggaagaag

SEQ ID NO: 463252 - DNA, 16 bp, R. norvegicus
aaaaagctggaggaag

SEQ ID NO: 463253 - DNA, 16 bp, R. norvegicus
aaaaaggaaaacattt

SEQ ID NO: 463254 - DNA, 16 bp, R. norvegicus
aaaaaggaagtctcaa

SEQ ID NO: 463255 - DNA, 16 bp, R. norvegicus
aaaaaggatgaccaaa

SEQ ID NO: 463256 - DNA, 16 bp, R. norvegicus
aaaaaggcattttctt

SEQ ID NO: 463257 - DNA, 16 bp, R. norvegicus
aaaaaggggctgggga

SEQ ID NO: 463258 - DNA, 20 bp, R. norvegicus
aaaaagggtacttctcccaa

SEQ ID NO: 463259 - DNA, 16 bp, R. norvegicus
aaaaaggtagcatttt

SEQ ID NO: 463260 - DNA, 16 bp, R. norvegicus
aaaaaggtattttttt

SEQ ID NO: 463261 - DNA, 16 bp, R. norvegicus
aaaaagtaacattttt

SEQ ID NO: 463262 - DNA, 16 bp, R. norvegicus
aaaaagtacagaacac

SEQ ID NO: 463263 - DNA, 16 bp, R. norvegicus
aaaaagtaccatgagg

SEQ ID NO: 463264 - DNA, 16 bp, R. norvegicus
aaaaagtattgttggt

SEQ ID NO: 463265 - DNA, 16 bp, R. norvegicus
aaaaagtcagagaagg

SEQ ID NO: 463266 - DNA, 16 bp, R. norvegicus
aaaaagtggggtagag

SEQ ID NO: 463267 - DNA, 16 bp, R. norvegicus
aaaaagttagcatttt

SEQ ID NO: 463268 - DNA, 16 bp, R. norvegicus
aaaaagttccaccaga

SEQ ID NO: 463269 - DNA, 16 bp, R. norvegicus
aaaaagttccccagat

SEQ ID NO: 463270 - DNA, 16 bp, R. norvegicus
aaaaagtttccctttt

SEQ ID NO: 463271 - DNA, 16 bp, R. norvegicus
aaaaataaaacttcag

SEQ ID NO: 463272 - DNA, 16 bp, R. norvegicus
aaaaataaaagctgca

SEQ ID NO: 463273 - DNA, 16 bp, R. norvegicus
aaaaataaaatgtgtg

SEQ ID NO: 463274 - DNA, 27 bp, R. norvegicus
aaaaataaaattgtcgccttgatcaga

SEQ ID NO: 463275 - DNA, 16 bp, R. norvegicus
aaaaataaagctattt

SEQ ID NO: 463276 - DNA, 16 bp, R. norvegicus
aaaaataaagtgtttt

SEQ ID NO: 463277 - DNA, 16 bp, R. norvegicus
aaaaataaatgtgtgt

SEQ ID NO: 463278 - DNA, 16 bp, R. norvegicus
aaaaataacttctttt

SEQ ID NO: 463279 - DNA, 16 bp, R. norvegicus
aaaaataattttgtgg

SEQ ID NO: 463280 - DNA, 16 bp, R. norvegicus
aaaaatacacactgga

SEQ ID NO: 463281 - DNA, 16 bp, R. norvegicus
aaaaatacagacagag

SEQ ID NO: 463282 - DNA, 16 bp, R. norvegicus
aaaaatacatagatta

SEQ ID NO: 463283 - DNA, 16 bp, R. norvegicus
aaaaataccagaaagc

SEQ ID NO: 463284 - DNA, 16 bp, R. norvegicus
aaaaatacccaattta

SEQ ID NO: 463285 - DNA, 16 bp, R. norvegicus
aaaaatagggtttttt

SEQ ID NO: 463286 - DNA, 16 bp, R. norvegicus
aaaaatatatttcaga

SEQ ID NO: 463287 - DNA, 16 bp, R. norvegicus
aaaaatatcatcctga

SEQ ID NO: 463288 - DNA, 16 bp, R. norvegicus
aaaaatatgatcatct

SEQ ID NO: 463289 - DNA, 16 bp, R. norvegicus
aaaaatattacctcaa

SEQ ID NO: 463290 - DNA, 16 bp, R. norvegicus
aaaaatatttgttttg

SEQ ID NO: 463291 - DNA, 16 bp, R. norvegicus
aaaaatattttcaaga

SEQ ID NO: 463292 - DNA, 16 bp, R. norvegicus
aaaaatatttttgttc

SEQ ID NO: 463293 - DNA, 16 bp, R. norvegicus
aaaaatcaaaatggca

SEQ ID NO: 463294 - DNA, 16 bp, R. norvegicus
aaaaatcaagtgagca

SEQ ID NO: 463295 - DNA, 16 bp, R. norvegicus
aaaaatcacaaggagg

SEQ ID NO: 463296 - DNA, 16 bp, R. norvegicus
aaaaatcacatctcat

SEQ ID NO: 463297 - DNA, 16 bp, R. norvegicus
aaaaatcagaagttca

SEQ ID NO: 463298 - DNA, 16 bp, R. norvegicus
aaaaatcagatgaaga

SEQ ID NO: 463299 - DNA, 17 bp, R. norvegicus
aaaaatcagggactaga

SEQ ID NO: 463300 - DNA, 16 bp, R. norvegicus
aaaaatcatgttttat

SEQ ID NO: 463301 - DNA, 16 bp, R. norvegicus
aaaaatcatttctttt

SEQ ID NO: 463302 - DNA, 16 bp, R. norvegicus
aaaaatccaaaatctc

SEQ ID NO: 463303 - DNA, 34 bp, R. norvegicus
aaaaatccctgaaagaatatcaggaaatcataaa

SEQ ID NO: 463304 - DNA, 16 bp, R. norvegicus
aaaaatccctggaaga

SEQ ID NO: 463305 - DNA, 16 bp, R. norvegicus
aaaaatcccttaaaga

SEQ ID NO: 463306 - DNA, 16 bp, R. norvegicus
aaaaatcctgaaaata

SEQ ID NO: 463307 - DNA, 17 bp, R. norvegicus
aaaaatccttgaaagaa

SEQ ID NO: 463308 - DNA, 16 bp, R. norvegicus
aaaaatcctttgacaa

SEQ ID NO: 463309 - DNA, 16 bp, R. norvegicus
aaaaatcgaaatgtaa

SEQ ID NO: 463310 - DNA, 16 bp, R. norvegicus
aaaaatctctctatgg

SEQ ID NO: 463311 - DNA, 16 bp, R. norvegicus
aaaaatctgaatgaaa

SEQ ID NO: 463312 - DNA, 16 bp, R. norvegicus
aaaaatctgccaagat

SEQ ID NO: 463313 - DNA, 16 bp, R. norvegicus
aaaaatctgttttctt

SEQ ID NO: 463314 - DNA, 16 bp, R. norvegicus
aaaaatcttggaaaaa

SEQ ID NO: 463315 - DNA, 16 bp, R. norvegicus
aaaaatgaccatctta

SEQ ID NO: 463316 - DNA, 16 bp, R. norvegicus
aaaaatgagattcaga

SEQ ID NO: 463317 - DNA, 16 bp, R. norvegicus
aaaaatgattcatttt

SEQ ID NO: 463318 - DNA, 16 bp, R. norvegicus
aaaaatgattttcttt

SEQ ID NO: 463319 - DNA, 16 bp, R. norvegicus
aaaaatgcagagaaca

SEQ ID NO: 463320 - DNA, 16 bp, R. norvegicus
aaaaatgcaggaaaac

SEQ ID NO: 463321 - DNA, 16 bp, R. norvegicus
aaaaatgccaacagcc

SEQ ID NO: 463322 - DNA, 16 bp, R. norvegicus
aaaaatgccaagcaac

SEQ ID NO: 463323 - DNA, 16 bp, R. norvegicus
aaaaatgcccatttta

SEQ ID NO: 463324 - DNA, 16 bp, R. norvegicus
aaaaatgccttaaaga

SEQ ID NO: 463325 - DNA, 16 bp, R. norvegicus
aaaaatgctacataaa

SEQ ID NO: 463326 - DNA, 16 bp, R. norvegicus
aaaaatgctcacagga

SEQ ID NO: 463327 - DNA, 16 bp, R. norvegicus
aaaaatgctttaaaga

SEQ ID NO: 463328 - DNA, 16 bp, R. norvegicus
aaaaatgcttttaaaa

SEQ ID NO: 463329 - DNA, 16 bp, R. norvegicus
aaaaatggacattttt

SEQ ID NO: 463330 - DNA, 16 bp, R. norvegicus
aaaaatggggaagagc

SEQ ID NO: 463331 - DNA, 47 bp, R. norvegicus
aaaaatggggctcagagctaaacaaagaattcacagctgaggaatgc

SEQ ID NO: 463332 - DNA, 47 bp, R. norvegicus
aaaaatggggttcagagctaaacaaagaattcacagctgaggaatgc

SEQ ID NO: 463333 - DNA, 56 bp, R. norvegicus
aaaaatggggttcagagctgaacaaagaattcacagctgaggaatgccgaatggct

SEQ ID NO: 463334 - DNA, 16 bp, R. norvegicus
aaaaatgtatattttg

SEQ ID NO: 463335 - DNA, 16 bp, R. norvegicus
aaaaatgtatcttttt

SEQ ID NO: 463336 - DNA, 16 bp, R. norvegicus
aaaaatgtatttttct

SEQ ID NO: 463337 - DNA, 16 bp, R. norvegicus
aaaaatgtcagaaatt

SEQ ID NO: 463338 - DNA, 16 bp, R. norvegicus
aaaaatgtcattaaaa

SEQ ID NO: 463339 - DNA, 22 bp, R. norvegicus
aaaaatgtggtacatctacaca

SEQ ID NO: 463340 - DNA, 16 bp, R. norvegicus
aaaaatgtgtgtatgt

SEQ ID NO: 463341 - DNA, 16 bp, R. norvegicus
aaaaatgttcattttg

SEQ ID NO: 463342 - DNA, 16 bp, R. norvegicus
aaaaatgtttacatta

SEQ ID NO: 463343 - DNA, 16 bp, R. norvegicus
aaaaatgtttattctt

SEQ ID NO: 463344 - DNA, 16 bp, R. norvegicus
aaaaatgtttatttca

SEQ ID NO: 463345 - DNA, 16 bp, R. norvegicus
aaaaatgttttaaatg

SEQ ID NO: 463346 - DNA, 16 bp, R. norvegicus
aaaaatgttttatgta

SEQ ID NO: 463347 - DNA, 16 bp, R. norvegicus
aaaaattaaagccata

SEQ ID NO: 463348 - DNA, 16 bp, R. norvegicus
aaaaattaaagtcatt

SEQ ID NO: 463349 - DNA, 16 bp, R. norvegicus
aaaaattaatcttctt

SEQ ID NO: 463350 - DNA, 16 bp, R. norvegicus
aaaaattacaattatg

SEQ ID NO: 463351 - DNA, 16 bp, R. norvegicus
aaaaattacatgaaat

SEQ ID NO: 463352 - DNA, 16 bp, R. norvegicus
aaaaattaggaattca

SEQ ID NO: 463353 - DNA, 16 bp, R. norvegicus
aaaaattagggaaaca

SEQ ID NO: 463354 - DNA, 16 bp, R. norvegicus
aaaaattatatgtatg

SEQ ID NO: 463355 - DNA, 16 bp, R. norvegicus
aaaaattcagaaatgt

SEQ ID NO: 463356 - DNA, 16 bp, R. norvegicus
aaaaattcatcaagat

SEQ ID NO: 463357 - DNA, 16 bp, R. norvegicus
aaaaattcatcagatc

SEQ ID NO: 463358 - DNA, 16 bp, R. norvegicus
aaaaattccagcagag

SEQ ID NO: 463359 - DNA, 16 bp, R. norvegicus
aaaaattctttaaaag

SEQ ID NO: 463360 - DNA, 16 bp, R. norvegicus
aaaaattgtatttgtt

SEQ ID NO: 463361 - DNA, 16 bp, R. norvegicus
aaaaattgtgtgtgtg

SEQ ID NO: 463362 - DNA, 16 bp, R. norvegicus
aaaaatttaaaaaggc

SEQ ID NO: 463363 - DNA, 16 bp, R. norvegicus
aaaacaaaaaacctgt

SEQ ID NO: 463364 - DNA, 16 bp, R. norvegicus
aaaacaaaaacagttg

SEQ ID NO: 463365 - DNA, 16 bp, R. norvegicus
aaaacaaacctttctt

SEQ ID NO: 463366 - DNA, 16 bp, R. norvegicus
aaaacaaagacaccat

SEQ ID NO: 463367 - DNA, 16 bp, R. norvegicus
aaaacaaagagcattt

SEQ ID NO: 463368 - DNA, 16 bp, R. norvegicus
aaaacaaagatggcgc

SEQ ID NO: 463369 - DNA, 16 bp, R. norvegicus
aaaacaaagtttgttt

SEQ ID NO: 463370 - DNA, 16 bp, R. norvegicus
aaaacaaatatggaat

SEQ ID NO: 463371 - DNA, 16 bp, R. norvegicus
aaaacaaatctttcct

SEQ ID NO: 463372 - DNA, 16 bp, R. norvegicus
aaaacaaatgtgtttt

SEQ ID NO: 463373 - DNA, 16 bp, R. norvegicus
aaaacaaatgttttat

SEQ ID NO: 463374 - DNA, 16 bp, R. norvegicus
aaaacaaatgttttct

SEQ ID NO: 463375 - DNA, 16 bp, R. norvegicus
aaaacaaattcttcct

SEQ ID NO: 463376 - DNA, 16 bp, R. norvegicus
aaaacaaattgaaatt

SEQ ID NO: 463377 - DNA, 16 bp, R. norvegicus
aaaacaacaaatgcca

SEQ ID NO: 463378 - DNA, 16 bp, R. norvegicus
aaaacaacaacttcat

SEQ ID NO: 463379 - DNA, 16 bp, R. norvegicus
aaaacaacaaggcagg

SEQ ID NO: 463380 - DNA, 16 bp, R. norvegicus
aaaacaacttaaagga

SEQ ID NO: 463381 - DNA, 16 bp, R. norvegicus
aaaacaacttagggaa

SEQ ID NO: 463382 - DNA, 16 bp, R. norvegicus
aaaacaactttgaaaa

SEQ ID NO: 463383 - DNA, 16 bp, R. norvegicus
aaaacaagaagagagt

SEQ ID NO: 463384 - DNA, 16 bp, R. norvegicus
aaaacaagatatttca

SEQ ID NO: 463385 - DNA, 16 bp, R. norvegicus
aaaacaaggacttcat

SEQ ID NO: 463386 - DNA, 16 bp, R. norvegicus
aaaacaatcatcagat

SEQ ID NO: 463387 - DNA, 16 bp, R. norvegicus
aaaacaatgactccat

SEQ ID NO: 463388 - DNA, 16 bp, R. norvegicus
aaaacaatgacttcct

SEQ ID NO: 463389 - DNA, 16 bp, R. norvegicus
aaaacaatgtattttt

SEQ ID NO: 463390 - DNA, 16 bp, R. norvegicus
aaaacaatttcatgaa

SEQ ID NO: 463391 - DNA, 16 bp, R. norvegicus
aaaacacaaaaagttc

SEQ ID NO: 463392 - DNA, 16 bp, R. norvegicus
aaaacacagattttta

SEQ ID NO: 463393 - DNA, 16 bp, R. norvegicus
aaaacacagttaaaca

SEQ ID NO: 463394 - DNA, 16 bp, R. norvegicus
aaaacacatgcaaaca

SEQ ID NO: 463395 - DNA, 16 bp, R. norvegicus
aaaacacattcttttt

SEQ ID NO: 463396 - DNA, 16 bp, R. norvegicus
aaaacaccaaatggac

SEQ ID NO: 463397 - DNA, 16 bp, R. norvegicus
aaaacaccagaaaatg

SEQ ID NO: 463398 - DNA, 16 bp, R. norvegicus
aaaacactgagaaaat

SEQ ID NO: 463399 - DNA, 16 bp, R. norvegicus
aaaacactggctgctc

SEQ ID NO: 463400 - DNA, 16 bp, R. norvegicus
aaaacagaaaacattt

SEQ ID NO: 463401 - DNA, 16 bp, R. norvegicus
aaaacagaaatatttt

SEQ ID NO: 463402 - DNA, 16 bp, R. norvegicus
aaaacagaaatggaag

SEQ ID NO: 463403 - DNA, 16 bp, R. norvegicus
aaaacagagaatctta

SEQ ID NO: 463404 - DNA, 16 bp, R. norvegicus
aaaacagagagtgaag

SEQ ID NO: 463405 - DNA, 16 bp, R. norvegicus
aaaacagatgcagaaa

SEQ ID NO: 463406 - DNA, 16 bp, R. norvegicus
aaaacagattcagaag

SEQ ID NO: 463407 - DNA, 16 bp, R. norvegicus
aaaacagcaaagcttc

SEQ ID NO: 463408 - DNA, 16 bp, R. norvegicus
aaaacagcagcagcag

SEQ ID NO: 463409 - DNA, 16 bp, R. norvegicus
aaaacagcttcaggaa

SEQ ID NO: 463410 - DNA, 16 bp, R. norvegicus
aaaacaggaaaacagt

SEQ ID NO: 463411 - DNA, 16 bp, R. norvegicus
aaaacaggccatctaa

SEQ ID NO: 463412 - DNA, 16 bp, R. norvegicus
aaaacaggtctacatc

SEQ ID NO: 463413 - DNA, 16 bp, R. norvegicus
aaaacagtgacatcat

SEQ ID NO: 463414 - DNA, 16 bp, R. norvegicus
aaaacagtggctctca

SEQ ID NO: 463415 - DNA, 16 bp, R. norvegicus
aaaacatacatgatat

SEQ ID NO: 463416 - DNA, 16 bp, R. norvegicus
aaaacatagaggaaat

SEQ ID NO: 463417 - DNA, 16 bp, R. norvegicus
aaaacatatgatcatt

SEQ ID NO: 463418 - DNA, 16 bp, R. norvegicus
aaaacatcagaaagcc

SEQ ID NO: 463419 - DNA, 16 bp, R. norvegicus
aaaacatccagaaaac

SEQ ID NO: 463420 - DNA, 16 bp, R. norvegicus
aaaacatccaggaaat

SEQ ID NO: 463421 - DNA, 16 bp, R. norvegicus
aaaacatcctgaccaa

SEQ ID NO: 463422 - DNA, 16 bp, R. norvegicus
aaaacatgatttaaaa

SEQ ID NO: 463423 - DNA, 16 bp, R. norvegicus
aaaacatgatttcaaa

SEQ ID NO: 463424 - DNA, 16 bp, R. norvegicus
aaaacatgcagaaaat

SEQ ID NO: 463425 - DNA, 16 bp, R. norvegicus
aaaacattatgaccaa

SEQ ID NO: 463426 - DNA, 16 bp, R. norvegicus
aaaacattcacatttt

SEQ ID NO: 463427 - DNA, 16 bp, R. norvegicus
aaaacatttaaaagga

SEQ ID NO: 463428 - DNA, 16 bp, R. norvegicus
aaaacatttatgaaaa

SEQ ID NO: 463429 - DNA, 16 bp, R. norvegicus
aaaacatttcattgtg

SEQ ID NO: 463430 - DNA, 16 bp, R. norvegicus
aaaacatttgacaaaa

SEQ ID NO: 463431 - DNA, 16 bp, R. norvegicus
aaaacattttaagaaa

SEQ ID NO: 463432 - DNA, 16 bp, R. norvegicus
aaaacattttagaaat

SEQ ID NO: 463433 - DNA, 16 bp, R. norvegicus
aaaacattttcagaaa

SEQ ID NO: 463434 - DNA, 16 bp, R. norvegicus
aaaacattttcatatt

SEQ ID NO: 463435 - DNA, 16 bp, R. norvegicus
aaaacatttttaaaga

SEQ ID NO: 463436 - DNA, 16 bp, R. norvegicus
aaaacattttttcaaa

SEQ ID NO: 463437 - DNA, 16 bp, R. norvegicus
aaaaccaaatgtacac

SEQ ID NO: 463438 - DNA, 16 bp, R. norvegicus
aaaaccaaatttacac

SEQ ID NO: 463439 - DNA, 16 bp, R. norvegicus
aaaaccaaccagagct

SEQ ID NO: 463440 - DNA, 16 bp, R. norvegicus
aaaaccaagttgggga

SEQ ID NO: 463441 - DNA, 16 bp, R. norvegicus
aaaaccacaatgagct

SEQ ID NO: 463442 - DNA, 16 bp, R. norvegicus
aaaaccacacccctgc

SEQ ID NO: 463443 - DNA, 16 bp, R. norvegicus
aaaaccagagccacat

SEQ ID NO: 463444 - DNA, 16 bp, R. norvegicus
aaaaccagatacaatg

SEQ ID NO: 463445 - DNA, 16 bp, R. norvegicus
aaaaccagcagtctca

SEQ ID NO: 463446 - DNA, 16 bp, R. norvegicus
aaaaccagggacaaga

SEQ ID NO: 463447 - DNA, 16 bp, R. norvegicus
aaaaccaggtgctggt

SEQ ID NO: 463448 - DNA, 16 bp, R. norvegicus
aaaaccatttttttct

SEQ ID NO: 463449 - DNA, 16 bp, R. norvegicus
aaaacccaaactgaaa

SEQ ID NO: 463450 - DNA, 16 bp, R. norvegicus
aaaaccccaaaatgga

SEQ ID NO: 463451 - DNA, 16 bp, R. norvegicus
aaaaccctgtctccaa

SEQ ID NO: 463452 - DNA, 16 bp, R. norvegicus
aaaaccgaattcaaga

SEQ ID NO: 463453 - DNA, 16 bp, R. norvegicus
aaaaccggaagagtct

SEQ ID NO: 463454 - DNA, 16 bp, R. norvegicus
aaaacctaagaataat

SEQ ID NO: 463455 - DNA, 16 bp, R. norvegicus
aaaacctacaggaaat

SEQ ID NO: 463456 - DNA, 16 bp, R. norvegicus
aaaacctagagaagag

SEQ ID NO: 463457 - DNA, 16 bp, R. norvegicus
aaaacctcaagaaact

SEQ ID NO: 463458 - DNA, 16 bp, R. norvegicus
aaaacctccaggaaat

SEQ ID NO: 463459 - DNA, 16 bp, R. norvegicus
aaaacctgggtcctct

SEQ ID NO: 463460 - DNA, 16 bp, R. norvegicus
aaaacctgtaaatatt

SEQ ID NO: 463461 - DNA, 16 bp, R. norvegicus
aaaaccttcagcaaag

SEQ ID NO: 463462 - DNA, 16 bp, R. norvegicus
aaaacgaagcaaatac

SEQ ID NO: 463463 - DNA, 16 bp, R. norvegicus
aaaacggaggaggcag

SEQ ID NO: 463464 - DNA, 16 bp, R. norvegicus
aaaactaaaggagatc

SEQ ID NO: 463465 - DNA, 16 bp, R. norvegicus
aaaactaaatcaggta

SEQ ID NO: 463466 - DNA, 16 bp, R. norvegicus
aaaactaatcagaaga

SEQ ID NO: 463467 - DNA, 16 bp, R. norvegicus
aaaactacacagagaa

SEQ ID NO: 463468 - DNA, 16 bp, R. norvegicus
aaaactataccatcag

SEQ ID NO: 463469 - DNA, 16 bp, R. norvegicus
aaaactatcaatgtga

SEQ ID NO: 463470 - DNA, 16 bp, R. norvegicus
aaaactatcctaaaca

SEQ ID NO: 463471 - DNA, 16 bp, R. norvegicus
aaaactattttcatta

SEQ ID NO: 463472 - DNA, 16 bp, R. norvegicus
aaaactcaagtccaaa

SEQ ID NO: 463473 - DNA, 16 bp, R. norvegicus
aaaactcaggtgacaa

SEQ ID NO: 463474 - DNA, 16 bp, R. norvegicus
aaaactccagcacaag

SEQ ID NO: 463475 - DNA, 16 bp, R. norvegicus
aaaactctaccaagat

SEQ ID NO: 463476 - DNA, 17 bp, R. norvegicus
aaaactctcaattacca

SEQ ID NO: 463477 - DNA, 16 bp, R. norvegicus
aaaactcttcaacgaa

SEQ ID NO: 463478 - DNA, 16 bp, R. norvegicus
aaaactgactcctaca

SEQ ID NO: 463479 - DNA, 16 bp, R. norvegicus
aaaactgactttccaa

SEQ ID NO: 463480 - DNA, 16 bp, R. norvegicus
aaaactgactttcctt

SEQ ID NO: 463481 - DNA, 16 bp, R. norvegicus
aaaactgagtccaaaa

SEQ ID NO: 463482 - DNA, 16 bp, R. norvegicus
aaaactgcaaaagaac

SEQ ID NO: 463483 - DNA, 16 bp, R. norvegicus
aaaactgcagttatac

SEQ ID NO: 463484 - DNA, 16 bp, R. norvegicus
aaaactggaaaagctg

SEQ ID NO: 463485 - DNA, 16 bp, R. norvegicus
aaaactggaaaatctg

SEQ ID NO: 463486 - DNA, 16 bp, R. norvegicus
aaaactggatgaaatg

SEQ ID NO: 463487 - DNA, 16 bp, R. norvegicus
aaaactggcttccagg

SEQ ID NO: 463488 - DNA, 16 bp, R. norvegicus
aaaactggttttctac

SEQ ID NO: 463489 - DNA, 21 bp, R. norvegicus
aaaactgtataaggcctctgg

SEQ ID NO: 463490 - DNA, 16 bp, R. norvegicus
aaaactgtatggcatt

SEQ ID NO: 463491 - DNA, 16 bp, R. norvegicus
aaaacttccaccagag

SEQ ID NO: 463492 - DNA, 16 bp, R. norvegicus
aaaacttgaaaaactg

SEQ ID NO: 463493 - DNA, 16 bp, R. norvegicus
aaaactttaaaatctt

SEQ ID NO: 463494 - DNA, 16 bp, R. norvegicus
aaaactttaagacact

SEQ ID NO: 463495 - DNA, 16 bp, R. norvegicus
aaaacttttcctgggg

SEQ ID NO: 463496 - DNA, 16 bp, R. norvegicus
aaaagaaaaaatgtct

SEQ ID NO: 463497 - DNA, 16 bp, R. norvegicus
aaaagaaaaaattctt

SEQ ID NO: 463498 - DNA, 16 bp, R. norvegicus
aaaagaaaaacctcag

SEQ ID NO: 463499 - DNA, 16 bp, R. norvegicus
aaaagaaaaagaggct

SEQ ID NO: 463500 - DNA, 16 bp, R. norvegicus
aaaagaaaaatctgtt

SEQ ID NO: 463501 - DNA, 16 bp, R. norvegicus
aaaagaaaaattttca

SEQ ID NO: 463502 - DNA, 16 bp, R. norvegicus
aaaagaaaacccacat

SEQ ID NO: 463503 - DNA, 16 bp, R. norvegicus
aaaagaaaactggagg

SEQ ID NO: 463504 - DNA, 16 bp, R. norvegicus
aaaagaaaacttttaa

SEQ ID NO: 463505 - DNA, 16 bp, R. norvegicus
aaaagaaaatactctt

SEQ ID NO: 463506 - DNA, 16 bp, R. norvegicus
aaaagaaaatattttc

SEQ ID NO: 463507 - DNA, 16 bp, R. norvegicus
aaaagaaaattattct

SEQ ID NO: 463508 - DNA, 16 bp, R. norvegicus
aaaagaaaatttacta

SEQ ID NO: 463509 - DNA, 16 bp, R. norvegicus
aaaagaaaatttccta

SEQ ID NO: 463510 - DNA, 16 bp, R. norvegicus
aaaagaaacacctcca

SEQ ID NO: 463511 - DNA, 16 bp, R. norvegicus
aaaagaaacattttaa

SEQ ID NO: 463512 - DNA, 16 bp, R. norvegicus
aaaagaaaccaagact

SEQ ID NO: 463513 - DNA, 16 bp, R. norvegicus
aaaagaaaccttatta

SEQ ID NO: 463514 - DNA, 16 bp, R. norvegicus
aaaagaaactgaagag

SEQ ID NO: 463515 - DNA, 16 bp, R. norvegicus
aaaagaaactgggaag

SEQ ID NO: 463516 - DNA, 16 bp, R. norvegicus
aaaagaaacttgagga

SEQ ID NO: 463517 - DNA, 16 bp, R. norvegicus
aaaagaaagaaactgt

SEQ ID NO: 463518 - DNA, 16 bp, R. norvegicus
aaaagaaagaaatgct

SEQ ID NO: 463519 - DNA, 16 bp, R. norvegicus
aaaagaaagaatttgt

SEQ ID NO: 463520 - DNA, 16 bp, R. norvegicus
aaaagaaagacagatg

SEQ ID NO: 463521 - DNA, 16 bp, R. norvegicus
aaaagaaagagaactt

SEQ ID NO: 463522 - DNA, 16 bp, R. norvegicus
aaaagaaagcttcttc

SEQ ID NO: 463523 - DNA, 16 bp, R. norvegicus
aaaagaaagctttttt

SEQ ID NO: 463524 - DNA, 16 bp, R. norvegicus
aaaagaaatcacagga

SEQ ID NO: 463525 - DNA, 16 bp, R. norvegicus
aaaagaaatccctcct

SEQ ID NO: 463526 - DNA, 16 bp, R. norvegicus
aaaagaaatctatttt

SEQ ID NO: 463527 - DNA, 16 bp, R. norvegicus
aaaagaaatcttactg

SEQ ID NO: 463528 - DNA, 16 bp, R. norvegicus
aaaagaaatgcagtga

SEQ ID NO: 463529 - DNA, 16 bp, R. norvegicus
aaaagaaatgttttta

SEQ ID NO: 463530 - DNA, 16 bp, R. norvegicus
aaaagaaattcaggaa

SEQ ID NO: 463531 - DNA, 16 bp, R. norvegicus
aaaagaaattcttcct

SEQ ID NO: 463532 - DNA, 16 bp, R. norvegicus
aaaagaacacacaggg

SEQ ID NO: 463533 - DNA, 16 bp, R. norvegicus
aaaagaacagcagata

SEQ ID NO: 463534 - DNA, 16 bp, R. norvegicus
aaaagaacaggaattc

SEQ ID NO: 463535 - DNA, 16 bp, R. norvegicus
aaaagaactacaggga

SEQ ID NO: 463536 - DNA, 16 bp, R. norvegicus
aaaagaacttccagag

SEQ ID NO: 463537 - DNA, 16 bp, R. norvegicus
aaaagaacttctgaag

SEQ ID NO: 463538 - DNA, 16 bp, R. norvegicus
aaaagaacttcttgag

SEQ ID NO: 463539 - DNA, 16 bp, R. norvegicus
aaaagaagaagaagct

SEQ ID NO: 463540 - DNA, 16 bp, R. norvegicus
aaaagaagaggaagct

SEQ ID NO: 463541 - DNA, 16 bp, R. norvegicus
aaaagaagcaaattca

SEQ ID NO: 463542 - DNA, 16 bp, R. norvegicus
aaaagaagcaagtaca

SEQ ID NO: 463543 - DNA, 16 bp, R. norvegicus
aaaagaagcccttggt

SEQ ID NO: 463544 - DNA, 16 bp, R. norvegicus
aaaagaaggcatcaga

SEQ ID NO: 463545 - DNA, 16 bp, R. norvegicus
aaaagaaggggctggg

SEQ ID NO: 463546 - DNA, 16 bp, R. norvegicus
aaaagaagtcaaagta

SEQ ID NO: 463547 - DNA, 16 bp, R. norvegicus
aaaagaagttggagat

SEQ ID NO: 463548 - DNA, 16 bp, R. norvegicus
aaaagaataaggcaga

SEQ ID NO: 463549 - DNA, 16 bp, R. norvegicus
aaaagaatctgaagaa

SEQ ID NO: 463550 - DNA, 16 bp, R. norvegicus
aaaagaattcagaaat

SEQ ID NO: 463551 - DNA, 20 bp, R. norvegicus
aaaagaattccaggaaaaca

SEQ ID NO: 463552 - DNA, 16 bp, R. norvegicus
aaaagacagaattttc

SEQ ID NO: 463553 - DNA, 16 bp, R. norvegicus
aaaagacattttaaat

SEQ ID NO: 463554 - DNA, 18 bp, R. norvegicus
aaaagaccttgacacttt

SEQ ID NO: 463555 - DNA, 16 bp, R. norvegicus
aaaagactcagagaca

SEQ ID NO: 463556 - DNA, 16 bp, R. norvegicus
aaaagactttttagaa

SEQ ID NO: 463557 - DNA, 16 bp, R. norvegicus
aaaagagaaacaggct

SEQ ID NO: 463558 - DNA, 16 bp, R. norvegicus
aaaagagaacatgaag

SEQ ID NO: 463559 - DNA, 16 bp, R. norvegicus
aaaagagaacttcaga

SEQ ID NO: 463560 - DNA, 16 bp, R. norvegicus
aaaagagcccaggaca

SEQ ID NO: 463561 - DNA, 16 bp, R. norvegicus
aaaagagcctgaggaa

SEQ ID NO: 463562 - DNA, 16 bp, R. norvegicus
aaaagaggtcaagggg

SEQ ID NO: 463563 - DNA, 16 bp, R. norvegicus
aaaagagtccaagaaa

SEQ ID NO: 463564 - DNA, 16 bp, R. norvegicus
aaaagatcttgaccaa

SEQ ID NO: 463565 - DNA, 16 bp, R. norvegicus
aaaagatctttatcaa

SEQ ID NO: 463566 - DNA, 16 bp, R. norvegicus
aaaagatgatttattt

SEQ ID NO: 463567 - DNA, 16 bp, R. norvegicus
aaaagatgcccaacat

SEQ ID NO: 463568 - DNA, 18 bp, R. norvegicus
aaaagatgccccaatata

SEQ ID NO: 463569 - DNA, 16 bp, R. norvegicus
aaaagatggaaaactc

SEQ ID NO: 463570 - DNA, 16 bp, R. norvegicus
aaaagatggagcaatt

SEQ ID NO: 463571 - DNA, 16 bp, R. norvegicus
aaaagatgttccaaaa

SEQ ID NO: 463572 - DNA, 16 bp, R. norvegicus
aaaagattaactttct

SEQ ID NO: 463573 - DNA, 16 bp, R. norvegicus
aaaagattaatttctt

SEQ ID NO: 463574 - DNA, 16 bp, R. norvegicus
aaaagatttcagaaga

SEQ ID NO: 463575 - DNA, 16 bp, R. norvegicus
aaaagattttccaagc

SEQ ID NO: 463576 - DNA, 16 bp, R. norvegicus
aaaagcaaactgagca

SEQ ID NO: 463577 - DNA, 16 bp, R. norvegicus
aaaagcaaagacatca

SEQ ID NO: 463578 - DNA, 16 bp, R. norvegicus
aaaagcaaatatatat

SEQ ID NO: 463579 - DNA, 16 bp, R. norvegicus
aaaagcaacttgagaa

SEQ ID NO: 463580 - DNA, 16 bp, R. norvegicus
aaaagcaacttgagga

SEQ ID NO: 463581 - DNA, 16 bp, R. norvegicus
aaaagcaagagagtaa

SEQ ID NO: 463582 - DNA, 16 bp, R. norvegicus
aaaagcaagctgaaca

SEQ ID NO: 463583 - DNA, 16 bp, R. norvegicus
aaaagcaagctggagt

SEQ ID NO: 463584 - DNA, 16 bp, R. norvegicus
aaaagcaaggaagtaa

SEQ ID NO: 463585 - DNA, 16 bp, R. norvegicus
aaaagcaaggtttaga

SEQ ID NO: 463586 - DNA, 16 bp, R. norvegicus
aaaagcaatctccaga

SEQ ID NO: 463587 - DNA, 16 bp, R. norvegicus
aaaagcaatttgaaaa

SEQ ID NO: 463588 - DNA, 16 bp, R. norvegicus
aaaagcaatttgcaga

SEQ ID NO: 463589 - DNA, 16 bp, R. norvegicus
aaaagcacttactgct

SEQ ID NO: 463590 - DNA, 16 bp, R. norvegicus
aaaagcacttggtcct

SEQ ID NO: 463591 - DNA, 16 bp, R. norvegicus
aaaagcagaaagtgct

SEQ ID NO: 463592 - DNA, 16 bp, R. norvegicus
aaaagcaggagctggt

SEQ ID NO: 463593 - DNA, 16 bp, R. norvegicus
aaaagcaggaggcaga

SEQ ID NO: 463594 - DNA, 16 bp, R. norvegicus
aaaagcaggccctgga

SEQ ID NO: 463595 - DNA, 16 bp, R. norvegicus
aaaagcatattaatag

SEQ ID NO: 463596 - DNA, 16 bp, R. norvegicus
aaaagcattggattcc

SEQ ID NO: 463597 - DNA, 16 bp, R. norvegicus
aaaagcattttcaaaa

SEQ ID NO: 463598 - DNA, 17 bp, R. norvegicus
aaaagccaccaagatga

SEQ ID NO: 463599 - DNA, 16 bp, R. norvegicus
aaaagccagaaggtcc

SEQ ID NO: 463600 - DNA, 16 bp, R. norvegicus
aaaagccaggatagca

SEQ ID NO: 463601 - DNA, 16 bp, R. norvegicus
aaaagccattggtgtt

SEQ ID NO: 463602 - DNA, 16 bp, R. norvegicus
aaaagcccaagagaag

SEQ ID NO: 463603 - DNA, 16 bp, R. norvegicus
aaaagcccagagccag

SEQ ID NO: 463604 - DNA, 17 bp, R. norvegicus
aaaagccctaaatacct

SEQ ID NO: 463605 - DNA, 21 bp, R. norvegicus
aaaagcctatattcaacaaaa

SEQ ID NO: 463606 - DNA, 16 bp, R. norvegicus
aaaagctcagggccag

SEQ ID NO: 463607 - DNA, 18 bp, R. norvegicus
aaaagctcctagcccaaa

SEQ ID NO: 463608 - DNA, 16 bp, R. norvegicus
aaaagctgaaggggtt

SEQ ID NO: 463609 - DNA, 16 bp, R. norvegicus
aaaagctgagagaagc

SEQ ID NO: 463610 - DNA, 16 bp, R. norvegicus
aaaagctgaggaagag

SEQ ID NO: 463611 - DNA, 16 bp, R. norvegicus
aaaagctggaaagaat

SEQ ID NO: 463612 - DNA, 16 bp, R. norvegicus
aaaagctggaagaaga

SEQ ID NO: 463613 - DNA, 16 bp, R. norvegicus
aaaagctggagagatg

SEQ ID NO: 463614 - DNA, 16 bp, R. norvegicus
aaaagcttcaagaaaa

SEQ ID NO: 463615 - DNA, 16 bp, R. norvegicus
aaaagcttcaagggaa

SEQ ID NO: 463616 - DNA, 16 bp, R. norvegicus
aaaagcttctataaag

SEQ ID NO: 463617 - DNA, 16 bp, R. norvegicus
aaaagcttctctgatg

SEQ ID NO: 463618 - DNA, 16 bp, R. norvegicus
aaaagctttaagaaaa

SEQ ID NO: 463619 - DNA, 16 bp, R. norvegicus
aaaagcttttgaaaaa

SEQ ID NO: 463620 - DNA, 16 bp, R. norvegicus
aaaaggaaaggaaact

SEQ ID NO: 463621 - DNA, 16 bp, R. norvegicus
aaaaggaaatagaagc

SEQ ID NO: 463622 - DNA, 16 bp, R. norvegicus
aaaaggaaatctttat

SEQ ID NO: 463623 - DNA, 16 bp, R. norvegicus
aaaaggaactatacaa

SEQ ID NO: 463624 - DNA, 16 bp, R. norvegicus
aaaaggaatctacaga

SEQ ID NO: 463625 - DNA, 16 bp, R. norvegicus
aaaaggaatgcaagaa

SEQ ID NO: 463626 - DNA, 16 bp, R. norvegicus
aaaaggaatgttttct

SEQ ID NO: 463627 - DNA, 16 bp, R. norvegicus
aaaaggacaggcctcc

SEQ ID NO: 463628 - DNA, 16 bp, R. norvegicus
aaaaggactgccacac

SEQ ID NO: 463629 - DNA, 16 bp, R. norvegicus
aaaaggagaaactgag

SEQ ID NO: 463630 - DNA, 18 bp, R. norvegicus
aaaaggagaagtctttat

SEQ ID NO: 463631 - DNA, 16 bp, R. norvegicus
aaaaggagattgaaat

SEQ ID NO: 463632 - DNA, 16 bp, R. norvegicus
aaaaggagctaaaact

SEQ ID NO: 463633 - DNA, 16 bp, R. norvegicus
aaaaggagctggagag

SEQ ID NO: 463634 - DNA, 16 bp, R. norvegicus
aaaaggaggaagctca

SEQ ID NO: 463635 - DNA, 16 bp, R. norvegicus
aaaaggaggtcaatgg

SEQ ID NO: 463636 - DNA, 18 bp, R. norvegicus
aaaaggatagcattttca

SEQ ID NO: 463637 - DNA, 16 bp, R. norvegicus
aaaaggatttaacaga

SEQ ID NO: 463638 - DNA, 16 bp, R. norvegicus
aaaaggcaaagaaatg

SEQ ID NO: 463639 - DNA, 16 bp, R. norvegicus
aaaaggccacacccac

SEQ ID NO: 463640 - DNA, 16 bp, R. norvegicus
aaaaggctcttcccag

SEQ ID NO: 463641 - DNA, 16 bp, R. norvegicus
aaaaggctgaaagaaa

SEQ ID NO: 463642 - DNA, 16 bp, R. norvegicus
aaaaggctgaagcctg

SEQ ID NO: 463643 - DNA, 16 bp, R. norvegicus
aaaaggctgagaaaga

SEQ ID NO: 463644 - DNA, 18 bp, R. norvegicus
aaaaggctgagagtgagg

SEQ ID NO: 463645 - DNA, 16 bp, R. norvegicus
aaaaggcttggtttca

SEQ ID NO: 463646 - DNA, 16 bp, R. norvegicus
aaaagggaactaacaa

SEQ ID NO: 463647 - DNA, 27 bp, R. norvegicus
aaaagggacaggctgtgttagaaatgc

SEQ ID NO: 463648 - DNA, 16 bp, R. norvegicus
aaaagggagaaataac

SEQ ID NO: 463649 - DNA, 16 bp, R. norvegicus
aaaagggatccaaagg

SEQ ID NO: 463650 - DNA, 16 bp, R. norvegicus
aaaagggggaaaaatc

SEQ ID NO: 463651 - DNA, 16 bp, R. norvegicus
aaaaggtcaaagggat

SEQ ID NO: 463652 - DNA, 16 bp, R. norvegicus
aaaaggtcatccagaa

SEQ ID NO: 463653 - DNA, 16 bp, R. norvegicus
aaaaggtcatccagag

SEQ ID NO: 463654 - DNA, 16 bp, R. norvegicus
aaaaggtcttcaccaa

SEQ ID NO: 463655 - DNA, 16 bp, R. norvegicus
aaaaggttctttggag

SEQ ID NO: 463656 - DNA, 16 bp, R. norvegicus
aaaagtaaatgttttt

SEQ ID NO: 463657 - DNA, 16 bp, R. norvegicus
aaaagtaagttgggga

SEQ ID NO: 463658 - DNA, 16 bp, R. norvegicus
aaaagtacttttaaaa

SEQ ID NO: 463659 - DNA, 16 bp, R. norvegicus
aaaagtagcattttca

SEQ ID NO: 463660 - DNA, 16 bp, R. norvegicus
aaaagtcaaaatattt

SEQ ID NO: 463661 - DNA, 16 bp, R. norvegicus
aaaagtcaattaaaat

SEQ ID NO: 463662 - DNA, 16 bp, R. norvegicus
aaaagtcatcaaaaca

SEQ ID NO: 463663 - DNA, 16 bp, R. norvegicus
aaaagtcatcaaaaga

SEQ ID NO: 463664 - DNA, 16 bp, R. norvegicus
aaaagtcatcaataaa

SEQ ID NO: 463665 - DNA, 16 bp, R. norvegicus
aaaagtcatcagaaaa

SEQ ID NO: 463666 - DNA, 16 bp, R. norvegicus
aaaagtccaaagctca

SEQ ID NO: 463667 - DNA, 16 bp, R. norvegicus
aaaagtccagagttca

SEQ ID NO: 463668 - DNA, 16 bp, R. norvegicus
aaaagtcctggaagaa

SEQ ID NO: 463669 - DNA, 16 bp, R. norvegicus
aaaagtcctggaagga

SEQ ID NO: 463670 - DNA, 16 bp, R. norvegicus
aaaagtctcagaaaga

SEQ ID NO: 463671 - DNA, 16 bp, R. norvegicus
aaaagtctctcaaaca

SEQ ID NO: 463672 - DNA, 16 bp, R. norvegicus
aaaagtctctcaacca

SEQ ID NO: 463673 - DNA, 16 bp, R. norvegicus
aaaagtctcttttttt

SEQ ID NO: 463674 - DNA, 16 bp, R. norvegicus
aaaagtcttggaaata

SEQ ID NO: 463675 - DNA, 16 bp, R. norvegicus
aaaagtcttggagaaa

SEQ ID NO: 463676 - DNA, 16 bp, R. norvegicus
aaaagtctttaaaatt

SEQ ID NO: 463677 - DNA, 16 bp, R. norvegicus
aaaagtctttactttc

SEQ ID NO: 463678 - DNA, 16 bp, R. norvegicus
aaaagtgatgaatcag

SEQ ID NO: 463679 - DNA, 16 bp, R. norvegicus
aaaagtgccactccct

SEQ ID NO: 463680 - DNA, 16 bp, R. norvegicus
aaaagtggtgaagaat

SEQ ID NO: 463681 - DNA, 16 bp, R. norvegicus
aaaagtgtttatttgg

SEQ ID NO: 463682 - DNA, 16 bp, R. norvegicus
aaaagttatcaaaaat

SEQ ID NO: 463683 - DNA, 16 bp, R. norvegicus
aaaagttctctgcacc

SEQ ID NO: 463684 - DNA, 16 bp, R. norvegicus
aaaagttctggaaaga

SEQ ID NO: 463685 - DNA, 16 bp, R. norvegicus
aaaagttctttaaaat

SEQ ID NO: 463686 - DNA, 16 bp, R. norvegicus
aaaagttggaagaagc

SEQ ID NO: 463687 - DNA, 16 bp, R. norvegicus
aaaagttggctctttg

SEQ ID NO: 463688 - DNA, 16 bp, R. norvegicus
aaaagtttccagaatt

SEQ ID NO: 463689 - DNA, 16 bp, R. norvegicus
aaaagtttgtccaagt

SEQ ID NO: 463690 - DNA, 16 bp, R. norvegicus
aaaagttttcaataaa

SEQ ID NO: 463691 - DNA, 16 bp, R. norvegicus
aaaagttttcttttct

SEQ ID NO: 463692 - DNA, 16 bp, R. norvegicus
aaaagtttttagaatt

SEQ ID NO: 463693 - DNA, 16 bp, R. norvegicus
aaaataaaacagtatt

SEQ ID NO: 463694 - DNA, 16 bp, R. norvegicus
aaaataaaacattgtt

SEQ ID NO: 463695 - DNA, 16 bp, R. norvegicus
aaaataaaaccttttt

SEQ ID NO: 463696 - DNA, 16 bp, R. norvegicus
aaaataaaagaacttc

SEQ ID NO: 463697 - DNA, 16 bp, R. norvegicus
aaaataaaagcaatgt

SEQ ID NO: 463698 - DNA, 16 bp, R. norvegicus
aaaataaaatccacag

SEQ ID NO: 463699 - DNA, 16 bp, R. norvegicus
aaaataaaatttgttg

SEQ ID NO: 463700 - DNA, 16 bp, R. norvegicus
aaaataaaccttcctt

SEQ ID NO: 463701 - DNA, 16 bp, R. norvegicus
aaaataaactgatttt

SEQ ID NO: 463702 - DNA, 16 bp, R. norvegicus
aaaataaacttcattt

SEQ ID NO: 463703 - DNA, 16 bp, R. norvegicus
aaaataaagacatttt

SEQ ID NO: 463704 - DNA, 16 bp, R. norvegicus
aaaataaagacttttt

SEQ ID NO: 463705 - DNA, 16 bp, R. norvegicus
aaaataaagatgtttt

SEQ ID NO: 463706 - DNA, 16 bp, R. norvegicus
aaaataaagatttggg

SEQ ID NO: 463707 - DNA, 16 bp, R. norvegicus
aaaataaagctttctt

SEQ ID NO: 463708 - DNA, 16 bp, R. norvegicus
aaaataaagtgttttt

SEQ ID NO: 463709 - DNA, 16 bp, R. norvegicus
aaaataaatctttctt

SEQ ID NO: 463710 - DNA, 16 bp, R. norvegicus
aaaataaatgatttgt

SEQ ID NO: 463711 - DNA, 16 bp, R. norvegicus
aaaataaatgtatctt

SEQ ID NO: 463712 - DNA, 16 bp, R. norvegicus
aaaataaatttccatt

SEQ ID NO: 463713 - DNA, 16 bp, R. norvegicus
aaaataaatttctttg

SEQ ID NO: 463714 - DNA, 16 bp, R. norvegicus
aaaataacagaaagcc

SEQ ID NO: 463715 - DNA, 16 bp, R. norvegicus
aaaataacatcatttt

SEQ ID NO: 463716 - DNA, 16 bp, R. norvegicus
aaaataacatcctgaa

SEQ ID NO: 463717 - DNA, 16 bp, R. norvegicus
aaaataacattaaatg

SEQ ID NO: 463718 - DNA, 16 bp, R. norvegicus
aaaataagtatttttc

SEQ ID NO: 463719 - DNA, 16 bp, R. norvegicus
aaaataatatatcttc

SEQ ID NO: 463720 - DNA, 16 bp, R. norvegicus
aaaataatcatccacc

SEQ ID NO: 463721 - DNA, 16 bp, R. norvegicus
aaaataattcagagat

SEQ ID NO: 463722 - DNA, 16 bp, R. norvegicus
aaaataatttgcttga

SEQ ID NO: 463723 - DNA, 16 bp, R. norvegicus
aaaatacagaaatatt

SEQ ID NO: 463724 - DNA, 16 bp, R. norvegicus
aaaatacagagttgtg

SEQ ID NO: 463725 - DNA, 16 bp, R. norvegicus
aaaatacagcattttc

SEQ ID NO: 463726 - DNA, 16 bp, R. norvegicus
aaaatacagttatatt

SEQ ID NO: 463727 - DNA, 16 bp, R. norvegicus
aaaatacatgctgaaa

SEQ ID NO: 463728 - DNA, 16 bp, R. norvegicus
aaaatacatgttaaaa

SEQ ID NO: 463729 - DNA, 22 bp, R. norvegicus
aaaataccaatccagttcttca

SEQ ID NO: 463730 - DNA, 16 bp, R. norvegicus
aaaataccacagactg

SEQ ID NO: 463731 - DNA, 16 bp, R. norvegicus
aaaatacccttgggag

SEQ ID NO: 463732 - DNA, 16 bp, R. norvegicus
aaaatactgtattttt

SEQ ID NO: 463733 - DNA, 16 bp, R. norvegicus
aaaatacttgaaagaa

SEQ ID NO: 463734 - DNA, 16 bp, R. norvegicus
aaaatactttgaaaaa

SEQ ID NO: 463735 - DNA, 16 bp, R. norvegicus
aaaatacttttgagat

SEQ ID NO: 463736 - DNA, 16 bp, R. norvegicus
aaaatagacacagcag

SEQ ID NO: 463737 - DNA, 16 bp, R. norvegicus
aaaatagactttaaaa

SEQ ID NO: 463738 - DNA, 16 bp, R. norvegicus
aaaatagccttttaaa

SEQ ID NO: 463739 - DNA, 16 bp, R. norvegicus
aaaatagggctggaga

SEQ ID NO: 463740 - DNA, 16 bp, R. norvegicus
aaaatatattgtgtga

SEQ ID NO: 463741 - DNA, 17 bp, R. norvegicus
aaaatatcatcctgagg

SEQ ID NO: 463742 - DNA, 18 bp, R. norvegicus
aaaatatcatcctgagta

SEQ ID NO: 463743 - DNA, 24 bp, R. norvegicus
aaaatatcatcctgagtgaggtaa

SEQ ID NO: 463744 - DNA, 24 bp, R. norvegicus
aaaatatcatcctgagtgaggtta

SEQ ID NO: 463745 - DNA, 21 bp, R. norvegicus
aaaatatcatcctgagtgagt

SEQ ID NO: 463746 - DNA, 20 bp, R. norvegicus
aaaatatcatcctgagtgat

SEQ ID NO: 463747 - DNA, 19 bp, R. norvegicus
aaaatatcatcctgagtgg

SEQ ID NO: 463748 - DNA, 16 bp, R. norvegicus
aaaatatcatcctgat

SEQ ID NO: 463749 - DNA, 16 bp, R. norvegicus
aaaatatcattagaaa

SEQ ID NO: 463750 - DNA, 19 bp, R. norvegicus
aaaatatcattctgagtga

SEQ ID NO: 463751 - DNA, 16 bp, R. norvegicus
aaaatatccagaggag

SEQ ID NO: 463752 - DNA, 16 bp, R. norvegicus
aaaatatgcattaaaa

SEQ ID NO: 463753 - DNA, 16 bp, R. norvegicus
aaaatatgctaataaa

SEQ ID NO: 463754 - DNA, 16 bp, R. norvegicus
aaaatatgtcttttaa

SEQ ID NO: 463755 - DNA, 16 bp, R. norvegicus
aaaatatgttcatttt

SEQ ID NO: 463756 - DNA, 16 bp, R. norvegicus
aaaatatgtttcattt

SEQ ID NO: 463757 - DNA, 16 bp, R. norvegicus
aaaatattaaaatcag

SEQ ID NO: 463758 - DNA, 16 bp, R. norvegicus
aaaatattcataggag

SEQ ID NO: 463759 - DNA, 16 bp, R. norvegicus
aaaatattctgaatga

SEQ ID NO: 463760 - DNA, 16 bp, R. norvegicus
aaaatattgaggaaca

SEQ ID NO: 463761 - DNA, 16 bp, R. norvegicus
aaaatattggatatcc

SEQ ID NO: 463762 - DNA, 16 bp, R. norvegicus
aaaatatttaaagaac

SEQ ID NO: 463763 - DNA, 16 bp, R. norvegicus
aaaatatttactttca

SEQ ID NO: 463764 - DNA, 16 bp, R. norvegicus
aaaatatttcagaaaa

SEQ ID NO: 463765 - DNA, 16 bp, R. norvegicus
aaaatatttgggaaaa

SEQ ID NO: 463766 - DNA, 16 bp, R. norvegicus
aaaatatttgtacaat

SEQ ID NO: 463767 - DNA, 16 bp, R. norvegicus
aaaatattttcaacat

SEQ ID NO: 463768 - DNA, 16 bp, R. norvegicus
aaaatattttcaatga

SEQ ID NO: 463769 - DNA, 16 bp, R. norvegicus
aaaatattttctagaa

SEQ ID NO: 463770 - DNA, 16 bp, R. norvegicus
aaaatattttctagtt

SEQ ID NO: 463771 - DNA, 16 bp, R. norvegicus
aaaatattttctgatt

SEQ ID NO: 463772 - DNA, 16 bp, R. norvegicus
aaaatattttctggtc

SEQ ID NO: 463773 - DNA, 16 bp, R. norvegicus
aaaatatttttccatt

SEQ ID NO: 463774 - DNA, 16 bp, R. norvegicus
aaaatcaaaactctgg

SEQ ID NO: 463775 - DNA, 16 bp, R. norvegicus
aaaatcaaaagaaggg

SEQ ID NO: 463776 - DNA, 16 bp, R. norvegicus
aaaatcaaataaatgt

SEQ ID NO: 463777 - DNA, 16 bp, R. norvegicus
aaaatcaaattaaatg

SEQ ID NO: 463778 - DNA, 24 bp, R. norvegicus
aaaatcaacaagatagataaacca

SEQ ID NO: 463779 - DNA, 17 bp, R. norvegicus
aaaatcaacaaggtaga

SEQ ID NO: 463780 - DNA, 16 bp, R. norvegicus
aaaatcaaccaagtag

SEQ ID NO: 463781 - DNA, 16 bp, R. norvegicus
aaaatcaagtgcccac

SEQ ID NO: 463782 - DNA, 16 bp, R. norvegicus
aaaatcaatcaattag

SEQ ID NO: 463783 - DNA, 16 bp, R. norvegicus
aaaatcagagaaagga

SEQ ID NO: 463784 - DNA, 16 bp, R. norvegicus
aaaatcagagaggaaa

SEQ ID NO: 463785 - DNA, 16 bp, R. norvegicus
aaaatcaggaagaaat

SEQ ID NO: 463786 - DNA, 16 bp, R. norvegicus
aaaatcagggattaga

SEQ ID NO: 463787 - DNA, 16 bp, R. norvegicus
aaaatcagtaagattg

SEQ ID NO: 463788 - DNA, 16 bp, R. norvegicus
aaaatcatatttcatc

SEQ ID NO: 463789 - DNA, 16 bp, R. norvegicus
aaaatcatcagacctt

SEQ ID NO: 463790 - DNA, 16 bp, R. norvegicus
aaaatcatccatcatg

SEQ ID NO: 463791 - DNA, 16 bp, R. norvegicus
aaaatcatgaacaaga

SEQ ID NO: 463792 - DNA, 16 bp, R. norvegicus
aaaatcattaaaatgt

SEQ ID NO: 463793 - DNA, 16 bp, R. norvegicus
aaaatcattttccaaa

SEQ ID NO: 463794 - DNA, 16 bp, R. norvegicus
aaaatccaagatgaac

SEQ ID NO: 463795 - DNA, 16 bp, R. norvegicus
aaaatccaccaacatg

SEQ ID NO: 463796 - DNA, 16 bp, R. norvegicus
aaaatccaccagagaa

SEQ ID NO: 463797 - DNA, 16 bp, R. norvegicus
aaaatccagaacacaa

SEQ ID NO: 463798 - DNA, 16 bp, R. norvegicus
aaaatccaggaaatct

SEQ ID NO: 463799 - DNA, 16 bp, R. norvegicus
aaaatccctgacagaa

SEQ ID NO: 463800 - DNA, 16 bp, R. norvegicus
aaaatcccttgaagaa

SEQ ID NO: 463801 - DNA, 16 bp, R. norvegicus
aaaatcctagccagag

SEQ ID NO: 463802 - DNA, 16 bp, R. norvegicus
aaaatcctctgtcaag

SEQ ID NO: 463803 - DNA, 16 bp, R. norvegicus
aaaatcctgtatacat

SEQ ID NO: 463804 - DNA, 16 bp, R. norvegicus
aaaatcgaaggtaaaa

SEQ ID NO: 463805 - DNA, 16 bp, R. norvegicus
aaaatctaagcctgca

SEQ ID NO: 463806 - DNA, 16 bp, R. norvegicus
aaaatctaataaaatg

SEQ ID NO: 463807 - DNA, 16 bp, R. norvegicus
aaaatctcagaaaaat

SEQ ID NO: 463808 - DNA, 16 bp, R. norvegicus
aaaatctcaggtgaca

SEQ ID NO: 463809 - DNA, 17 bp, R. norvegicus
aaaatctcattctttat

SEQ ID NO: 463810 - DNA, 16 bp, R. norvegicus
aaaatctgaagatttt

SEQ ID NO: 463811 - DNA, 16 bp, R. norvegicus
aaaatctgaagtgtaa

SEQ ID NO: 463812 - DNA, 37 bp, R. norvegicus
aaaatctgcaggaaatggacaatttcctagacagata

SEQ ID NO: 463813 - DNA, 16 bp, R. norvegicus
aaaatctgctgctcac

SEQ ID NO: 463814 - DNA, 16 bp, R. norvegicus
aaaatctggaggaaat

SEQ ID NO: 463815 - DNA, 16 bp, R. norvegicus
aaaatctgggacacta

SEQ ID NO: 463816 - DNA, 16 bp, R. norvegicus
aaaatctgtggctctg

SEQ ID NO: 463817 - DNA, 16 bp, R. norvegicus
aaaatcttagaagaaa

SEQ ID NO: 463818 - DNA, 16 bp, R. norvegicus
aaaatcttgatgaaat

SEQ ID NO: 463819 - DNA, 16 bp, R. norvegicus
aaaatcttggagagat

SEQ ID NO: 463820 - DNA, 16 bp, R. norvegicus
aaaatgaaaatctttt

SEQ ID NO: 463821 - DNA, 16 bp, R. norvegicus
aaaatgaaacaaattt

SEQ ID NO: 463822 - DNA, 16 bp, R. norvegicus
aaaatgaaagctattt

SEQ ID NO: 463823 - DNA, 16 bp, R. norvegicus
aaaatgaaatattttg

SEQ ID NO: 463824 - DNA, 16 bp, R. norvegicus
aaaatgaaatttctaa

SEQ ID NO: 463825 - DNA, 16 bp, R. norvegicus
aaaatgaacaattttc

SEQ ID NO: 463826 - DNA, 16 bp, R. norvegicus
aaaatgaacccacaca

SEQ ID NO: 463827 - DNA, 16 bp, R. norvegicus
aaaatgaagaagatct

SEQ ID NO: 463828 - DNA, 16 bp, R. norvegicus
aaaatgaagaagtcaa

SEQ ID NO: 463829 - DNA, 16 bp, R. norvegicus
aaaatgaagcaaatac

SEQ ID NO: 463830 - DNA, 16 bp, R. norvegicus
aaaatgaagcaaatgc

SEQ ID NO: 463831 - DNA, 16 bp, R. norvegicus
aaaatgaattcaaaga

SEQ ID NO: 463832 - DNA, 16 bp, R. norvegicus
aaaatgaatttacaaa

SEQ ID NO: 463833 - DNA, 16 bp, R. norvegicus
aaaatgaatttggaaa

SEQ ID NO: 463834 - DNA, 16 bp, R. norvegicus
aaaatgacattttaaa

SEQ ID NO: 463835 - DNA, 16 bp, R. norvegicus
aaaatgaccatcttta

SEQ ID NO: 463836 - DNA, 16 bp, R. norvegicus
aaaatgagttcaaggc

SEQ ID NO: 463837 - DNA, 16 bp, R. norvegicus
aaaatgatgaaaatgt

SEQ ID NO: 463838 - DNA, 16 bp, R. norvegicus
aaaatgatgaagtttt

SEQ ID NO: 463839 - DNA, 16 bp, R. norvegicus
aaaatgatgatgatga

SEQ ID NO: 463840 - DNA, 16 bp, R. norvegicus
aaaatgatgatttttt

SEQ ID NO: 463841 - DNA, 16 bp, R. norvegicus
aaaatgattttgaaat

SEQ ID NO: 463842 - DNA, 16 bp, R. norvegicus
aaaatgatttttttct

SEQ ID NO: 463843 - DNA, 16 bp, R. norvegicus
aaaatgcaaaaactcc

SEQ ID NO: 463844 - DNA, 16 bp, R. norvegicus
aaaatgcaaaaagctc

SEQ ID NO: 463845 - DNA, 16 bp, R. norvegicus
aaaatgcaaaatattt

SEQ ID NO: 463846 - DNA, 16 bp, R. norvegicus
aaaatgcaggctgagc

SEQ ID NO: 463847 - DNA, 16 bp, R. norvegicus
aaaatgcagtccacaa

SEQ ID NO: 463848 - DNA, 16 bp, R. norvegicus
aaaatgcatacatata

SEQ ID NO: 463849 - DNA, 16 bp, R. norvegicus
aaaatgcatataaaat

SEQ ID NO: 463850 - DNA, 16 bp, R. norvegicus
aaaatgcatgctgaaa

SEQ ID NO: 463851 - DNA, 16 bp, R. norvegicus
aaaatgccccaccaat

SEQ ID NO: 463852 - DNA, 16 bp, R. norvegicus
aaaatgcctccaccag

SEQ ID NO: 463853 - DNA, 16 bp, R. norvegicus
aaaatgcctcggtgtg

SEQ ID NO: 463854 - DNA, 16 bp, R. norvegicus
aaaatgccttaaagaa

SEQ ID NO: 463855 - DNA, 16 bp, R. norvegicus
aaaatgctatcttctt

SEQ ID NO: 463856 - DNA, 16 bp, R. norvegicus
aaaatgctcaacatcc

SEQ ID NO: 463857 - DNA, 16 bp, R. norvegicus
aaaatgctctttctaa

SEQ ID NO: 463858 - DNA, 16 bp, R. norvegicus
aaaatgctcttttttc

SEQ ID NO: 463859 - DNA, 16 bp, R. norvegicus
aaaatgctgagaaaag

SEQ ID NO: 463860 - DNA, 16 bp, R. norvegicus
aaaatgctgggtcctc

SEQ ID NO: 463861 - DNA, 16 bp, R. norvegicus
aaaatgctgtctgttt

SEQ ID NO: 463862 - DNA, 16 bp, R. norvegicus
aaaatgcttgcaaact

SEQ ID NO: 463863 - DNA, 16 bp, R. norvegicus
aaaatgcttttgaaaa

SEQ ID NO: 463864 - DNA, 16 bp, R. norvegicus
aaaatggaaacatttt

SEQ ID NO: 463865 - DNA, 16 bp, R. norvegicus
aaaatggaatctcaaa

SEQ ID NO: 463866 - DNA, 16 bp, R. norvegicus
aaaatggaatctcaga

SEQ ID NO: 463867 - DNA, 16 bp, R. norvegicus
aaaatggacaaataag

SEQ ID NO: 463868 - DNA, 16 bp, R. norvegicus
aaaatggagaaatgtt

SEQ ID NO: 463869 - DNA, 44 bp, R. norvegicus
aaaatggagttcagagctaaacaaagaattcacagctgaggaat

SEQ ID NO: 463870 - DNA, 16 bp, R. norvegicus
aaaatggcaacaaaca

SEQ ID NO: 463871 - DNA, 16 bp, R. norvegicus
aaaatggcagacattt

SEQ ID NO: 463872 - DNA, 16 bp, R. norvegicus
aaaatggcagcatcca

SEQ ID NO: 463873 - DNA, 16 bp, R. norvegicus
aaaatggcagccaaca

SEQ ID NO: 463874 - DNA, 16 bp, R. norvegicus
aaaatggcatctgtgt

SEQ ID NO: 463875 - DNA, 22 bp, R. norvegicus
aaaatggccattttaccaaaaa

SEQ ID NO: 463876 - DNA, 16 bp, R. norvegicus
aaaatggccattttag

SEQ ID NO: 463877 - DNA, 16 bp, R. norvegicus
aaaatgggacacagag

SEQ ID NO: 463878 - DNA, 16 bp, R. norvegicus
aaaatggggatcagag

SEQ ID NO: 463879 - DNA, 16 bp, R. norvegicus
aaaatggtcattttta

SEQ ID NO: 463880 - DNA, 16 bp, R. norvegicus
aaaatggtgtacagaa

SEQ ID NO: 463881 - DNA, 16 bp, R. norvegicus
aaaatgtaaaatttct

SEQ ID NO: 463882 - DNA, 17 bp, R. norvegicus
aaaatgtaacattgata

SEQ ID NO: 463883 - DNA, 16 bp, R. norvegicus
aaaatgtaacttaaaa

SEQ ID NO: 463884 - DNA, 16 bp, R. norvegicus
aaaatgtacttgctgt

SEQ ID NO: 463885 - DNA, 16 bp, R. norvegicus
aaaatgtatctttaaa

SEQ ID NO: 463886 - DNA, 16 bp, R. norvegicus
aaaatgtcataaggaa

SEQ ID NO: 463887 - DNA, 16 bp, R. norvegicus
aaaatgtcatccagag

SEQ ID NO: 463888 - DNA, 16 bp, R. norvegicus
aaaatgtcattctgag

SEQ ID NO: 463889 - DNA, 16 bp, R. norvegicus
aaaatgtctccataaa

SEQ ID NO: 463890 - DNA, 16 bp, R. norvegicus
aaaatgtctgccattt

SEQ ID NO: 463891 - DNA, 16 bp, R. norvegicus
aaaatgtgacatttgt

SEQ ID NO: 463892 - DNA, 23 bp, R. norvegicus
aaaatgtggtacatctacacaac

SEQ ID NO: 463893 - DNA, 24 bp, R. norvegicus
aaaatgtggtacatctacacagtg

SEQ ID NO: 463894 - DNA, 21 bp, R. norvegicus
aaaatgtggtacatctacacg

SEQ ID NO: 463895 - DNA, 18 bp, R. norvegicus
aaaatgtggtacatctat

SEQ ID NO: 463896 - DNA, 16 bp, R. norvegicus
aaaatgtggtacatgt

SEQ ID NO: 463897 - DNA, 16 bp, R. norvegicus
aaaatgtggtttgttt

SEQ ID NO: 463898 - DNA, 16 bp, R. norvegicus
aaaatgtgttcatttt

SEQ ID NO: 463899 - DNA, 16 bp, R. norvegicus
aaaatgtgtttaaaat

SEQ ID NO: 463900 - DNA, 16 bp, R. norvegicus
aaaatgtgttttgaaa

SEQ ID NO: 463901 - DNA, 16 bp, R. norvegicus
aaaatgttatctttct

SEQ ID NO: 463902 - DNA, 16 bp, R. norvegicus
aaaatgttcatatttt

SEQ ID NO: 463903 - DNA, 16 bp, R. norvegicus
aaaatgtttcagtgaa

SEQ ID NO: 463904 - DNA, 16 bp, R. norvegicus
aaaatgtttgaaaaca

SEQ ID NO: 463905 - DNA, 16 bp, R. norvegicus
aaaatgtttgctgtgt

SEQ ID NO: 463906 - DNA, 16 bp, R. norvegicus
aaaatgttttcaacaa

SEQ ID NO: 463907 - DNA, 16 bp, R. norvegicus
aaaatgttttccttct

SEQ ID NO: 463908 - DNA, 16 bp, R. norvegicus
aaaatgtttttaagtt

SEQ ID NO: 463909 - DNA, 16 bp, R. norvegicus
aaaattaaaatctgaa

SEQ ID NO: 463910 - DNA, 16 bp, R. norvegicus
aaaattaactgaaaca

SEQ ID NO: 463911 - DNA, 16 bp, R. norvegicus
aaaattacaaagcttc

SEQ ID NO: 463912 - DNA, 16 bp, R. norvegicus
aaaattacacttattt

SEQ ID NO: 463913 - DNA, 16 bp, R. norvegicus
aaaattacagtgatga

SEQ ID NO: 463914 - DNA, 16 bp, R. norvegicus
aaaattacatttgaaa

SEQ ID NO: 463915 - DNA, 16 bp, R. norvegicus
aaaattactttgaaat

SEQ ID NO: 463916 - DNA, 16 bp, R. norvegicus
aaaattatagaaaact

SEQ ID NO: 463917 - DNA, 16 bp, R. norvegicus
aaaattatcagatctt

SEQ ID NO: 463918 - DNA, 16 bp, R. norvegicus
aaaattatcattttct

SEQ ID NO: 463919 - DNA, 16 bp, R. norvegicus
aaaattatttgtgttg

SEQ ID NO: 463920 - DNA, 16 bp, R. norvegicus
aaaattcaaaaagctc

SEQ ID NO: 463921 - DNA, 16 bp, R. norvegicus
aaaattcagatgacag

SEQ ID NO: 463922 - DNA, 17 bp, R. norvegicus
aaaattcataggcaaat

SEQ ID NO: 463923 - DNA, 16 bp, R. norvegicus
aaaattcatgataaaa

SEQ ID NO: 463924 - DNA, 16 bp, R. norvegicus
aaaattccaaatagat

SEQ ID NO: 463925 - DNA, 16 bp, R. norvegicus
aaaattccaccaaaga

SEQ ID NO: 463926 - DNA, 16 bp, R. norvegicus
aaaattccaccacaga

SEQ ID NO: 463927 - DNA, 16 bp, R. norvegicus
aaaattccaccagaga

SEQ ID NO: 463928 - DNA, 16 bp, R. norvegicus
aaaattccaccagagg

SEQ ID NO: 463929 - DNA, 16 bp, R. norvegicus
aaaattctaaaattct

SEQ ID NO: 463930 - DNA, 16 bp, R. norvegicus
aaaattctaacagaga

SEQ ID NO: 463931 - DNA, 16 bp, R. norvegicus
aaaattctagaagaaa

SEQ ID NO: 463932 - DNA, 16 bp, R. norvegicus
aaaattctcaacagaa

SEQ ID NO: 463933 - DNA, 16 bp, R. norvegicus
aaaattctcaacttca

SEQ ID NO: 463934 - DNA, 16 bp, R. norvegicus
aaaattctgaataaaa

SEQ ID NO: 463935 - DNA, 16 bp, R. norvegicus
aaaattctgacccaga

SEQ ID NO: 463936 - DNA, 16 bp, R. norvegicus
aaaattcttgcaaaat

SEQ ID NO: 463937 - DNA, 16 bp, R. norvegicus
aaaattgaagtggtta

SEQ ID NO: 463938 - DNA, 16 bp, R. norvegicus
aaaattgaccaaataa

SEQ ID NO: 463939 - DNA, 17 bp, R. norvegicus
aaaattgcaaagcttct

SEQ ID NO: 463940 - DNA, 16 bp, R. norvegicus
aaaattgcccacctaa

SEQ ID NO: 463941 - DNA, 16 bp, R. norvegicus
aaaattggatattaca

SEQ ID NO: 463942 - DNA, 16 bp, R. norvegicus
aaaattggggaagagt

SEQ ID NO: 463943 - DNA, 16 bp, R. norvegicus
aaaattgggtacagaa

SEQ ID NO: 463944 - DNA, 16 bp, R. norvegicus
aaaattgtatgatatt

SEQ ID NO: 463945 - DNA, 16 bp, R. norvegicus
aaaattgtcaaagaaa

SEQ ID NO: 463946 - DNA, 16 bp, R. norvegicus
aaaattgtctatttct

SEQ ID NO: 463947 - DNA, 16 bp, R. norvegicus
aaaatttaaatctttc

SEQ ID NO: 463948 - DNA, 16 bp, R. norvegicus
aaaatttactcaaaga

SEQ ID NO: 463949 - DNA, 16 bp, R. norvegicus
aaaatttatcctgtct

SEQ ID NO: 463950 - DNA, 16 bp, R. norvegicus
aaaatttcaattcaat

SEQ ID NO: 463951 - DNA, 16 bp, R. norvegicus
aaaatttcctgaagag

SEQ ID NO: 463952 - DNA, 16 bp, R. norvegicus
aaaatttctttcaaaa

SEQ ID NO: 463953 - DNA, 16 bp, R. norvegicus
aaaatttgaagatgag

SEQ ID NO: 463954 - DNA, 16 bp, R. norvegicus
aaaatttggagaaaat

SEQ ID NO: 463955 - DNA, 16 bp, R. norvegicus
aaaattttaatgacat

SEQ ID NO: 463956 - DNA, 16 bp, R. norvegicus
aaaattttctctctct

SEQ ID NO: 463957 - DNA, 16 bp, R. norvegicus
aaaattttctggacaa

SEQ ID NO: 463958 - DNA, 16 bp, R. norvegicus
aaaatttttgttgttg

SEQ ID NO: 463959 - DNA, 16 bp, R. norvegicus
aaaattttttttccag

SEQ ID NO: 463960 - DNA, 16 bp, R. norvegicus
aaacaaaaaacccttg

SEQ ID NO: 463961 - DNA, 16 bp, R. norvegicus
aaacaaaacatttttc

SEQ ID NO: 463962 - DNA, 16 bp, R. norvegicus
aaacaaaaggaactat

SEQ ID NO: 463963 - DNA, 16 bp, R. norvegicus
aaacaaaattaccagc

SEQ ID NO: 463964 - DNA, 16 bp, R. norvegicus
aaacaaacaaactcag

SEQ ID NO: 463965 - DNA, 16 bp, R. norvegicus
aaacaaacacatttat

SEQ ID NO: 463966 - DNA, 16 bp, R. norvegicus
aaacaaaccctttctc

SEQ ID NO: 463967 - DNA, 16 bp, R. norvegicus
aaacaaacctcagaaa

SEQ ID NO: 463968 - DNA, 16 bp, R. norvegicus
aaacaaactgaaggaa

SEQ ID NO: 463969 - DNA, 16 bp, R. norvegicus
aaacaaactggaagaa

SEQ ID NO: 463970 - DNA, 16 bp, R. norvegicus
aaacaaactttactaa

SEQ ID NO: 463971 - DNA, 26 bp, R. norvegicus
aaacaaagaattcagagctgaggaat

SEQ ID NO: 463972 - DNA, 52 bp, R. norvegicus
aaacaaagatggcgccgacatccagccttgtctggatataaacgacttactg

SEQ ID NO: 463973 - DNA, 16 bp, R. norvegicus
aaacaaagattttttt

SEQ ID NO: 463974 - DNA, 16 bp, R. norvegicus
aaacaaagcttccagt

SEQ ID NO: 463975 - DNA, 16 bp, R. norvegicus
aaacaaaggttttact

SEQ ID NO: 463976 - DNA, 16 bp, R. norvegicus
aaacaaataattctca

SEQ ID NO: 463977 - DNA, 16 bp, R. norvegicus
aaacaaatcagtagtt

SEQ ID NO: 463978 - DNA, 16 bp, R. norvegicus
aaacaaatggacaaac

SEQ ID NO: 463979 - DNA, 16 bp, R. norvegicus
aaacaaattcaaggaa

SEQ ID NO: 463980 - DNA, 16 bp, R. norvegicus
aaacaaattgagaaat

SEQ ID NO: 463981 - DNA, 16 bp, R. norvegicus
aaacaacagaaattta

SEQ ID NO: 463982 - DNA, 17 bp, R. norvegicus
aaacaacagcagcagca

SEQ ID NO: 463983 - DNA, 16 bp, R. norvegicus
aaacaactggagcaga

SEQ ID NO: 463984 - DNA, 16 bp, R. norvegicus
aaacaactttttgaaa

SEQ ID NO: 463985 - DNA, 16 bp, R. norvegicus
aaacaagaagaagcct

SEQ ID NO: 463986 - DNA, 16 bp, R. norvegicus
aaacaagcaagtgaaa

SEQ ID NO: 463987 - DNA, 16 bp, R. norvegicus
aaacaagcctcaacat

SEQ ID NO: 463988 - DNA, 16 bp, R. norvegicus
aaacaagctctacaca

SEQ ID NO: 463989 - DNA, 16 bp, R. norvegicus
aaacaaggagaatgaa

SEQ ID NO: 463990 - DNA, 16 bp, R. norvegicus
aaacaagggctggaga

SEQ ID NO: 463991 - DNA, 16 bp, R. norvegicus
aaacaagtaacaccag

SEQ ID NO: 463992 - DNA, 17 bp, R. norvegicus
aaacaagtccttatttg

SEQ ID NO: 463993 - DNA, 16 bp, R. norvegicus
aaacaataaagagagc

SEQ ID NO: 463994 - DNA, 16 bp, R. norvegicus
aaacaataatccatca

SEQ ID NO: 463995 - DNA, 16 bp, R. norvegicus
aaacaatgaatatcca

SEQ ID NO: 463996 - DNA, 16 bp, R. norvegicus
aaacaatgactttatt

SEQ ID NO: 463997 - DNA, 16 bp, R. norvegicus
aaacaatgtcttccag

SEQ ID NO: 463998 - DNA, 16 bp, R. norvegicus
aaacaatgtgaggaag

SEQ ID NO: 463999 - DNA, 16 bp, R. norvegicus
aaacaatgttccaagc

SEQ ID NO: 464000 - DNA, 16 bp, R. norvegicus
aaacacaaatattttt

SEQ ID NO: 464001 - DNA, 16 bp, R. norvegicus
aaacacaaatggagac

SEQ ID NO: 464002 - DNA, 16 bp, R. norvegicus
aaacacaaatggctga

SEQ ID NO: 464003 - DNA, 16 bp, R. norvegicus
aaacacaacctggaca

SEQ ID NO: 464004 - DNA, 16 bp, R. norvegicus
aaacacaagcacacat

SEQ ID NO: 464005 - DNA, 16 bp, R. norvegicus
aaacacaaggacctga

SEQ ID NO: 464006 - DNA, 16 bp, R. norvegicus
aaacacacacatgcac

SEQ ID NO: 464007 - DNA, 16 bp, R. norvegicus
aaacacacatgtgcac

SEQ ID NO: 464008 - DNA, 16 bp, R. norvegicus
aaacacacctcaatga

SEQ ID NO: 464009 - DNA, 16 bp, R. norvegicus
aaacacacctcagaaa

SEQ ID NO: 464010 - DNA, 27 bp, R. norvegicus
aaacacacctcagagacaaagacagat

SEQ ID NO: 464011 - DNA, 16 bp, R. norvegicus
aaacacagaaaacatt

SEQ ID NO: 464012 - DNA, 16 bp, R. norvegicus
aaacacagaaatgtta

SEQ ID NO: 464013 - DNA, 16 bp, R. norvegicus
aaacacagacatacag

SEQ ID NO: 464014 - DNA, 16 bp, R. norvegicus
aaacacagagagaaat

SEQ ID NO: 464015 - DNA, 16 bp, R. norvegicus
aaacacaggaaaatat

SEQ ID NO: 464016 - DNA, 16 bp, R. norvegicus
aaacacaggaaacatt

SEQ ID NO: 464017 - DNA, 17 bp, R. norvegicus
aaacacaggcttatagg

SEQ ID NO: 464018 - DNA, 16 bp, R. norvegicus
aaacacaggtcatcag

SEQ ID NO: 464019 - DNA, 16 bp, R. norvegicus
aaacacatctcagtga

SEQ ID NO: 464020 - DNA, 16 bp, R. norvegicus
aaacacatgaagaaat

SEQ ID NO: 464021 - DNA, 16 bp, R. norvegicus
aaacacatgcacaaaa

SEQ ID NO: 464022 - DNA, 16 bp, R. norvegicus
aaacaccaatgcacac

SEQ ID NO: 464023 - DNA, 16 bp, R. norvegicus
aaacaccatgaacaaa

SEQ ID NO: 464024 - DNA, 16 bp, R. norvegicus
aaacaccatgactgaa

SEQ ID NO: 464025 - DNA, 16 bp, R. norvegicus
aaacaccatggccaaa

SEQ ID NO: 464026 - DNA, 16 bp, R. norvegicus
aaacaccatgttaaca

SEQ ID NO: 464027 - DNA, 16 bp, R. norvegicus
aaacacctaaagatat

SEQ ID NO: 464028 - DNA, 16 bp, R. norvegicus
aaacacctatacacat

SEQ ID NO: 464029 - DNA, 16 bp, R. norvegicus
aaacaccttcagtgaa

SEQ ID NO: 464030 - DNA, 16 bp, R. norvegicus
aaacactaaattcaca

SEQ ID NO: 464031 - DNA, 16 bp, R. norvegicus
aaacactctcacacac

SEQ ID NO: 464032 - DNA, 16 bp, R. norvegicus
aaacactgaaagaaat

SEQ ID NO: 464033 - DNA, 16 bp, R. norvegicus
aaacactgacttcatg

SEQ ID NO: 464034 - DNA, 16 bp, R. norvegicus
aaacactgtgggagag

SEQ ID NO: 464035 - DNA, 16 bp, R. norvegicus
aaacactgtttaaaaa

SEQ ID NO: 464036 - DNA, 16 bp, R. norvegicus
aaacacttaaagaaat

SEQ ID NO: 464037 - DNA, 16 bp, R. norvegicus
aaacacttagagaaat

SEQ ID NO: 464038 - DNA, 16 bp, R. norvegicus
aaacactttttttctt

SEQ ID NO: 464039 - DNA, 16 bp, R. norvegicus
aaacagaaattttaaa

SEQ ID NO: 464040 - DNA, 16 bp, R. norvegicus
aaacagaagaaaatgt

SEQ ID NO: 464041 - DNA, 16 bp, R. norvegicus
aaacagaagactgtct

SEQ ID NO: 464042 - DNA, 16 bp, R. norvegicus
aaacagaaggaatact

SEQ ID NO: 464043 - DNA, 16 bp, R. norvegicus
aaacagaagggcctgc

SEQ ID NO: 464044 - DNA, 16 bp, R. norvegicus
aaacagaagtcattgt

SEQ ID NO: 464045 - DNA, 16 bp, R. norvegicus
aaacagaatgagaaag

SEQ ID NO: 464046 - DNA, 17 bp, R. norvegicus
aaacagacacagaagga

SEQ ID NO: 464047 - DNA, 16 bp, R. norvegicus
aaacagacacatacat

SEQ ID NO: 464048 - DNA, 16 bp, R. norvegicus
aaacagacatgtagac

SEQ ID NO: 464049 - DNA, 23 bp, R. norvegicus
aaacagacattaacaaaaacctt

SEQ ID NO: 464050 - DNA, 16 bp, R. norvegicus
aaacagactcagagaa

SEQ ID NO: 464051 - DNA, 16 bp, R. norvegicus
aaacagagaaacaatg

SEQ ID NO: 464052 - DNA, 16 bp, R. norvegicus
aaacagagaattctga

SEQ ID NO: 464053 - DNA, 16 bp, R. norvegicus
aaacagagacattgag

SEQ ID NO: 464054 - DNA, 16 bp, R. norvegicus
aaacagagacttctca

SEQ ID NO: 464055 - DNA, 16 bp, R. norvegicus
aaacagagagagatga

SEQ ID NO: 464056 - DNA, 16 bp, R. norvegicus
aaacagaggagcagtg

SEQ ID NO: 464057 - DNA, 16 bp, R. norvegicus
aaacagaggcaagcag

SEQ ID NO: 464058 - DNA, 16 bp, R. norvegicus
aaacagaggcagacag

SEQ ID NO: 464059 - DNA, 16 bp, R. norvegicus
aaacagaggcagagag

SEQ ID NO: 464060 - DNA, 16 bp, R. norvegicus
aaacagaggctgaagg

SEQ ID NO: 464061 - DNA, 16 bp, R. norvegicus
aaacagagtctgaagg

SEQ ID NO: 464062 - DNA, 16 bp, R. norvegicus
aaacagatagaagccc

SEQ ID NO: 464063 - DNA, 16 bp, R. norvegicus
aaacagatatgcagta

SEQ ID NO: 464064 - DNA, 16 bp, R. norvegicus
aaacagatattttaaa

SEQ ID NO: 464065 - DNA, 16 bp, R. norvegicus
aaacagatcatggaaa

SEQ ID NO: 464066 - DNA, 16 bp, R. norvegicus
aaacagatgcagagac

SEQ ID NO: 464067 - DNA, 16 bp, R. norvegicus
aaacagatggggcact

SEQ ID NO: 464068 - DNA, 17 bp, R. norvegicus
aaacagattggaccaga

SEQ ID NO: 464069 - DNA, 16 bp, R. norvegicus
aaacagcaagcacagg

SEQ ID NO: 464070 - DNA, 47 bp, R. norvegicus
aaacagcacagttctgttactcttgtggtacctggcaccattttttt

SEQ ID NO: 464071 - DNA, 16 bp, R. norvegicus
aaacagcagcagcaac

SEQ ID NO: 464072 - DNA, 16 bp, R. norvegicus
aaacagcagcagcaga

SEQ ID NO: 464073 - DNA, 18 bp, R. norvegicus
aaacagcagcagcagcaa

SEQ ID NO: 464074 - DNA, 16 bp, R. norvegicus
aaacagcagcagcagt

SEQ ID NO: 464075 - DNA, 16 bp, R. norvegicus
aaacagcatgaccaaa

SEQ ID NO: 464076 - DNA, 16 bp, R. norvegicus
aaacaggaaaacaagt

SEQ ID NO: 464077 - DNA, 16 bp, R. norvegicus
aaacaggaaagagaat

SEQ ID NO: 464078 - DNA, 16 bp, R. norvegicus
aaacaggaacctggag

SEQ ID NO: 464079 - DNA, 16 bp, R. norvegicus
aaacaggaaggatcct

SEQ ID NO: 464080 - DNA, 16 bp, R. norvegicus
aaacaggatctcatgt

SEQ ID NO: 464081 - DNA, 16 bp, R. norvegicus
aaacaggctaagaaag

SEQ ID NO: 464082 - DNA, 16 bp, R. norvegicus
aaacaggctgagaagg

SEQ ID NO: 464083 - DNA, 16 bp, R. norvegicus
aaacagggggctggag

SEQ ID NO: 464084 - DNA, 16 bp, R. norvegicus
aaacaggtaaaagaat

SEQ ID NO: 464085 - DNA, 16 bp, R. norvegicus
aaacaggtaacctcag

SEQ ID NO: 464086 - DNA, 16 bp, R. norvegicus
aaacaggtacagaaaa

SEQ ID NO: 464087 - DNA, 16 bp, R. norvegicus
aaacaggtctacaaga

SEQ ID NO: 464088 - DNA, 17 bp, R. norvegicus
aaacaggtgaaggaatt

SEQ ID NO: 464089 - DNA, 16 bp, R. norvegicus
aaacagtagccaacat

SEQ ID NO: 464090 - DNA, 16 bp, R. norvegicus
aaacagtatctttcta

SEQ ID NO: 464091 - DNA, 16 bp, R. norvegicus
aaacagtgaaagagaa

SEQ ID NO: 464092 - DNA, 16 bp, R. norvegicus
aaacagtggaagaaaa

SEQ ID NO: 464093 - DNA, 16 bp, R. norvegicus
aaacagtggggctgga

SEQ ID NO: 464094 - DNA, 16 bp, R. norvegicus
aaacagtgggtggagc

SEQ ID NO: 464095 - DNA, 16 bp, R. norvegicus
aaacagtgtgtgtgtg

SEQ ID NO: 464096 - DNA, 16 bp, R. norvegicus
aaacagtttggaacca

SEQ ID NO: 464097 - DNA, 16 bp, R. norvegicus
aaacagtttttaaaaa

SEQ ID NO: 464098 - DNA, 16 bp, R. norvegicus
aaacataatcaaacag

SEQ ID NO: 464099 - DNA, 16 bp, R. norvegicus
aaacatacccaagagg

SEQ ID NO: 464100 - DNA, 16 bp, R. norvegicus
aaacatatcagaaaat

SEQ ID NO: 464101 - DNA, 16 bp, R. norvegicus
aaacatcaacaacaga

SEQ ID NO: 464102 - DNA, 16 bp, R. norvegicus
aaacatcatgaccaag

SEQ ID NO: 464103 - DNA, 16 bp, R. norvegicus
aaacatccaggacaca

SEQ ID NO: 464104 - DNA, 16 bp, R. norvegicus
aaacatcttattttta

SEQ ID NO: 464105 - DNA, 16 bp, R. norvegicus
aaacatgaaattcatt

SEQ ID NO: 464106 - DNA, 16 bp, R. norvegicus
aaacatgagtttaaaa

SEQ ID NO: 464107 - DNA, 16 bp, R. norvegicus
aaacatgattttaaaa

SEQ ID NO: 464108 - DNA, 16 bp, R. norvegicus
aaacatggagaaatca

SEQ ID NO: 464109 - DNA, 16 bp, R. norvegicus
aaacatgggctggaga

SEQ ID NO: 464110 - DNA, 16 bp, R. norvegicus
aaacatggtcaagttg

SEQ ID NO: 464111 - DNA, 16 bp, R. norvegicus
aaacatgtttttaaaa

SEQ ID NO: 464112 - DNA, 17 bp, R. norvegicus
aaacattaaatgacttt

SEQ ID NO: 464113 - DNA, 16 bp, R. norvegicus
aaacattcatagaaga

SEQ ID NO: 464114 - DNA, 16 bp, R. norvegicus
aaacattctcaataaa

SEQ ID NO: 464115 - DNA, 16 bp, R. norvegicus
aaacattggcaatggc

SEQ ID NO: 464116 - DNA, 16 bp, R. norvegicus
aaacatttaaaatgtg

SEQ ID NO: 464117 - DNA, 16 bp, R. norvegicus
aaacatttaattgtgg

SEQ ID NO: 464118 - DNA, 16 bp, R. norvegicus
aaacatttacagaaaa

SEQ ID NO: 464119 - DNA, 16 bp, R. norvegicus
aaacatttcattgagg

SEQ ID NO: 464120 - DNA, 16 bp, R. norvegicus
aaacatttgcattttg

SEQ ID NO: 464121 - DNA, 16 bp, R. norvegicus
aaacatttggaaaaat

SEQ ID NO: 464122 - DNA, 16 bp, R. norvegicus
aaacattttaaagaaa

SEQ ID NO: 464123 - DNA, 16 bp, R. norvegicus
aaacattttcagctga

SEQ ID NO: 464124 - DNA, 16 bp, R. norvegicus
aaacattttctcattt

SEQ ID NO: 464125 - DNA, 16 bp, R. norvegicus
aaacattttcttttcc

SEQ ID NO: 464126 - DNA, 16 bp, R. norvegicus
aaacattttgaaaaaa

SEQ ID NO: 464127 - DNA, 16 bp, R. norvegicus
aaacatttttagtttt

SEQ ID NO: 464128 - DNA, 16 bp, R. norvegicus
aaaccaaaatattcca

SEQ ID NO: 464129 - DNA, 16 bp, R. norvegicus
aaaccaaaatggagga

SEQ ID NO: 464130 - DNA, 16 bp, R. norvegicus
aaaccaaaccttttga

SEQ ID NO: 464131 - DNA, 16 bp, R. norvegicus
aaaccaaaggagacta

SEQ ID NO: 464132 - DNA, 16 bp, R. norvegicus
aaaccaaatagcccaa

SEQ ID NO: 464133 - DNA, 16 bp, R. norvegicus
aaaccaaatggagaga

SEQ ID NO: 464134 - DNA, 16 bp, R. norvegicus
aaaccaagacttcatg

SEQ ID NO: 464135 - DNA, 21 bp, R. norvegicus
aaaccaagagtcaggagttcc

SEQ ID NO: 464136 - DNA, 16 bp, R. norvegicus
aaaccaagccttttga

SEQ ID NO: 464137 - DNA, 16 bp, R. norvegicus
aaaccaaggcagaggc

SEQ ID NO: 464138 - DNA, 16 bp, R. norvegicus
aaaccaagtcaaacca

SEQ ID NO: 464139 - DNA, 16 bp, R. norvegicus
aaaccaataaatgtaa

SEQ ID NO: 464140 - DNA, 16 bp, R. norvegicus
aaaccaatcacagaaa

SEQ ID NO: 464141 - DNA, 16 bp, R. norvegicus
aaaccacagaggaatg

SEQ ID NO: 464142 - DNA, 16 bp, R. norvegicus
aaaccagaaattccca

SEQ ID NO: 464143 - DNA, 16 bp, R. norvegicus
aaaccagaagagtcct

SEQ ID NO: 464144 - DNA, 18 bp, R. norvegicus
aaaccagaagagtctaca

SEQ ID NO: 464145 - DNA, 16 bp, R. norvegicus
aaaccagaagtgtcct

SEQ ID NO: 464146 - DNA, 16 bp, R. norvegicus
aaaccagacaagcaag

SEQ ID NO: 464147 - DNA, 16 bp, R. norvegicus
aaaccagacagtacaa

SEQ ID NO: 464148 - DNA, 16 bp, R. norvegicus
aaaccagagacagagg

SEQ ID NO: 464149 - DNA, 16 bp, R. norvegicus
aaaccagataaagaca

SEQ ID NO: 464150 - DNA, 16 bp, R. norvegicus
aaaccagattatattt

SEQ ID NO: 464151 - DNA, 16 bp, R. norvegicus
aaaccagcagcagcag

SEQ ID NO: 464152 - DNA, 16 bp, R. norvegicus
aaaccagccaggacag

SEQ ID NO: 464153 - DNA, 16 bp, R. norvegicus
aaaccagcctgagcta

SEQ ID NO: 464154 - DNA, 16 bp, R. norvegicus
aaaccagctcctggtt

SEQ ID NO: 464155 - DNA, 16 bp, R. norvegicus
aaaccaggaaggagtt

SEQ ID NO: 464156 - DNA, 16 bp, R. norvegicus
aaaccaggaagggggg

SEQ ID NO: 464157 - DNA, 16 bp, R. norvegicus
aaaccaggagagggga

SEQ ID NO: 464158 - DNA, 16 bp, R. norvegicus
aaaccaggagccaaca

SEQ ID NO: 464159 - DNA, 16 bp, R. norvegicus
aaaccatatttacaca

SEQ ID NO: 464160 - DNA, 16 bp, R. norvegicus
aaaccatcacagtgac

SEQ ID NO: 464161 - DNA, 16 bp, R. norvegicus
aaaccatccctgcctg

SEQ ID NO: 464162 - DNA, 16 bp, R. norvegicus
aaaccatccctgtatg

SEQ ID NO: 464163 - DNA, 16 bp, R. norvegicus
aaaccatctgtaatgg

SEQ ID NO: 464164 - DNA, 16 bp, R. norvegicus
aaacccagaaatgaat

SEQ ID NO: 464165 - DNA, 16 bp, R. norvegicus
aaacccagacactctt

SEQ ID NO: 464166 - DNA, 16 bp, R. norvegicus
aaacccagagctttgt

SEQ ID NO: 464167 - DNA, 16 bp, R. norvegicus
aaacccagaggaaaag

SEQ ID NO: 464168 - DNA, 16 bp, R. norvegicus
aaacccaggaaaagct

SEQ ID NO: 464169 - DNA, 16 bp, R. norvegicus
aaacccagggccttga

SEQ ID NO: 464170 - DNA, 16 bp, R. norvegicus
aaacccagtcactatt

SEQ ID NO: 464171 - DNA, 16 bp, R. norvegicus
aaacccagtctcaaaa

SEQ ID NO: 464172 - DNA, 16 bp, R. norvegicus
aaacccattactttgt

SEQ ID NO: 464173 - DNA, 16 bp, R. norvegicus
aaacccattattttat

SEQ ID NO: 464174 - DNA, 16 bp, R. norvegicus
aaaccccctagctttc

SEQ ID NO: 464175 - DNA, 16 bp, R. norvegicus
aaaccctaagacattg

SEQ ID NO: 464176 - DNA, 16 bp, R. norvegicus
aaaccctctatcccat

SEQ ID NO: 464177 - DNA, 16 bp, R. norvegicus
aaaccctgacactatt

SEQ ID NO: 464178 - DNA, 16 bp, R. norvegicus
aaaccctgactcaaaa

SEQ ID NO: 464179 - DNA, 16 bp, R. norvegicus
aaaccctgagtaagac

SEQ ID NO: 464180 - DNA, 16 bp, R. norvegicus
aaaccctgcctggaaa

SEQ ID NO: 464181 - DNA, 17 bp, R. norvegicus
aaaccctggaccaccca

SEQ ID NO: 464182 - DNA, 16 bp, R. norvegicus
aaaccctggagataga

SEQ ID NO: 464183 - DNA, 16 bp, R. norvegicus
aaaccctgtctcggaa

SEQ ID NO: 464184 - DNA, 16 bp, R. norvegicus
aaaccctgtctggaaa

SEQ ID NO: 464185 - DNA, 16 bp, R. norvegicus
aaaccctttcagcttc

SEQ ID NO: 464186 - DNA, 16 bp, R. norvegicus
aaaccctttctcccct

SEQ ID NO: 464187 - DNA, 16 bp, R. norvegicus
aaaccctttctttccc

SEQ ID NO: 464188 - DNA, 16 bp, R. norvegicus
aaaccgaatcaaagaa

SEQ ID NO: 464189 - DNA, 16 bp, R. norvegicus
aaacctaagaaagaga

SEQ ID NO: 464190 - DNA, 16 bp, R. norvegicus
aaacctaagaataata

SEQ ID NO: 464191 - DNA, 16 bp, R. norvegicus
aaacctaaggaagaga

SEQ ID NO: 464192 - DNA, 41 bp, R. norvegicus
aaacctagggaagcatctggaacacatgggcactggaaaaa

SEQ ID NO: 464193 - DNA, 16 bp, R. norvegicus
aaacctagtcactatt

SEQ ID NO: 464194 - DNA, 16 bp, R. norvegicus
aaacctcaaaacccat

SEQ ID NO: 464195 - DNA, 16 bp, R. norvegicus
aaacctcaaagcccca

SEQ ID NO: 464196 - DNA, 16 bp, R. norvegicus
aaacctcaaagccccc

SEQ ID NO: 464197 - DNA, 16 bp, R. norvegicus
aaacctcaaggcccac

SEQ ID NO: 464198 - DNA, 16 bp, R. norvegicus
aaacctcagatgacaa

SEQ ID NO: 464199 - DNA, 16 bp, R. norvegicus
aaacctccaagcacaa

SEQ ID NO: 464200 - DNA, 16 bp, R. norvegicus
aaacctcttgttgatt

SEQ ID NO: 464201 - DNA, 16 bp, R. norvegicus
aaacctggaaaaggaa

SEQ ID NO: 464202 - DNA, 16 bp, R. norvegicus
aaacctggaggcagaa

SEQ ID NO: 464203 - DNA, 16 bp, R. norvegicus
aaacctggcatggtgg

SEQ ID NO: 464204 - DNA, 16 bp, R. norvegicus
aaacctgtgtgtcagc

SEQ ID NO: 464205 - DNA, 16 bp, R. norvegicus
aaaccttacaaatgta

SEQ ID NO: 464206 - DNA, 16 bp, R. norvegicus
aaaccttctatcccat

SEQ ID NO: 464207 - DNA, 16 bp, R. norvegicus
aaaccttctcttcctc

SEQ ID NO: 464208 - DNA, 16 bp, R. norvegicus
aaaccttgccttgaaa

SEQ ID NO: 464209 - DNA, 16 bp, R. norvegicus
aaaccttgcttttcca

SEQ ID NO: 464210 - DNA, 16 bp, R. norvegicus
aaaccttgtctcaaaa

SEQ ID NO: 464211 - DNA, 16 bp, R. norvegicus
aaacctttaaagaaaa

SEQ ID NO: 464212 - DNA, 16 bp, R. norvegicus
aaacctttgctttgct

SEQ ID NO: 464213 - DNA, 17 bp, R. norvegicus
aaacgaagatattccat

SEQ ID NO: 464214 - DNA, 16 bp, R. norvegicus
aaacgactttatgaaa

SEQ ID NO: 464215 - DNA, 16 bp, R. norvegicus
aaacgccaaacgcaca

SEQ ID NO: 464216 - DNA, 16 bp, R. norvegicus
aaacgccaaatgcaca

SEQ ID NO: 464217 - DNA, 16 bp, R. norvegicus
aaactaaaagaagtta

SEQ ID NO: 464218 - DNA, 16 bp, R. norvegicus
aaactaaacctctgaa

SEQ ID NO: 464219 - DNA, 16 bp, R. norvegicus
aaactaaatgacttca

SEQ ID NO: 464220 - DNA, 16 bp, R. norvegicus
aaactaacagaagaga

SEQ ID NO: 464221 - DNA, 16 bp, R. norvegicus
aaactaagtgaaatca

SEQ ID NO: 464222 - DNA, 16 bp, R. norvegicus
aaactaatcagaagag

SEQ ID NO: 464223 - DNA, 16 bp, R. norvegicus
aaactaattgaagaaa

SEQ ID NO: 464224 - DNA, 16 bp, R. norvegicus
aaactacacagagaaa

SEQ ID NO: 464225 - DNA, 16 bp, R. norvegicus
aaactaccaagatgaa

SEQ ID NO: 464226 - DNA, 16 bp, R. norvegicus
aaactagggaagcata

SEQ ID NO: 464227 - DNA, 16 bp, R. norvegicus
aaactaggggctgggg

SEQ ID NO: 464228 - DNA, 16 bp, R. norvegicus
aaactatatgaaaata

SEQ ID NO: 464229 - DNA, 16 bp, R. norvegicus
aaactatttaaacaac

SEQ ID NO: 464230 - DNA, 16 bp, R. norvegicus
aaactatttgacaaaa

SEQ ID NO: 464231 - DNA, 16 bp, R. norvegicus
aaactattttcaaaat

SEQ ID NO: 464232 - DNA, 16 bp, R. norvegicus
aaactcaaagcacaca

SEQ ID NO: 464233 - DNA, 16 bp, R. norvegicus
aaactcaagtggcagc

SEQ ID NO: 464234 - DNA, 16 bp, R. norvegicus
aaactcacaaagaacc

SEQ ID NO: 464235 - DNA, 16 bp, R. norvegicus
aaactcacagaggtcc

SEQ ID NO: 464236 - DNA, 16 bp, R. norvegicus
aaactcaccgagatcc

SEQ ID NO: 464237 - DNA, 16 bp, R. norvegicus
aaactcagaaatgaaa

SEQ ID NO: 464238 - DNA, 16 bp, R. norvegicus
aaactcagaggacaac

SEQ ID NO: 464239 - DNA, 16 bp, R. norvegicus
aaactcagatgacaac

SEQ ID NO: 464240 - DNA, 16 bp, R. norvegicus
aaactcaggttctcct

SEQ ID NO: 464241 - DNA, 16 bp, R. norvegicus
aaactcatacttctga

SEQ ID NO: 464242 - DNA, 16 bp, R. norvegicus
aaactcatcaaaaaag

SEQ ID NO: 464243 - DNA, 16 bp, R. norvegicus
aaactcatcaaaggaa

SEQ ID NO: 464244 - DNA, 16 bp, R. norvegicus
aaactcattggcacag

SEQ ID NO: 464245 - DNA, 16 bp, R. norvegicus
aaactccagaaggatg

SEQ ID NO: 464246 - DNA, 16 bp, R. norvegicus
aaactccagctccagg

SEQ ID NO: 464247 - DNA, 16 bp, R. norvegicus
aaactcctgatcctcc

SEQ ID NO: 464248 - DNA, 16 bp, R. norvegicus
aaactctagaggcttg

SEQ ID NO: 464249 - DNA, 16 bp, R. norvegicus
aaactctcagagatct

SEQ ID NO: 464250 - DNA, 16 bp, R. norvegicus
aaactctgtctcagaa

SEQ ID NO: 464251 - DNA, 17 bp, R. norvegicus
aaactcttagctctgag

SEQ ID NO: 464252 - DNA, 16 bp, R. norvegicus
aaactctttaagttag

SEQ ID NO: 464253 - DNA, 16 bp, R. norvegicus
aaactgaaagaggaaa

SEQ ID NO: 464254 - DNA, 16 bp, R. norvegicus
aaactgaagaagatct

SEQ ID NO: 464255 - DNA, 16 bp, R. norvegicus
aaactgagaaagagaa

SEQ ID NO: 464256 - DNA, 16 bp, R. norvegicus
aaactgagaaaggaaa

SEQ ID NO: 464257 - DNA, 16 bp, R. norvegicus
aaactgaggaaagaaa

SEQ ID NO: 464258 - DNA, 16 bp, R. norvegicus
aaactgaggcagagag

SEQ ID NO: 464259 - DNA, 16 bp, R. norvegicus
aaactgaggctcaggg

SEQ ID NO: 464260 - DNA, 16 bp, R. norvegicus
aaactgattttaaaat

SEQ ID NO: 464261 - DNA, 16 bp, R. norvegicus
aaactgcagggacaaa

SEQ ID NO: 464262 - DNA, 16 bp, R. norvegicus
aaactgcagttgggat

SEQ ID NO: 464263 - DNA, 16 bp, R. norvegicus
aaactgcattctaaat

SEQ ID NO: 464264 - DNA, 17 bp, R. norvegicus
aaactgcttgaagaaga

SEQ ID NO: 464265 - DNA, 26 bp, R. norvegicus
aaactggaaaatatcatcctgagtga

SEQ ID NO: 464266 - DNA, 16 bp, R. norvegicus
aaactggaaacaaacc

SEQ ID NO: 464267 - DNA, 16 bp, R. norvegicus
aaactggaaacagaaa

SEQ ID NO: 464268 - DNA, 16 bp, R. norvegicus
aaactggaaaggagga

SEQ ID NO: 464269 - DNA, 16 bp, R. norvegicus
aaactggaagagaaaa

SEQ ID NO: 464270 - DNA, 16 bp, R. norvegicus
aaactggaaggaaaaa

SEQ ID NO: 464271 - DNA, 16 bp, R. norvegicus
aaactggagagagaat

SEQ ID NO: 464272 - DNA, 16 bp, R. norvegicus
aaactggcctcaaact

SEQ ID NO: 464273 - DNA, 16 bp, R. norvegicus
aaactggccttgaact

SEQ ID NO: 464274 - DNA, 16 bp, R. norvegicus
aaactgggaaagagaa

SEQ ID NO: 464275 - DNA, 16 bp, R. norvegicus
aaactgggaaggaaga

SEQ ID NO: 464276 - DNA, 16 bp, R. norvegicus
aaactgggcacagtgg

SEQ ID NO: 464277 - DNA, 16 bp, R. norvegicus
aaactggtacaagcac

SEQ ID NO: 464278 - DNA, 16 bp, R. norvegicus
aaactgtaaagaactt

SEQ ID NO: 464279 - DNA, 16 bp, R. norvegicus
aaactgtgaatgcttc

SEQ ID NO: 464280 - DNA, 16 bp, R. norvegicus
aaactgttagaagaaa

SEQ ID NO: 464281 - DNA, 16 bp, R. norvegicus
aaactgttccacaaaa

SEQ ID NO: 464282 - DNA, 16 bp, R. norvegicus
aaactgtttaaaaata

SEQ ID NO: 464283 - DNA, 16 bp, R. norvegicus
aaactgtttttaaaaa

SEQ ID NO: 464284 - DNA, 16 bp, R. norvegicus
aaacttaaaacatttt

SEQ ID NO: 464285 - DNA, 16 bp, R. norvegicus
aaacttaattccacct

SEQ ID NO: 464286 - DNA, 16 bp, R. norvegicus
aaacttaatttctgtt

SEQ ID NO: 464287 - DNA, 16 bp, R. norvegicus
aaacttacacaatatc

SEQ ID NO: 464288 - DNA, 16 bp, R. norvegicus
aaacttcaagaactat

SEQ ID NO: 464289 - DNA, 16 bp, R. norvegicus
aaacttcaatgaaaat

SEQ ID NO: 464290 - DNA, 26 bp, R. norvegicus
aaacttcacagagtcatactgatcag

SEQ ID NO: 464291 - DNA, 16 bp, R. norvegicus
aaacttcaggtgacaa

SEQ ID NO: 464292 - DNA, 16 bp, R. norvegicus
aaacttcatcaaagaa

SEQ ID NO: 464293 - DNA, 16 bp, R. norvegicus
aaacttccaaaggagg

SEQ ID NO: 464294 - DNA, 16 bp, R. norvegicus
aaacttccccaaacta

SEQ ID NO: 464295 - DNA, 16 bp, R. norvegicus
aaacttcctgggacct

SEQ ID NO: 464296 - DNA, 16 bp, R. norvegicus
aaacttctagaaatga

SEQ ID NO: 464297 - DNA, 16 bp, R. norvegicus
aaacttctccagccca

SEQ ID NO: 464298 - DNA, 16 bp, R. norvegicus
aaacttctctttctaa

SEQ ID NO: 464299 - DNA, 16 bp, R. norvegicus
aaacttctgaatctgt

SEQ ID NO: 464300 - DNA, 16 bp, R. norvegicus
aaacttctgatttctt

SEQ ID NO: 464301 - DNA, 16 bp, R. norvegicus
aaacttcttagaattt

SEQ ID NO: 464302 - DNA, 16 bp, R. norvegicus
aaacttctttcttctg

SEQ ID NO: 464303 - DNA, 16 bp, R. norvegicus
aaacttctttttgcaa

SEQ ID NO: 464304 - DNA, 16 bp, R. norvegicus
aaacttgaagattgtg

SEQ ID NO: 464305 - DNA, 16 bp, R. norvegicus
aaacttgaagcaatca

SEQ ID NO: 464306 - DNA, 16 bp, R. norvegicus
aaacttgttttatttt

SEQ ID NO: 464307 - DNA, 16 bp, R. norvegicus
aaactttaaaggaaaa

SEQ ID NO: 464308 - DNA, 16 bp, R. norvegicus
aaactttctgtaaggc

SEQ ID NO: 464309 - DNA, 16 bp, R. norvegicus
aaactttcttttaaaa

SEQ ID NO: 464310 - DNA, 16 bp, R. norvegicus
aaactttgaagtttta

SEQ ID NO: 464311 - DNA, 16 bp, R. norvegicus
aaacttttctgctcca

SEQ ID NO: 464312 - DNA, 16 bp, R. norvegicus
aaagaaaaaaaccctt

SEQ ID NO: 464313 - DNA, 16 bp, R. norvegicus
aaagaaaaaatgtcat

SEQ ID NO: 464314 - DNA, 16 bp, R. norvegicus
aaagaaaaagaacttc

SEQ ID NO: 464315 - DNA, 17 bp, R. norvegicus
aaagaaaaagtccctga

SEQ ID NO: 464316 - DNA, 16 bp, R. norvegicus
aaagaaaaatgctatt

SEQ ID NO: 464317 - DNA, 16 bp, R. norvegicus
aaagaaaaattcattt

SEQ ID NO: 464318 - DNA, 16 bp, R. norvegicus
aaagaaaacaaatctt

SEQ ID NO: 464319 - DNA, 16 bp, R. norvegicus
aaagaaaacaaatttt

SEQ ID NO: 464320 - DNA, 16 bp, R. norvegicus
aaagaaaacatacatt

SEQ ID NO: 464321 - DNA, 16 bp, R. norvegicus
aaagaaaacatttctt

SEQ ID NO: 464322 - DNA, 16 bp, R. norvegicus
aaagaaaaccttagaa

SEQ ID NO: 464323 - DNA, 16 bp, R. norvegicus
aaagaaaactgacttt

SEQ ID NO: 464324 - DNA, 16 bp, R. norvegicus
aaagaaaactttgaaa

SEQ ID NO: 464325 - DNA, 16 bp, R. norvegicus
aaagaaaaggaatgca

SEQ ID NO: 464326 - DNA, 17 bp, R. norvegicus
aaagaaaaggtcatcca

SEQ ID NO: 464327 - DNA, 16 bp, R. norvegicus
aaagaaaagtttcttt

SEQ ID NO: 464328 - DNA, 16 bp, R. norvegicus
aaagaaaataatgtca

SEQ ID NO: 464329 - DNA, 16 bp, R. norvegicus
aaagaaaatattctca

SEQ ID NO: 464330 - DNA, 16 bp, R. norvegicus
aaagaaaatatttcct

SEQ ID NO: 464331 - DNA, 16 bp, R. norvegicus
aaagaaaatccaaact

SEQ ID NO: 464332 - DNA, 16 bp, R. norvegicus
aaagaaaatgggctgg

SEQ ID NO: 464333 - DNA, 16 bp, R. norvegicus
aaagaaaatgtgaaac

SEQ ID NO: 464334 - DNA, 16 bp, R. norvegicus
aaagaaaatgtggaat

SEQ ID NO: 464335 - DNA, 16 bp, R. norvegicus
aaagaaaattaaactt

SEQ ID NO: 464336 - DNA, 16 bp, R. norvegicus
aaagaaaattaacttt

SEQ ID NO: 464337 - DNA, 16 bp, R. norvegicus
aaagaaaattcactgt

SEQ ID NO: 464338 - DNA, 16 bp, R. norvegicus
aaagaaaattctcaaa

SEQ ID NO: 464339 - DNA, 16 bp, R. norvegicus
aaagaaacacagggac

SEQ ID NO: 464340 - DNA, 16 bp, R. norvegicus
aaagaaacactttaaa

SEQ ID NO: 464341 - DNA, 16 bp, R. norvegicus
aaagaaacagcttttg

SEQ ID NO: 464342 - DNA, 16 bp, R. norvegicus
aaagaaacatttcaaa

SEQ ID NO: 464343 - DNA, 16 bp, R. norvegicus
aaagaaacatttttct

SEQ ID NO: 464344 - DNA, 16 bp, R. norvegicus
aaagaaaccttacaaa

SEQ ID NO: 464345 - DNA, 16 bp, R. norvegicus
aaagaaaccttcctaa

SEQ ID NO: 464346 - DNA, 16 bp, R. norvegicus
aaagaaactaagacat

SEQ ID NO: 464347 - DNA, 16 bp, R. norvegicus
aaagaaactcctccta

SEQ ID NO: 464348 - DNA, 16 bp, R. norvegicus
aaagaaactgaagaca

SEQ ID NO: 464349 - DNA, 16 bp, R. norvegicus
aaagaaactgaagact

SEQ ID NO: 464350 - DNA, 16 bp, R. norvegicus
aaagaaactgaagata

SEQ ID NO: 464351 - DNA, 16 bp, R. norvegicus
aaagaaactgagaaag

SEQ ID NO: 464352 - DNA, 16 bp, R. norvegicus
aaagaaactggaaaga

SEQ ID NO: 464353 - DNA, 16 bp, R. norvegicus
aaagaaactggacaga

SEQ ID NO: 464354 - DNA, 16 bp, R. norvegicus
aaagaaacttccagaa

SEQ ID NO: 464355 - DNA, 16 bp, R. norvegicus
aaagaaagaaaacctt

SEQ ID NO: 464356 - DNA, 16 bp, R. norvegicus
aaagaaagaaatcctt

SEQ ID NO: 464357 - DNA, 16 bp, R. norvegicus
aaagaaagaaatgacc

SEQ ID NO: 464358 - DNA, 16 bp, R. norvegicus
aaagaaagaaattcta

SEQ ID NO: 464359 - DNA, 16 bp, R. norvegicus
aaagaaagaatttcaa

SEQ ID NO: 464360 - DNA, 16 bp, R. norvegicus
aaagaaagaatttcag

SEQ ID NO: 464361 - DNA, 16 bp, R. norvegicus
aaagaaagacgtgaag

SEQ ID NO: 464362 - DNA, 16 bp, R. norvegicus
aaagaaagagaacgtc

SEQ ID NO: 464363 - DNA, 16 bp, R. norvegicus
aaagaaagagatgcca

SEQ ID NO: 464364 - DNA, 16 bp, R. norvegicus
aaagaaagatctagat

SEQ ID NO: 464365 - DNA, 16 bp, R. norvegicus
aaagaaagatgcccat

SEQ ID NO: 464366 - DNA, 16 bp, R. norvegicus
aaagaaagatgtcaaa

SEQ ID NO: 464367 - DNA, 16 bp, R. norvegicus
aaagaaagattttttt

SEQ ID NO: 464368 - DNA, 16 bp, R. norvegicus
aaagaaagcatcttca

SEQ ID NO: 464369 - DNA, 16 bp, R. norvegicus
aaagaaagccatgggc

SEQ ID NO: 464370 - DNA, 16 bp, R. norvegicus
aaagaaagccattttt

SEQ ID NO: 464371 - DNA, 16 bp, R. norvegicus
aaagaaaggccttcat

SEQ ID NO: 464372 - DNA, 16 bp, R. norvegicus
aaagaaagggcatcaa

SEQ ID NO: 464373 - DNA, 16 bp, R. norvegicus
aaagaaagttctagaa

SEQ ID NO: 464374 - DNA, 16 bp, R. norvegicus
aaagaaagttctggaa

SEQ ID NO: 464375 - DNA, 16 bp, R. norvegicus
aaagaaataaagttgt

SEQ ID NO: 464376 - DNA, 16 bp, R. norvegicus
aaagaaatacagagac

SEQ ID NO: 464377 - DNA, 16 bp, R. norvegicus
aaagaaatacaggcaa

SEQ ID NO: 464378 - DNA, 16 bp, R. norvegicus
aaagaaatatccaata

SEQ ID NO: 464379 - DNA, 16 bp, R. norvegicus
aaagaaatcaaagatc

SEQ ID NO: 464380 - DNA, 16 bp, R. norvegicus
aaagaaatcaaagatg

SEQ ID NO: 464381 - DNA, 16 bp, R. norvegicus
aaagaaatcaagaagt

SEQ ID NO: 464382 - DNA, 16 bp, R. norvegicus
aaagaaatcaaggaag

SEQ ID NO: 464383 - DNA, 16 bp, R. norvegicus
aaagaaatcacagagg

SEQ ID NO: 464384 - DNA, 16 bp, R. norvegicus
aaagaaatcagtgaaa

SEQ ID NO: 464385 - DNA, 16 bp, R. norvegicus
aaagaaatcatcctga

SEQ ID NO: 464386 - DNA, 16 bp, R. norvegicus
aaagaaatccaggaaa

SEQ ID NO: 464387 - DNA, 16 bp, R. norvegicus
aaagaaatccttaaaa

SEQ ID NO: 464388 - DNA, 16 bp, R. norvegicus
aaagaaatcgaagaag

SEQ ID NO: 464389 - DNA, 19 bp, R. norvegicus
aaagaaatcgaagatctca

SEQ ID NO: 464390 - DNA, 16 bp, R. norvegicus
aaagaaatctcagaaa

SEQ ID NO: 464391 - DNA, 16 bp, R. norvegicus
aaagaaatcttcaaca

SEQ ID NO: 464392 - DNA, 16 bp, R. norvegicus
aaagaaatctttgaaa

SEQ ID NO: 464393 - DNA, 16 bp, R. norvegicus
aaagaaatgcagaaca

SEQ ID NO: 464394 - DNA, 16 bp, R. norvegicus
aaagaaatgcaggaca

SEQ ID NO: 464395 - DNA, 16 bp, R. norvegicus
aaagaaatggaagagc

SEQ ID NO: 464396 - DNA, 16 bp, R. norvegicus
aaagaaatggctgaga

SEQ ID NO: 464397 - DNA, 16 bp, R. norvegicus
aaagaaatgtccaaaa

SEQ ID NO: 464398 - DNA, 16 bp, R. norvegicus
aaagaaatgtgtgaaa

SEQ ID NO: 464399 - DNA, 16 bp, R. norvegicus
aaagaaatgttatttt

SEQ ID NO: 464400 - DNA, 16 bp, R. norvegicus
aaagaaatgttcaaaa

SEQ ID NO: 464401 - DNA, 16 bp, R. norvegicus
aaagaaatgttcacat

SEQ ID NO: 464402 - DNA, 16 bp, R. norvegicus
aaagaaatgttctaca

SEQ ID NO: 464403 - DNA, 16 bp, R. norvegicus
aaagaaatgtttaatg

SEQ ID NO: 464404 - DNA, 16 bp, R. norvegicus
aaagaaatgtttattt

SEQ ID NO: 464405 - DNA, 16 bp, R. norvegicus
aaagaaatgtttgttt

SEQ ID NO: 464406 - DNA, 16 bp, R. norvegicus
aaagaaatgtttttat

SEQ ID NO: 464407 - DNA, 16 bp, R. norvegicus
aaagaaatgtttttct

SEQ ID NO: 464408 - DNA, 16 bp, R. norvegicus
aaagaaattaaaactt

SEQ ID NO: 464409 - DNA, 16 bp, R. norvegicus
aaagaaattagggaca

SEQ ID NO: 464410 - DNA, 16 bp, R. norvegicus
aaagaaattctggaaa

SEQ ID NO: 464411 - DNA, 16 bp, R. norvegicus
aaagaaattgatgaag

SEQ ID NO: 464412 - DNA, 16 bp, R. norvegicus
aaagaaattgggaaat

SEQ ID NO: 464413 - DNA, 16 bp, R. norvegicus
aaagaaattgtagaag

SEQ ID NO: 464414 - DNA, 16 bp, R. norvegicus
aaagaacacatgaaac

SEQ ID NO: 464415 - DNA, 16 bp, R. norvegicus
aaagaacacattgaaa

SEQ ID NO: 464416 - DNA, 16 bp, R. norvegicus
aaagaacatatggaaa

SEQ ID NO: 464417 - DNA, 16 bp, R. norvegicus
aaagaacatctggagg

SEQ ID NO: 464418 - DNA, 16 bp, R. norvegicus
aaagaacatttctttt

SEQ ID NO: 464419 - DNA, 16 bp, R. norvegicus
aaagaacattttcaaa

SEQ ID NO: 464420 - DNA, 16 bp, R. norvegicus
aaagaaccaaattttg

SEQ ID NO: 464421 - DNA, 16 bp, R. norvegicus
aaagaaccagtaaata

SEQ ID NO: 464422 - DNA, 16 bp, R. norvegicus
aaagaaccatgaggag

SEQ ID NO: 464423 - DNA, 16 bp, R. norvegicus
aaagaacccaagaagc

SEQ ID NO: 464424 - DNA, 16 bp, R. norvegicus
aaagaacccagatgtc

SEQ ID NO: 464425 - DNA, 16 bp, R. norvegicus
aaagaactcaaaaagt

SEQ ID NO: 464426 - DNA, 16 bp, R. norvegicus
aaagaactcaaagagc

SEQ ID NO: 464427 - DNA, 16 bp, R. norvegicus
aaagaactcaagaaca

SEQ ID NO: 464428 - DNA, 16 bp, R. norvegicus
aaagaactcaagaaga

SEQ ID NO: 464429 - DNA, 17 bp, R. norvegicus
aaagaactcaaggagtt

SEQ ID NO: 464430 - DNA, 16 bp, R. norvegicus
aaagaactcaggaagt

SEQ ID NO: 464431 - DNA, 16 bp, R. norvegicus
aaagaactctcttaga

SEQ ID NO: 464432 - DNA, 16 bp, R. norvegicus
aaagaactgaaaaagt

SEQ ID NO: 464433 - DNA, 16 bp, R. norvegicus
aaagaactgcaggaac

SEQ ID NO: 464434 - DNA, 16 bp, R. norvegicus
aaagaacttcaaacca

SEQ ID NO: 464435 - DNA, 16 bp, R. norvegicus
aaagaacttcaagttt

SEQ ID NO: 464436 - DNA, 16 bp, R. norvegicus
aaagaacttgaagaag

SEQ ID NO: 464437 - DNA, 16 bp, R. norvegicus
aaagaactttatttta

SEQ ID NO: 464438 - DNA, 16 bp, R. norvegicus
aaagaacttttctaaa

SEQ ID NO: 464439 - DNA, 16 bp, R. norvegicus
aaagaagaaaatgtca

SEQ ID NO: 464440 - DNA, 16 bp, R. norvegicus
aaagaagaaacattta

SEQ ID NO: 464441 - DNA, 16 bp, R. norvegicus
aaagaagaaagcaatc

SEQ ID NO: 464442 - DNA, 16 bp, R. norvegicus
aaagaagaaatatgtt

SEQ ID NO: 464443 - DNA, 16 bp, R. norvegicus
aaagaagaacatttaa

SEQ ID NO: 464444 - DNA, 16 bp, R. norvegicus
aaagaagaagctgcag

SEQ ID NO: 464445 - DNA, 16 bp, R. norvegicus
aaagaagaagtcagaa

SEQ ID NO: 464446 - DNA, 16 bp, R. norvegicus
aaagaagaatctattt

SEQ ID NO: 464447 - DNA, 16 bp, R. norvegicus
aaagaagaattaatgc

SEQ ID NO: 464448 - DNA, 16 bp, R. norvegicus
aaagaagacatggaaa

SEQ ID NO: 464449 - DNA, 16 bp, R. norvegicus
aaagaagactcagaga

SEQ ID NO: 464450 - DNA, 16 bp, R. norvegicus
aaagaagactctcaga

SEQ ID NO: 464451 - DNA, 28 bp, R. norvegicus
aaagaagaggaagctagagagctaaaga

SEQ ID NO: 464452 - DNA, 16 bp, R. norvegicus
aaagaagataacattt

SEQ ID NO: 464453 - DNA, 16 bp, R. norvegicus
aaagaagatcaagggg

SEQ ID NO: 464454 - DNA, 16 bp, R. norvegicus
aaagaagatgtcaaaa

SEQ ID NO: 464455 - DNA, 16 bp, R. norvegicus
aaagaagcaaatgcac

SEQ ID NO: 464456 - DNA, 16 bp, R. norvegicus
aaagaagcaaatttac

SEQ ID NO: 464457 - DNA, 16 bp, R. norvegicus
aaagaagccaaaatca

SEQ ID NO: 464458 - DNA, 16 bp, R. norvegicus
aaagaagccaaaccat

SEQ ID NO: 464459 - DNA, 16 bp, R. norvegicus
aaagaagctgaggagg

SEQ ID NO: 464460 - DNA, 16 bp, R. norvegicus
aaagaagctggagaga

SEQ ID NO: 464461 - DNA, 16 bp, R. norvegicus
aaagaagctggagttg

SEQ ID NO: 464462 - DNA, 16 bp, R. norvegicus
aaagaagcttcctcct

SEQ ID NO: 464463 - DNA, 16 bp, R. norvegicus
aaagaagcttctcttt

SEQ ID NO: 464464 - DNA, 16 bp, R. norvegicus
aaagaagcttcttttg

SEQ ID NO: 464465 - DNA, 16 bp, R. norvegicus
aaagaagctttgcagt

SEQ ID NO: 464466 - DNA, 16 bp, R. norvegicus
aaagaaggaaatacac

SEQ ID NO: 464467 - DNA, 16 bp, R. norvegicus
aaagaaggaattgggt

SEQ ID NO: 464468 - DNA, 17 bp, R. norvegicus
aaagaaggagtgaagca

SEQ ID NO: 464469 - DNA, 16 bp, R. norvegicus
aaagaaggagtgaagt

SEQ ID NO: 464470 - DNA, 16 bp, R. norvegicus
aaagaaggatgggtgg

SEQ ID NO: 464471 - DNA, 24 bp, R. norvegicus
aaagaaggccaaggggaagaaggt

SEQ ID NO: 464472 - DNA, 16 bp, R. norvegicus
aaagaaggctggagag

SEQ ID NO: 464473 - DNA, 16 bp, R. norvegicus
aaagaaggtcaaaggg

SEQ ID NO: 464474 - DNA, 16 bp, R. norvegicus
aaagaagtaaatacat

SEQ ID NO: 464475 - DNA, 16 bp, R. norvegicus
aaagaagtatttgatg

SEQ ID NO: 464476 - DNA, 16 bp, R. norvegicus
aaagaagtcaaagaag

SEQ ID NO: 464477 - DNA, 16 bp, R. norvegicus
aaagaagtccaggaaa

SEQ ID NO: 464478 - DNA, 16 bp, R. norvegicus
aaagaagtgcaagctg

SEQ ID NO: 464479 - DNA, 16 bp, R. norvegicus
aaagaagtgcagtctg

SEQ ID NO: 464480 - DNA, 16 bp, R. norvegicus
aaagaagtggaggctg

SEQ ID NO: 464481 - DNA, 16 bp, R. norvegicus
aaagaagtgttcaaag

SEQ ID NO: 464482 - DNA, 16 bp, R. norvegicus
aaagaagttgaggaag

SEQ ID NO: 464483 - DNA, 16 bp, R. norvegicus
aaagaagttgaggctt

SEQ ID NO: 464484 - DNA, 16 bp, R. norvegicus
aaagaagttggagatc

SEQ ID NO: 464485 - DNA, 21 bp, R. norvegicus
aaagaatcaacagaaccaaaa

SEQ ID NO: 464486 - DNA, 16 bp, R. norvegicus
aaagaatcacaaatct

SEQ ID NO: 464487 - DNA, 16 bp, R. norvegicus
aaagaatcagagacac

SEQ ID NO: 464488 - DNA, 16 bp, R. norvegicus
aaagaatgaatgaaca

SEQ ID NO: 464489 - DNA, 16 bp, R. norvegicus
aaagaatgcagatcga

SEQ ID NO: 464490 - DNA, 17 bp, R. norvegicus
aaagaatgttccagaca

SEQ ID NO: 464491 - DNA, 16 bp, R. norvegicus
aaagaattacaggaaa

SEQ ID NO: 464492 - DNA, 16 bp, R. norvegicus
aaagaattacttttat

SEQ ID NO: 464493 - DNA, 16 bp, R. norvegicus
aaagaattcaagaagt

SEQ ID NO: 464494 - DNA, 16 bp, R. norvegicus
aaagaattcaagaatt

SEQ ID NO: 464495 - DNA, 16 bp, R. norvegicus
aaagaattcaaggaaa

SEQ ID NO: 464496 - DNA, 16 bp, R. norvegicus
aaagaattcatgaagt

SEQ ID NO: 464497 - DNA, 16 bp, R. norvegicus
aaagaattccaggaca

SEQ ID NO: 464498 - DNA, 16 bp, R. norvegicus
aaagaattccgggaaa

SEQ ID NO: 464499 - DNA, 16 bp, R. norvegicus
aaagaattgcaggaaa

SEQ ID NO: 464500 - DNA, 16 bp, R. norvegicus
aaagaatttaaatgac

SEQ ID NO: 464501 - DNA, 16 bp, R. norvegicus
aaagaatttcaggaaa

SEQ ID NO: 464502 - DNA, 16 bp, R. norvegicus
aaagaatttccagatg

SEQ ID NO: 464503 - DNA, 16 bp, R. norvegicus
aaagaatttgaagaag

SEQ ID NO: 464504 - DNA, 16 bp, R. norvegicus
aaagacaaaatatttt

SEQ ID NO: 464505 - DNA, 16 bp, R. norvegicus
aaagacaagcaggcag

SEQ ID NO: 464506 - DNA, 18 bp, R. norvegicus
aaagacacatgttccact

SEQ ID NO: 464507 - DNA, 16 bp, R. norvegicus
aaagacactgtctcaa

SEQ ID NO: 464508 - DNA, 16 bp, R. norvegicus
aaagacagaaatcaca

SEQ ID NO: 464509 - DNA, 16 bp, R. norvegicus
aaagacagagtcagag

SEQ ID NO: 464510 - DNA, 16 bp, R. norvegicus
aaagacagccaggcct

SEQ ID NO: 464511 - DNA, 16 bp, R. norvegicus
aaagacagccttttca

SEQ ID NO: 464512 - DNA, 16 bp, R. norvegicus
aaagacaggacatcaa

SEQ ID NO: 464513 - DNA, 16 bp, R. norvegicus
aaagacagtgacagag

SEQ ID NO: 464514 - DNA, 16 bp, R. norvegicus
aaagacatagaagcag

SEQ ID NO: 464515 - DNA, 16 bp, R. norvegicus
aaagacatgctccact

SEQ ID NO: 464516 - DNA, 16 bp, R. norvegicus
aaagacatggaagaag

SEQ ID NO: 464517 - DNA, 16 bp, R. norvegicus
aaagacattgaacatt

SEQ ID NO: 464518 - DNA, 16 bp, R. norvegicus
aaagacatttaaaaca

SEQ ID NO: 464519 - DNA, 16 bp, R. norvegicus
aaagaccaaatctaaa

SEQ ID NO: 464520 - DNA, 16 bp, R. norvegicus
aaagaccaccaaggag

SEQ ID NO: 464521 - DNA, 16 bp, R. norvegicus
aaagaccagaagaggg

SEQ ID NO: 464522 - DNA, 16 bp, R. norvegicus
aaagaccagcaaagag

SEQ ID NO: 464523 - DNA, 16 bp, R. norvegicus
aaagaccaggaattca

SEQ ID NO: 464524 - DNA, 16 bp, R. norvegicus
aaagaccatcagaaaa

SEQ ID NO: 464525 - DNA, 16 bp, R. norvegicus
aaagaccatccagaga

SEQ ID NO: 464526 - DNA, 16 bp, R. norvegicus
aaagaccctgctgtga

SEQ ID NO: 464527 - DNA, 16 bp, R. norvegicus
aaagacctaaagaaat

SEQ ID NO: 464528 - DNA, 16 bp, R. norvegicus
aaagacctaacaagca

SEQ ID NO: 464529 - DNA, 28 bp, R. norvegicus
aaagacctacaggtgatacagaaagaag

SEQ ID NO: 464530 - DNA, 16 bp, R. norvegicus
aaagacctagaaatga

SEQ ID NO: 464531 - DNA, 16 bp, R. norvegicus
aaagacctctgcaact

SEQ ID NO: 464532 - DNA, 17 bp, R. norvegicus
aaagaccttgttacttt

SEQ ID NO: 464533 - DNA, 37 bp, R. norvegicus
aaagaccttgttattttcgctgctattgtagcagcca

SEQ ID NO: 464534 - DNA, 16 bp, R. norvegicus
aaagacctttactaat

SEQ ID NO: 464535 - DNA, 16 bp, R. norvegicus
aaagactacatgaaat

SEQ ID NO: 464536 - DNA, 16 bp, R. norvegicus
aaagactatacacaga

SEQ ID NO: 464537 - DNA, 23 bp, R. norvegicus
aaagactatacatggactgaccc

SEQ ID NO: 464538 - DNA, 16 bp, R. norvegicus
aaagactatccatgga

SEQ ID NO: 464539 - DNA, 16 bp, R. norvegicus
aaagactcaataaaat

SEQ ID NO: 464540 - DNA, 16 bp, R. norvegicus
aaagactctgtgtgtg

SEQ ID NO: 464541 - DNA, 16 bp, R. norvegicus
aaagactgaaagcctc

SEQ ID NO: 464542 - DNA, 16 bp, R. norvegicus
aaagactgaaggaaaa

SEQ ID NO: 464543 - DNA, 16 bp, R. norvegicus
aaagactgaaggaaag

SEQ ID NO: 464544 - DNA, 16 bp, R. norvegicus
aaagactgaaggaact

SEQ ID NO: 464545 - DNA, 16 bp, R. norvegicus
aaagactggaaaacca

SEQ ID NO: 464546 - DNA, 16 bp, R. norvegicus
aaagactggaagagct

SEQ ID NO: 464547 - DNA, 16 bp, R. norvegicus
aaagacttcagatctg

SEQ ID NO: 464548 - DNA, 16 bp, R. norvegicus
aaagactttttaaaaa

SEQ ID NO: 464549 - DNA, 16 bp, R. norvegicus
aaagagaaaaagctga

SEQ ID NO: 464550 - DNA, 16 bp, R. norvegicus
aaagagaaaattctct

SEQ ID NO: 464551 - DNA, 16 bp, R. norvegicus
aaagagaaactgaaag

SEQ ID NO: 464552 - DNA, 16 bp, R. norvegicus
aaagagaaactggaga

SEQ ID NO: 464553 - DNA, 16 bp, R. norvegicus
aaagagaaagaaatcc

SEQ ID NO: 464554 - DNA, 16 bp, R. norvegicus
aaagagaaagcatctt

SEQ ID NO: 464555 - DNA, 16 bp, R. norvegicus
aaagagaaatggaaac

SEQ ID NO: 464556 - DNA, 16 bp, R. norvegicus
aaagagaacttttaaa

SEQ ID NO: 464557 - DNA, 16 bp, R. norvegicus
aaagagaagaaatact

SEQ ID NO: 464558 - DNA, 16 bp, R. norvegicus
aaagagaagcaagccg

SEQ ID NO: 464559 - DNA, 16 bp, R. norvegicus
aaagagaagcttctct

SEQ ID NO: 464560 - DNA, 16 bp, R. norvegicus
aaagagaaggaacatt

SEQ ID NO: 464561 - DNA, 16 bp, R. norvegicus
aaagagaatgagagca

SEQ ID NO: 464562 - DNA, 16 bp, R. norvegicus
aaagagaatgatacaa

SEQ ID NO: 464563 - DNA, 16 bp, R. norvegicus
aaagagaattttagac

SEQ ID NO: 464564 - DNA, 16 bp, R. norvegicus
aaagagaccctgcctc

SEQ ID NO: 464565 - DNA, 16 bp, R. norvegicus
aaagagaccttgtctc

SEQ ID NO: 464566 - DNA, 16 bp, R. norvegicus
aaagagactggagaga

SEQ ID NO: 464567 - DNA, 16 bp, R. norvegicus
aaagagagacaaacat

SEQ ID NO: 464568 - DNA, 16 bp, R. norvegicus
aaagagagagacactg

SEQ ID NO: 464569 - DNA, 16 bp, R. norvegicus
aaagagatacaaaagg

SEQ ID NO: 464570 - DNA, 16 bp, R. norvegicus
aaagagatgatcatgt

SEQ ID NO: 464571 - DNA, 16 bp, R. norvegicus
aaagagattgttgcca

SEQ ID NO: 464572 - DNA, 16 bp, R. norvegicus
aaagagcaatttgaaa

SEQ ID NO: 464573 - DNA, 16 bp, R. norvegicus
aaagagcacacatgat

SEQ ID NO: 464574 - DNA, 16 bp, R. norvegicus
aaagagcaggtctccc

SEQ ID NO: 464575 - DNA, 16 bp, R. norvegicus
aaagagcatcagatct

SEQ ID NO: 464576 - DNA, 16 bp, R. norvegicus
aaagagcatgcaggga

SEQ ID NO: 464577 - DNA, 16 bp, R. norvegicus
aaagagcccaagacca

SEQ ID NO: 464578 - DNA, 18 bp, R. norvegicus
aaagagcccacgtccaga

SEQ ID NO: 464579 - DNA, 16 bp, R. norvegicus
aaagagctatttgcaa

SEQ ID NO: 464580 - DNA, 16 bp, R. norvegicus
aaagagctcttacaaa

SEQ ID NO: 464581 - DNA, 16 bp, R. norvegicus
aaagagctgaagaggc

SEQ ID NO: 464582 - DNA, 16 bp, R. norvegicus
aaagagcttatgtcag

SEQ ID NO: 464583 - DNA, 16 bp, R. norvegicus
aaagaggaaaacattt

SEQ ID NO: 464584 - DNA, 16 bp, R. norvegicus
aaagaggaaatgcaaa

SEQ ID NO: 464585 - DNA, 16 bp, R. norvegicus
aaagaggaactctcct

SEQ ID NO: 464586 - DNA, 16 bp, R. norvegicus
aaagaggaagcaaata

SEQ ID NO: 464587 - DNA, 16 bp, R. norvegicus
aaagaggaatattcct

SEQ ID NO: 464588 - DNA, 16 bp, R. norvegicus
aaagaggacccagaat

SEQ ID NO: 464589 - DNA, 16 bp, R. norvegicus
aaagaggagatagaac

SEQ ID NO: 464590 - DNA, 29 bp, R. norvegicus
aaagaggagtggaagcctgccagtccttg

SEQ ID NO: 464591 - DNA, 16 bp, R. norvegicus
aaagagggacatggaa

SEQ ID NO: 464592 - DNA, 16 bp, R. norvegicus
aaagagggacctgcca

SEQ ID NO: 464593 - DNA, 16 bp, R. norvegicus
aaagaggtagaggcag

SEQ ID NO: 464594 - DNA, 16 bp, R. norvegicus
aaagaggtgaatgctg

SEQ ID NO: 464595 - DNA, 16 bp, R. norvegicus
aaagagtacttcagac

SEQ ID NO: 464596 - DNA, 16 bp, R. norvegicus
aaagagtatttaaagg

SEQ ID NO: 464597 - DNA, 16 bp, R. norvegicus
aaagagtcaaagacag

SEQ ID NO: 464598 - DNA, 16 bp, R. norvegicus
aaagagtccttcatca

SEQ ID NO: 464599 - DNA, 16 bp, R. norvegicus
aaagagtggcaaggca

SEQ ID NO: 464600 - DNA, 16 bp, R. norvegicus
aaagagttacagaaaa

SEQ ID NO: 464601 - DNA, 16 bp, R. norvegicus
aaagagttagggaaag

SEQ ID NO: 464602 - DNA, 16 bp, R. norvegicus
aaagagttgaagaggc

SEQ ID NO: 464603 - DNA, 16 bp, R. norvegicus
aaagataaagcagaga

SEQ ID NO: 464604 - DNA, 16 bp, R. norvegicus
aaagataagcaaggac

SEQ ID NO: 464605 - DNA, 16 bp, R. norvegicus
aaagataccaggtatc

SEQ ID NO: 464606 - DNA, 16 bp, R. norvegicus
aaagataccagtggaa

SEQ ID NO: 464607 - DNA, 16 bp, R. norvegicus
aaagatactaaggaaa

SEQ ID NO: 464608 - DNA, 16 bp, R. norvegicus
aaagatacttcatact

SEQ ID NO: 464609 - DNA, 17 bp, R. norvegicus
aaagatagcattttcaa

SEQ ID NO: 464610 - DNA, 16 bp, R. norvegicus
aaagatatcagggaaa

SEQ ID NO: 464611 - DNA, 17 bp, R. norvegicus
aaagatattgaacattt

SEQ ID NO: 464612 - DNA, 16 bp, R. norvegicus
aaagatattttaggag

SEQ ID NO: 464613 - DNA, 16 bp, R. norvegicus
aaagatcaaaacagag

SEQ ID NO: 464614 - DNA, 16 bp, R. norvegicus
aaagatcaagagttca

SEQ ID NO: 464615 - DNA, 16 bp, R. norvegicus
aaagatcaagtgactg

SEQ ID NO: 464616 - DNA, 16 bp, R. norvegicus
aaagatcaagtgatga

SEQ ID NO: 464617 - DNA, 16 bp, R. norvegicus
aaagatcagaggagga

SEQ ID NO: 464618 - DNA, 16 bp, R. norvegicus
aaagatcaggtgacca

SEQ ID NO: 464619 - DNA, 16 bp, R. norvegicus
aaagatcatggaaaca

SEQ ID NO: 464620 - DNA, 16 bp, R. norvegicus
aaagatctgtaaaata

SEQ ID NO: 464621 - DNA, 16 bp, R. norvegicus
aaagatcttcacaaac

SEQ ID NO: 464622 - DNA, 16 bp, R. norvegicus
aaagatctttaccaaa

SEQ ID NO: 464623 - DNA, 17 bp, R. norvegicus
aaagatctttaccaatg

SEQ ID NO: 464624 - DNA, 16 bp, R. norvegicus
aaagatcttttccaaa

SEQ ID NO: 464625 - DNA, 16 bp, R. norvegicus
aaagatgacccagatc

SEQ ID NO: 464626 - DNA, 16 bp, R. norvegicus
aaagatggcattttca

SEQ ID NO: 464627 - DNA, 16 bp, R. norvegicus
aaagatggctcagctg

SEQ ID NO: 464628 - DNA, 16 bp, R. norvegicus
aaagatggctcaggag

SEQ ID NO: 464629 - DNA, 17 bp, R. norvegicus
aaagatgggggtgccct

SEQ ID NO: 464630 - DNA, 26 bp, R. norvegicus
aaagatgggggtgccctactgcatca

SEQ ID NO: 464631 - DNA, 16 bp, R. norvegicus
aaagatgtggagaaat

SEQ ID NO: 464632 - DNA, 16 bp, R. norvegicus
aaagatgttgtggcct

SEQ ID NO: 464633 - DNA, 16 bp, R. norvegicus
aaagatgttttccagc

SEQ ID NO: 464634 - DNA, 29 bp, R. norvegicus
aaagattaaagagctcaaagagaaaaggt

SEQ ID NO: 464635 - DNA, 16 bp, R. norvegicus
aaagattcaaaggcaa

SEQ ID NO: 464636 - DNA, 16 bp, R. norvegicus
aaagattcaggcaaga

SEQ ID NO: 464637 - DNA, 16 bp, R. norvegicus
aaagattccccaccat

SEQ ID NO: 464638 - DNA, 16 bp, R. norvegicus
aaagattctctcccat

SEQ ID NO: 464639 - DNA, 16 bp, R. norvegicus
aaagattggggaaaga

SEQ ID NO: 464640 - DNA, 16 bp, R. norvegicus
aaagatttataccaat

SEQ ID NO: 464641 - DNA, 16 bp, R. norvegicus
aaagatttcatttatt

SEQ ID NO: 464642 - DNA, 16 bp, R. norvegicus
aaagatttcttttttt

SEQ ID NO: 464643 - DNA, 16 bp, R. norvegicus
aaagatttggcctctc

SEQ ID NO: 464644 - DNA, 16 bp, R. norvegicus
aaagattttgtttttg

SEQ ID NO: 464645 - DNA, 16 bp, R. norvegicus
aaagcaaaatatattt

SEQ ID NO: 464646 - DNA, 16 bp, R. norvegicus
aaagcaaaccagtaag

SEQ ID NO: 464647 - DNA, 16 bp, R. norvegicus
aaagcaaagagcattt

SEQ ID NO: 464648 - DNA, 16 bp, R. norvegicus
aaagcaaattaaggaa

SEQ ID NO: 464649 - DNA, 16 bp, R. norvegicus
aaagcaacagttttta

SEQ ID NO: 464650 - DNA, 16 bp, R. norvegicus
aaagcaaccacaagag

SEQ ID NO: 464651 - DNA, 16 bp, R. norvegicus
aaagcaaccaggccca

SEQ ID NO: 464652 - DNA, 16 bp, R. norvegicus
aaagcaacctgagcaa

SEQ ID NO: 464653 - DNA, 16 bp, R. norvegicus
aaagcaactgaggaaa

SEQ ID NO: 464654 - DNA, 16 bp, R. norvegicus
aaagcaacttaaagaa

SEQ ID NO: 464655 - DNA, 16 bp, R. norvegicus
aaagcaagatcttgtt

SEQ ID NO: 464656 - DNA, 16 bp, R. norvegicus
aaagcaagatttagtt

SEQ ID NO: 464657 - DNA, 16 bp, R. norvegicus
aaagcaagctgagcga

SEQ ID NO: 464658 - DNA, 17 bp, R. norvegicus
aaagcaagtaaaagatt

SEQ ID NO: 464659 - DNA, 16 bp, R. norvegicus
aaagcaatcctctgct

SEQ ID NO: 464660 - DNA, 16 bp, R. norvegicus
aaagcaattttcaaat

SEQ ID NO: 464661 - DNA, 16 bp, R. norvegicus
aaagcacagaaaacat

SEQ ID NO: 464662 - DNA, 16 bp, R. norvegicus
aaagcacaggaaccca

SEQ ID NO: 464663 - DNA, 16 bp, R. norvegicus
aaagcacaggatgaga

SEQ ID NO: 464664 - DNA, 16 bp, R. norvegicus
aaagcaccgactgctc

SEQ ID NO: 464665 - DNA, 16 bp, R. norvegicus
aaagcactgactgctc

SEQ ID NO: 464666 - DNA, 16 bp, R. norvegicus
aaagcactttttaaaa

SEQ ID NO: 464667 - DNA, 16 bp, R. norvegicus
aaagcagaacacagag

SEQ ID NO: 464668 - DNA, 16 bp, R. norvegicus
aaagcagactgggaaa

SEQ ID NO: 464669 - DNA, 16 bp, R. norvegicus
aaagcagagagagatg

SEQ ID NO: 464670 - DNA, 16 bp, R. norvegicus
aaagcagaggcaagtg

SEQ ID NO: 464671 - DNA, 16 bp, R. norvegicus
aaagcagaggccacag

SEQ ID NO: 464672 - DNA, 16 bp, R. norvegicus
aaagcagatgcagaga

SEQ ID NO: 464673 - DNA, 16 bp, R. norvegicus
aaagcaggatgcagag

SEQ ID NO: 464674 - DNA, 16 bp, R. norvegicus
aaagcagggtagcaaa

SEQ ID NO: 464675 - DNA, 16 bp, R. norvegicus
aaagcagtaaaggaaa

SEQ ID NO: 464676 - DNA, 16 bp, R. norvegicus
aaagcagtaagggaaa

SEQ ID NO: 464677 - DNA, 16 bp, R. norvegicus
aaagcagtgctgagag

SEQ ID NO: 464678 - DNA, 16 bp, R. norvegicus
aaagcagtggccactc

SEQ ID NO: 464679 - DNA, 16 bp, R. norvegicus
aaagcagttataccaa

SEQ ID NO: 464680 - DNA, 16 bp, R. norvegicus
aaagcagtttattcag

SEQ ID NO: 464681 - DNA, 16 bp, R. norvegicus
aaagcatctgtggaga

SEQ ID NO: 464682 - DNA, 16 bp, R. norvegicus
aaagcatgaaagcaag

SEQ ID NO: 464683 - DNA, 16 bp, R. norvegicus
aaagcatgcacacaca

SEQ ID NO: 464684 - DNA, 16 bp, R. norvegicus
aaagcattcttttttt

SEQ ID NO: 464685 - DNA, 16 bp, R. norvegicus
aaagcatttaattgga

SEQ ID NO: 464686 - DNA, 16 bp, R. norvegicus
aaagcatttcacaaaa

SEQ ID NO: 464687 - DNA, 16 bp, R. norvegicus
aaagcatttgaaaaat

SEQ ID NO: 464688 - DNA, 16 bp, R. norvegicus
aaagcattttcatttt

SEQ ID NO: 464689 - DNA, 16 bp, R. norvegicus
aaagccaacatcaaaa

SEQ ID NO: 464690 - DNA, 16 bp, R. norvegicus
aaagccaagcacagtg

SEQ ID NO: 464691 - DNA, 16 bp, R. norvegicus
aaagccacacctctta

SEQ ID NO: 464692 - DNA, 16 bp, R. norvegicus
aaagccaccaagtatc

SEQ ID NO: 464693 - DNA, 16 bp, R. norvegicus
aaagccagaagagcct

SEQ ID NO: 464694 - DNA, 16 bp, R. norvegicus
aaagccagagaggcag

SEQ ID NO: 464695 - DNA, 16 bp, R. norvegicus
aaagccagagccatgt

SEQ ID NO: 464696 - DNA, 16 bp, R. norvegicus
aaagccagatgcagtg

SEQ ID NO: 464697 - DNA, 16 bp, R. norvegicus
aaagccagatgccaag

SEQ ID NO: 464698 - DNA, 16 bp, R. norvegicus
aaagccagcagatcct

SEQ ID NO: 464699 - DNA, 16 bp, R. norvegicus
aaagccagcctggttt

SEQ ID NO: 464700 - DNA, 16 bp, R. norvegicus
aaagccaggcatgaca

SEQ ID NO: 464701 - DNA, 16 bp, R. norvegicus
aaagccaggcatggct

SEQ ID NO: 464702 - DNA, 16 bp, R. norvegicus
aaagccatatggaaac

SEQ ID NO: 464703 - DNA, 16 bp, R. norvegicus
aaagccatccaggatt

SEQ ID NO: 464704 - DNA, 16 bp, R. norvegicus
aaagccatcttctgct

SEQ ID NO: 464705 - DNA, 16 bp, R. norvegicus
aaagccattctggaaa

SEQ ID NO: 464706 - DNA, 16 bp, R. norvegicus
aaagccattgagtgtt

SEQ ID NO: 464707 - DNA, 16 bp, R. norvegicus
aaagcccacatatgca

SEQ ID NO: 464708 - DNA, 16 bp, R. norvegicus
aaagcccacccccata

SEQ ID NO: 464709 - DNA, 16 bp, R. norvegicus
aaagcccaggcccaca

SEQ ID NO: 464710 - DNA, 16 bp, R. norvegicus
aaagcccatctccaca

SEQ ID NO: 464711 - DNA, 16 bp, R. norvegicus
aaagccctgggctcca

SEQ ID NO: 464712 - DNA, 16 bp, R. norvegicus
aaagcctcccaggaga

SEQ ID NO: 464713 - DNA, 16 bp, R. norvegicus
aaagcctccctggagt

SEQ ID NO: 464714 - DNA, 16 bp, R. norvegicus
aaagcctgcctccagt

SEQ ID NO: 464715 - DNA, 16 bp, R. norvegicus
aaagcctggaaaacaa

SEQ ID NO: 464716 - DNA, 16 bp, R. norvegicus
aaagccttgtctcaaa

SEQ ID NO: 464717 - DNA, 16 bp, R. norvegicus
aaagcctttaaaaaaa

SEQ ID NO: 464718 - DNA, 16 bp, R. norvegicus
aaagcctttggcaaaa

SEQ ID NO: 464719 - DNA, 16 bp, R. norvegicus
aaagccttttcttctt

SEQ ID NO: 464720 - DNA, 16 bp, R. norvegicus
aaagcgtttattgtat

SEQ ID NO: 464721 - DNA, 16 bp, R. norvegicus
aaagctaagaagtgca

SEQ ID NO: 464722 - DNA, 16 bp, R. norvegicus
aaagctagaagatctt

SEQ ID NO: 464723 - DNA, 16 bp, R. norvegicus
aaagctagacttcaac

SEQ ID NO: 464724 - DNA, 16 bp, R. norvegicus
aaagctagctaagcat

SEQ ID NO: 464725 - DNA, 43 bp, R. norvegicus
aaagctatatggaagctggttaagaattgtttaaaggatgaaa

SEQ ID NO: 464726 - DNA, 16 bp, R. norvegicus
aaagctatcccagctt

SEQ ID NO: 464727 - DNA, 16 bp, R. norvegicus
aaagctcaaagcacgc

SEQ ID NO: 464728 - DNA, 16 bp, R. norvegicus
aaagctcaaagcatat

SEQ ID NO: 464729 - DNA, 16 bp, R. norvegicus
aaagctcaagaagaaa

SEQ ID NO: 464730 - DNA, 16 bp, R. norvegicus
aaagctcaccctcagt

SEQ ID NO: 464731 - DNA, 16 bp, R. norvegicus
aaagctcagaataacc

SEQ ID NO: 464732 - DNA, 16 bp, R. norvegicus
aaagctctagaacgaa

SEQ ID NO: 464733 - DNA, 16 bp, R. norvegicus
aaagctctgaccttgc

SEQ ID NO: 464734 - DNA, 16 bp, R. norvegicus
aaagctctggatctgg

SEQ ID NO: 464735 - DNA, 16 bp, R. norvegicus
aaagctgaagcaggag

SEQ ID NO: 464736 - DNA, 16 bp, R. norvegicus
aaagctgagagctcac

SEQ ID NO: 464737 - DNA, 16 bp, R. norvegicus
aaagctgataaacaaa

SEQ ID NO: 464738 - DNA, 16 bp, R. norvegicus
aaagctgccatgaaca

SEQ ID NO: 464739 - DNA, 20 bp, R. norvegicus
aaagctgctggcaaagggga

SEQ ID NO: 464740 - DNA, 16 bp, R. norvegicus
aaagctggaaagaacc

SEQ ID NO: 464741 - DNA, 16 bp, R. norvegicus
aaagctggaagaagca

SEQ ID NO: 464742 - DNA, 16 bp, R. norvegicus
aaagctggaagaagct

SEQ ID NO: 464743 - DNA, 16 bp, R. norvegicus
aaagctggggctggag

SEQ ID NO: 464744 - DNA, 16 bp, R. norvegicus
aaagctgggtatggtg

SEQ ID NO: 464745 - DNA, 16 bp, R. norvegicus
aaagctggtaatagaa

SEQ ID NO: 464746 - DNA, 16 bp, R. norvegicus
aaagctggtcttcaaa

SEQ ID NO: 464747 - DNA, 16 bp, R. norvegicus
aaagctgtcctctgct

SEQ ID NO: 464748 - DNA, 16 bp, R. norvegicus
aaagctgtcctctggc

SEQ ID NO: 464749 - DNA, 16 bp, R. norvegicus
aaagctgttgctgctg

SEQ ID NO: 464750 - DNA, 16 bp, R. norvegicus
aaagcttcaccaacag

SEQ ID NO: 464751 - DNA, 16 bp, R. norvegicus
aaagcttcagtaaggc

SEQ ID NO: 464752 - DNA, 16 bp, R. norvegicus
aaagcttccttcttct

SEQ ID NO: 464753 - DNA, 16 bp, R. norvegicus
aaagcttctgtcaggc

SEQ ID NO: 464754 - DNA, 16 bp, R. norvegicus
aaagcttctttaaagc

SEQ ID NO: 464755 - DNA, 16 bp, R. norvegicus
aaagcttgatttttta

SEQ ID NO: 464756 - DNA, 16 bp, R. norvegicus
aaagctttgttttgtt

SEQ ID NO: 464757 - DNA, 16 bp, R. norvegicus
aaaggaaaaatttcag

SEQ ID NO: 464758 - DNA, 16 bp, R. norvegicus
aaaggaaaagaacttc

SEQ ID NO: 464759 - DNA, 16 bp, R. norvegicus
aaaggaaaatattcaa

SEQ ID NO: 464760 - DNA, 16 bp, R. norvegicus
aaaggaaaatgtcaaa

SEQ ID NO: 464761 - DNA, 16 bp, R. norvegicus
aaaggaaacaaaattt

SEQ ID NO: 464762 - DNA, 16 bp, R. norvegicus
aaaggaaacattacta

SEQ ID NO: 464763 - DNA, 16 bp, R. norvegicus
aaaggaaacctgattt

SEQ ID NO: 464764 - DNA, 16 bp, R. norvegicus
aaaggaaactccattt

SEQ ID NO: 464765 - DNA, 16 bp, R. norvegicus
aaaggaaaggacactg

SEQ ID NO: 464766 - DNA, 16 bp, R. norvegicus
aaaggaaaggacatga

SEQ ID NO: 464767 - DNA, 16 bp, R. norvegicus
aaaggaaatatgggga

SEQ ID NO: 464768 - DNA, 16 bp, R. norvegicus
aaaggaaatctcaaaa

SEQ ID NO: 464769 - DNA, 16 bp, R. norvegicus
aaaggaaatgaagtca

SEQ ID NO: 464770 - DNA, 16 bp, R. norvegicus
aaaggaaattgatcct

SEQ ID NO: 464771 - DNA, 16 bp, R. norvegicus
aaaggaaatttaattt

SEQ ID NO: 464772 - DNA, 16 bp, R. norvegicus
aaaggaacaagccttt

SEQ ID NO: 464773 - DNA, 16 bp, R. norvegicus
aaaggaacatgaacag

SEQ ID NO: 464774 - DNA, 16 bp, R. norvegicus
aaaggaactctgggaa

SEQ ID NO: 464775 - DNA, 16 bp, R. norvegicus
aaaggaactggagaga

SEQ ID NO: 464776 - DNA, 16 bp, R. norvegicus
aaaggaagaactcaaa

SEQ ID NO: 464777 - DNA, 16 bp, R. norvegicus
aaaggaagaagccaca

SEQ ID NO: 464778 - DNA, 16 bp, R. norvegicus
aaaggaagaagtcaaa

SEQ ID NO: 464779 - DNA, 16 bp, R. norvegicus
aaaggaagaagtcaag

SEQ ID NO: 464780 - DNA, 16 bp, R. norvegicus
aaaggaagaagtcaga

SEQ ID NO: 464781 - DNA, 16 bp, R. norvegicus
aaaggaagattttttt

SEQ ID NO: 464782 - DNA, 16 bp, R. norvegicus
aaaggaatcccagttt

SEQ ID NO: 464783 - DNA, 16 bp, R. norvegicus
aaaggaatgaaagagc

SEQ ID NO: 464784 - DNA, 16 bp, R. norvegicus
aaaggaatgcaagaac

SEQ ID NO: 464785 - DNA, 16 bp, R. norvegicus
aaaggacaacttttaa

SEQ ID NO: 464786 - DNA, 16 bp, R. norvegicus
aaaggacactgggtca

SEQ ID NO: 464787 - DNA, 16 bp, R. norvegicus
aaaggacactgtgatt

SEQ ID NO: 464788 - DNA, 16 bp, R. norvegicus
aaaggacattgtcttt

SEQ ID NO: 464789 - DNA, 16 bp, R. norvegicus
aaaggacctgagttca

SEQ ID NO: 464790 - DNA, 16 bp, R. norvegicus
aaaggactgaagcctt

SEQ ID NO: 464791 - DNA, 16 bp, R. norvegicus
aaaggagaaacaagcc

SEQ ID NO: 464792 - DNA, 16 bp, R. norvegicus
aaaggagacaacattt

SEQ ID NO: 464793 - DNA, 16 bp, R. norvegicus
aaaggagaccaagggg

SEQ ID NO: 464794 - DNA, 16 bp, R. norvegicus
aaaggagagaaaacat

SEQ ID NO: 464795 - DNA, 16 bp, R. norvegicus
aaaggagataacattt

SEQ ID NO: 464796 - DNA, 16 bp, R. norvegicus
aaaggagccccagttg

SEQ ID NO: 464797 - DNA, 16 bp, R. norvegicus
aaaggagctggagatc

SEQ ID NO: 464798 - DNA, 16 bp, R. norvegicus
aaaggaggaaaatatt

SEQ ID NO: 464799 - DNA, 16 bp, R. norvegicus
aaaggaggcaaaacca

SEQ ID NO: 464800 - DNA, 16 bp, R. norvegicus
aaaggaggttttgaaa

SEQ ID NO: 464801 - DNA, 16 bp, R. norvegicus
aaaggatgctgggaaa

SEQ ID NO: 464802 - DNA, 16 bp, R. norvegicus
aaaggatgggcaggag

SEQ ID NO: 464803 - DNA, 16 bp, R. norvegicus
aaaggatgttgaattt

SEQ ID NO: 464804 - DNA, 16 bp, R. norvegicus
aaaggattgaaggagt

SEQ ID NO: 464805 - DNA, 16 bp, R. norvegicus
aaaggatttgaaagat

SEQ ID NO: 464806 - DNA, 16 bp, R. norvegicus
aaaggatttgacaaaa

SEQ ID NO: 464807 - DNA, 16 bp, R. norvegicus
aaaggcaaagaaaatg

SEQ ID NO: 464808 - DNA, 16 bp, R. norvegicus
aaaggcacagaaaatg

SEQ ID NO: 464809 - DNA, 16 bp, R. norvegicus
aaaggcacttgctgct

SEQ ID NO: 464810 - DNA, 16 bp, R. norvegicus
aaaggcagaagcaact

SEQ ID NO: 464811 - DNA, 16 bp, R. norvegicus
aaaggcagagagacag

SEQ ID NO: 464812 - DNA, 16 bp, R. norvegicus
aaaggcagagaggcag

SEQ ID NO: 464813 - DNA, 16 bp, R. norvegicus
aaaggcagcagaagga

SEQ ID NO: 464814 - DNA, 16 bp, R. norvegicus
aaaggcaggcaaatct

SEQ ID NO: 464815 - DNA, 16 bp, R. norvegicus
aaaggcatgaaagaat

SEQ ID NO: 464816 - DNA, 16 bp, R. norvegicus
aaaggccaagctgtct

SEQ ID NO: 464817 - DNA, 16 bp, R. norvegicus
aaaggccaggctcaca

SEQ ID NO: 464818 - DNA, 16 bp, R. norvegicus
aaaggccatcaagaga

SEQ ID NO: 464819 - DNA, 16 bp, R. norvegicus
aaaggccatccagaga

SEQ ID NO: 464820 - DNA, 16 bp, R. norvegicus
aaaggccattcagaaa

SEQ ID NO: 464821 - DNA, 16 bp, R. norvegicus
aaaggcctccataaga

SEQ ID NO: 464822 - DNA, 16 bp, R. norvegicus
aaaggccttacaggat

SEQ ID NO: 464823 - DNA, 16 bp, R. norvegicus
aaaggctacagcaaga

SEQ ID NO: 464824 - DNA, 16 bp, R. norvegicus
aaaggctactgatttg

SEQ ID NO: 464825 - DNA, 16 bp, R. norvegicus
aaaggctagaaaaaat

SEQ ID NO: 464826 - DNA, 16 bp, R. norvegicus
aaaggctattcagaga

SEQ ID NO: 464827 - DNA, 16 bp, R. norvegicus
aaaggctcagaaaata

SEQ ID NO: 464828 - DNA, 16 bp, R. norvegicus
aaaggctcctgccagt

SEQ ID NO: 464829 - DNA, 16 bp, R. norvegicus
aaaggctctaccagag

SEQ ID NO: 464830 - DNA, 16 bp, R. norvegicus
aaaggctgaaaaacaa

SEQ ID NO: 464831 - DNA, 16 bp, R. norvegicus
aaaggctgaaaacatt

SEQ ID NO: 464832 - DNA, 16 bp, R. norvegicus
aaaggctgaaagaaaa

SEQ ID NO: 464833 - DNA, 16 bp, R. norvegicus
aaaggctgaggcagga

SEQ ID NO: 464834 - DNA, 16 bp, R. norvegicus
aaaggctggaaaagaa

SEQ ID NO: 464835 - DNA, 16 bp, R. norvegicus
aaaggctggaagaagt

SEQ ID NO: 464836 - DNA, 16 bp, R. norvegicus
aaaggctggggagatg

SEQ ID NO: 464837 - DNA, 16 bp, R. norvegicus
aaaggcttggaaagat

SEQ ID NO: 464838 - DNA, 17 bp, R. norvegicus
aaaggctttaccacatt

SEQ ID NO: 464839 - DNA, 16 bp, R. norvegicus
aaaggcttttcacagt

SEQ ID NO: 464840 - DNA, 16 bp, R. norvegicus
aaagggaacaaatgaa

SEQ ID NO: 464841 - DNA, 16 bp, R. norvegicus
aaagggaacttgtaga

SEQ ID NO: 464842 - DNA, 16 bp, R. norvegicus
aaagggaagaaatcaa

SEQ ID NO: 464843 - DNA, 16 bp, R. norvegicus
aaagggaataaaattt

SEQ ID NO: 464844 - DNA, 16 bp, R. norvegicus
aaagggagaaagcatt

SEQ ID NO: 464845 - DNA, 16 bp, R. norvegicus
aaagggagacatacca

SEQ ID NO: 464846 - DNA, 16 bp, R. norvegicus
aaagggcaccaggaag

SEQ ID NO: 464847 - DNA, 16 bp, R. norvegicus
aaagggcagactctct

SEQ ID NO: 464848 - DNA, 16 bp, R. norvegicus
aaagggccagtaaata

SEQ ID NO: 464849 - DNA, 16 bp, R. norvegicus
aaagggctggagaaat

SEQ ID NO: 464850 - DNA, 16 bp, R. norvegicus
aaaggggggctggaga

SEQ ID NO: 464851 - DNA, 16 bp, R. norvegicus
aaagggggtgcctcag

SEQ ID NO: 464852 - DNA, 16 bp, R. norvegicus
aaagggtcatcatctc

SEQ ID NO: 464853 - DNA, 16 bp, R. norvegicus
aaagggtgaaatgttg

SEQ ID NO: 464854 - DNA, 16 bp, R. norvegicus
aaagggttgcaaccca

SEQ ID NO: 464855 - DNA, 16 bp, R. norvegicus
aaagggtttatttagt

SEQ ID NO: 464856 - DNA, 16 bp, R. norvegicus
aaaggtaaaaagccaa

SEQ ID NO: 464857 - DNA, 16 bp, R. norvegicus
aaaggtaaaagtttta

SEQ ID NO: 464858 - DNA, 16 bp, R. norvegicus
aaaggtacagaaagat

SEQ ID NO: 464859 - DNA, 16 bp, R. norvegicus
aaaggtcaacaagagg

SEQ ID NO: 464860 - DNA, 16 bp, R. norvegicus
aaaggtcaagtaacct

SEQ ID NO: 464861 - DNA, 16 bp, R. norvegicus
aaaggtcaagtaagat

SEQ ID NO: 464862 - DNA, 16 bp, R. norvegicus
aaaggtcagaagagag

SEQ ID NO: 464863 - DNA, 16 bp, R. norvegicus
aaaggtcagagggcaa

SEQ ID NO: 464864 - DNA, 16 bp, R. norvegicus
aaaggtgagcaccacc

SEQ ID NO: 464865 - DNA, 16 bp, R. norvegicus
aaaggtgattttattt

SEQ ID NO: 464866 - DNA, 16 bp, R. norvegicus
aaaggtgggactggag

SEQ ID NO: 464867 - DNA, 16 bp, R. norvegicus
aaaggtggggctggag

SEQ ID NO: 464868 - DNA, 16 bp, R. norvegicus
aaaggtggtggtggtg

SEQ ID NO: 464869 - DNA, 16 bp, R. norvegicus
aaaggtgtcgtttccc

SEQ ID NO: 464870 - DNA, 16 bp, R. norvegicus
aaaggtgtgtgctgct

SEQ ID NO: 464871 - DNA, 16 bp, R. norvegicus
aaaggtgtgtgtcact

SEQ ID NO: 464872 - DNA, 16 bp, R. norvegicus
aaaggttctttggaaa

SEQ ID NO: 464873 - DNA, 16 bp, R. norvegicus
aaaggtttaaatagcc

SEQ ID NO: 464874 - DNA, 16 bp, R. norvegicus
aaaggtttatttttct

SEQ ID NO: 464875 - DNA, 16 bp, R. norvegicus
aaaggtttcttttttt

SEQ ID NO: 464876 - DNA, 16 bp, R. norvegicus
aaaggttttgggtttt

SEQ ID NO: 464877 - DNA, 16 bp, R. norvegicus
aaaggtttttaaaaat

SEQ ID NO: 464878 - DNA, 16 bp, R. norvegicus
aaaggttttttaaaaa

SEQ ID NO: 464879 - DNA, 16 bp, R. norvegicus
aaagtaaagttaaagt

SEQ ID NO: 464880 - DNA, 16 bp, R. norvegicus
aaagtaaataatgtga

SEQ ID NO: 464881 - DNA, 16 bp, R. norvegicus
aaagtaacaaaatcag

SEQ ID NO: 464882 - DNA, 16 bp, R. norvegicus
aaagtaacaatgaaat

SEQ ID NO: 464883 - DNA, 16 bp, R. norvegicus
aaagtaacattaaaat

SEQ ID NO: 464884 - DNA, 16 bp, R. norvegicus
aaagtaattttaacat

SEQ ID NO: 464885 - DNA, 16 bp, R. norvegicus
aaagtacagagaataa

SEQ ID NO: 464886 - DNA, 16 bp, R. norvegicus
aaagtacctcgctgtg

SEQ ID NO: 464887 - DNA, 16 bp, R. norvegicus
aaagtaccttgaggag

SEQ ID NO: 464888 - DNA, 16 bp, R. norvegicus
aaagtactagaagaaa

SEQ ID NO: 464889 - DNA, 16 bp, R. norvegicus
aaagtaggaaagaacc

SEQ ID NO: 464890 - DNA, 16 bp, R. norvegicus
aaagtatcaataaaat

SEQ ID NO: 464891 - DNA, 16 bp, R. norvegicus
aaagtatccaagaaaa

SEQ ID NO: 464892 - DNA, 16 bp, R. norvegicus
aaagtatttttctttt

SEQ ID NO: 464893 - DNA, 16 bp, R. norvegicus
aaagtcaacaacaaca

SEQ ID NO: 464894 - DNA, 16 bp, R. norvegicus
aaagtcaatgaaataa

SEQ ID NO: 464895 - DNA, 16 bp, R. norvegicus
aaagtcacttttattt

SEQ ID NO: 464896 - DNA, 16 bp, R. norvegicus
aaagtcaggaagcaga

SEQ ID NO: 464897 - DNA, 16 bp, R. norvegicus
aaagtcagggcaagaa

SEQ ID NO: 464898 - DNA, 16 bp, R. norvegicus
aaagtcagggtggcag

SEQ ID NO: 464899 - DNA, 16 bp, R. norvegicus
aaagtcatccagagac

SEQ ID NO: 464900 - DNA, 16 bp, R. norvegicus
aaagtcatctttggct

SEQ ID NO: 464901 - DNA, 16 bp, R. norvegicus
aaagtcatgtgccacc

SEQ ID NO: 464902 - DNA, 16 bp, R. norvegicus
aaagtccaaagttcaa

SEQ ID NO: 464903 - DNA, 16 bp, R. norvegicus
aaagtccaagaattca

SEQ ID NO: 464904 - DNA, 16 bp, R. norvegicus
aaagtccaataaaaat

SEQ ID NO: 464905 - DNA, 16 bp, R. norvegicus
aaagtccagtgacagg

SEQ ID NO: 464906 - DNA, 16 bp, R. norvegicus
aaagtccttaatttct

SEQ ID NO: 464907 - DNA, 16 bp, R. norvegicus
aaagtctattttatta

SEQ ID NO: 464908 - DNA, 16 bp, R. norvegicus
aaagtctcatgcaata

SEQ ID NO: 464909 - DNA, 17 bp, R. norvegicus
aaagtctcctctggacc

SEQ ID NO: 464910 - DNA, 16 bp, R. norvegicus
aaagtctcttaactat

SEQ ID NO: 464911 - DNA, 16 bp, R. norvegicus
aaagtctggagcagag

SEQ ID NO: 464912 - DNA, 16 bp, R. norvegicus
aaagtcttagaaaaat

SEQ ID NO: 464913 - DNA, 16 bp, R. norvegicus
aaagtctttttaaaat

SEQ ID NO: 464914 - DNA, 16 bp, R. norvegicus
aaagtgatttttttcc

SEQ ID NO: 464915 - DNA, 16 bp, R. norvegicus
aaagtgcaaagcttct

SEQ ID NO: 464916 - DNA, 16 bp, R. norvegicus
aaagtgcagacaatcc

SEQ ID NO: 464917 - DNA, 16 bp, R. norvegicus
aaagtgctgagaataa

SEQ ID NO: 464918 - DNA, 16 bp, R. norvegicus
aaagtggaaaatctgg

SEQ ID NO: 464919 - DNA, 16 bp, R. norvegicus
aaagtggaaatttctg

SEQ ID NO: 464920 - DNA, 16 bp, R. norvegicus
aaagtggacctgttta

SEQ ID NO: 464921 - DNA, 22 bp, R. norvegicus
aaagtggagattgttgccatca

SEQ ID NO: 464922 - DNA, 16 bp, R. norvegicus
aaagtggcagcctaca

SEQ ID NO: 464923 - DNA, 16 bp, R. norvegicus
aaagtggcagggtata

SEQ ID NO: 464924 - DNA, 16 bp, R. norvegicus
aaagtggctggataga

SEQ ID NO: 464925 - DNA, 16 bp, R. norvegicus
aaagtgtgaatgtttc

SEQ ID NO: 464926 - DNA, 16 bp, R. norvegicus
aaagttaaaaaccata

SEQ ID NO: 464927 - DNA, 16 bp, R. norvegicus
aaagttaaattaagag

SEQ ID NO: 464928 - DNA, 16 bp, R. norvegicus
aaagttaagtcaagat

SEQ ID NO: 464929 - DNA, 16 bp, R. norvegicus
aaagttacttttatga

SEQ ID NO: 464930 - DNA, 16 bp, R. norvegicus
aaagttagtatgaggc

SEQ ID NO: 464931 - DNA, 16 bp, R. norvegicus
aaagttatcaaaacag

SEQ ID NO: 464932 - DNA, 38 bp, R. norvegicus
aaagttatggatcctttgtgggcaaggctggtaatttt

SEQ ID NO: 464933 - DNA, 16 bp, R. norvegicus
aaagttccaacagaga

SEQ ID NO: 464934 - DNA, 16 bp, R. norvegicus
aaagttctctggaggt

SEQ ID NO: 464935 - DNA, 16 bp, R. norvegicus
aaagttctggaaagat

SEQ ID NO: 464936 - DNA, 16 bp, R. norvegicus
aaagttctttataaaa

SEQ ID NO: 464937 - DNA, 16 bp, R. norvegicus
aaagtttacaacagag

SEQ ID NO: 464938 - DNA, 16 bp, R. norvegicus
aaagttttcctttttt

SEQ ID NO: 464939 - DNA, 16 bp, R. norvegicus
aaagtttttaaaaact

SEQ ID NO: 464940 - DNA, 16 bp, R. norvegicus
aaataaaaactgcttt

SEQ ID NO: 464941 - DNA, 16 bp, R. norvegicus
aaataaaaactgtttt

SEQ ID NO: 464942 - DNA, 16 bp, R. norvegicus
aaataaaaacttgatt

SEQ ID NO: 464943 - DNA, 16 bp, R. norvegicus
aaataaaaactttcca

SEQ ID NO: 464944 - DNA, 16 bp, R. norvegicus
aaataaaaattcatga

SEQ ID NO: 464945 - DNA, 16 bp, R. norvegicus
aaataaaactttgaaa

SEQ ID NO: 464946 - DNA, 16 bp, R. norvegicus
aaataaaagatgtttt

SEQ ID NO: 464947 - DNA, 16 bp, R. norvegicus
aaataaaagtatttct

SEQ ID NO: 464948 - DNA, 16 bp, R. norvegicus
aaataaaagtgatttt

SEQ ID NO: 464949 - DNA, 16 bp, R. norvegicus
aaataaaagttttcaa

SEQ ID NO: 464950 - DNA, 16 bp, R. norvegicus
aaataaaatacctgga

SEQ ID NO: 464951 - DNA, 16 bp, R. norvegicus
aaataaaatattctga

SEQ ID NO: 464952 - DNA, 16 bp, R. norvegicus
aaataaaatcaaatgt

SEQ ID NO: 464953 - DNA, 16 bp, R. norvegicus
aaataaaatctacttt

SEQ ID NO: 464954 - DNA, 16 bp, R. norvegicus
aaataaaatcttttct

SEQ ID NO: 464955 - DNA, 16 bp, R. norvegicus
aaataaaatgaatgct

SEQ ID NO: 464956 - DNA, 16 bp, R. norvegicus
aaataaaatgagcttt

SEQ ID NO: 464957 - DNA, 16 bp, R. norvegicus
aaataaaattgatgtt

SEQ ID NO: 464958 - DNA, 16 bp, R. norvegicus
aaataaacagtgatgt

SEQ ID NO: 464959 - DNA, 16 bp, R. norvegicus
aaataaaccatttctc

SEQ ID NO: 464960 - DNA, 16 bp, R. norvegicus
aaataaaccatttctt

SEQ ID NO: 464961 - DNA, 16 bp, R. norvegicus
aaataaaccattttct

SEQ ID NO: 464962 - DNA, 16 bp, R. norvegicus
aaataaaccctttatt

SEQ ID NO: 464963 - DNA, 16 bp, R. norvegicus
aaataaacccttttcc

SEQ ID NO: 464964 - DNA, 16 bp, R. norvegicus
aaataaacctcttcct

SEQ ID NO: 464965 - DNA, 16 bp, R. norvegicus
aaataaacctcttttc

SEQ ID NO: 464966 - DNA, 16 bp, R. norvegicus
aaataaaccttttcct

SEQ ID NO: 464967 - DNA, 16 bp, R. norvegicus
aaataaactcttccct

SEQ ID NO: 464968 - DNA, 16 bp, R. norvegicus
aaataaagaaatcatt

SEQ ID NO: 464969 - DNA, 16 bp, R. norvegicus
aaataaagacagaatt

SEQ ID NO: 464970 - DNA, 16 bp, R. norvegicus
aaataaagacataatt

SEQ ID NO: 464971 - DNA, 16 bp, R. norvegicus
aaataaagacttttta

SEQ ID NO: 464972 - DNA, 16 bp, R. norvegicus
aaataaagagaatttc

SEQ ID NO: 464973 - DNA, 16 bp, R. norvegicus
aaataaagcatcttca

SEQ ID NO: 464974 - DNA, 16 bp, R. norvegicus
aaataaagccttttct

SEQ ID NO: 464975 - DNA, 16 bp, R. norvegicus
aaataaaggttttttt

SEQ ID NO: 464976 - DNA, 16 bp, R. norvegicus
aaataaagttacagaa

SEQ ID NO: 464977 - DNA, 16 bp, R. norvegicus
aaataaatacattgaa

SEQ ID NO: 464978 - DNA, 16 bp, R. norvegicus
aaataaatagatggat

SEQ ID NO: 464979 - DNA, 16 bp, R. norvegicus
aaataaatatttcctt

SEQ ID NO: 464980 - DNA, 16 bp, R. norvegicus
aaataaatccttccct

SEQ ID NO: 464981 - DNA, 16 bp, R. norvegicus
aaataaatcttccttt

SEQ ID NO: 464982 - DNA, 16 bp, R. norvegicus
aaataaatctttgaaa

SEQ ID NO: 464983 - DNA, 16 bp, R. norvegicus
aaataaatcttttcct

SEQ ID NO: 464984 - DNA, 16 bp, R. norvegicus
aaataaatgacttaaa

SEQ ID NO: 464985 - DNA, 16 bp, R. norvegicus
aaataaatgcttcctt

SEQ ID NO: 464986 - DNA, 16 bp, R. norvegicus
aaataaatggaatgat

SEQ ID NO: 464987 - DNA, 16 bp, R. norvegicus
aaataaatgtaacaga

SEQ ID NO: 464988 - DNA, 16 bp, R. norvegicus
aaataaatgtactttt

SEQ ID NO: 464989 - DNA, 16 bp, R. norvegicus
aaataaatgtcaataa

SEQ ID NO: 464990 - DNA, 16 bp, R. norvegicus
aaataaatgtgatttt

SEQ ID NO: 464991 - DNA, 16 bp, R. norvegicus
aaataaatgtgtgtgt

SEQ ID NO: 464992 - DNA, 16 bp, R. norvegicus
aaataaatgtttcaaa

SEQ ID NO: 464993 - DNA, 16 bp, R. norvegicus
aaataaattttcaact

SEQ ID NO: 464994 - DNA, 16 bp, R. norvegicus
aaataacagtaattaa

SEQ ID NO: 464995 - DNA, 16 bp, R. norvegicus
aaataactcctttaaa

SEQ ID NO: 464996 - DNA, 16 bp, R. norvegicus
aaataagacattttaa

SEQ ID NO: 464997 - DNA, 16 bp, R. norvegicus
aaataagcagaatcag

SEQ ID NO: 464998 - DNA, 16 bp, R. norvegicus
aaataagcctcaacag

SEQ ID NO: 464999 - DNA, 16 bp, R. norvegicus
aaataaggccatcctc

SEQ ID NO: 465000 - DNA, 16 bp, R. norvegicus
aaataaggctaaatct

SEQ ID NO: 465001 - DNA, 16 bp, R. norvegicus
aaataatattttctgt

SEQ ID NO: 465002 - DNA, 16 bp, R. norvegicus
aaataatcccatgcat

SEQ ID NO: 465003 - DNA, 16 bp, R. norvegicus
aaataatgaaactaac

SEQ ID NO: 465004 - DNA, 16 bp, R. norvegicus
aaataatgttttcaaa

SEQ ID NO: 465005 - DNA, 16 bp, R. norvegicus
aaataatttctcattt

SEQ ID NO: 465006 - DNA, 16 bp, R. norvegicus
aaataattttatggtg

SEQ ID NO: 465007 - DNA, 16 bp, R. norvegicus
aaatacaaatttgaaa

SEQ ID NO: 465008 - DNA, 16 bp, R. norvegicus
aaatacaagcagaatt

SEQ ID NO: 465009 - DNA, 16 bp, R. norvegicus
aaatacacagagcaaa

SEQ ID NO: 465010 - DNA, 16 bp, R. norvegicus
aaatacagaaatatat

SEQ ID NO: 465011 - DNA, 16 bp, R. norvegicus
aaatacagaagtggat

SEQ ID NO: 465012 - DNA, 16 bp, R. norvegicus
aaatacagagaagaat

SEQ ID NO: 465013 - DNA, 16 bp, R. norvegicus
aaatacagagggaaat

SEQ ID NO: 465014 - DNA, 16 bp, R. norvegicus
aaatacagagttgaat

SEQ ID NO: 465015 - DNA, 16 bp, R. norvegicus
aaatacagatgcttca

SEQ ID NO: 465016 - DNA, 16 bp, R. norvegicus
aaatacagcaaataca

SEQ ID NO: 465017 - DNA, 16 bp, R. norvegicus
aaatacagccaccaaa

SEQ ID NO: 465018 - DNA, 17 bp, R. norvegicus
aaatacaggacaacaca

SEQ ID NO: 465019 - DNA, 16 bp, R. norvegicus
aaatacagttttaaaa

SEQ ID NO: 465020 - DNA, 16 bp, R. norvegicus
aaatacataaataagt

SEQ ID NO: 465021 - DNA, 16 bp, R. norvegicus
aaatacatagacgaat

SEQ ID NO: 465022 - DNA, 17 bp, R. norvegicus
aaatacatctgatgtca

SEQ ID NO: 465023 - DNA, 16 bp, R. norvegicus
aaatacatgaaataat

SEQ ID NO: 465024 - DNA, 16 bp, R. norvegicus
aaatacatttcctttt

SEQ ID NO: 465025 - DNA, 16 bp, R. norvegicus
aaatacattttaagtt

SEQ ID NO: 465026 - DNA, 16 bp, R. norvegicus
aaataccggaagtgcc

SEQ ID NO: 465027 - DNA, 16 bp, R. norvegicus
aaataccttcatgaga

SEQ ID NO: 465028 - DNA, 16 bp, R. norvegicus
aaatactcaagtaaat

SEQ ID NO: 465029 - DNA, 16 bp, R. norvegicus
aaatactgaaagaaat

SEQ ID NO: 465030 - DNA, 16 bp, R. norvegicus
aaatactgatattttg

SEQ ID NO: 465031 - DNA, 16 bp, R. norvegicus
aaatactggaccaaaa

SEQ ID NO: 465032 - DNA, 16 bp, R. norvegicus
aaatactgttttcctt

SEQ ID NO: 465033 - DNA, 16 bp, R. norvegicus
aaatacttgaagaaaa

SEQ ID NO: 465034 - DNA, 16 bp, R. norvegicus
aaatacttgcaaacca

SEQ ID NO: 465035 - DNA, 16 bp, R. norvegicus
aaatactttccagaag

SEQ ID NO: 465036 - DNA, 16 bp, R. norvegicus
aaatactttttgcagg

SEQ ID NO: 465037 - DNA, 16 bp, R. norvegicus
aaatacttttttaaag

SEQ ID NO: 465038 - DNA, 16 bp, R. norvegicus
aaatagaaacaaatgg

SEQ ID NO: 465039 - DNA, 16 bp, R. norvegicus
aaatagaagaaaactt

SEQ ID NO: 465040 - DNA, 16 bp, R. norvegicus
aaatagaagcagaaga

SEQ ID NO: 465041 - DNA, 16 bp, R. norvegicus
aaatagaatagattct

SEQ ID NO: 465042 - DNA, 16 bp, R. norvegicus
aaatagacttaacaga

SEQ ID NO: 465043 - DNA, 16 bp, R. norvegicus
aaatagaggacaacac

SEQ ID NO: 465044 - DNA, 16 bp, R. norvegicus
aaatagatctacctga

SEQ ID NO: 465045 - DNA, 16 bp, R. norvegicus
aaatagatgattttct

SEQ ID NO: 465046 - DNA, 16 bp, R. norvegicus
aaatagattcacaaaa

SEQ ID NO: 465047 - DNA, 28 bp, R. norvegicus
aaatagcagaacaaagtaacaccagaga

SEQ ID NO: 465048 - DNA, 16 bp, R. norvegicus
aaatagcttttaaaaa

SEQ ID NO: 465049 - DNA, 16 bp, R. norvegicus
aaatagtgataaaaac

SEQ ID NO: 465050 - DNA, 16 bp, R. norvegicus
aaatagtttggacagt

SEQ ID NO: 465051 - DNA, 16 bp, R. norvegicus
aaatataaagactgtg

SEQ ID NO: 465052 - DNA, 16 bp, R. norvegicus
aaatataagctgagca

SEQ ID NO: 465053 - DNA, 16 bp, R. norvegicus
aaatataatttctcaa

SEQ ID NO: 465054 - DNA, 16 bp, R. norvegicus
aaatatacaggaaata

SEQ ID NO: 465055 - DNA, 16 bp, R. norvegicus
aaatatacaggaagta

SEQ ID NO: 465056 - DNA, 16 bp, R. norvegicus
aaatatacatacacac

SEQ ID NO: 465057 - DNA, 16 bp, R. norvegicus
aaatataggacaacac

SEQ ID NO: 465058 - DNA, 16 bp, R. norvegicus
aaatatatacatgtaa

SEQ ID NO: 465059 - DNA, 16 bp, R. norvegicus
aaatatatgagactat

SEQ ID NO: 465060 - DNA, 16 bp, R. norvegicus
aaatatatgcatatat

SEQ ID NO: 465061 - DNA, 16 bp, R. norvegicus
aaatatatgtacattt

SEQ ID NO: 465062 - DNA, 16 bp, R. norvegicus
aaatatattcatttct

SEQ ID NO: 465063 - DNA, 16 bp, R. norvegicus
aaatatattttgtttc

SEQ ID NO: 465064 - DNA, 16 bp, R. norvegicus
aaatatcaggtaccaa

SEQ ID NO: 465065 - DNA, 16 bp, R. norvegicus
aaatatcatcctaaat

SEQ ID NO: 465066 - DNA, 16 bp, R. norvegicus
aaatatcatcctgaac

SEQ ID NO: 465067 - DNA, 16 bp, R. norvegicus
aaatatcatcctgaag

SEQ ID NO: 465068 - DNA, 16 bp, R. norvegicus
aaatatccaacaaagg

SEQ ID NO: 465069 - DNA, 16 bp, R. norvegicus
aaatatcctgagtgaa

SEQ ID NO: 465070 - DNA, 16 bp, R. norvegicus
aaatatcctggaaaga

SEQ ID NO: 465071 - DNA, 16 bp, R. norvegicus
aaatatccttttaaaa

SEQ ID NO: 465072 - DNA, 16 bp, R. norvegicus
aaatatctgatatgca

SEQ ID NO: 465073 - DNA, 16 bp, R. norvegicus
aaatatcttaaaagaa

SEQ ID NO: 465074 - DNA, 16 bp, R. norvegicus
aaatatcttcagcaaa

SEQ ID NO: 465075 - DNA, 16 bp, R. norvegicus
aaatatcttgaaaaca

SEQ ID NO: 465076 - DNA, 16 bp, R. norvegicus
aaatatgaaaacaatt

SEQ ID NO: 465077 - DNA, 16 bp, R. norvegicus
aaatatgaaatgcaaa

SEQ ID NO: 465078 - DNA, 16 bp, R. norvegicus
aaatatgattttgaaa

SEQ ID NO: 465079 - DNA, 16 bp, R. norvegicus
aaatatgattttgtaa

SEQ ID NO: 465080 - DNA, 16 bp, R. norvegicus
aaatatgcaataaaag

SEQ ID NO: 465081 - DNA, 16 bp, R. norvegicus
aaatatgcatatttat

SEQ ID NO: 465082 - DNA, 16 bp, R. norvegicus
aaatatgtaaaacata

SEQ ID NO: 465083 - DNA, 16 bp, R. norvegicus
aaatatgtacacatac

SEQ ID NO: 465084 - DNA, 16 bp, R. norvegicus
aaatatgtatttctta

SEQ ID NO: 465085 - DNA, 16 bp, R. norvegicus
aaatatgtgtatattt

SEQ ID NO: 465086 - DNA, 18 bp, R. norvegicus
aaatattaaaagcagtaa

SEQ ID NO: 465087 - DNA, 16 bp, R. norvegicus
aaatattaaaagtctt

SEQ ID NO: 465088 - DNA, 16 bp, R. norvegicus
aaatattaaagacttt

SEQ ID NO: 465089 - DNA, 16 bp, R. norvegicus
aaatattcaaacacag

SEQ ID NO: 465090 - DNA, 16 bp, R. norvegicus
aaatattcagaataaa

SEQ ID NO: 465091 - DNA, 16 bp, R. norvegicus
aaatattcaggaaaaa

SEQ ID NO: 465092 - DNA, 16 bp, R. norvegicus
aaatattcaggtgaca

SEQ ID NO: 465093 - DNA, 16 bp, R. norvegicus
aaatattgaaattctt

SEQ ID NO: 465094 - DNA, 16 bp, R. norvegicus
aaatatttacacattt

SEQ ID NO: 465095 - DNA, 16 bp, R. norvegicus
aaatatttacagaata

SEQ ID NO: 465096 - DNA, 16 bp, R. norvegicus
aaatatttcaaaagaa

SEQ ID NO: 465097 - DNA, 16 bp, R. norvegicus
aaatatttcaaaatga

SEQ ID NO: 465098 - DNA, 16 bp, R. norvegicus
aaatatttctcttaaa

SEQ ID NO: 465099 - DNA, 16 bp, R. norvegicus
aaatatttctgttttt

SEQ ID NO: 465100 - DNA, 16 bp, R. norvegicus
aaatatttcttcttca

SEQ ID NO: 465101 - DNA, 16 bp, R. norvegicus
aaatatttgaaggaaa

SEQ ID NO: 465102 - DNA, 16 bp, R. norvegicus
aaatatttgagcctat

SEQ ID NO: 465103 - DNA, 16 bp, R. norvegicus
aaatatttggaaatga

SEQ ID NO: 465104 - DNA, 16 bp, R. norvegicus
aaatatttggtaactt

SEQ ID NO: 465105 - DNA, 16 bp, R. norvegicus
aaatatttgtaaaaca

SEQ ID NO: 465106 - DNA, 16 bp, R. norvegicus
aaatatttgtcctttt

SEQ ID NO: 465107 - DNA, 16 bp, R. norvegicus
aaatatttgttgaatt

SEQ ID NO: 465108 - DNA, 16 bp, R. norvegicus
aaatattttaagcttt

SEQ ID NO: 465109 - DNA, 16 bp, R. norvegicus
aaatattttcagaaag

SEQ ID NO: 465110 - DNA, 16 bp, R. norvegicus
aaatattttcagaatt

SEQ ID NO: 465111 - DNA, 16 bp, R. norvegicus
aaatattttgatttct

SEQ ID NO: 465112 - DNA, 16 bp, R. norvegicus
aaatatttttccagcc

SEQ ID NO: 465113 - DNA, 16 bp, R. norvegicus
aaatatttttgtgtgt

SEQ ID NO: 465114 - DNA, 16 bp, R. norvegicus
aaatcaaaaggaccct

SEQ ID NO: 465115 - DNA, 16 bp, R. norvegicus
aaatcaaacatttact

SEQ ID NO: 465116 - DNA, 16 bp, R. norvegicus
aaatcaaaccaactct

SEQ ID NO: 465117 - DNA, 16 bp, R. norvegicus
aaatcaaacctttctt

SEQ ID NO: 465118 - DNA, 16 bp, R. norvegicus
aaatcaaagaacacat

SEQ ID NO: 465119 - DNA, 16 bp, R. norvegicus
aaatcaaagaatatct

SEQ ID NO: 465120 - DNA, 16 bp, R. norvegicus
aaatcaaatgcccata

SEQ ID NO: 465121 - DNA, 16 bp, R. norvegicus
aaatcaaccaaacagg

SEQ ID NO: 465122 - DNA, 16 bp, R. norvegicus
aaatcaaccaaataga

SEQ ID NO: 465123 - DNA, 16 bp, R. norvegicus
aaatcaaccacatttt

SEQ ID NO: 465124 - DNA, 16 bp, R. norvegicus
aaatcaatcaatcaat

SEQ ID NO: 465125 - DNA, 16 bp, R. norvegicus
aaatcaatccactctt

SEQ ID NO: 465126 - DNA, 16 bp, R. norvegicus
aaatcaatttacaact

SEQ ID NO: 465127 - DNA, 16 bp, R. norvegicus
aaatcaatttccaagt

SEQ ID NO: 465128 - DNA, 16 bp, R. norvegicus
aaatcaatttggcaat

SEQ ID NO: 465129 - DNA, 16 bp, R. norvegicus
aaatcacaaaggaaga

SEQ ID NO: 465130 - DNA, 16 bp, R. norvegicus
aaatcacaaatagatt

SEQ ID NO: 465131 - DNA, 16 bp, R. norvegicus
aaatcacaaggaagaa

SEQ ID NO: 465132 - DNA, 16 bp, R. norvegicus
aaatcacaattatgaa

SEQ ID NO: 465133 - DNA, 51 bp, R. norvegicus
aaatcactatccctgaactcaagcagtattacagagcaatagtgataaaaa

SEQ ID NO: 465134 - DNA, 16 bp, R. norvegicus
aaatcagaaaagggag

SEQ ID NO: 465135 - DNA, 16 bp, R. norvegicus
aaatcagaaaattgga

SEQ ID NO: 465136 - DNA, 16 bp, R. norvegicus
aaatcagaaacaaatg

SEQ ID NO: 465137 - DNA, 16 bp, R. norvegicus
aaatcagaaattcaag

SEQ ID NO: 465138 - DNA, 16 bp, R. norvegicus
aaatcagaacaaccct

SEQ ID NO: 465139 - DNA, 16 bp, R. norvegicus
aaatcagacacactca

SEQ ID NO: 465140 - DNA, 16 bp, R. norvegicus
aaatcagagaaaacca

SEQ ID NO: 465141 - DNA, 16 bp, R. norvegicus
aaatcagatattgttg

SEQ ID NO: 465142 - DNA, 18 bp, R. norvegicus
aaatcaggaacagatgaa

SEQ ID NO: 465143 - DNA, 16 bp, R. norvegicus
aaatcaggaagaaata

SEQ ID NO: 465144 - DNA, 16 bp, R. norvegicus
aaatcaggaatgagac

SEQ ID NO: 465145 - DNA, 16 bp, R. norvegicus
aaatcagtctggaagt

SEQ ID NO: 465146 - DNA, 16 bp, R. norvegicus
aaatcatagaaacaga

SEQ ID NO: 465147 - DNA, 16 bp, R. norvegicus
aaatcatgacatttgc

SEQ ID NO: 465148 - DNA, 16 bp, R. norvegicus
aaatcatgcaaatcaa

SEQ ID NO: 465149 - DNA, 16 bp, R. norvegicus
aaatcattaagagtct

SEQ ID NO: 465150 - DNA, 16 bp, R. norvegicus
aaatcattctcagctg

SEQ ID NO: 465151 - DNA, 16 bp, R. norvegicus
aaatcattgcagaaaa

SEQ ID NO: 465152 - DNA, 16 bp, R. norvegicus
aaatcatttaaacaac

SEQ ID NO: 465153 - DNA, 16 bp, R. norvegicus
aaatcatttgaaaaaa

SEQ ID NO: 465154 - DNA, 16 bp, R. norvegicus
aaatcatttggcaaaa

SEQ ID NO: 465155 - DNA, 16 bp, R. norvegicus
aaatccaaacaaccct

SEQ ID NO: 465156 - DNA, 16 bp, R. norvegicus
aaatccaagaaaacat

SEQ ID NO: 465157 - DNA, 16 bp, R. norvegicus
aaatccaagactcaat

SEQ ID NO: 465158 - DNA, 16 bp, R. norvegicus
aaatccacctgcctca

SEQ ID NO: 465159 - DNA, 16 bp, R. norvegicus
aaatccagatcttgct

SEQ ID NO: 465160 - DNA, 16 bp, R. norvegicus
aaatccaggacacaat

SEQ ID NO: 465161 - DNA, 16 bp, R. norvegicus
aaatccaggatgcaat

SEQ ID NO: 465162 - DNA, 16 bp, R. norvegicus
aaatccagtctcaaaa

SEQ ID NO: 465163 - DNA, 16 bp, R. norvegicus
aaatccagttttaaaa

SEQ ID NO: 465164 - DNA, 16 bp, R. norvegicus
aaatccatcactgtaa

SEQ ID NO: 465165 - DNA, 16 bp, R. norvegicus
aaatcccagcatccac

SEQ ID NO: 465166 - DNA, 16 bp, R. norvegicus
aaatccccaaccccag

SEQ ID NO: 465167 - DNA, 16 bp, R. norvegicus
aaatccccaaccctga

SEQ ID NO: 465168 - DNA, 16 bp, R. norvegicus
aaatccccaactccac

SEQ ID NO: 465169 - DNA, 16 bp, R. norvegicus
aaatccccagcccaac

SEQ ID NO: 465170 - DNA, 16 bp, R. norvegicus
aaatccccagcccgga

SEQ ID NO: 465171 - DNA, 16 bp, R. norvegicus
aaatccccagcccttc

SEQ ID NO: 465172 - DNA, 16 bp, R. norvegicus
aaatccctaaaagaat

SEQ ID NO: 465173 - DNA, 16 bp, R. norvegicus
aaatccctccctccct

SEQ ID NO: 465174 - DNA, 16 bp, R. norvegicus
aaatccctgaagaaag

SEQ ID NO: 465175 - DNA, 17 bp, R. norvegicus
aaatccctgacttatta

SEQ ID NO: 465176 - DNA, 16 bp, R. norvegicus
aaatcctatttcaaaa

SEQ ID NO: 465177 - DNA, 16 bp, R. norvegicus
aaatcctctggaagag

SEQ ID NO: 465178 - DNA, 16 bp, R. norvegicus
aaatcctgggtcctgt

SEQ ID NO: 465179 - DNA, 16 bp, R. norvegicus
aaatcctgtttcaaaa

SEQ ID NO: 465180 - DNA, 16 bp, R. norvegicus
aaatccttgccagcat

SEQ ID NO: 465181 - DNA, 16 bp, R. norvegicus
aaatcctttcctccca

SEQ ID NO: 465182 - DNA, 39 bp, R. norvegicus
aaatcgacaaatgggatctcataaaactgcaaagcttct

SEQ ID NO: 465183 - DNA, 16 bp, R. norvegicus
aaatctaagtctagag

SEQ ID NO: 465184 - DNA, 16 bp, R. norvegicus
aaatctaccaagagga

SEQ ID NO: 465185 - DNA, 22 bp, R. norvegicus
aaatctaccaagtagaaacaaa

SEQ ID NO: 465186 - DNA, 16 bp, R. norvegicus
aaatctactttttaaa

SEQ ID NO: 465187 - DNA, 16 bp, R. norvegicus
aaatctatatttcatc

SEQ ID NO: 465188 - DNA, 16 bp, R. norvegicus
aaatctatcaaagtaa

SEQ ID NO: 465189 - DNA, 16 bp, R. norvegicus
aaatctattccattgg

SEQ ID NO: 465190 - DNA, 16 bp, R. norvegicus
aaatctcaggagcaga

SEQ ID NO: 465191 - DNA, 16 bp, R. norvegicus
aaatctctagaagaaa

SEQ ID NO: 465192 - DNA, 16 bp, R. norvegicus
aaatctgattttgaaa

SEQ ID NO: 465193 - DNA, 16 bp, R. norvegicus
aaatctgatttttttt

SEQ ID NO: 465194 - DNA, 16 bp, R. norvegicus
aaatctgcacatgaaa

SEQ ID NO: 465195 - DNA, 16 bp, R. norvegicus
aaatctggaacactat

SEQ ID NO: 465196 - DNA, 16 bp, R. norvegicus
aaatctggcaaatgga

SEQ ID NO: 465197 - DNA, 16 bp, R. norvegicus
aaatctgtatgaaatg

SEQ ID NO: 465198 - DNA, 16 bp, R. norvegicus
aaatctgttttaaaat

SEQ ID NO: 465199 - DNA, 16 bp, R. norvegicus
aaatcttaaaaaggaa

SEQ ID NO: 465200 - DNA, 16 bp, R. norvegicus
aaatcttaaagaaaga

SEQ ID NO: 465201 - DNA, 16 bp, R. norvegicus
aaatcttaaaggaaaa

SEQ ID NO: 465202 - DNA, 16 bp, R. norvegicus
aaatcttaaatccaaa

SEQ ID NO: 465203 - DNA, 16 bp, R. norvegicus
aaatcttcaagaaatg

SEQ ID NO: 465204 - DNA, 16 bp, R. norvegicus
aaatcttctgtaagac

SEQ ID NO: 465205 - DNA, 17 bp, R. norvegicus
aaatcttgaaaagtaca

SEQ ID NO: 465206 - DNA, 16 bp, R. norvegicus
aaatcttgtctcaaaa

SEQ ID NO: 465207 - DNA, 16 bp, R. norvegicus
aaatctttaaaaatga

SEQ ID NO: 465208 - DNA, 16 bp, R. norvegicus
aaatctttaaaagaaa

SEQ ID NO: 465209 - DNA, 16 bp, R. norvegicus
aaatctttccagaaaa

SEQ ID NO: 465210 - DNA, 16 bp, R. norvegicus
aaatcttttaagttca

SEQ ID NO: 465211 - DNA, 16 bp, R. norvegicus
aaatcttttacatgct

SEQ ID NO: 465212 - DNA, 16 bp, R. norvegicus
aaatcttttgaaaaaa

SEQ ID NO: 465213 - DNA, 16 bp, R. norvegicus
aaatctttttttaagt

SEQ ID NO: 465214 - DNA, 16 bp, R. norvegicus
aaatgaaaaacttttt

SEQ ID NO: 465215 - DNA, 16 bp, R. norvegicus
aaatgaaaaattctca

SEQ ID NO: 465216 - DNA, 16 bp, R. norvegicus
aaatgaaaactacttt

SEQ ID NO: 465217 - DNA, 20 bp, R. norvegicus
aaatgaaaagggagacatac

SEQ ID NO: 465218 - DNA, 16 bp, R. norvegicus
aaatgaaaatgatttt

SEQ ID NO: 465219 - DNA, 16 bp, R. norvegicus
aaatgaaacacatttt

SEQ ID NO: 465220 - DNA, 16 bp, R. norvegicus
aaatgaaacgcaagac

SEQ ID NO: 465221 - DNA, 16 bp, R. norvegicus
aaatgaaactcaaggc

SEQ ID NO: 465222 - DNA, 16 bp, R. norvegicus
aaatgaaacttttatt

SEQ ID NO: 465223 - DNA, 16 bp, R. norvegicus
aaatgaaagcaaagca

SEQ ID NO: 465224 - DNA, 16 bp, R. norvegicus
aaatgaaataaaacct

SEQ ID NO: 465225 - DNA, 16 bp, R. norvegicus
aaatgaaatcttaaaa

SEQ ID NO: 465226 - DNA, 16 bp, R. norvegicus
aaatgaaatggaaatt

SEQ ID NO: 465227 - DNA, 16 bp, R. norvegicus
aaatgaaatggatgaa

SEQ ID NO: 465228 - DNA, 16 bp, R. norvegicus
aaatgaaatttggaaa

SEQ ID NO: 465229 - DNA, 16 bp, R. norvegicus
aaatgaacacacaaac

SEQ ID NO: 465230 - DNA, 16 bp, R. norvegicus
aaatgaactgaaagaa

SEQ ID NO: 465231 - DNA, 16 bp, R. norvegicus
aaatgaagaatgacat

SEQ ID NO: 465232 - DNA, 16 bp, R. norvegicus
aaatgaagacccagaa

SEQ ID NO: 465233 - DNA, 16 bp, R. norvegicus
aaatgaagatattcca

SEQ ID NO: 465234 - DNA, 16 bp, R. norvegicus
aaatgaagatggaatt

SEQ ID NO: 465235 - DNA, 16 bp, R. norvegicus
aaatgaagcagtgttc

SEQ ID NO: 465236 - DNA, 16 bp, R. norvegicus
aaatgaagcttccaat

SEQ ID NO: 465237 - DNA, 16 bp, R. norvegicus
aaatgaaggaaaacat

SEQ ID NO: 465238 - DNA, 16 bp, R. norvegicus
aaatgaaggcttagca

SEQ ID NO: 465239 - DNA, 16 bp, R. norvegicus
aaatgaataaaaccat

SEQ ID NO: 465240 - DNA, 16 bp, R. norvegicus
aaatgaataaatctct

SEQ ID NO: 465241 - DNA, 16 bp, R. norvegicus
aaatgaatacatttta

SEQ ID NO: 465242 - DNA, 16 bp, R. norvegicus
aaatgaatcaaggacc

SEQ ID NO: 465243 - DNA, 16 bp, R. norvegicus
aaatgaatcataatgc

SEQ ID NO: 465244 - DNA, 16 bp, R. norvegicus
aaatgaatccaagagc

SEQ ID NO: 465245 - DNA, 16 bp, R. norvegicus
aaatgaatttcaaaat

SEQ ID NO: 465246 - DNA, 16 bp, R. norvegicus
aaatgactgccataaa

SEQ ID NO: 465247 - DNA, 16 bp, R. norvegicus
aaatgacttcatgaaa

SEQ ID NO: 465248 - DNA, 18 bp, R. norvegicus
aaatgactttatgaaatt

SEQ ID NO: 465249 - DNA, 16 bp, R. norvegicus
aaatgactttttaaaa

SEQ ID NO: 465250 - DNA, 16 bp, R. norvegicus
aaatgacttttttaaa

SEQ ID NO: 465251 - DNA, 16 bp, R. norvegicus
aaatgagaagacagaa

SEQ ID NO: 465252 - DNA, 16 bp, R. norvegicus
aaatgagagtttagat

SEQ ID NO: 465253 - DNA, 16 bp, R. norvegicus
aaatgaggaaggacac

SEQ ID NO: 465254 - DNA, 16 bp, R. norvegicus
aaatgaggaatatcaa

SEQ ID NO: 465255 - DNA, 16 bp, R. norvegicus
aaatgaggtaactcag

SEQ ID NO: 465256 - DNA, 16 bp, R. norvegicus
aaatgaggttgtcaca

SEQ ID NO: 465257 - DNA, 16 bp, R. norvegicus
aaatgataaaacattt

SEQ ID NO: 465258 - DNA, 16 bp, R. norvegicus
aaatgatcaaaggcag

SEQ ID NO: 465259 - DNA, 16 bp, R. norvegicus
aaatgatcatgaggtt

SEQ ID NO: 465260 - DNA, 16 bp, R. norvegicus
aaatgatttctaatga

SEQ ID NO: 465261 - DNA, 16 bp, R. norvegicus
aaatgattttatagtt

SEQ ID NO: 465262 - DNA, 16 bp, R. norvegicus
aaatgatttttcagca

SEQ ID NO: 465263 - DNA, 16 bp, R. norvegicus
aaatgatttttgttgc

SEQ ID NO: 465264 - DNA, 16 bp, R. norvegicus
aaatgcaaaactcaaa

SEQ ID NO: 465265 - DNA, 16 bp, R. norvegicus
aaatgcaaacattttc

SEQ ID NO: 465266 - DNA, 16 bp, R. norvegicus
aaatgcaaattcaaac

SEQ ID NO: 465267 - DNA, 16 bp, R. norvegicus
aaatgcaaattcattt

SEQ ID NO: 465268 - DNA, 16 bp, R. norvegicus
aaatgcaacttaaaaa

SEQ ID NO: 465269 - DNA, 16 bp, R. norvegicus
aaatgcaagaacacat

SEQ ID NO: 465270 - DNA, 16 bp, R. norvegicus
aaatgcacaattttct

SEQ ID NO: 465271 - DNA, 16 bp, R. norvegicus
aaatgcacacaaaaca

SEQ ID NO: 465272 - DNA, 16 bp, R. norvegicus
aaatgcacagaataaa

SEQ ID NO: 465273 - DNA, 16 bp, R. norvegicus
aaatgcactaaacaaa

SEQ ID NO: 465274 - DNA, 16 bp, R. norvegicus
aaatgcagaggcagat

SEQ ID NO: 465275 - DNA, 16 bp, R. norvegicus
aaatgcagatacttca

SEQ ID NO: 465276 - DNA, 16 bp, R. norvegicus
aaatgcaggtgacagc

SEQ ID NO: 465277 - DNA, 16 bp, R. norvegicus
aaatgcagtgaatgtg

SEQ ID NO: 465278 - DNA, 16 bp, R. norvegicus
aaatgcatatatatat

SEQ ID NO: 465279 - DNA, 16 bp, R. norvegicus
aaatgcatgaaagaat

SEQ ID NO: 465280 - DNA, 16 bp, R. norvegicus
aaatgcatgggatttc

SEQ ID NO: 465281 - DNA, 16 bp, R. norvegicus
aaatgcatttataaat

SEQ ID NO: 465282 - DNA, 16 bp, R. norvegicus
aaatgcatttgtattt

SEQ ID NO: 465283 - DNA, 16 bp, R. norvegicus
aaatgcattttaaaaa

SEQ ID NO: 465284 - DNA, 16 bp, R. norvegicus
aaatgccaaagaaatg

SEQ ID NO: 465285 - DNA, 17 bp, R. norvegicus
aaatgccacaccatcgc

SEQ ID NO: 465286 - DNA, 16 bp, R. norvegicus
aaatgccattttaaaa

SEQ ID NO: 465287 - DNA, 16 bp, R. norvegicus
aaatgcccaaggagag

SEQ ID NO: 465288 - DNA, 16 bp, R. norvegicus
aaatgcctaccatccc

SEQ ID NO: 465289 - DNA, 16 bp, R. norvegicus
aaatgctatttgtcct

SEQ ID NO: 465290 - DNA, 18 bp, R. norvegicus
aaatgctcaacatcttta

SEQ ID NO: 465291 - DNA, 16 bp, R. norvegicus
aaatgctcccactcct

SEQ ID NO: 465292 - DNA, 16 bp, R. norvegicus
aaatgctctgtaaata

SEQ ID NO: 465293 - DNA, 16 bp, R. norvegicus
aaatgctgaaagaaaa

SEQ ID NO: 465294 - DNA, 16 bp, R. norvegicus
aaatgctgagaaaaca

SEQ ID NO: 465295 - DNA, 16 bp, R. norvegicus
aaatgctggcaaggat

SEQ ID NO: 465296 - DNA, 16 bp, R. norvegicus
aaatgctgtcttttcc

SEQ ID NO: 465297 - DNA, 16 bp, R. norvegicus
aaatgctgtgtgtgtg

SEQ ID NO: 465298 - DNA, 16 bp, R. norvegicus
aaatgctgttaagaaa

SEQ ID NO: 465299 - DNA, 16 bp, R. norvegicus
aaatgctgttttaaaa

SEQ ID NO: 465300 - DNA, 16 bp, R. norvegicus
aaatgctgttttcatt

SEQ ID NO: 465301 - DNA, 16 bp, R. norvegicus
aaatgctgtttttttc

SEQ ID NO: 465302 - DNA, 16 bp, R. norvegicus
aaatgcttatttattt

SEQ ID NO: 465303 - DNA, 16 bp, R. norvegicus
aaatgcttctatttct

SEQ ID NO: 465304 - DNA, 16 bp, R. norvegicus
aaatgctttaaagaaa

SEQ ID NO: 465305 - DNA, 16 bp, R. norvegicus
aaatgctttattaaaa

SEQ ID NO: 465306 - DNA, 16 bp, R. norvegicus
aaatgctttatttctg

SEQ ID NO: 465307 - DNA, 16 bp, R. norvegicus
aaatgctttgttttat

SEQ ID NO: 465308 - DNA, 16 bp, R. norvegicus
aaatgcttttaaaaag

SEQ ID NO: 465309 - DNA, 16 bp, R. norvegicus
aaatgcttttaaccac

SEQ ID NO: 465310 - DNA, 16 bp, R. norvegicus
aaatgcttttattttt

SEQ ID NO: 465311 - DNA, 16 bp, R. norvegicus
aaatgctttttatttt

SEQ ID NO: 465312 - DNA, 16 bp, R. norvegicus
aaatggaactgaatcc

SEQ ID NO: 465313 - DNA, 17 bp, R. norvegicus
aaatggaagcaatcaag

SEQ ID NO: 465314 - DNA, 16 bp, R. norvegicus
aaatggaatccaagaa

SEQ ID NO: 465315 - DNA, 16 bp, R. norvegicus
aaatggaattggaaaa

SEQ ID NO: 465316 - DNA, 16 bp, R. norvegicus
aaatggacattttcta

SEQ ID NO: 465317 - DNA, 16 bp, R. norvegicus
aaatggagaaaagcaa

SEQ ID NO: 465318 - DNA, 16 bp, R. norvegicus
aaatggagaaaagtct

SEQ ID NO: 465319 - DNA, 16 bp, R. norvegicus
aaatggagaaaattca

SEQ ID NO: 465320 - DNA, 16 bp, R. norvegicus
aaatggagaagagcct

SEQ ID NO: 465321 - DNA, 16 bp, R. norvegicus
aaatggagacataaaa

SEQ ID NO: 465322 - DNA, 16 bp, R. norvegicus
aaatggagattttttt

SEQ ID NO: 465323 - DNA, 16 bp, R. norvegicus
aaatggaggagcagtg

SEQ ID NO: 465324 - DNA, 16 bp, R. norvegicus
aaatggaggaggaatg

SEQ ID NO: 465325 - DNA, 16 bp, R. norvegicus
aaatggaggcacagag

SEQ ID NO: 465326 - DNA, 16 bp, R. norvegicus
aaatggatacagaaaa

SEQ ID NO: 465327 - DNA, 16 bp, R. norvegicus
aaatggatgaaaatag

SEQ ID NO: 465328 - DNA, 16 bp, R. norvegicus
aaatggatgaaattag

SEQ ID NO: 465329 - DNA, 16 bp, R. norvegicus
aaatggatgatcaaaa

SEQ ID NO: 465330 - DNA, 16 bp, R. norvegicus
aaatggatggaagtgg

SEQ ID NO: 465331 - DNA, 16 bp, R. norvegicus
aaatggattattttct

SEQ ID NO: 465332 - DNA, 17 bp, R. norvegicus
aaatggattggaccaga

SEQ ID NO: 465333 - DNA, 16 bp, R. norvegicus
aaatggcctgaagaag

SEQ ID NO: 465334 - DNA, 16 bp, R. norvegicus
aaatggctcagcagtt

SEQ ID NO: 465335 - DNA, 16 bp, R. norvegicus
aaatggctcaggagtt

SEQ ID NO: 465336 - DNA, 16 bp, R. norvegicus
aaatggctctgtgggt

SEQ ID NO: 465337 - DNA, 16 bp, R. norvegicus
aaatggctgaaagaaa

SEQ ID NO: 465338 - DNA, 16 bp, R. norvegicus
aaatggctggattata

SEQ ID NO: 465339 - DNA, 21 bp, R. norvegicus
aaatggcttatgctctaagat

SEQ ID NO: 465340 - DNA, 16 bp, R. norvegicus
aaatggctttaaaaaa

SEQ ID NO: 465341 - DNA, 17 bp, R. norvegicus
aaatgggacctcataaa

SEQ ID NO: 465342 - DNA, 16 bp, R. norvegicus
aaatgggagagagaac

SEQ ID NO: 465343 - DNA, 16 bp, R. norvegicus
aaatggggaagaacct

SEQ ID NO: 465344 - DNA, 16 bp, R. norvegicus
aaatggggagaaactc

SEQ ID NO: 465345 - DNA, 16 bp, R. norvegicus
aaatggggtagagagc

SEQ ID NO: 465346 - DNA, 16 bp, R. norvegicus
aaatgggtacagaaaa

SEQ ID NO: 465347 - DNA, 16 bp, R. norvegicus
aaatgggtctgaagtt

SEQ ID NO: 465348 - DNA, 24 bp, R. norvegicus
aaatggtgctggttcaactggaga

SEQ ID NO: 465349 - DNA, 16 bp, R. norvegicus
aaatggtgggaagaag

SEQ ID NO: 465350 - DNA, 16 bp, R. norvegicus
aaatggtggtctcccc

SEQ ID NO: 465351 - DNA, 16 bp, R. norvegicus
aaatggttctttggag

SEQ ID NO: 465352 - DNA, 16 bp, R. norvegicus
aaatggtttatgtgtt

SEQ ID NO: 465353 - DNA, 16 bp, R. norvegicus
aaatggttttgttttg

SEQ ID NO: 465354 - DNA, 16 bp, R. norvegicus
aaatgtaaaaataact

SEQ ID NO: 465355 - DNA, 16 bp, R. norvegicus
aaatgtaaataaaatc

SEQ ID NO: 465356 - DNA, 16 bp, R. norvegicus
aaatgtaaatacagaa

SEQ ID NO: 465357 - DNA, 16 bp, R. norvegicus
aaatgtaattctaaaa

SEQ ID NO: 465358 - DNA, 16 bp, R. norvegicus
aaatgtaatttctttt

SEQ ID NO: 465359 - DNA, 17 bp, R. norvegicus
aaatgtacaatttccta

SEQ ID NO: 465360 - DNA, 16 bp, R. norvegicus
aaatgtacagaacaca

SEQ ID NO: 465361 - DNA, 16 bp, R. norvegicus
aaatgtactatatttt

SEQ ID NO: 465362 - DNA, 16 bp, R. norvegicus
aaatgtacttgctgtc

SEQ ID NO: 465363 - DNA, 16 bp, R. norvegicus
aaatgtactttttaat

SEQ ID NO: 465364 - DNA, 16 bp, R. norvegicus
aaatgtactttttatt

SEQ ID NO: 465365 - DNA, 16 bp, R. norvegicus
aaatgtacttttttat

SEQ ID NO: 465366 - DNA, 16 bp, R. norvegicus
aaatgtagtgtgtgtg

SEQ ID NO: 465367 - DNA, 16 bp, R. norvegicus
aaatgtatacatatac

SEQ ID NO: 465368 - DNA, 16 bp, R. norvegicus
aaatgtattcttctct

SEQ ID NO: 465369 - DNA, 16 bp, R. norvegicus
aaatgtatttacattt

SEQ ID NO: 465370 - DNA, 16 bp, R. norvegicus
aaatgtatttatatgt

SEQ ID NO: 465371 - DNA, 16 bp, R. norvegicus
aaatgtatttatttca

SEQ ID NO: 465372 - DNA, 16 bp, R. norvegicus
aaatgtattttaaaag

SEQ ID NO: 465373 - DNA, 16 bp, R. norvegicus
aaatgtattttgaaaa

SEQ ID NO: 465374 - DNA, 16 bp, R. norvegicus
aaatgtatttttcatt

SEQ ID NO: 465375 - DNA, 16 bp, R. norvegicus
aaatgtatttttctaa

SEQ ID NO: 465376 - DNA, 16 bp, R. norvegicus
aaatgtatttttgaaa

SEQ ID NO: 465377 - DNA, 16 bp, R. norvegicus
aaatgtcaaattttct

SEQ ID NO: 465378 - DNA, 16 bp, R. norvegicus
aaatgtcacaataaaa

SEQ ID NO: 465379 - DNA, 16 bp, R. norvegicus
aaatgtcacagtgaag

SEQ ID NO: 465380 - DNA, 16 bp, R. norvegicus
aaatgtcagcagcaaa

SEQ ID NO: 465381 - DNA, 16 bp, R. norvegicus
aaatgtcatttctttt

SEQ ID NO: 465382 - DNA, 16 bp, R. norvegicus
aaatgtcatttttttt

SEQ ID NO: 465383 - DNA, 16 bp, R. norvegicus
aaatgtccttataaga

SEQ ID NO: 465384 - DNA, 16 bp, R. norvegicus
aaatgtcttcaacaaa

SEQ ID NO: 465385 - DNA, 16 bp, R. norvegicus
aaatgtgaattcttca

SEQ ID NO: 465386 - DNA, 16 bp, R. norvegicus
aaatgtgactgcttca

SEQ ID NO: 465387 - DNA, 16 bp, R. norvegicus
aaatgtgagcagagag

SEQ ID NO: 465388 - DNA, 16 bp, R. norvegicus
aaatgtgcattggtgt

SEQ ID NO: 465389 - DNA, 16 bp, R. norvegicus
aaatgtgcttttaaaa

SEQ ID NO: 465390 - DNA, 16 bp, R. norvegicus
aaatgtggatacttca

SEQ ID NO: 465391 - DNA, 16 bp, R. norvegicus
aaatgtggtacatctt

SEQ ID NO: 465392 - DNA, 16 bp, R. norvegicus
aaatgtggtacattca

SEQ ID NO: 465393 - DNA, 16 bp, R. norvegicus
aaatgtggtttttaaa

SEQ ID NO: 465394 - DNA, 16 bp, R. norvegicus
aaatgtgttttaaaat

SEQ ID NO: 465395 - DNA, 16 bp, R. norvegicus
aaatgttaaaatatgt

SEQ ID NO: 465396 - DNA, 16 bp, R. norvegicus
aaatgttaaaatgtta

SEQ ID NO: 465397 - DNA, 16 bp, R. norvegicus
aaatgttaagtagaaa

SEQ ID NO: 465398 - DNA, 16 bp, R. norvegicus
aaatgttagcaactgg

SEQ ID NO: 465399 - DNA, 16 bp, R. norvegicus
aaatgttatctcattt

SEQ ID NO: 465400 - DNA, 16 bp, R. norvegicus
aaatgttcaacatgtt

SEQ ID NO: 465401 - DNA, 16 bp, R. norvegicus
aaatgttcaattaaaa

SEQ ID NO: 465402 - DNA, 16 bp, R. norvegicus
aaatgttcatcatctt

SEQ ID NO: 465403 - DNA, 16 bp, R. norvegicus
aaatgttctttataaa

SEQ ID NO: 465404 - DNA, 16 bp, R. norvegicus
aaatgttgtaattaaa

SEQ ID NO: 465405 - DNA, 34 bp, R. norvegicus
aaatgttgtcaggcagctatagagaaggggcaag

SEQ ID NO: 465406 - DNA, 16 bp, R. norvegicus
aaatgttgtccttaaa

SEQ ID NO: 465407 - DNA, 16 bp, R. norvegicus
aaatgtttaaaaacat

SEQ ID NO: 465408 - DNA, 16 bp, R. norvegicus
aaatgtttacattttg

SEQ ID NO: 465409 - DNA, 16 bp, R. norvegicus
aaatgtttcagaaaca

SEQ ID NO: 465410 - DNA, 16 bp, R. norvegicus
aaatgtttcatttctt

SEQ ID NO: 465411 - DNA, 16 bp, R. norvegicus
aaatgtttgaaagaaa

SEQ ID NO: 465412 - DNA, 16 bp, R. norvegicus
aaatgttttaaagttt

SEQ ID NO: 465413 - DNA, 16 bp, R. norvegicus
aaatgttttaagattt

SEQ ID NO: 465414 - DNA, 16 bp, R. norvegicus
aaatgttttaatgaaa

SEQ ID NO: 465415 - DNA, 16 bp, R. norvegicus
aaatgttttatttgaa

SEQ ID NO: 465416 - DNA, 16 bp, R. norvegicus
aaatgttttccttcat

SEQ ID NO: 465417 - DNA, 16 bp, R. norvegicus
aaatgttttccttttt

SEQ ID NO: 465418 - DNA, 16 bp, R. norvegicus
aaatgttttcttcatt

SEQ ID NO: 465419 - DNA, 16 bp, R. norvegicus
aaatgttttgaaattt

SEQ ID NO: 465420 - DNA, 16 bp, R. norvegicus
aaatgtttttaaagat

SEQ ID NO: 465421 - DNA, 16 bp, R. norvegicus
aaatgtttttcccctt

SEQ ID NO: 465422 - DNA, 16 bp, R. norvegicus
aaatgtttttcttcct

SEQ ID NO: 465423 - DNA, 16 bp, R. norvegicus
aaatgtttttgagaaa

SEQ ID NO: 465424 - DNA, 16 bp, R. norvegicus
aaattaaaaacctttt

SEQ ID NO: 465425 - DNA, 16 bp, R. norvegicus
aaattaaactgaaaat

SEQ ID NO: 465426 - DNA, 16 bp, R. norvegicus
aaattaaagacctttt

SEQ ID NO: 465427 - DNA, 16 bp, R. norvegicus
aaattaaagactttgt

SEQ ID NO: 465428 - DNA, 16 bp, R. norvegicus
aaattaaagagagacg

SEQ ID NO: 465429 - DNA, 16 bp, R. norvegicus
aaattaaatgctttat

SEQ ID NO: 465430 - DNA, 17 bp, R. norvegicus
aaattaactcaaagaaa

SEQ ID NO: 465431 - DNA, 16 bp, R. norvegicus
aaattaagaaaatatc

SEQ ID NO: 465432 - DNA, 16 bp, R. norvegicus
aaattaaggaaaggac

SEQ ID NO: 465433 - DNA, 16 bp, R. norvegicus
aaattaaggatttttt

SEQ ID NO: 465434 - DNA, 16 bp, R. norvegicus
aaattaagtttccttt

SEQ ID NO: 465435 - DNA, 16 bp, R. norvegicus
aaattaataaaatcag

SEQ ID NO: 465436 - DNA, 16 bp, R. norvegicus
aaattacaagtcctac

SEQ ID NO: 465437 - DNA, 16 bp, R. norvegicus
aaattactccacaaaa

SEQ ID NO: 465438 - DNA, 16 bp, R. norvegicus
aaattagattcaggga

SEQ ID NO: 465439 - DNA, 16 bp, R. norvegicus
aaattatcaaaatgaa

SEQ ID NO: 465440 - DNA, 45 bp, R. norvegicus
aaattatctgaaaggaaactggtccatgaaagcagagcaactatc

SEQ ID NO: 465441 - DNA, 16 bp, R. norvegicus
aaattatctgcagctg

SEQ ID NO: 465442 - DNA, 16 bp, R. norvegicus
aaattattctgcaaaa

SEQ ID NO: 465443 - DNA, 16 bp, R. norvegicus
aaattatttgaaaatg

SEQ ID NO: 465444 - DNA, 16 bp, R. norvegicus
aaattcaaggccagcc

SEQ ID NO: 465445 - DNA, 16 bp, R. norvegicus
aaattcaagtccaagt

SEQ ID NO: 465446 - DNA, 18 bp, R. norvegicus
aaattcacagctgaggaa

SEQ ID NO: 465447 - DNA, 16 bp, R. norvegicus
aaattcagaaatgaaa

SEQ ID NO: 465448 - DNA, 16 bp, R. norvegicus
aaattcagatcatgaa

SEQ ID NO: 465449 - DNA, 16 bp, R. norvegicus
aaattcagatttaaaa

SEQ ID NO: 465450 - DNA, 16 bp, R. norvegicus
aaattcaggaaaacac

SEQ ID NO: 465451 - DNA, 16 bp, R. norvegicus
aaattcaggaaaatat

SEQ ID NO: 465452 - DNA, 16 bp, R. norvegicus
aaattcaggaagaatg

SEQ ID NO: 465453 - DNA, 16 bp, R. norvegicus
aaattcagggaaaaaa

SEQ ID NO: 465454 - DNA, 16 bp, R. norvegicus
aaattcagtacagaca

SEQ ID NO: 465455 - DNA, 16 bp, R. norvegicus
aaattcatcagatctt

SEQ ID NO: 465456 - DNA, 16 bp, R. norvegicus
aaattcatctgggata

SEQ ID NO: 465457 - DNA, 16 bp, R. norvegicus
aaattcatctgtaata

SEQ ID NO: 465458 - DNA, 16 bp, R. norvegicus
aaattcatgatgtcat

SEQ ID NO: 465459 - DNA, 16 bp, R. norvegicus
aaattcatggctctga

SEQ ID NO: 465460 - DNA, 16 bp, R. norvegicus
aaattcatgttttttt

SEQ ID NO: 465461 - DNA, 16 bp, R. norvegicus
aaattcattaaaaatg

SEQ ID NO: 465462 - DNA, 16 bp, R. norvegicus
aaattccaacttaatt

SEQ ID NO: 465463 - DNA, 16 bp, R. norvegicus
aaattcctcctgtcac

SEQ ID NO: 465464 - DNA, 16 bp, R. norvegicus
aaattcctggaaagat

SEQ ID NO: 465465 - DNA, 16 bp, R. norvegicus
aaattcctttcctgtt

SEQ ID NO: 465466 - DNA, 16 bp, R. norvegicus
aaattcctttctacct

SEQ ID NO: 465467 - DNA, 17 bp, R. norvegicus
aaattcgaaggcaaatg

SEQ ID NO: 465468 - DNA, 16 bp, R. norvegicus
aaattctaccaaagaa

SEQ ID NO: 465469 - DNA, 16 bp, R. norvegicus
aaattctctcttccat

SEQ ID NO: 465470 - DNA, 16 bp, R. norvegicus
aaattctgaagaaaat

SEQ ID NO: 465471 - DNA, 16 bp, R. norvegicus
aaattctgcttctgtg

SEQ ID NO: 465472 - DNA, 16 bp, R. norvegicus
aaattctgtttcaaaa

SEQ ID NO: 465473 - DNA, 16 bp, R. norvegicus
aaattcttaggcaaat

SEQ ID NO: 465474 - DNA, 16 bp, R. norvegicus
aaattctttgattttt

SEQ ID NO: 465475 - DNA, 16 bp, R. norvegicus
aaattgaaacagttgg

SEQ ID NO: 465476 - DNA, 16 bp, R. norvegicus
aaattgaaagaacaga

SEQ ID NO: 465477 - DNA, 16 bp, R. norvegicus
aaattgaaagaatttt

SEQ ID NO: 465478 - DNA, 16 bp, R. norvegicus
aaattgaaatgcttct

SEQ ID NO: 465479 - DNA, 16 bp, R. norvegicus
aaattgaagaagatac

SEQ ID NO: 465480 - DNA, 16 bp, R. norvegicus
aaattgaagacacaga

SEQ ID NO: 465481 - DNA, 16 bp, R. norvegicus
aaattgaagatcttag

SEQ ID NO: 465482 - DNA, 16 bp, R. norvegicus
aaattgaagatgatct

SEQ ID NO: 465483 - DNA, 16 bp, R. norvegicus
aaattgaaggaaaggc

SEQ ID NO: 465484 - DNA, 16 bp, R. norvegicus
aaattgaatccattga

SEQ ID NO: 465485 - DNA, 16 bp, R. norvegicus
aaattgaatgaactag

SEQ ID NO: 465486 - DNA, 17 bp, R. norvegicus
aaattgaattgtctatt

SEQ ID NO: 465487 - DNA, 18 bp, R. norvegicus
aaattgagataatatttt

SEQ ID NO: 465488 - DNA, 16 bp, R. norvegicus
aaattgataattttac

SEQ ID NO: 465489 - DNA, 16 bp, R. norvegicus
aaattgatacatcagt

SEQ ID NO: 465490 - DNA, 16 bp, R. norvegicus
aaattgatctttctat

SEQ ID NO: 465491 - DNA, 16 bp, R. norvegicus
aaattgcaaatcaaaa

SEQ ID NO: 465492 - DNA, 16 bp, R. norvegicus
aaattgccaagcttct

SEQ ID NO: 465493 - DNA, 16 bp, R. norvegicus
aaattgcttttaaaaa

SEQ ID NO: 465494 - DNA, 16 bp, R. norvegicus
aaattgcttttatttt

SEQ ID NO: 465495 - DNA, 16 bp, R. norvegicus
aaattggaaaatattt

SEQ ID NO: 465496 - DNA, 16 bp, R. norvegicus
aaattggaaatgaaga

SEQ ID NO: 465497 - DNA, 16 bp, R. norvegicus
aaattggagaagatct

SEQ ID NO: 465498 - DNA, 16 bp, R. norvegicus
aaattggcaaagaaaa

SEQ ID NO: 465499 - DNA, 16 bp, R. norvegicus
aaattggggttgggga

SEQ ID NO: 465500 - DNA, 16 bp, R. norvegicus
aaattggtatgaagtt

SEQ ID NO: 465501 - DNA, 16 bp, R. norvegicus
aaattgtcagaagaag

SEQ ID NO: 465502 - DNA, 16 bp, R. norvegicus
aaattgtccatttctt

SEQ ID NO: 465503 - DNA, 20 bp, R. norvegicus
aaattgttggaactggaaaa

SEQ ID NO: 465504 - DNA, 16 bp, R. norvegicus
aaattgtttatttcct

SEQ ID NO: 465505 - DNA, 16 bp, R. norvegicus
aaattgtttctgtttt

SEQ ID NO: 465506 - DNA, 16 bp, R. norvegicus
aaattgttttctgcca

SEQ ID NO: 465507 - DNA, 16 bp, R. norvegicus
aaattgttttctttta

SEQ ID NO: 465508 - DNA, 16 bp, R. norvegicus
aaatttaaagaatcat

SEQ ID NO: 465509 - DNA, 16 bp, R. norvegicus
aaatttaactcttcaa

SEQ ID NO: 465510 - DNA, 27 bp, R. norvegicus
aaatttacacaatatctttccacaaat

SEQ ID NO: 465511 - DNA, 16 bp, R. norvegicus
aaatttacaggaaata

SEQ ID NO: 465512 - DNA, 16 bp, R. norvegicus
aaatttataagcaaat

SEQ ID NO: 465513 - DNA, 16 bp, R. norvegicus
aaatttatagacaaat

SEQ ID NO: 465514 - DNA, 16 bp, R. norvegicus
aaatttcaaaaggaaa

SEQ ID NO: 465515 - DNA, 16 bp, R. norvegicus
aaatttcaaatgaaaa

SEQ ID NO: 465516 - DNA, 16 bp, R. norvegicus
aaatttcacctctcct

SEQ ID NO: 465517 - DNA, 16 bp, R. norvegicus
aaatttcagaagaaaa

SEQ ID NO: 465518 - DNA, 16 bp, R. norvegicus
aaatttcagttttaaa

SEQ ID NO: 465519 - DNA, 16 bp, R. norvegicus
aaatttcatgatgcca

SEQ ID NO: 465520 - DNA, 16 bp, R. norvegicus
aaatttccccagtgcc

SEQ ID NO: 465521 - DNA, 16 bp, R. norvegicus
aaatttcctaaaccaa

SEQ ID NO: 465522 - DNA, 16 bp, R. norvegicus
aaatttcctgaagaga

SEQ ID NO: 465523 - DNA, 16 bp, R. norvegicus
aaatttctcttttaaa

SEQ ID NO: 465524 - DNA, 16 bp, R. norvegicus
aaatttctgaacagaa

SEQ ID NO: 465525 - DNA, 16 bp, R. norvegicus
aaatttgaaaattgtt

SEQ ID NO: 465526 - DNA, 16 bp, R. norvegicus
aaatttgattcccagc

SEQ ID NO: 465527 - DNA, 16 bp, R. norvegicus
aaatttgcaaatttct

SEQ ID NO: 465528 - DNA, 16 bp, R. norvegicus
aaatttgtccatttca

SEQ ID NO: 465529 - DNA, 16 bp, R. norvegicus
aaatttgtcccaagtc

SEQ ID NO: 465530 - DNA, 16 bp, R. norvegicus
aaatttgtttttgaca

SEQ ID NO: 465531 - DNA, 16 bp, R. norvegicus
aaattttaaaaagtca

SEQ ID NO: 465532 - DNA, 16 bp, R. norvegicus
aaattttaaaaagtct

SEQ ID NO: 465533 - DNA, 16 bp, R. norvegicus
aaattttaaaagagac

SEQ ID NO: 465534 - DNA, 16 bp, R. norvegicus
aaattttaaaggaaag

SEQ ID NO: 465535 - DNA, 16 bp, R. norvegicus
aaattttatccctttt

SEQ ID NO: 465536 - DNA, 16 bp, R. norvegicus
aaattttcaagaaaaa

SEQ ID NO: 465537 - DNA, 16 bp, R. norvegicus
aaattttcagaaaaca

SEQ ID NO: 465538 - DNA, 16 bp, R. norvegicus
aaattttcatttcaaa

SEQ ID NO: 465539 - DNA, 16 bp, R. norvegicus
aaattttcattttcaa

SEQ ID NO: 465540 - DNA, 16 bp, R. norvegicus
aaattttctgaagaaa

SEQ ID NO: 465541 - DNA, 16 bp, R. norvegicus
aaattttgatgaggat

SEQ ID NO: 465542 - DNA, 16 bp, R. norvegicus
aaattttgcaattatt

SEQ ID NO: 465543 - DNA, 16 bp, R. norvegicus
aaatttttcaaaagaa

SEQ ID NO: 465544 - DNA, 16 bp, R. norvegicus
aaatttttgagatgtg

SEQ ID NO: 465545 - DNA, 16 bp, R. norvegicus
aacaaaaaatgcagga

SEQ ID NO: 465546 - DNA, 16 bp, R. norvegicus
aacaaaaacattttca

SEQ ID NO: 465547 - DNA, 16 bp, R. norvegicus
aacaaaaaggagtata

SEQ ID NO: 465548 - DNA, 38 bp, R. norvegicus
aacaaaacaccaatggcttacgctctaagatcaagaat

SEQ ID NO: 465549 - DNA, 16 bp, R. norvegicus
aacaaaacagaaatct

SEQ ID NO: 465550 - DNA, 17 bp, R. norvegicus
aacaaaacagcaatggc

SEQ ID NO: 465551 - DNA, 16 bp, R. norvegicus
aacaaaacaggtgaag

SEQ ID NO: 465552 - DNA, 16 bp, R. norvegicus
aacaaaaccaagagct

SEQ ID NO: 465553 - DNA, 16 bp, R. norvegicus
aacaaaaccaggtgct

SEQ ID NO: 465554 - DNA, 16 bp, R. norvegicus
aacaaaaccatccaga

SEQ ID NO: 465555 - DNA, 16 bp, R. norvegicus
aacaaaaccatcctgg

SEQ ID NO: 465556 - DNA, 16 bp, R. norvegicus
aacaaaacccagagag

SEQ ID NO: 465557 - DNA, 16 bp, R. norvegicus
aacaaaactggaagat

SEQ ID NO: 465558 - DNA, 16 bp, R. norvegicus
aacaaaagactgggaa

SEQ ID NO: 465559 - DNA, 16 bp, R. norvegicus
aacaaaaggaggccaa

SEQ ID NO: 465560 - DNA, 16 bp, R. norvegicus
aacaaaagtattcata

SEQ ID NO: 465561 - DNA, 16 bp, R. norvegicus
aacaaaagtgaaagag

SEQ ID NO: 465562 - DNA, 16 bp, R. norvegicus
aacaaaataacctttt

SEQ ID NO: 465563 - DNA, 16 bp, R. norvegicus
aacaaaatactcacag

SEQ ID NO: 465564 - DNA, 16 bp, R. norvegicus
aacaaaatattcatgg

SEQ ID NO: 465565 - DNA, 16 bp, R. norvegicus
aacaaaatcaaacagg

SEQ ID NO: 465566 - DNA, 16 bp, R. norvegicus
aacaaaatcattcagg

SEQ ID NO: 465567 - DNA, 16 bp, R. norvegicus
aacaaaatgaaaatgt

SEQ ID NO: 465568 - DNA, 16 bp, R. norvegicus
aacaaaatgattttat

SEQ ID NO: 465569 - DNA, 16 bp, R. norvegicus
aacaaaatggaaggag

SEQ ID NO: 465570 - DNA, 16 bp, R. norvegicus
aacaaaattacagtta

SEQ ID NO: 465571 - DNA, 16 bp, R. norvegicus
aacaaaattatagaat

SEQ ID NO: 465572 - DNA, 16 bp, R. norvegicus
aacaaaatttacacag

SEQ ID NO: 465573 - DNA, 16 bp, R. norvegicus
aacaaacaaaactttt

SEQ ID NO: 465574 - DNA, 16 bp, R. norvegicus
aacaaacaccatgacc

SEQ ID NO: 465575 - DNA, 16 bp, R. norvegicus
aacaaacagctgactg

SEQ ID NO: 465576 - DNA, 16 bp, R. norvegicus
aacaaacatggaataa

SEQ ID NO: 465577 - DNA, 16 bp, R. norvegicus
aacaaactgaaaggac

SEQ ID NO: 465578 - DNA, 17 bp, R. norvegicus
aacaaacttaaagaaca

SEQ ID NO: 465579 - DNA, 16 bp, R. norvegicus
aacaaagaatacacag

SEQ ID NO: 465580 - DNA, 16 bp, R. norvegicus
aacaaagaattcacac

SEQ ID NO: 465581 - DNA, 16 bp, R. norvegicus
aacaaagaattttcag

SEQ ID NO: 465582 - DNA, 16 bp, R. norvegicus
aacaaagacacatatt

SEQ ID NO: 465583 - DNA, 35 bp, R. norvegicus
aacaaagcaaacagtttcatgatttcaaacacagt

SEQ ID NO: 465584 - DNA, 16 bp, R. norvegicus
aacaaagcagatcaag

SEQ ID NO: 465585 - DNA, 18 bp, R. norvegicus
aacaaaggaaactcaaga

SEQ ID NO: 465586 - DNA, 19 bp, R. norvegicus
aacaaaggcaccagcctta

SEQ ID NO: 465587 - DNA, 16 bp, R. norvegicus
aacaaaggctgaagga

SEQ ID NO: 465588 - DNA, 16 bp, R. norvegicus
aacaaataaaagccca

SEQ ID NO: 465589 - DNA, 16 bp, R. norvegicus
aacaaataccaggtac

SEQ ID NO: 465590 - DNA, 16 bp, R. norvegicus
aacaaatcagtggcct

SEQ ID NO: 465591 - DNA, 16 bp, R. norvegicus
aacaaatgaacagaag

SEQ ID NO: 465592 - DNA, 16 bp, R. norvegicus
aacaaatggtgctgat

SEQ ID NO: 465593 - DNA, 16 bp, R. norvegicus
aacaaatgtaaaaagc

SEQ ID NO: 465594 - DNA, 16 bp, R. norvegicus
aacaaattgaaaatgg

SEQ ID NO: 465595 - DNA, 16 bp, R. norvegicus
aacaacaacaaaagct

SEQ ID NO: 465596 - DNA, 16 bp, R. norvegicus
aacaacaacaacagta

SEQ ID NO: 465597 - DNA, 16 bp, R. norvegicus
aacaacaacagtgaca

SEQ ID NO: 465598 - DNA, 16 bp, R. norvegicus
aacaacaatggaggaa

SEQ ID NO: 465599 - DNA, 16 bp, R. norvegicus
aacaacaatgtcaagc

SEQ ID NO: 465600 - DNA, 16 bp, R. norvegicus
aacaacacagagtggg

SEQ ID NO: 465601 - DNA, 16 bp, R. norvegicus
aacaacagaaagctta

SEQ ID NO: 465602 - DNA, 16 bp, R. norvegicus
aacaacagaaagtcca

SEQ ID NO: 465603 - DNA, 16 bp, R. norvegicus
aacaacagaacccaat

SEQ ID NO: 465604 - DNA, 16 bp, R. norvegicus
aacaacagcaacaact

SEQ ID NO: 465605 - DNA, 16 bp, R. norvegicus
aacaacagcagcagca

SEQ ID NO: 465606 - DNA, 16 bp, R. norvegicus
aacaacagcaggaaca

SEQ ID NO: 465607 - DNA, 16 bp, R. norvegicus
aacaacagtttccttt

SEQ ID NO: 465608 - DNA, 16 bp, R. norvegicus
aacaacatcagcagca

SEQ ID NO: 465609 - DNA, 16 bp, R. norvegicus
aacaacatgaagctca

SEQ ID NO: 465610 - DNA, 16 bp, R. norvegicus
aacaacattgccaacc

SEQ ID NO: 465611 - DNA, 16 bp, R. norvegicus
aacaaccagaagggcc

SEQ ID NO: 465612 - DNA, 16 bp, R. norvegicus
aacaaccccgagattc

SEQ ID NO: 465613 - DNA, 16 bp, R. norvegicus
aacaaccctgatattt

SEQ ID NO: 465614 - DNA, 16 bp, R. norvegicus
aacaacctacagattg

SEQ ID NO: 465615 - DNA, 16 bp, R. norvegicus
aacaactactggattc

SEQ ID NO: 465616 - DNA, 16 bp, R. norvegicus
aacaactggagcgggg

SEQ ID NO: 465617 - DNA, 16 bp, R. norvegicus
aacaacttaaaactca

SEQ ID NO: 465618 - DNA, 16 bp, R. norvegicus
aacaacttagatgtcc

SEQ ID NO: 465619 - DNA, 16 bp, R. norvegicus
aacaacttcagaaaag

SEQ ID NO: 465620 - DNA, 16 bp, R. norvegicus
aacaacttcagcaaaa

SEQ ID NO: 465621 - DNA, 16 bp, R. norvegicus
aacaacttcagcatag

SEQ ID NO: 465622 - DNA, 16 bp, R. norvegicus
aacaactttggaaagc

SEQ ID NO: 465623 - DNA, 16 bp, R. norvegicus
aacaagaaactgtaac

SEQ ID NO: 465624 - DNA, 16 bp, R. norvegicus
aacaagaagaagccca

SEQ ID NO: 465625 - DNA, 16 bp, R. norvegicus
aacaagagaaggaaat

SEQ ID NO: 465626 - DNA, 16 bp, R. norvegicus
aacaagagaccctgtc

SEQ ID NO: 465627 - DNA, 16 bp, R. norvegicus
aacaagagatagaaga

SEQ ID NO: 465628 - DNA, 16 bp, R. norvegicus
aacaagagccagggca

SEQ ID NO: 465629 - DNA, 16 bp, R. norvegicus
aacaagagcctgaaag

SEQ ID NO: 465630 - DNA, 16 bp, R. norvegicus
aacaagatagagaaac

SEQ ID NO: 465631 - DNA, 16 bp, R. norvegicus
aacaagatcagaaatg

SEQ ID NO: 465632 - DNA, 16 bp, R. norvegicus
aacaagatgcagaact

SEQ ID NO: 465633 - DNA, 16 bp, R. norvegicus
aacaagatggataaac

SEQ ID NO: 465634 - DNA, 16 bp, R. norvegicus
aacaagattttgattt

SEQ ID NO: 465635 - DNA, 16 bp, R. norvegicus
aacaagcagcagaact

SEQ ID NO: 465636 - DNA, 16 bp, R. norvegicus
aacaagcagcctcagg

SEQ ID NO: 465637 - DNA, 16 bp, R. norvegicus
aacaagcagctgacag

SEQ ID NO: 465638 - DNA, 16 bp, R. norvegicus
aacaagcagtggttcc

SEQ ID NO: 465639 - DNA, 16 bp, R. norvegicus
aacaagcctccacagg

SEQ ID NO: 465640 - DNA, 16 bp, R. norvegicus
aacaagctccagtcag

SEQ ID NO: 465641 - DNA, 16 bp, R. norvegicus
aacaagctgaaaaaga

SEQ ID NO: 465642 - DNA, 16 bp, R. norvegicus
aacaagctgaggaaga

SEQ ID NO: 465643 - DNA, 16 bp, R. norvegicus
aacaaggaaacagcca

SEQ ID NO: 465644 - DNA, 16 bp, R. norvegicus
aacaaggaaactgagg

SEQ ID NO: 465645 - DNA, 16 bp, R. norvegicus
aacaaggaaggatgaa

SEQ ID NO: 465646 - DNA, 16 bp, R. norvegicus
aacaaggaccgcttct

SEQ ID NO: 465647 - DNA, 16 bp, R. norvegicus
aacaaggagctgaaag

SEQ ID NO: 465648 - DNA, 16 bp, R. norvegicus
aacaaggccacaccta

SEQ ID NO: 465649 - DNA, 16 bp, R. norvegicus
aacaaggccacacctt

SEQ ID NO: 465650 - DNA, 16 bp, R. norvegicus
aacaaggccacagctt

SEQ ID NO: 465651 - DNA, 16 bp, R. norvegicus
aacaaggctattgtct

SEQ ID NO: 465652 - DNA, 16 bp, R. norvegicus
aacaaggctccacctc

SEQ ID NO: 465653 - DNA, 16 bp, R. norvegicus
aacaaggctggagaga

SEQ ID NO: 465654 - DNA, 16 bp, R. norvegicus
aacaaggctgtcctct

SEQ ID NO: 465655 - DNA, 16 bp, R. norvegicus
aacaaggggctggaga

SEQ ID NO: 465656 - DNA, 16 bp, R. norvegicus
aacaaggtcttgctat

SEQ ID NO: 465657 - DNA, 28 bp, R. norvegicus
aacaagtagaagcctacagagaagaatc

SEQ ID NO: 465658 - DNA, 27 bp, R. norvegicus
aacaagtagaagcctacagagaggaat

SEQ ID NO: 465659 - DNA, 16 bp, R. norvegicus
aacaagtgctgttaac

SEQ ID NO: 465660 - DNA, 16 bp, R. norvegicus
aacaagtttttaaaaa

SEQ ID NO: 465661 - DNA, 16 bp, R. norvegicus
aacaatacagaaatca

SEQ ID NO: 465662 - DNA, 16 bp, R. norvegicus
aacaatacaggctatt

SEQ ID NO: 465663 - DNA, 54 bp, R. norvegicus
aacaatacttatggactgcccgaagaacagtggaccttggcgtgggccgggtaa

SEQ ID NO: 465664 - DNA, 16 bp, R. norvegicus
aacaatatcatccaac

SEQ ID NO: 465665 - DNA, 16 bp, R. norvegicus
aacaatcaaacaagca

SEQ ID NO: 465666 - DNA, 16 bp, R. norvegicus
aacaatcagggaagaa

SEQ ID NO: 465667 - DNA, 16 bp, R. norvegicus
aacaatccacagacca

SEQ ID NO: 465668 - DNA, 16 bp, R. norvegicus
aacaatctattttcaa

SEQ ID NO: 465669 - DNA, 16 bp, R. norvegicus
aacaatctcattcttt

SEQ ID NO: 465670 - DNA, 16 bp, R. norvegicus
aacaatgaaggccaga

SEQ ID NO: 465671 - DNA, 16 bp, R. norvegicus
aacaatgactatgaaa

SEQ ID NO: 465672 - DNA, 16 bp, R. norvegicus
aacaatgactattcct

SEQ ID NO: 465673 - DNA, 20 bp, R. norvegicus
aacaatgccaaccaaccaga

SEQ ID NO: 465674 - DNA, 16 bp, R. norvegicus
aacaatggacaaatgg

SEQ ID NO: 465675 - DNA, 16 bp, R. norvegicus
aacaattagaagccca

SEQ ID NO: 465676 - DNA, 16 bp, R. norvegicus
aacaattctgagattc

SEQ ID NO: 465677 - DNA, 16 bp, R. norvegicus
aacaattttccttatg

SEQ ID NO: 465678 - DNA, 16 bp, R. norvegicus
aacacaaactggactt

SEQ ID NO: 465679 - DNA, 16 bp, R. norvegicus
aacacaactggaaaaa

SEQ ID NO: 465680 - DNA, 16 bp, R. norvegicus
aacacaagttctgttt

SEQ ID NO: 465681 - DNA, 16 bp, R. norvegicus
aacacaattaaacagt

SEQ ID NO: 465682 - DNA, 16 bp, R. norvegicus
aacacacacctgtctg

SEQ ID NO: 465683 - DNA, 16 bp, R. norvegicus
aacacacagaggcaaa

SEQ ID NO: 465684 - DNA, 16 bp, R. norvegicus
aacacacagatattta

SEQ ID NO: 465685 - DNA, 16 bp, R. norvegicus
aacacagacccaggag

SEQ ID NO: 465686 - DNA, 16 bp, R. norvegicus
aacacagactgaagga

SEQ ID NO: 465687 - DNA, 16 bp, R. norvegicus
aacacagagaagttga

SEQ ID NO: 465688 - DNA, 16 bp, R. norvegicus
aacacagagctgaaat

SEQ ID NO: 465689 - DNA, 16 bp, R. norvegicus
aacacagattattaaa

SEQ ID NO: 465690 - DNA, 16 bp, R. norvegicus
aacacagcagcatcca

SEQ ID NO: 465691 - DNA, 16 bp, R. norvegicus
aacacagggctggaga

SEQ ID NO: 465692 - DNA, 16 bp, R. norvegicus
aacacagtagagctgg

SEQ ID NO: 465693 - DNA, 16 bp, R. norvegicus
aacacagttggattct

SEQ ID NO: 465694 - DNA, 16 bp, R. norvegicus
aacacataaaaatgat

SEQ ID NO: 465695 - DNA, 16 bp, R. norvegicus
aacacataaaccattt

SEQ ID NO: 465696 - DNA, 16 bp, R. norvegicus
aacacatacaggaaat

SEQ ID NO: 465697 - DNA, 16 bp, R. norvegicus
aacacatctttaaaaa

SEQ ID NO: 465698 - DNA, 16 bp, R. norvegicus
aacacatgcagacaca

SEQ ID NO: 465699 - DNA, 16 bp, R. norvegicus
aacacatgctggcaag

SEQ ID NO: 465700 - DNA, 21 bp, R. norvegicus
aacacatgggcactggagaaa

SEQ ID NO: 465701 - DNA, 16 bp, R. norvegicus
aacacattccaagaag

SEQ ID NO: 465702 - DNA, 16 bp, R. norvegicus
aacacattttaaaatt

SEQ ID NO: 465703 - DNA, 16 bp, R. norvegicus
aacaccaacttttctg

SEQ ID NO: 465704 - DNA, 16 bp, R. norvegicus
aacaccaataaagaag

SEQ ID NO: 465705 - DNA, 16 bp, R. norvegicus
aacaccacttgagaga

SEQ ID NO: 465706 - DNA, 16 bp, R. norvegicus
aacaccagagacaacc

SEQ ID NO: 465707 - DNA, 16 bp, R. norvegicus
aacaccagggaaaacc

SEQ ID NO: 465708 - DNA, 16 bp, R. norvegicus
aacaccagggagagtg

SEQ ID NO: 465709 - DNA, 16 bp, R. norvegicus
aacaccagtgttagct

SEQ ID NO: 465710 - DNA, 16 bp, R. norvegicus
aacaccatctgggacc

SEQ ID NO: 465711 - DNA, 16 bp, R. norvegicus
aacaccatgaccaaaa

SEQ ID NO: 465712 - DNA, 16 bp, R. norvegicus
aacaccatgaccacaa

SEQ ID NO: 465713 - DNA, 16 bp, R. norvegicus
aacaccatgagcaaaa

SEQ ID NO: 465714 - DNA, 16 bp, R. norvegicus
aacaccattcatgaat

SEQ ID NO: 465715 - DNA, 16 bp, R. norvegicus
aacacccataaagaaa

SEQ ID NO: 465716 - DNA, 16 bp, R. norvegicus
aacacccatgcacatt

SEQ ID NO: 465717 - DNA, 17 bp, R. norvegicus
aacacccattcagatcc

SEQ ID NO: 465718 - DNA, 16 bp, R. norvegicus
aacaccctgacaaaag

SEQ ID NO: 465719 - DNA, 16 bp, R. norvegicus
aacaccctgaccaaag

SEQ ID NO: 465720 - DNA, 16 bp, R. norvegicus
aacaccctgctttcct

SEQ ID NO: 465721 - DNA, 18 bp, R. norvegicus
aacacctgaagacctgta

SEQ ID NO: 465722 - DNA, 16 bp, R. norvegicus
aacaccttcaacaaag

SEQ ID NO: 465723 - DNA, 16 bp, R. norvegicus
aacacctttaatctca

SEQ ID NO: 465724 - DNA, 16 bp, R. norvegicus
aacacgtgcccctgtg

SEQ ID NO: 465725 - DNA, 16 bp, R. norvegicus
aacacgtgggcactgg

SEQ ID NO: 465726 - DNA, 16 bp, R. norvegicus
aacactcaggagacag

SEQ ID NO: 465727 - DNA, 16 bp, R. norvegicus
aacactcctccactga

SEQ ID NO: 465728 - DNA, 17 bp, R. norvegicus
aacactcctccattgct

SEQ ID NO: 465729 - DNA, 16 bp, R. norvegicus
aacactctgttcccag

SEQ ID NO: 465730 - DNA, 16 bp, R. norvegicus
aacactgaggaaattc

SEQ ID NO: 465731 - DNA, 16 bp, R. norvegicus
aacactgccacttggg

SEQ ID NO: 465732 - DNA, 18 bp, R. norvegicus
aacactggatatagaaaa

SEQ ID NO: 465733 - DNA, 16 bp, R. norvegicus
aacactgtcaatagga

SEQ ID NO: 465734 - DNA, 16 bp, R. norvegicus
aacactgtgtatgtaa

SEQ ID NO: 465735 - DNA, 16 bp, R. norvegicus
aacacttaggaagcag

SEQ ID NO: 465736 - DNA, 16 bp, R. norvegicus
aacacttcaaaacaat

SEQ ID NO: 465737 - DNA, 16 bp, R. norvegicus
aacacttggtcctcag

SEQ ID NO: 465738 - DNA, 16 bp, R. norvegicus
aacactttattttaaa

SEQ ID NO: 465739 - DNA, 16 bp, R. norvegicus
aacagaaaaaccagtt

SEQ ID NO: 465740 - DNA, 16 bp, R. norvegicus
aacagaaaaaccattt

SEQ ID NO: 465741 - DNA, 16 bp, R. norvegicus
aacagaaaataaattc

SEQ ID NO: 465742 - DNA, 16 bp, R. norvegicus
aacagaaaatgaggaa

SEQ ID NO: 465743 - DNA, 16 bp, R. norvegicus
aacagaaacagcagca

SEQ ID NO: 465744 - DNA, 16 bp, R. norvegicus
aacagaaacaggaaat

SEQ ID NO: 465745 - DNA, 18 bp, R. norvegicus
aacagaaaccaagactat

SEQ ID NO: 465746 - DNA, 16 bp, R. norvegicus
aacagaaaccaaggtc

SEQ ID NO: 465747 - DNA, 16 bp, R. norvegicus
aacagaaaccagggaa

SEQ ID NO: 465748 - DNA, 16 bp, R. norvegicus
aacagaaactgaaaga

SEQ ID NO: 465749 - DNA, 16 bp, R. norvegicus
aacagaaacttaggcc

SEQ ID NO: 465750 - DNA, 16 bp, R. norvegicus
aacagaaagaacacta

SEQ ID NO: 465751 - DNA, 16 bp, R. norvegicus
aacagaaagaacactg

SEQ ID NO: 465752 - DNA, 16 bp, R. norvegicus
aacagaaagaatgtaa

SEQ ID NO: 465753 - DNA, 16 bp, R. norvegicus
aacagaaagccaacat

SEQ ID NO: 465754 - DNA, 16 bp, R. norvegicus
aacagaaaggcaagca

SEQ ID NO: 465755 - DNA, 16 bp, R. norvegicus
aacagaaatcaagact

SEQ ID NO: 465756 - DNA, 16 bp, R. norvegicus
aacagaaatggaggaa

SEQ ID NO: 465757 - DNA, 16 bp, R. norvegicus
aacagaaatgtatttt

SEQ ID NO: 465758 - DNA, 37 bp, R. norvegicus
aacagaacaatttgcaaattcatctggaataacaaaa

SEQ ID NO: 465759 - DNA, 16 bp, R. norvegicus
aacagaacaccaacgg

SEQ ID NO: 465760 - DNA, 16 bp, R. norvegicus
aacagaacaccaatgg

SEQ ID NO: 465761 - DNA, 16 bp, R. norvegicus
aacagaaccaaaaatt

SEQ ID NO: 465762 - DNA, 16 bp, R. norvegicus
aacagaaccaaaggct

SEQ ID NO: 465763 - DNA, 16 bp, R. norvegicus
aacagaactcaggtcc

SEQ ID NO: 465764 - DNA, 16 bp, R. norvegicus
aacagaagaaatacta

SEQ ID NO: 465765 - DNA, 16 bp, R. norvegicus
aacagaagaatggatt

SEQ ID NO: 465766 - DNA, 16 bp, R. norvegicus
aacagaagagtaacta

SEQ ID NO: 465767 - DNA, 16 bp, R. norvegicus
aacagaagcagaagct

SEQ ID NO: 465768 - DNA, 16 bp, R. norvegicus
aacagaagcagagacc

SEQ ID NO: 465769 - DNA, 16 bp, R. norvegicus
aacagaaggcagagag

SEQ ID NO: 465770 - DNA, 16 bp, R. norvegicus
aacagaatcaaagacc

SEQ ID NO: 465771 - DNA, 16 bp, R. norvegicus
aacagacccagaagga

SEQ ID NO: 465772 - DNA, 16 bp, R. norvegicus
aacagactgaaggaaa

SEQ ID NO: 465773 - DNA, 16 bp, R. norvegicus
aacagactgagaagga

SEQ ID NO: 465774 - DNA, 16 bp, R. norvegicus
aacagagaaatgcaaa

SEQ ID NO: 465775 - DNA, 16 bp, R. norvegicus
aacagagaattctcca

SEQ ID NO: 465776 - DNA, 16 bp, R. norvegicus
aacagagacagagaca

SEQ ID NO: 465777 - DNA, 16 bp, R. norvegicus
aacagagactaaagga

SEQ ID NO: 465778 - DNA, 16 bp, R. norvegicus
aacagagactgaaagg

SEQ ID NO: 465779 - DNA, 16 bp, R. norvegicus
aacagagagctgctgc

SEQ ID NO: 465780 - DNA, 16 bp, R. norvegicus
aacagagcccaggtcc

SEQ ID NO: 465781 - DNA, 16 bp, R. norvegicus
aacagaggaagacacc

SEQ ID NO: 465782 - DNA, 16 bp, R. norvegicus
aacagaggcagctgca

SEQ ID NO: 465783 - DNA, 16 bp, R. norvegicus
aacagagtgctctgct

SEQ ID NO: 465784 - DNA, 16 bp, R. norvegicus
aacagatacagacaga

SEQ ID NO: 465785 - DNA, 16 bp, R. norvegicus
aacagatagaagcctt

SEQ ID NO: 465786 - DNA, 16 bp, R. norvegicus
aacagatatttacaaa

SEQ ID NO: 465787 - DNA, 16 bp, R. norvegicus
aacagatgcagagaac

SEQ ID NO: 465788 - DNA, 16 bp, R. norvegicus
aacagatggttgtgag

SEQ ID NO: 465789 - DNA, 16 bp, R. norvegicus
aacagattcagaaaag

SEQ ID NO: 465790 - DNA, 16 bp, R. norvegicus
aacagattcagggaca

SEQ ID NO: 465791 - DNA, 16 bp, R. norvegicus
aacagatttccagagt

SEQ ID NO: 465792 - DNA, 16 bp, R. norvegicus
aacagatttttttttt

SEQ ID NO: 465793 - DNA, 16 bp, R. norvegicus
aacagcaaatgttctt

SEQ ID NO: 465794 - DNA, 16 bp, R. norvegicus
aacagcaacaatgaca

SEQ ID NO: 465795 - DNA, 16 bp, R. norvegicus
aacagcaacagaaagc

SEQ ID NO: 465796 - DNA, 16 bp, R. norvegicus
aacagcaacagtaaca

SEQ ID NO: 465797 - DNA, 16 bp, R. norvegicus
aacagcaactcccact

SEQ ID NO: 465798 - DNA, 16 bp, R. norvegicus
aacagcaatctacaga

SEQ ID NO: 465799 - DNA, 16 bp, R. norvegicus
aacagcaatgtggaag

SEQ ID NO: 465800 - DNA, 16 bp, R. norvegicus
aacagcacagaaagca

SEQ ID NO: 465801 - DNA, 16 bp, R. norvegicus
aacagcagatgctggc

SEQ ID NO: 465802 - DNA, 16 bp, R. norvegicus
aacagcagcagcaaga

SEQ ID NO: 465803 - DNA, 16 bp, R. norvegicus
aacagcagcagcagaa

SEQ ID NO: 465804 - DNA, 23 bp, R. norvegicus
aacagcagcagcagcaacaacag

SEQ ID NO: 465805 - DNA, 16 bp, R. norvegicus
aacagcagcagcagcc

SEQ ID NO: 465806 - DNA, 16 bp, R. norvegicus
aacagcagcagtggag

SEQ ID NO: 465807 - DNA, 16 bp, R. norvegicus
aacagcagcatcaaca

SEQ ID NO: 465808 - DNA, 16 bp, R. norvegicus
aacagcagctccattt

SEQ ID NO: 465809 - DNA, 16 bp, R. norvegicus
aacagcaggaggtagc

SEQ ID NO: 465810 - DNA, 16 bp, R. norvegicus
aacagcagtgtggaag

SEQ ID NO: 465811 - DNA, 16 bp, R. norvegicus
aacagcatcttccaga

SEQ ID NO: 465812 - DNA, 16 bp, R. norvegicus
aacagccaccatgacc

SEQ ID NO: 465813 - DNA, 16 bp, R. norvegicus
aacagccaggcctctg

SEQ ID NO: 465814 - DNA, 16 bp, R. norvegicus
aacagccccctgaccg

SEQ ID NO: 465815 - DNA, 17 bp, R. norvegicus
aacagccttatttataa

SEQ ID NO: 465816 - DNA, 16 bp, R. norvegicus
aacagccttgtattat

SEQ ID NO: 465817 - DNA, 16 bp, R. norvegicus
aacagctctacagcac

SEQ ID NO: 465818 - DNA, 16 bp, R. norvegicus
aacagctctctgctcc

SEQ ID NO: 465819 - DNA, 16 bp, R. norvegicus
aacagctgaaagaaaa

SEQ ID NO: 465820 - DNA, 18 bp, R. norvegicus
aacagctgaagaccagta

SEQ ID NO: 465821 - DNA, 16 bp, R. norvegicus
aacagctgaaggaatt

SEQ ID NO: 465822 - DNA, 16 bp, R. norvegicus
aacagctgataaacaa

SEQ ID NO: 465823 - DNA, 16 bp, R. norvegicus
aacagctggagcaggg

SEQ ID NO: 465824 - DNA, 16 bp, R. norvegicus
aacaggaaaacccacc

SEQ ID NO: 465825 - DNA, 16 bp, R. norvegicus
aacaggaaaagccttt

SEQ ID NO: 465826 - DNA, 16 bp, R. norvegicus
aacaggaaagaacata

SEQ ID NO: 465827 - DNA, 16 bp, R. norvegicus
aacaggaacaccagaa

SEQ ID NO: 465828 - DNA, 16 bp, R. norvegicus
aacaggaacctggagg

SEQ ID NO: 465829 - DNA, 16 bp, R. norvegicus
aacaggaactggatgt

SEQ ID NO: 465830 - DNA, 16 bp, R. norvegicus
aacaggaagatctctg

SEQ ID NO: 465831 - DNA, 16 bp, R. norvegicus
aacaggaagcaggaag

SEQ ID NO: 465832 - DNA, 16 bp, R. norvegicus
aacaggaagtgacaat

SEQ ID NO: 465833 - DNA, 16 bp, R. norvegicus
aacaggactgaagccc

SEQ ID NO: 465834 - DNA, 16 bp, R. norvegicus
aacaggagagaaaccc

SEQ ID NO: 465835 - DNA, 16 bp, R. norvegicus
aacaggagagaacata

SEQ ID NO: 465836 - DNA, 16 bp, R. norvegicus
aacaggagcagcagca

SEQ ID NO: 465837 - DNA, 16 bp, R. norvegicus
aacaggagcctggtat

SEQ ID NO: 465838 - DNA, 16 bp, R. norvegicus
aacaggcagaagaggc

SEQ ID NO: 465839 - DNA, 16 bp, R. norvegicus
aacaggcagttttgtc

SEQ ID NO: 465840 - DNA, 16 bp, R. norvegicus
aacagggctgccttgt

SEQ ID NO: 465841 - DNA, 25 bp, R. norvegicus
aacaggggactctaagacctggggt

SEQ ID NO: 465842 - DNA, 16 bp, R. norvegicus
aacagggttggagaga

SEQ ID NO: 465843 - DNA, 16 bp, R. norvegicus
aacaggtaaagaaatt

SEQ ID NO: 465844 - DNA, 17 bp, R. norvegicus
aacaggtacatcataat

SEQ ID NO: 465845 - DNA, 16 bp, R. norvegicus
aacaggtgagggaatt

SEQ ID NO: 465846 - DNA, 16 bp, R. norvegicus
aacaggtgtgtgtgtg

SEQ ID NO: 465847 - DNA, 16 bp, R. norvegicus
aacaggttcagtttgg

SEQ ID NO: 465848 - DNA, 16 bp, R. norvegicus
aacagtaacaacaaca

SEQ ID NO: 465849 - DNA, 16 bp, R. norvegicus
aacagtagcagaatta

SEQ ID NO: 465850 - DNA, 16 bp, R. norvegicus
aacagtctcaacaatg

SEQ ID NO: 465851 - DNA, 16 bp, R. norvegicus
aacagtctctaggcca

SEQ ID NO: 465852 - DNA, 16 bp, R. norvegicus
aacagtgaacagcact

SEQ ID NO: 465853 - DNA, 16 bp, R. norvegicus
aacagtgaacagcaga

SEQ ID NO: 465854 - DNA, 16 bp, R. norvegicus
aacagtgacaaagaca

SEQ ID NO: 465855 - DNA, 16 bp, R. norvegicus
aacagtgccaccagct

SEQ ID NO: 465856 - DNA, 16 bp, R. norvegicus
aacagtgccactccct

SEQ ID NO: 465857 - DNA, 16 bp, R. norvegicus
aacagtgtcaccaact

SEQ ID NO: 465858 - DNA, 16 bp, R. norvegicus
aacagtgtttctttgt

SEQ ID NO: 465859 - DNA, 17 bp, R. norvegicus
aacagttctctgcacca

SEQ ID NO: 465860 - DNA, 39 bp, R. norvegicus
aacagttctctgcacccaaatcccgtgggaaggagagct

SEQ ID NO: 465861 - DNA, 16 bp, R. norvegicus
aacagttgaaggaact

SEQ ID NO: 465862 - DNA, 16 bp, R. norvegicus
aacagttgacaaatgg

SEQ ID NO: 465863 - DNA, 16 bp, R. norvegicus
aacagtttttaaaaag

SEQ ID NO: 465864 - DNA, 16 bp, R. norvegicus
aacataaaaatcaatg

SEQ ID NO: 465865 - DNA, 16 bp, R. norvegicus
aacataaaactagaca

SEQ ID NO: 465866 - DNA, 16 bp, R. norvegicus
aacataaagaactata

SEQ ID NO: 465867 - DNA, 17 bp, R. norvegicus
aacataaccatggtaga

SEQ ID NO: 465868 - DNA, 16 bp, R. norvegicus
aacataatctcatctc

SEQ ID NO: 465869 - DNA, 16 bp, R. norvegicus
aacatacaaaggtaga

SEQ ID NO: 465870 - DNA, 17 bp, R. norvegicus
aacatacaacaaagaca

SEQ ID NO: 465871 - DNA, 17 bp, R. norvegicus
aacatacaacaaagtca

SEQ ID NO: 465872 - DNA, 16 bp, R. norvegicus
aacatacacagaaaca

SEQ ID NO: 465873 - DNA, 16 bp, R. norvegicus
aacatacaccagctga

SEQ ID NO: 465874 - DNA, 16 bp, R. norvegicus
aacatacagaacataa

SEQ ID NO: 465875 - DNA, 16 bp, R. norvegicus
aacatactaaaaatgg

SEQ ID NO: 465876 - DNA, 16 bp, R. norvegicus
aacatactggatatgt

SEQ ID NO: 465877 - DNA, 16 bp, R. norvegicus
aacatagactgaagac

SEQ ID NO: 465878 - DNA, 33 bp, R. norvegicus
aacatagtaaaagccatatacagcaaaccagtc

SEQ ID NO: 465879 - DNA, 16 bp, R. norvegicus
aacatagtgttttggg

SEQ ID NO: 465880 - DNA, 16 bp, R. norvegicus
aacatataaaaatgac

SEQ ID NO: 465881 - DNA, 16 bp, R. norvegicus
aacatatatatgtgtg

SEQ ID NO: 465882 - DNA, 16 bp, R. norvegicus
aacatatatcaaagac

SEQ ID NO: 465883 - DNA, 16 bp, R. norvegicus
aacatatccttagaag

SEQ ID NO: 465884 - DNA, 16 bp, R. norvegicus
aacatatgagcctata

SEQ ID NO: 465885 - DNA, 16 bp, R. norvegicus
aacatcaaattaaatg

SEQ ID NO: 465886 - DNA, 16 bp, R. norvegicus
aacatcaacacaactg

SEQ ID NO: 465887 - DNA, 16 bp, R. norvegicus
aacatcaacttctggc

SEQ ID NO: 465888 - DNA, 16 bp, R. norvegicus
aacatcacagaaagtt

SEQ ID NO: 465889 - DNA, 16 bp, R. norvegicus
aacatcacatgccctc

SEQ ID NO: 465890 - DNA, 16 bp, R. norvegicus
aacatcagaagctata

SEQ ID NO: 465891 - DNA, 16 bp, R. norvegicus
aacatcagcaacaaca

SEQ ID NO: 465892 - DNA, 16 bp, R. norvegicus
aacatcagcctccatt

SEQ ID NO: 465893 - DNA, 16 bp, R. norvegicus
aacatcatcaacagaa

SEQ ID NO: 465894 - DNA, 16 bp, R. norvegicus
aacatccacatagaag

SEQ ID NO: 465895 - DNA, 16 bp, R. norvegicus
aacatccaggcaggca

SEQ ID NO: 465896 - DNA, 16 bp, R. norvegicus
aacatccccaggcagc

SEQ ID NO: 465897 - DNA, 16 bp, R. norvegicus
aacatccctccacggc

SEQ ID NO: 465898 - DNA, 16 bp, R. norvegicus
aacatcctgctgacca

SEQ ID NO: 465899 - DNA, 16 bp, R. norvegicus
aacatctatgtcccaa

SEQ ID NO: 465900 - DNA, 16 bp, R. norvegicus
aacatctcagaagatg

SEQ ID NO: 465901 - DNA, 16 bp, R. norvegicus
aacatctcagaccaag

SEQ ID NO: 465902 - DNA, 16 bp, R. norvegicus
aacatctgtggccatg

SEQ ID NO: 465903 - DNA, 16 bp, R. norvegicus
aacatcttcagcaaag

SEQ ID NO: 465904 - DNA, 16 bp, R. norvegicus
aacatcttcagctcct

SEQ ID NO: 465905 - DNA, 16 bp, R. norvegicus
aacatctttaatcatc

SEQ ID NO: 465906 - DNA, 16 bp, R. norvegicus
aacatgacacctgcaa

SEQ ID NO: 465907 - DNA, 18 bp, R. norvegicus
aacatgactgttccagaa

SEQ ID NO: 465908 - DNA, 16 bp, R. norvegicus
aacatgaggaaatgta

SEQ ID NO: 465909 - DNA, 16 bp, R. norvegicus
aacatgatttttttct

SEQ ID NO: 465910 - DNA, 16 bp, R. norvegicus
aacatgcaaaggcaga

SEQ ID NO: 465911 - DNA, 16 bp, R. norvegicus
aacatgcccctccccc

SEQ ID NO: 465912 - DNA, 16 bp, R. norvegicus
aacatggaagacatgc

SEQ ID NO: 465913 - DNA, 16 bp, R. norvegicus
aacatggcagcacaca

SEQ ID NO: 465914 - DNA, 16 bp, R. norvegicus
aacatgggtcctggga

SEQ ID NO: 465915 - DNA, 16 bp, R. norvegicus
aacatggtggaaagag

SEQ ID NO: 465916 - DNA, 16 bp, R. norvegicus
aacatgtaaataaatg

SEQ ID NO: 465917 - DNA, 16 bp, R. norvegicus
aacatgtacaaatttt

SEQ ID NO: 465918 - DNA, 16 bp, R. norvegicus
aacatgtacacacaca

SEQ ID NO: 465919 - DNA, 16 bp, R. norvegicus
aacatgtttgagcaag

SEQ ID NO: 465920 - DNA, 16 bp, R. norvegicus
aacatgtttttggaaa

SEQ ID NO: 465921 - DNA, 16 bp, R. norvegicus
aacattaaagtaaatg

SEQ ID NO: 465922 - DNA, 17 bp, R. norvegicus
aacattcaggaaattca

SEQ ID NO: 465923 - DNA, 16 bp, R. norvegicus
aacattcatagaagac

SEQ ID NO: 465924 - DNA, 16 bp, R. norvegicus
aacattccattgtgta

SEQ ID NO: 465925 - DNA, 16 bp, R. norvegicus
aacattgatgaagcta

SEQ ID NO: 465926 - DNA, 16 bp, R. norvegicus
aacatttaaaaaggaa

SEQ ID NO: 465927 - DNA, 16 bp, R. norvegicus
aacatttatgctccaa

SEQ ID NO: 465928 - DNA, 16 bp, R. norvegicus
aacatttcaaaacaat

SEQ ID NO: 465929 - DNA, 16 bp, R. norvegicus
aacatttcattctcaa

SEQ ID NO: 465930 - DNA, 16 bp, R. norvegicus
aacatttcttttaaaa

SEQ ID NO: 465931 - DNA, 16 bp, R. norvegicus
aacatttgaaagtaaa

SEQ ID NO: 465932 - DNA, 16 bp, R. norvegicus
aacatttgaaatgtaa

SEQ ID NO: 465933 - DNA, 16 bp, R. norvegicus
aacatttgaaattcaa

SEQ ID NO: 465934 - DNA, 16 bp, R. norvegicus
aacattttaaatggaa

SEQ ID NO: 465935 - DNA, 16 bp, R. norvegicus
aacattttagtcataa

SEQ ID NO: 465936 - DNA, 16 bp, R. norvegicus
aacattttcagcaaag

SEQ ID NO: 465937 - DNA, 16 bp, R. norvegicus
aacattttcttctatg

SEQ ID NO: 465938 - DNA, 16 bp, R. norvegicus
aacatttttaaatgta

SEQ ID NO: 465939 - DNA, 16 bp, R. norvegicus
aacatttttgtgtttt

SEQ ID NO: 465940 - DNA, 16 bp, R. norvegicus
aacattttttgaaatt

SEQ ID NO: 465941 - DNA, 16 bp, R. norvegicus
aacatttttttaagtg

SEQ ID NO: 465942 - DNA, 16 bp, R. norvegicus
aaccaaaagtcatgaa

SEQ ID NO: 465943 - DNA, 16 bp, R. norvegicus
aaccaaacagctgaag

SEQ ID NO: 465944 - DNA, 16 bp, R. norvegicus
aaccaaacctggatcc

SEQ ID NO: 465945 - DNA, 16 bp, R. norvegicus
aaccaaagaagtgaaa

SEQ ID NO: 465946 - DNA, 16 bp, R. norvegicus
aaccaaagaatataca

SEQ ID NO: 465947 - DNA, 16 bp, R. norvegicus
aaccaaagaatggatt

SEQ ID NO: 465948 - DNA, 16 bp, R. norvegicus
aaccaaagagaatgaa

SEQ ID NO: 465949 - DNA, 16 bp, R. norvegicus
aaccaaagagagcaca

SEQ ID NO: 465950 - DNA, 16 bp, R. norvegicus
aaccaaagatgaggat

SEQ ID NO: 465951 - DNA, 16 bp, R. norvegicus
aaccaaagcaacattt

SEQ ID NO: 465952 - DNA, 16 bp, R. norvegicus
aaccaaagccaaagcc

SEQ ID NO: 465953 - DNA, 16 bp, R. norvegicus
aaccaaagctgcagga

SEQ ID NO: 465954 - DNA, 16 bp, R. norvegicus
aaccaaatcacagaaa

SEQ ID NO: 465955 - DNA, 16 bp, R. norvegicus
aaccaaatgataaaga

SEQ ID NO: 465956 - DNA, 35 bp, R. norvegicus
aaccaacatcgccggtgccgaggggacccttcagt

SEQ ID NO: 465957 - DNA, 16 bp, R. norvegicus
aaccaacatggttcca

SEQ ID NO: 465958 - DNA, 16 bp, R. norvegicus
aaccaaccaaaatgca

SEQ ID NO: 465959 - DNA, 16 bp, R. norvegicus
aaccaaccacagctcc

SEQ ID NO: 465960 - DNA, 16 bp, R. norvegicus
aaccaaccagaacctc

SEQ ID NO: 465961 - DNA, 16 bp, R. norvegicus
aaccaaccagaccctt

SEQ ID NO: 465962 - DNA, 16 bp, R. norvegicus
aaccaagaaagtgaaa

SEQ ID NO: 465963 - DNA, 16 bp, R. norvegicus
aaccaagaagggggat

SEQ ID NO: 465964 - DNA, 16 bp, R. norvegicus
aaccaagaataaccat

SEQ ID NO: 465965 - DNA, 16 bp, R. norvegicus
aaccaagagtcaggag

SEQ ID NO: 465966 - DNA, 17 bp, R. norvegicus
aaccaagcaagtaaaaa

SEQ ID NO: 465967 - DNA, 16 bp, R. norvegicus
aaccaaggcaacttat

SEQ ID NO: 465968 - DNA, 16 bp, R. norvegicus
aaccaagtaaaagatc

SEQ ID NO: 465969 - DNA, 16 bp, R. norvegicus
aaccaagtagaaaaga

SEQ ID NO: 465970 - DNA, 16 bp, R. norvegicus
aaccaatgaagagaag

SEQ ID NO: 465971 - DNA, 16 bp, R. norvegicus
aaccaatgagcagaag

SEQ ID NO: 465972 - DNA, 16 bp, R. norvegicus
aaccacacagagacac

SEQ ID NO: 465973 - DNA, 16 bp, R. norvegicus
aaccacagcagcaaca

SEQ ID NO: 465974 - DNA, 16 bp, R. norvegicus
aaccacagctgctgtg

SEQ ID NO: 465975 - DNA, 16 bp, R. norvegicus
aaccacaggagtcccc

SEQ ID NO: 465976 - DNA, 16 bp, R. norvegicus
aaccacagggtggttc

SEQ ID NO: 465977 - DNA, 16 bp, R. norvegicus
aaccacagttttccct

SEQ ID NO: 465978 - DNA, 77 bp, R. norvegicus
aaccacatgatcatttcattagacgctgagaaagcatttgacaaaattcaacaccccttcatgataaaagtcctgga

SEQ ID NO: 465979 - DNA, 101 bp, R. norvegicus
aaccacatgatcatttcattagatgctgagaaagcatttgacaaaattcaacaccccttcatgataaaagtcctggaaagaataggaattcaaggcccata

SEQ ID NO: 465980 - DNA, 16 bp, R. norvegicus
aaccacatggtggtca

SEQ ID NO: 465981 - DNA, 16 bp, R. norvegicus
aaccaccaactgaaga

SEQ ID NO: 465982 - DNA, 16 bp, R. norvegicus
aaccacccacagtggg

SEQ ID NO: 465983 - DNA, 16 bp, R. norvegicus
aaccacctaccaaaga

SEQ ID NO: 465984 - DNA, 17 bp, R. norvegicus
aaccacctcctggtttt

SEQ ID NO: 465985 - DNA, 16 bp, R. norvegicus
aaccacctgtaactcc

SEQ ID NO: 465986 - DNA, 16 bp, R. norvegicus
aaccacggagccacct

SEQ ID NO: 465987 - DNA, 16 bp, R. norvegicus
aaccactagccaaaga

SEQ ID NO: 465988 - DNA, 17 bp, R. norvegicus
aaccactctggaaatca

SEQ ID NO: 465989 - DNA, 16 bp, R. norvegicus
aaccactgacttagag

SEQ ID NO: 465990 - DNA, 16 bp, R. norvegicus
aaccactgagaaacag

SEQ ID NO: 465991 - DNA, 16 bp, R. norvegicus
aaccactgagcaatcc

SEQ ID NO: 465992 - DNA, 16 bp, R. norvegicus
aaccactgctctagag

SEQ ID NO: 465993 - DNA, 16 bp, R. norvegicus
aaccactgctttaagg

SEQ ID NO: 465994 - DNA, 16 bp, R. norvegicus
aaccagaaactggaag

SEQ ID NO: 465995 - DNA, 16 bp, R. norvegicus
aaccagaaatttccac

SEQ ID NO: 465996 - DNA, 16 bp, R. norvegicus
aaccagaacactctgt

SEQ ID NO: 465997 - DNA, 16 bp, R. norvegicus
aaccagaaccacatgg

SEQ ID NO: 465998 - DNA, 16 bp, R. norvegicus
aaccagaagagaaatt

SEQ ID NO: 465999 - DNA, 16 bp, R. norvegicus
aaccagaagaggctgc

SEQ ID NO: 466000 - DNA, 16 bp, R. norvegicus
aaccagaaggacctgc

SEQ ID NO: 466001 - DNA, 16 bp, R. norvegicus
aaccagaagtcacaga

SEQ ID NO: 466002 - DNA, 16 bp, R. norvegicus
aaccagacactccaga

SEQ ID NO: 466003 - DNA, 16 bp, R. norvegicus
aaccagacactctcaa

SEQ ID NO: 466004 - DNA, 16 bp, R. norvegicus
aaccagacagcccaga

SEQ ID NO: 466005 - DNA, 16 bp, R. norvegicus
aaccagaccctccaga

SEQ ID NO: 466006 - DNA, 16 bp, R. norvegicus
aaccagagaaagaact

SEQ ID NO: 466007 - DNA, 16 bp, R. norvegicus
aaccagagccatcttt

SEQ ID NO: 466008 - DNA, 16 bp, R. norvegicus
aaccagagctctcaga

SEQ ID NO: 466009 - DNA, 16 bp, R. norvegicus
aaccagagctttcaga

SEQ ID NO: 466010 - DNA, 16 bp, R. norvegicus
aaccagagttcccagg

SEQ ID NO: 466011 - DNA, 16 bp, R. norvegicus
aaccagatggtgaaag

SEQ ID NO: 466012 - DNA, 16 bp, R. norvegicus
aaccagatggtgttca

SEQ ID NO: 466013 - DNA, 16 bp, R. norvegicus
aaccagccagccagcc

SEQ ID NO: 466014 - DNA, 16 bp, R. norvegicus
aaccagccatgtggca

SEQ ID NO: 466015 - DNA, 17 bp, R. norvegicus
aaccagcctccaaatga

SEQ ID NO: 466016 - DNA, 16 bp, R. norvegicus
aaccagctgcagaaga

SEQ ID NO: 466017 - DNA, 16 bp, R. norvegicus
aaccagctggtttctg

SEQ ID NO: 466018 - DNA, 16 bp, R. norvegicus
aaccaggaaaagaaat

SEQ ID NO: 466019 - DNA, 16 bp, R. norvegicus
aaccaggaacagactg

SEQ ID NO: 466020 - DNA, 17 bp, R. norvegicus
aaccaggaagacctgta

SEQ ID NO: 466021 - DNA, 16 bp, R. norvegicus
aaccaggaagatctgt

SEQ ID NO: 466022 - DNA, 16 bp, R. norvegicus
aaccaggaagggaaat

SEQ ID NO: 466023 - DNA, 16 bp, R. norvegicus
aaccaggagagctgaa

SEQ ID NO: 466024 - DNA, 16 bp, R. norvegicus
aaccaggcagtcctct

SEQ ID NO: 466025 - DNA, 16 bp, R. norvegicus
aaccaggcatggtggc

SEQ ID NO: 466026 - DNA, 16 bp, R. norvegicus
aaccagggctcccagg

SEQ ID NO: 466027 - DNA, 16 bp, R. norvegicus
aaccaggtaactcaaa

SEQ ID NO: 466028 - DNA, 16 bp, R. norvegicus
aaccagtaccacctgg

SEQ ID NO: 466029 - DNA, 16 bp, R. norvegicus
aaccagtgctcccagg

SEQ ID NO: 466030 - DNA, 16 bp, R. norvegicus
aaccagttctcctgca

SEQ ID NO: 466031 - DNA, 16 bp, R. norvegicus
aaccagttgataagga

SEQ ID NO: 466032 - DNA, 16 bp, R. norvegicus
aaccagtttggaaatc

SEQ ID NO: 466033 - DNA, 16 bp, R. norvegicus
aaccataaaattattt

SEQ ID NO: 466034 - DNA, 16 bp, R. norvegicus
aaccatcaaagataac

SEQ ID NO: 466035 - DNA, 16 bp, R. norvegicus
aaccatcaccaacaga

SEQ ID NO: 466036 - DNA, 16 bp, R. norvegicus
aaccatctacaactcc

SEQ ID NO: 466037 - DNA, 16 bp, R. norvegicus
aaccatctcaccagcc

SEQ ID NO: 466038 - DNA, 16 bp, R. norvegicus
aaccatctctccagtc

SEQ ID NO: 466039 - DNA, 16 bp, R. norvegicus
aaccatctcttcagtc

SEQ ID NO: 466040 - DNA, 16 bp, R. norvegicus
aaccatctgcaactct

SEQ ID NO: 466041 - DNA, 16 bp, R. norvegicus
aaccatctgtacctcc

SEQ ID NO: 466042 - DNA, 16 bp, R. norvegicus
aaccatcttatctagt

SEQ ID NO: 466043 - DNA, 16 bp, R. norvegicus
aaccatgagccaaagt

SEQ ID NO: 466044 - DNA, 16 bp, R. norvegicus
aaccatggaggagtgt

SEQ ID NO: 466045 - DNA, 16 bp, R. norvegicus
aaccattcagtggaaa

SEQ ID NO: 466046 - DNA, 25 bp, R. norvegicus
aaccattctggaaatcagtctggag

SEQ ID NO: 466047 - DNA, 16 bp, R. norvegicus
aacccaaacactattg

SEQ ID NO: 466048 - DNA, 16 bp, R. norvegicus
aacccaataacctctg

SEQ ID NO: 466049 - DNA, 16 bp, R. norvegicus
aacccaatcagagaaa

SEQ ID NO: 466050 - DNA, 16 bp, R. norvegicus
aacccacagactgaga

SEQ ID NO: 466051 - DNA, 16 bp, R. norvegicus
aacccagaaagataaa

SEQ ID NO: 466052 - DNA, 16 bp, R. norvegicus
aacccagaaccacaga

SEQ ID NO: 466053 - DNA, 16 bp, R. norvegicus
aacccagaagccttat

SEQ ID NO: 466054 - DNA, 16 bp, R. norvegicus
aacccagaattgttct

SEQ ID NO: 466055 - DNA, 16 bp, R. norvegicus
aacccagacacctatg

SEQ ID NO: 466056 - DNA, 17 bp, R. norvegicus
aacccagacactattga

SEQ ID NO: 466057 - DNA, 16 bp, R. norvegicus
aacccagacctggaaa

SEQ ID NO: 466058 - DNA, 16 bp, R. norvegicus
aacccagagcacagag

SEQ ID NO: 466059 - DNA, 16 bp, R. norvegicus
aacccagagccttgtg

SEQ ID NO: 466060 - DNA, 16 bp, R. norvegicus
aacccagagctcacca

SEQ ID NO: 466061 - DNA, 17 bp, R. norvegicus
aacccagatagttttcc

SEQ ID NO: 466062 - DNA, 16 bp, R. norvegicus
aacccagatgccccac

SEQ ID NO: 466063 - DNA, 16 bp, R. norvegicus
aacccagcatttggga

SEQ ID NO: 466064 - DNA, 16 bp, R. norvegicus
aacccaggaaagcaaa

SEQ ID NO: 466065 - DNA, 16 bp, R. norvegicus
aacccaggactgccag

SEQ ID NO: 466066 - DNA, 16 bp, R. norvegicus
aacccaggaggaggaa

SEQ ID NO: 466067 - DNA, 16 bp, R. norvegicus
aacccagggagtggca

SEQ ID NO: 466068 - DNA, 16 bp, R. norvegicus
aacccagggccagatg

SEQ ID NO: 466069 - DNA, 19 bp, R. norvegicus
aacccagggccttgagctt

SEQ ID NO: 466070 - DNA, 19 bp, R. norvegicus
aacccagggccttgcgctt

SEQ ID NO: 466071 - DNA, 24 bp, R. norvegicus
aacccagggccttgcgcttgctag

SEQ ID NO: 466072 - DNA, 17 bp, R. norvegicus
aacccagggccttgcgt

SEQ ID NO: 466073 - DNA, 19 bp, R. norvegicus
aacccagggccttgtgctt

SEQ ID NO: 466074 - DNA, 16 bp, R. norvegicus
aacccagggctccaac

SEQ ID NO: 466075 - DNA, 16 bp, R. norvegicus
aacccagggcttcttg

SEQ ID NO: 466076 - DNA, 16 bp, R. norvegicus
aacccagtcagcttga

SEQ ID NO: 466077 - DNA, 16 bp, R. norvegicus
aacccagtcccagaaa

SEQ ID NO: 466078 - DNA, 16 bp, R. norvegicus
aacccatccctgcatg

SEQ ID NO: 466079 - DNA, 16 bp, R. norvegicus
aacccatctggacctt

SEQ ID NO: 466080 - DNA, 16 bp, R. norvegicus
aacccatggctccagc

SEQ ID NO: 466081 - DNA, 16 bp, R. norvegicus
aacccattcctcccca

SEQ ID NO: 466082 - DNA, 16 bp, R. norvegicus
aaccccacaaacagtg

SEQ ID NO: 466083 - DNA, 16 bp, R. norvegicus
aaccccaccagcaatg

SEQ ID NO: 466084 - DNA, 16 bp, R. norvegicus
aaccccagaaaacagc

SEQ ID NO: 466085 - DNA, 16 bp, R. norvegicus
aaccccagagctccca

SEQ ID NO: 466086 - DNA, 16 bp, R. norvegicus
aaccccagccctcagg

SEQ ID NO: 466087 - DNA, 16 bp, R. norvegicus
aaccccagctccagga

SEQ ID NO: 466088 - DNA, 16 bp, R. norvegicus
aaccccagctctggga

SEQ ID NO: 466089 - DNA, 16 bp, R. norvegicus
aaccccagtgctgggg

SEQ ID NO: 466090 - DNA, 16 bp, R. norvegicus
aaccccagttctaggg

SEQ ID NO: 466091 - DNA, 16 bp, R. norvegicus
aacccccacagtgaca

SEQ ID NO: 466092 - DNA, 16 bp, R. norvegicus
aaccccctataccatc

SEQ ID NO: 466093 - DNA, 16 bp, R. norvegicus
aacccctctggacctg

SEQ ID NO: 466094 - DNA, 16 bp, R. norvegicus
aacccctgtggttgaa

SEQ ID NO: 466095 - DNA, 16 bp, R. norvegicus
aacccctttcctggtt

SEQ ID NO: 466096 - DNA, 16 bp, R. norvegicus
aacccctttcttgtat

SEQ ID NO: 466097 - DNA, 16 bp, R. norvegicus
aacccgggaccaccag

SEQ ID NO: 466098 - DNA, 16 bp, R. norvegicus
aacccggggccttgtg

SEQ ID NO: 466099 - DNA, 16 bp, R. norvegicus
aaccctaactaagaca

SEQ ID NO: 466100 - DNA, 16 bp, R. norvegicus
aaccctatgaatgtaa

SEQ ID NO: 466101 - DNA, 16 bp, R. norvegicus
aaccctcatatcaagg

SEQ ID NO: 466102 - DNA, 16 bp, R. norvegicus
aaccctgagaatccac

SEQ ID NO: 466103 - DNA, 16 bp, R. norvegicus
aaccctggaacccaca

SEQ ID NO: 466104 - DNA, 16 bp, R. norvegicus
aaccctggctatcctg

SEQ ID NO: 466105 - DNA, 16 bp, R. norvegicus
aaccctggctcaaaaa

SEQ ID NO: 466106 - DNA, 16 bp, R. norvegicus
aaccctggctttcctg

SEQ ID NO: 466107 - DNA, 16 bp, R. norvegicus
aaccctgggctggaga

SEQ ID NO: 466108 - DNA, 16 bp, R. norvegicus
aaccctgggctggtgg

SEQ ID NO: 466109 - DNA, 16 bp, R. norvegicus
aaccctgtctcaaaaa

SEQ ID NO: 466110 - DNA, 16 bp, R. norvegicus
aaccctgtggatgatc

SEQ ID NO: 466111 - DNA, 16 bp, R. norvegicus
aaccctgttttgaaaa

SEQ ID NO: 466112 - DNA, 16 bp, R. norvegicus
aacccttaaatttcca

SEQ ID NO: 466113 - DNA, 16 bp, R. norvegicus
aacccttcaactcctt

SEQ ID NO: 466114 - DNA, 16 bp, R. norvegicus
aaccctttcacagggt

SEQ ID NO: 466115 - DNA, 16 bp, R. norvegicus
aaccctttcatcccca

SEQ ID NO: 466116 - DNA, 16 bp, R. norvegicus
aaccctttcctcccaa

SEQ ID NO: 466117 - DNA, 16 bp, R. norvegicus
aaccctttcctctaca

SEQ ID NO: 466118 - DNA, 16 bp, R. norvegicus
aaccctttccttccca

SEQ ID NO: 466119 - DNA, 16 bp, R. norvegicus
aaccctttccttccct

SEQ ID NO: 466120 - DNA, 16 bp, R. norvegicus
aaccctttgatctaca

SEQ ID NO: 466121 - DNA, 16 bp, R. norvegicus
aaccctttttaaaaaa

SEQ ID NO: 466122 - DNA, 16 bp, R. norvegicus
aacctaaagttatcaa

SEQ ID NO: 466123 - DNA, 17 bp, R. norvegicus
aacctaagcaacagaaa

SEQ ID NO: 466124 - DNA, 16 bp, R. norvegicus
aacctaagcataatag

SEQ ID NO: 466125 - DNA, 39 bp, R. norvegicus
aacctaaggataataggtatagaagagagtgaagactca

SEQ ID NO: 466126 - DNA, 16 bp, R. norvegicus
aacctagagctcactg

SEQ ID NO: 466127 - DNA, 16 bp, R. norvegicus
aacctagaggcagaaa

SEQ ID NO: 466128 - DNA, 16 bp, R. norvegicus
aacctaggaaagagat

SEQ ID NO: 466129 - DNA, 16 bp, R. norvegicus
aacctagggaagagaa

SEQ ID NO: 466130 - DNA, 16 bp, R. norvegicus
aacctatagagaggaa

SEQ ID NO: 466131 - DNA, 16 bp, R. norvegicus
aacctcactcaggatg

SEQ ID NO: 466132 - DNA, 16 bp, R. norvegicus
aacctcagagatctgc

SEQ ID NO: 466133 - DNA, 16 bp, R. norvegicus
aacctcatgatcattt

SEQ ID NO: 466134 - DNA, 16 bp, R. norvegicus
aacctctcaggagaca

SEQ ID NO: 466135 - DNA, 16 bp, R. norvegicus
aacctctgaacccata

SEQ ID NO: 466136 - DNA, 17 bp, R. norvegicus
aacctctgaacctgtaa

SEQ ID NO: 466137 - DNA, 16 bp, R. norvegicus
aacctctgaactgtaa

SEQ ID NO: 466138 - DNA, 16 bp, R. norvegicus
aacctctgacctctac

SEQ ID NO: 466139 - DNA, 16 bp, R. norvegicus
aacctctggcttctac

SEQ ID NO: 466140 - DNA, 16 bp, R. norvegicus
aacctctgtctgtctt

SEQ ID NO: 466141 - DNA, 16 bp, R. norvegicus
aacctctttggcaaat

SEQ ID NO: 466142 - DNA, 16 bp, R. norvegicus
aacctgaaagaaacag

SEQ ID NO: 466143 - DNA, 17 bp, R. norvegicus
aacctgaaagaaacaga

SEQ ID NO: 466144 - DNA, 16 bp, R. norvegicus
aacctgaaaggacaga

SEQ ID NO: 466145 - DNA, 16 bp, R. norvegicus
aacctgaagaaagaga

SEQ ID NO: 466146 - DNA, 16 bp, R. norvegicus
aacctgaagaagccac

SEQ ID NO: 466147 - DNA, 16 bp, R. norvegicus
aacctgaagagaacac

SEQ ID NO: 466148 - DNA, 16 bp, R. norvegicus
aacctgaagcaatccc

SEQ ID NO: 466149 - DNA, 16 bp, R. norvegicus
aacctgaagctcacca

SEQ ID NO: 466150 - DNA, 16 bp, R. norvegicus
aacctgaagggtcctg

SEQ ID NO: 466151 - DNA, 16 bp, R. norvegicus
aacctgaagtaaatga

SEQ ID NO: 466152 - DNA, 16 bp, R. norvegicus
aacctgacactgttgc

SEQ ID NO: 466153 - DNA, 16 bp, R. norvegicus
aacctgagttcaagcc

SEQ ID NO: 466154 - DNA, 16 bp, R. norvegicus
aacctgagtttggtcc

SEQ ID NO: 466155 - DNA, 16 bp, R. norvegicus
aacctgataaacactt

SEQ ID NO: 466156 - DNA, 16 bp, R. norvegicus
aacctgatagaaaaga

SEQ ID NO: 466157 - DNA, 16 bp, R. norvegicus
aacctgatgaacaact

SEQ ID NO: 466158 - DNA, 16 bp, R. norvegicus
aacctgcctggtggac

SEQ ID NO: 466159 - DNA, 16 bp, R. norvegicus
aacctgcttcagcctc

SEQ ID NO: 466160 - DNA, 16 bp, R. norvegicus
aacctggaaaggagat

SEQ ID NO: 466161 - DNA, 16 bp, R. norvegicus
aacctggaagaagctg

SEQ ID NO: 466162 - DNA, 16 bp, R. norvegicus
aacctggaattataag

SEQ ID NO: 466163 - DNA, 16 bp, R. norvegicus
aacctggagctggttc

SEQ ID NO: 466164 - DNA, 16 bp, R. norvegicus
aacctggaggcaggaa

SEQ ID NO: 466165 - DNA, 16 bp, R. norvegicus
aacctggaggccaggt

SEQ ID NO: 466166 - DNA, 16 bp, R. norvegicus
aacctggaggtgcaga

SEQ ID NO: 466167 - DNA, 16 bp, R. norvegicus
aacctgggaaggacca

SEQ ID NO: 466168 - DNA, 16 bp, R. norvegicus
aacctgggcccatgga

SEQ ID NO: 466169 - DNA, 16 bp, R. norvegicus
aacctgggctggcact

SEQ ID NO: 466170 - DNA, 16 bp, R. norvegicus
aacctggggagaaaag

SEQ ID NO: 466171 - DNA, 16 bp, R. norvegicus
aacctggggcctctgg

SEQ ID NO: 466172 - DNA, 16 bp, R. norvegicus
aacctgggggtgcagg

SEQ ID NO: 466173 - DNA, 16 bp, R. norvegicus
aacctgggtttgatcc

SEQ ID NO: 466174 - DNA, 16 bp, R. norvegicus
aacctggttcctctgg

SEQ ID NO: 466175 - DNA, 16 bp, R. norvegicus
aacctgtacagaccat

SEQ ID NO: 466176 - DNA, 16 bp, R. norvegicus
aacctgtgaactgtaa

SEQ ID NO: 466177 - DNA, 16 bp, R. norvegicus
aacctgtgtcttctgg

SEQ ID NO: 466178 - DNA, 16 bp, R. norvegicus
aaccttaattaagaaa

SEQ ID NO: 466179 - DNA, 20 bp, R. norvegicus
aaccttcagagaggcagaca

SEQ ID NO: 466180 - DNA, 20 bp, R. norvegicus
aaccttcagagaggcggaca

SEQ ID NO: 466181 - DNA, 16 bp, R. norvegicus
aaccttcatgtgtcat

SEQ ID NO: 466182 - DNA, 16 bp, R. norvegicus
aaccttcccaggacca

SEQ ID NO: 466183 - DNA, 16 bp, R. norvegicus
aaccttcctggtgctg

SEQ ID NO: 466184 - DNA, 16 bp, R. norvegicus
aaccttgaactcagag

SEQ ID NO: 466185 - DNA, 16 bp, R. norvegicus
aaccttgccttgaaaa

SEQ ID NO: 466186 - DNA, 16 bp, R. norvegicus
aaccttggcaggacaa

SEQ ID NO: 466187 - DNA, 16 bp, R. norvegicus
aaccttggcaggacca

SEQ ID NO: 466188 - DNA, 16 bp, R. norvegicus
aaccttgtcaaggaag

SEQ ID NO: 466189 - DNA, 16 bp, R. norvegicus
aaccttttcttcccca

SEQ ID NO: 466190 - DNA, 16 bp, R. norvegicus
aacgaactgaaacagt

SEQ ID NO: 466191 - DNA, 16 bp, R. norvegicus
aacgaagagaatttgc

SEQ ID NO: 466192 - DNA, 16 bp, R. norvegicus
aacgacacggagccca

SEQ ID NO: 466193 - DNA, 17 bp, R. norvegicus
aacgactgaactgagaa

SEQ ID NO: 466194 - DNA, 17 bp, R. norvegicus
aacgagaggacacaaag

SEQ ID NO: 466195 - DNA, 16 bp, R. norvegicus
aacgctgcccactctc

SEQ ID NO: 466196 - DNA, 16 bp, R. norvegicus
aacggaggaggcagag

SEQ ID NO: 466197 - DNA, 16 bp, R. norvegicus
aacgtcaatggcctca

SEQ ID NO: 466198 - DNA, 16 bp, R. norvegicus
aacgtgggctccacag

SEQ ID NO: 466199 - DNA, 16 bp, R. norvegicus
aactaaaagcacaaat

SEQ ID NO: 466200 - DNA, 16 bp, R. norvegicus
aactaaaagtcatcca

SEQ ID NO: 466201 - DNA, 16 bp, R. norvegicus
aactaaaccactaccc

SEQ ID NO: 466202 - DNA, 16 bp, R. norvegicus
aactaaatggagaaaa

SEQ ID NO: 466203 - DNA, 16 bp, R. norvegicus
aactaacaaaatcaga

SEQ ID NO: 466204 - DNA, 16 bp, R. norvegicus
aactaagaaaatgcct

SEQ ID NO: 466205 - DNA, 16 bp, R. norvegicus
aactaagcaggactca

SEQ ID NO: 466206 - DNA, 16 bp, R. norvegicus
aactaaggctggtctt

SEQ ID NO: 466207 - DNA, 16 bp, R. norvegicus
aactaagtggaaagaa

SEQ ID NO: 466208 - DNA, 16 bp, R. norvegicus
aactaatagaggagaa

SEQ ID NO: 466209 - DNA, 19 bp, R. norvegicus
aactaatcgtcttggcaac

SEQ ID NO: 466210 - DNA, 16 bp, R. norvegicus
aactaatggaagagaa

SEQ ID NO: 466211 - DNA, 16 bp, R. norvegicus
aactacaaaccaaaga

SEQ ID NO: 466212 - DNA, 16 bp, R. norvegicus
aactacaatccagaag

SEQ ID NO: 466213 - DNA, 16 bp, R. norvegicus
aactacaatccagaat

SEQ ID NO: 466214 - DNA, 16 bp, R. norvegicus
aactacagatccagag

SEQ ID NO: 466215 - DNA, 16 bp, R. norvegicus
aactacagttccaggg

SEQ ID NO: 466216 - DNA, 16 bp, R. norvegicus
aactacatgaagctca

SEQ ID NO: 466217 - DNA, 16 bp, R. norvegicus
aactacatgatcattt

SEQ ID NO: 466218 - DNA, 16 bp, R. norvegicus
aactaccacccaaaga

SEQ ID NO: 466219 - DNA, 16 bp, R. norvegicus
aactaccatcccaaga

SEQ ID NO: 466220 - DNA, 25 bp, R. norvegicus
aactactccagaaagttcacccact

SEQ ID NO: 466221 - DNA, 16 bp, R. norvegicus
aactacttcctgctga

SEQ ID NO: 466222 - DNA, 16 bp, R. norvegicus
aactagaaaatatcct

SEQ ID NO: 466223 - DNA, 16 bp, R. norvegicus
aactagaattacagat

SEQ ID NO: 466224 - DNA, 16 bp, R. norvegicus
aactagataagattgt

SEQ ID NO: 466225 - DNA, 16 bp, R. norvegicus
aactaggtgtcctcca

SEQ ID NO: 466226 - DNA, 16 bp, R. norvegicus
aactataattctgcta

SEQ ID NO: 466227 - DNA, 16 bp, R. norvegicus
aactatacaaaacagt

SEQ ID NO: 466228 - DNA, 16 bp, R. norvegicus
aactatatgaagaatt

SEQ ID NO: 466229 - DNA, 16 bp, R. norvegicus
aactatccaagaaaaa

SEQ ID NO: 466230 - DNA, 16 bp, R. norvegicus
aactatgaaggtcaga

SEQ ID NO: 466231 - DNA, 16 bp, R. norvegicus
aactatgaccccggag

SEQ ID NO: 466232 - DNA, 16 bp, R. norvegicus
aactatgtccaatttt

SEQ ID NO: 466233 - DNA, 16 bp, R. norvegicus
aactatgtgtttccca

SEQ ID NO: 466234 - DNA, 16 bp, R. norvegicus
aactattttaaaagaa

SEQ ID NO: 466235 - DNA, 16 bp, R. norvegicus
aactcaaaacatccag

SEQ ID NO: 466236 - DNA, 16 bp, R. norvegicus
aactcaaacaggacag

SEQ ID NO: 466237 - DNA, 16 bp, R. norvegicus
aactcaaagaaaaacc

SEQ ID NO: 466238 - DNA, 16 bp, R. norvegicus
aactcaaagaaaaatt

SEQ ID NO: 466239 - DNA, 16 bp, R. norvegicus
aactcaaatcttcata

SEQ ID NO: 466240 - DNA, 16 bp, R. norvegicus
aactcaagaagaagga

SEQ ID NO: 466241 - DNA, 16 bp, R. norvegicus
aactcaagaaggatca

SEQ ID NO: 466242 - DNA, 16 bp, R. norvegicus
aactcaagatgttaga

SEQ ID NO: 466243 - DNA, 16 bp, R. norvegicus
aactcaagcaaggcag

SEQ ID NO: 466244 - DNA, 16 bp, R. norvegicus
aactcaagcaggagct

SEQ ID NO: 466245 - DNA, 16 bp, R. norvegicus
aactcacagagagcct

SEQ ID NO: 466246 - DNA, 16 bp, R. norvegicus
aactcacagagatcct

SEQ ID NO: 466247 - DNA, 16 bp, R. norvegicus
aactcacagagatctg

SEQ ID NO: 466248 - DNA, 16 bp, R. norvegicus
aactcactatgcagac

SEQ ID NO: 466249 - DNA, 16 bp, R. norvegicus
aactcactctgtagaa

SEQ ID NO: 466250 - DNA, 16 bp, R. norvegicus
aactcactgtagacca

SEQ ID NO: 466251 - DNA, 16 bp, R. norvegicus
aactcactgtgcagac

SEQ ID NO: 466252 - DNA, 16 bp, R. norvegicus
aactcactttgtagaa

SEQ ID NO: 466253 - DNA, 16 bp, R. norvegicus
aactcagaacctcagg

SEQ ID NO: 466254 - DNA, 16 bp, R. norvegicus
aactcagaagacaagg

SEQ ID NO: 466255 - DNA, 16 bp, R. norvegicus
aactcagaaggaaaaa

SEQ ID NO: 466256 - DNA, 16 bp, R. norvegicus
aactcagagatcttca

SEQ ID NO: 466257 - DNA, 16 bp, R. norvegicus
aactcagagatttacc

SEQ ID NO: 466258 - DNA, 18 bp, R. norvegicus
aactcagagctgaaatta

SEQ ID NO: 466259 - DNA, 16 bp, R. norvegicus
aactcaggaactctgg

SEQ ID NO: 466260 - DNA, 16 bp, R. norvegicus
aactcaggaccctgga

SEQ ID NO: 466261 - DNA, 16 bp, R. norvegicus
aactcagggccttgca

SEQ ID NO: 466262 - DNA, 16 bp, R. norvegicus
aactcagggctgatat

SEQ ID NO: 466263 - DNA, 16 bp, R. norvegicus
aactcaggtcctcaag

SEQ ID NO: 466264 - DNA, 16 bp, R. norvegicus
aactcaggtgaccaca

SEQ ID NO: 466265 - DNA, 16 bp, R. norvegicus
aactcaggttaccagg

SEQ ID NO: 466266 - DNA, 16 bp, R. norvegicus
aactcaggttctcatg

SEQ ID NO: 466267 - DNA, 16 bp, R. norvegicus
aactcaggtttccagg

SEQ ID NO: 466268 - DNA, 16 bp, R. norvegicus
aactcagtcacagaaa

SEQ ID NO: 466269 - DNA, 16 bp, R. norvegicus
aactcagtggtagagc

SEQ ID NO: 466270 - DNA, 16 bp, R. norvegicus
aactcatgaaactgaa

SEQ ID NO: 466271 - DNA, 16 bp, R. norvegicus
aactcattctctctct

SEQ ID NO: 466272 - DNA, 16 bp, R. norvegicus
aactcattgtcacagg

SEQ ID NO: 466273 - DNA, 16 bp, R. norvegicus
aactccaaactctgaa

SEQ ID NO: 466274 - DNA, 16 bp, R. norvegicus
aactccaactccagag

SEQ ID NO: 466275 - DNA, 16 bp, R. norvegicus
aactccaactccagga

SEQ ID NO: 466276 - DNA, 16 bp, R. norvegicus
aactccaagacaatga

SEQ ID NO: 466277 - DNA, 16 bp, R. norvegicus
aactccagaagagaaa

SEQ ID NO: 466278 - DNA, 17 bp, R. norvegicus
aactccagacactgcag

SEQ ID NO: 466279 - DNA, 16 bp, R. norvegicus
aactccagctccagca

SEQ ID NO: 466280 - DNA, 16 bp, R. norvegicus
aactccagctcctggg

SEQ ID NO: 466281 - DNA, 16 bp, R. norvegicus
aactccagctctgagg

SEQ ID NO: 466282 - DNA, 16 bp, R. norvegicus
aactccagtgtcaggg

SEQ ID NO: 466283 - DNA, 16 bp, R. norvegicus
aactccagttccagga

SEQ ID NO: 466284 - DNA, 16 bp, R. norvegicus
aactccagtttcaaag

SEQ ID NO: 466285 - DNA, 16 bp, R. norvegicus
aactcccaactacctg

SEQ ID NO: 466286 - DNA, 16 bp, R. norvegicus
aactcccagctccttc

SEQ ID NO: 466287 - DNA, 16 bp, R. norvegicus
aactccccttcccatg

SEQ ID NO: 466288 - DNA, 16 bp, R. norvegicus
aactccctgtgtagcc

SEQ ID NO: 466289 - DNA, 16 bp, R. norvegicus
aactcccttaaagaaa

SEQ ID NO: 466290 - DNA, 16 bp, R. norvegicus
aactcctaaggaaaga

SEQ ID NO: 466291 - DNA, 16 bp, R. norvegicus
aactcctcaggaaata

SEQ ID NO: 466292 - DNA, 16 bp, R. norvegicus
aactcctgacacacag

SEQ ID NO: 466293 - DNA, 16 bp, R. norvegicus
aactcctgatcttcct

SEQ ID NO: 466294 - DNA, 16 bp, R. norvegicus
aactccttccagatcc

SEQ ID NO: 466295 - DNA, 65 bp, R. norvegicus
aactctaccagtacatcagagagtcagggcacatagaggaggatgaggcccggcaaatatttgaa

SEQ ID NO: 466296 - DNA, 16 bp, R. norvegicus
aactctagatccaggg

SEQ ID NO: 466297 - DNA, 16 bp, R. norvegicus
aactctatgaagaatg

SEQ ID NO: 466298 - DNA, 16 bp, R. norvegicus
aactctatgaggaatt

SEQ ID NO: 466299 - DNA, 16 bp, R. norvegicus
aactctcaacttcata

SEQ ID NO: 466300 - DNA, 16 bp, R. norvegicus
aactctcaagagactg

SEQ ID NO: 466301 - DNA, 16 bp, R. norvegicus
aactctcatttctgaa

SEQ ID NO: 466302 - DNA, 16 bp, R. norvegicus
aactctctctgtgtgt

SEQ ID NO: 466303 - DNA, 16 bp, R. norvegicus
aactctctgtccccca

SEQ ID NO: 466304 - DNA, 16 bp, R. norvegicus
aactctgagatccacc

SEQ ID NO: 466305 - DNA, 16 bp, R. norvegicus
aactctgcctgcttct

SEQ ID NO: 466306 - DNA, 16 bp, R. norvegicus
aactctgggaaagagt

SEQ ID NO: 466307 - DNA, 16 bp, R. norvegicus
aactctgggctcctcc

SEQ ID NO: 466308 - DNA, 16 bp, R. norvegicus
aactctggggagtctg

SEQ ID NO: 466309 - DNA, 16 bp, R. norvegicus
aactcttaaaaggaaa

SEQ ID NO: 466310 - DNA, 16 bp, R. norvegicus
aactcttaaaatattt

SEQ ID NO: 466311 - DNA, 16 bp, R. norvegicus
aactcttataaaagga

SEQ ID NO: 466312 - DNA, 16 bp, R. norvegicus
aactcttataaagaaa

SEQ ID NO: 466313 - DNA, 16 bp, R. norvegicus
aactcttcagacaagg

SEQ ID NO: 466314 - DNA, 16 bp, R. norvegicus
aactcttcagctcctt

SEQ ID NO: 466315 - DNA, 16 bp, R. norvegicus
aactcttccattggga

SEQ ID NO: 466316 - DNA, 16 bp, R. norvegicus
aactcttccattgggg

SEQ ID NO: 466317 - DNA, 16 bp, R. norvegicus
aactcttctttgaaaa

SEQ ID NO: 466318 - DNA, 16 bp, R. norvegicus
aactctttgatgaatt

SEQ ID NO: 466319 - DNA, 16 bp, R. norvegicus
aactgaaaaatctaaa

SEQ ID NO: 466320 - DNA, 16 bp, R. norvegicus
aactgaaaagggagac

SEQ ID NO: 466321 - DNA, 16 bp, R. norvegicus
aactgaaacaacagaa

SEQ ID NO: 466322 - DNA, 16 bp, R. norvegicus
aactgaaagaacaaga

SEQ ID NO: 466323 - DNA, 17 bp, R. norvegicus
aactgaaagaacagaat

SEQ ID NO: 466324 - DNA, 16 bp, R. norvegicus
aactgaaagaactaaa

SEQ ID NO: 466325 - DNA, 16 bp, R. norvegicus
aactgaaagaagccag

SEQ ID NO: 466326 - DNA, 16 bp, R. norvegicus
aactgaaagagaaaga

SEQ ID NO: 466327 - DNA, 16 bp, R. norvegicus
aactgaacagagaaat

SEQ ID NO: 466328 - DNA, 16 bp, R. norvegicus
aactgaacccagacct

SEQ ID NO: 466329 - DNA, 16 bp, R. norvegicus
aactgaactccagtct

SEQ ID NO: 466330 - DNA, 16 bp, R. norvegicus
aactgaacttctgaac

SEQ ID NO: 466331 - DNA, 16 bp, R. norvegicus
aactgaacttgagtcc

SEQ ID NO: 466332 - DNA, 16 bp, R. norvegicus
aactgaagaaattaaa

SEQ ID NO: 466333 - DNA, 16 bp, R. norvegicus
aactgaagaaccagaa

SEQ ID NO: 466334 - DNA, 16 bp, R. norvegicus
aactgaagaatactga

SEQ ID NO: 466335 - DNA, 16 bp, R. norvegicus
aactgaagacacaggc

SEQ ID NO: 466336 - DNA, 16 bp, R. norvegicus
aactgaagagaataaa

SEQ ID NO: 466337 - DNA, 16 bp, R. norvegicus
aactgaagatggaaaa

SEQ ID NO: 466338 - DNA, 16 bp, R. norvegicus
aactgaaggagctaaa

SEQ ID NO: 466339 - DNA, 16 bp, R. norvegicus
aactgaaggggtttgc

SEQ ID NO: 466340 - DNA, 16 bp, R. norvegicus
aactgacagacagaca

SEQ ID NO: 466341 - DNA, 16 bp, R. norvegicus
aactgaccctgtgaca

SEQ ID NO: 466342 - DNA, 16 bp, R. norvegicus
aactgactttccctct

SEQ ID NO: 466343 - DNA, 16 bp, R. norvegicus
aactgagaaaatgcct

SEQ ID NO: 466344 - DNA, 16 bp, R. norvegicus
aactgagaatgaggtc

SEQ ID NO: 466345 - DNA, 16 bp, R. norvegicus
aactgagacagaagga

SEQ ID NO: 466346 - DNA, 16 bp, R. norvegicus
aactgagactgaagga

SEQ ID NO: 466347 - DNA, 16 bp, R. norvegicus
aactgagagttttgca

SEQ ID NO: 466348 - DNA, 16 bp, R. norvegicus
aactgaggaaattcaa

SEQ ID NO: 466349 - DNA, 16 bp, R. norvegicus
aactgaggcaggaggg

SEQ ID NO: 466350 - DNA, 16 bp, R. norvegicus
aactgaggcatcctca

SEQ ID NO: 466351 - DNA, 16 bp, R. norvegicus
aactgaggctgaagga

SEQ ID NO: 466352 - DNA, 16 bp, R. norvegicus
aactgatgcagaagcc

SEQ ID NO: 466353 - DNA, 16 bp, R. norvegicus
aactgatgctgggaga

SEQ ID NO: 466354 - DNA, 16 bp, R. norvegicus
aactgatgctggtgag

SEQ ID NO: 466355 - DNA, 16 bp, R. norvegicus
aactgatggaagcaga

SEQ ID NO: 466356 - DNA, 16 bp, R. norvegicus
aactgcaaagcttcta

SEQ ID NO: 466357 - DNA, 16 bp, R. norvegicus
aactgcaaaggttctg

SEQ ID NO: 466358 - DNA, 16 bp, R. norvegicus
aactgcaaatgtagca

SEQ ID NO: 466359 - DNA, 16 bp, R. norvegicus
aactgcaagagtggct

SEQ ID NO: 466360 - DNA, 16 bp, R. norvegicus
aactgcagcagcagca

SEQ ID NO: 466361 - DNA, 16 bp, R. norvegicus
aactgcagctccagga

SEQ ID NO: 466362 - DNA, 16 bp, R. norvegicus
aactgcaggatctcca

SEQ ID NO: 466363 - DNA, 16 bp, R. norvegicus
aactgcagggaaaaaa

SEQ ID NO: 466364 - DNA, 16 bp, R. norvegicus
aactgcaggtcaacat

SEQ ID NO: 466365 - DNA, 16 bp, R. norvegicus
aactgcataggtagca

SEQ ID NO: 466366 - DNA, 16 bp, R. norvegicus
aactgccatttcagga

SEQ ID NO: 466367 - DNA, 16 bp, R. norvegicus
aactgccttctaaatg

SEQ ID NO: 466368 - DNA, 16 bp, R. norvegicus
aactgctattacaaac

SEQ ID NO: 466369 - DNA, 16 bp, R. norvegicus
aactgctctaccactg

SEQ ID NO: 466370 - DNA, 16 bp, R. norvegicus
aactgctggagtgtgt

SEQ ID NO: 466371 - DNA, 25 bp, R. norvegicus
aactgctggtggagcagactgaact

SEQ ID NO: 466372 - DNA, 16 bp, R. norvegicus
aactgctgtttagaag

SEQ ID NO: 466373 - DNA, 16 bp, R. norvegicus
aactgcttccatgttg

SEQ ID NO: 466374 - DNA, 16 bp, R. norvegicus
aactgcttctctttct

SEQ ID NO: 466375 - DNA, 16 bp, R. norvegicus
aactgcttttgcctcc

SEQ ID NO: 466376 - DNA, 16 bp, R. norvegicus
aactggaaaaatctgg

SEQ ID NO: 466377 - DNA, 16 bp, R. norvegicus
aactggaaaagatcat

SEQ ID NO: 466378 - DNA, 16 bp, R. norvegicus
aactggaaaagcttga

SEQ ID NO: 466379 - DNA, 16 bp, R. norvegicus
aactggaaagaagcca

SEQ ID NO: 466380 - DNA, 16 bp, R. norvegicus
aactggaaagatggct

SEQ ID NO: 466381 - DNA, 16 bp, R. norvegicus
aactggaaatgaaaaa

SEQ ID NO: 466382 - DNA, 16 bp, R. norvegicus
aactggaacatctgga

SEQ ID NO: 466383 - DNA, 16 bp, R. norvegicus
aactggaagaagctga

SEQ ID NO: 466384 - DNA, 16 bp, R. norvegicus
aactggacagtgtgca

SEQ ID NO: 466385 - DNA, 16 bp, R. norvegicus
aactggagaaaataaa

SEQ ID NO: 466386 - DNA, 16 bp, R. norvegicus
aactggagagaaactt

SEQ ID NO: 466387 - DNA, 16 bp, R. norvegicus
aactggagagaggaag

SEQ ID NO: 466388 - DNA, 16 bp, R. norvegicus
aactggagatacagat

SEQ ID NO: 466389 - DNA, 16 bp, R. norvegicus
aactggagcagaagcc

SEQ ID NO: 466390 - DNA, 16 bp, R. norvegicus
aactggagcagaggct

SEQ ID NO: 466391 - DNA, 16 bp, R. norvegicus
aactggagcaggagct

SEQ ID NO: 466392 - DNA, 16 bp, R. norvegicus
aactggagcaggggtt

SEQ ID NO: 466393 - DNA, 16 bp, R. norvegicus
aactggagctggagag

SEQ ID NO: 466394 - DNA, 16 bp, R. norvegicus
aactggaggaaatgga

SEQ ID NO: 466395 - DNA, 16 bp, R. norvegicus
aactggaggacagcat

SEQ ID NO: 466396 - DNA, 16 bp, R. norvegicus
aactggaggattgaca

SEQ ID NO: 466397 - DNA, 16 bp, R. norvegicus
aactggaggccccagg

SEQ ID NO: 466398 - DNA, 16 bp, R. norvegicus
aactggaggtcaactt

SEQ ID NO: 466399 - DNA, 16 bp, R. norvegicus
aactggagtgacagat

SEQ ID NO: 466400 - DNA, 16 bp, R. norvegicus
aactggagttagagat

SEQ ID NO: 466401 - DNA, 16 bp, R. norvegicus
aactggctttgaactt

SEQ ID NO: 466402 - DNA, 16 bp, R. norvegicus
aactgggaaaaaggat

SEQ ID NO: 466403 - DNA, 16 bp, R. norvegicus
aactgggaaagggaat

SEQ ID NO: 466404 - DNA, 16 bp, R. norvegicus
aactgggaaatctgga

SEQ ID NO: 466405 - DNA, 16 bp, R. norvegicus
aactgggataacattt

SEQ ID NO: 466406 - DNA, 16 bp, R. norvegicus
aactgggtccccgctg

SEQ ID NO: 466407 - DNA, 70 bp, R. norvegicus
aactggtccatgaaagcagagcaactatcaagacaattgctgatgcagattgctgtcctcaacagcacta

SEQ ID NO: 466408 - DNA, 16 bp, R. norvegicus
aactgtaaaataaaat

SEQ ID NO: 466409 - DNA, 16 bp, R. norvegicus
aactgtacagtgcctc

SEQ ID NO: 466410 - DNA, 16 bp, R. norvegicus
aactgtatggtgttgg

SEQ ID NO: 466411 - DNA, 16 bp, R. norvegicus
aactgtattaaagggt

SEQ ID NO: 466412 - DNA, 16 bp, R. norvegicus
aactgtattaaggggt

SEQ ID NO: 466413 - DNA, 16 bp, R. norvegicus
aactgtcaacttgaca

SEQ ID NO: 466414 - DNA, 16 bp, R. norvegicus
aactgtctcaaaaaag

SEQ ID NO: 466415 - DNA, 16 bp, R. norvegicus
aactgtctgcagctgg

SEQ ID NO: 466416 - DNA, 16 bp, R. norvegicus
aactgtgaaccagaat

SEQ ID NO: 466417 - DNA, 16 bp, R. norvegicus
aactgtgagccaaagt

SEQ ID NO: 466418 - DNA, 16 bp, R. norvegicus
aactgtgagccacagt

SEQ ID NO: 466419 - DNA, 16 bp, R. norvegicus
aactgtgagctaaaat

SEQ ID NO: 466420 - DNA, 18 bp, R. norvegicus
aactgtgctaagaggaaa

SEQ ID NO: 466421 - DNA, 16 bp, R. norvegicus
aactgtggatggagaa

SEQ ID NO: 466422 - DNA, 16 bp, R. norvegicus
aactgtgtagaccagg

SEQ ID NO: 466423 - DNA, 16 bp, R. norvegicus
aactgtgtctttaaaa

SEQ ID NO: 466424 - DNA, 16 bp, R. norvegicus
aactgttaaagaaaat

SEQ ID NO: 466425 - DNA, 16 bp, R. norvegicus
aactgttataaaggaa

SEQ ID NO: 466426 - DNA, 16 bp, R. norvegicus
aactgttcaagatctg

SEQ ID NO: 466427 - DNA, 16 bp, R. norvegicus
aactgttttcttgttt

SEQ ID NO: 466428 - DNA, 16 bp, R. norvegicus
aactgtttttgtttgt

SEQ ID NO: 466429 - DNA, 16 bp, R. norvegicus
aacttaaaactcagga

SEQ ID NO: 466430 - DNA, 16 bp, R. norvegicus
aacttaaaggaagaaa

SEQ ID NO: 466431 - DNA, 16 bp, R. norvegicus
aacttaaatgaagaga

SEQ ID NO: 466432 - DNA, 16 bp, R. norvegicus
aacttaagacccatcc

SEQ ID NO: 466433 - DNA, 16 bp, R. norvegicus
aacttaaggaagaaaa

SEQ ID NO: 466434 - DNA, 16 bp, R. norvegicus
aacttacagaatgaat

SEQ ID NO: 466435 - DNA, 16 bp, R. norvegicus
aacttactatgtagcc

SEQ ID NO: 466436 - DNA, 17 bp, R. norvegicus
aacttagccctttccca

SEQ ID NO: 466437 - DNA, 16 bp, R. norvegicus
aacttatagagatcca

SEQ ID NO: 466438 - DNA, 16 bp, R. norvegicus
aacttattattataca

SEQ ID NO: 466439 - DNA, 16 bp, R. norvegicus
aacttcaaactctgca

SEQ ID NO: 466440 - DNA, 16 bp, R. norvegicus
aacttcaagacaatga

SEQ ID NO: 466441 - DNA, 16 bp, R. norvegicus
aacttcaagactgtga

SEQ ID NO: 466442 - DNA, 16 bp, R. norvegicus
aacttcaagcccctga

SEQ ID NO: 466443 - DNA, 16 bp, R. norvegicus
aacttcaagcttctga

SEQ ID NO: 466444 - DNA, 16 bp, R. norvegicus
aacttcaagttcctga

SEQ ID NO: 466445 - DNA, 16 bp, R. norvegicus
aacttcaatgataact

SEQ ID NO: 466446 - DNA, 16 bp, R. norvegicus
aacttcagcaaaatgg

SEQ ID NO: 466447 - DNA, 16 bp, R. norvegicus
aacttcagctccagag

SEQ ID NO: 466448 - DNA, 16 bp, R. norvegicus
aacttcatattgaaaa

SEQ ID NO: 466449 - DNA, 18 bp, R. norvegicus
aacttcatcagtgaattt

SEQ ID NO: 466450 - DNA, 16 bp, R. norvegicus
aacttccctaacctga

SEQ ID NO: 466451 - DNA, 16 bp, R. norvegicus
aacttcctaaacagaa

SEQ ID NO: 466452 - DNA, 16 bp, R. norvegicus
aacttcctacagggat

SEQ ID NO: 466453 - DNA, 16 bp, R. norvegicus
aacttcctccaggagg

SEQ ID NO: 466454 - DNA, 16 bp, R. norvegicus
aacttcctgagcagaa

SEQ ID NO: 466455 - DNA, 16 bp, R. norvegicus
aacttcctttctcctg

SEQ ID NO: 466456 - DNA, 16 bp, R. norvegicus
aacttctcaatggaga

SEQ ID NO: 466457 - DNA, 16 bp, R. norvegicus
aacttctggaggtatc

SEQ ID NO: 466458 - DNA, 17 bp, R. norvegicus
aacttcttgagttcatt

SEQ ID NO: 466459 - DNA, 16 bp, R. norvegicus
aacttctttgatgagg

SEQ ID NO: 466460 - DNA, 16 bp, R. norvegicus
aacttgaaaatcaatt

SEQ ID NO: 466461 - DNA, 16 bp, R. norvegicus
aacttgaaatcaggga

SEQ ID NO: 466462 - DNA, 16 bp, R. norvegicus
aacttgaagcagaaac

SEQ ID NO: 466463 - DNA, 16 bp, R. norvegicus
aacttgacacaagcta

SEQ ID NO: 466464 - DNA, 16 bp, R. norvegicus
aacttgagatcttcct

SEQ ID NO: 466465 - DNA, 16 bp, R. norvegicus
aacttgattttatttt

SEQ ID NO: 466466 - DNA, 16 bp, R. norvegicus
aacttgcagtcctcct

SEQ ID NO: 466467 - DNA, 16 bp, R. norvegicus
aacttgccaaagaact

SEQ ID NO: 466468 - DNA, 16 bp, R. norvegicus
aacttgctatgtagct

SEQ ID NO: 466469 - DNA, 16 bp, R. norvegicus
aacttggaaaagaaag

SEQ ID NO: 466470 - DNA, 16 bp, R. norvegicus
aacttggaatcctcct

SEQ ID NO: 466471 - DNA, 16 bp, R. norvegicus
aacttggaggcagagg

SEQ ID NO: 466472 - DNA, 16 bp, R. norvegicus
aacttgggagaggaaa

SEQ ID NO: 466473 - DNA, 16 bp, R. norvegicus
aacttgggatccattt

SEQ ID NO: 466474 - DNA, 16 bp, R. norvegicus
aacttgggtacctggt

SEQ ID NO: 466475 - DNA, 16 bp, R. norvegicus
aacttggtgaattcag

SEQ ID NO: 466476 - DNA, 16 bp, R. norvegicus
aactttatctccatat

SEQ ID NO: 466477 - DNA, 19 bp, R. norvegicus
aactttatgatagtccaca

SEQ ID NO: 466478 - DNA, 16 bp, R. norvegicus
aactttcaaagaataa

SEQ ID NO: 466479 - DNA, 16 bp, R. norvegicus
aactttccaagcagat

SEQ ID NO: 466480 - DNA, 16 bp, R. norvegicus
aactttccttcccaga

SEQ ID NO: 466481 - DNA, 16 bp, R. norvegicus
aactttctctctttat

SEQ ID NO: 466482 - DNA, 16 bp, R. norvegicus
aactttgaactagaag

SEQ ID NO: 466483 - DNA, 16 bp, R. norvegicus
aactttgactgtggga

SEQ ID NO: 466484 - DNA, 16 bp, R. norvegicus
aactttgcctctctct

SEQ ID NO: 466485 - DNA, 16 bp, R. norvegicus
aactttggttttgtca

SEQ ID NO: 466486 - DNA, 16 bp, R. norvegicus
aactttgtctccatat

SEQ ID NO: 466487 - DNA, 16 bp, R. norvegicus
aacttttaaaaaggaa

SEQ ID NO: 466488 - DNA, 16 bp, R. norvegicus
aacttttaaaggaaaa

SEQ ID NO: 466489 - DNA, 16 bp, R. norvegicus
aacttttatattcata

SEQ ID NO: 466490 - DNA, 16 bp, R. norvegicus
aacttttctcccaccc

SEQ ID NO: 466491 - DNA, 16 bp, R. norvegicus
aacttttgatccttct

SEQ ID NO: 466492 - DNA, 16 bp, R. norvegicus
aacttttggttgaaaa

SEQ ID NO: 466493 - DNA, 16 bp, R. norvegicus
aagaaaaaaaatgctt

SEQ ID NO: 466494 - DNA, 16 bp, R. norvegicus
aagaaaaaaaattcct

SEQ ID NO: 466495 - DNA, 16 bp, R. norvegicus
aagaaaaaaagctgga

SEQ ID NO: 466496 - DNA, 16 bp, R. norvegicus
aagaaaaaaatccacc

SEQ ID NO: 466497 - DNA, 16 bp, R. norvegicus
aagaaaaaagccacat

SEQ ID NO: 466498 - DNA, 16 bp, R. norvegicus
aagaaaaaagctggag

SEQ ID NO: 466499 - DNA, 16 bp, R. norvegicus
aagaaaaaattacttt

SEQ ID NO: 466500 - DNA, 16 bp, R. norvegicus
aagaaaaactggagaa

SEQ ID NO: 466501 - DNA, 16 bp, R. norvegicus
aagaaaaagaaactct

SEQ ID NO: 466502 - DNA, 16 bp, R. norvegicus
aagaaaaagaaatccc

SEQ ID NO: 466503 - DNA, 16 bp, R. norvegicus
aagaaaaagaaatctg

SEQ ID NO: 466504 - DNA, 16 bp, R. norvegicus
aagaaaaagaaatgct

SEQ ID NO: 466505 - DNA, 16 bp, R. norvegicus
aagaaaaagaagcagt

SEQ ID NO: 466506 - DNA, 16 bp, R. norvegicus
aagaaaaagaagtcag

SEQ ID NO: 466507 - DNA, 16 bp, R. norvegicus
aagaaaaagaatgacc

SEQ ID NO: 466508 - DNA, 16 bp, R. norvegicus
aagaaaaagatcagga

SEQ ID NO: 466509 - DNA, 16 bp, R. norvegicus
aagaaaaagatgtcca

SEQ ID NO: 466510 - DNA, 16 bp, R. norvegicus
aagaaaaagcccagga

SEQ ID NO: 466511 - DNA, 16 bp, R. norvegicus
aagaaaaatatatatc

SEQ ID NO: 466512 - DNA, 16 bp, R. norvegicus
aagaaaaatatcttaa

SEQ ID NO: 466513 - DNA, 16 bp, R. norvegicus
aagaaaaatctgattt

SEQ ID NO: 466514 - DNA, 16 bp, R. norvegicus
aagaaaaattcaaagt

SEQ ID NO: 466515 - DNA, 16 bp, R. norvegicus
aagaaaaatttcccaa

SEQ ID NO: 466516 - DNA, 16 bp, R. norvegicus
aagaaaacaatcacag

SEQ ID NO: 466517 - DNA, 16 bp, R. norvegicus
aagaaaacacattttt

SEQ ID NO: 466518 - DNA, 16 bp, R. norvegicus
aagaaaacagattttt

SEQ ID NO: 466519 - DNA, 16 bp, R. norvegicus
aagaaaacattgaatt

SEQ ID NO: 466520 - DNA, 16 bp, R. norvegicus
aagaaaacatttcaaa

SEQ ID NO: 466521 - DNA, 16 bp, R. norvegicus
aagaaaaccaaaactg

SEQ ID NO: 466522 - DNA, 16 bp, R. norvegicus
aagaaaaccaagagct

SEQ ID NO: 466523 - DNA, 16 bp, R. norvegicus
aagaaaaccaggagct

SEQ ID NO: 466524 - DNA, 16 bp, R. norvegicus
aagaaaacctacagaa

SEQ ID NO: 466525 - DNA, 16 bp, R. norvegicus
aagaaaacctacagag

SEQ ID NO: 466526 - DNA, 16 bp, R. norvegicus
aagaaaacttcctgaa

SEQ ID NO: 466527 - DNA, 16 bp, R. norvegicus
aagaaaacttctataa

SEQ ID NO: 466528 - DNA, 16 bp, R. norvegicus
aagaaaacttgaaaat

SEQ ID NO: 466529 - DNA, 16 bp, R. norvegicus
aagaaaactttgaaaa

SEQ ID NO: 466530 - DNA, 16 bp, R. norvegicus
aagaaaagaaaaggct

SEQ ID NO: 466531 - DNA, 16 bp, R. norvegicus
aagaaaagaaacattt

SEQ ID NO: 466532 - DNA, 16 bp, R. norvegicus
aagaaaagaaactctt

SEQ ID NO: 466533 - DNA, 16 bp, R. norvegicus
aagaaaagaaactgta

SEQ ID NO: 466534 - DNA, 16 bp, R. norvegicus
aagaaaagaaatctgt

SEQ ID NO: 466535 - DNA, 16 bp, R. norvegicus
aagaaaagaaatgcag

SEQ ID NO: 466536 - DNA, 16 bp, R. norvegicus
aagaaaagaagctgag

SEQ ID NO: 466537 - DNA, 16 bp, R. norvegicus
aagaaaagaagtgcag

SEQ ID NO: 466538 - DNA, 16 bp, R. norvegicus
aagaaaagcaacagtg

SEQ ID NO: 466539 - DNA, 16 bp, R. norvegicus
aagaaaagcatttatt

SEQ ID NO: 466540 - DNA, 16 bp, R. norvegicus
aagaaaaggaaagcat

SEQ ID NO: 466541 - DNA, 16 bp, R. norvegicus
aagaaaaggaaattca

SEQ ID NO: 466542 - DNA, 16 bp, R. norvegicus
aagaaaaggcagaaat

SEQ ID NO: 466543 - DNA, 16 bp, R. norvegicus
aagaaaaggccattca

SEQ ID NO: 466544 - DNA, 16 bp, R. norvegicus
aagaaaaggctgccca

SEQ ID NO: 466545 - DNA, 16 bp, R. norvegicus
aagaaaataaagactt

SEQ ID NO: 466546 - DNA, 16 bp, R. norvegicus
aagaaaataacattta

SEQ ID NO: 466547 - DNA, 16 bp, R. norvegicus
aagaaaataatcatga

SEQ ID NO: 466548 - DNA, 16 bp, R. norvegicus
aagaaaataattatgg

SEQ ID NO: 466549 - DNA, 16 bp, R. norvegicus
aagaaaatatcctaaa

SEQ ID NO: 466550 - DNA, 16 bp, R. norvegicus
aagaaaatatttactt

SEQ ID NO: 466551 - DNA, 16 bp, R. norvegicus
aagaaaatatttctgt

SEQ ID NO: 466552 - DNA, 16 bp, R. norvegicus
aagaaaatattttcca

SEQ ID NO: 466553 - DNA, 16 bp, R. norvegicus
aagaaaatattttctt

SEQ ID NO: 466554 - DNA, 16 bp, R. norvegicus
aagaaaatcagcaaga

SEQ ID NO: 466555 - DNA, 16 bp, R. norvegicus
aagaaaatcctacaaa

SEQ ID NO: 466556 - DNA, 16 bp, R. norvegicus
aagaaaatctcaggag

SEQ ID NO: 466557 - DNA, 16 bp, R. norvegicus
aagaaaatgaaatgca

SEQ ID NO: 466558 - DNA, 16 bp, R. norvegicus
aagaaaatgaagacag

SEQ ID NO: 466559 - DNA, 16 bp, R. norvegicus
aagaaaatgaagcaag

SEQ ID NO: 466560 - DNA, 16 bp, R. norvegicus
aagaaaatgatatttt

SEQ ID NO: 466561 - DNA, 16 bp, R. norvegicus
aagaaaatgccccaga

SEQ ID NO: 466562 - DNA, 16 bp, R. norvegicus
aagaaaatgccccata

SEQ ID NO: 466563 - DNA, 16 bp, R. norvegicus
aagaaaatgctttctt

SEQ ID NO: 466564 - DNA, 16 bp, R. norvegicus
aagaaaatgtcacaca

SEQ ID NO: 466565 - DNA, 16 bp, R. norvegicus
aagaaaatgtcatcca

SEQ ID NO: 466566 - DNA, 16 bp, R. norvegicus
aagaaaatgtcccaca

SEQ ID NO: 466567 - DNA, 16 bp, R. norvegicus
aagaaaatgtgataca

SEQ ID NO: 466568 - DNA, 16 bp, R. norvegicus
aagaaaatgttctaca

SEQ ID NO: 466569 - DNA, 16 bp, R. norvegicus
aagaaaatgtttattt

SEQ ID NO: 466570 - DNA, 16 bp, R. norvegicus
aagaaaattaaagact

SEQ ID NO: 466571 - DNA, 16 bp, R. norvegicus
aagaaaattatccatt

SEQ ID NO: 466572 - DNA, 16 bp, R. norvegicus
aagaaaattgaaatca

SEQ ID NO: 466573 - DNA, 16 bp, R. norvegicus
aagaaacaaacctcaa

SEQ ID NO: 466574 - DNA, 16 bp, R. norvegicus
aagaaacaaagaagtg

SEQ ID NO: 466575 - DNA, 16 bp, R. norvegicus
aagaaacaaatatttt

SEQ ID NO: 466576 - DNA, 16 bp, R. norvegicus
aagaaacaagatggag

SEQ ID NO: 466577 - DNA, 16 bp, R. norvegicus
aagaaacaagctaaag

SEQ ID NO: 466578 - DNA, 16 bp, R. norvegicus
aagaaacacatttcag

SEQ ID NO: 466579 - DNA, 17 bp, R. norvegicus
aagaaacacgtgaagaa

SEQ ID NO: 466580 - DNA, 16 bp, R. norvegicus
aagaaacagaagcagt

SEQ ID NO: 466581 - DNA, 16 bp, R. norvegicus
aagaaacagaccagat

SEQ ID NO: 466582 - DNA, 16 bp, R. norvegicus
aagaaacatttacaaa

SEQ ID NO: 466583 - DNA, 16 bp, R. norvegicus
aagaaaccctggacca

SEQ ID NO: 466584 - DNA, 16 bp, R. norvegicus
aagaaaccttccctga

SEQ ID NO: 466585 - DNA, 16 bp, R. norvegicus
aagaaactaaaaactt

SEQ ID NO: 466586 - DNA, 16 bp, R. norvegicus
aagaaactaggagaga

SEQ ID NO: 466587 - DNA, 16 bp, R. norvegicus
aagaaactcaaggcag

SEQ ID NO: 466588 - DNA, 16 bp, R. norvegicus
aagaaactgaagaaga

SEQ ID NO: 466589 - DNA, 16 bp, R. norvegicus
aagaaactgaagagaa

SEQ ID NO: 466590 - DNA, 16 bp, R. norvegicus
aagaaactgaagagga

SEQ ID NO: 466591 - DNA, 16 bp, R. norvegicus
aagaaactgaggaaga

SEQ ID NO: 466592 - DNA, 16 bp, R. norvegicus
aagaaactggagaaaa

SEQ ID NO: 466593 - DNA, 16 bp, R. norvegicus
aagaaactggagaaag

SEQ ID NO: 466594 - DNA, 16 bp, R. norvegicus
aagaaacttgaagaaa

SEQ ID NO: 466595 - DNA, 16 bp, R. norvegicus
aagaaacttgagtttg

SEQ ID NO: 466596 - DNA, 16 bp, R. norvegicus
aagaaagaaaacatgg

SEQ ID NO: 466597 - DNA, 16 bp, R. norvegicus
aagaaagaaaacttca

SEQ ID NO: 466598 - DNA, 16 bp, R. norvegicus
aagaaagaaaagctgg

SEQ ID NO: 466599 - DNA, 16 bp, R. norvegicus
aagaaagaaaatgcct

SEQ ID NO: 466600 - DNA, 16 bp, R. norvegicus
aagaaagaaactgtct

SEQ ID NO: 466601 - DNA, 16 bp, R. norvegicus
aagaaagaaagaactg

SEQ ID NO: 466602 - DNA, 16 bp, R. norvegicus
aagaaagaaagcatga

SEQ ID NO: 466603 - DNA, 16 bp, R. norvegicus
aagaaagaaataccca

SEQ ID NO: 466604 - DNA, 16 bp, R. norvegicus
aagaaagaaatcttct

SEQ ID NO: 466605 - DNA, 16 bp, R. norvegicus
aagaaagaagctggag

SEQ ID NO: 466606 - DNA, 16 bp, R. norvegicus
aagaaagaatattttt

SEQ ID NO: 466607 - DNA, 16 bp, R. norvegicus
aagaaagaatctcagg

SEQ ID NO: 466608 - DNA, 16 bp, R. norvegicus
aagaaagacatacatg

SEQ ID NO: 466609 - DNA, 16 bp, R. norvegicus
aagaaagaccatccag

SEQ ID NO: 466610 - DNA, 16 bp, R. norvegicus
aagaaagacctgaaga

SEQ ID NO: 466611 - DNA, 16 bp, R. norvegicus
aagaaagagaagcagt

SEQ ID NO: 466612 - DNA, 16 bp, R. norvegicus
aagaaagagatcaaga

SEQ ID NO: 466613 - DNA, 16 bp, R. norvegicus
aagaaagagatgaaca

SEQ ID NO: 466614 - DNA, 16 bp, R. norvegicus
aagaaagagatggcca

SEQ ID NO: 466615 - DNA, 16 bp, R. norvegicus
aagaaagagatggcta

SEQ ID NO: 466616 - DNA, 16 bp, R. norvegicus
aagaaagagggctatg

SEQ ID NO: 466617 - DNA, 16 bp, R. norvegicus
aagaaagattgaagca

SEQ ID NO: 466618 - DNA, 16 bp, R. norvegicus
aagaaagcaaactgaa

SEQ ID NO: 466619 - DNA, 16 bp, R. norvegicus
aagaaagcaaactgag

SEQ ID NO: 466620 - DNA, 16 bp, R. norvegicus
aagaaagcaagctgag

SEQ ID NO: 466621 - DNA, 16 bp, R. norvegicus
aagaaagcaggttaag

SEQ ID NO: 466622 - DNA, 16 bp, R. norvegicus
aagaaagcagtgctaa

SEQ ID NO: 466623 - DNA, 16 bp, R. norvegicus
aagaaagcatcatcaa

SEQ ID NO: 466624 - DNA, 17 bp, R. norvegicus
aagaaagcatttgacaa

SEQ ID NO: 466625 - DNA, 16 bp, R. norvegicus
aagaaagcttcttcaa

SEQ ID NO: 466626 - DNA, 16 bp, R. norvegicus
aagaaagctttgaaaa

SEQ ID NO: 466627 - DNA, 16 bp, R. norvegicus
aagaaaggaaacttca

SEQ ID NO: 466628 - DNA, 16 bp, R. norvegicus
aagaaaggcctcctgg

SEQ ID NO: 466629 - DNA, 16 bp, R. norvegicus
aagaaaggctgagcaa

SEQ ID NO: 466630 - DNA, 16 bp, R. norvegicus
aagaaagggaagactc

SEQ ID NO: 466631 - DNA, 16 bp, R. norvegicus
aagaaaggggctggag

SEQ ID NO: 466632 - DNA, 16 bp, R. norvegicus
aagaaaggtttgattt

SEQ ID NO: 466633 - DNA, 16 bp, R. norvegicus
aagaaagtacagaata

SEQ ID NO: 466634 - DNA, 16 bp, R. norvegicus
aagaaagtgatgccca

SEQ ID NO: 466635 - DNA, 16 bp, R. norvegicus
aagaaagttggggagg

SEQ ID NO: 466636 - DNA, 16 bp, R. norvegicus
aagaaagttttgaaaa

SEQ ID NO: 466637 - DNA, 16 bp, R. norvegicus
aagaaataaaatactt

SEQ ID NO: 466638 - DNA, 16 bp, R. norvegicus
aagaaataattcacag

SEQ ID NO: 466639 - DNA, 16 bp, R. norvegicus
aagaaatacaaaattt

SEQ ID NO: 466640 - DNA, 16 bp, R. norvegicus
aagaaatacaaatggc

SEQ ID NO: 466641 - DNA, 16 bp, R. norvegicus
aagaaatacagagaca

SEQ ID NO: 466642 - DNA, 16 bp, R. norvegicus
aagaaatacaggaaga

SEQ ID NO: 466643 - DNA, 18 bp, R. norvegicus
aagaaatactcaagttaa

SEQ ID NO: 466644 - DNA, 16 bp, R. norvegicus
aagaaatactggaaaa

SEQ ID NO: 466645 - DNA, 16 bp, R. norvegicus
aagaaatagaagcagt

SEQ ID NO: 466646 - DNA, 16 bp, R. norvegicus
aagaaatattttcata

SEQ ID NO: 466647 - DNA, 16 bp, R. norvegicus
aagaaatcaaaatacc

SEQ ID NO: 466648 - DNA, 16 bp, R. norvegicus
aagaaatcaaaatgtc

SEQ ID NO: 466649 - DNA, 16 bp, R. norvegicus
aagaaatcaaagatct

SEQ ID NO: 466650 - DNA, 16 bp, R. norvegicus
aagaaatcaaggaaga

SEQ ID NO: 466651 - DNA, 16 bp, R. norvegicus
aagaaatccaagaaga

SEQ ID NO: 466652 - DNA, 16 bp, R. norvegicus
aagaaatccagaagag

SEQ ID NO: 466653 - DNA, 16 bp, R. norvegicus
aagaaatccaggacaa

SEQ ID NO: 466654 - DNA, 16 bp, R. norvegicus
aagaaatctatgaaaa

SEQ ID NO: 466655 - DNA, 16 bp, R. norvegicus
aagaaatcttccctaa

SEQ ID NO: 466656 - DNA, 16 bp, R. norvegicus
aagaaatgaagacaga

SEQ ID NO: 466657 - DNA, 16 bp, R. norvegicus
aagaaatgatcaacat

SEQ ID NO: 466658 - DNA, 16 bp, R. norvegicus
aagaaatgcaagctga

SEQ ID NO: 466659 - DNA, 16 bp, R. norvegicus
aagaaatgcttataaa

SEQ ID NO: 466660 - DNA, 16 bp, R. norvegicus
aagaaatgcttgctga

SEQ ID NO: 466661 - DNA, 16 bp, R. norvegicus
aagaaatgtggacaaa

SEQ ID NO: 466662 - DNA, 16 bp, R. norvegicus
aagaaatgttcaacaa

SEQ ID NO: 466663 - DNA, 16 bp, R. norvegicus
aagaaatgttcttttt

SEQ ID NO: 466664 - DNA, 16 bp, R. norvegicus
aagaaattaaacatca

SEQ ID NO: 466665 - DNA, 16 bp, R. norvegicus
aagaaattaaactttt

SEQ ID NO: 466666 - DNA, 16 bp, R. norvegicus
aagaaattagtgaaat

SEQ ID NO: 466667 - DNA, 16 bp, R. norvegicus
aagaaattatggaaat

SEQ ID NO: 466668 - DNA, 16 bp, R. norvegicus
aagaaattcaggaaaa

SEQ ID NO: 466669 - DNA, 16 bp, R. norvegicus
aagaaattctggggaa

SEQ ID NO: 466670 - DNA, 16 bp, R. norvegicus
aagaaattgaacaaga

SEQ ID NO: 466671 - DNA, 16 bp, R. norvegicus
aagaaattgaagaaac

SEQ ID NO: 466672 - DNA, 16 bp, R. norvegicus
aagaaattgatatttt

SEQ ID NO: 466673 - DNA, 16 bp, R. norvegicus
aagaaattggagagag

SEQ ID NO: 466674 - DNA, 16 bp, R. norvegicus
aagaaattgtgtgtgt

SEQ ID NO: 466675 - DNA, 16 bp, R. norvegicus
aagaacaaacacattt

SEQ ID NO: 466676 - DNA, 17 bp, R. norvegicus
aagaacaacaatatcaa

SEQ ID NO: 466677 - DNA, 16 bp, R. norvegicus
aagaacaagagagtga

SEQ ID NO: 466678 - DNA, 16 bp, R. norvegicus
aagaacaagaggggcc

SEQ ID NO: 466679 - DNA, 16 bp, R. norvegicus
aagaacaagcaggcaa

SEQ ID NO: 466680 - DNA, 16 bp, R. norvegicus
aagaacaatgaagaga

SEQ ID NO: 466681 - DNA, 16 bp, R. norvegicus
aagaacaatgacttca

SEQ ID NO: 466682 - DNA, 16 bp, R. norvegicus
aagaacaatttgaaaa

SEQ ID NO: 466683 - DNA, 16 bp, R. norvegicus
aagaacacaagaagct

SEQ ID NO: 466684 - DNA, 16 bp, R. norvegicus
aagaacacagggaaat

SEQ ID NO: 466685 - DNA, 16 bp, R. norvegicus
aagaacacatcaaaga

SEQ ID NO: 466686 - DNA, 16 bp, R. norvegicus
aagaacacatggaaaa

SEQ ID NO: 466687 - DNA, 16 bp, R. norvegicus
aagaacacatttgtct

SEQ ID NO: 466688 - DNA, 16 bp, R. norvegicus
aagaacacctgctgct

SEQ ID NO: 466689 - DNA, 16 bp, R. norvegicus
aagaacacttcatatt

SEQ ID NO: 466690 - DNA, 16 bp, R. norvegicus
aagaacacttgctatt

SEQ ID NO: 466691 - DNA, 16 bp, R. norvegicus
aagaacacttgctgct

SEQ ID NO: 466692 - DNA, 16 bp, R. norvegicus
aagaacagaaagccca

SEQ ID NO: 466693 - DNA, 16 bp, R. norvegicus
aagaacagactgagca

SEQ ID NO: 466694 - DNA, 16 bp, R. norvegicus
aagaacagcaacagca

SEQ ID NO: 466695 - DNA, 16 bp, R. norvegicus
aagaacagcaagagct

SEQ ID NO: 466696 - DNA, 16 bp, R. norvegicus
aagaacagcagcagca

SEQ ID NO: 466697 - DNA, 16 bp, R. norvegicus
aagaacagcagcctca

SEQ ID NO: 466698 - DNA, 16 bp, R. norvegicus
aagaacagcagtggca

SEQ ID NO: 466699 - DNA, 16 bp, R. norvegicus
aagaacagcctgggga

SEQ ID NO: 466700 - DNA, 16 bp, R. norvegicus
aagaacagcttttctt

SEQ ID NO: 466701 - DNA, 16 bp, R. norvegicus
aagaacagtgactgct

SEQ ID NO: 466702 - DNA, 16 bp, R. norvegicus
aagaacatatacaggc

SEQ ID NO: 466703 - DNA, 16 bp, R. norvegicus
aagaacatgatcaaaa

SEQ ID NO: 466704 - DNA, 16 bp, R. norvegicus
aagaacattaaaagca

SEQ ID NO: 466705 - DNA, 16 bp, R. norvegicus
aagaacattatttaaa

SEQ ID NO: 466706 - DNA, 16 bp, R. norvegicus
aagaacattttgaaca

SEQ ID NO: 466707 - DNA, 16 bp, R. norvegicus
aagaaccaaaatggag

SEQ ID NO: 466708 - DNA, 16 bp, R. norvegicus
aagaaccaactccaca

SEQ ID NO: 466709 - DNA, 16 bp, R. norvegicus
aagaaccaagatgtcc

SEQ ID NO: 466710 - DNA, 16 bp, R. norvegicus
aagaaccagatcctgg

SEQ ID NO: 466711 - DNA, 16 bp, R. norvegicus
aagaaccagctcccag

SEQ ID NO: 466712 - DNA, 16 bp, R. norvegicus
aagaaccagctcctag

SEQ ID NO: 466713 - DNA, 16 bp, R. norvegicus
aagaaccagcttctgg

SEQ ID NO: 466714 - DNA, 16 bp, R. norvegicus
aagaaccagttcctag

SEQ ID NO: 466715 - DNA, 16 bp, R. norvegicus
aagaacctaagcaaca

SEQ ID NO: 466716 - DNA, 16 bp, R. norvegicus
aagaacctcaaactca

SEQ ID NO: 466717 - DNA, 16 bp, R. norvegicus
aagaactacaactccc

SEQ ID NO: 466718 - DNA, 16 bp, R. norvegicus
aagaactacagacaac

SEQ ID NO: 466719 - DNA, 16 bp, R. norvegicus
aagaactacagagaca

SEQ ID NO: 466720 - DNA, 16 bp, R. norvegicus
aagaactcaaaatatc

SEQ ID NO: 466721 - DNA, 16 bp, R. norvegicus
aagaactcaagaattt

SEQ ID NO: 466722 - DNA, 16 bp, R. norvegicus
aagaactccaggaaaa

SEQ ID NO: 466723 - DNA, 16 bp, R. norvegicus
aagaactcccttagag

SEQ ID NO: 466724 - DNA, 18 bp, R. norvegicus
aagaactctcttagagaa

SEQ ID NO: 466725 - DNA, 16 bp, R. norvegicus
aagaactgaagaagct

SEQ ID NO: 466726 - DNA, 16 bp, R. norvegicus
aagaactgaagcatct

SEQ ID NO: 466727 - DNA, 16 bp, R. norvegicus
aagaactgaaggagct

SEQ ID NO: 466728 - DNA, 16 bp, R. norvegicus
aagaactgaaggggat

SEQ ID NO: 466729 - DNA, 16 bp, R. norvegicus
aagaactgcaaagaca

SEQ ID NO: 466730 - DNA, 16 bp, R. norvegicus
aagaactggaacagct

SEQ ID NO: 466731 - DNA, 17 bp, R. norvegicus
aagaactggaagagctt

SEQ ID NO: 466732 - DNA, 16 bp, R. norvegicus
aagaactggaagctct

SEQ ID NO: 466733 - DNA, 16 bp, R. norvegicus
aagaactgtatgacaa

SEQ ID NO: 466734 - DNA, 16 bp, R. norvegicus
aagaactgttttaaaa

SEQ ID NO: 466735 - DNA, 16 bp, R. norvegicus
aagaacttcaagacag

SEQ ID NO: 466736 - DNA, 16 bp, R. norvegicus
aagaacttcaagacat

SEQ ID NO: 466737 - DNA, 16 bp, R. norvegicus
aagaacttcagtctct

SEQ ID NO: 466738 - DNA, 16 bp, R. norvegicus
aagaacttcatgaagt

SEQ ID NO: 466739 - DNA, 16 bp, R. norvegicus
aagaacttctggaggt

SEQ ID NO: 466740 - DNA, 16 bp, R. norvegicus
aagaacttgaagaaga

SEQ ID NO: 466741 - DNA, 16 bp, R. norvegicus
aagaagaaaaaattct

SEQ ID NO: 466742 - DNA, 16 bp, R. norvegicus
aagaagaaaacatttt

SEQ ID NO: 466743 - DNA, 16 bp, R. norvegicus
aagaagaaaatatacc

SEQ ID NO: 466744 - DNA, 16 bp, R. norvegicus
aagaagaaaatatcat

SEQ ID NO: 466745 - DNA, 16 bp, R. norvegicus
aagaagaaaatcacat

SEQ ID NO: 466746 - DNA, 16 bp, R. norvegicus
aagaagaaactggaga

SEQ ID NO: 466747 - DNA, 16 bp, R. norvegicus
aagaagaaagaatttt

SEQ ID NO: 466748 - DNA, 16 bp, R. norvegicus
aagaagaaagcatctt

SEQ ID NO: 466749 - DNA, 16 bp, R. norvegicus
aagaagaaagctggag

SEQ ID NO: 466750 - DNA, 16 bp, R. norvegicus
aagaagaaaggaatca

SEQ ID NO: 466751 - DNA, 16 bp, R. norvegicus
aagaagaacattcctc

SEQ ID NO: 466752 - DNA, 16 bp, R. norvegicus
aagaagaagaagccgc

SEQ ID NO: 466753 - DNA, 16 bp, R. norvegicus
aagaagaagacgatga

SEQ ID NO: 466754 - DNA, 16 bp, R. norvegicus
aagaagaagactccat

SEQ ID NO: 466755 - DNA, 17 bp, R. norvegicus
aagaagaagcagcagca

SEQ ID NO: 466756 - DNA, 16 bp, R. norvegicus
aagaagaagctgcaga

SEQ ID NO: 466757 - DNA, 16 bp, R. norvegicus
aagaagaagctggaga

SEQ ID NO: 466758 - DNA, 16 bp, R. norvegicus
aagaagaaggaagtcc

SEQ ID NO: 466759 - DNA, 16 bp, R. norvegicus
aagaagaaggatgtcc

SEQ ID NO: 466760 - DNA, 16 bp, R. norvegicus
aagaagaaggcatcag

SEQ ID NO: 466761 - DNA, 16 bp, R. norvegicus
aagaagaagtcaaagt

SEQ ID NO: 466762 - DNA, 16 bp, R. norvegicus
aagaagaatccacaaa

SEQ ID NO: 466763 - DNA, 16 bp, R. norvegicus
aagaagaatgaagacc

SEQ ID NO: 466764 - DNA, 16 bp, R. norvegicus
aagaagaattcagtaa

SEQ ID NO: 466765 - DNA, 16 bp, R. norvegicus
aagaagaattgaagca

SEQ ID NO: 466766 - DNA, 16 bp, R. norvegicus
aagaagaccaaaatat

SEQ ID NO: 466767 - DNA, 17 bp, R. norvegicus
aagaagacgacgacgac

SEQ ID NO: 466768 - DNA, 16 bp, R. norvegicus
aagaagactccagaga

SEQ ID NO: 466769 - DNA, 16 bp, R. norvegicus
aagaagagaaaactga

SEQ ID NO: 466770 - DNA, 16 bp, R. norvegicus
aagaagagagaatctt

SEQ ID NO: 466771 - DNA, 16 bp, R. norvegicus
aagaagagagccacag

SEQ ID NO: 466772 - DNA, 16 bp, R. norvegicus
aagaagaggagactgg

SEQ ID NO: 466773 - DNA, 16 bp, R. norvegicus
aagaagagggcaccag

SEQ ID NO: 466774 - DNA, 16 bp, R. norvegicus
aagaagatactggaag

SEQ ID NO: 466775 - DNA, 16 bp, R. norvegicus
aagaagatagccacaa

SEQ ID NO: 466776 - DNA, 16 bp, R. norvegicus
aagaagatcaagctac

SEQ ID NO: 466777 - DNA, 16 bp, R. norvegicus
aagaagatcctgggca

SEQ ID NO: 466778 - DNA, 16 bp, R. norvegicus
aagaagatctcaaaaa

SEQ ID NO: 466779 - DNA, 16 bp, R. norvegicus
aagaagatctgtaaca

SEQ ID NO: 466780 - DNA, 16 bp, R. norvegicus
aagaagatgaagaccc

SEQ ID NO: 466781 - DNA, 16 bp, R. norvegicus
aagaagattgaaatca

SEQ ID NO: 466782 - DNA, 16 bp, R. norvegicus
aagaagcaaactggag

SEQ ID NO: 466783 - DNA, 16 bp, R. norvegicus
aagaagcaactaaaga

SEQ ID NO: 466784 - DNA, 16 bp, R. norvegicus
aagaagcaagaaagta

SEQ ID NO: 466785 - DNA, 16 bp, R. norvegicus
aagaagcaagatggag

SEQ ID NO: 466786 - DNA, 16 bp, R. norvegicus
aagaagcaagttggga

SEQ ID NO: 466787 - DNA, 16 bp, R. norvegicus
aagaagcaatgaagag

SEQ ID NO: 466788 - DNA, 16 bp, R. norvegicus
aagaagcacgcggaca

SEQ ID NO: 466789 - DNA, 16 bp, R. norvegicus
aagaagcacttggggg

SEQ ID NO: 466790 - DNA, 16 bp, R. norvegicus
aagaagcagaagccag

SEQ ID NO: 466791 - DNA, 16 bp, R. norvegicus
aagaagcagagagcag

SEQ ID NO: 466792 - DNA, 16 bp, R. norvegicus
aagaagcagctcctgg

SEQ ID NO: 466793 - DNA, 16 bp, R. norvegicus
aagaagcataaagaac

SEQ ID NO: 466794 - DNA, 16 bp, R. norvegicus
aagaagcatttaaaga

SEQ ID NO: 466795 - DNA, 16 bp, R. norvegicus
aagaagccaaaagcat

SEQ ID NO: 466796 - DNA, 16 bp, R. norvegicus
aagaagccagaagagg

SEQ ID NO: 466797 - DNA, 16 bp, R. norvegicus
aagaagccattgaaga

SEQ ID NO: 466798 - DNA, 16 bp, R. norvegicus
aagaagcccaggacca

SEQ ID NO: 466799 - DNA, 25 bp, R. norvegicus
aagaagcctacagaactccaaatac

SEQ ID NO: 466800 - DNA, 16 bp, R. norvegicus
aagaagcctatagaac

SEQ ID NO: 466801 - DNA, 16 bp, R. norvegicus
aagaagccttcacagg

SEQ ID NO: 466802 - DNA, 18 bp, R. norvegicus
aagaagcgcaaggccctg

SEQ ID NO: 466803 - DNA, 16 bp, R. norvegicus
aagaagcgcatgctga

SEQ ID NO: 466804 - DNA, 16 bp, R. norvegicus
aagaagctaaagaaga

SEQ ID NO: 466805 - DNA, 16 bp, R. norvegicus
aagaagctaagcaaga

SEQ ID NO: 466806 - DNA, 16 bp, R. norvegicus
aagaagctaaggagga

SEQ ID NO: 466807 - DNA, 16 bp, R. norvegicus
aagaagctgaagagaa

SEQ ID NO: 466808 - DNA, 16 bp, R. norvegicus
aagaagctgaaggaga

SEQ ID NO: 466809 - DNA, 16 bp, R. norvegicus
aagaagctgaggaaga

SEQ ID NO: 466810 - DNA, 16 bp, R. norvegicus
aagaagctgaggaggg

SEQ ID NO: 466811 - DNA, 16 bp, R. norvegicus
aagaagctgaggatga

SEQ ID NO: 466812 - DNA, 16 bp, R. norvegicus
aagaagctggagaagc

SEQ ID NO: 466813 - DNA, 16 bp, R. norvegicus
aagaagcttctttgat

SEQ ID NO: 466814 - DNA, 16 bp, R. norvegicus
aagaagcttggcctgg

SEQ ID NO: 466815 - DNA, 16 bp, R. norvegicus
aagaaggaaaacattt

SEQ ID NO: 466816 - DNA, 16 bp, R. norvegicus
aagaaggaaaagccct

SEQ ID NO: 466817 - DNA, 16 bp, R. norvegicus
aagaaggaaagaaact

SEQ ID NO: 466818 - DNA, 16 bp, R. norvegicus
aagaaggaaagcccaa

SEQ ID NO: 466819 - DNA, 16 bp, R. norvegicus
aagaaggacgtgaaga

SEQ ID NO: 466820 - DNA, 16 bp, R. norvegicus
aagaaggagagcaagt

SEQ ID NO: 466821 - DNA, 16 bp, R. norvegicus
aagaaggagatgccca

SEQ ID NO: 466822 - DNA, 16 bp, R. norvegicus
aagaaggagcagagac

SEQ ID NO: 466823 - DNA, 16 bp, R. norvegicus
aagaaggagtgaggca

SEQ ID NO: 466824 - DNA, 16 bp, R. norvegicus
aagaaggagtggagca

SEQ ID NO: 466825 - DNA, 16 bp, R. norvegicus
aagaaggagttaagca

SEQ ID NO: 466826 - DNA, 16 bp, R. norvegicus
aagaaggatgacgaaa

SEQ ID NO: 466827 - DNA, 16 bp, R. norvegicus
aagaaggcaagctgag

SEQ ID NO: 466828 - DNA, 16 bp, R. norvegicus
aagaaggcagagacag

SEQ ID NO: 466829 - DNA, 16 bp, R. norvegicus
aagaaggcagaggcag

SEQ ID NO: 466830 - DNA, 16 bp, R. norvegicus
aagaaggcatcagacc

SEQ ID NO: 466831 - DNA, 16 bp, R. norvegicus
aagaaggcattggatc

SEQ ID NO: 466832 - DNA, 16 bp, R. norvegicus
aagaaggcttcatccc

SEQ ID NO: 466833 - DNA, 16 bp, R. norvegicus
aagaaggggctgggga

SEQ ID NO: 466834 - DNA, 16 bp, R. norvegicus
aagaaggtattggatc

SEQ ID NO: 466835 - DNA, 16 bp, R. norvegicus
aagaaggtctcagaag

SEQ ID NO: 466836 - DNA, 16 bp, R. norvegicus
aagaaggtgcaggagg

SEQ ID NO: 466837 - DNA, 19 bp, R. norvegicus
aagaaggtggtgaagcagg

SEQ ID NO: 466838 - DNA, 16 bp, R. norvegicus
aagaaggtggtggtgg

SEQ ID NO: 466839 - DNA, 16 bp, R. norvegicus
aagaaggtgttggatc

SEQ ID NO: 466840 - DNA, 16 bp, R. norvegicus
aagaagtacctgctga

SEQ ID NO: 466841 - DNA, 16 bp, R. norvegicus
aagaagtacttactga

SEQ ID NO: 466842 - DNA, 27 bp, R. norvegicus
aagaagtagaagcctacagagaggaat

SEQ ID NO: 466843 - DNA, 16 bp, R. norvegicus
aagaagtcaaagcatc

SEQ ID NO: 466844 - DNA, 16 bp, R. norvegicus
aagaagtcaagaaatt

SEQ ID NO: 466845 - DNA, 31 bp, R. norvegicus
aagaagtcgcactggagaggtgaggcacggc

SEQ ID NO: 466846 - DNA, 16 bp, R. norvegicus
aagaagtgcagcagtt

SEQ ID NO: 466847 - DNA, 16 bp, R. norvegicus
aagaagtgcagcctga

SEQ ID NO: 466848 - DNA, 16 bp, R. norvegicus
aagaagtgcaggccgt

SEQ ID NO: 466849 - DNA, 16 bp, R. norvegicus
aagaagtgcttgctga

SEQ ID NO: 466850 - DNA, 16 bp, R. norvegicus
aagaagtgcttggtga

SEQ ID NO: 466851 - DNA, 16 bp, R. norvegicus
aagaagtggatgctga

SEQ ID NO: 466852 - DNA, 16 bp, R. norvegicus
aagaagtggattcact

SEQ ID NO: 466853 - DNA, 16 bp, R. norvegicus
aagaagtgtatgttga

SEQ ID NO: 466854 - DNA, 16 bp, R. norvegicus
aagaagttaaacaaga

SEQ ID NO: 466855 - DNA, 16 bp, R. norvegicus
aagaagttaatttctt

SEQ ID NO: 466856 - DNA, 16 bp, R. norvegicus
aagaagttagacagca

SEQ ID NO: 466857 - DNA, 16 bp, R. norvegicus
aagaagttagactcca

SEQ ID NO: 466858 - DNA, 16 bp, R. norvegicus
aagaagttattgaaga

SEQ ID NO: 466859 - DNA, 16 bp, R. norvegicus
aagaagttcaagaaga

SEQ ID NO: 466860 - DNA, 16 bp, R. norvegicus
aagaagttgaagagga

SEQ ID NO: 466861 - DNA, 16 bp, R. norvegicus
aagaagttgaagatct

SEQ ID NO: 466862 - DNA, 16 bp, R. norvegicus
aagaagttgagaagga

SEQ ID NO: 466863 - DNA, 16 bp, R. norvegicus
aagaagttgaggagaa

SEQ ID NO: 466864 - DNA, 16 bp, R. norvegicus
aagaagtttattgagt

SEQ ID NO: 466865 - DNA, 16 bp, R. norvegicus
aagaataaacaaatgg

SEQ ID NO: 466866 - DNA, 16 bp, R. norvegicus
aagaataaatacatta

SEQ ID NO: 466867 - DNA, 16 bp, R. norvegicus
aagaatacatttttaa

SEQ ID NO: 466868 - DNA, 16 bp, R. norvegicus
aagaataccaggaaaa

SEQ ID NO: 466869 - DNA, 16 bp, R. norvegicus
aagaatagccatcaca

SEQ ID NO: 466870 - DNA, 16 bp, R. norvegicus
aagaatataatttctt

SEQ ID NO: 466871 - DNA, 16 bp, R. norvegicus
aagaatatgaaaagct

SEQ ID NO: 466872 - DNA, 16 bp, R. norvegicus
aagaatatttgaaact

SEQ ID NO: 466873 - DNA, 16 bp, R. norvegicus
aagaatcaaaagaacc

SEQ ID NO: 466874 - DNA, 16 bp, R. norvegicus
aagaatcaacaaattg

SEQ ID NO: 466875 - DNA, 16 bp, R. norvegicus
aagaatcaacaagacc

SEQ ID NO: 466876 - DNA, 16 bp, R. norvegicus
aagaatcaacagaagc

SEQ ID NO: 466877 - DNA, 16 bp, R. norvegicus
aagaatcagaaatgaa

SEQ ID NO: 466878 - DNA, 16 bp, R. norvegicus
aagaatcaggaaagag

SEQ ID NO: 466879 - DNA, 16 bp, R. norvegicus
aagaatctgaggaaat

SEQ ID NO: 466880 - DNA, 16 bp, R. norvegicus
aagaatctgaggagga

SEQ ID NO: 466881 - DNA, 16 bp, R. norvegicus
aagaatctggaggcag

SEQ ID NO: 466882 - DNA, 16 bp, R. norvegicus
aagaatgatgaagcta

SEQ ID NO: 466883 - DNA, 16 bp, R. norvegicus
aagaatgccttcctta

SEQ ID NO: 466884 - DNA, 16 bp, R. norvegicus
aagaatgctgcttcta

SEQ ID NO: 466885 - DNA, 16 bp, R. norvegicus
aagaatggatcaactt

SEQ ID NO: 466886 - DNA, 16 bp, R. norvegicus
aagaatggtttgattt

SEQ ID NO: 466887 - DNA, 16 bp, R. norvegicus
aagaatgtggagaaat

SEQ ID NO: 466888 - DNA, 16 bp, R. norvegicus
aagaatgttctagaaa

SEQ ID NO: 466889 - DNA, 16 bp, R. norvegicus
aagaatgttttgctga

SEQ ID NO: 466890 - DNA, 16 bp, R. norvegicus
aagaatgttttgttta

SEQ ID NO: 466891 - DNA, 16 bp, R. norvegicus
aagaattaagaagtca

SEQ ID NO: 466892 - DNA, 16 bp, R. norvegicus
aagaattaatgaaaca

SEQ ID NO: 466893 - DNA, 16 bp, R. norvegicus
aagaattacatgaaaa

SEQ ID NO: 466894 - DNA, 16 bp, R. norvegicus
aagaattcaaagaaga

SEQ ID NO: 466895 - DNA, 16 bp, R. norvegicus
aagaattcaaatctat

SEQ ID NO: 466896 - DNA, 16 bp, R. norvegicus
aagaattcaagaaact

SEQ ID NO: 466897 - DNA, 16 bp, R. norvegicus
aagaattcacagcgga

SEQ ID NO: 466898 - DNA, 16 bp, R. norvegicus
aagaattcacagctga

SEQ ID NO: 466899 - DNA, 16 bp, R. norvegicus
aagaattccagaaaat

SEQ ID NO: 466900 - DNA, 16 bp, R. norvegicus
aagaattccaggaaga

SEQ ID NO: 466901 - DNA, 16 bp, R. norvegicus
aagaattctcaactga

SEQ ID NO: 466902 - DNA, 31 bp, R. norvegicus
aagaattgacaaatgggatctcataaaacta

SEQ ID NO: 466903 - DNA, 16 bp, R. norvegicus
aagaattgatcaattt

SEQ ID NO: 466904 - DNA, 16 bp, R. norvegicus
aagaatttcaggaaaa

SEQ ID NO: 466905 - DNA, 16 bp, R. norvegicus
aagaatttgaatggca

SEQ ID NO: 466906 - DNA, 16 bp, R. norvegicus
aagaattttataaagt

SEQ ID NO: 466907 - DNA, 16 bp, R. norvegicus
aagacaaaaacatttt

SEQ ID NO: 466908 - DNA, 16 bp, R. norvegicus
aagacaaacaatttca

SEQ ID NO: 466909 - DNA, 16 bp, R. norvegicus
aagacaaacatggcat

SEQ ID NO: 466910 - DNA, 16 bp, R. norvegicus
aagacaaagggcttct

SEQ ID NO: 466911 - DNA, 16 bp, R. norvegicus
aagacaaatgttataa

SEQ ID NO: 466912 - DNA, 16 bp, R. norvegicus
aagacaaccctggaga

SEQ ID NO: 466913 - DNA, 16 bp, R. norvegicus
aagacaagcagatctc

SEQ ID NO: 466914 - DNA, 35 bp, R. norvegicus
aagacaagggtgctctggctaagctggtggaagct

SEQ ID NO: 466915 - DNA, 16 bp, R. norvegicus
aagacaatgaagaaga

SEQ ID NO: 466916 - DNA, 16 bp, R. norvegicus
aagacaatggaaagat

SEQ ID NO: 466917 - DNA, 16 bp, R. norvegicus
aagacaatttttaaaa

SEQ ID NO: 466918 - DNA, 16 bp, R. norvegicus
aagacacacagaagga

SEQ ID NO: 466919 - DNA, 16 bp, R. norvegicus
aagacacacatgcaca

SEQ ID NO: 466920 - DNA, 16 bp, R. norvegicus
aagacacagacttttg

SEQ ID NO: 466921 - DNA, 16 bp, R. norvegicus
aagacacagagacaga

SEQ ID NO: 466922 - DNA, 16 bp, R. norvegicus
aagacacaggctaata

SEQ ID NO: 466923 - DNA, 16 bp, R. norvegicus
aagacacctgacatca

SEQ ID NO: 466924 - DNA, 16 bp, R. norvegicus
aagacactgtcagaaa

SEQ ID NO: 466925 - DNA, 16 bp, R. norvegicus
aagacagaaatcaaga

SEQ ID NO: 466926 - DNA, 16 bp, R. norvegicus
aagacagaatctcagg

SEQ ID NO: 466927 - DNA, 16 bp, R. norvegicus
aagacagagaaaatga

SEQ ID NO: 466928 - DNA, 16 bp, R. norvegicus
aagacagagcagagac

SEQ ID NO: 466929 - DNA, 16 bp, R. norvegicus
aagacagaggcaagca

SEQ ID NO: 466930 - DNA, 16 bp, R. norvegicus
aagacagaggcagaga

SEQ ID NO: 466931 - DNA, 16 bp, R. norvegicus
aagacagccagagctg

SEQ ID NO: 466932 - DNA, 16 bp, R. norvegicus
aagacaggacaggaac

SEQ ID NO: 466933 - DNA, 16 bp, R. norvegicus
aagacaggagatagag

SEQ ID NO: 466934 - DNA, 16 bp, R. norvegicus
aagacagggtcttatg

SEQ ID NO: 466935 - DNA, 16 bp, R. norvegicus
aagacagtgacagtgt

SEQ ID NO: 466936 - DNA, 16 bp, R. norvegicus
aagacagtgtcctttg

SEQ ID NO: 466937 - DNA, 16 bp, R. norvegicus
aagacatagaagagag

SEQ ID NO: 466938 - DNA, 16 bp, R. norvegicus
aagacatagataaaca

SEQ ID NO: 466939 - DNA, 16 bp, R. norvegicus
aagacatcacatactt

SEQ ID NO: 466940 - DNA, 16 bp, R. norvegicus
aagacatcagaaaatg

SEQ ID NO: 466941 - DNA, 16 bp, R. norvegicus
aagacatggaaagatc

SEQ ID NO: 466942 - DNA, 16 bp, R. norvegicus
aagacattgaagaaga

SEQ ID NO: 466943 - DNA, 16 bp, R. norvegicus
aagacattgacacaac

SEQ ID NO: 466944 - DNA, 16 bp, R. norvegicus
aagacatttaaaagaa

SEQ ID NO: 466945 - DNA, 16 bp, R. norvegicus
aagacatttaaataaa

SEQ ID NO: 466946 - DNA, 16 bp, R. norvegicus
aagacattttatttta

SEQ ID NO: 466947 - DNA, 16 bp, R. norvegicus
aagaccaaaatatgga

SEQ ID NO: 466948 - DNA, 16 bp, R. norvegicus
aagaccaaaatgagga

SEQ ID NO: 466949 - DNA, 16 bp, R. norvegicus
aagaccaaagtgtgga

SEQ ID NO: 466950 - DNA, 16 bp, R. norvegicus
aagaccaagaccaaga

SEQ ID NO: 466951 - DNA, 16 bp, R. norvegicus
aagaccaagctgcacg

SEQ ID NO: 466952 - DNA, 16 bp, R. norvegicus
aagaccaaggtgcaca

SEQ ID NO: 466953 - DNA, 29 bp, R. norvegicus
aagaccaagtggagggtgacaggccattc

SEQ ID NO: 466954 - DNA, 16 bp, R. norvegicus
aagaccaccagtggaa

SEQ ID NO: 466955 - DNA, 16 bp, R. norvegicus
aagaccaccatcccag

SEQ ID NO: 466956 - DNA, 16 bp, R. norvegicus
aagaccactaccacaa

SEQ ID NO: 466957 - DNA, 16 bp, R. norvegicus
aagaccagataaacag

SEQ ID NO: 466958 - DNA, 16 bp, R. norvegicus
aagaccagcagtctca

SEQ ID NO: 466959 - DNA, 16 bp, R. norvegicus
aagaccagcagtctta

SEQ ID NO: 466960 - DNA, 16 bp, R. norvegicus
aagaccagcctggtcc

SEQ ID NO: 466961 - DNA, 16 bp, R. norvegicus
aagaccagctgtctca

SEQ ID NO: 466962 - DNA, 16 bp, R. norvegicus
aagaccaggctggcct

SEQ ID NO: 466963 - DNA, 16 bp, R. norvegicus
aagaccagtagacaag

SEQ ID NO: 466964 - DNA, 16 bp, R. norvegicus
aagaccagtgtcagca

SEQ ID NO: 466965 - DNA, 16 bp, R. norvegicus
aagaccatgagttcca

SEQ ID NO: 466966 - DNA, 16 bp, R. norvegicus
aagacccagatataaa

SEQ ID NO: 466967 - DNA, 16 bp, R. norvegicus
aagacccagcaagcag

SEQ ID NO: 466968 - DNA, 16 bp, R. norvegicus
aagacccagctgcaca

SEQ ID NO: 466969 - DNA, 16 bp, R. norvegicus
aagaccccagaagatg

SEQ ID NO: 466970 - DNA, 16 bp, R. norvegicus
aagaccccagtgtatt

SEQ ID NO: 466971 - DNA, 16 bp, R. norvegicus
aagaccctggctcaaa

SEQ ID NO: 466972 - DNA, 16 bp, R. norvegicus
aagaccctgggttcgg

SEQ ID NO: 466973 - DNA, 16 bp, R. norvegicus
aagaccctgtctcaca

SEQ ID NO: 466974 - DNA, 16 bp, R. norvegicus
aagaccctgtcttgaa

SEQ ID NO: 466975 - DNA, 16 bp, R. norvegicus
aagacctcaaagccca

SEQ ID NO: 466976 - DNA, 16 bp, R. norvegicus
aagacctcaacataaa

SEQ ID NO: 466977 - DNA, 16 bp, R. norvegicus
aagacctctgaaagag

SEQ ID NO: 466978 - DNA, 16 bp, R. norvegicus
aagacctctggcttct

SEQ ID NO: 466979 - DNA, 16 bp, R. norvegicus
aagacctgctcaacaa

SEQ ID NO: 466980 - DNA, 16 bp, R. norvegicus
aagacctggagtctgc

SEQ ID NO: 466981 - DNA, 16 bp, R. norvegicus
aagacctgggtttgga

SEQ ID NO: 466982 - DNA, 17 bp, R. norvegicus
aagaccttgaaggggct

SEQ ID NO: 466983 - DNA, 16 bp, R. norvegicus
aagacgaagatgaaga

SEQ ID NO: 466984 - DNA, 16 bp, R. norvegicus
aagacggaatcctact

SEQ ID NO: 466985 - DNA, 16 bp, R. norvegicus
aagactacagaactcc

SEQ ID NO: 466986 - DNA, 16 bp, R. norvegicus
aagactaccagctcaa

SEQ ID NO: 466987 - DNA, 16 bp, R. norvegicus
aagactatacatgaac

SEQ ID NO: 466988 - DNA, 16 bp, R. norvegicus
aagactatgaagaaag

SEQ ID NO: 466989 - DNA, 16 bp, R. norvegicus
aagactatttctctca

SEQ ID NO: 466990 - DNA, 16 bp, R. norvegicus
aagactcagaaaatat

SEQ ID NO: 466991 - DNA, 16 bp, R. norvegicus
aagactcagagacaaa

SEQ ID NO: 466992 - DNA, 24 bp, R. norvegicus
aagactcccagctcaaaggaccat

SEQ ID NO: 466993 - DNA, 16 bp, R. norvegicus
aagactcctagcagtg

SEQ ID NO: 466994 - DNA, 16 bp, R. norvegicus
aagactctgtctcaga

SEQ ID NO: 466995 - DNA, 16 bp, R. norvegicus
aagactgaaccaccaa

SEQ ID NO: 466996 - DNA, 16 bp, R. norvegicus
aagactgaactcccag

SEQ ID NO: 466997 - DNA, 16 bp, R. norvegicus
aagactgaaggaaagg

SEQ ID NO: 466998 - DNA, 16 bp, R. norvegicus
aagactgaattctaaa

SEQ ID NO: 466999 - DNA, 16 bp, R. norvegicus
aagactgattgatcag

SEQ ID NO: 467000 - DNA, 16 bp, R. norvegicus
aagactgatttccaga

SEQ ID NO: 467001 - DNA, 16 bp, R. norvegicus
aagactgccccacctg

SEQ ID NO: 467002 - DNA, 16 bp, R. norvegicus
aagactgctatgagca

SEQ ID NO: 467003 - DNA, 16 bp, R. norvegicus
aagactggcttccatg

SEQ ID NO: 467004 - DNA, 16 bp, R. norvegicus
aagactgggaggagag

SEQ ID NO: 467005 - DNA, 16 bp, R. norvegicus
aagactgtaagagctg

SEQ ID NO: 467006 - DNA, 16 bp, R. norvegicus
aagactgtcctctccc

SEQ ID NO: 467007 - DNA, 16 bp, R. norvegicus
aagacttccaatggag

SEQ ID NO: 467008 - DNA, 16 bp, R. norvegicus
aagacttccccttcca

SEQ ID NO: 467009 - DNA, 16 bp, R. norvegicus
aagacttctccttttc

SEQ ID NO: 467010 - DNA, 16 bp, R. norvegicus
aagacttctgggggaa

SEQ ID NO: 467011 - DNA, 16 bp, R. norvegicus
aagacttgtcttcaat

SEQ ID NO: 467012 - DNA, 16 bp, R. norvegicus
aagactttaagaaaga

SEQ ID NO: 467013 - DNA, 16 bp, R. norvegicus
aagactttaagaagga

SEQ ID NO: 467014 - DNA, 16 bp, R. norvegicus
aagactttctggaatt

SEQ ID NO: 467015 - DNA, 16 bp, R. norvegicus
aagactttcttttctg

SEQ ID NO: 467016 - DNA, 16 bp, R. norvegicus
aagacttttaacatgg

SEQ ID NO: 467017 - DNA, 16 bp, R. norvegicus
aagacttttttaaaaa

SEQ ID NO: 467018 - DNA, 16 bp, R. norvegicus
aagacttttttctttt

SEQ ID NO: 467019 - DNA, 16 bp, R. norvegicus
aagagaaaatggcaaa

SEQ ID NO: 467020 - DNA, 16 bp, R. norvegicus
aagagaaacatgaaca

SEQ ID NO: 467021 - DNA, 16 bp, R. norvegicus
aagagaaacatggaca

SEQ ID NO: 467022 - DNA, 16 bp, R. norvegicus
aagagaaaccctatct

SEQ ID NO: 467023 - DNA, 16 bp, R. norvegicus
aagagaaactgaagga

SEQ ID NO: 467024 - DNA, 16 bp, R. norvegicus
aagagaaactgaggaa

SEQ ID NO: 467025 - DNA, 16 bp, R. norvegicus
aagagaaactggctga

SEQ ID NO: 467026 - DNA, 16 bp, R. norvegicus
aagagaaacttgaaga

SEQ ID NO: 467027 - DNA, 16 bp, R. norvegicus
aagagaaagaacatga

SEQ ID NO: 467028 - DNA, 16 bp, R. norvegicus
aagagaaagcaaacta

SEQ ID NO: 467029 - DNA, 16 bp, R. norvegicus
aagagaaagcaagctg

SEQ ID NO: 467030 - DNA, 16 bp, R. norvegicus
aagagaaagggcactg

SEQ ID NO: 467031 - DNA, 16 bp, R. norvegicus
aagagaaatttggaaa

SEQ ID NO: 467032 - DNA, 16 bp, R. norvegicus
aagagaacaattcaaa

SEQ ID NO: 467033 - DNA, 16 bp, R. norvegicus
aagagaaccatacaaa

SEQ ID NO: 467034 - DNA, 16 bp, R. norvegicus
aagagaacccagcatt

SEQ ID NO: 467035 - DNA, 16 bp, R. norvegicus
aagagaagcaagtgct

SEQ ID NO: 467036 - DNA, 16 bp, R. norvegicus
aagagaagccagattg

SEQ ID NO: 467037 - DNA, 16 bp, R. norvegicus
aagagaagctatttaa

SEQ ID NO: 467038 - DNA, 16 bp, R. norvegicus
aagagaagcttctctg

SEQ ID NO: 467039 - DNA, 16 bp, R. norvegicus
aagagaatacaagaga

SEQ ID NO: 467040 - DNA, 16 bp, R. norvegicus
aagagaatcacaagtt

SEQ ID NO: 467041 - DNA, 16 bp, R. norvegicus
aagagaatcatgagtt

SEQ ID NO: 467042 - DNA, 16 bp, R. norvegicus
aagagaatctagagaa

SEQ ID NO: 467043 - DNA, 16 bp, R. norvegicus
aagagaatctcaggtg

SEQ ID NO: 467044 - DNA, 16 bp, R. norvegicus
aagagaatgtcagatc

SEQ ID NO: 467045 - DNA, 16 bp, R. norvegicus
aagagacaaggaaccg

SEQ ID NO: 467046 - DNA, 29 bp, R. norvegicus
aagagacaaggagctgtagatacaagcat

SEQ ID NO: 467047 - DNA, 16 bp, R. norvegicus
aagagacactgtctca

SEQ ID NO: 467048 - DNA, 16 bp, R. norvegicus
aagagacagaaataga

SEQ ID NO: 467049 - DNA, 16 bp, R. norvegicus
aagagacagaggcaag

SEQ ID NO: 467050 - DNA, 16 bp, R. norvegicus
aagagacatcatggcc

SEQ ID NO: 467051 - DNA, 16 bp, R. norvegicus
aagagacattttaaat

SEQ ID NO: 467052 - DNA, 16 bp, R. norvegicus
aagagaccacaaatgt

SEQ ID NO: 467053 - DNA, 16 bp, R. norvegicus
aagagaccagcatcac

SEQ ID NO: 467054 - DNA, 16 bp, R. norvegicus
aagagaccttatctca

SEQ ID NO: 467055 - DNA, 16 bp, R. norvegicus
aagagactagaacaca

SEQ ID NO: 467056 - DNA, 16 bp, R. norvegicus
aagagactgagaaaga

SEQ ID NO: 467057 - DNA, 16 bp, R. norvegicus
aagagactgagagaaa

SEQ ID NO: 467058 - DNA, 16 bp, R. norvegicus
aagagactgtgtgcct

SEQ ID NO: 467059 - DNA, 16 bp, R. norvegicus
aagagagaaaagcaat

SEQ ID NO: 467060 - DNA, 17 bp, R. norvegicus
aagagagaatctcaggg

SEQ ID NO: 467061 - DNA, 16 bp, R. norvegicus
aagagagacagtaaaa

SEQ ID NO: 467062 - DNA, 16 bp, R. norvegicus
aagagagagaatctca

SEQ ID NO: 467063 - DNA, 16 bp, R. norvegicus
aagagagagctgactc

SEQ ID NO: 467064 - DNA, 16 bp, R. norvegicus
aagagagaggattctg

SEQ ID NO: 467065 - DNA, 16 bp, R. norvegicus
aagagagagtttattc

SEQ ID NO: 467066 - DNA, 16 bp, R. norvegicus
aagagagcaggcctcc

SEQ ID NO: 467067 - DNA, 16 bp, R. norvegicus
aagagagcccaggaga

SEQ ID NO: 467068 - DNA, 16 bp, R. norvegicus
aagagagtccagaaaa

SEQ ID NO: 467069 - DNA, 16 bp, R. norvegicus
aagagataagaagttt

SEQ ID NO: 467070 - DNA, 16 bp, R. norvegicus
aagagatacagaaaga

SEQ ID NO: 467071 - DNA, 16 bp, R. norvegicus
aagagatattatggaa

SEQ ID NO: 467072 - DNA, 16 bp, R. norvegicus
aagagatcaggagaca

SEQ ID NO: 467073 - DNA, 16 bp, R. norvegicus
aagagatcaggagtca

SEQ ID NO: 467074 - DNA, 16 bp, R. norvegicus
aagagatctgtctgcc

SEQ ID NO: 467075 - DNA, 16 bp, R. norvegicus
aagagatgctcatgaa

SEQ ID NO: 467076 - DNA, 16 bp, R. norvegicus
aagagatggacagaga

SEQ ID NO: 467077 - DNA, 16 bp, R. norvegicus
aagagatggcccagca

SEQ ID NO: 467078 - DNA, 16 bp, R. norvegicus
aagagatggctataaa

SEQ ID NO: 467079 - DNA, 16 bp, R. norvegicus
aagagattattttctt

SEQ ID NO: 467080 - DNA, 16 bp, R. norvegicus
aagagattcgatgccc

SEQ ID NO: 467081 - DNA, 16 bp, R. norvegicus
aagagatttcagagga

SEQ ID NO: 467082 - DNA, 16 bp, R. norvegicus
aagagcaaaagcttcc

SEQ ID NO: 467083 - DNA, 16 bp, R. norvegicus
aagagcaacaaatact

SEQ ID NO: 467084 - DNA, 16 bp, R. norvegicus
aagagcaagagagagc

SEQ ID NO: 467085 - DNA, 16 bp, R. norvegicus
aagagcaagattctga

SEQ ID NO: 467086 - DNA, 18 bp, R. norvegicus
aagagcacatcaaaacca

SEQ ID NO: 467087 - DNA, 17 bp, R. norvegicus
aagagcaccagtgtaag

SEQ ID NO: 467088 - DNA, 16 bp, R. norvegicus
aagagcaccgactgct

SEQ ID NO: 467089 - DNA, 16 bp, R. norvegicus
aagagcactgtgtgct

SEQ ID NO: 467090 - DNA, 16 bp, R. norvegicus
aagagcacttgcagct

SEQ ID NO: 467091 - DNA, 16 bp, R. norvegicus
aagagcagacagtact

SEQ ID NO: 467092 - DNA, 16 bp, R. norvegicus
aagagcagagccatct

SEQ ID NO: 467093 - DNA, 16 bp, R. norvegicus
aagagcagcaaggact

SEQ ID NO: 467094 - DNA, 16 bp, R. norvegicus
aagagcagcagcaagt

SEQ ID NO: 467095 - DNA, 16 bp, R. norvegicus
aagagcagcagcagca

SEQ ID NO: 467096 - DNA, 16 bp, R. norvegicus
aagagcagcagtgctc

SEQ ID NO: 467097 - DNA, 16 bp, R. norvegicus
aagagcagccagagtt

SEQ ID NO: 467098 - DNA, 16 bp, R. norvegicus
aagagcagccagtgct

SEQ ID NO: 467099 - DNA, 16 bp, R. norvegicus
aagagcagcccagagg

SEQ ID NO: 467100 - DNA, 16 bp, R. norvegicus
aagagcagctctctgt

SEQ ID NO: 467101 - DNA, 16 bp, R. norvegicus
aagagcagctgaaaca

SEQ ID NO: 467102 - DNA, 16 bp, R. norvegicus
aagagcagctggtact

SEQ ID NO: 467103 - DNA, 16 bp, R. norvegicus
aagagcaggaacctaa

SEQ ID NO: 467104 - DNA, 16 bp, R. norvegicus
aagagcaggaggaagc

SEQ ID NO: 467105 - DNA, 16 bp, R. norvegicus
aagagcaggctgacag

SEQ ID NO: 467106 - DNA, 16 bp, R. norvegicus
aagagcaggtaaactt

SEQ ID NO: 467107 - DNA, 16 bp, R. norvegicus
aagagcagtatagctg

SEQ ID NO: 467108 - DNA, 16 bp, R. norvegicus
aagagcagtatgcact

SEQ ID NO: 467109 - DNA, 16 bp, R. norvegicus
aagagcagtcagggct

SEQ ID NO: 467110 - DNA, 22 bp, R. norvegicus
aagagcagtcagtgctcttaac

SEQ ID NO: 467111 - DNA, 16 bp, R. norvegicus
aagagcagtgcacact

SEQ ID NO: 467112 - DNA, 16 bp, R. norvegicus
aagagcagtggctgct

SEQ ID NO: 467113 - DNA, 16 bp, R. norvegicus
aagagcagtgggtgct

SEQ ID NO: 467114 - DNA, 16 bp, R. norvegicus
aagagcagtgtgcact

SEQ ID NO: 467115 - DNA, 16 bp, R. norvegicus
aagagcagtgtgtgct

SEQ ID NO: 467116 - DNA, 17 bp, R. norvegicus
aagagcatgaaggggct

SEQ ID NO: 467117 - DNA, 16 bp, R. norvegicus
aagagcattggttgct

SEQ ID NO: 467118 - DNA, 16 bp, R. norvegicus
aagagcatttgcttct

SEQ ID NO: 467119 - DNA, 16 bp, R. norvegicus
aagagccaaaaccatc

SEQ ID NO: 467120 - DNA, 16 bp, R. norvegicus
aagagccaaaggacca

SEQ ID NO: 467121 - DNA, 16 bp, R. norvegicus
aagagccaagagttct

SEQ ID NO: 467122 - DNA, 16 bp, R. norvegicus
aagagccaaggtccag

SEQ ID NO: 467123 - DNA, 16 bp, R. norvegicus
aagagccagaggatgg

SEQ ID NO: 467124 - DNA, 16 bp, R. norvegicus
aagagcccagaagatc

SEQ ID NO: 467125 - DNA, 16 bp, R. norvegicus
aagagcctcaaataca

SEQ ID NO: 467126 - DNA, 16 bp, R. norvegicus
aagagctcaagagaag

SEQ ID NO: 467127 - DNA, 16 bp, R. norvegicus
aagagctgaaggaact

SEQ ID NO: 467128 - DNA, 16 bp, R. norvegicus
aagagctgaaggagct

SEQ ID NO: 467129 - DNA, 16 bp, R. norvegicus
aagagctgagattaaa

SEQ ID NO: 467130 - DNA, 16 bp, R. norvegicus
aagagctgatgatttt

SEQ ID NO: 467131 - DNA, 16 bp, R. norvegicus
aagagctgcaggagag

SEQ ID NO: 467132 - DNA, 16 bp, R. norvegicus
aagagctggaagagct

SEQ ID NO: 467133 - DNA, 16 bp, R. norvegicus
aagagctggagaaatg

SEQ ID NO: 467134 - DNA, 16 bp, R. norvegicus
aagagctggaggaagg

SEQ ID NO: 467135 - DNA, 16 bp, R. norvegicus
aagagctggctcagca

SEQ ID NO: 467136 - DNA, 16 bp, R. norvegicus
aagagctgttggcagt

SEQ ID NO: 467137 - DNA, 16 bp, R. norvegicus
aagagcttgaagggcc

SEQ ID NO: 467138 - DNA, 16 bp, R. norvegicus
aagaggaaaactcaga

SEQ ID NO: 467139 - DNA, 16 bp, R. norvegicus
aagaggaaaactcttc

SEQ ID NO: 467140 - DNA, 16 bp, R. norvegicus
aagaggaagatgatga

SEQ ID NO: 467141 - DNA, 16 bp, R. norvegicus
aagaggaagcaggagc

SEQ ID NO: 467142 - DNA, 16 bp, R. norvegicus
aagaggaagcccacag

SEQ ID NO: 467143 - DNA, 16 bp, R. norvegicus
aagaggaagtggccaa

SEQ ID NO: 467144 - DNA, 16 bp, R. norvegicus
aagaggaatactcttc

SEQ ID NO: 467145 - DNA, 16 bp, R. norvegicus
aagaggaatttctttt

SEQ ID NO: 467146 - DNA, 16 bp, R. norvegicus
aagaggacttcagatc

SEQ ID NO: 467147 - DNA, 16 bp, R. norvegicus
aagaggacttgctgct

SEQ ID NO: 467148 - DNA, 16 bp, R. norvegicus
aagaggagaaatcaag

SEQ ID NO: 467149 - DNA, 16 bp, R. norvegicus
aagaggagaagatggc

SEQ ID NO: 467150 - DNA, 16 bp, R. norvegicus
aagaggagacagacag

SEQ ID NO: 467151 - DNA, 16 bp, R. norvegicus
aagaggagactactct

SEQ ID NO: 467152 - DNA, 16 bp, R. norvegicus
aagaggagcagatggc

SEQ ID NO: 467153 - DNA, 16 bp, R. norvegicus
aagaggaggaaactag

SEQ ID NO: 467154 - DNA, 16 bp, R. norvegicus
aagaggaggagactag

SEQ ID NO: 467155 - DNA, 16 bp, R. norvegicus
aagaggaggcagaatg

SEQ ID NO: 467156 - DNA, 16 bp, R. norvegicus
aagaggatcttgagtt

SEQ ID NO: 467157 - DNA, 16 bp, R. norvegicus
aagaggatgctgggaa

SEQ ID NO: 467158 - DNA, 16 bp, R. norvegicus
aagaggattctgggaa

SEQ ID NO: 467159 - DNA, 16 bp, R. norvegicus
aagaggcaaagattaa

SEQ ID NO: 467160 - DNA, 16 bp, R. norvegicus
aagaggcaaatgcagg

SEQ ID NO: 467161 - DNA, 16 bp, R. norvegicus
aagaggcacctaaaga

SEQ ID NO: 467162 - DNA, 16 bp, R. norvegicus
aagaggcagacagaca

SEQ ID NO: 467163 - DNA, 16 bp, R. norvegicus
aagaggcagacaggaa

SEQ ID NO: 467164 - DNA, 16 bp, R. norvegicus
aagaggcagatggaga

SEQ ID NO: 467165 - DNA, 16 bp, R. norvegicus
aagaggctgaggaaaa

SEQ ID NO: 467166 - DNA, 16 bp, R. norvegicus
aagagggaaaaaaatc

SEQ ID NO: 467167 - DNA, 16 bp, R. norvegicus
aagagggaatcacata

SEQ ID NO: 467168 - DNA, 16 bp, R. norvegicus
aagagggaatctcaat

SEQ ID NO: 467169 - DNA, 16 bp, R. norvegicus
aagagggcatcagatt

SEQ ID NO: 467170 - DNA, 16 bp, R. norvegicus
aagagggcattacaga

SEQ ID NO: 467171 - DNA, 16 bp, R. norvegicus
aagagggcattggagc

SEQ ID NO: 467172 - DNA, 16 bp, R. norvegicus
aagagggcggctgctg

SEQ ID NO: 467173 - DNA, 16 bp, R. norvegicus
aagagggctcagtggg

SEQ ID NO: 467174 - DNA, 16 bp, R. norvegicus
aagagggtgcttcccc

SEQ ID NO: 467175 - DNA, 16 bp, R. norvegicus
aagagggtggctgctg

SEQ ID NO: 467176 - DNA, 16 bp, R. norvegicus
aagaggtacagaaaga

SEQ ID NO: 467177 - DNA, 16 bp, R. norvegicus
aagaggtcaaaaggat

SEQ ID NO: 467178 - DNA, 16 bp, R. norvegicus
aagaggtcaaaggaat

SEQ ID NO: 467179 - DNA, 16 bp, R. norvegicus
aagagtaacaagtgct

SEQ ID NO: 467180 - DNA, 16 bp, R. norvegicus
aagagtaaccagtgct

SEQ ID NO: 467181 - DNA, 16 bp, R. norvegicus
aagagtactgactgct

SEQ ID NO: 467182 - DNA, 16 bp, R. norvegicus
aagagtatacacatgg

SEQ ID NO: 467183 - DNA, 16 bp, R. norvegicus
aagagtatttgttgct

SEQ ID NO: 467184 - DNA, 16 bp, R. norvegicus
aagagtcagatggaga

SEQ ID NO: 467185 - DNA, 16 bp, R. norvegicus
aagagtccacctccag

SEQ ID NO: 467186 - DNA, 16 bp, R. norvegicus
aagagtccccaggctc

SEQ ID NO: 467187 - DNA, 16 bp, R. norvegicus
aagagtcctgcccctg

SEQ ID NO: 467188 - DNA, 16 bp, R. norvegicus
aagagtctcaaacaca

SEQ ID NO: 467189 - DNA, 16 bp, R. norvegicus
aagagtctgcctaagg

SEQ ID NO: 467190 - DNA, 16 bp, R. norvegicus
aagagtggccttggtc

SEQ ID NO: 467191 - DNA, 16 bp, R. norvegicus
aagagtgtctgggaag

SEQ ID NO: 467192 - DNA, 16 bp, R. norvegicus
aagagttagagaaagg

SEQ ID NO: 467193 - DNA, 16 bp, R. norvegicus
aagagttagaggaaga

SEQ ID NO: 467194 - DNA, 16 bp, R. norvegicus
aagagttagatgcaga

SEQ ID NO: 467195 - DNA, 16 bp, R. norvegicus
aagagttcaaggtcac

SEQ ID NO: 467196 - DNA, 16 bp, R. norvegicus
aagagttgagcagaga

SEQ ID NO: 467197 - DNA, 16 bp, R. norvegicus
aagagtttgaaggagc

SEQ ID NO: 467198 - DNA, 16 bp, R. norvegicus
aagataaaaaagtcag

SEQ ID NO: 467199 - DNA, 16 bp, R. norvegicus
aagataaaaatctcaa

SEQ ID NO: 467200 - DNA, 16 bp, R. norvegicus
aagataaaggagcaca

SEQ ID NO: 467201 - DNA, 16 bp, R. norvegicus
aagatacaaattggaa

SEQ ID NO: 467202 - DNA, 16 bp, R. norvegicus
aagatacaaggagctg

SEQ ID NO: 467203 - DNA, 16 bp, R. norvegicus
aagatacagactaaca

SEQ ID NO: 467204 - DNA, 17 bp, R. norvegicus
aagatacagtccacaga

SEQ ID NO: 467205 - DNA, 16 bp, R. norvegicus
aagatacatttaaaaa

SEQ ID NO: 467206 - DNA, 16 bp, R. norvegicus
aagatacccttggcag

SEQ ID NO: 467207 - DNA, 16 bp, R. norvegicus
aagatactgaaagaaa

SEQ ID NO: 467208 - DNA, 16 bp, R. norvegicus
aagataggaaatgtca

SEQ ID NO: 467209 - DNA, 16 bp, R. norvegicus
aagatatagcagcatt

SEQ ID NO: 467210 - DNA, 16 bp, R. norvegicus
aagatatatgtatata

SEQ ID NO: 467211 - DNA, 16 bp, R. norvegicus
aagatatatttcttta

SEQ ID NO: 467212 - DNA, 16 bp, R. norvegicus
aagatatgattttaaa

SEQ ID NO: 467213 - DNA, 18 bp, R. norvegicus
aagatattcaatgacaaa

SEQ ID NO: 467214 - DNA, 16 bp, R. norvegicus
aagatattccatggca

SEQ ID NO: 467215 - DNA, 16 bp, R. norvegicus
aagatattgttaagat

SEQ ID NO: 467216 - DNA, 16 bp, R. norvegicus
aagatcaaaaactcaa

SEQ ID NO: 467217 - DNA, 16 bp, R. norvegicus
aagatcaaaaatcgac

SEQ ID NO: 467218 - DNA, 19 bp, R. norvegicus
aagatcaaagactcaggtg

SEQ ID NO: 467219 - DNA, 16 bp, R. norvegicus
aagatcaaatctcagg

SEQ ID NO: 467220 - DNA, 24 bp, R. norvegicus
aagatcaagaatcgacaaatgggg

SEQ ID NO: 467221 - DNA, 16 bp, R. norvegicus
aagatcaagatttaaa

SEQ ID NO: 467222 - DNA, 16 bp, R. norvegicus
aagatcaaggagagga

SEQ ID NO: 467223 - DNA, 16 bp, R. norvegicus
aagatcaagtgtgcat

SEQ ID NO: 467224 - DNA, 16 bp, R. norvegicus
aagatcacaacctgtt

SEQ ID NO: 467225 - DNA, 16 bp, R. norvegicus
aagatcagaaactcag

SEQ ID NO: 467226 - DNA, 34 bp, R. norvegicus
aagatcagaaatgctgtcaacaggctataaaaaa

SEQ ID NO: 467227 - DNA, 16 bp, R. norvegicus
aagatcagcaaagaaa

SEQ ID NO: 467228 - DNA, 16 bp, R. norvegicus
aagatccaaaaatgaa

SEQ ID NO: 467229 - DNA, 16 bp, R. norvegicus
aagatccacctgcctc

SEQ ID NO: 467230 - DNA, 16 bp, R. norvegicus
aagatccacttggact

SEQ ID NO: 467231 - DNA, 16 bp, R. norvegicus
aagatccagctcctgg

SEQ ID NO: 467232 - DNA, 16 bp, R. norvegicus
aagatccaggcagcag

SEQ ID NO: 467233 - DNA, 16 bp, R. norvegicus
aagatccatgtcagaa

SEQ ID NO: 467234 - DNA, 16 bp, R. norvegicus
aagatcccacgctgta

SEQ ID NO: 467235 - DNA, 16 bp, R. norvegicus
aagatcctcctgtctc

SEQ ID NO: 467236 - DNA, 16 bp, R. norvegicus
aagatccttcaactct

SEQ ID NO: 467237 - DNA, 16 bp, R. norvegicus
aagatctatatccagt

SEQ ID NO: 467238 - DNA, 16 bp, R. norvegicus
aagatctatgacttca

SEQ ID NO: 467239 - DNA, 16 bp, R. norvegicus
aagatctcacaagatg

SEQ ID NO: 467240 - DNA, 16 bp, R. norvegicus
aagatctcagaaaata

SEQ ID NO: 467241 - DNA, 16 bp, R. norvegicus
aagatctcagaaggtg

SEQ ID NO: 467242 - DNA, 16 bp, R. norvegicus
aagatctgaaaatgga

SEQ ID NO: 467243 - DNA, 16 bp, R. norvegicus
aagatctggaagagct

SEQ ID NO: 467244 - DNA, 16 bp, R. norvegicus
aagatctggtgatttt

SEQ ID NO: 467245 - DNA, 16 bp, R. norvegicus
aagatctgtgctgccc

SEQ ID NO: 467246 - DNA, 16 bp, R. norvegicus
aagatcttattgtaca

SEQ ID NO: 467247 - DNA, 16 bp, R. norvegicus
aagatcttcaccaact

SEQ ID NO: 467248 - DNA, 16 bp, R. norvegicus
aagatcttcctggttg

SEQ ID NO: 467249 - DNA, 16 bp, R. norvegicus
aagatcttgtgtggca

SEQ ID NO: 467250 - DNA, 16 bp, R. norvegicus
aagatctttacccaat

SEQ ID NO: 467251 - DNA, 16 bp, R. norvegicus
aagatgaaaaaatctc

SEQ ID NO: 467252 - DNA, 16 bp, R. norvegicus
aagatgaactctcact

SEQ ID NO: 467253 - DNA, 16 bp, R. norvegicus
aagatgaactttcaat

SEQ ID NO: 467254 - DNA, 16 bp, R. norvegicus
aagatgaagaaaacag

SEQ ID NO: 467255 - DNA, 16 bp, R. norvegicus
aagatgaagaactctc

SEQ ID NO: 467256 - DNA, 16 bp, R. norvegicus
aagatgaagacgaaga

SEQ ID NO: 467257 - DNA, 16 bp, R. norvegicus
aagatgaagcaaaaac

SEQ ID NO: 467258 - DNA, 16 bp, R. norvegicus
aagatgaagcagagac

SEQ ID NO: 467259 - DNA, 16 bp, R. norvegicus
aagatgaaggcagaga

SEQ ID NO: 467260 - DNA, 16 bp, R. norvegicus
aagatgaccttgagtt

SEQ ID NO: 467261 - DNA, 16 bp, R. norvegicus
aagatgagaaacagaa

SEQ ID NO: 467262 - DNA, 16 bp, R. norvegicus
aagatgagaaattcaa

SEQ ID NO: 467263 - DNA, 17 bp, R. norvegicus
aagatgagagaggaaca

SEQ ID NO: 467264 - DNA, 16 bp, R. norvegicus
aagatgaggaaactga

SEQ ID NO: 467265 - DNA, 16 bp, R. norvegicus
aagatgaggaaagaca

SEQ ID NO: 467266 - DNA, 16 bp, R. norvegicus
aagatgaggaagatga

SEQ ID NO: 467267 - DNA, 16 bp, R. norvegicus
aagatgatctcagaag

SEQ ID NO: 467268 - DNA, 16 bp, R. norvegicus
aagatgatgatgaaga

SEQ ID NO: 467269 - DNA, 16 bp, R. norvegicus
aagatgattttctttt

SEQ ID NO: 467270 - DNA, 16 bp, R. norvegicus
aagatgcagaaatgaa

SEQ ID NO: 467271 - DNA, 16 bp, R. norvegicus
aagatgccatagaaaa

SEQ ID NO: 467272 - DNA, 16 bp, R. norvegicus
aagatgctccagcata

SEQ ID NO: 467273 - DNA, 16 bp, R. norvegicus
aagatgctttcctttt

SEQ ID NO: 467274 - DNA, 16 bp, R. norvegicus
aagatggaaaactcca

SEQ ID NO: 467275 - DNA, 16 bp, R. norvegicus
aagatggaaagacatc

SEQ ID NO: 467276 - DNA, 16 bp, R. norvegicus
aagatggagacagaaa

SEQ ID NO: 467277 - DNA, 16 bp, R. norvegicus
aagatggagacagaga

SEQ ID NO: 467278 - DNA, 16 bp, R. norvegicus
aagatggagacaggag

SEQ ID NO: 467279 - DNA, 16 bp, R. norvegicus
aagatggagacaggga

SEQ ID NO: 467280 - DNA, 16 bp, R. norvegicus
aagatggagacggaga

SEQ ID NO: 467281 - DNA, 16 bp, R. norvegicus
aagatggagatggaga

SEQ ID NO: 467282 - DNA, 16 bp, R. norvegicus
aagatggataaagcaa

SEQ ID NO: 467283 - DNA, 16 bp, R. norvegicus
aagatggatcaagcaa

SEQ ID NO: 467284 - DNA, 21 bp, R. norvegicus
aagatggatgaagcaaagaag

SEQ ID NO: 467285 - DNA, 18 bp, R. norvegicus
aagatggatgaatcaaag

SEQ ID NO: 467286 - DNA, 16 bp, R. norvegicus
aagatggctcaacagt

SEQ ID NO: 467287 - DNA, 16 bp, R. norvegicus
aagatggctcagcact

SEQ ID NO: 467288 - DNA, 16 bp, R. norvegicus
aagatggctgctgtaa

SEQ ID NO: 467289 - DNA, 16 bp, R. norvegicus
aagatggggcatcaag

SEQ ID NO: 467290 - DNA, 16 bp, R. norvegicus
aagatggtgctggttt

SEQ ID NO: 467291 - DNA, 16 bp, R. norvegicus
aagatggtggtggtgg

SEQ ID NO: 467292 - DNA, 16 bp, R. norvegicus
aagatgttcagggata

SEQ ID NO: 467293 - DNA, 17 bp, R. norvegicus
aagatgttgaatatttc

SEQ ID NO: 467294 - DNA, 16 bp, R. norvegicus
aagattaaaacagtga

SEQ ID NO: 467295 - DNA, 16 bp, R. norvegicus
aagattagaacatatt

SEQ ID NO: 467296 - DNA, 16 bp, R. norvegicus
aagattcagaaatgaa

SEQ ID NO: 467297 - DNA, 16 bp, R. norvegicus
aagattccacccagct

SEQ ID NO: 467298 - DNA, 17 bp, R. norvegicus
aagattcccagctcaaa

SEQ ID NO: 467299 - DNA, 16 bp, R. norvegicus
aagattccccttcatc

SEQ ID NO: 467300 - DNA, 27 bp, R. norvegicus
aagattccctcctttgtgccaatccca

SEQ ID NO: 467301 - DNA, 16 bp, R. norvegicus
aagattccttacagct

SEQ ID NO: 467302 - DNA, 16 bp, R. norvegicus
aagattctcctgtctc

SEQ ID NO: 467303 - DNA, 16 bp, R. norvegicus
aagattctgtggtttt

SEQ ID NO: 467304 - DNA, 16 bp, R. norvegicus
aagattgggaggggaa

SEQ ID NO: 467305 - DNA, 16 bp, R. norvegicus
aagatttcctctgctg

SEQ ID NO: 467306 - DNA, 16 bp, R. norvegicus
aagatttggacttaaa

SEQ ID NO: 467307 - DNA, 16 bp, R. norvegicus
aagattttatttttca

SEQ ID NO: 467308 - DNA, 16 bp, R. norvegicus
aagattttcaattttt

SEQ ID NO: 467309 - DNA, 16 bp, R. norvegicus
aagattttccatgaca

SEQ ID NO: 467310 - DNA, 16 bp, R. norvegicus
aagatttttttcccca

SEQ ID NO: 467311 - DNA, 16 bp, R. norvegicus
aagattttttttttcc

SEQ ID NO: 467312 - DNA, 16 bp, R. norvegicus
aagcaaaaggctccca

SEQ ID NO: 467313 - DNA, 16 bp, R. norvegicus
aagcaaacagacagac

SEQ ID NO: 467314 - DNA, 16 bp, R. norvegicus
aagcaaacaggctgta

SEQ ID NO: 467315 - DNA, 16 bp, R. norvegicus
aagcaaactgcccata

SEQ ID NO: 467316 - DNA, 16 bp, R. norvegicus
aagcaaagaacactgt

SEQ ID NO: 467317 - DNA, 16 bp, R. norvegicus
aagcaaagaagtccag

SEQ ID NO: 467318 - DNA, 16 bp, R. norvegicus
aagcaaagacaggcag

SEQ ID NO: 467319 - DNA, 16 bp, R. norvegicus
aagcaaagtgcaggcc

SEQ ID NO: 467320 - DNA, 16 bp, R. norvegicus
aagcaaagtttggagc

SEQ ID NO: 467321 - DNA, 16 bp, R. norvegicus
aagcaaataaaccagc

SEQ ID NO: 467322 - DNA, 17 bp, R. norvegicus
aagcaaatgaaagatct

SEQ ID NO: 467323 - DNA, 16 bp, R. norvegicus
aagcaaatgaatggaa

SEQ ID NO: 467324 - DNA, 16 bp, R. norvegicus
aagcaaatggaagaaa

SEQ ID NO: 467325 - DNA, 16 bp, R. norvegicus
aagcaaatggatgaaa

SEQ ID NO: 467326 - DNA, 16 bp, R. norvegicus
aagcaaatggccccaa

SEQ ID NO: 467327 - DNA, 16 bp, R. norvegicus
aagcaaatggtaagaa

SEQ ID NO: 467328 - DNA, 16 bp, R. norvegicus
aagcaaatggttggaa

SEQ ID NO: 467329 - DNA, 16 bp, R. norvegicus
aagcaacaacagcagc

SEQ ID NO: 467330 - DNA, 16 bp, R. norvegicus
aagcaacaagagcttc

SEQ ID NO: 467331 - DNA, 16 bp, R. norvegicus
aagcaacagaagtcaa

SEQ ID NO: 467332 - DNA, 16 bp, R. norvegicus
aagcaacagcttttgg

SEQ ID NO: 467333 - DNA, 16 bp, R. norvegicus
aagcaaccagaggttc

SEQ ID NO: 467334 - DNA, 16 bp, R. norvegicus
aagcaaccccaaaatt

SEQ ID NO: 467335 - DNA, 16 bp, R. norvegicus
aagcaactcagggagg

SEQ ID NO: 467336 - DNA, 16 bp, R. norvegicus
aagcaactgaggaaga

SEQ ID NO: 467337 - DNA, 16 bp, R. norvegicus
aagcaacttgaagaag

SEQ ID NO: 467338 - DNA, 16 bp, R. norvegicus
aagcaagaaacaaatc

SEQ ID NO: 467339 - DNA, 16 bp, R. norvegicus
aagcaagaaactaaac

SEQ ID NO: 467340 - DNA, 16 bp, R. norvegicus
aagcaagaggaccaga

SEQ ID NO: 467341 - DNA, 16 bp, R. norvegicus
aagcaagatttgtatt

SEQ ID NO: 467342 - DNA, 16 bp, R. norvegicus
aagcaagcaagcaggg

SEQ ID NO: 467343 - DNA, 16 bp, R. norvegicus
aagcaagcaagctgag

SEQ ID NO: 467344 - DNA, 16 bp, R. norvegicus
aagcaagcaggcaagc

SEQ ID NO: 467345 - DNA, 16 bp, R. norvegicus
aagcaagctggagaag

SEQ ID NO: 467346 - DNA, 16 bp, R. norvegicus
aagcaagtaaaaaatt

SEQ ID NO: 467347 - DNA, 16 bp, R. norvegicus
aagcaataaacagcaa

SEQ ID NO: 467348 - DNA, 16 bp, R. norvegicus
aagcaataatttttat

SEQ ID NO: 467349 - DNA, 16 bp, R. norvegicus
aagcaatcattaaaat

SEQ ID NO: 467350 - DNA, 16 bp, R. norvegicus
aagcaatcccaataaa

SEQ ID NO: 467351 - DNA, 16 bp, R. norvegicus
aagcacaaagccctgg

SEQ ID NO: 467352 - DNA, 16 bp, R. norvegicus
aagcacaatggaaaaa

SEQ ID NO: 467353 - DNA, 16 bp, R. norvegicus
aagcacacacacatgt

SEQ ID NO: 467354 - DNA, 16 bp, R. norvegicus
aagcacacacagacac

SEQ ID NO: 467355 - DNA, 16 bp, R. norvegicus
aagcacaccacagcat

SEQ ID NO: 467356 - DNA, 16 bp, R. norvegicus
aagcacagaaaacatc

SEQ ID NO: 467357 - DNA, 16 bp, R. norvegicus
aagcacagacacacac

SEQ ID NO: 467358 - DNA, 16 bp, R. norvegicus
aagcacagggacctga

SEQ ID NO: 467359 - DNA, 16 bp, R. norvegicus
aagcacagtggataaa

SEQ ID NO: 467360 - DNA, 16 bp, R. norvegicus
aagcacatcctcttcc

SEQ ID NO: 467361 - DNA, 16 bp, R. norvegicus
aagcaccaatgcacat

SEQ ID NO: 467362 - DNA, 17 bp, R. norvegicus
aagcaccagtggaaggg

SEQ ID NO: 467363 - DNA, 16 bp, R. norvegicus
aagcaccatgatcaaa

SEQ ID NO: 467364 - DNA, 16 bp, R. norvegicus
aagcacccagctgacc

SEQ ID NO: 467365 - DNA, 16 bp, R. norvegicus
aagcaccttcacctgc

SEQ ID NO: 467366 - DNA, 16 bp, R. norvegicus
aagcacgaggacctga

SEQ ID NO: 467367 - DNA, 16 bp, R. norvegicus
aagcactcaaacacat

SEQ ID NO: 467368 - DNA, 16 bp, R. norvegicus
aagcactgaaggagct

SEQ ID NO: 467369 - DNA, 16 bp, R. norvegicus
aagcacttaagaaatg

SEQ ID NO: 467370 - DNA, 16 bp, R. norvegicus
aagcagaaagcaagca

SEQ ID NO: 467371 - DNA, 16 bp, R. norvegicus
aagcagaaagcagcag

SEQ ID NO: 467372 - DNA, 16 bp, R. norvegicus
aagcagaaagttctca

SEQ ID NO: 467373 - DNA, 16 bp, R. norvegicus
aagcagaactgcaggt

SEQ ID NO: 467374 - DNA, 16 bp, R. norvegicus
aagcagaagcaagagg

SEQ ID NO: 467375 - DNA, 16 bp, R. norvegicus
aagcagaagcagaggc

SEQ ID NO: 467376 - DNA, 16 bp, R. norvegicus
aagcagaagcagcaga

SEQ ID NO: 467377 - DNA, 16 bp, R. norvegicus
aagcagaagcaggaag

SEQ ID NO: 467378 - DNA, 17 bp, R. norvegicus
aagcagaagcctataga

SEQ ID NO: 467379 - DNA, 19 bp, R. norvegicus
aagcagaagctcatctgaa

SEQ ID NO: 467380 - DNA, 16 bp, R. norvegicus
aagcagaagctggaaa

SEQ ID NO: 467381 - DNA, 16 bp, R. norvegicus
aagcagaaggcagaga

SEQ ID NO: 467382 - DNA, 16 bp, R. norvegicus
aagcagaaggccctgg

SEQ ID NO: 467383 - DNA, 16 bp, R. norvegicus
aagcagacacagaagg

SEQ ID NO: 467384 - DNA, 16 bp, R. norvegicus
aagcagaccaggaagc

SEQ ID NO: 467385 - DNA, 16 bp, R. norvegicus
aagcagactgaggaag

SEQ ID NO: 467386 - DNA, 16 bp, R. norvegicus
aagcagagaaaggact

SEQ ID NO: 467387 - DNA, 16 bp, R. norvegicus
aagcagagaagcagag

SEQ ID NO: 467388 - DNA, 16 bp, R. norvegicus
aagcagagacagaggg

SEQ ID NO: 467389 - DNA, 16 bp, R. norvegicus
aagcagagaccacaga

SEQ ID NO: 467390 - DNA, 16 bp, R. norvegicus
aagcagagaccatgaa

SEQ ID NO: 467391 - DNA, 16 bp, R. norvegicus
aagcagagagacagag

SEQ ID NO: 467392 - DNA, 16 bp, R. norvegicus
aagcagagagacagga

SEQ ID NO: 467393 - DNA, 16 bp, R. norvegicus
aagcagagagaggtga

SEQ ID NO: 467394 - DNA, 16 bp, R. norvegicus
aagcagagagcacaga

SEQ ID NO: 467395 - DNA, 16 bp, R. norvegicus
aagcagagagcagagg

SEQ ID NO: 467396 - DNA, 16 bp, R. norvegicus
aagcagagccaggcag

SEQ ID NO: 467397 - DNA, 16 bp, R. norvegicus
aagcagaggacacaga

SEQ ID NO: 467398 - DNA, 16 bp, R. norvegicus
aagcagaggcagaaag

SEQ ID NO: 467399 - DNA, 16 bp, R. norvegicus
aagcagaggcaggcgg

SEQ ID NO: 467400 - DNA, 16 bp, R. norvegicus
aagcagaggccagaag

SEQ ID NO: 467401 - DNA, 16 bp, R. norvegicus
aagcagaggccttgga

SEQ ID NO: 467402 - DNA, 16 bp, R. norvegicus
aagcagagggcagagg

SEQ ID NO: 467403 - DNA, 16 bp, R. norvegicus
aagcagatgctggcaa

SEQ ID NO: 467404 - DNA, 16 bp, R. norvegicus
aagcagcaagaagctg

SEQ ID NO: 467405 - DNA, 16 bp, R. norvegicus
aagcagcaatcacaga

SEQ ID NO: 467406 - DNA, 16 bp, R. norvegicus
aagcagcaccactcca

SEQ ID NO: 467407 - DNA, 16 bp, R. norvegicus
aagcagcaccagacca

SEQ ID NO: 467408 - DNA, 16 bp, R. norvegicus
aagcagcacctgcagc

SEQ ID NO: 467409 - DNA, 16 bp, R. norvegicus
aagcagcactcctcca

SEQ ID NO: 467410 - DNA, 16 bp, R. norvegicus
aagcagcagcaacaaa

SEQ ID NO: 467411 - DNA, 16 bp, R. norvegicus
aagcagcagcaacagc

SEQ ID NO: 467412 - DNA, 16 bp, R. norvegicus
aagcagcagcagaaga

SEQ ID NO: 467413 - DNA, 16 bp, R. norvegicus
aagcagcagcagcaac

SEQ ID NO: 467414 - DNA, 16 bp, R. norvegicus
aagcagcagcagcaga

SEQ ID NO: 467415 - DNA, 16 bp, R. norvegicus
aagcagcagcagcagt

SEQ ID NO: 467416 - DNA, 16 bp, R. norvegicus
aagcagcaggaagaga

SEQ ID NO: 467417 - DNA, 16 bp, R. norvegicus
aagcagcaggcacagc

SEQ ID NO: 467418 - DNA, 16 bp, R. norvegicus
aagcagcaggcagcag

SEQ ID NO: 467419 - DNA, 16 bp, R. norvegicus
aagcagccatgtttaa

SEQ ID NO: 467420 - DNA, 16 bp, R. norvegicus
aagcagcctggaaaaa

SEQ ID NO: 467421 - DNA, 30 bp, R. norvegicus
aagcagctaaggttaagctgcagtttgggc

SEQ ID NO: 467422 - DNA, 16 bp, R. norvegicus
aagcagctgaaagaat

SEQ ID NO: 467423 - DNA, 16 bp, R. norvegicus
aagcagctgaaggagt

SEQ ID NO: 467424 - DNA, 18 bp, R. norvegicus
aagcagctgacaaaagaa

SEQ ID NO: 467425 - DNA, 16 bp, R. norvegicus
aagcagctgacagaga

SEQ ID NO: 467426 - DNA, 16 bp, R. norvegicus
aagcagctggaagagt

SEQ ID NO: 467427 - DNA, 16 bp, R. norvegicus
aagcaggaaggaagtg

SEQ ID NO: 467428 - DNA, 16 bp, R. norvegicus
aagcaggagacagaga

SEQ ID NO: 467429 - DNA, 16 bp, R. norvegicus
aagcaggagatgctca

SEQ ID NO: 467430 - DNA, 16 bp, R. norvegicus
aagcaggagctgaagc

SEQ ID NO: 467431 - DNA, 16 bp, R. norvegicus
aagcaggagctggtgc

SEQ ID NO: 467432 - DNA, 16 bp, R. norvegicus
aagcaggaggaccaga

SEQ ID NO: 467433 - DNA, 16 bp, R. norvegicus
aagcaggaggcagaga

SEQ ID NO: 467434 - DNA, 16 bp, R. norvegicus
aagcaggcaggtctct

SEQ ID NO: 467435 - DNA, 16 bp, R. norvegicus
aagcaggcagtgctct

SEQ ID NO: 467436 - DNA, 16 bp, R. norvegicus
aagcaggctaagaaag

SEQ ID NO: 467437 - DNA, 16 bp, R. norvegicus
aagcaggctcagcaag

SEQ ID NO: 467438 - DNA, 16 bp, R. norvegicus
aagcaggctgaagaag

SEQ ID NO: 467439 - DNA, 16 bp, R. norvegicus
aagcagggctcacagg

SEQ ID NO: 467440 - DNA, 16 bp, R. norvegicus
aagcagggctcatggg

SEQ ID NO: 467441 - DNA, 16 bp, R. norvegicus
aagcaggtagaaaaaa

SEQ ID NO: 467442 - DNA, 16 bp, R. norvegicus
aagcaggtgaagaaga

SEQ ID NO: 467443 - DNA, 16 bp, R. norvegicus
aagcaggtgaaggaaa

SEQ ID NO: 467444 - DNA, 16 bp, R. norvegicus
aagcagtgattctcaa

SEQ ID NO: 467445 - DNA, 16 bp, R. norvegicus
aagcagtgcttagagg

SEQ ID NO: 467446 - DNA, 16 bp, R. norvegicus
aagcagttattaaaag

SEQ ID NO: 467447 - DNA, 16 bp, R. norvegicus
aagcagttccaccaac

SEQ ID NO: 467448 - DNA, 16 bp, R. norvegicus
aagcagttcttggcat

SEQ ID NO: 467449 - DNA, 16 bp, R. norvegicus
aagcataataaaagca

SEQ ID NO: 467450 - DNA, 16 bp, R. norvegicus
aagcatagcaaaatat

SEQ ID NO: 467451 - DNA, 16 bp, R. norvegicus
aagcatattcaaacca

SEQ ID NO: 467452 - DNA, 16 bp, R. norvegicus
aagcatcaccaacaaa

SEQ ID NO: 467453 - DNA, 16 bp, R. norvegicus
aagcatccacaccctg

SEQ ID NO: 467454 - DNA, 16 bp, R. norvegicus
aagcatcctcccttgg

SEQ ID NO: 467455 - DNA, 16 bp, R. norvegicus
aagcatccttgcttgt

SEQ ID NO: 467456 - DNA, 16 bp, R. norvegicus
aagcatctcaggagac

SEQ ID NO: 467457 - DNA, 16 bp, R. norvegicus
aagcatcttaatttgt

SEQ ID NO: 467458 - DNA, 16 bp, R. norvegicus
aagcatgaagacctga

SEQ ID NO: 467459 - DNA, 16 bp, R. norvegicus
aagcatgaggccctga

SEQ ID NO: 467460 - DNA, 16 bp, R. norvegicus
aagcatgcatgaatac

SEQ ID NO: 467461 - DNA, 16 bp, R. norvegicus
aagcatggagacctga

SEQ ID NO: 467462 - DNA, 16 bp, R. norvegicus
aagcatggggtcagaa

SEQ ID NO: 467463 - DNA, 16 bp, R. norvegicus
aagcatgtggagaaag

SEQ ID NO: 467464 - DNA, 16 bp, R. norvegicus
aagcatgtgtgtcagg

SEQ ID NO: 467465 - DNA, 16 bp, R. norvegicus
aagcattaaaatatat

SEQ ID NO: 467466 - DNA, 16 bp, R. norvegicus
aagcattcaaatacat

SEQ ID NO: 467467 - DNA, 16 bp, R. norvegicus
aagcatttaattggag

SEQ ID NO: 467468 - DNA, 16 bp, R. norvegicus
aagcatttcagtttca

SEQ ID NO: 467469 - DNA, 16 bp, R. norvegicus
aagcatttgaaaacat

SEQ ID NO: 467470 - DNA, 16 bp, R. norvegicus
aagcatttgacaaaac

SEQ ID NO: 467471 - DNA, 16 bp, R. norvegicus
aagcattttgtcacag

SEQ ID NO: 467472 - DNA, 16 bp, R. norvegicus
aagccaaatgctggca

SEQ ID NO: 467473 - DNA, 16 bp, R. norvegicus
aagccaacatccccct

SEQ ID NO: 467474 - DNA, 16 bp, R. norvegicus
aagccaagcatggtgg

SEQ ID NO: 467475 - DNA, 16 bp, R. norvegicus
aagccaaggaagaaat

SEQ ID NO: 467476 - DNA, 16 bp, R. norvegicus
aagccaaggatgacct

SEQ ID NO: 467477 - DNA, 16 bp, R. norvegicus
aagccaaggccctggg

SEQ ID NO: 467478 - DNA, 16 bp, R. norvegicus
aagccaataagcaaca

SEQ ID NO: 467479 - DNA, 16 bp, R. norvegicus
aagccaatctggtcta

SEQ ID NO: 467480 - DNA, 16 bp, R. norvegicus
aagccacaaactcagg

SEQ ID NO: 467481 - DNA, 16 bp, R. norvegicus
aagccacagaggaatg

SEQ ID NO: 467482 - DNA, 16 bp, R. norvegicus
aagccacagttatgct

SEQ ID NO: 467483 - DNA, 16 bp, R. norvegicus
aagccacatccccagc

SEQ ID NO: 467484 - DNA, 16 bp, R. norvegicus
aagccaccaagatgaa

SEQ ID NO: 467485 - DNA, 16 bp, R. norvegicus
aagccaccctgggcta

SEQ ID NO: 467486 - DNA, 16 bp, R. norvegicus
aagccactgtcaaaga

SEQ ID NO: 467487 - DNA, 16 bp, R. norvegicus
aagccactttcagagt

SEQ ID NO: 467488 - DNA, 16 bp, R. norvegicus
aagccagaaaagacta

SEQ ID NO: 467489 - DNA, 16 bp, R. norvegicus
aagccagaagagggtg

SEQ ID NO: 467490 - DNA, 16 bp, R. norvegicus
aagccagaagctcctg

SEQ ID NO: 467491 - DNA, 16 bp, R. norvegicus
aagccagagacctcaa

SEQ ID NO: 467492 - DNA, 16 bp, R. norvegicus
aagccagcagatcctg

SEQ ID NO: 467493 - DNA, 16 bp, R. norvegicus
aagccagccccaactg

SEQ ID NO: 467494 - DNA, 16 bp, R. norvegicus
aagccagccccagtta

SEQ ID NO: 467495 - DNA, 16 bp, R. norvegicus
aagccagcgccaggct

SEQ ID NO: 467496 - DNA, 16 bp, R. norvegicus
aagccagctcagtcaa

SEQ ID NO: 467497 - DNA, 16 bp, R. norvegicus
aagccagctctccagc

SEQ ID NO: 467498 - DNA, 16 bp, R. norvegicus
aagccagcttggacta

SEQ ID NO: 467499 - DNA, 16 bp, R. norvegicus
aagccaggaaaagcaa

SEQ ID NO: 467500 - DNA, 16 bp, R. norvegicus
aagccaggaagcagtg

SEQ ID NO: 467501 - DNA, 16 bp, R. norvegicus
aagccaggagcagact

SEQ ID NO: 467502 - DNA, 16 bp, R. norvegicus
aagccaggcacagtag

SEQ ID NO: 467503 - DNA, 16 bp, R. norvegicus
aagccaggcccagtgt

SEQ ID NO: 467504 - DNA, 16 bp, R. norvegicus
aagccagggagagcaa

SEQ ID NO: 467505 - DNA, 16 bp, R. norvegicus
aagccaggtgtggtag

SEQ ID NO: 467506 - DNA, 16 bp, R. norvegicus
aagccagtaaacaaca

SEQ ID NO: 467507 - DNA, 16 bp, R. norvegicus
aagccagtacctaaag

SEQ ID NO: 467508 - DNA, 16 bp, R. norvegicus
aagccagtcttctcct

SEQ ID NO: 467509 - DNA, 16 bp, R. norvegicus
aagccagtgaacagca

SEQ ID NO: 467510 - DNA, 16 bp, R. norvegicus
aagccataaagaaaag

SEQ ID NO: 467511 - DNA, 16 bp, R. norvegicus
aagccatcatctgcta

SEQ ID NO: 467512 - DNA, 16 bp, R. norvegicus
aagccatccctgcatg

SEQ ID NO: 467513 - DNA, 16 bp, R. norvegicus
aagccatcctctgcta

SEQ ID NO: 467514 - DNA, 16 bp, R. norvegicus
aagccatctctccagg

SEQ ID NO: 467515 - DNA, 16 bp, R. norvegicus
aagccatctggacctg

SEQ ID NO: 467516 - DNA, 16 bp, R. norvegicus
aagccatgaggaacaa

SEQ ID NO: 467517 - DNA, 16 bp, R. norvegicus
aagccatgaggagcaa

SEQ ID NO: 467518 - DNA, 16 bp, R. norvegicus
aagccatgatgaacaa

SEQ ID NO: 467519 - DNA, 16 bp, R. norvegicus
aagcccaacaaagacc

SEQ ID NO: 467520 - DNA, 16 bp, R. norvegicus
aagcccaagaagaaag

SEQ ID NO: 467521 - DNA, 16 bp, R. norvegicus
aagcccaagatgccaa

SEQ ID NO: 467522 - DNA, 16 bp, R. norvegicus
aagcccaaggccctgg

SEQ ID NO: 467523 - DNA, 16 bp, R. norvegicus
aagcccaaggtcctgg

SEQ ID NO: 467524 - DNA, 16 bp, R. norvegicus
aagcccaatgaccaga

SEQ ID NO: 467525 - DNA, 16 bp, R. norvegicus
aagcccaatgacctga

SEQ ID NO: 467526 - DNA, 16 bp, R. norvegicus
aagcccacaaccacag

SEQ ID NO: 467527 - DNA, 16 bp, R. norvegicus
aagcccacagccacag

SEQ ID NO: 467528 - DNA, 16 bp, R. norvegicus
aagcccagaagatcat

SEQ ID NO: 467529 - DNA, 16 bp, R. norvegicus
aagcccagcccagccc

SEQ ID NO: 467530 - DNA, 16 bp, R. norvegicus
aagcccaggcccacag

SEQ ID NO: 467531 - DNA, 16 bp, R. norvegicus
aagcccatcctcagtg

SEQ ID NO: 467532 - DNA, 16 bp, R. norvegicus
aagcccatggtcctgt

SEQ ID NO: 467533 - DNA, 16 bp, R. norvegicus
aagccccaaatacctc

SEQ ID NO: 467534 - DNA, 17 bp, R. norvegicus
aagcccctaaagaggaa

SEQ ID NO: 467535 - DNA, 16 bp, R. norvegicus
aagcccctagaaacag

SEQ ID NO: 467536 - DNA, 16 bp, R. norvegicus
aagcccctccacatgc

SEQ ID NO: 467537 - DNA, 16 bp, R. norvegicus
aagccccttcaaggtc

SEQ ID NO: 467538 - DNA, 16 bp, R. norvegicus
aagccctatgtatgtg

SEQ ID NO: 467539 - DNA, 16 bp, R. norvegicus
aagccctcctggttgc

SEQ ID NO: 467540 - DNA, 16 bp, R. norvegicus
aagccctggattcaat

SEQ ID NO: 467541 - DNA, 16 bp, R. norvegicus
aagccctgggacctgc

SEQ ID NO: 467542 - DNA, 16 bp, R. norvegicus
aagccctggttcctgc

SEQ ID NO: 467543 - DNA, 16 bp, R. norvegicus
aagcccttcagctcct

SEQ ID NO: 467544 - DNA, 16 bp, R. norvegicus
aagcccttgattctgc

SEQ ID NO: 467545 - DNA, 16 bp, R. norvegicus
aagcctatagaaagga

SEQ ID NO: 467546 - DNA, 16 bp, R. norvegicus
aagcctcaccaacaaa

SEQ ID NO: 467547 - DNA, 16 bp, R. norvegicus
aagcctcagaagaaag

SEQ ID NO: 467548 - DNA, 16 bp, R. norvegicus
aagcctctcaggaaac

SEQ ID NO: 467549 - DNA, 16 bp, R. norvegicus
aagcctctgaacctgt

SEQ ID NO: 467550 - DNA, 16 bp, R. norvegicus
aagcctctgtaataaa

SEQ ID NO: 467551 - DNA, 16 bp, R. norvegicus
aagcctgatcacctga

SEQ ID NO: 467552 - DNA, 16 bp, R. norvegicus
aagcctgcaagggagg

SEQ ID NO: 467553 - DNA, 16 bp, R. norvegicus
aagcctgcagcccctt

SEQ ID NO: 467554 - DNA, 16 bp, R. norvegicus
aagcctgcaggattaa

SEQ ID NO: 467555 - DNA, 16 bp, R. norvegicus
aagcctggcttccagg

SEQ ID NO: 467556 - DNA, 16 bp, R. norvegicus
aagcctgggaaagttc

SEQ ID NO: 467557 - DNA, 16 bp, R. norvegicus
aagcctgggctacaaa

SEQ ID NO: 467558 - DNA, 16 bp, R. norvegicus
aagcctggggctggag

SEQ ID NO: 467559 - DNA, 16 bp, R. norvegicus
aagcctggtgacctgg

SEQ ID NO: 467560 - DNA, 16 bp, R. norvegicus
aagcctgtgggacatt

SEQ ID NO: 467561 - DNA, 17 bp, R. norvegicus
aagccttatttataata

SEQ ID NO: 467562 - DNA, 16 bp, R. norvegicus
aagccttcaacacatg

SEQ ID NO: 467563 - DNA, 16 bp, R. norvegicus
aagccttcacaggaca

SEQ ID NO: 467564 - DNA, 16 bp, R. norvegicus
aagccttcatagaaga

SEQ ID NO: 467565 - DNA, 16 bp, R. norvegicus
aagccttctccctctt

SEQ ID NO: 467566 - DNA, 16 bp, R. norvegicus
aagccttgaggaaaat

SEQ ID NO: 467567 - DNA, 16 bp, R. norvegicus
aagccttgagggccag

SEQ ID NO: 467568 - DNA, 16 bp, R. norvegicus
aagccttgtctcaaaa

SEQ ID NO: 467569 - DNA, 16 bp, R. norvegicus
aagcctttactgtaca

SEQ ID NO: 467570 - DNA, 16 bp, R. norvegicus
aagcctttatccggta

SEQ ID NO: 467571 - DNA, 16 bp, R. norvegicus
aagcctttcaggagac

SEQ ID NO: 467572 - DNA, 16 bp, R. norvegicus
aagcctttcctcccca

SEQ ID NO: 467573 - DNA, 16 bp, R. norvegicus
aagcctttgcacattt

SEQ ID NO: 467574 - DNA, 16 bp, R. norvegicus
aagcctttggtcctac

SEQ ID NO: 467575 - DNA, 16 bp, R. norvegicus
aagccttttgatttgt

SEQ ID NO: 467576 - DNA, 16 bp, R. norvegicus
aagcgcgaggccctgg

SEQ ID NO: 467577 - DNA, 16 bp, R. norvegicus
aagcggagaaagaaat

SEQ ID NO: 467578 - DNA, 16 bp, R. norvegicus
aagcgtgaggccctgg

SEQ ID NO: 467579 - DNA, 17 bp, R. norvegicus
aagctaaacaaagaatt

SEQ ID NO: 467580 - DNA, 16 bp, R. norvegicus
aagctaacagcagaga

SEQ ID NO: 467581 - DNA, 16 bp, R. norvegicus
aagctaatttttctca

SEQ ID NO: 467582 - DNA, 16 bp, R. norvegicus
aagctaccagatgtct

SEQ ID NO: 467583 - DNA, 16 bp, R. norvegicus
aagctactgtcagaga

SEQ ID NO: 467584 - DNA, 16 bp, R. norvegicus
aagctagaagagacta

SEQ ID NO: 467585 - DNA, 16 bp, R. norvegicus
aagctatattacagaa

SEQ ID NO: 467586 - DNA, 16 bp, R. norvegicus
aagctcaagaaaaatg

SEQ ID NO: 467587 - DNA, 16 bp, R. norvegicus
aagctcaagaagaaga

SEQ ID NO: 467588 - DNA, 16 bp, R. norvegicus
aagctcaagaaggagg

SEQ ID NO: 467589 - DNA, 16 bp, R. norvegicus
aagctcaagaggaaga

SEQ ID NO: 467590 - DNA, 16 bp, R. norvegicus
aagctcaaggtcatcc

SEQ ID NO: 467591 - DNA, 16 bp, R. norvegicus
aagctcaagtcagaca

SEQ ID NO: 467592 - DNA, 16 bp, R. norvegicus
aagctcaatgccccag

SEQ ID NO: 467593 - DNA, 16 bp, R. norvegicus
aagctcactcaggatg

SEQ ID NO: 467594 - DNA, 16 bp, R. norvegicus
aagctcagaagagagg

SEQ ID NO: 467595 - DNA, 16 bp, R. norvegicus
aagctcagcactctct

SEQ ID NO: 467596 - DNA, 16 bp, R. norvegicus
aagctcattttgagag

SEQ ID NO: 467597 - DNA, 16 bp, R. norvegicus
aagctccaggaaaggg

SEQ ID NO: 467598 - DNA, 16 bp, R. norvegicus
aagctccagtccaagt

SEQ ID NO: 467599 - DNA, 16 bp, R. norvegicus
aagctcccacaaccag

SEQ ID NO: 467600 - DNA, 16 bp, R. norvegicus
aagctcctaaagaaat

SEQ ID NO: 467601 - DNA, 16 bp, R. norvegicus
aagctctaccacccac

SEQ ID NO: 467602 - DNA, 16 bp, R. norvegicus
aagctctctggatagc

SEQ ID NO: 467603 - DNA, 16 bp, R. norvegicus
aagctctgcctagtgt

SEQ ID NO: 467604 - DNA, 16 bp, R. norvegicus
aagctctggctgctct

SEQ ID NO: 467605 - DNA, 16 bp, R. norvegicus
aagctctgggtttaat

SEQ ID NO: 467606 - DNA, 16 bp, R. norvegicus
aagctcttaaagaaga

SEQ ID NO: 467607 - DNA, 16 bp, R. norvegicus
aagctcttccagctct

SEQ ID NO: 467608 - DNA, 16 bp, R. norvegicus
aagctcttccagtcca

SEQ ID NO: 467609 - DNA, 16 bp, R. norvegicus
aagctcttccagtcct

SEQ ID NO: 467610 - DNA, 16 bp, R. norvegicus
aagctcttcctgtcct

SEQ ID NO: 467611 - DNA, 16 bp, R. norvegicus
aagctctttatatatt

SEQ ID NO: 467612 - DNA, 16 bp, R. norvegicus
aagctgaaaaagaaat

SEQ ID NO: 467613 - DNA, 16 bp, R. norvegicus
aagctgaaagaagcca

SEQ ID NO: 467614 - DNA, 16 bp, R. norvegicus
aagctgaaagagaaaa

SEQ ID NO: 467615 - DNA, 16 bp, R. norvegicus
aagctgaagaaaccct

SEQ ID NO: 467616 - DNA, 16 bp, R. norvegicus
aagctgaagagatggc

SEQ ID NO: 467617 - DNA, 16 bp, R. norvegicus
aagctgaagaggaggg

SEQ ID NO: 467618 - DNA, 16 bp, R. norvegicus
aagctgaaggagaagt

SEQ ID NO: 467619 - DNA, 16 bp, R. norvegicus
aagctgacctctgacc

SEQ ID NO: 467620 - DNA, 16 bp, R. norvegicus
aagctgagaaaggaaa

SEQ ID NO: 467621 - DNA, 16 bp, R. norvegicus
aagctgagcaagccaa

SEQ ID NO: 467622 - DNA, 16 bp, R. norvegicus
aagctgagcacaagca

SEQ ID NO: 467623 - DNA, 16 bp, R. norvegicus
aagctgagcagaaatg

SEQ ID NO: 467624 - DNA, 16 bp, R. norvegicus
aagctgagcaggccag

SEQ ID NO: 467625 - DNA, 16 bp, R. norvegicus
aagctgaggaagagga

SEQ ID NO: 467626 - DNA, 16 bp, R. norvegicus
aagctgaggactgaac

SEQ ID NO: 467627 - DNA, 16 bp, R. norvegicus
aagctgaggaggaagg

SEQ ID NO: 467628 - DNA, 16 bp, R. norvegicus
aagctgaggaggaggg

SEQ ID NO: 467629 - DNA, 16 bp, R. norvegicus
aagctgaggagggaga

SEQ ID NO: 467630 - DNA, 16 bp, R. norvegicus
aagctgaggatgaggg

SEQ ID NO: 467631 - DNA, 16 bp, R. norvegicus
aagctgaggcagaagg

SEQ ID NO: 467632 - DNA, 16 bp, R. norvegicus
aagctgaggcaggaga

SEQ ID NO: 467633 - DNA, 16 bp, R. norvegicus
aagctgaggcaggagt

SEQ ID NO: 467634 - DNA, 16 bp, R. norvegicus
aagctgcaaaggaaaa

SEQ ID NO: 467635 - DNA, 16 bp, R. norvegicus
aagctgcagggtctcc

SEQ ID NO: 467636 - DNA, 16 bp, R. norvegicus
aagctgccacaggaac

SEQ ID NO: 467637 - DNA, 16 bp, R. norvegicus
aagctgcccagaagct

SEQ ID NO: 467638 - DNA, 16 bp, R. norvegicus
aagctgcctgatgtgg

SEQ ID NO: 467639 - DNA, 16 bp, R. norvegicus
aagctgctaacagaga

SEQ ID NO: 467640 - DNA, 16 bp, R. norvegicus
aagctgctatgaacac

SEQ ID NO: 467641 - DNA, 16 bp, R. norvegicus
aagctgctatggacat

SEQ ID NO: 467642 - DNA, 16 bp, R. norvegicus
aagctgctgacctctg

SEQ ID NO: 467643 - DNA, 16 bp, R. norvegicus
aagctgctgctgctgc

SEQ ID NO: 467644 - DNA, 26 bp, R. norvegicus
aagctgctgtggactggggaactctg

SEQ ID NO: 467645 - DNA, 16 bp, R. norvegicus
aagctggaaacaacca

SEQ ID NO: 467646 - DNA, 16 bp, R. norvegicus
aagctggaaagaccca

SEQ ID NO: 467647 - DNA, 16 bp, R. norvegicus
aagctggaaaggaccc

SEQ ID NO: 467648 - DNA, 16 bp, R. norvegicus
aagctggaagaaggtg

SEQ ID NO: 467649 - DNA, 16 bp, R. norvegicus
aagctggactctcaga

SEQ ID NO: 467650 - DNA, 16 bp, R. norvegicus
aagctggagaaagctg

SEQ ID NO: 467651 - DNA, 16 bp, R. norvegicus
aagctggagaagccat

SEQ ID NO: 467652 - DNA, 17 bp, R. norvegicus
aagctggagagaaccca

SEQ ID NO: 467653 - DNA, 16 bp, R. norvegicus
aagctggaggaagatg

SEQ ID NO: 467654 - DNA, 16 bp, R. norvegicus
aagctggaggacttca

SEQ ID NO: 467655 - DNA, 16 bp, R. norvegicus
aagctggaggagccat

SEQ ID NO: 467656 - DNA, 20 bp, R. norvegicus
aagctggagtagccattctg

SEQ ID NO: 467657 - DNA, 16 bp, R. norvegicus
aagctggagttagcac

SEQ ID NO: 467658 - DNA, 16 bp, R. norvegicus
aagctggatgaggcaa

SEQ ID NO: 467659 - DNA, 16 bp, R. norvegicus
aagctggctgtggtgg

SEQ ID NO: 467660 - DNA, 16 bp, R. norvegicus
aagctgggaacctgga

SEQ ID NO: 467661 - DNA, 16 bp, R. norvegicus
aagctggtaaagaaaa

SEQ ID NO: 467662 - DNA, 16 bp, R. norvegicus
aagctggtaaaggaag

SEQ ID NO: 467663 - DNA, 16 bp, R. norvegicus
aagctggttttgaact

SEQ ID NO: 467664 - DNA, 16 bp, R. norvegicus
aagctgtaatttagca

SEQ ID NO: 467665 - DNA, 16 bp, R. norvegicus
aagctgtattacagat

SEQ ID NO: 467666 - DNA, 16 bp, R. norvegicus
aagctgtccttgaact

SEQ ID NO: 467667 - DNA, 16 bp, R. norvegicus
aagctgtgccaagagg

SEQ ID NO: 467668 - DNA, 16 bp, R. norvegicus
aagctgttgccaggcc

SEQ ID NO: 467669 - DNA, 16 bp, R. norvegicus
aagcttcaggacaact

SEQ ID NO: 467670 - DNA, 16 bp, R. norvegicus
aagcttccagggacta

SEQ ID NO: 467671 - DNA, 16 bp, R. norvegicus
aagcttctctccattt

SEQ ID NO: 467672 - DNA, 16 bp, R. norvegicus
aagcttctgacccctc

SEQ ID NO: 467673 - DNA, 16 bp, R. norvegicus
aagcttctttctgcag

SEQ ID NO: 467674 - DNA, 16 bp, R. norvegicus
aagcttgaggacctga

SEQ ID NO: 467675 - DNA, 16 bp, R. norvegicus
aagctttaaagaaggt

SEQ ID NO: 467676 - DNA, 16 bp, R. norvegicus
aagctttctacagggt

SEQ ID NO: 467677 - DNA, 16 bp, R. norvegicus
aagctttcttttttct

SEQ ID NO: 467678 - DNA, 16 bp, R. norvegicus
aagctttgaggtttta

SEQ ID NO: 467679 - DNA, 16 bp, R. norvegicus
aagcttttaaaatatt

SEQ ID NO: 467680 - DNA, 16 bp, R. norvegicus
aaggaaaaacatttca

SEQ ID NO: 467681 - DNA, 17 bp, R. norvegicus
aaggaaaacacaatcaa

SEQ ID NO: 467682 - DNA, 16 bp, R. norvegicus
aaggaaaacagaaact

SEQ ID NO: 467683 - DNA, 16 bp, R. norvegicus
aaggaaaacattcctt

SEQ ID NO: 467684 - DNA, 16 bp, R. norvegicus
aaggaaaacatttact

SEQ ID NO: 467685 - DNA, 16 bp, R. norvegicus
aaggaaaagaaattca

SEQ ID NO: 467686 - DNA, 16 bp, R. norvegicus
aaggaaaagccctgtg

SEQ ID NO: 467687 - DNA, 16 bp, R. norvegicus
aaggaaaagctatcca

SEQ ID NO: 467688 - DNA, 16 bp, R. norvegicus
aaggaaaagctggaag

SEQ ID NO: 467689 - DNA, 16 bp, R. norvegicus
aaggaaaaggaaaact

SEQ ID NO: 467690 - DNA, 16 bp, R. norvegicus
aaggaaaaggctgaag

SEQ ID NO: 467691 - DNA, 16 bp, R. norvegicus
aaggaaaaggtgtgtg

SEQ ID NO: 467692 - DNA, 16 bp, R. norvegicus
aaggaaaatgaagaca

SEQ ID NO: 467693 - DNA, 16 bp, R. norvegicus
aaggaaaatgacagac

SEQ ID NO: 467694 - DNA, 16 bp, R. norvegicus
aaggaaacaccagaga

SEQ ID NO: 467695 - DNA, 16 bp, R. norvegicus
aaggaaacagcatctt

SEQ ID NO: 467696 - DNA, 16 bp, R. norvegicus
aaggaaacattgtttt

SEQ ID NO: 467697 - DNA, 16 bp, R. norvegicus
aaggaaactgaagaag

SEQ ID NO: 467698 - DNA, 16 bp, R. norvegicus
aaggaaagaaaatgtt

SEQ ID NO: 467699 - DNA, 16 bp, R. norvegicus
aaggaaagaaagccca

SEQ ID NO: 467700 - DNA, 16 bp, R. norvegicus
aaggaaagaaccaact

SEQ ID NO: 467701 - DNA, 16 bp, R. norvegicus
aaggaaagaatcaact

SEQ ID NO: 467702 - DNA, 16 bp, R. norvegicus
aaggaaagaatgtttt

SEQ ID NO: 467703 - DNA, 16 bp, R. norvegicus
aaggaaagacacttta

SEQ ID NO: 467704 - DNA, 16 bp, R. norvegicus
aaggaaagcaagaggc

SEQ ID NO: 467705 - DNA, 16 bp, R. norvegicus
aaggaaagcacacaca

SEQ ID NO: 467706 - DNA, 16 bp, R. norvegicus
aaggaaagccactgag

SEQ ID NO: 467707 - DNA, 16 bp, R. norvegicus
aaggaaaggctgtcca

SEQ ID NO: 467708 - DNA, 16 bp, R. norvegicus
aaggaaaggggataac

SEQ ID NO: 467709 - DNA, 16 bp, R. norvegicus
aaggaaataaactcag

SEQ ID NO: 467710 - DNA, 16 bp, R. norvegicus
aaggaaatacagaaca

SEQ ID NO: 467711 - DNA, 16 bp, R. norvegicus
aaggaaatattcaaca

SEQ ID NO: 467712 - DNA, 16 bp, R. norvegicus
aaggaaatcaaagaag

SEQ ID NO: 467713 - DNA, 16 bp, R. norvegicus
aaggaaatcagaacag

SEQ ID NO: 467714 - DNA, 16 bp, R. norvegicus
aaggaaatccaggaca

SEQ ID NO: 467715 - DNA, 16 bp, R. norvegicus
aaggaaatgaagacag

SEQ ID NO: 467716 - DNA, 16 bp, R. norvegicus
aaggaaatggacaaaa

SEQ ID NO: 467717 - DNA, 25 bp, R. norvegicus
aaggaacacagtattttgggagaaa

SEQ ID NO: 467718 - DNA, 16 bp, R. norvegicus
aaggaacactgcccaa

SEQ ID NO: 467719 - DNA, 16 bp, R. norvegicus
aaggaacatcctgacc

SEQ ID NO: 467720 - DNA, 16 bp, R. norvegicus
aaggaacattctagaa

SEQ ID NO: 467721 - DNA, 16 bp, R. norvegicus
aaggaacattgtcaaa

SEQ ID NO: 467722 - DNA, 16 bp, R. norvegicus
aaggaacgaccattca

SEQ ID NO: 467723 - DNA, 16 bp, R. norvegicus
aaggaactctctgagt

SEQ ID NO: 467724 - DNA, 16 bp, R. norvegicus
aaggaactgaagaaaa

SEQ ID NO: 467725 - DNA, 16 bp, R. norvegicus
aaggaacttgccacca

SEQ ID NO: 467726 - DNA, 16 bp, R. norvegicus
aaggaagaaaattaca

SEQ ID NO: 467727 - DNA, 16 bp, R. norvegicus
aaggaagaaattgagg

SEQ ID NO: 467728 - DNA, 16 bp, R. norvegicus
aaggaagaacaacaat

SEQ ID NO: 467729 - DNA, 16 bp, R. norvegicus
aaggaagaactctctg

SEQ ID NO: 467730 - DNA, 16 bp, R. norvegicus
aaggaagaatggatac

SEQ ID NO: 467731 - DNA, 16 bp, R. norvegicus
aaggaagacatgaaga

SEQ ID NO: 467732 - DNA, 16 bp, R. norvegicus
aaggaagaccaaagca

SEQ ID NO: 467733 - DNA, 16 bp, R. norvegicus
aaggaagagaccagga

SEQ ID NO: 467734 - DNA, 16 bp, R. norvegicus
aaggaagagatgccca

SEQ ID NO: 467735 - DNA, 16 bp, R. norvegicus
aaggaagagctgagaa

SEQ ID NO: 467736 - DNA, 16 bp, R. norvegicus
aaggaagagtgattat

SEQ ID NO: 467737 - DNA, 22 bp, R. norvegicus
aaggaagatctgcatgaggaag

SEQ ID NO: 467738 - DNA, 16 bp, R. norvegicus
aaggaagccacatttt

SEQ ID NO: 467739 - DNA, 16 bp, R. norvegicus
aaggaagcccagttag

SEQ ID NO: 467740 - DNA, 16 bp, R. norvegicus
aaggaagcttcttttg

SEQ ID NO: 467741 - DNA, 16 bp, R. norvegicus
aaggaaggaacctcaa

SEQ ID NO: 467742 - DNA, 16 bp, R. norvegicus
aaggaaggacacttga

SEQ ID NO: 467743 - DNA, 16 bp, R. norvegicus
aaggaaggagaagtcc

SEQ ID NO: 467744 - DNA, 16 bp, R. norvegicus
aaggaaggaggccagg

SEQ ID NO: 467745 - DNA, 16 bp, R. norvegicus
aaggaagtaatcttct

SEQ ID NO: 467746 - DNA, 16 bp, R. norvegicus
aaggaagtcaaaatat

SEQ ID NO: 467747 - DNA, 16 bp, R. norvegicus
aaggaagtcaaggcag

SEQ ID NO: 467748 - DNA, 16 bp, R. norvegicus
aaggaagtctcaaaag

SEQ ID NO: 467749 - DNA, 16 bp, R. norvegicus
aaggaagtgaggacag

SEQ ID NO: 467750 - DNA, 16 bp, R. norvegicus
aaggaatagacaagga

SEQ ID NO: 467751 - DNA, 16 bp, R. norvegicus
aaggaatatccttttg

SEQ ID NO: 467752 - DNA, 16 bp, R. norvegicus
aaggaatcagaaagga

SEQ ID NO: 467753 - DNA, 16 bp, R. norvegicus
aaggaatcagacaaag

SEQ ID NO: 467754 - DNA, 16 bp, R. norvegicus
aaggaatcagagaatg

SEQ ID NO: 467755 - DNA, 16 bp, R. norvegicus
aaggaatcttaaaggc

SEQ ID NO: 467756 - DNA, 16 bp, R. norvegicus
aaggaatcttctgctc

SEQ ID NO: 467757 - DNA, 16 bp, R. norvegicus
aaggaatgaaggagct

SEQ ID NO: 467758 - DNA, 16 bp, R. norvegicus
aaggaatggtgattgt

SEQ ID NO: 467759 - DNA, 16 bp, R. norvegicus
aaggaattgaaccaaa

SEQ ID NO: 467760 - DNA, 16 bp, R. norvegicus
aaggacaaagaagtgg

SEQ ID NO: 467761 - DNA, 16 bp, R. norvegicus
aaggacaacattaatt

SEQ ID NO: 467762 - DNA, 16 bp, R. norvegicus
aaggacaagtttctga

SEQ ID NO: 467763 - DNA, 16 bp, R. norvegicus
aaggacacatgtccca

SEQ ID NO: 467764 - DNA, 16 bp, R. norvegicus
aaggacaccaagacaa

SEQ ID NO: 467765 - DNA, 16 bp, R. norvegicus
aaggacaccatcaaaa

SEQ ID NO: 467766 - DNA, 16 bp, R. norvegicus
aaggacaccatcattt

SEQ ID NO: 467767 - DNA, 16 bp, R. norvegicus
aaggacactgggccag

SEQ ID NO: 467768 - DNA, 16 bp, R. norvegicus
aaggacactgtcattg

SEQ ID NO: 467769 - DNA, 16 bp, R. norvegicus
aaggacactgttgttt

SEQ ID NO: 467770 - DNA, 16 bp, R. norvegicus
aaggacagaaagccca

SEQ ID NO: 467771 - DNA, 16 bp, R. norvegicus
aaggacagaagataaa

SEQ ID NO: 467772 - DNA, 16 bp, R. norvegicus
aaggacagacacacag

SEQ ID NO: 467773 - DNA, 16 bp, R. norvegicus
aaggacagacagggag

SEQ ID NO: 467774 - DNA, 16 bp, R. norvegicus
aaggacagcagcagca

SEQ ID NO: 467775 - DNA, 16 bp, R. norvegicus
aaggacataaagaaat

SEQ ID NO: 467776 - DNA, 16 bp, R. norvegicus
aaggacatattttaaa

SEQ ID NO: 467777 - DNA, 16 bp, R. norvegicus
aaggacatgactgctc

SEQ ID NO: 467778 - DNA, 16 bp, R. norvegicus
aaggacattaagaaca

SEQ ID NO: 467779 - DNA, 16 bp, R. norvegicus
aaggacattagaagaa

SEQ ID NO: 467780 - DNA, 16 bp, R. norvegicus
aaggaccaccaccaaa

SEQ ID NO: 467781 - DNA, 16 bp, R. norvegicus
aaggaccagctcctgg

SEQ ID NO: 467782 - DNA, 16 bp, R. norvegicus
aaggaccaggcagaag

SEQ ID NO: 467783 - DNA, 16 bp, R. norvegicus
aaggacccaagttcaa

SEQ ID NO: 467784 - DNA, 16 bp, R. norvegicus
aaggaccccatggctt

SEQ ID NO: 467785 - DNA, 16 bp, R. norvegicus
aaggaccctttcacag

SEQ ID NO: 467786 - DNA, 16 bp, R. norvegicus
aaggacctgaaaatgt

SEQ ID NO: 467787 - DNA, 18 bp, R. norvegicus
aaggacgacatttaattg

SEQ ID NO: 467788 - DNA, 16 bp, R. norvegicus
aaggactctaccactg

SEQ ID NO: 467789 - DNA, 16 bp, R. norvegicus
aaggactctttctgct

SEQ ID NO: 467790 - DNA, 16 bp, R. norvegicus
aaggactgaaggagtt

SEQ ID NO: 467791 - DNA, 16 bp, R. norvegicus
aaggactgaaggatct

SEQ ID NO: 467792 - DNA, 16 bp, R. norvegicus
aaggacttcaagaaag

SEQ ID NO: 467793 - DNA, 16 bp, R. norvegicus
aaggacttcaagactc

SEQ ID NO: 467794 - DNA, 16 bp, R. norvegicus
aaggacttcaggggaa

SEQ ID NO: 467795 - DNA, 16 bp, R. norvegicus
aaggacttctacctgt

SEQ ID NO: 467796 - DNA, 16 bp, R. norvegicus
aaggacttgacatcct

SEQ ID NO: 467797 - DNA, 16 bp, R. norvegicus
aaggacttgggttcaa

SEQ ID NO: 467798 - DNA, 16 bp, R. norvegicus
aaggactttaagaaag

SEQ ID NO: 467799 - DNA, 16 bp, R. norvegicus
aaggactttctgaaca

SEQ ID NO: 467800 - DNA, 16 bp, R. norvegicus
aaggagaaaacaagat

SEQ ID NO: 467801 - DNA, 16 bp, R. norvegicus
aaggagaaaatatttt

SEQ ID NO: 467802 - DNA, 16 bp, R. norvegicus
aaggagaaacaagcca

SEQ ID NO: 467803 - DNA, 16 bp, R. norvegicus
aaggagaaacagaagt

SEQ ID NO: 467804 - DNA, 16 bp, R. norvegicus
aaggagaaagccagct

SEQ ID NO: 467805 - DNA, 16 bp, R. norvegicus
aaggagaacaagaata

SEQ ID NO: 467806 - DNA, 16 bp, R. norvegicus
aaggagaacttcagtt

SEQ ID NO: 467807 - DNA, 16 bp, R. norvegicus
aaggagaagcagaagc

SEQ ID NO: 467808 - DNA, 16 bp, R. norvegicus
aaggagaagcagcagc

SEQ ID NO: 467809 - DNA, 16 bp, R. norvegicus
aaggagaagccctggg

SEQ ID NO: 467810 - DNA, 16 bp, R. norvegicus
aaggagaagctggaga

SEQ ID NO: 467811 - DNA, 16 bp, R. norvegicus
aaggagaagcttcctg

SEQ ID NO: 467812 - DNA, 19 bp, R. norvegicus
aaggagaatgaccaggcca

SEQ ID NO: 467813 - DNA, 16 bp, R. norvegicus
aaggagacacacacac

SEQ ID NO: 467814 - DNA, 16 bp, R. norvegicus
aaggagactggagaga

SEQ ID NO: 467815 - DNA, 16 bp, R. norvegicus
aaggagagacctgact

SEQ ID NO: 467816 - DNA, 23 bp, R. norvegicus
aaggagagagatgaactcaggag

SEQ ID NO: 467817 - DNA, 16 bp, R. norvegicus
aaggagagcgctcatt

SEQ ID NO: 467818 - DNA, 16 bp, R. norvegicus
aaggagaggaaggatt

SEQ ID NO: 467819 - DNA, 16 bp, R. norvegicus
aaggagaggcaggtgg

SEQ ID NO: 467820 - DNA, 16 bp, R. norvegicus
aaggagagggtggcag

SEQ ID NO: 467821 - DNA, 16 bp, R. norvegicus
aaggagatcaaagaga

SEQ ID NO: 467822 - DNA, 16 bp, R. norvegicus
aaggagatcaagagga

SEQ ID NO: 467823 - DNA, 17 bp, R. norvegicus
aaggagatcaaggtgat

SEQ ID NO: 467824 - DNA, 17 bp, R. norvegicus
aaggagatcaagtggat

SEQ ID NO: 467825 - DNA, 16 bp, R. norvegicus
aaggagatcagaggga

SEQ ID NO: 467826 - DNA, 16 bp, R. norvegicus
aaggagatcctaagaa

SEQ ID NO: 467827 - DNA, 16 bp, R. norvegicus
aaggagatggctcaga

SEQ ID NO: 467828 - DNA, 16 bp, R. norvegicus
aaggagatggctcagt

SEQ ID NO: 467829 - DNA, 16 bp, R. norvegicus
aaggagcaagaaacta

SEQ ID NO: 467830 - DNA, 16 bp, R. norvegicus
aaggagcaaggttaca

SEQ ID NO: 467831 - DNA, 16 bp, R. norvegicus
aaggagcagaaggcag

SEQ ID NO: 467832 - DNA, 16 bp, R. norvegicus
aaggagcagaaggggc

SEQ ID NO: 467833 - DNA, 16 bp, R. norvegicus
aaggagccaaaaccct

SEQ ID NO: 467834 - DNA, 16 bp, R. norvegicus
aaggagccaaacccat

SEQ ID NO: 467835 - DNA, 16 bp, R. norvegicus
aaggagccaagaccat

SEQ ID NO: 467836 - DNA, 16 bp, R. norvegicus
aaggagccgtagacac

SEQ ID NO: 467837 - DNA, 16 bp, R. norvegicus
aaggagcgacttcagg

SEQ ID NO: 467838 - DNA, 16 bp, R. norvegicus
aaggagctgaagaggc

SEQ ID NO: 467839 - DNA, 16 bp, R. norvegicus
aaggagctgaaggaac

SEQ ID NO: 467840 - DNA, 16 bp, R. norvegicus
aaggagctgaaggagc

SEQ ID NO: 467841 - DNA, 16 bp, R. norvegicus
aaggagctgaagggga

SEQ ID NO: 467842 - DNA, 16 bp, R. norvegicus
aaggagctgaatgggt

SEQ ID NO: 467843 - DNA, 16 bp, R. norvegicus
aaggagctgaggggga

SEQ ID NO: 467844 - DNA, 16 bp, R. norvegicus
aaggagctggagagat

SEQ ID NO: 467845 - DNA, 16 bp, R. norvegicus
aaggagctgggtgtgg

SEQ ID NO: 467846 - DNA, 16 bp, R. norvegicus
aaggaggaacaagaat

SEQ ID NO: 467847 - DNA, 16 bp, R. norvegicus
aaggaggaagcagcag

SEQ ID NO: 467848 - DNA, 16 bp, R. norvegicus
aaggaggaatgtctgg

SEQ ID NO: 467849 - DNA, 16 bp, R. norvegicus
aaggaggaattccagg

SEQ ID NO: 467850 - DNA, 16 bp, R. norvegicus
aaggaggagaaaaccc

SEQ ID NO: 467851 - DNA, 16 bp, R. norvegicus
aaggaggagaaagccc

SEQ ID NO: 467852 - DNA, 16 bp, R. norvegicus
aaggaggagatatgga

SEQ ID NO: 467853 - DNA, 17 bp, R. norvegicus
aaggaggagcttcctgt

SEQ ID NO: 467854 - DNA, 16 bp, R. norvegicus
aaggaggaggacaacc

SEQ ID NO: 467855 - DNA, 16 bp, R. norvegicus
aaggaggagggcgacc

SEQ ID NO: 467856 - DNA, 16 bp, R. norvegicus
aaggaggagttccaga

SEQ ID NO: 467857 - DNA, 16 bp, R. norvegicus
aaggaggatgtggacc

SEQ ID NO: 467858 - DNA, 16 bp, R. norvegicus
aaggaggcaagccaca

SEQ ID NO: 467859 - DNA, 16 bp, R. norvegicus
aaggaggcaagctgca

SEQ ID NO: 467860 - DNA, 16 bp, R. norvegicus
aaggaggcaggcaggc

SEQ ID NO: 467861 - DNA, 16 bp, R. norvegicus
aaggagggaaaactgt

SEQ ID NO: 467862 - DNA, 16 bp, R. norvegicus
aaggagggcaaccctg

SEQ ID NO: 467863 - DNA, 16 bp, R. norvegicus
aaggagggttccattg

SEQ ID NO: 467864 - DNA, 16 bp, R. norvegicus
aaggaggtcaaagaga

SEQ ID NO: 467865 - DNA, 16 bp, R. norvegicus
aaggaggtcaaaggaa

SEQ ID NO: 467866 - DNA, 16 bp, R. norvegicus
aaggaggtcaaggggg

SEQ ID NO: 467867 - DNA, 16 bp, R. norvegicus
aaggaggtcctgttct

SEQ ID NO: 467868 - DNA, 16 bp, R. norvegicus
aaggagtagtgattgt

SEQ ID NO: 467869 - DNA, 16 bp, R. norvegicus
aaggagtggagcagag

SEQ ID NO: 467870 - DNA, 22 bp, R. norvegicus
aaggagtgggcgggcatgtttg

SEQ ID NO: 467871 - DNA, 16 bp, R. norvegicus
aaggagttaaaaatgg

SEQ ID NO: 467872 - DNA, 16 bp, R. norvegicus
aaggagttaaaaccat

SEQ ID NO: 467873 - DNA, 16 bp, R. norvegicus
aaggataaacatgctg

SEQ ID NO: 467874 - DNA, 16 bp, R. norvegicus
aaggatacagaaaata

SEQ ID NO: 467875 - DNA, 16 bp, R. norvegicus
aaggatcctgtcccag

SEQ ID NO: 467876 - DNA, 16 bp, R. norvegicus
aaggatgaacaggctg

SEQ ID NO: 467877 - DNA, 16 bp, R. norvegicus
aaggatgaccaaaagg

SEQ ID NO: 467878 - DNA, 16 bp, R. norvegicus
aaggatgatgaagatg

SEQ ID NO: 467879 - DNA, 16 bp, R. norvegicus
aaggatgcagagaaag

SEQ ID NO: 467880 - DNA, 16 bp, R. norvegicus
aaggatggggctggag

SEQ ID NO: 467881 - DNA, 16 bp, R. norvegicus
aaggatgtcaaaggga

SEQ ID NO: 467882 - DNA, 18 bp, R. norvegicus
aaggatgtggagaaagaa

SEQ ID NO: 467883 - DNA, 16 bp, R. norvegicus
aaggatgttgaacaat

SEQ ID NO: 467884 - DNA, 17 bp, R. norvegicus
aaggatgttgaacattt

SEQ ID NO: 467885 - DNA, 16 bp, R. norvegicus
aaggattaaaaggatt

SEQ ID NO: 467886 - DNA, 16 bp, R. norvegicus
aaggattacaggaaaa

SEQ ID NO: 467887 - DNA, 16 bp, R. norvegicus
aaggattcagagaaag

SEQ ID NO: 467888 - DNA, 16 bp, R. norvegicus
aaggattgtgggaagg

SEQ ID NO: 467889 - DNA, 16 bp, R. norvegicus
aaggatttattcagtt

SEQ ID NO: 467890 - DNA, 16 bp, R. norvegicus
aaggatttgacaaaat

SEQ ID NO: 467891 - DNA, 16 bp, R. norvegicus
aaggatttgatggaga

SEQ ID NO: 467892 - DNA, 16 bp, R. norvegicus
aaggcaaaagacactt

SEQ ID NO: 467893 - DNA, 16 bp, R. norvegicus
aaggcaaaattcctct

SEQ ID NO: 467894 - DNA, 18 bp, R. norvegicus
aaggcaaaggacactgtc

SEQ ID NO: 467895 - DNA, 16 bp, R. norvegicus
aaggcaaattataaaa

SEQ ID NO: 467896 - DNA, 16 bp, R. norvegicus
aaggcaactctcacaa

SEQ ID NO: 467897 - DNA, 16 bp, R. norvegicus
aaggcaactgttataa

SEQ ID NO: 467898 - DNA, 16 bp, R. norvegicus
aaggcaagtctttttt

SEQ ID NO: 467899 - DNA, 16 bp, R. norvegicus
aaggcacaagcacaga

SEQ ID NO: 467900 - DNA, 16 bp, R. norvegicus
aaggcacttaccacca

SEQ ID NO: 467901 - DNA, 16 bp, R. norvegicus
aaggcacttgccacac

SEQ ID NO: 467902 - DNA, 16 bp, R. norvegicus
aaggcagaaacttgaa

SEQ ID NO: 467903 - DNA, 16 bp, R. norvegicus
aaggcagaagagggca

SEQ ID NO: 467904 - DNA, 16 bp, R. norvegicus
aaggcagaggacaact

SEQ ID NO: 467905 - DNA, 16 bp, R. norvegicus
aaggcagaggacactg

SEQ ID NO: 467906 - DNA, 16 bp, R. norvegicus
aaggcagaggcagaca

SEQ ID NO: 467907 - DNA, 16 bp, R. norvegicus
aaggcagagggcagag

SEQ ID NO: 467908 - DNA, 16 bp, R. norvegicus
aaggcagctctctgct

SEQ ID NO: 467909 - DNA, 16 bp, R. norvegicus
aaggcaggaacatggt

SEQ ID NO: 467910 - DNA, 16 bp, R. norvegicus
aaggcaggagctgagg

SEQ ID NO: 467911 - DNA, 16 bp, R. norvegicus
aaggcaggaggagcag

SEQ ID NO: 467912 - DNA, 16 bp, R. norvegicus
aaggcatgatgggaaa

SEQ ID NO: 467913 - DNA, 16 bp, R. norvegicus
aaggcatgcaccccca

SEQ ID NO: 467914 - DNA, 16 bp, R. norvegicus
aaggcattatttgaga

SEQ ID NO: 467915 - DNA, 16 bp, R. norvegicus
aaggccaaggcaggaa

SEQ ID NO: 467916 - DNA, 16 bp, R. norvegicus
aaggccacacccctcc

SEQ ID NO: 467917 - DNA, 16 bp, R. norvegicus
aaggccacgcctcctc

SEQ ID NO: 467918 - DNA, 16 bp, R. norvegicus
aaggccacgccttcta

SEQ ID NO: 467919 - DNA, 16 bp, R. norvegicus
aaggccagactgatct

SEQ ID NO: 467920 - DNA, 16 bp, R. norvegicus
aaggccagcagataag

SEQ ID NO: 467921 - DNA, 16 bp, R. norvegicus
aaggccagccagagac

SEQ ID NO: 467922 - DNA, 16 bp, R. norvegicus
aaggccagccaggtct

SEQ ID NO: 467923 - DNA, 16 bp, R. norvegicus
aaggccagcctcatct

SEQ ID NO: 467924 - DNA, 16 bp, R. norvegicus
aaggccagcctcttct

SEQ ID NO: 467925 - DNA, 16 bp, R. norvegicus
aaggccagcctggtat

SEQ ID NO: 467926 - DNA, 16 bp, R. norvegicus
aaggccagcttgggct

SEQ ID NO: 467927 - DNA, 16 bp, R. norvegicus
aaggccagggccagat

SEQ ID NO: 467928 - DNA, 16 bp, R. norvegicus
aaggccatccagaaac

SEQ ID NO: 467929 - DNA, 16 bp, R. norvegicus
aaggccatcctctgct

SEQ ID NO: 467930 - DNA, 16 bp, R. norvegicus
aaggccatctgctgct

SEQ ID NO: 467931 - DNA, 16 bp, R. norvegicus
aaggccatctgggacc

SEQ ID NO: 467932 - DNA, 16 bp, R. norvegicus
aaggccatggaggagt

SEQ ID NO: 467933 - DNA, 16 bp, R. norvegicus
aaggccattggtgaag

SEQ ID NO: 467934 - DNA, 16 bp, R. norvegicus
aaggcccaagggagga

SEQ ID NO: 467935 - DNA, 16 bp, R. norvegicus
aaggcccacactcagc

SEQ ID NO: 467936 - DNA, 16 bp, R. norvegicus
aaggcccagacctaaa

SEQ ID NO: 467937 - DNA, 16 bp, R. norvegicus
aaggcccagctctccc

SEQ ID NO: 467938 - DNA, 16 bp, R. norvegicus
aaggccctgaggcagg

SEQ ID NO: 467939 - DNA, 33 bp, R. norvegicus
aaggccctgggttcagtccccagctccgaaaaa

SEQ ID NO: 467940 - DNA, 16 bp, R. norvegicus
aaggccctgggttggg

SEQ ID NO: 467941 - DNA, 16 bp, R. norvegicus
aaggccctgtctcaaa

SEQ ID NO: 467942 - DNA, 16 bp, R. norvegicus
aaggcctagatgagga

SEQ ID NO: 467943 - DNA, 16 bp, R. norvegicus
aaggcctatgccacca

SEQ ID NO: 467944 - DNA, 16 bp, R. norvegicus
aaggcctatgtagatg

SEQ ID NO: 467945 - DNA, 16 bp, R. norvegicus
aaggcctcccctccca

SEQ ID NO: 467946 - DNA, 16 bp, R. norvegicus
aaggcctgcctgagct

SEQ ID NO: 467947 - DNA, 16 bp, R. norvegicus
aaggcctgcctgggct

SEQ ID NO: 467948 - DNA, 16 bp, R. norvegicus
aaggcctggaaggcac

SEQ ID NO: 467949 - DNA, 16 bp, R. norvegicus
aaggccttcacctaca

SEQ ID NO: 467950 - DNA, 16 bp, R. norvegicus
aaggccttctccatgg

SEQ ID NO: 467951 - DNA, 17 bp, R. norvegicus
aaggcgccagcagctcc

SEQ ID NO: 467952 - DNA, 16 bp, R. norvegicus
aaggcgggaacatggc

SEQ ID NO: 467953 - DNA, 16 bp, R. norvegicus
aaggctaagacagact

SEQ ID NO: 467954 - DNA, 16 bp, R. norvegicus
aaggctacataaagaa

SEQ ID NO: 467955 - DNA, 16 bp, R. norvegicus
aaggctacatggagaa

SEQ ID NO: 467956 - DNA, 17 bp, R. norvegicus
aaggctactcatttgtt

SEQ ID NO: 467957 - DNA, 16 bp, R. norvegicus
aaggctagaaaacaat

SEQ ID NO: 467958 - DNA, 16 bp, R. norvegicus
aaggctcaagtccaag

SEQ ID NO: 467959 - DNA, 16 bp, R. norvegicus
aaggctcagagaatat

SEQ ID NO: 467960 - DNA, 16 bp, R. norvegicus
aaggctctaggttcaa

SEQ ID NO: 467961 - DNA, 16 bp, R. norvegicus
aaggctctggctgagc

SEQ ID NO: 467962 - DNA, 16 bp, R. norvegicus
aaggctgaaaaaaatt

SEQ ID NO: 467963 - DNA, 16 bp, R. norvegicus
aaggctgaaagaagct

SEQ ID NO: 467964 - DNA, 16 bp, R. norvegicus
aaggctgaagaagctg

SEQ ID NO: 467965 - DNA, 16 bp, R. norvegicus
aaggctgagaaagaaa

SEQ ID NO: 467966 - DNA, 16 bp, R. norvegicus
aaggctgagaaccact

SEQ ID NO: 467967 - DNA, 16 bp, R. norvegicus
aaggctgaggctggag

SEQ ID NO: 467968 - DNA, 17 bp, R. norvegicus
aaggctgcccactctcc

SEQ ID NO: 467969 - DNA, 16 bp, R. norvegicus
aaggctgcctggtgaa

SEQ ID NO: 467970 - DNA, 16 bp, R. norvegicus
aaggctgctgatttat

SEQ ID NO: 467971 - DNA, 16 bp, R. norvegicus
aaggctgctggcagaa

SEQ ID NO: 467972 - DNA, 17 bp, R. norvegicus
aaggctggaaaaaattt

SEQ ID NO: 467973 - DNA, 16 bp, R. norvegicus
aaggctggaaaacagc

SEQ ID NO: 467974 - DNA, 16 bp, R. norvegicus
aaggctggaagaaact

SEQ ID NO: 467975 - DNA, 16 bp, R. norvegicus
aaggctggacccacag

SEQ ID NO: 467976 - DNA, 16 bp, R. norvegicus
aaggctggatgaagca

SEQ ID NO: 467977 - DNA, 16 bp, R. norvegicus
aaggctggatgtccca

SEQ ID NO: 467978 - DNA, 16 bp, R. norvegicus
aaggctggcctcagac

SEQ ID NO: 467979 - DNA, 16 bp, R. norvegicus
aaggctgggattacag

SEQ ID NO: 467980 - DNA, 16 bp, R. norvegicus
aaggctggtttatttg

SEQ ID NO: 467981 - DNA, 16 bp, R. norvegicus
aaggctgtacccccag

SEQ ID NO: 467982 - DNA, 16 bp, R. norvegicus
aaggctgtccactctc

SEQ ID NO: 467983 - DNA, 16 bp, R. norvegicus
aaggctgtggagaaag

SEQ ID NO: 467984 - DNA, 16 bp, R. norvegicus
aagggaaaacttttac

SEQ ID NO: 467985 - DNA, 16 bp, R. norvegicus
aagggaaacatgatca

SEQ ID NO: 467986 - DNA, 16 bp, R. norvegicus
aagggaaagaggtcaa

SEQ ID NO: 467987 - DNA, 16 bp, R. norvegicus
aagggaaatttttctg

SEQ ID NO: 467988 - DNA, 16 bp, R. norvegicus
aagggaacaatgcata

SEQ ID NO: 467989 - DNA, 16 bp, R. norvegicus
aagggaagggagaacc

SEQ ID NO: 467990 - DNA, 16 bp, R. norvegicus
aagggaagtccttggt

SEQ ID NO: 467991 - DNA, 16 bp, R. norvegicus
aagggaatgggcactg

SEQ ID NO: 467992 - DNA, 16 bp, R. norvegicus
aagggacaaaggtcaa

SEQ ID NO: 467993 - DNA, 16 bp, R. norvegicus
aagggacaacacagag

SEQ ID NO: 467994 - DNA, 16 bp, R. norvegicus
aagggacaagctccag

SEQ ID NO: 467995 - DNA, 16 bp, R. norvegicus
aagggaccccaatgga

SEQ ID NO: 467996 - DNA, 16 bp, R. norvegicus
aagggaccggagccag

SEQ ID NO: 467997 - DNA, 16 bp, R. norvegicus
aagggactgtttagat

SEQ ID NO: 467998 - DNA, 16 bp, R. norvegicus
aagggagccatgttcc

SEQ ID NO: 467999 - DNA, 16 bp, R. norvegicus
aagggaggagggccca

SEQ ID NO: 468000 - DNA, 16 bp, R. norvegicus
aagggaggctccaagg

SEQ ID NO: 468001 - DNA, 16 bp, R. norvegicus
aagggagtcatttatg

SEQ ID NO: 468002 - DNA, 16 bp, R. norvegicus
aagggatggaactgga

SEQ ID NO: 468003 - DNA, 16 bp, R. norvegicus
aagggatgggtggtac

SEQ ID NO: 468004 - DNA, 16 bp, R. norvegicus
aagggcacacctactc

SEQ ID NO: 468005 - DNA, 16 bp, R. norvegicus
aagggcagaattcaaa

SEQ ID NO: 468006 - DNA, 16 bp, R. norvegicus
aagggcagggaataag

SEQ ID NO: 468007 - DNA, 16 bp, R. norvegicus
aagggcagggctcagc

SEQ ID NO: 468008 - DNA, 18 bp, R. norvegicus
aagggcattgactgctct

SEQ ID NO: 468009 - DNA, 16 bp, R. norvegicus
aagggccagcagaatg

SEQ ID NO: 468010 - DNA, 16 bp, R. norvegicus
aagggctgaagagatg

SEQ ID NO: 468011 - DNA, 16 bp, R. norvegicus
aagggctgcccagaag

SEQ ID NO: 468012 - DNA, 16 bp, R. norvegicus
aagggcttctcctctt

SEQ ID NO: 468013 - DNA, 16 bp, R. norvegicus
aagggctttgaacatt

SEQ ID NO: 468014 - DNA, 16 bp, R. norvegicus
aagggctttttaaagg

SEQ ID NO: 468015 - DNA, 16 bp, R. norvegicus
aaggggaaaaaaatca

SEQ ID NO: 468016 - DNA, 16 bp, R. norvegicus
aaggggaaactacaca

SEQ ID NO: 468017 - DNA, 16 bp, R. norvegicus
aaggggaaactgcaca

SEQ ID NO: 468018 - DNA, 17 bp, R. norvegicus
aaggggaagccgttggt

SEQ ID NO: 468019 - DNA, 16 bp, R. norvegicus
aaggggacatttgaaa

SEQ ID NO: 468020 - DNA, 16 bp, R. norvegicus
aaggggaggccccaaa

SEQ ID NO: 468021 - DNA, 26 bp, R. norvegicus
aaggggatacaggtcggaaaagaaga

SEQ ID NO: 468022 - DNA, 16 bp, R. norvegicus
aaggggatgcaaattg

SEQ ID NO: 468023 - DNA, 16 bp, R. norvegicus
aaggggatgtatgggg

SEQ ID NO: 468024 - DNA, 16 bp, R. norvegicus
aaggggccaaggaaaa

SEQ ID NO: 468025 - DNA, 21 bp, R. norvegicus
aaggggcgctacccttgggcc

SEQ ID NO: 468026 - DNA, 16 bp, R. norvegicus
aaggggctgcaggctt

SEQ ID NO: 468027 - DNA, 16 bp, R. norvegicus
aaggggctggatataa

SEQ ID NO: 468028 - DNA, 16 bp, R. norvegicus
aaggggctttccttgg

SEQ ID NO: 468029 - DNA, 16 bp, R. norvegicus
aagggggaaactgagg

SEQ ID NO: 468030 - DNA, 16 bp, R. norvegicus
aagggggaggggcatg

SEQ ID NO: 468031 - DNA, 16 bp, R. norvegicus
aaggggttgcttgccc

SEQ ID NO: 468032 - DNA, 16 bp, R. norvegicus
aagggtcaggttctga

SEQ ID NO: 468033 - DNA, 16 bp, R. norvegicus
aagggtgcttgctgct

SEQ ID NO: 468034 - DNA, 16 bp, R. norvegicus
aagggtggagggcaga

SEQ ID NO: 468035 - DNA, 16 bp, R. norvegicus
aagggtggcaccatcc

SEQ ID NO: 468036 - DNA, 16 bp, R. norvegicus
aagggtttctttggct

SEQ ID NO: 468037 - DNA, 16 bp, R. norvegicus
aaggtaaagttaattt

SEQ ID NO: 468038 - DNA, 16 bp, R. norvegicus
aaggtaaggaaggaca

SEQ ID NO: 468039 - DNA, 16 bp, R. norvegicus
aaggtacaaggaagag

SEQ ID NO: 468040 - DNA, 16 bp, R. norvegicus
aaggtacagcctcagt

SEQ ID NO: 468041 - DNA, 16 bp, R. norvegicus
aaggtaccatgaggag

SEQ ID NO: 468042 - DNA, 16 bp, R. norvegicus
aaggtagaaggtagaa

SEQ ID NO: 468043 - DNA, 16 bp, R. norvegicus
aaggtaggaactgaag

SEQ ID NO: 468044 - DNA, 16 bp, R. norvegicus
aaggtagttatttatg

SEQ ID NO: 468045 - DNA, 16 bp, R. norvegicus
aaggtatttataaata

SEQ ID NO: 468046 - DNA, 16 bp, R. norvegicus
aaggtcaaggccagcc

SEQ ID NO: 468047 - DNA, 16 bp, R. norvegicus
aaggtcacacagctag

SEQ ID NO: 468048 - DNA, 16 bp, R. norvegicus
aaggtcaccctcaact

SEQ ID NO: 468049 - DNA, 16 bp, R. norvegicus
aaggtcagcctgggat

SEQ ID NO: 468050 - DNA, 16 bp, R. norvegicus
aaggtcagtctgagct

SEQ ID NO: 468051 - DNA, 16 bp, R. norvegicus
aaggtcatcctcttct

SEQ ID NO: 468052 - DNA, 16 bp, R. norvegicus
aaggtcatctccagct

SEQ ID NO: 468053 - DNA, 16 bp, R. norvegicus
aaggtcattactccct

SEQ ID NO: 468054 - DNA, 16 bp, R. norvegicus
aaggtccctccttttg

SEQ ID NO: 468055 - DNA, 16 bp, R. norvegicus
aaggtcctgagttcaa

SEQ ID NO: 468056 - DNA, 16 bp, R. norvegicus
aaggtccttgctgcca

SEQ ID NO: 468057 - DNA, 16 bp, R. norvegicus
aaggtctcactctgta

SEQ ID NO: 468058 - DNA, 16 bp, R. norvegicus
aaggtctcagaaaatg

SEQ ID NO: 468059 - DNA, 16 bp, R. norvegicus
aaggtctcccacccaa

SEQ ID NO: 468060 - DNA, 16 bp, R. norvegicus
aaggtctctctgtgta

SEQ ID NO: 468061 - DNA, 16 bp, R. norvegicus
aaggtctgaaggagct

SEQ ID NO: 468062 - DNA, 16 bp, R. norvegicus
aaggtctgatagaatt

SEQ ID NO: 468063 - DNA, 16 bp, R. norvegicus
aaggtcttcctctgct

SEQ ID NO: 468064 - DNA, 16 bp, R. norvegicus
aaggtcttctatgaag

SEQ ID NO: 468065 - DNA, 16 bp, R. norvegicus
aaggtgaagcctggat

SEQ ID NO: 468066 - DNA, 16 bp, R. norvegicus
aaggtgacactgatgg

SEQ ID NO: 468067 - DNA, 16 bp, R. norvegicus
aaggtgaggcaggagg

SEQ ID NO: 468068 - DNA, 16 bp, R. norvegicus
aaggtgaggctgggag

SEQ ID NO: 468069 - DNA, 16 bp, R. norvegicus
aaggtgataaatatgg

SEQ ID NO: 468070 - DNA, 18 bp, R. norvegicus
aaggtgataccaggttga

SEQ ID NO: 468071 - DNA, 16 bp, R. norvegicus
aaggtgattcctccta

SEQ ID NO: 468072 - DNA, 16 bp, R. norvegicus
aaggtgattgagtttg

SEQ ID NO: 468073 - DNA, 17 bp, R. norvegicus
aaggtgccctctggagg

SEQ ID NO: 468074 - DNA, 16 bp, R. norvegicus
aaggtgctagtgtatg

SEQ ID NO: 468075 - DNA, 16 bp, R. norvegicus
aaggtgcttgctgcca

SEQ ID NO: 468076 - DNA, 16 bp, R. norvegicus
aaggtggggaagagcc

SEQ ID NO: 468077 - DNA, 16 bp, R. norvegicus
aaggtggtctgacaag

SEQ ID NO: 468078 - DNA, 16 bp, R. norvegicus
aaggtggtcttcaata

SEQ ID NO: 468079 - DNA, 16 bp, R. norvegicus
aaggtgttcaccacca

SEQ ID NO: 468080 - DNA, 16 bp, R. norvegicus
aaggttacatagcatc

SEQ ID NO: 468081 - DNA, 16 bp, R. norvegicus
aaggttatccttggct

SEQ ID NO: 468082 - DNA, 16 bp, R. norvegicus
aaggttctgccagagc

SEQ ID NO: 468083 - DNA, 16 bp, R. norvegicus
aaggttgtggagaaag

SEQ ID NO: 468084 - DNA, 16 bp, R. norvegicus
aaggtttcaaaagccc

SEQ ID NO: 468085 - DNA, 16 bp, R. norvegicus
aaggtttcttttactt

SEQ ID NO: 468086 - DNA, 17 bp, R. norvegicus
aaggtttcttttatgaa

SEQ ID NO: 468087 - DNA, 16 bp, R. norvegicus
aaggttttcaagtttt

SEQ ID NO: 468088 - DNA, 16 bp, R. norvegicus
aaggttttgtagctgg

SEQ ID NO: 468089 - DNA, 16 bp, R. norvegicus
aagtaaaaatatccaa

SEQ ID NO: 468090 - DNA, 16 bp, R. norvegicus
aagtaaacaagtaaat

SEQ ID NO: 468091 - DNA, 16 bp, R. norvegicus
aagtaaactttttatt

SEQ ID NO: 468092 - DNA, 16 bp, R. norvegicus
aagtaaaggcacttgc

SEQ ID NO: 468093 - DNA, 16 bp, R. norvegicus
aagtaaatttcttatt

SEQ ID NO: 468094 - DNA, 17 bp, R. norvegicus
aagtaacacagaacaca

SEQ ID NO: 468095 - DNA, 17 bp, R. norvegicus
aagtaacagccattcag

SEQ ID NO: 468096 - DNA, 16 bp, R. norvegicus
aagtacaagtcatccg

SEQ ID NO: 468097 - DNA, 16 bp, R. norvegicus
aagtacagaattccca

SEQ ID NO: 468098 - DNA, 16 bp, R. norvegicus
aagtacatggtgacag

SEQ ID NO: 468099 - DNA, 16 bp, R. norvegicus
aagtaccagcttccca

SEQ ID NO: 468100 - DNA, 16 bp, R. norvegicus
aagtaccatgaggaga

SEQ ID NO: 468101 - DNA, 16 bp, R. norvegicus
aagtacctcaccttac

SEQ ID NO: 468102 - DNA, 16 bp, R. norvegicus
aagtactgagaacaaa

SEQ ID NO: 468103 - DNA, 16 bp, R. norvegicus
aagtactggctgctct

SEQ ID NO: 468104 - DNA, 16 bp, R. norvegicus
aagtagaagacaggaa

SEQ ID NO: 468105 - DNA, 16 bp, R. norvegicus
aagtagaagccaacag

SEQ ID NO: 468106 - DNA, 25 bp, R. norvegicus
aagtagaaggcaggaaataatcaaa

SEQ ID NO: 468107 - DNA, 16 bp, R. norvegicus
aagtagcaaagaaata

SEQ ID NO: 468108 - DNA, 16 bp, R. norvegicus
aagtagcaacaaaata

SEQ ID NO: 468109 - DNA, 16 bp, R. norvegicus
aagtagcagcagcagc

SEQ ID NO: 468110 - DNA, 16 bp, R. norvegicus
aagtagggagagtgtg

SEQ ID NO: 468111 - DNA, 16 bp, R. norvegicus
aagtagttttcatttg

SEQ ID NO: 468112 - DNA, 16 bp, R. norvegicus
aagtatcaacaaaaat

SEQ ID NO: 468113 - DNA, 16 bp, R. norvegicus
aagtatgtggtggaga

SEQ ID NO: 468114 - DNA, 16 bp, R. norvegicus
aagtcaaaacatcact

SEQ ID NO: 468115 - DNA, 16 bp, R. norvegicus
aagtcaaaaggataca

SEQ ID NO: 468116 - DNA, 16 bp, R. norvegicus
aagtcaactcttataa

SEQ ID NO: 468117 - DNA, 16 bp, R. norvegicus
aagtcaagaaatgcat

SEQ ID NO: 468118 - DNA, 16 bp, R. norvegicus
aagtcaattttgtttg

SEQ ID NO: 468119 - DNA, 16 bp, R. norvegicus
aagtcacagaagaaaa

SEQ ID NO: 468120 - DNA, 17 bp, R. norvegicus
aagtcacctgagtcctg

SEQ ID NO: 468121 - DNA, 16 bp, R. norvegicus
aagtcactatgtagct

SEQ ID NO: 468122 - DNA, 16 bp, R. norvegicus
aagtcagaagaggaca

SEQ ID NO: 468123 - DNA, 16 bp, R. norvegicus
aagtcagaagaggatg

SEQ ID NO: 468124 - DNA, 16 bp, R. norvegicus
aagtcagagacttccc

SEQ ID NO: 468125 - DNA, 16 bp, R. norvegicus
aagtcagagcaagaac

SEQ ID NO: 468126 - DNA, 16 bp, R. norvegicus
aagtcagcatttgaat

SEQ ID NO: 468127 - DNA, 16 bp, R. norvegicus
aagtcaggaagcagga

SEQ ID NO: 468128 - DNA, 16 bp, R. norvegicus
aagtcagggaaggagc

SEQ ID NO: 468129 - DNA, 16 bp, R. norvegicus
aagtcagtcctctgct

SEQ ID NO: 468130 - DNA, 16 bp, R. norvegicus
aagtcagtttttaaaa

SEQ ID NO: 468131 - DNA, 16 bp, R. norvegicus
aagtcatcagacttgg

SEQ ID NO: 468132 - DNA, 16 bp, R. norvegicus
aagtcatcctctgcta

SEQ ID NO: 468133 - DNA, 16 bp, R. norvegicus
aagtcatctcttcagc

SEQ ID NO: 468134 - DNA, 16 bp, R. norvegicus
aagtcatcttcccaca

SEQ ID NO: 468135 - DNA, 16 bp, R. norvegicus
aagtcatgaagagcaa

SEQ ID NO: 468136 - DNA, 16 bp, R. norvegicus
aagtcattctttttaa

SEQ ID NO: 468137 - DNA, 16 bp, R. norvegicus
aagtcattggttttga

SEQ ID NO: 468138 - DNA, 16 bp, R. norvegicus
aagtcattgtttttga

SEQ ID NO: 468139 - DNA, 16 bp, R. norvegicus
aagtcatttatttgtg

SEQ ID NO: 468140 - DNA, 16 bp, R. norvegicus
aagtcatttgagagga

SEQ ID NO: 468141 - DNA, 16 bp, R. norvegicus
aagtccaagatcaagg

SEQ ID NO: 468142 - DNA, 29 bp, R. norvegicus
aagtccaagtggatcaaggacctccacgt

SEQ ID NO: 468143 - DNA, 17 bp, R. norvegicus
aagtccaagtgggtcaa

SEQ ID NO: 468144 - DNA, 16 bp, R. norvegicus
aagtccagcaatcaaa

SEQ ID NO: 468145 - DNA, 16 bp, R. norvegicus
aagtccagcctggtct

SEQ ID NO: 468146 - DNA, 16 bp, R. norvegicus
aagtccagctgcagca

SEQ ID NO: 468147 - DNA, 16 bp, R. norvegicus
aagtccatcatggctg

SEQ ID NO: 468148 - DNA, 16 bp, R. norvegicus
aagtccatgttgttga

SEQ ID NO: 468149 - DNA, 16 bp, R. norvegicus
aagtcccagaaatgaa

SEQ ID NO: 468150 - DNA, 16 bp, R. norvegicus
aagtcccagaacagcc

SEQ ID NO: 468151 - DNA, 16 bp, R. norvegicus
aagtccccagaatccc

SEQ ID NO: 468152 - DNA, 16 bp, R. norvegicus
aagtcccttcagctcc

SEQ ID NO: 468153 - DNA, 16 bp, R. norvegicus
aagtcctagcaagagc

SEQ ID NO: 468154 - DNA, 16 bp, R. norvegicus
aagtcctccatcttca

SEQ ID NO: 468155 - DNA, 16 bp, R. norvegicus
aagtcctctatcacca

SEQ ID NO: 468156 - DNA, 16 bp, R. norvegicus
aagtcctctatcttca

SEQ ID NO: 468157 - DNA, 16 bp, R. norvegicus
aagtcctgcagcatca

SEQ ID NO: 468158 - DNA, 16 bp, R. norvegicus
aagtcctttattgttg

SEQ ID NO: 468159 - DNA, 16 bp, R. norvegicus
aagtctacaaaagaga

SEQ ID NO: 468160 - DNA, 16 bp, R. norvegicus
aagtctcaaatatttt

SEQ ID NO: 468161 - DNA, 16 bp, R. norvegicus
aagtctcaactgagga

SEQ ID NO: 468162 - DNA, 16 bp, R. norvegicus
aagtctcagaaaagcc

SEQ ID NO: 468163 - DNA, 16 bp, R. norvegicus
aagtctcaggatgatg

SEQ ID NO: 468164 - DNA, 16 bp, R. norvegicus
aagtctcagttctgaa

SEQ ID NO: 468165 - DNA, 16 bp, R. norvegicus
aagtctccaaataatg

SEQ ID NO: 468166 - DNA, 16 bp, R. norvegicus
aagtctcccaaacaac

SEQ ID NO: 468167 - DNA, 16 bp, R. norvegicus
aagtctctgcaaagct

SEQ ID NO: 468168 - DNA, 16 bp, R. norvegicus
aagtctctggcagagc

SEQ ID NO: 468169 - DNA, 16 bp, R. norvegicus
aagtctgaggatgaac

SEQ ID NO: 468170 - DNA, 16 bp, R. norvegicus
aagtctgaggtcagcc

SEQ ID NO: 468171 - DNA, 16 bp, R. norvegicus
aagtctgattatttcc

SEQ ID NO: 468172 - DNA, 16 bp, R. norvegicus
aagtctggggaatgtg

SEQ ID NO: 468173 - DNA, 16 bp, R. norvegicus
aagtctgtcactgtgg

SEQ ID NO: 468174 - DNA, 16 bp, R. norvegicus
aagtctgtgtcttcca

SEQ ID NO: 468175 - DNA, 16 bp, R. norvegicus
aagtcttcccacctca

SEQ ID NO: 468176 - DNA, 16 bp, R. norvegicus
aagtcttctactatta

SEQ ID NO: 468177 - DNA, 16 bp, R. norvegicus
aagtcttctgcaagaa

SEQ ID NO: 468178 - DNA, 16 bp, R. norvegicus
aagtgaaagaacagaa

SEQ ID NO: 468179 - DNA, 16 bp, R. norvegicus
aagtgaaagaccttta

SEQ ID NO: 468180 - DNA, 16 bp, R. norvegicus
aagtgaaattatgttt

SEQ ID NO: 468181 - DNA, 16 bp, R. norvegicus
aagtgaagatgcttca

SEQ ID NO: 468182 - DNA, 16 bp, R. norvegicus
aagtgaatattaaccc

SEQ ID NO: 468183 - DNA, 16 bp, R. norvegicus
aagtgaatgtgattgt

SEQ ID NO: 468184 - DNA, 16 bp, R. norvegicus
aagtgaatttgcaaat

SEQ ID NO: 468185 - DNA, 16 bp, R. norvegicus
aagtgacaccagccct

SEQ ID NO: 468186 - DNA, 16 bp, R. norvegicus
aagtgacagacagaca

SEQ ID NO: 468187 - DNA, 16 bp, R. norvegicus
aagtgaccacaggtgt

SEQ ID NO: 468188 - DNA, 16 bp, R. norvegicus
aagtgacctgcttggt

SEQ ID NO: 468189 - DNA, 16 bp, R. norvegicus
aagtgactgaggaaga

SEQ ID NO: 468190 - DNA, 16 bp, R. norvegicus
aagtgagattatgttt

SEQ ID NO: 468191 - DNA, 16 bp, R. norvegicus
aagtgatcattgagta

SEQ ID NO: 468192 - DNA, 16 bp, R. norvegicus
aagtgatgggattaaa

SEQ ID NO: 468193 - DNA, 16 bp, R. norvegicus
aagtgcaaaaagggga

SEQ ID NO: 468194 - DNA, 16 bp, R. norvegicus
aagtgcaaggacctgg

SEQ ID NO: 468195 - DNA, 16 bp, R. norvegicus
aagtgcaaggctctgg

SEQ ID NO: 468196 - DNA, 16 bp, R. norvegicus
aagtgcagaaaatcct

SEQ ID NO: 468197 - DNA, 16 bp, R. norvegicus
aagtgcagggacaaag

SEQ ID NO: 468198 - DNA, 16 bp, R. norvegicus
aagtgcagtctgacag

SEQ ID NO: 468199 - DNA, 16 bp, R. norvegicus
aagtgcatggtgacag

SEQ ID NO: 468200 - DNA, 16 bp, R. norvegicus
aagtgccctgacccag

SEQ ID NO: 468201 - DNA, 16 bp, R. norvegicus
aagtgcctcaaacaca

SEQ ID NO: 468202 - DNA, 16 bp, R. norvegicus
aagtgcctttgcccac

SEQ ID NO: 468203 - DNA, 16 bp, R. norvegicus
aagtgctctacactga

SEQ ID NO: 468204 - DNA, 25 bp, R. norvegicus
aagtgctctaccactgagctaaatc

SEQ ID NO: 468205 - DNA, 16 bp, R. norvegicus
aagtgctgggaatcaa

SEQ ID NO: 468206 - DNA, 16 bp, R. norvegicus
aagtgctgggattaca

SEQ ID NO: 468207 - DNA, 16 bp, R. norvegicus
aagtgcttctcagtca

SEQ ID NO: 468208 - DNA, 16 bp, R. norvegicus
aagtgcttgccacaca

SEQ ID NO: 468209 - DNA, 16 bp, R. norvegicus
aagtgcttgccaccaa

SEQ ID NO: 468210 - DNA, 16 bp, R. norvegicus
aagtgcttgctgtcag

SEQ ID NO: 468211 - DNA, 16 bp, R. norvegicus
aagtgctttctgagag

SEQ ID NO: 468212 - DNA, 16 bp, R. norvegicus
aagtgctttcttttat

SEQ ID NO: 468213 - DNA, 16 bp, R. norvegicus
aagtgctttgcccact

SEQ ID NO: 468214 - DNA, 16 bp, R. norvegicus
aagtgcttttatccac

SEQ ID NO: 468215 - DNA, 16 bp, R. norvegicus
aagtggaaacttaaga

SEQ ID NO: 468216 - DNA, 16 bp, R. norvegicus
aagtggaagcaggaag

SEQ ID NO: 468217 - DNA, 16 bp, R. norvegicus
aagtggaagtagaaac

SEQ ID NO: 468218 - DNA, 16 bp, R. norvegicus
aagtggacagcaccta

SEQ ID NO: 468219 - DNA, 16 bp, R. norvegicus
aagtggaggtctctcc

SEQ ID NO: 468220 - DNA, 16 bp, R. norvegicus
aagtggatcaagaact

SEQ ID NO: 468221 - DNA, 16 bp, R. norvegicus
aagtggatctctgact

SEQ ID NO: 468222 - DNA, 16 bp, R. norvegicus
aagtggatgaaagacc

SEQ ID NO: 468223 - DNA, 16 bp, R. norvegicus
aagtggatgttagcca

SEQ ID NO: 468224 - DNA, 16 bp, R. norvegicus
aagtggcaacaaaata

SEQ ID NO: 468225 - DNA, 16 bp, R. norvegicus
aagtggcagagctggg

SEQ ID NO: 468226 - DNA, 16 bp, R. norvegicus
aagtggctacacctat

SEQ ID NO: 468227 - DNA, 16 bp, R. norvegicus
aagtggctggagagat

SEQ ID NO: 468228 - DNA, 16 bp, R. norvegicus
aagtgggaaagagcct

SEQ ID NO: 468229 - DNA, 16 bp, R. norvegicus
aagtgggttccaggac

SEQ ID NO: 468230 - DNA, 16 bp, R. norvegicus
aagtggtcagaggcag

SEQ ID NO: 468231 - DNA, 16 bp, R. norvegicus
aagtggtgttctttgg

SEQ ID NO: 468232 - DNA, 16 bp, R. norvegicus
aagtgtcctgtgtctt

SEQ ID NO: 468233 - DNA, 16 bp, R. norvegicus
aagtgtccttgtggtg

SEQ ID NO: 468234 - DNA, 16 bp, R. norvegicus
aagtgtccttgttaaa

SEQ ID NO: 468235 - DNA, 16 bp, R. norvegicus
aagtgtctcctgagag

SEQ ID NO: 468236 - DNA, 16 bp, R. norvegicus
aagtgtcttgaacaca

SEQ ID NO: 468237 - DNA, 16 bp, R. norvegicus
aagtgtgaggacctga

SEQ ID NO: 468238 - DNA, 16 bp, R. norvegicus
aagtgtgatgcttcag

SEQ ID NO: 468239 - DNA, 16 bp, R. norvegicus
aagtgtggagcagagg

SEQ ID NO: 468240 - DNA, 16 bp, R. norvegicus
aagtgtggatcagaga

SEQ ID NO: 468241 - DNA, 16 bp, R. norvegicus
aagtgtggctttgttg

SEQ ID NO: 468242 - DNA, 16 bp, R. norvegicus
aagtgtggtgtgtgtg

SEQ ID NO: 468243 - DNA, 16 bp, R. norvegicus
aagtgtgtggtgtgtg

SEQ ID NO: 468244 - DNA, 16 bp, R. norvegicus
aagtgttcttctttat

SEQ ID NO: 468245 - DNA, 16 bp, R. norvegicus
aagttaaaaaatgcat

SEQ ID NO: 468246 - DNA, 43 bp, R. norvegicus
aagttaaatcaggaacagataaaccagttaaacaaccccatac

SEQ ID NO: 468247 - DNA, 16 bp, R. norvegicus
aagttaagactccaga

SEQ ID NO: 468248 - DNA, 16 bp, R. norvegicus
aagttaagtttatgat

SEQ ID NO: 468249 - DNA, 18 bp, R. norvegicus
aagttagactgcagggag

SEQ ID NO: 468250 - DNA, 16 bp, R. norvegicus
aagttagttttaaaaa

SEQ ID NO: 468251 - DNA, 16 bp, R. norvegicus
aagttatcattgaagt

SEQ ID NO: 468252 - DNA, 16 bp, R. norvegicus
aagttcaaagtctcct

SEQ ID NO: 468253 - DNA, 16 bp, R. norvegicus
aagttcaaagttcaag

SEQ ID NO: 468254 - DNA, 16 bp, R. norvegicus
aagttcaagaaggaag

SEQ ID NO: 468255 - DNA, 16 bp, R. norvegicus
aagttcaagaatcaac

SEQ ID NO: 468256 - DNA, 16 bp, R. norvegicus
aagttcaagacactga

SEQ ID NO: 468257 - DNA, 16 bp, R. norvegicus
aagttcaagaccagcc

SEQ ID NO: 468258 - DNA, 16 bp, R. norvegicus
aagttcaagatcaacc

SEQ ID NO: 468259 - DNA, 16 bp, R. norvegicus
aagttcaagccagaca

SEQ ID NO: 468260 - DNA, 16 bp, R. norvegicus
aagttcaaggccagcc

SEQ ID NO: 468261 - DNA, 16 bp, R. norvegicus
aagttcaagttcaagt

SEQ ID NO: 468262 - DNA, 16 bp, R. norvegicus
aagttcacatgcacat

SEQ ID NO: 468263 - DNA, 16 bp, R. norvegicus
aagttcagacaatcct

SEQ ID NO: 468264 - DNA, 16 bp, R. norvegicus
aagttcaggccaacag

SEQ ID NO: 468265 - DNA, 16 bp, R. norvegicus
aagttccaagacagcc

SEQ ID NO: 468266 - DNA, 16 bp, R. norvegicus
aagttccaggacagct

SEQ ID NO: 468267 - DNA, 16 bp, R. norvegicus
aagttccaggacatcc

SEQ ID NO: 468268 - DNA, 16 bp, R. norvegicus
aagttccaggttcagt

SEQ ID NO: 468269 - DNA, 16 bp, R. norvegicus
aagttcccaagacctc

SEQ ID NO: 468270 - DNA, 16 bp, R. norvegicus
aagttcctgaagaaag

SEQ ID NO: 468271 - DNA, 16 bp, R. norvegicus
aagttcctgaggaatg

SEQ ID NO: 468272 - DNA, 16 bp, R. norvegicus
aagttcctggaacaga

SEQ ID NO: 468273 - DNA, 16 bp, R. norvegicus
aagttccttcagctcc

SEQ ID NO: 468274 - DNA, 16 bp, R. norvegicus
aagttctacaacaaaa

SEQ ID NO: 468275 - DNA, 16 bp, R. norvegicus
aagttctagccaaagc

SEQ ID NO: 468276 - DNA, 16 bp, R. norvegicus
aagttctaggccagcc

SEQ ID NO: 468277 - DNA, 16 bp, R. norvegicus
aagttctcatgagttc

SEQ ID NO: 468278 - DNA, 16 bp, R. norvegicus
aagttctccatctcca

SEQ ID NO: 468279 - DNA, 16 bp, R. norvegicus
aagttctctttctgtg

SEQ ID NO: 468280 - DNA, 16 bp, R. norvegicus
aagttctgtgacttta

SEQ ID NO: 468281 - DNA, 16 bp, R. norvegicus
aagttctgtttccatg

SEQ ID NO: 468282 - DNA, 16 bp, R. norvegicus
aagttgaagaagatat

SEQ ID NO: 468283 - DNA, 16 bp, R. norvegicus
aagttgaagaagatct

SEQ ID NO: 468284 - DNA, 16 bp, R. norvegicus
aagttgactttgaaga

SEQ ID NO: 468285 - DNA, 16 bp, R. norvegicus
aagttgctcttgtcag

SEQ ID NO: 468286 - DNA, 16 bp, R. norvegicus
aagttgctggtggcca

SEQ ID NO: 468287 - DNA, 16 bp, R. norvegicus
aagttgcttgtggggg

SEQ ID NO: 468288 - DNA, 16 bp, R. norvegicus
aagttgcttttttgtc

SEQ ID NO: 468289 - DNA, 16 bp, R. norvegicus
aagttggagaggaaag

SEQ ID NO: 468290 - DNA, 16 bp, R. norvegicus
aagttggcctcaaact

SEQ ID NO: 468291 - DNA, 16 bp, R. norvegicus
aagttggcctctgacc

SEQ ID NO: 468292 - DNA, 16 bp, R. norvegicus
aagttgtcatggatga

SEQ ID NO: 468293 - DNA, 16 bp, R. norvegicus
aagttgtcctcagacc

SEQ ID NO: 468294 - DNA, 16 bp, R. norvegicus
aagttgtcctctggtt

SEQ ID NO: 468295 - DNA, 16 bp, R. norvegicus
aagttgtgccttcatt

SEQ ID NO: 468296 - DNA, 16 bp, R. norvegicus
aagttgttcatcaggc

SEQ ID NO: 468297 - DNA, 16 bp, R. norvegicus
aagttgttggccaaag

SEQ ID NO: 468298 - DNA, 16 bp, R. norvegicus
aagttgtttataaggt

SEQ ID NO: 468299 - DNA, 16 bp, R. norvegicus
aagttgtttatctgct

SEQ ID NO: 468300 - DNA, 16 bp, R. norvegicus
aagtttaaaggaagag

SEQ ID NO: 468301 - DNA, 16 bp, R. norvegicus
aagtttaagctgaata

SEQ ID NO: 468302 - DNA, 16 bp, R. norvegicus
aagtttaaggacagcc

SEQ ID NO: 468303 - DNA, 16 bp, R. norvegicus
aagtttagagcagagc

SEQ ID NO: 468304 - DNA, 16 bp, R. norvegicus
aagtttagatcagaga

SEQ ID NO: 468305 - DNA, 16 bp, R. norvegicus
aagtttctgaagaaaa

SEQ ID NO: 468306 - DNA, 16 bp, R. norvegicus
aagtttctgaagaaat

SEQ ID NO: 468307 - DNA, 16 bp, R. norvegicus
aagtttgaagaaatta

SEQ ID NO: 468308 - DNA, 16 bp, R. norvegicus
aagtttgaaggaagag

SEQ ID NO: 468309 - DNA, 16 bp, R. norvegicus
aagtttgagagcttga

SEQ ID NO: 468310 - DNA, 16 bp, R. norvegicus
aagtttgaggatagcc

SEQ ID NO: 468311 - DNA, 16 bp, R. norvegicus
aagtttgatgccagcc

SEQ ID NO: 468312 - DNA, 16 bp, R. norvegicus
aagttttaaaaggaaa

SEQ ID NO: 468313 - DNA, 16 bp, R. norvegicus
aagttttcaaaagaaa

SEQ ID NO: 468314 - DNA, 16 bp, R. norvegicus
aagttttctctgtgta

SEQ ID NO: 468315 - DNA, 16 bp, R. norvegicus
aagttttcttttgtaa

SEQ ID NO: 468316 - DNA, 16 bp, R. norvegicus
aagttttgtggctggg

SEQ ID NO: 468317 - DNA, 22 bp, R. norvegicus
aagttttgtttagcatgattca

SEQ ID NO: 468318 - DNA, 16 bp, R. norvegicus
aagtttttaaaagttt

SEQ ID NO: 468319 - DNA, 16 bp, R. norvegicus
aagtttttgatcttag

SEQ ID NO: 468320 - DNA, 16 bp, R. norvegicus
aataaaaaatgtccaa

SEQ ID NO: 468321 - DNA, 16 bp, R. norvegicus
aataaaaagagcatta

SEQ ID NO: 468322 - DNA, 16 bp, R. norvegicus
aataaaaatgtctaaa

SEQ ID NO: 468323 - DNA, 16 bp, R. norvegicus
aataaaaatgttctct

SEQ ID NO: 468324 - DNA, 16 bp, R. norvegicus
aataaaacaaaccttt

SEQ ID NO: 468325 - DNA, 16 bp, R. norvegicus
aataaaacagagacgt

SEQ ID NO: 468326 - DNA, 16 bp, R. norvegicus
aataaaaccagaaatg

SEQ ID NO: 468327 - DNA, 16 bp, R. norvegicus
aataaaacccaaactg

SEQ ID NO: 468328 - DNA, 16 bp, R. norvegicus
aataaaactatcattt

SEQ ID NO: 468329 - DNA, 16 bp, R. norvegicus
aataaaactttattga

SEQ ID NO: 468330 - DNA, 16 bp, R. norvegicus
aataaaaggacttctg

SEQ ID NO: 468331 - DNA, 16 bp, R. norvegicus
aataaaaggctgaaaa

SEQ ID NO: 468332 - DNA, 16 bp, R. norvegicus
aataaaagtgacattt

SEQ ID NO: 468333 - DNA, 16 bp, R. norvegicus
aataaaataaagccag

SEQ ID NO: 468334 - DNA, 16 bp, R. norvegicus
aataaaataagtcttt

SEQ ID NO: 468335 - DNA, 16 bp, R. norvegicus
aataaaatcaaaatgt

SEQ ID NO: 468336 - DNA, 16 bp, R. norvegicus
aataaaatcacatttt

SEQ ID NO: 468337 - DNA, 16 bp, R. norvegicus
aataaaatcttgaaaa

SEQ ID NO: 468338 - DNA, 16 bp, R. norvegicus
aataaaatgaattttc

SEQ ID NO: 468339 - DNA, 16 bp, R. norvegicus
aataaaatgactccta

SEQ ID NO: 468340 - DNA, 16 bp, R. norvegicus
aataaaatggacatat

SEQ ID NO: 468341 - DNA, 16 bp, R. norvegicus
aataaaattttgaact

SEQ ID NO: 468342 - DNA, 16 bp, R. norvegicus
aataaacaagcagaag

SEQ ID NO: 468343 - DNA, 16 bp, R. norvegicus
aataaacacataaatg

SEQ ID NO: 468344 - DNA, 16 bp, R. norvegicus
aataaacacatgattt

SEQ ID NO: 468345 - DNA, 16 bp, R. norvegicus
aataaacagtctgaga

SEQ ID NO: 468346 - DNA, 16 bp, R. norvegicus
aataaacatcatcctg

SEQ ID NO: 468347 - DNA, 16 bp, R. norvegicus
aataaacatttttctc

SEQ ID NO: 468348 - DNA, 16 bp, R. norvegicus
aataaaccctttcctc

SEQ ID NO: 468349 - DNA, 16 bp, R. norvegicus
aataaacctcatgttt

SEQ ID NO: 468350 - DNA, 16 bp, R. norvegicus
aataaagaaatacatt

SEQ ID NO: 468351 - DNA, 16 bp, R. norvegicus
aataaagaactcaaga

SEQ ID NO: 468352 - DNA, 16 bp, R. norvegicus
aataaagaaggcagaa

SEQ ID NO: 468353 - DNA, 16 bp, R. norvegicus
aataaagaattcaaga

SEQ ID NO: 468354 - DNA, 16 bp, R. norvegicus
aataaagacatttaaa

SEQ ID NO: 468355 - DNA, 16 bp, R. norvegicus
aataaagacttcaaat

SEQ ID NO: 468356 - DNA, 16 bp, R. norvegicus
aataaagagatgccca

SEQ ID NO: 468357 - DNA, 16 bp, R. norvegicus
aataaagcatccacat

SEQ ID NO: 468358 - DNA, 16 bp, R. norvegicus
aataaagctgctatga

SEQ ID NO: 468359 - DNA, 16 bp, R. norvegicus
aataaagcttctgtga

SEQ ID NO: 468360 - DNA, 16 bp, R. norvegicus
aataaagctttattta

SEQ ID NO: 468361 - DNA, 16 bp, R. norvegicus
aataaagggacttctg

SEQ ID NO: 468362 - DNA, 16 bp, R. norvegicus
aataaataaatgttca

SEQ ID NO: 468363 - DNA, 16 bp, R. norvegicus
aataaatattctttgt

SEQ ID NO: 468364 - DNA, 16 bp, R. norvegicus
aataaatatttctttg

SEQ ID NO: 468365 - DNA, 16 bp, R. norvegicus
aataaatgcttatttt

SEQ ID NO: 468366 - DNA, 16 bp, R. norvegicus
aataaatgtattttct

SEQ ID NO: 468367 - DNA, 16 bp, R. norvegicus
aataaatgtttacaaa

SEQ ID NO: 468368 - DNA, 16 bp, R. norvegicus
aataaattctttaaag

SEQ ID NO: 468369 - DNA, 16 bp, R. norvegicus
aataaattttcaggtg

SEQ ID NO: 468370 - DNA, 16 bp, R. norvegicus
aataacaacaacagca

SEQ ID NO: 468371 - DNA, 16 bp, R. norvegicus
aataacaacagcaaca

SEQ ID NO: 468372 - DNA, 16 bp, R. norvegicus
aataacaaccaaccag

SEQ ID NO: 468373 - DNA, 16 bp, R. norvegicus
aataaccatgatacaa

SEQ ID NO: 468374 - DNA, 16 bp, R. norvegicus
aataactcctaatgat

SEQ ID NO: 468375 - DNA, 16 bp, R. norvegicus
aataactcttaaagaa

SEQ ID NO: 468376 - DNA, 16 bp, R. norvegicus
aataagacaactgaag

SEQ ID NO: 468377 - DNA, 16 bp, R. norvegicus
aataagagaaagaact

SEQ ID NO: 468378 - DNA, 25 bp, R. norvegicus
aataagggaagaatgcccacatata

SEQ ID NO: 468379 - DNA, 16 bp, R. norvegicus
aataagtcttttaaaa

SEQ ID NO: 468380 - DNA, 16 bp, R. norvegicus
aataagtgtgtgtgtg

SEQ ID NO: 468381 - DNA, 16 bp, R. norvegicus
aataataatggtgatg

SEQ ID NO: 468382 - DNA, 16 bp, R. norvegicus
aataatctctgatcca

SEQ ID NO: 468383 - DNA, 16 bp, R. norvegicus
aataatgatatgacaa

SEQ ID NO: 468384 - DNA, 18 bp, R. norvegicus
aataatgatttgtatgcc

SEQ ID NO: 468385 - DNA, 16 bp, R. norvegicus
aataatggtgggagat

SEQ ID NO: 468386 - DNA, 16 bp, R. norvegicus
aataatgtcacttcct

SEQ ID NO: 468387 - DNA, 16 bp, R. norvegicus
aataattcttttgttt

SEQ ID NO: 468388 - DNA, 16 bp, R. norvegicus
aataatttcagcaaag

SEQ ID NO: 468389 - DNA, 16 bp, R. norvegicus
aataattttatagttg

SEQ ID NO: 468390 - DNA, 16 bp, R. norvegicus
aatacaaagacaacct

SEQ ID NO: 468391 - DNA, 16 bp, R. norvegicus
aatacaaagagggaaa

SEQ ID NO: 468392 - DNA, 16 bp, R. norvegicus
aatacaaatgtatgaa

SEQ ID NO: 468393 - DNA, 16 bp, R. norvegicus
aatacaagagattgaa

SEQ ID NO: 468394 - DNA, 16 bp, R. norvegicus
aatacaaggaaggaaa

SEQ ID NO: 468395 - DNA, 16 bp, R. norvegicus
aatacaatgacttcat

SEQ ID NO: 468396 - DNA, 16 bp, R. norvegicus
aatacacaatggtatt

SEQ ID NO: 468397 - DNA, 16 bp, R. norvegicus
aatacacacaggagga

SEQ ID NO: 468398 - DNA, 16 bp, R. norvegicus
aatacacactggagaa

SEQ ID NO: 468399 - DNA, 16 bp, R. norvegicus
aatacacagaagtgaa

SEQ ID NO: 468400 - DNA, 20 bp, R. norvegicus
aatacaccagaaaagcaaga

SEQ ID NO: 468401 - DNA, 16 bp, R. norvegicus
aatacagaaaatatgg

SEQ ID NO: 468402 - DNA, 16 bp, R. norvegicus
aatacagaaagaaatt

SEQ ID NO: 468403 - DNA, 16 bp, R. norvegicus
aatacagagacaatgt

SEQ ID NO: 468404 - DNA, 16 bp, R. norvegicus
aatacagatgcaaaaa

SEQ ID NO: 468405 - DNA, 16 bp, R. norvegicus
aatacagccattgcaa

SEQ ID NO: 468406 - DNA, 16 bp, R. norvegicus
aatacaggaaaacaca

SEQ ID NO: 468407 - DNA, 16 bp, R. norvegicus
aatacaggaaatacag

SEQ ID NO: 468408 - DNA, 16 bp, R. norvegicus
aatacaggagaataca

SEQ ID NO: 468409 - DNA, 16 bp, R. norvegicus
aatacagtttttggat

SEQ ID NO: 468410 - DNA, 16 bp, R. norvegicus
aatacataaaatgtcc

SEQ ID NO: 468411 - DNA, 16 bp, R. norvegicus
aatacatactggaaaa

SEQ ID NO: 468412 - DNA, 16 bp, R. norvegicus
aatacatatgtgtgtg

SEQ ID NO: 468413 - DNA, 16 bp, R. norvegicus
aatacatctttttaaa

SEQ ID NO: 468414 - DNA, 16 bp, R. norvegicus
aatacatgggcactgg

SEQ ID NO: 468415 - DNA, 16 bp, R. norvegicus
aatacattttatgaaa

SEQ ID NO: 468416 - DNA, 16 bp, R. norvegicus
aataccaaattaaatg

SEQ ID NO: 468417 - DNA, 16 bp, R. norvegicus
aataccaagctgcaca

SEQ ID NO: 468418 - DNA, 26 bp, R. norvegicus
aataccaatccaattcttcaaagagg

SEQ ID NO: 468419 - DNA, 16 bp, R. norvegicus
aataccaatgcaaaaa

SEQ ID NO: 468420 - DNA, 16 bp, R. norvegicus
aataccaatggcttat

SEQ ID NO: 468421 - DNA, 16 bp, R. norvegicus
aataccagaagagggc

SEQ ID NO: 468422 - DNA, 16 bp, R. norvegicus
aataccagtgaaaaaa

SEQ ID NO: 468423 - DNA, 16 bp, R. norvegicus
aataccccacttctgg

SEQ ID NO: 468424 - DNA, 16 bp, R. norvegicus
aataccccattctcat

SEQ ID NO: 468425 - DNA, 17 bp, R. norvegicus
aatacccttggcagtga

SEQ ID NO: 468426 - DNA, 16 bp, R. norvegicus
aatacctccagaagtt

SEQ ID NO: 468427 - DNA, 16 bp, R. norvegicus
aatacctcttagtgtt

SEQ ID NO: 468428 - DNA, 16 bp, R. norvegicus
aatactactactaata

SEQ ID NO: 468429 - DNA, 16 bp, R. norvegicus
aatactattcacctat

SEQ ID NO: 468430 - DNA, 16 bp, R. norvegicus
aatactctttggttgg

SEQ ID NO: 468431 - DNA, 16 bp, R. norvegicus
aatacttgaaatgtat

SEQ ID NO: 468432 - DNA, 16 bp, R. norvegicus
aatactttgatttctt

SEQ ID NO: 468433 - DNA, 16 bp, R. norvegicus
aatagaaaacctaact

SEQ ID NO: 468434 - DNA, 16 bp, R. norvegicus
aatagaagcagttgtt

SEQ ID NO: 468435 - DNA, 16 bp, R. norvegicus
aatagaaggaaaagcc

SEQ ID NO: 468436 - DNA, 40 bp, R. norvegicus
aatagaccaatggaatagaattgaagacccagaaatgaac

SEQ ID NO: 468437 - DNA, 16 bp, R. norvegicus
aatagacccaagaagc

SEQ ID NO: 468438 - DNA, 16 bp, R. norvegicus
aatagaggagttagag

SEQ ID NO: 468439 - DNA, 16 bp, R. norvegicus
aatagatctacatgaa

SEQ ID NO: 468440 - DNA, 16 bp, R. norvegicus
aatagatggaaaagtc

SEQ ID NO: 468441 - DNA, 16 bp, R. norvegicus
aatagatggatagata

SEQ ID NO: 468442 - DNA, 16 bp, R. norvegicus
aatagcaaaaactatt

SEQ ID NO: 468443 - DNA, 16 bp, R. norvegicus
aatagcaacaaaaatg

SEQ ID NO: 468444 - DNA, 16 bp, R. norvegicus
aatagcaccagcagca

SEQ ID NO: 468445 - DNA, 16 bp, R. norvegicus
aatagccaaaacacca

SEQ ID NO: 468446 - DNA, 16 bp, R. norvegicus
aatagccagagactgg

SEQ ID NO: 468447 - DNA, 16 bp, R. norvegicus
aatagcgataaaaact

SEQ ID NO: 468448 - DNA, 16 bp, R. norvegicus
aatagctgccttcaac

SEQ ID NO: 468449 - DNA, 16 bp, R. norvegicus
aataggaaaactcata

SEQ ID NO: 468450 - DNA, 16 bp, R. norvegicus
aataggaggtgtggcc

SEQ ID NO: 468451 - DNA, 16 bp, R. norvegicus
aatagtaataataaca

SEQ ID NO: 468452 - DNA, 16 bp, R. norvegicus
aatagtaatgaaaact

SEQ ID NO: 468453 - DNA, 16 bp, R. norvegicus
aatagtcaataaaatt

SEQ ID NO: 468454 - DNA, 16 bp, R. norvegicus
aatagtgctactccct

SEQ ID NO: 468455 - DNA, 16 bp, R. norvegicus
aatagtgctgattcaa

SEQ ID NO: 468456 - DNA, 16 bp, R. norvegicus
aatagttctttggggg

SEQ ID NO: 468457 - DNA, 16 bp, R. norvegicus
aatataagaaactatt

SEQ ID NO: 468458 - DNA, 16 bp, R. norvegicus
aatataaggaacctgg

SEQ ID NO: 468459 - DNA, 16 bp, R. norvegicus
aatatacccaaactta

SEQ ID NO: 468460 - DNA, 16 bp, R. norvegicus
aatatacccaagaaga

SEQ ID NO: 468461 - DNA, 16 bp, R. norvegicus
aatataccttcttttt

SEQ ID NO: 468462 - DNA, 16 bp, R. norvegicus
aatataggagaacaca

SEQ ID NO: 468463 - DNA, 16 bp, R. norvegicus
aatataggggctgagg

SEQ ID NO: 468464 - DNA, 16 bp, R. norvegicus
aatatataaaatatgc

SEQ ID NO: 468465 - DNA, 16 bp, R. norvegicus
aatatataaatatgca

SEQ ID NO: 468466 - DNA, 16 bp, R. norvegicus
aatatatctgtatata

SEQ ID NO: 468467 - DNA, 16 bp, R. norvegicus
aatatattcatacata

SEQ ID NO: 468468 - DNA, 16 bp, R. norvegicus
aatatattggtgtgac

SEQ ID NO: 468469 - DNA, 16 bp, R. norvegicus
aatatatttattcact

SEQ ID NO: 468470 - DNA, 16 bp, R. norvegicus
aatatcacaaggagga

SEQ ID NO: 468471 - DNA, 18 bp, R. norvegicus
aatatcatcctgaatgag

SEQ ID NO: 468472 - DNA, 16 bp, R. norvegicus
aatatcattaataatg

SEQ ID NO: 468473 - DNA, 16 bp, R. norvegicus
aatatccaaacacagc

SEQ ID NO: 468474 - DNA, 16 bp, R. norvegicus
aatatccacttatctg

SEQ ID NO: 468475 - DNA, 16 bp, R. norvegicus
aatatccagaaactgg

SEQ ID NO: 468476 - DNA, 16 bp, R. norvegicus
aatatccaggaaattt

SEQ ID NO: 468477 - DNA, 16 bp, R. norvegicus
aatatccatttatcaa

SEQ ID NO: 468478 - DNA, 16 bp, R. norvegicus
aatatccattttaaaa

SEQ ID NO: 468479 - DNA, 16 bp, R. norvegicus
aatatcctagaaagag

SEQ ID NO: 468480 - DNA, 16 bp, R. norvegicus
aatatctaagaagaaa

SEQ ID NO: 468481 - DNA, 16 bp, R. norvegicus
aatatgaaatacctca

SEQ ID NO: 468482 - DNA, 16 bp, R. norvegicus
aatatgcatatacaca

SEQ ID NO: 468483 - DNA, 16 bp, R. norvegicus
aatatgcatatatatg

SEQ ID NO: 468484 - DNA, 16 bp, R. norvegicus
aatatgcctggcccag

SEQ ID NO: 468485 - DNA, 16 bp, R. norvegicus
aatatgctgtcttttt

SEQ ID NO: 468486 - DNA, 16 bp, R. norvegicus
aatatggaataaaatc

SEQ ID NO: 468487 - DNA, 16 bp, R. norvegicus
aatatggagaaataat

SEQ ID NO: 468488 - DNA, 16 bp, R. norvegicus
aatatggatatatttg

SEQ ID NO: 468489 - DNA, 16 bp, R. norvegicus
aatatgggatgtggaa

SEQ ID NO: 468490 - DNA, 16 bp, R. norvegicus
aatatggttaaagaga

SEQ ID NO: 468491 - DNA, 16 bp, R. norvegicus
aatatgtatcccattt

SEQ ID NO: 468492 - DNA, 17 bp, R. norvegicus
aatattaaccaaccaga

SEQ ID NO: 468493 - DNA, 16 bp, R. norvegicus
aatattaatgaagcca

SEQ ID NO: 468494 - DNA, 16 bp, R. norvegicus
aatattacagagaaat

SEQ ID NO: 468495 - DNA, 16 bp, R. norvegicus
aatattactcaactat

SEQ ID NO: 468496 - DNA, 16 bp, R. norvegicus
aatattcaaagaaaat

SEQ ID NO: 468497 - DNA, 16 bp, R. norvegicus
aatattcatagaaggg

SEQ ID NO: 468498 - DNA, 16 bp, R. norvegicus
aatattcattcaatta

SEQ ID NO: 468499 - DNA, 16 bp, R. norvegicus
aatattccactgtgta

SEQ ID NO: 468500 - DNA, 16 bp, R. norvegicus
aatattccaggacaaa

SEQ ID NO: 468501 - DNA, 16 bp, R. norvegicus
aatattccatgacaaa

SEQ ID NO: 468502 - DNA, 16 bp, R. norvegicus
aatattcctctgttga

SEQ ID NO: 468503 - DNA, 16 bp, R. norvegicus
aatattctctctttat

SEQ ID NO: 468504 - DNA, 16 bp, R. norvegicus
aatattgcagatgcca

SEQ ID NO: 468505 - DNA, 16 bp, R. norvegicus
aatattgtttgggttt

SEQ ID NO: 468506 - DNA, 16 bp, R. norvegicus
aatatttacaaaatga

SEQ ID NO: 468507 - DNA, 16 bp, R. norvegicus
aatatttactgcaaca

SEQ ID NO: 468508 - DNA, 16 bp, R. norvegicus
aatatttatgtatgta

SEQ ID NO: 468509 - DNA, 16 bp, R. norvegicus
aatatttcagaaaaat

SEQ ID NO: 468510 - DNA, 16 bp, R. norvegicus
aatatttcagtttcct

SEQ ID NO: 468511 - DNA, 16 bp, R. norvegicus
aatatttcatttgttt

SEQ ID NO: 468512 - DNA, 16 bp, R. norvegicus
aatatttgtatgaggt

SEQ ID NO: 468513 - DNA, 16 bp, R. norvegicus
aatattttaaaagttc

SEQ ID NO: 468514 - DNA, 16 bp, R. norvegicus
aatattttaagcaaaa

SEQ ID NO: 468515 - DNA, 16 bp, R. norvegicus
aatattttattgagta

SEQ ID NO: 468516 - DNA, 16 bp, R. norvegicus
aatattttcaagaaaa

SEQ ID NO: 468517 - DNA, 16 bp, R. norvegicus
aatattttcatgtttt

SEQ ID NO: 468518 - DNA, 16 bp, R. norvegicus
aatattttcctaccat

SEQ ID NO: 468519 - DNA, 16 bp, R. norvegicus
aatattttctaaaaca

SEQ ID NO: 468520 - DNA, 16 bp, R. norvegicus
aatattttctatggaa

SEQ ID NO: 468521 - DNA, 16 bp, R. norvegicus
aatattttctctttgt

SEQ ID NO: 468522 - DNA, 16 bp, R. norvegicus
aatattttctgtttat

SEQ ID NO: 468523 - DNA, 16 bp, R. norvegicus
aatattttctttgcaa

SEQ ID NO: 468524 - DNA, 16 bp, R. norvegicus
aatattttgagaagaa

SEQ ID NO: 468525 - DNA, 16 bp, R. norvegicus
aatattttggaaaaga

SEQ ID NO: 468526 - DNA, 16 bp, R. norvegicus
aatattttggaaaata

SEQ ID NO: 468527 - DNA, 16 bp, R. norvegicus
aatattttgtctttgt

SEQ ID NO: 468528 - DNA, 16 bp, R. norvegicus
aatatttttatggaac

SEQ ID NO: 468529 - DNA, 16 bp, R. norvegicus
aatcaaaaagtacaca

SEQ ID NO: 468530 - DNA, 16 bp, R. norvegicus
aatcaaaagaagagag

SEQ ID NO: 468531 - DNA, 16 bp, R. norvegicus
aatcaaaataccacta

SEQ ID NO: 468532 - DNA, 16 bp, R. norvegicus
aatcaaaattgaaaag

SEQ ID NO: 468533 - DNA, 16 bp, R. norvegicus
aatcaaagaaaaattt

SEQ ID NO: 468534 - DNA, 16 bp, R. norvegicus
aatcaaagttccagaa

SEQ ID NO: 468535 - DNA, 16 bp, R. norvegicus
aatcaaattcttcaga

SEQ ID NO: 468536 - DNA, 16 bp, R. norvegicus
aatcaacaaaattaga

SEQ ID NO: 468537 - DNA, 16 bp, R. norvegicus
aatcaacaagacagac

SEQ ID NO: 468538 - DNA, 16 bp, R. norvegicus
aatcaacagaaggaaa

SEQ ID NO: 468539 - DNA, 16 bp, R. norvegicus
aatcaacagacccaaa

SEQ ID NO: 468540 - DNA, 16 bp, R. norvegicus
aatcaacaggatgctc

SEQ ID NO: 468541 - DNA, 16 bp, R. norvegicus
aatcaaccaaagagaa

SEQ ID NO: 468542 - DNA, 16 bp, R. norvegicus
aatcaagaaagcacaa

SEQ ID NO: 468543 - DNA, 16 bp, R. norvegicus
aatcaagacaatcctc

SEQ ID NO: 468544 - DNA, 26 bp, R. norvegicus
aatcaaggaagaatgcccacatatac

SEQ ID NO: 468545 - DNA, 17 bp, R. norvegicus
aatcaaggaagaatgtc

SEQ ID NO: 468546 - DNA, 16 bp, R. norvegicus
aatcaataaaaccaag

SEQ ID NO: 468547 - DNA, 16 bp, R. norvegicus
aatcaatctcagggct

SEQ ID NO: 468548 - DNA, 16 bp, R. norvegicus
aatcaattttccaagc

SEQ ID NO: 468549 - DNA, 16 bp, R. norvegicus
aatcacaaatggtctg

SEQ ID NO: 468550 - DNA, 16 bp, R. norvegicus
aatcacaagaaaatga

SEQ ID NO: 468551 - DNA, 16 bp, R. norvegicus
aatcacaaggccctgg

SEQ ID NO: 468552 - DNA, 20 bp, R. norvegicus
aatcacagaaaaacacactt

SEQ ID NO: 468553 - DNA, 16 bp, R. norvegicus
aatcacagagcctgca

SEQ ID NO: 468554 - DNA, 16 bp, R. norvegicus
aatcacatgaccatct

SEQ ID NO: 468555 - DNA, 16 bp, R. norvegicus
aatcaccatccccgac

SEQ ID NO: 468556 - DNA, 16 bp, R. norvegicus
aatcacctaaagaaat

SEQ ID NO: 468557 - DNA, 16 bp, R. norvegicus
aatcacctgggagaca

SEQ ID NO: 468558 - DNA, 77 bp, R. norvegicus
aatcactatccctgaactcaagcagtattacagagcaatagtgataaaaactgcatggtattggtacagagacagaa

SEQ ID NO: 468559 - DNA, 165 bp, R. norvegicus
aatcactatccctgaactcaagcagtattacagagcaatagtgataaaaactgcatggtattggtacagagacagacagatagaccaatggaatagaattgaagacccagaaatgaacccacacacctatggtcacttgatttttgacaaaggagccaaaaccat

SEQ ID NO: 468560 - DNA, 16 bp, R. norvegicus
aatcactgaaagaatt

SEQ ID NO: 468561 - DNA, 16 bp, R. norvegicus
aatcactgaattgaga

SEQ ID NO: 468562 - DNA, 16 bp, R. norvegicus
aatcagaaatgagaag

SEQ ID NO: 468563 - DNA, 16 bp, R. norvegicus
aatcagaagttcaagg

SEQ ID NO: 468564 - DNA, 16 bp, R. norvegicus
aatcagaagtttaagg

SEQ ID NO: 468565 - DNA, 16 bp, R. norvegicus
aatcagacaacaagag

SEQ ID NO: 468566 - DNA, 16 bp, R. norvegicus
aatcagacaataaaat

SEQ ID NO: 468567 - DNA, 16 bp, R. norvegicus
aatcagacaatgaaaa

SEQ ID NO: 468568 - DNA, 16 bp, R. norvegicus
aatcagagaaaaaact

SEQ ID NO: 468569 - DNA, 16 bp, R. norvegicus
aatcagagaaaggttt

SEQ ID NO: 468570 - DNA, 16 bp, R. norvegicus
aatcagatattgttga

SEQ ID NO: 468571 - DNA, 16 bp, R. norvegicus
aatcagatggtgagag

SEQ ID NO: 468572 - DNA, 16 bp, R. norvegicus
aatcagcaaaaccaaa

SEQ ID NO: 468573 - DNA, 16 bp, R. norvegicus
aatcagctctctctcc

SEQ ID NO: 468574 - DNA, 17 bp, R. norvegicus
aatcaggccttccagca

SEQ ID NO: 468575 - DNA, 16 bp, R. norvegicus
aatcagggtacctttc

SEQ ID NO: 468576 - DNA, 16 bp, R. norvegicus
aatcagtcatatctac

SEQ ID NO: 468577 - DNA, 16 bp, R. norvegicus
aatcagtgagcttcag

SEQ ID NO: 468578 - DNA, 16 bp, R. norvegicus
aatcagttacaaaaca

SEQ ID NO: 468579 - DNA, 16 bp, R. norvegicus
aatcatagaatctatt

SEQ ID NO: 468580 - DNA, 16 bp, R. norvegicus
aatcatcaaagaaaat

SEQ ID NO: 468581 - DNA, 16 bp, R. norvegicus
aatcatccctgcattc

SEQ ID NO: 468582 - DNA, 16 bp, R. norvegicus
aatcatctgtaaggag

SEQ ID NO: 468583 - DNA, 16 bp, R. norvegicus
aatcatgagatgtgat

SEQ ID NO: 468584 - DNA, 16 bp, R. norvegicus
aatcattgatcattaa

SEQ ID NO: 468585 - DNA, 16 bp, R. norvegicus
aatcatttctcttctt

SEQ ID NO: 468586 - DNA, 16 bp, R. norvegicus
aatcatttttgttgtt

SEQ ID NO: 468587 - DNA, 16 bp, R. norvegicus
aatccaaatccaagaa

SEQ ID NO: 468588 - DNA, 16 bp, R. norvegicus
aatccaaatcttcaaa

SEQ ID NO: 468589 - DNA, 16 bp, R. norvegicus
aatccaacccagaatt

SEQ ID NO: 468590 - DNA, 16 bp, R. norvegicus
aatccaagaacaaatt

SEQ ID NO: 468591 - DNA, 16 bp, R. norvegicus
aatccacagatccaaa

SEQ ID NO: 468592 - DNA, 16 bp, R. norvegicus
aatccacatcaaaata

SEQ ID NO: 468593 - DNA, 16 bp, R. norvegicus
aatccacatcaaaatc

SEQ ID NO: 468594 - DNA, 16 bp, R. norvegicus
aatccaccaagatgat

SEQ ID NO: 468595 - DNA, 16 bp, R. norvegicus
aatccacctccagcag

SEQ ID NO: 468596 - DNA, 16 bp, R. norvegicus
aatccacttcttcaaa

SEQ ID NO: 468597 - DNA, 16 bp, R. norvegicus
aatccagaaaatgaac

SEQ ID NO: 468598 - DNA, 16 bp, R. norvegicus
aatccagaaccaccag

SEQ ID NO: 468599 - DNA, 16 bp, R. norvegicus
aatccagagaatcaaa

SEQ ID NO: 468600 - DNA, 16 bp, R. norvegicus
aatccagatcttctga

SEQ ID NO: 468601 - DNA, 16 bp, R. norvegicus
aatccagcaagatgaa

SEQ ID NO: 468602 - DNA, 16 bp, R. norvegicus
aatccagcacttggga

SEQ ID NO: 468603 - DNA, 17 bp, R. norvegicus
aatccaggatgagaggt

SEQ ID NO: 468604 - DNA, 16 bp, R. norvegicus
aatccagtttgagttc

SEQ ID NO: 468605 - DNA, 16 bp, R. norvegicus
aatccatctgcctctg

SEQ ID NO: 468606 - DNA, 16 bp, R. norvegicus
aatccatgagcagggg

SEQ ID NO: 468607 - DNA, 16 bp, R. norvegicus
aatccattatcatcac

SEQ ID NO: 468608 - DNA, 16 bp, R. norvegicus
aatccattgtataaac

SEQ ID NO: 468609 - DNA, 16 bp, R. norvegicus
aatcccaaagaagcag

SEQ ID NO: 468610 - DNA, 16 bp, R. norvegicus
aatcccaacagccaca

SEQ ID NO: 468611 - DNA, 16 bp, R. norvegicus
aatcccactagaatca

SEQ ID NO: 468612 - DNA, 16 bp, R. norvegicus
aatcccagaactctga

SEQ ID NO: 468613 - DNA, 16 bp, R. norvegicus
aatcccagcacaggga

SEQ ID NO: 468614 - DNA, 16 bp, R. norvegicus
aatcccagcacatagg

SEQ ID NO: 468615 - DNA, 16 bp, R. norvegicus
aatcccagcacccaag

SEQ ID NO: 468616 - DNA, 16 bp, R. norvegicus
aatcccagcacctaga

SEQ ID NO: 468617 - DNA, 16 bp, R. norvegicus
aatcccagcactcggg

SEQ ID NO: 468618 - DNA, 16 bp, R. norvegicus
aatcccagcacttgga

SEQ ID NO: 468619 - DNA, 16 bp, R. norvegicus
aatcccagcactttgg

SEQ ID NO: 468620 - DNA, 16 bp, R. norvegicus
aatcccagccaccaca

SEQ ID NO: 468621 - DNA, 16 bp, R. norvegicus
aatcccagctctccag

SEQ ID NO: 468622 - DNA, 16 bp, R. norvegicus
aatcccaggactccag

SEQ ID NO: 468623 - DNA, 16 bp, R. norvegicus
aatcccaggactggag

SEQ ID NO: 468624 - DNA, 16 bp, R. norvegicus
aatcccaggagacaga

SEQ ID NO: 468625 - DNA, 16 bp, R. norvegicus
aatcccagggctggag

SEQ ID NO: 468626 - DNA, 16 bp, R. norvegicus
aatcccagtcctcagg

SEQ ID NO: 468627 - DNA, 16 bp, R. norvegicus
aatcccataagaagaa

SEQ ID NO: 468628 - DNA, 16 bp, R. norvegicus
aatcccatggaaggga

SEQ ID NO: 468629 - DNA, 16 bp, R. norvegicus
aatccccaaccccgtt

SEQ ID NO: 468630 - DNA, 16 bp, R. norvegicus
aatccccaactccttc

SEQ ID NO: 468631 - DNA, 16 bp, R. norvegicus
aatccccagccccgcc

SEQ ID NO: 468632 - DNA, 16 bp, R. norvegicus
aatccccagcccctgt

SEQ ID NO: 468633 - DNA, 16 bp, R. norvegicus
aatccccatcaaaatt

SEQ ID NO: 468634 - DNA, 16 bp, R. norvegicus
aatccccctgcctcag

SEQ ID NO: 468635 - DNA, 16 bp, R. norvegicus
aatcccgttcactgag

SEQ ID NO: 468636 - DNA, 16 bp, R. norvegicus
aatccctagaaataga

SEQ ID NO: 468637 - DNA, 16 bp, R. norvegicus
aatccctattctcacc

SEQ ID NO: 468638 - DNA, 18 bp, R. norvegicus
aatcctacaactgataga

SEQ ID NO: 468639 - DNA, 16 bp, R. norvegicus
aatcctagcacttaga

SEQ ID NO: 468640 - DNA, 16 bp, R. norvegicus
aatcctagtatttggg

SEQ ID NO: 468641 - DNA, 16 bp, R. norvegicus
aatcctcagaagatgg

SEQ ID NO: 468642 - DNA, 16 bp, R. norvegicus
aatcctccacaggacc

SEQ ID NO: 468643 - DNA, 16 bp, R. norvegicus
aatcctccagcctctg

SEQ ID NO: 468644 - DNA, 16 bp, R. norvegicus
aatcctcctgcctcag

SEQ ID NO: 468645 - DNA, 16 bp, R. norvegicus
aatcctcctggctcag

SEQ ID NO: 468646 - DNA, 16 bp, R. norvegicus
aatcctcttcagcaca

SEQ ID NO: 468647 - DNA, 16 bp, R. norvegicus
aatcctgaagaaatag

SEQ ID NO: 468648 - DNA, 16 bp, R. norvegicus
aatcctgataggtctg

SEQ ID NO: 468649 - DNA, 16 bp, R. norvegicus
aatcctgccctacaaa

SEQ ID NO: 468650 - DNA, 16 bp, R. norvegicus
aatcctgtctcaaaac

SEQ ID NO: 468651 - DNA, 16 bp, R. norvegicus
aatccttcactgctga

SEQ ID NO: 468652 - DNA, 16 bp, R. norvegicus
aatccttcatctgccc

SEQ ID NO: 468653 - DNA, 16 bp, R. norvegicus
aatccttcctcctgtt

SEQ ID NO: 468654 - DNA, 16 bp, R. norvegicus
aatccttcctctaatt

SEQ ID NO: 468655 - DNA, 16 bp, R. norvegicus
aatccttcctctgatt

SEQ ID NO: 468656 - DNA, 16 bp, R. norvegicus
aatcctttctctgatt

SEQ ID NO: 468657 - DNA, 16 bp, R. norvegicus
aatcggaaaagaagaa

SEQ ID NO: 468658 - DNA, 16 bp, R. norvegicus
aatctacaagaagggt

SEQ ID NO: 468659 - DNA, 16 bp, R. norvegicus
aatctagaattggaag

SEQ ID NO: 468660 - DNA, 16 bp, R. norvegicus
aatctagagaagcaaa

SEQ ID NO: 468661 - DNA, 16 bp, R. norvegicus
aatctagtttactggg

SEQ ID NO: 468662 - DNA, 16 bp, R. norvegicus
aatctcaacactctgg

SEQ ID NO: 468663 - DNA, 16 bp, R. norvegicus
aatctcaaggacagaa

SEQ ID NO: 468664 - DNA, 16 bp, R. norvegicus
aatctcacccaaggga

SEQ ID NO: 468665 - DNA, 16 bp, R. norvegicus
aatctcagaactcagg

SEQ ID NO: 468666 - DNA, 16 bp, R. norvegicus
aatctcagcacgtggg

SEQ ID NO: 468667 - DNA, 16 bp, R. norvegicus
aatctcaggcactgaa

SEQ ID NO: 468668 - DNA, 16 bp, R. norvegicus
aatctcagtgctggga

SEQ ID NO: 468669 - DNA, 24 bp, R. norvegicus
aatctcgaattacaatagaattca

SEQ ID NO: 468670 - DNA, 16 bp, R. norvegicus
aatctctgaaactgta

SEQ ID NO: 468671 - DNA, 16 bp, R. norvegicus
aatctctggttcaccc

SEQ ID NO: 468672 - DNA, 16 bp, R. norvegicus
aatctctttttaaaag

SEQ ID NO: 468673 - DNA, 16 bp, R. norvegicus
aatctgaaaataattt

SEQ ID NO: 468674 - DNA, 16 bp, R. norvegicus
aatctgaaatggctga

SEQ ID NO: 468675 - DNA, 17 bp, R. norvegicus
aatctgaagaaattaaa

SEQ ID NO: 468676 - DNA, 16 bp, R. norvegicus
aatctgaggaggaggg

SEQ ID NO: 468677 - DNA, 16 bp, R. norvegicus
aatctgaggctagcct

SEQ ID NO: 468678 - DNA, 16 bp, R. norvegicus
aatctgatcaagaaaa

SEQ ID NO: 468679 - DNA, 16 bp, R. norvegicus
aatctgatgccttctt

SEQ ID NO: 468680 - DNA, 16 bp, R. norvegicus
aatctgcagctgctgg

SEQ ID NO: 468681 - DNA, 16 bp, R. norvegicus
aatctgcaggcagcag

SEQ ID NO: 468682 - DNA, 16 bp, R. norvegicus
aatctgccacagaagg

SEQ ID NO: 468683 - DNA, 16 bp, R. norvegicus
aatctggatgaagtgg

SEQ ID NO: 468684 - DNA, 16 bp, R. norvegicus
aatctggatgcttatg

SEQ ID NO: 468685 - DNA, 16 bp, R. norvegicus
aatctggccaagaacc

SEQ ID NO: 468686 - DNA, 16 bp, R. norvegicus
aatctggctgttcctc

SEQ ID NO: 468687 - DNA, 16 bp, R. norvegicus
aatctgggacatgtat

SEQ ID NO: 468688 - DNA, 16 bp, R. norvegicus
aatctgggtcctttgg

SEQ ID NO: 468689 - DNA, 16 bp, R. norvegicus
aatctgggtgcctgaa

SEQ ID NO: 468690 - DNA, 16 bp, R. norvegicus
aatctggttctttgag

SEQ ID NO: 468691 - DNA, 16 bp, R. norvegicus
aatctgtaagtcagcc

SEQ ID NO: 468692 - DNA, 16 bp, R. norvegicus
aatctgtagattgttt

SEQ ID NO: 468693 - DNA, 16 bp, R. norvegicus
aatctgtatcccttga

SEQ ID NO: 468694 - DNA, 16 bp, R. norvegicus
aatcttatggaggcat

SEQ ID NO: 468695 - DNA, 16 bp, R. norvegicus
aatcttatttttcttg

SEQ ID NO: 468696 - DNA, 16 bp, R. norvegicus
aatcttcagatcttac

SEQ ID NO: 468697 - DNA, 16 bp, R. norvegicus
aatcttccaaccaaaa

SEQ ID NO: 468698 - DNA, 16 bp, R. norvegicus
aatcttcctacaacaa

SEQ ID NO: 468699 - DNA, 16 bp, R. norvegicus
aatcttccttttctgg

SEQ ID NO: 468700 - DNA, 16 bp, R. norvegicus
aatcttctttcaaaaa

SEQ ID NO: 468701 - DNA, 16 bp, R. norvegicus
aatcttggctgtcaac

SEQ ID NO: 468702 - DNA, 16 bp, R. norvegicus
aatctttaaaaaagaa

SEQ ID NO: 468703 - DNA, 16 bp, R. norvegicus
aatctttaaaaattga

SEQ ID NO: 468704 - DNA, 16 bp, R. norvegicus
aatctttaaaatgaaa

SEQ ID NO: 468705 - DNA, 16 bp, R. norvegicus
aatctttatctttgca

SEQ ID NO: 468706 - DNA, 16 bp, R. norvegicus
aatctttcccaggtat

SEQ ID NO: 468707 - DNA, 16 bp, R. norvegicus
aatctttgaagaaaga

SEQ ID NO: 468708 - DNA, 16 bp, R. norvegicus
aatctttgcctccctc

SEQ ID NO: 468709 - DNA, 16 bp, R. norvegicus
aatctttttttaaaag

SEQ ID NO: 468710 - DNA, 16 bp, R. norvegicus
aatgaaaaatcacaag

SEQ ID NO: 468711 - DNA, 16 bp, R. norvegicus
aatgaaaaatgtttta

SEQ ID NO: 468712 - DNA, 16 bp, R. norvegicus
aatgaaaacaaagacc

SEQ ID NO: 468713 - DNA, 16 bp, R. norvegicus
aatgaaaacatttaat

SEQ ID NO: 468714 - DNA, 16 bp, R. norvegicus
aatgaaaacctggtca

SEQ ID NO: 468715 - DNA, 16 bp, R. norvegicus
aatgaaaagacagaga

SEQ ID NO: 468716 - DNA, 16 bp, R. norvegicus
aatgaaaagcccaact

SEQ ID NO: 468717 - DNA, 16 bp, R. norvegicus
aatgaaaaggagcaaa

SEQ ID NO: 468718 - DNA, 16 bp, R. norvegicus
aatgaaaaggtgacca

SEQ ID NO: 468719 - DNA, 16 bp, R. norvegicus
aatgaaaagtattttt

SEQ ID NO: 468720 - DNA, 16 bp, R. norvegicus
aatgaaaataaatgca

SEQ ID NO: 468721 - DNA, 16 bp, R. norvegicus
aatgaaaatcctagta

SEQ ID NO: 468722 - DNA, 16 bp, R. norvegicus
aatgaaaatctcagtg

SEQ ID NO: 468723 - DNA, 16 bp, R. norvegicus
aatgaaaatgaaggtg

SEQ ID NO: 468724 - DNA, 16 bp, R. norvegicus
aatgaaaatgactttt

SEQ ID NO: 468725 - DNA, 16 bp, R. norvegicus
aatgaaaatgaggata

SEQ ID NO: 468726 - DNA, 16 bp, R. norvegicus
aatgaaaatgtaggta

SEQ ID NO: 468727 - DNA, 16 bp, R. norvegicus
aatgaaacaggagaca

SEQ ID NO: 468728 - DNA, 16 bp, R. norvegicus
aatgaaacctcacctc

SEQ ID NO: 468729 - DNA, 16 bp, R. norvegicus
aatgaaactaatgctg

SEQ ID NO: 468730 - DNA, 16 bp, R. norvegicus
aatgaaactcaagaag

SEQ ID NO: 468731 - DNA, 16 bp, R. norvegicus
aatgaaactggaaaat

SEQ ID NO: 468732 - DNA, 16 bp, R. norvegicus
aatgaaactttttttt

SEQ ID NO: 468733 - DNA, 16 bp, R. norvegicus
aatgaaagaacttctg

SEQ ID NO: 468734 - DNA, 16 bp, R. norvegicus
aatgaaagaatgaatg

SEQ ID NO: 468735 - DNA, 16 bp, R. norvegicus
aatgaaagagaaacag

SEQ ID NO: 468736 - DNA, 16 bp, R. norvegicus
aatgaaagccatgcta

SEQ ID NO: 468737 - DNA, 16 bp, R. norvegicus
aatgaaaggagaagcc

SEQ ID NO: 468738 - DNA, 16 bp, R. norvegicus
aatgaaaggatttatt

SEQ ID NO: 468739 - DNA, 16 bp, R. norvegicus
aatgaaataattgtat

SEQ ID NO: 468740 - DNA, 16 bp, R. norvegicus
aatgaaatatgatcat

SEQ ID NO: 468741 - DNA, 16 bp, R. norvegicus
aatgaaatcaaatcaa

SEQ ID NO: 468742 - DNA, 16 bp, R. norvegicus
aatgaaatgtttgaga

SEQ ID NO: 468743 - DNA, 16 bp, R. norvegicus
aatgaaattgaattga

SEQ ID NO: 468744 - DNA, 16 bp, R. norvegicus
aatgaaattgcaaatt

SEQ ID NO: 468745 - DNA, 16 bp, R. norvegicus
aatgaacatttttaaa

SEQ ID NO: 468746 - DNA, 16 bp, R. norvegicus
aatgaacccagatgcc

SEQ ID NO: 468747 - DNA, 16 bp, R. norvegicus
aatgaactgaacttct

SEQ ID NO: 468748 - DNA, 16 bp, R. norvegicus
aatgaagaaaatgtcc

SEQ ID NO: 468749 - DNA, 16 bp, R. norvegicus
aatgaagaaaccaaga

SEQ ID NO: 468750 - DNA, 16 bp, R. norvegicus
aatgaagaacaagcaa

SEQ ID NO: 468751 - DNA, 16 bp, R. norvegicus
aatgaagagaaacttg

SEQ ID NO: 468752 - DNA, 16 bp, R. norvegicus
aatgaagattggaatt

SEQ ID NO: 468753 - DNA, 18 bp, R. norvegicus
aatgaagcaaatgctgta

SEQ ID NO: 468754 - DNA, 16 bp, R. norvegicus
aatgaagcatcctttg

SEQ ID NO: 468755 - DNA, 16 bp, R. norvegicus
aatgaaggcacaaaat

SEQ ID NO: 468756 - DNA, 16 bp, R. norvegicus
aatgaagtgcaggctg

SEQ ID NO: 468757 - DNA, 16 bp, R. norvegicus
aatgaatacataaaat

SEQ ID NO: 468758 - DNA, 16 bp, R. norvegicus
aatgaatatgaaggca

SEQ ID NO: 468759 - DNA, 16 bp, R. norvegicus
aatgaatatgaatatg

SEQ ID NO: 468760 - DNA, 16 bp, R. norvegicus
aatgaatgaatgtgaa

SEQ ID NO: 468761 - DNA, 16 bp, R. norvegicus
aatgaatgcaataaaa

SEQ ID NO: 468762 - DNA, 16 bp, R. norvegicus
aatgaatggatggatg

SEQ ID NO: 468763 - DNA, 16 bp, R. norvegicus
aatgaattctatggaa

SEQ ID NO: 468764 - DNA, 16 bp, R. norvegicus
aatgaattcttttttt

SEQ ID NO: 468765 - DNA, 16 bp, R. norvegicus
aatgacaacagcaaca

SEQ ID NO: 468766 - DNA, 16 bp, R. norvegicus
aatgacaagcaaccag

SEQ ID NO: 468767 - DNA, 16 bp, R. norvegicus
aatgacaatgacaaca

SEQ ID NO: 468768 - DNA, 16 bp, R. norvegicus
aatgacacagactcca

SEQ ID NO: 468769 - DNA, 16 bp, R. norvegicus
aatgacacatttcctc

SEQ ID NO: 468770 - DNA, 16 bp, R. norvegicus
aatgacagcgtccttt

SEQ ID NO: 468771 - DNA, 16 bp, R. norvegicus
aatgacagtgtctttg

SEQ ID NO: 468772 - DNA, 16 bp, R. norvegicus
aatgacctttccttca

SEQ ID NO: 468773 - DNA, 16 bp, R. norvegicus
aatgactaagaatgtt

SEQ ID NO: 468774 - DNA, 17 bp, R. norvegicus
aatgactacacacctga

SEQ ID NO: 468775 - DNA, 16 bp, R. norvegicus
aatgacttctatggaa

SEQ ID NO: 468776 - DNA, 16 bp, R. norvegicus
aatgacttctgtttag

SEQ ID NO: 468777 - DNA, 16 bp, R. norvegicus
aatgactttgaatttc

SEQ ID NO: 468778 - DNA, 16 bp, R. norvegicus
aatgactttttgaaat

SEQ ID NO: 468779 - DNA, 16 bp, R. norvegicus
aatgagaaaaccaaac

SEQ ID NO: 468780 - DNA, 16 bp, R. norvegicus
aatgagaaaatgaatg

SEQ ID NO: 468781 - DNA, 16 bp, R. norvegicus
aatgagaagacaaaac

SEQ ID NO: 468782 - DNA, 16 bp, R. norvegicus
aatgagaagatgaccc

SEQ ID NO: 468783 - DNA, 16 bp, R. norvegicus
aatgagaagcccttgg

SEQ ID NO: 468784 - DNA, 21 bp, R. norvegicus
aatgagaaggtcaaacctaag

SEQ ID NO: 468785 - DNA, 16 bp, R. norvegicus
aatgagaagttcaaac

SEQ ID NO: 468786 - DNA, 16 bp, R. norvegicus
aatgagaatgaaggta

SEQ ID NO: 468787 - DNA, 16 bp, R. norvegicus
aatgagaatgtctccc

SEQ ID NO: 468788 - DNA, 16 bp, R. norvegicus
aatgagaggaaattca

SEQ ID NO: 468789 - DNA, 16 bp, R. norvegicus
aatgagatcatcatgt

SEQ ID NO: 468790 - DNA, 16 bp, R. norvegicus
aatgagatgatcatgt

SEQ ID NO: 468791 - DNA, 16 bp, R. norvegicus
aatgagcagccttgtc

SEQ ID NO: 468792 - DNA, 16 bp, R. norvegicus
aatgagctccaggaca

SEQ ID NO: 468793 - DNA, 16 bp, R. norvegicus
aatgaggaacaagaat

SEQ ID NO: 468794 - DNA, 16 bp, R. norvegicus
aatgaggaagctttct

SEQ ID NO: 468795 - DNA, 16 bp, R. norvegicus
aatgaggacattgtga

SEQ ID NO: 468796 - DNA, 16 bp, R. norvegicus
aatgaggacctgagga

SEQ ID NO: 468797 - DNA, 16 bp, R. norvegicus
aatgaggagaggcaag

SEQ ID NO: 468798 - DNA, 16 bp, R. norvegicus
aatgagggcatcatga

SEQ ID NO: 468799 - DNA, 16 bp, R. norvegicus
aatgaggggctggggg

SEQ ID NO: 468800 - DNA, 16 bp, R. norvegicus
aatgaggtctggtgcc

SEQ ID NO: 468801 - DNA, 16 bp, R. norvegicus
aatgagtattttaaaa

SEQ ID NO: 468802 - DNA, 16 bp, R. norvegicus
aatgataacctggtct

SEQ ID NO: 468803 - DNA, 16 bp, R. norvegicus
aatgataactgggtca

SEQ ID NO: 468804 - DNA, 16 bp, R. norvegicus
aatgataatggattga

SEQ ID NO: 468805 - DNA, 17 bp, R. norvegicus
aatgatattttccagtt

SEQ ID NO: 468806 - DNA, 16 bp, R. norvegicus
aatgatctagaaaata

SEQ ID NO: 468807 - DNA, 16 bp, R. norvegicus
aatgatgaagatgatg

SEQ ID NO: 468808 - DNA, 17 bp, R. norvegicus
aatgatgatgatgatgg

SEQ ID NO: 468809 - DNA, 16 bp, R. norvegicus
aatgatggaggacttc

SEQ ID NO: 468810 - DNA, 16 bp, R. norvegicus
aatgatggctttgatg

SEQ ID NO: 468811 - DNA, 16 bp, R. norvegicus
aatgatggtgtggacc

SEQ ID NO: 468812 - DNA, 16 bp, R. norvegicus
aatgatgtggagaaag

SEQ ID NO: 468813 - DNA, 16 bp, R. norvegicus
aatgatttccatggaa

SEQ ID NO: 468814 - DNA, 16 bp, R. norvegicus
aatgatttctttttca

SEQ ID NO: 468815 - DNA, 16 bp, R. norvegicus
aatgcaaaaatattca

SEQ ID NO: 468816 - DNA, 16 bp, R. norvegicus
aatgcaaagcagccct

SEQ ID NO: 468817 - DNA, 16 bp, R. norvegicus
aatgcaaatattttca

SEQ ID NO: 468818 - DNA, 16 bp, R. norvegicus
aatgcacaatttccta

SEQ ID NO: 468819 - DNA, 16 bp, R. norvegicus
aatgcacacagataca

SEQ ID NO: 468820 - DNA, 16 bp, R. norvegicus
aatgcacccaagagga

SEQ ID NO: 468821 - DNA, 16 bp, R. norvegicus
aatgcagaaaatgtgg

SEQ ID NO: 468822 - DNA, 16 bp, R. norvegicus
aatgcagaaggaaaga

SEQ ID NO: 468823 - DNA, 16 bp, R. norvegicus
aatgcagaaggggatg

SEQ ID NO: 468824 - DNA, 16 bp, R. norvegicus
aatgcagagaaacttg

SEQ ID NO: 468825 - DNA, 16 bp, R. norvegicus
aatgcagatgaacaca

SEQ ID NO: 468826 - DNA, 16 bp, R. norvegicus
aatgcaggctgacagg

SEQ ID NO: 468827 - DNA, 16 bp, R. norvegicus
aatgcaggggccaaag

SEQ ID NO: 468828 - DNA, 16 bp, R. norvegicus
aatgcagggtcttcat

SEQ ID NO: 468829 - DNA, 16 bp, R. norvegicus
aatgcatcttttaaaa

SEQ ID NO: 468830 - DNA, 16 bp, R. norvegicus
aatgcatgaatgaatg

SEQ ID NO: 468831 - DNA, 17 bp, R. norvegicus
aatgcatgggatttcaa

SEQ ID NO: 468832 - DNA, 16 bp, R. norvegicus
aatgcattttgcatta

SEQ ID NO: 468833 - DNA, 16 bp, R. norvegicus
aatgcatttttatttt

SEQ ID NO: 468834 - DNA, 16 bp, R. norvegicus
aatgccaacaaccaga

SEQ ID NO: 468835 - DNA, 16 bp, R. norvegicus
aatgccaagaagtaca

SEQ ID NO: 468836 - DNA, 16 bp, R. norvegicus
aatgccaagaagtgca

SEQ ID NO: 468837 - DNA, 16 bp, R. norvegicus
aatgccaaggcagtga

SEQ ID NO: 468838 - DNA, 16 bp, R. norvegicus
aatgccagtgaaagaa

SEQ ID NO: 468839 - DNA, 16 bp, R. norvegicus
aatgcccccaccccca

SEQ ID NO: 468840 - DNA, 16 bp, R. norvegicus
aatgcccctgcctcag

SEQ ID NO: 468841 - DNA, 16 bp, R. norvegicus
aatgccctacagttgg

SEQ ID NO: 468842 - DNA, 16 bp, R. norvegicus
aatgctaaatctaaaa

SEQ ID NO: 468843 - DNA, 16 bp, R. norvegicus
aatgctatgacccttt

SEQ ID NO: 468844 - DNA, 16 bp, R. norvegicus
aatgctatttttaaaa

SEQ ID NO: 468845 - DNA, 16 bp, R. norvegicus
aatgctccaacataca

SEQ ID NO: 468846 - DNA, 16 bp, R. norvegicus
aatgctgagaatggga

SEQ ID NO: 468847 - DNA, 16 bp, R. norvegicus
aatgctgagccatctc

SEQ ID NO: 468848 - DNA, 16 bp, R. norvegicus
aatgctgcagcccttt

SEQ ID NO: 468849 - DNA, 16 bp, R. norvegicus
aatgctgcccttgaga

SEQ ID NO: 468850 - DNA, 16 bp, R. norvegicus
aatgctgctgctgctg

SEQ ID NO: 468851 - DNA, 16 bp, R. norvegicus
aatgctggcttccagg

SEQ ID NO: 468852 - DNA, 16 bp, R. norvegicus
aatgctgggatcacaa

SEQ ID NO: 468853 - DNA, 16 bp, R. norvegicus
aatgctggggaggatg

SEQ ID NO: 468854 - DNA, 16 bp, R. norvegicus
aatgctgtcctcacag

SEQ ID NO: 468855 - DNA, 16 bp, R. norvegicus
aatgcttcaagtttct

SEQ ID NO: 468856 - DNA, 16 bp, R. norvegicus
aatgcttgctgcacaa

SEQ ID NO: 468857 - DNA, 16 bp, R. norvegicus
aatgctttcattgtgt

SEQ ID NO: 468858 - DNA, 16 bp, R. norvegicus
aatgctttcattttct

SEQ ID NO: 468859 - DNA, 16 bp, R. norvegicus
aatgctttctcatttt

SEQ ID NO: 468860 - DNA, 16 bp, R. norvegicus
aatgctttctccacat

SEQ ID NO: 468861 - DNA, 16 bp, R. norvegicus
aatgctttcttctggc

SEQ ID NO: 468862 - DNA, 16 bp, R. norvegicus
aatgctttcttctgta

SEQ ID NO: 468863 - DNA, 16 bp, R. norvegicus
aatgctttcttttgtt

SEQ ID NO: 468864 - DNA, 16 bp, R. norvegicus
aatgcttttaaaaata

SEQ ID NO: 468865 - DNA, 16 bp, R. norvegicus
aatggaaaaaagactg

SEQ ID NO: 468866 - DNA, 16 bp, R. norvegicus
aatggaaaaatccacc

SEQ ID NO: 468867 - DNA, 18 bp, R. norvegicus
aatggaaaagagcctgag

SEQ ID NO: 468868 - DNA, 16 bp, R. norvegicus
aatggaaacaaccagt

SEQ ID NO: 468869 - DNA, 16 bp, R. norvegicus
aatggaaacagaagaa

SEQ ID NO: 468870 - DNA, 16 bp, R. norvegicus
aatggaaacagatgga

SEQ ID NO: 468871 - DNA, 16 bp, R. norvegicus
aatggaaactttgaaa

SEQ ID NO: 468872 - DNA, 16 bp, R. norvegicus
aatggaaatttctggt

SEQ ID NO: 468873 - DNA, 16 bp, R. norvegicus
aatggaacagaattaa

SEQ ID NO: 468874 - DNA, 16 bp, R. norvegicus
aatggaacctcacaaa

SEQ ID NO: 468875 - DNA, 16 bp, R. norvegicus
aatggaactgaagacc

SEQ ID NO: 468876 - DNA, 17 bp, R. norvegicus
aatggaactggaaaata

SEQ ID NO: 468877 - DNA, 16 bp, R. norvegicus
aatggaatattactaa

SEQ ID NO: 468878 - DNA, 16 bp, R. norvegicus
aatggaatcacagttt

SEQ ID NO: 468879 - DNA, 16 bp, R. norvegicus
aatggaatgaacaaga

SEQ ID NO: 468880 - DNA, 16 bp, R. norvegicus
aatggaatggagaaat

SEQ ID NO: 468881 - DNA, 16 bp, R. norvegicus
aatggacaaagaaaat

SEQ ID NO: 468882 - DNA, 16 bp, R. norvegicus
aatggacaaatggaac

SEQ ID NO: 468883 - DNA, 16 bp, R. norvegicus
aatggacaatttcctc

SEQ ID NO: 468884 - DNA, 16 bp, R. norvegicus
aatggacaatttcctg

SEQ ID NO: 468885 - DNA, 17 bp, R. norvegicus
aatggacagaagttgct

SEQ ID NO: 468886 - DNA, 16 bp, R. norvegicus
aatggacagatggatg

SEQ ID NO: 468887 - DNA, 16 bp, R. norvegicus
aatggacatagaaaat

SEQ ID NO: 468888 - DNA, 16 bp, R. norvegicus
aatggactcaacctct

SEQ ID NO: 468889 - DNA, 16 bp, R. norvegicus
aatggactgaacctca

SEQ ID NO: 468890 - DNA, 16 bp, R. norvegicus
aatggacttaattccc

SEQ ID NO: 468891 - DNA, 16 bp, R. norvegicus
aatggacttggagaag

SEQ ID NO: 468892 - DNA, 16 bp, R. norvegicus
aatggagaaaaacctg

SEQ ID NO: 468893 - DNA, 16 bp, R. norvegicus
aatggagaagaaactg

SEQ ID NO: 468894 - DNA, 16 bp, R. norvegicus
aatggagaagaccctg

SEQ ID NO: 468895 - DNA, 16 bp, R. norvegicus
aatggagaagttagag

SEQ ID NO: 468896 - DNA, 16 bp, R. norvegicus
aatggagcagagatgg

SEQ ID NO: 468897 - DNA, 16 bp, R. norvegicus
aatggagcagaggctg

SEQ ID NO: 468898 - DNA, 16 bp, R. norvegicus
aatggaggaagagtgg

SEQ ID NO: 468899 - DNA, 16 bp, R. norvegicus
aatggaggagaagccc

SEQ ID NO: 468900 - DNA, 16 bp, R. norvegicus
aatggaggcaaaccag

SEQ ID NO: 468901 - DNA, 16 bp, R. norvegicus
aatggaggcagagaag

SEQ ID NO: 468902 - DNA, 16 bp, R. norvegicus
aatggagttttccctt

SEQ ID NO: 468903 - DNA, 16 bp, R. norvegicus
aatggataaagaaatt

SEQ ID NO: 468904 - DNA, 16 bp, R. norvegicus
aatggataatttccta

SEQ ID NO: 468905 - DNA, 16 bp, R. norvegicus
aatggataattttctt

SEQ ID NO: 468906 - DNA, 18 bp, R. norvegicus
aatggatacagaaaatat

SEQ ID NO: 468907 - DNA, 18 bp, R. norvegicus
aatggatacagaaaatgc

SEQ ID NO: 468908 - DNA, 18 bp, R. norvegicus
aatggatacagaaaatgg

SEQ ID NO: 468909 - DNA, 20 bp, R. norvegicus
aatggatacagaaaatgtgc

SEQ ID NO: 468910 - DNA, 16 bp, R. norvegicus
aatggatacagaaagt

SEQ ID NO: 468911 - DNA, 16 bp, R. norvegicus
aatggatgcagaaaat

SEQ ID NO: 468912 - DNA, 18 bp, R. norvegicus
aatggatggatctagaaa

SEQ ID NO: 468913 - DNA, 16 bp, R. norvegicus
aatggatggatgatgg

SEQ ID NO: 468914 - DNA, 16 bp, R. norvegicus
aatggatggttttcta

SEQ ID NO: 468915 - DNA, 16 bp, R. norvegicus
aatggattaaacttct

SEQ ID NO: 468916 - DNA, 16 bp, R. norvegicus
aatggcaaagaagcac

SEQ ID NO: 468917 - DNA, 16 bp, R. norvegicus
aatggcaacctacaga

SEQ ID NO: 468918 - DNA, 16 bp, R. norvegicus
aatggcagacaaagtg

SEQ ID NO: 468919 - DNA, 16 bp, R. norvegicus
aatggccaaaaatcac

SEQ ID NO: 468920 - DNA, 16 bp, R. norvegicus
aatggccattcctcca

SEQ ID NO: 468921 - DNA, 16 bp, R. norvegicus
aatggccattccttca

SEQ ID NO: 468922 - DNA, 16 bp, R. norvegicus
aatggcccccatgggc

SEQ ID NO: 468923 - DNA, 16 bp, R. norvegicus
aatggcctcaacttcc

SEQ ID NO: 468924 - DNA, 16 bp, R. norvegicus
aatggccttgttgggg

SEQ ID NO: 468925 - DNA, 17 bp, R. norvegicus
aatggctaagaacaaaa

SEQ ID NO: 468926 - DNA, 18 bp, R. norvegicus
aatggctaagatcaaaag

SEQ ID NO: 468927 - DNA, 17 bp, R. norvegicus
aatggctaagttcaaaa

SEQ ID NO: 468928 - DNA, 16 bp, R. norvegicus
aatggctacagaaaat

SEQ ID NO: 468929 - DNA, 17 bp, R. norvegicus
aatggctactcctgctt

SEQ ID NO: 468930 - DNA, 46 bp, R. norvegicus
aatggctgagaaacacctaaagaaatgttcaacatctttagtcatg

SEQ ID NO: 468931 - DNA, 16 bp, R. norvegicus
aatggctgagaagcac

SEQ ID NO: 468932 - DNA, 16 bp, R. norvegicus
aatggctggaaaaaaa

SEQ ID NO: 468933 - DNA, 16 bp, R. norvegicus
aatggctggaaagcac

SEQ ID NO: 468934 - DNA, 16 bp, R. norvegicus
aatggctggctgtgaa

SEQ ID NO: 468935 - DNA, 16 bp, R. norvegicus
aatggcttacaggctg

SEQ ID NO: 468936 - DNA, 16 bp, R. norvegicus
aatgggaaaaaagaca

SEQ ID NO: 468937 - DNA, 16 bp, R. norvegicus
aatgggaagattctgg

SEQ ID NO: 468938 - DNA, 16 bp, R. norvegicus
aatgggacatttatat

SEQ ID NO: 468939 - DNA, 16 bp, R. norvegicus
aatgggagcatccaca

SEQ ID NO: 468940 - DNA, 16 bp, R. norvegicus
aatgggatccagtgtc

SEQ ID NO: 468941 - DNA, 16 bp, R. norvegicus
aatgggatccggtgcc

SEQ ID NO: 468942 - DNA, 16 bp, R. norvegicus
aatgggattcttgggg

SEQ ID NO: 468943 - DNA, 16 bp, R. norvegicus
aatgggcaaagacctg

SEQ ID NO: 468944 - DNA, 16 bp, R. norvegicus
aatgggcatttcttca

SEQ ID NO: 468945 - DNA, 17 bp, R. norvegicus
aatgggctttgaaaagt

SEQ ID NO: 468946 - DNA, 16 bp, R. norvegicus
aatggggaaaggatgg

SEQ ID NO: 468947 - DNA, 16 bp, R. norvegicus
aatggggaagggaaca

SEQ ID NO: 468948 - DNA, 16 bp, R. norvegicus
aatggggactggagag

SEQ ID NO: 468949 - DNA, 16 bp, R. norvegicus
aatggggagaccccag

SEQ ID NO: 468950 - DNA, 17 bp, R. norvegicus
aatgggtgagaggtaca

SEQ ID NO: 468951 - DNA, 16 bp, R. norvegicus
aatgggtggaggagca

SEQ ID NO: 468952 - DNA, 17 bp, R. norvegicus
aatgggtttgggaaaaa

SEQ ID NO: 468953 - DNA, 16 bp, R. norvegicus
aatggtatagaattga

SEQ ID NO: 468954 - DNA, 17 bp, R. norvegicus
aatggtcagaagaagta

SEQ ID NO: 468955 - DNA, 16 bp, R. norvegicus
aatggtcagaagcagc

SEQ ID NO: 468956 - DNA, 16 bp, R. norvegicus
aatggtcagaggaagc

SEQ ID NO: 468957 - DNA, 37 bp, R. norvegicus
aatggtccaccatcaaagacaaaggggttatcacagt

SEQ ID NO: 468958 - DNA, 18 bp, R. norvegicus
aatggtccctgcctgctt

SEQ ID NO: 468959 - DNA, 16 bp, R. norvegicus
aatggtcctcaacctt

SEQ ID NO: 468960 - DNA, 16 bp, R. norvegicus
aatggtctgaagaaaa

SEQ ID NO: 468961 - DNA, 16 bp, R. norvegicus
aatggtgatggtggtg

SEQ ID NO: 468962 - DNA, 16 bp, R. norvegicus
aatggtgccagccaaa

SEQ ID NO: 468963 - DNA, 16 bp, R. norvegicus
aatggtggaaggagag

SEQ ID NO: 468964 - DNA, 16 bp, R. norvegicus
aatggtggcacatgcc

SEQ ID NO: 468965 - DNA, 16 bp, R. norvegicus
aatggttaagatcaaa

SEQ ID NO: 468966 - DNA, 16 bp, R. norvegicus
aatggttgggtgtaag

SEQ ID NO: 468967 - DNA, 16 bp, R. norvegicus
aatggtttcatgaaat

SEQ ID NO: 468968 - DNA, 16 bp, R. norvegicus
aatgtaaaacaggaaa

SEQ ID NO: 468969 - DNA, 16 bp, R. norvegicus
aatgtaaatatgtttt

SEQ ID NO: 468970 - DNA, 16 bp, R. norvegicus
aatgtaaatcagaaaa

SEQ ID NO: 468971 - DNA, 16 bp, R. norvegicus
aatgtaactttttaaa

SEQ ID NO: 468972 - DNA, 16 bp, R. norvegicus
aatgtaataaaaacat

SEQ ID NO: 468973 - DNA, 16 bp, R. norvegicus
aatgtaattttgaaaa

SEQ ID NO: 468974 - DNA, 16 bp, R. norvegicus
aatgtataaaatgtat

SEQ ID NO: 468975 - DNA, 16 bp, R. norvegicus
aatgtatgacattttc

SEQ ID NO: 468976 - DNA, 16 bp, R. norvegicus
aatgtatggaaatcca

SEQ ID NO: 468977 - DNA, 16 bp, R. norvegicus
aatgtatttctttctt

SEQ ID NO: 468978 - DNA, 16 bp, R. norvegicus
aatgtattttactttt

SEQ ID NO: 468979 - DNA, 16 bp, R. norvegicus
aatgtattttatttct

SEQ ID NO: 468980 - DNA, 16 bp, R. norvegicus
aatgtcaaaacaaaac

SEQ ID NO: 468981 - DNA, 16 bp, R. norvegicus
aatgtcagaaatccac

SEQ ID NO: 468982 - DNA, 16 bp, R. norvegicus
aatgtcagggccagga

SEQ ID NO: 468983 - DNA, 16 bp, R. norvegicus
aatgtcatcctctgct

SEQ ID NO: 468984 - DNA, 16 bp, R. norvegicus
aatgtcatctccattg

SEQ ID NO: 468985 - DNA, 16 bp, R. norvegicus
aatgtcatggatcaca

SEQ ID NO: 468986 - DNA, 16 bp, R. norvegicus
aatgtcattttctttt

SEQ ID NO: 468987 - DNA, 16 bp, R. norvegicus
aatgtccttcttaaag

SEQ ID NO: 468988 - DNA, 16 bp, R. norvegicus
aatgtctctttggtga

SEQ ID NO: 468989 - DNA, 16 bp, R. norvegicus
aatgtctgtgaagaat

SEQ ID NO: 468990 - DNA, 16 bp, R. norvegicus
aatgtctgtgttttcc

SEQ ID NO: 468991 - DNA, 16 bp, R. norvegicus
aatgtctgttttattt

SEQ ID NO: 468992 - DNA, 16 bp, R. norvegicus
aatgtgactggatata

SEQ ID NO: 468993 - DNA, 16 bp, R. norvegicus
aatgtgataaagcctt

SEQ ID NO: 468994 - DNA, 16 bp, R. norvegicus
aatgtgatgatcatgt

SEQ ID NO: 468995 - DNA, 16 bp, R. norvegicus
aatgtgcccattcctc

SEQ ID NO: 468996 - DNA, 16 bp, R. norvegicus
aatgtgctttctgtac

SEQ ID NO: 468997 - DNA, 16 bp, R. norvegicus
aatgtggaaaaagagg

SEQ ID NO: 468998 - DNA, 16 bp, R. norvegicus
aatgtggaaaagcctt

SEQ ID NO: 468999 - DNA, 16 bp, R. norvegicus
aatgtggagaaagaag

SEQ ID NO: 469000 - DNA, 16 bp, R. norvegicus
aatgtggatgacagca

SEQ ID NO: 469001 - DNA, 16 bp, R. norvegicus
aatgtggatgcttcag

SEQ ID NO: 469002 - DNA, 16 bp, R. norvegicus
aatgtggatgcttcca

SEQ ID NO: 469003 - DNA, 16 bp, R. norvegicus
aatgtggcaaagcctt

SEQ ID NO: 469004 - DNA, 16 bp, R. norvegicus
aatgtggcaagggttt

SEQ ID NO: 469005 - DNA, 16 bp, R. norvegicus
aatgtgggaaatcttt

SEQ ID NO: 469006 - DNA, 16 bp, R. norvegicus
aatgtggggaagaatc

SEQ ID NO: 469007 - DNA, 17 bp, R. norvegicus
aatgtggtaaagccttt

SEQ ID NO: 469008 - DNA, 16 bp, R. norvegicus
aatgtggtaaagcttt

SEQ ID NO: 469009 - DNA, 16 bp, R. norvegicus
aatgtgtatatataca

SEQ ID NO: 469010 - DNA, 16 bp, R. norvegicus
aatgtgtatgtgtaca

SEQ ID NO: 469011 - DNA, 16 bp, R. norvegicus
aatgtgtctgtgtctg

SEQ ID NO: 469012 - DNA, 16 bp, R. norvegicus
aatgtgtgatttgaac

SEQ ID NO: 469013 - DNA, 16 bp, R. norvegicus
aatgttaaactaaatg

SEQ ID NO: 469014 - DNA, 16 bp, R. norvegicus
aatgttacatatatat

SEQ ID NO: 469015 - DNA, 16 bp, R. norvegicus
aatgttatataaaact

SEQ ID NO: 469016 - DNA, 16 bp, R. norvegicus
aatgttatccaccttc

SEQ ID NO: 469017 - DNA, 16 bp, R. norvegicus
aatgttcaaatacatg

SEQ ID NO: 469018 - DNA, 16 bp, R. norvegicus
aatgttcatgagggaa

SEQ ID NO: 469019 - DNA, 16 bp, R. norvegicus
aatgttcctgcagaat

SEQ ID NO: 469020 - DNA, 16 bp, R. norvegicus
aatgttccttctattt

SEQ ID NO: 469021 - DNA, 16 bp, R. norvegicus
aatgttccttctgctt

SEQ ID NO: 469022 - DNA, 16 bp, R. norvegicus
aatgttcttaaaggat

SEQ ID NO: 469023 - DNA, 16 bp, R. norvegicus
aatgttctttttaaag

SEQ ID NO: 469024 - DNA, 16 bp, R. norvegicus
aatgttggcctggaaa

SEQ ID NO: 469025 - DNA, 16 bp, R. norvegicus
aatgtttaagatcaaa

SEQ ID NO: 469026 - DNA, 16 bp, R. norvegicus
aatgtttctctttctc

SEQ ID NO: 469027 - DNA, 16 bp, R. norvegicus
aatgtttgtgttttct

SEQ ID NO: 469028 - DNA, 17 bp, R. norvegicus
aatgttttcctgtgctt

SEQ ID NO: 469029 - DNA, 16 bp, R. norvegicus
aatgttttgaaaataa

SEQ ID NO: 469030 - DNA, 16 bp, R. norvegicus
aatgtttttatggaat

SEQ ID NO: 469031 - DNA, 16 bp, R. norvegicus
aatgtttttcttctct

SEQ ID NO: 469032 - DNA, 16 bp, R. norvegicus
aattaaaaatgcaaat

SEQ ID NO: 469033 - DNA, 16 bp, R. norvegicus
aattaaaacaactttg

SEQ ID NO: 469034 - DNA, 16 bp, R. norvegicus
aattaaaacattttca

SEQ ID NO: 469035 - DNA, 16 bp, R. norvegicus
aattaaaaccatccag

SEQ ID NO: 469036 - DNA, 16 bp, R. norvegicus
aattaaaaccattgta

SEQ ID NO: 469037 - DNA, 16 bp, R. norvegicus
aattaaaactgctttg

SEQ ID NO: 469038 - DNA, 16 bp, R. norvegicus
aattaaaagctttctt

SEQ ID NO: 469039 - DNA, 16 bp, R. norvegicus
aattaaaagttatcaa

SEQ ID NO: 469040 - DNA, 16 bp, R. norvegicus
aattaaaatgttttca

SEQ ID NO: 469041 - DNA, 16 bp, R. norvegicus
aattaaagaaaggatt

SEQ ID NO: 469042 - DNA, 16 bp, R. norvegicus
aattaaagacccagaa

SEQ ID NO: 469043 - DNA, 16 bp, R. norvegicus
aattaaagactcttta

SEQ ID NO: 469044 - DNA, 16 bp, R. norvegicus
aattaaagctaaccat

SEQ ID NO: 469045 - DNA, 16 bp, R. norvegicus
aattaaatactggcca

SEQ ID NO: 469046 - DNA, 16 bp, R. norvegicus
aattaaatactttctt

SEQ ID NO: 469047 - DNA, 16 bp, R. norvegicus
aattaaatccaggtcc

SEQ ID NO: 469048 - DNA, 16 bp, R. norvegicus
aattaaatcttgtcct

SEQ ID NO: 469049 - DNA, 16 bp, R. norvegicus
aattaaatgaaaatca

SEQ ID NO: 469050 - DNA, 16 bp, R. norvegicus
aattaacaaattccag

SEQ ID NO: 469051 - DNA, 16 bp, R. norvegicus
aattaacagttttatg

SEQ ID NO: 469052 - DNA, 16 bp, R. norvegicus
aattaacattagaata

SEQ ID NO: 469053 - DNA, 16 bp, R. norvegicus
aattaaggttgaagtc

SEQ ID NO: 469054 - DNA, 16 bp, R. norvegicus
aattacaaaatcagaa

SEQ ID NO: 469055 - DNA, 16 bp, R. norvegicus
aattacaaaatttgat

SEQ ID NO: 469056 - DNA, 17 bp, R. norvegicus
aattacaccagccttct

SEQ ID NO: 469057 - DNA, 16 bp, R. norvegicus
aattacatcttatcaa

SEQ ID NO: 469058 - DNA, 16 bp, R. norvegicus
aattacattggaaaaa

SEQ ID NO: 469059 - DNA, 16 bp, R. norvegicus
aattaccatttccacc

SEQ ID NO: 469060 - DNA, 16 bp, R. norvegicus
aattaccccagatcca

SEQ ID NO: 469061 - DNA, 16 bp, R. norvegicus
aattacctcagagata

SEQ ID NO: 469062 - DNA, 17 bp, R. norvegicus
aattacgttcactgggg

SEQ ID NO: 469063 - DNA, 18 bp, R. norvegicus
aattactacaccttggtt

SEQ ID NO: 469064 - DNA, 16 bp, R. norvegicus
aattactcccttaaag

SEQ ID NO: 469065 - DNA, 16 bp, R. norvegicus
aattacttgtggagag

SEQ ID NO: 469066 - DNA, 16 bp, R. norvegicus
aattagaaaatatcat

SEQ ID NO: 469067 - DNA, 21 bp, R. norvegicus
aattagaggaagaggcagcca

SEQ ID NO: 469068 - DNA, 23 bp, R. norvegicus
aattagcttctcaatcatcatct

SEQ ID NO: 469069 - DNA, 16 bp, R. norvegicus
aattataaataaggct

SEQ ID NO: 469070 - DNA, 16 bp, R. norvegicus
aattatagcagaaaat

SEQ ID NO: 469071 - DNA, 16 bp, R. norvegicus
aattatatatctgtat

SEQ ID NO: 469072 - DNA, 16 bp, R. norvegicus
aattatatattcttga

SEQ ID NO: 469073 - DNA, 16 bp, R. norvegicus
aattatgaggggcttc

SEQ ID NO: 469074 - DNA, 16 bp, R. norvegicus
aattatgttgatggtt

SEQ ID NO: 469075 - DNA, 16 bp, R. norvegicus
aattattcattcattc

SEQ ID NO: 469076 - DNA, 16 bp, R. norvegicus
aattattttaaggaaa

SEQ ID NO: 469077 - DNA, 16 bp, R. norvegicus
aattattttcagaaaa

SEQ ID NO: 469078 - DNA, 16 bp, R. norvegicus
aattattttcattaca

SEQ ID NO: 469079 - DNA, 16 bp, R. norvegicus
aattattttgtgaatg

SEQ ID NO: 469080 - DNA, 16 bp, R. norvegicus
aattatttttaaaagc

SEQ ID NO: 469081 - DNA, 16 bp, R. norvegicus
aattatttttgctatt

SEQ ID NO: 469082 - DNA, 16 bp, R. norvegicus
aattcaaaagaaagca

SEQ ID NO: 469083 - DNA, 16 bp, R. norvegicus
aattcaaacacattaa

SEQ ID NO: 469084 - DNA, 16 bp, R. norvegicus
aattcaaagaccatat

SEQ ID NO: 469085 - DNA, 16 bp, R. norvegicus
aattcaaagcaattaa

SEQ ID NO: 469086 - DNA, 16 bp, R. norvegicus
aattcaaatcaatcca

SEQ ID NO: 469087 - DNA, 16 bp, R. norvegicus
aattcaagaagataga

SEQ ID NO: 469088 - DNA, 16 bp, R. norvegicus
aattcaagacactgaa

SEQ ID NO: 469089 - DNA, 16 bp, R. norvegicus
aattcaagcatttgga

SEQ ID NO: 469090 - DNA, 16 bp, R. norvegicus
aattcaagcctctgaa

SEQ ID NO: 469091 - DNA, 16 bp, R. norvegicus
aattcaaggctagcct

SEQ ID NO: 469092 - DNA, 16 bp, R. norvegicus
aattcaatgacaatga

SEQ ID NO: 469093 - DNA, 16 bp, R. norvegicus
aattcacaaaaatcag

SEQ ID NO: 469094 - DNA, 16 bp, R. norvegicus
aattcacaaaatcaga

SEQ ID NO: 469095 - DNA, 16 bp, R. norvegicus
aattcagaaaatgcct

SEQ ID NO: 469096 - DNA, 16 bp, R. norvegicus
aattcagaaatggagg

SEQ ID NO: 469097 - DNA, 16 bp, R. norvegicus
aattcaggacaaaatg

SEQ ID NO: 469098 - DNA, 16 bp, R. norvegicus
aattcaggtgacagca

SEQ ID NO: 469099 - DNA, 16 bp, R. norvegicus
aattcagtggggagaa

SEQ ID NO: 469100 - DNA, 16 bp, R. norvegicus
aattcataccggaaga

SEQ ID NO: 469101 - DNA, 16 bp, R. norvegicus
aattcatcttggtgaa

SEQ ID NO: 469102 - DNA, 16 bp, R. norvegicus
aattccagaaataaat

SEQ ID NO: 469103 - DNA, 16 bp, R. norvegicus
aattccagaacagtca

SEQ ID NO: 469104 - DNA, 16 bp, R. norvegicus
aattccagaccctgcc

SEQ ID NO: 469105 - DNA, 16 bp, R. norvegicus
aattccagaccctgct

SEQ ID NO: 469106 - DNA, 16 bp, R. norvegicus
aattccagcactggga

SEQ ID NO: 469107 - DNA, 16 bp, R. norvegicus
aattccaggaaaaaca

SEQ ID NO: 469108 - DNA, 16 bp, R. norvegicus
aattccaggacagcca

SEQ ID NO: 469109 - DNA, 16 bp, R. norvegicus
aattccaggagacaga

SEQ ID NO: 469110 - DNA, 16 bp, R. norvegicus
aattccaggccagctt

SEQ ID NO: 469111 - DNA, 16 bp, R. norvegicus
aattccagttccaggg

SEQ ID NO: 469112 - DNA, 16 bp, R. norvegicus
aattccagtttcctga

SEQ ID NO: 469113 - DNA, 16 bp, R. norvegicus
aattccatctatgaag

SEQ ID NO: 469114 - DNA, 16 bp, R. norvegicus
aattccatgggggaga

SEQ ID NO: 469115 - DNA, 16 bp, R. norvegicus
aattcccagcaactac

SEQ ID NO: 469116 - DNA, 16 bp, R. norvegicus
aattcccagcaccaaa

SEQ ID NO: 469117 - DNA, 16 bp, R. norvegicus
aattccctcttcacag

SEQ ID NO: 469118 - DNA, 16 bp, R. norvegicus
aattcctccatcatca

SEQ ID NO: 469119 - DNA, 16 bp, R. norvegicus
aattcctcccattaca

SEQ ID NO: 469120 - DNA, 16 bp, R. norvegicus
aattcctcccctcaga

SEQ ID NO: 469121 - DNA, 16 bp, R. norvegicus
aattcctcctgtaaca

SEQ ID NO: 469122 - DNA, 16 bp, R. norvegicus
aattcctgaccctctg

SEQ ID NO: 469123 - DNA, 16 bp, R. norvegicus
aattcgagattttggg

SEQ ID NO: 469124 - DNA, 16 bp, R. norvegicus
aattctacaagacttt

SEQ ID NO: 469125 - DNA, 16 bp, R. norvegicus
aattctattaaaaatg

SEQ ID NO: 469126 - DNA, 16 bp, R. norvegicus
aattctcaaaagaaga

SEQ ID NO: 469127 - DNA, 16 bp, R. norvegicus
aattctcaacatctat

SEQ ID NO: 469128 - DNA, 16 bp, R. norvegicus
aattctcaacttcaca

SEQ ID NO: 469129 - DNA, 16 bp, R. norvegicus
aattctcaattgagaa

SEQ ID NO: 469130 - DNA, 16 bp, R. norvegicus
aattctcaccttcata

SEQ ID NO: 469131 - DNA, 16 bp, R. norvegicus
aattctcagaaataaa

SEQ ID NO: 469132 - DNA, 16 bp, R. norvegicus
aattctcagctgagga

SEQ ID NO: 469133 - DNA, 16 bp, R. norvegicus
aattctctggagtcta

SEQ ID NO: 469134 - DNA, 16 bp, R. norvegicus
aattctctgtttcctg

SEQ ID NO: 469135 - DNA, 16 bp, R. norvegicus
aattctgaatatctgt

SEQ ID NO: 469136 - DNA, 36 bp, R. norvegicus
aattctgcttccgtgtgtcccaagctcaccaggcag

SEQ ID NO: 469137 - DNA, 16 bp, R. norvegicus
aattctggcacttggg

SEQ ID NO: 469138 - DNA, 16 bp, R. norvegicus
aattctggtttaaaat

SEQ ID NO: 469139 - DNA, 16 bp, R. norvegicus
aattctgtacaataaa

SEQ ID NO: 469140 - DNA, 16 bp, R. norvegicus
aattcttaatccacaa

SEQ ID NO: 469141 - DNA, 16 bp, R. norvegicus
aattcttataaagaaa

SEQ ID NO: 469142 - DNA, 16 bp, R. norvegicus
aattcttattctaaaa

SEQ ID NO: 469143 - DNA, 16 bp, R. norvegicus
aattcttcaaaaaatt

SEQ ID NO: 469144 - DNA, 16 bp, R. norvegicus
aattcttcaaagacat

SEQ ID NO: 469145 - DNA, 16 bp, R. norvegicus
aattcttcctcttcct

SEQ ID NO: 469146 - DNA, 16 bp, R. norvegicus
aattctttaagggact

SEQ ID NO: 469147 - DNA, 16 bp, R. norvegicus
aattctttttaaagat

SEQ ID NO: 469148 - DNA, 16 bp, R. norvegicus
aattgaaaacacagaa

SEQ ID NO: 469149 - DNA, 16 bp, R. norvegicus
aattgaacaaaactgt

SEQ ID NO: 469150 - DNA, 16 bp, R. norvegicus
aattgaactcagaact

SEQ ID NO: 469151 - DNA, 16 bp, R. norvegicus
aattgaagaaaaacta

SEQ ID NO: 469152 - DNA, 16 bp, R. norvegicus
aattgaagaagacacc

SEQ ID NO: 469153 - DNA, 16 bp, R. norvegicus
aattgaagaagctgaa

SEQ ID NO: 469154 - DNA, 16 bp, R. norvegicus
aattgaagacccagca

SEQ ID NO: 469155 - DNA, 16 bp, R. norvegicus
aattgaagatctagaa

SEQ ID NO: 469156 - DNA, 16 bp, R. norvegicus
aattgaagatgcagaa

SEQ ID NO: 469157 - DNA, 16 bp, R. norvegicus
aattgaatggctgtat

SEQ ID NO: 469158 - DNA, 16 bp, R. norvegicus
aattgacaaaaatgat

SEQ ID NO: 469159 - DNA, 16 bp, R. norvegicus
aattgacaaattggat

SEQ ID NO: 469160 - DNA, 16 bp, R. norvegicus
aattgactctgttggt

SEQ ID NO: 469161 - DNA, 16 bp, R. norvegicus
aattgagaaaaggcct

SEQ ID NO: 469162 - DNA, 16 bp, R. norvegicus
aattgagaaaatccct

SEQ ID NO: 469163 - DNA, 16 bp, R. norvegicus
aattgagcccattgat

SEQ ID NO: 469164 - DNA, 16 bp, R. norvegicus
aattgaggacccagaa

SEQ ID NO: 469165 - DNA, 16 bp, R. norvegicus
aattgagtggctgtat

SEQ ID NO: 469166 - DNA, 16 bp, R. norvegicus
aattgatattgagaga

SEQ ID NO: 469167 - DNA, 16 bp, R. norvegicus
aattgatggagaaacc

SEQ ID NO: 469168 - DNA, 16 bp, R. norvegicus
aattgcagtttcttgg

SEQ ID NO: 469169 - DNA, 16 bp, R. norvegicus
aattgcatcatttccc

SEQ ID NO: 469170 - DNA, 18 bp, R. norvegicus
aattgctacaccttggtt

SEQ ID NO: 469171 - DNA, 16 bp, R. norvegicus
aattgctttgacaaag

SEQ ID NO: 469172 - DNA, 16 bp, R. norvegicus
aattgctttttaaaaa

SEQ ID NO: 469173 - DNA, 16 bp, R. norvegicus
aattggaaattgatct

SEQ ID NO: 469174 - DNA, 16 bp, R. norvegicus
aattggaattttgata

SEQ ID NO: 469175 - DNA, 16 bp, R. norvegicus
aattggacattgacct

SEQ ID NO: 469176 - DNA, 16 bp, R. norvegicus
aattggattgcctctc

SEQ ID NO: 469177 - DNA, 16 bp, R. norvegicus
aattggctgtagccac

SEQ ID NO: 469178 - DNA, 16 bp, R. norvegicus
aattggggaaaagctg

SEQ ID NO: 469179 - DNA, 18 bp, R. norvegicus
aattgggttgtgagtaaa

SEQ ID NO: 469180 - DNA, 16 bp, R. norvegicus
aattggttctgagttt

SEQ ID NO: 469181 - DNA, 16 bp, R. norvegicus
aattgtaatgtaaata

SEQ ID NO: 469182 - DNA, 16 bp, R. norvegicus
aattgtattggaattt

SEQ ID NO: 469183 - DNA, 16 bp, R. norvegicus
aattgtcatctcagag

SEQ ID NO: 469184 - DNA, 16 bp, R. norvegicus
aattgtccttgagctt

SEQ ID NO: 469185 - DNA, 16 bp, R. norvegicus
aattgtggaaagagca

SEQ ID NO: 469186 - DNA, 16 bp, R. norvegicus
aattgtggatgcttca

SEQ ID NO: 469187 - DNA, 16 bp, R. norvegicus
aattgtggcttcatgg

SEQ ID NO: 469188 - DNA, 16 bp, R. norvegicus
aattgtgttggatttt

SEQ ID NO: 469189 - DNA, 16 bp, R. norvegicus
aattgttggctgtgag

SEQ ID NO: 469190 - DNA, 16 bp, R. norvegicus
aattgttttacagcct

SEQ ID NO: 469191 - DNA, 16 bp, R. norvegicus
aattgttttttctaac

SEQ ID NO: 469192 - DNA, 16 bp, R. norvegicus
aatttaaaaagccaaa

SEQ ID NO: 469193 - DNA, 16 bp, R. norvegicus
aatttaaaatgaaaca

SEQ ID NO: 469194 - DNA, 16 bp, R. norvegicus
aatttaaaatgcattt

SEQ ID NO: 469195 - DNA, 16 bp, R. norvegicus
aatttaaatgaacaaa

SEQ ID NO: 469196 - DNA, 16 bp, R. norvegicus
aatttaataaaggtgg

SEQ ID NO: 469197 - DNA, 16 bp, R. norvegicus
aatttacatttgaaat

SEQ ID NO: 469198 - DNA, 16 bp, R. norvegicus
aatttagacaatatct

SEQ ID NO: 469199 - DNA, 16 bp, R. norvegicus
aatttagactggtttc

SEQ ID NO: 469200 - DNA, 16 bp, R. norvegicus
aatttaggggaaaaaa

SEQ ID NO: 469201 - DNA, 16 bp, R. norvegicus
aatttagttggaattt

SEQ ID NO: 469202 - DNA, 16 bp, R. norvegicus
aatttatatctcccaa

SEQ ID NO: 469203 - DNA, 16 bp, R. norvegicus
aatttatgaagtcatt

SEQ ID NO: 469204 - DNA, 16 bp, R. norvegicus
aatttattcaagaaca

SEQ ID NO: 469205 - DNA, 16 bp, R. norvegicus
aatttattcttttgta

SEQ ID NO: 469206 - DNA, 16 bp, R. norvegicus
aatttatttcttcagt

SEQ ID NO: 469207 - DNA, 16 bp, R. norvegicus
aatttattttcatgtt

SEQ ID NO: 469208 - DNA, 16 bp, R. norvegicus
aatttcaagtctctca

SEQ ID NO: 469209 - DNA, 16 bp, R. norvegicus
aatttcacttaaaaat

SEQ ID NO: 469210 - DNA, 16 bp, R. norvegicus
aatttcacttttaaaa

SEQ ID NO: 469211 - DNA, 16 bp, R. norvegicus
aatttcagaaagaaaa

SEQ ID NO: 469212 - DNA, 16 bp, R. norvegicus
aatttcagaccagttt

SEQ ID NO: 469213 - DNA, 16 bp, R. norvegicus
aatttcatatggaaaa

SEQ ID NO: 469214 - DNA, 16 bp, R. norvegicus
aatttcattaaattct

SEQ ID NO: 469215 - DNA, 16 bp, R. norvegicus
aatttcattttcaaaa

SEQ ID NO: 469216 - DNA, 16 bp, R. norvegicus
aatttccactgattct

SEQ ID NO: 469217 - DNA, 16 bp, R. norvegicus
aatttccagcaaccac

SEQ ID NO: 469218 - DNA, 16 bp, R. norvegicus
aatttcccaactttga

SEQ ID NO: 469219 - DNA, 16 bp, R. norvegicus
aatttcccaatggatg

SEQ ID NO: 469220 - DNA, 16 bp, R. norvegicus
aatttcctcatctgta

SEQ ID NO: 469221 - DNA, 16 bp, R. norvegicus
aatttcctccagtgcc

SEQ ID NO: 469222 - DNA, 16 bp, R. norvegicus
aatttcctgaaaagaa

SEQ ID NO: 469223 - DNA, 16 bp, R. norvegicus
aatttcctgaataaaa

SEQ ID NO: 469224 - DNA, 16 bp, R. norvegicus
aatttcctgaatgttt

SEQ ID NO: 469225 - DNA, 16 bp, R. norvegicus
aatttctcagaaaatt

SEQ ID NO: 469226 - DNA, 16 bp, R. norvegicus
aatttctctcctattt

SEQ ID NO: 469227 - DNA, 16 bp, R. norvegicus
aatttctgaaaaaaaa

SEQ ID NO: 469228 - DNA, 16 bp, R. norvegicus
aatttctgactattat

SEQ ID NO: 469229 - DNA, 16 bp, R. norvegicus
aatttcttagctccag

SEQ ID NO: 469230 - DNA, 16 bp, R. norvegicus
aatttcttcagttttt

SEQ ID NO: 469231 - DNA, 16 bp, R. norvegicus
aatttctttatttctg

SEQ ID NO: 469232 - DNA, 16 bp, R. norvegicus
aatttctttggtgtct

SEQ ID NO: 469233 - DNA, 16 bp, R. norvegicus
aatttcttttaagttt

SEQ ID NO: 469234 - DNA, 16 bp, R. norvegicus
aatttgaagcaatcct

SEQ ID NO: 469235 - DNA, 16 bp, R. norvegicus
aatttgaagctagcct

SEQ ID NO: 469236 - DNA, 16 bp, R. norvegicus
aatttgaaggagagca

SEQ ID NO: 469237 - DNA, 16 bp, R. norvegicus
aatttgaaggtaaatg

SEQ ID NO: 469238 - DNA, 16 bp, R. norvegicus
aatttgaagtcagcct

SEQ ID NO: 469239 - DNA, 16 bp, R. norvegicus
aatttgacttggcaac

SEQ ID NO: 469240 - DNA, 16 bp, R. norvegicus
aatttgagaaaatcaa

SEQ ID NO: 469241 - DNA, 16 bp, R. norvegicus
aatttgaggtcatcct

SEQ ID NO: 469242 - DNA, 16 bp, R. norvegicus
aatttgattgctgttt

SEQ ID NO: 469243 - DNA, 16 bp, R. norvegicus
aatttgcaaattcacc

SEQ ID NO: 469244 - DNA, 16 bp, R. norvegicus
aatttgcaaattcgtt

SEQ ID NO: 469245 - DNA, 16 bp, R. norvegicus
aatttgcacattgttc

SEQ ID NO: 469246 - DNA, 16 bp, R. norvegicus
aatttgctttcttcta

SEQ ID NO: 469247 - DNA, 16 bp, R. norvegicus
aatttggaaatgaaaa

SEQ ID NO: 469248 - DNA, 16 bp, R. norvegicus
aatttggacactctct

SEQ ID NO: 469249 - DNA, 16 bp, R. norvegicus
aatttggaggaaatgg

SEQ ID NO: 469250 - DNA, 16 bp, R. norvegicus
aatttggatgaagtca

SEQ ID NO: 469251 - DNA, 16 bp, R. norvegicus
aatttgggagtctttg

SEQ ID NO: 469252 - DNA, 16 bp, R. norvegicus
aatttggggaagaaaa

SEQ ID NO: 469253 - DNA, 16 bp, R. norvegicus
aatttgtagaagaaaa

SEQ ID NO: 469254 - DNA, 16 bp, R. norvegicus
aattttaaaaatgcct

SEQ ID NO: 469255 - DNA, 16 bp, R. norvegicus
aattttaaaacacatt

SEQ ID NO: 469256 - DNA, 16 bp, R. norvegicus
aattttaaaacttgaa

SEQ ID NO: 469257 - DNA, 16 bp, R. norvegicus
aattttaaaagtgttt

SEQ ID NO: 469258 - DNA, 16 bp, R. norvegicus
aattttaagtcatttt

SEQ ID NO: 469259 - DNA, 16 bp, R. norvegicus
aattttagaaattctt

SEQ ID NO: 469260 - DNA, 16 bp, R. norvegicus
aattttaggaagaaaa

SEQ ID NO: 469261 - DNA, 16 bp, R. norvegicus
aattttattttgctga

SEQ ID NO: 469262 - DNA, 16 bp, R. norvegicus
aattttcaataaaaga

SEQ ID NO: 469263 - DNA, 16 bp, R. norvegicus
aattttcacattaaaa

SEQ ID NO: 469264 - DNA, 16 bp, R. norvegicus
aattttccagaacaga

SEQ ID NO: 469265 - DNA, 16 bp, R. norvegicus
aattttccaggcaaat

SEQ ID NO: 469266 - DNA, 16 bp, R. norvegicus
aattttcctcaaggct

SEQ ID NO: 469267 - DNA, 16 bp, R. norvegicus
aattttcctcagaaaa

SEQ ID NO: 469268 - DNA, 16 bp, R. norvegicus
aattttctagagaaat

SEQ ID NO: 469269 - DNA, 16 bp, R. norvegicus
aattttctccatttct

SEQ ID NO: 469270 - DNA, 16 bp, R. norvegicus
aattttctgaatgttt

SEQ ID NO: 469271 - DNA, 16 bp, R. norvegicus
aattttctgaggaatg

SEQ ID NO: 469272 - DNA, 16 bp, R. norvegicus
aattttctgaggagcc

SEQ ID NO: 469273 - DNA, 16 bp, R. norvegicus
aattttctttcaaaaa

SEQ ID NO: 469274 - DNA, 16 bp, R. norvegicus
aattttgatatgcctt

SEQ ID NO: 469275 - DNA, 16 bp, R. norvegicus
aattttgatggggatt

SEQ ID NO: 469276 - DNA, 16 bp, R. norvegicus
aattttgcctttttgt

SEQ ID NO: 469277 - DNA, 16 bp, R. norvegicus
aattttggagaaaatt

SEQ ID NO: 469278 - DNA, 16 bp, R. norvegicus
aattttggagaagatt

SEQ ID NO: 469279 - DNA, 16 bp, R. norvegicus
aattttggagttttgg

SEQ ID NO: 469280 - DNA, 16 bp, R. norvegicus
aattttgggttcattt

SEQ ID NO: 469281 - DNA, 16 bp, R. norvegicus
aattttgtagaatata

SEQ ID NO: 469282 - DNA, 16 bp, R. norvegicus
aattttgtgtttctgt

SEQ ID NO: 469283 - DNA, 16 bp, R. norvegicus
aattttgttactttta

SEQ ID NO: 469284 - DNA, 16 bp, R. norvegicus
aattttgttttgtcat

SEQ ID NO: 469285 - DNA, 16 bp, R. norvegicus
aatttttaaaaaatgg

SEQ ID NO: 469286 - DNA, 16 bp, R. norvegicus
aatttttaaaaagcag

SEQ ID NO: 469287 - DNA, 16 bp, R. norvegicus
aatttttaaaaagtca

SEQ ID NO: 469288 - DNA, 16 bp, R. norvegicus
aatttttaaaaatggg

SEQ ID NO: 469289 - DNA, 16 bp, R. norvegicus
aatttttaaagacttt

SEQ ID NO: 469290 - DNA, 16 bp, R. norvegicus
aatttttagggtcatt

SEQ ID NO: 469291 - DNA, 16 bp, R. norvegicus
aatttttatcatgaaa

SEQ ID NO: 469292 - DNA, 16 bp, R. norvegicus
aatttttattcataag

SEQ ID NO: 469293 - DNA, 16 bp, R. norvegicus
aatttttcaaaagaaa

SEQ ID NO: 469294 - DNA, 16 bp, R. norvegicus
aatttttcagacaaaa

SEQ ID NO: 469295 - DNA, 16 bp, R. norvegicus
aatttttctttgagtt

SEQ ID NO: 469296 - DNA, 16 bp, R. norvegicus
aatttttgagatgagt

SEQ ID NO: 469297 - DNA, 16 bp, R. norvegicus
aatttttggaaatcat

SEQ ID NO: 469298 - DNA, 16 bp, R. norvegicus
aattttttaaaagaga

SEQ ID NO: 469299 - DNA, 16 bp, R. norvegicus
aattttttaaagcttt

SEQ ID NO: 469300 - DNA, 17 bp, R. norvegicus
acaaaaaacccaggaga

SEQ ID NO: 469301 - DNA, 16 bp, R. norvegicus
acaaaaaacctaggat

SEQ ID NO: 469302 - DNA, 16 bp, R. norvegicus
acaaaaagaagcaagt

SEQ ID NO: 469303 - DNA, 16 bp, R. norvegicus
acaaaaagcctacaga

SEQ ID NO: 469304 - DNA, 16 bp, R. norvegicus
acaaaaaggccattgt

SEQ ID NO: 469305 - DNA, 16 bp, R. norvegicus
acaaaaataccactga

SEQ ID NO: 469306 - DNA, 16 bp, R. norvegicus
acaaaaatatttgaaa

SEQ ID NO: 469307 - DNA, 16 bp, R. norvegicus
acaaaaatcccttcaa

SEQ ID NO: 469308 - DNA, 17 bp, R. norvegicus
acaaaaatgatagctgt

SEQ ID NO: 469309 - DNA, 16 bp, R. norvegicus
acaaaaatgtccttgc

SEQ ID NO: 469310 - DNA, 16 bp, R. norvegicus
acaaaacaaaatgatt

SEQ ID NO: 469311 - DNA, 16 bp, R. norvegicus
acaaaacaagcttcaa

SEQ ID NO: 469312 - DNA, 16 bp, R. norvegicus
acaaaaccagaagctg

SEQ ID NO: 469313 - DNA, 16 bp, R. norvegicus
acaaaaccagccctac

SEQ ID NO: 469314 - DNA, 16 bp, R. norvegicus
acaaaaccctccagga

SEQ ID NO: 469315 - DNA, 16 bp, R. norvegicus
acaaaacccttcagct

SEQ ID NO: 469316 - DNA, 16 bp, R. norvegicus
acaaaaccttccagga

SEQ ID NO: 469317 - DNA, 16 bp, R. norvegicus
acaaaacctttttttt

SEQ ID NO: 469318 - DNA, 16 bp, R. norvegicus
acaaaactcaagacag

SEQ ID NO: 469319 - DNA, 16 bp, R. norvegicus
acaaaactctcaatta

SEQ ID NO: 469320 - DNA, 16 bp, R. norvegicus
acaaaactctggcttt

SEQ ID NO: 469321 - DNA, 16 bp, R. norvegicus
acaaaagaaaaatgtt

SEQ ID NO: 469322 - DNA, 16 bp, R. norvegicus
acaaaagaaaatttta

SEQ ID NO: 469323 - DNA, 16 bp, R. norvegicus
acaaaagaacacacat

SEQ ID NO: 469324 - DNA, 16 bp, R. norvegicus
acaaaagagatacaag

SEQ ID NO: 469325 - DNA, 16 bp, R. norvegicus
acaaaagaggcctcaa

SEQ ID NO: 469326 - DNA, 16 bp, R. norvegicus
acaaaagcaatttaag

SEQ ID NO: 469327 - DNA, 16 bp, R. norvegicus
acaaaagcttccttct

SEQ ID NO: 469328 - DNA, 16 bp, R. norvegicus
acaaaaggaagcaaat

SEQ ID NO: 469329 - DNA, 16 bp, R. norvegicus
acaaaaggagacaatc

SEQ ID NO: 469330 - DNA, 16 bp, R. norvegicus
acaaaaggagatgaaa

SEQ ID NO: 469331 - DNA, 16 bp, R. norvegicus
acaaaatactcagagg

SEQ ID NO: 469332 - DNA, 16 bp, R. norvegicus
acaaaatagtcacagg

SEQ ID NO: 469333 - DNA, 16 bp, R. norvegicus
acaaaatattttctta

SEQ ID NO: 469334 - DNA, 16 bp, R. norvegicus
acaaaatcatggaaga

SEQ ID NO: 469335 - DNA, 16 bp, R. norvegicus
acaaaatgaaaactca

SEQ ID NO: 469336 - DNA, 16 bp, R. norvegicus
acaaaatgaactctca

SEQ ID NO: 469337 - DNA, 16 bp, R. norvegicus
acaaaatgacaatcaa

SEQ ID NO: 469338 - DNA, 16 bp, R. norvegicus
acaaaatggaaagaga

SEQ ID NO: 469339 - DNA, 16 bp, R. norvegicus
acaaaatggagaagag

SEQ ID NO: 469340 - DNA, 16 bp, R. norvegicus
acaaaatggagtttat

SEQ ID NO: 469341 - DNA, 16 bp, R. norvegicus
acaaaattatagaaat

SEQ ID NO: 469342 - DNA, 16 bp, R. norvegicus
acaaaattattttcac

SEQ ID NO: 469343 - DNA, 16 bp, R. norvegicus
acaaaattctcaaaga

SEQ ID NO: 469344 - DNA, 16 bp, R. norvegicus
acaaaatttaagatta

SEQ ID NO: 469345 - DNA, 16 bp, R. norvegicus
acaaacacacacatga

SEQ ID NO: 469346 - DNA, 16 bp, R. norvegicus
acaaacaccttggcca

SEQ ID NO: 469347 - DNA, 16 bp, R. norvegicus
acaaacactctgaaaa

SEQ ID NO: 469348 - DNA, 16 bp, R. norvegicus
acaaacacttcacaga

SEQ ID NO: 469349 - DNA, 16 bp, R. norvegicus
acaaacaggtgaagaa

SEQ ID NO: 469350 - DNA, 16 bp, R. norvegicus
acaaacaggtgaagga

SEQ ID NO: 469351 - DNA, 16 bp, R. norvegicus
acaaacagtggaagga

SEQ ID NO: 469352 - DNA, 16 bp, R. norvegicus
acaaacatacagagaa

SEQ ID NO: 469353 - DNA, 16 bp, R. norvegicus
acaaacatacagagac

SEQ ID NO: 469354 - DNA, 16 bp, R. norvegicus
acaaaccacaccaggc

SEQ ID NO: 469355 - DNA, 16 bp, R. norvegicus
acaaaccatcacatct

SEQ ID NO: 469356 - DNA, 16 bp, R. norvegicus
acaaaccctcatatca

SEQ ID NO: 469357 - DNA, 16 bp, R. norvegicus
acaaaccctgtctcaa

SEQ ID NO: 469358 - DNA, 16 bp, R. norvegicus
acaaactagaaaggaa

SEQ ID NO: 469359 - DNA, 16 bp, R. norvegicus
acaaactagagtcact

SEQ ID NO: 469360 - DNA, 16 bp, R. norvegicus
acaaactcaagtccaa

SEQ ID NO: 469361 - DNA, 16 bp, R. norvegicus
acaaactctaagaaaa

SEQ ID NO: 469362 - DNA, 16 bp, R. norvegicus
acaaactctcacacac

SEQ ID NO: 469363 - DNA, 17 bp, R. norvegicus
acaaactgaaagaacat

SEQ ID NO: 469364 - DNA, 16 bp, R. norvegicus
acaaactgaaaggaaa

SEQ ID NO: 469365 - DNA, 16 bp, R. norvegicus
acaaactgaaggaaca

SEQ ID NO: 469366 - DNA, 16 bp, R. norvegicus
acaaactgagaaagaa

SEQ ID NO: 469367 - DNA, 16 bp, R. norvegicus
acaaactggatacaaa

SEQ ID NO: 469368 - DNA, 16 bp, R. norvegicus
acaaagaaaacattta

SEQ ID NO: 469369 - DNA, 16 bp, R. norvegicus
acaaagaaaagcattt

SEQ ID NO: 469370 - DNA, 16 bp, R. norvegicus
acaaagaaaatatttc

SEQ ID NO: 469371 - DNA, 16 bp, R. norvegicus
acaaagaaacagaact

SEQ ID NO: 469372 - DNA, 16 bp, R. norvegicus
acaaagaagctgtgtt

SEQ ID NO: 469373 - DNA, 16 bp, R. norvegicus
acaaagaaggagaact

SEQ ID NO: 469374 - DNA, 16 bp, R. norvegicus
acaaagaaggtgtcct

SEQ ID NO: 469375 - DNA, 16 bp, R. norvegicus
acaaagaagtcaaaat

SEQ ID NO: 469376 - DNA, 16 bp, R. norvegicus
acaaagaagtcaagaa

SEQ ID NO: 469377 - DNA, 16 bp, R. norvegicus
acaaagaagtggagta

SEQ ID NO: 469378 - DNA, 16 bp, R. norvegicus
acaaagaatggaaaca

SEQ ID NO: 469379 - DNA, 16 bp, R. norvegicus
acaaagaatggataca

SEQ ID NO: 469380 - DNA, 16 bp, R. norvegicus
acaaagacacagacag

SEQ ID NO: 469381 - DNA, 16 bp, R. norvegicus
acaaagacactacctc

SEQ ID NO: 469382 - DNA, 16 bp, R. norvegicus
acaaagacagaggcag

SEQ ID NO: 469383 - DNA, 16 bp, R. norvegicus
acaaagacaggaaata

SEQ ID NO: 469384 - DNA, 16 bp, R. norvegicus
acaaagacaggagaca

SEQ ID NO: 469385 - DNA, 16 bp, R. norvegicus
acaaagacatcatgaa

SEQ ID NO: 469386 - DNA, 16 bp, R. norvegicus
acaaagacatgaattt

SEQ ID NO: 469387 - DNA, 16 bp, R. norvegicus
acaaagaccctataaa

SEQ ID NO: 469388 - DNA, 16 bp, R. norvegicus
acaaagagaatgaaat

SEQ ID NO: 469389 - DNA, 16 bp, R. norvegicus
acaaagagagagaact

SEQ ID NO: 469390 - DNA, 16 bp, R. norvegicus
acaaagagctgtggga

SEQ ID NO: 469391 - DNA, 16 bp, R. norvegicus
acaaagaggaaatgca

SEQ ID NO: 469392 - DNA, 16 bp, R. norvegicus
acaaagatgaactctc

SEQ ID NO: 469393 - DNA, 16 bp, R. norvegicus
acaaagatgccaaaaa

SEQ ID NO: 469394 - DNA, 16 bp, R. norvegicus
acaaagatggagaaga

SEQ ID NO: 469395 - DNA, 16 bp, R. norvegicus
acaaagattcccagct

SEQ ID NO: 469396 - DNA, 16 bp, R. norvegicus
acaaagatttatttta

SEQ ID NO: 469397 - DNA, 16 bp, R. norvegicus
acaaagcaagaccctg

SEQ ID NO: 469398 - DNA, 16 bp, R. norvegicus
acaaagcaagcttcaa

SEQ ID NO: 469399 - DNA, 16 bp, R. norvegicus
acaaagcaatagtcat

SEQ ID NO: 469400 - DNA, 16 bp, R. norvegicus
acaaagcagagagagc

SEQ ID NO: 469401 - DNA, 16 bp, R. norvegicus
acaaagcagatttcag

SEQ ID NO: 469402 - DNA, 16 bp, R. norvegicus
acaaagcattcattca

SEQ ID NO: 469403 - DNA, 16 bp, R. norvegicus
acaaagcccggtacca

SEQ ID NO: 469404 - DNA, 16 bp, R. norvegicus
acaaagctcaactcca

SEQ ID NO: 469405 - DNA, 16 bp, R. norvegicus
acaaagctcaagttca

SEQ ID NO: 469406 - DNA, 16 bp, R. norvegicus
acaaagctcaggtcca

SEQ ID NO: 469407 - DNA, 16 bp, R. norvegicus
acaaagctgaagtcca

SEQ ID NO: 469408 - DNA, 16 bp, R. norvegicus
acaaaggaaagcattt

SEQ ID NO: 469409 - DNA, 16 bp, R. norvegicus
acaaaggactttgaac

SEQ ID NO: 469410 - DNA, 16 bp, R. norvegicus
acaaaggaggcaaaac

SEQ ID NO: 469411 - DNA, 16 bp, R. norvegicus
acaaaggatccataac

SEQ ID NO: 469412 - DNA, 16 bp, R. norvegicus
acaaaggcagctgcac

SEQ ID NO: 469413 - DNA, 16 bp, R. norvegicus
acaaagtcagagaatg

SEQ ID NO: 469414 - DNA, 16 bp, R. norvegicus
acaaagtcccactcct

SEQ ID NO: 469415 - DNA, 16 bp, R. norvegicus
acaaagtgtgtgtgtg

SEQ ID NO: 469416 - DNA, 16 bp, R. norvegicus
acaaagttgtcattga

SEQ ID NO: 469417 - DNA, 16 bp, R. norvegicus
acaaataaatactttt

SEQ ID NO: 469418 - DNA, 16 bp, R. norvegicus
acaaataaccctatta

SEQ ID NO: 469419 - DNA, 16 bp, R. norvegicus
acaaataactcaagaa

SEQ ID NO: 469420 - DNA, 16 bp, R. norvegicus
acaaataatcctatta

SEQ ID NO: 469421 - DNA, 16 bp, R. norvegicus
acaaatacaagaagac

SEQ ID NO: 469422 - DNA, 16 bp, R. norvegicus
acaaatactgcatgtt

SEQ ID NO: 469423 - DNA, 16 bp, R. norvegicus
acaaatactttggcca

SEQ ID NO: 469424 - DNA, 16 bp, R. norvegicus
acaaatatacacacat

SEQ ID NO: 469425 - DNA, 16 bp, R. norvegicus
acaaatatgaagtgtc

SEQ ID NO: 469426 - DNA, 16 bp, R. norvegicus
acaaatatttgttgaa

SEQ ID NO: 469427 - DNA, 16 bp, R. norvegicus
acaaatcaaagagaag

SEQ ID NO: 469428 - DNA, 16 bp, R. norvegicus
acaaatgaaatgaatg

SEQ ID NO: 469429 - DNA, 16 bp, R. norvegicus
acaaatgcaagcatca

SEQ ID NO: 469430 - DNA, 16 bp, R. norvegicus
acaaatgcacagaaaa

SEQ ID NO: 469431 - DNA, 16 bp, R. norvegicus
acaaatgcagatactt

SEQ ID NO: 469432 - DNA, 16 bp, R. norvegicus
acaaatgccaacccaa

SEQ ID NO: 469433 - DNA, 16 bp, R. norvegicus
acaaatggaaagaaac

SEQ ID NO: 469434 - DNA, 16 bp, R. norvegicus
acaaatggatgaagca

SEQ ID NO: 469435 - DNA, 16 bp, R. norvegicus
acaaatggatggaaat

SEQ ID NO: 469436 - DNA, 16 bp, R. norvegicus
acaaatgggaaaagaa

SEQ ID NO: 469437 - DNA, 50 bp, R. norvegicus
acaaatgggatctcataaaactgcaaagcttctgtaaggcaaaggacacc

SEQ ID NO: 469438 - DNA, 65 bp, R. norvegicus
acaaatgggatctcataaaactgcaaagcttctgtaaggcaaaggacacggtggttaggacaaaa

SEQ ID NO: 469439 - DNA, 64 bp, R. norvegicus
acaaatgggatctcataaaactgcaaagcttctgtaaggcaaaggacactgtggttaggacaaa

SEQ ID NO: 469440 - DNA, 16 bp, R. norvegicus
acaaatggggctggtt

SEQ ID NO: 469441 - DNA, 16 bp, R. norvegicus
acaaatgtatatttat

SEQ ID NO: 469442 - DNA, 16 bp, R. norvegicus
acaaatgtggtcaaca

SEQ ID NO: 469443 - DNA, 16 bp, R. norvegicus
acaaattaaactcaag

SEQ ID NO: 469444 - DNA, 16 bp, R. norvegicus
acaaattgacaaccta

SEQ ID NO: 469445 - DNA, 16 bp, R. norvegicus
acaaattggaaggaaa

SEQ ID NO: 469446 - DNA, 16 bp, R. norvegicus
acaaattgtagagaca

SEQ ID NO: 469447 - DNA, 16 bp, R. norvegicus
acaaatttaaaaagca

SEQ ID NO: 469448 - DNA, 16 bp, R. norvegicus
acaaatttgaaaagaa

SEQ ID NO: 469449 - DNA, 16 bp, R. norvegicus
acaacaaaaatggact

SEQ ID NO: 469450 - DNA, 16 bp, R. norvegicus
acaacaaaaccacatg

SEQ ID NO: 469451 - DNA, 16 bp, R. norvegicus
acaacaaattccctta

SEQ ID NO: 469452 - DNA, 16 bp, R. norvegicus
acaacaacaaaagtca

SEQ ID NO: 469453 - DNA, 16 bp, R. norvegicus
acaacaagaccaacta

SEQ ID NO: 469454 - DNA, 16 bp, R. norvegicus
acaacaagcctacaga

SEQ ID NO: 469455 - DNA, 16 bp, R. norvegicus
acaacaatgaccagca

SEQ ID NO: 469456 - DNA, 16 bp, R. norvegicus
acaacaatgccaatca

SEQ ID NO: 469457 - DNA, 16 bp, R. norvegicus
acaacacaggtaaaca

SEQ ID NO: 469458 - DNA, 16 bp, R. norvegicus
acaacacgaggagctg

SEQ ID NO: 469459 - DNA, 16 bp, R. norvegicus
acaacactgctgacat

SEQ ID NO: 469460 - DNA, 16 bp, R. norvegicus
acaacagaatctgaaa

SEQ ID NO: 469461 - DNA, 16 bp, R. norvegicus
acaacagaggaatctt

SEQ ID NO: 469462 - DNA, 16 bp, R. norvegicus
acaacagaggactgcc

SEQ ID NO: 469463 - DNA, 16 bp, R. norvegicus
acaacagatgctggcc

SEQ ID NO: 469464 - DNA, 16 bp, R. norvegicus
acaacagcaacaaaat

SEQ ID NO: 469465 - DNA, 16 bp, R. norvegicus
acaacagcagcagcaa

SEQ ID NO: 469466 - DNA, 16 bp, R. norvegicus
acaacagctacagtgt

SEQ ID NO: 469467 - DNA, 16 bp, R. norvegicus
acaacaggaaaagcat

SEQ ID NO: 469468 - DNA, 16 bp, R. norvegicus
acaacatacccaaacg

SEQ ID NO: 469469 - DNA, 16 bp, R. norvegicus
acaacatccacacagc

SEQ ID NO: 469470 - DNA, 16 bp, R. norvegicus
acaacattgatgaagc

SEQ ID NO: 469471 - DNA, 16 bp, R. norvegicus
acaacattggaaatgt

SEQ ID NO: 469472 - DNA, 16 bp, R. norvegicus
acaacatttcttcctt

SEQ ID NO: 469473 - DNA, 38 bp, R. norvegicus
acaaccaacagattgggaaaagatctttaccaatccta

SEQ ID NO: 469474 - DNA, 16 bp, R. norvegicus
acaaccacaaggcaga

SEQ ID NO: 469475 - DNA, 16 bp, R. norvegicus
acaaccagcactcctg

SEQ ID NO: 469476 - DNA, 17 bp, R. norvegicus
acaaccaggaagacctg

SEQ ID NO: 469477 - DNA, 17 bp, R. norvegicus
acaaccctcaaggacag

SEQ ID NO: 469478 - DNA, 16 bp, R. norvegicus
acaaccctgaccaaca

SEQ ID NO: 469479 - DNA, 16 bp, R. norvegicus
acaacctgatgacaag

SEQ ID NO: 469480 - DNA, 16 bp, R. norvegicus
acaacctgatggccag

SEQ ID NO: 469481 - DNA, 16 bp, R. norvegicus
acaacctgctgagtcc

SEQ ID NO: 469482 - DNA, 16 bp, R. norvegicus
acaaccttatttataa

SEQ ID NO: 469483 - DNA, 16 bp, R. norvegicus
acaaccttcaaagata

SEQ ID NO: 469484 - DNA, 16 bp, R. norvegicus
acaacgacgacgacga

SEQ ID NO: 469485 - DNA, 16 bp, R. norvegicus
acaacgacgacgatga

SEQ ID NO: 469486 - DNA, 118 bp, R. norvegicus
acaacgagtttatgaaattcgtaggcaaatggttggaactggaaaatatcatcctgagtgaactaacccaatcacagaaagacatacatggtatgcactcattgataagtggctatta

SEQ ID NO: 469487 - DNA, 16 bp, R. norvegicus
acaacgtcagcaaagt

SEQ ID NO: 469488 - DNA, 16 bp, R. norvegicus
acaactactctagaaa

SEQ ID NO: 469489 - DNA, 16 bp, R. norvegicus
acaactataactccag

SEQ ID NO: 469490 - DNA, 16 bp, R. norvegicus
acaactatgccaagca

SEQ ID NO: 469491 - DNA, 16 bp, R. norvegicus
acaactcagagaccat

SEQ ID NO: 469492 - DNA, 16 bp, R. norvegicus
acaactccagtctcca

SEQ ID NO: 469493 - DNA, 16 bp, R. norvegicus
acaactccagttccag

SEQ ID NO: 469494 - DNA, 16 bp, R. norvegicus
acaactcttgctcaga

SEQ ID NO: 469495 - DNA, 16 bp, R. norvegicus
acaactgtctgtagct

SEQ ID NO: 469496 - DNA, 16 bp, R. norvegicus
acaacttcagccaagt

SEQ ID NO: 469497 - DNA, 16 bp, R. norvegicus
acaacttcatcaaagt

SEQ ID NO: 469498 - DNA, 16 bp, R. norvegicus
acaactttggaaagca

SEQ ID NO: 469499 - DNA, 16 bp, R. norvegicus
acaactttggctatga

SEQ ID NO: 469500 - DNA, 16 bp, R. norvegicus
acaagaaaaataattt

SEQ ID NO: 469501 - DNA, 16 bp, R. norvegicus
acaagaaaaatattct

SEQ ID NO: 469502 - DNA, 16 bp, R. norvegicus
acaagaaaaggctgcc

SEQ ID NO: 469503 - DNA, 16 bp, R. norvegicus
acaagaaaatgatctt

SEQ ID NO: 469504 - DNA, 16 bp, R. norvegicus
acaagaaactgggaaa

SEQ ID NO: 469505 - DNA, 16 bp, R. norvegicus
acaagaaatgcaagga

SEQ ID NO: 469506 - DNA, 16 bp, R. norvegicus
acaagaaatgcaggaa

SEQ ID NO: 469507 - DNA, 16 bp, R. norvegicus
acaagaacacaaacat

SEQ ID NO: 469508 - DNA, 16 bp, R. norvegicus
acaagaacacagccca

SEQ ID NO: 469509 - DNA, 16 bp, R. norvegicus
acaagaacacatgctt

SEQ ID NO: 469510 - DNA, 16 bp, R. norvegicus
acaagaacacccttgg

SEQ ID NO: 469511 - DNA, 16 bp, R. norvegicus
acaagaacataagcaa

SEQ ID NO: 469512 - DNA, 16 bp, R. norvegicus
acaagaagagaaacta

SEQ ID NO: 469513 - DNA, 16 bp, R. norvegicus
acaagaagcctacaca

SEQ ID NO: 469514 - DNA, 16 bp, R. norvegicus
acaagaagcttataga

SEQ ID NO: 469515 - DNA, 16 bp, R. norvegicus
acaagaaggacaggct

SEQ ID NO: 469516 - DNA, 17 bp, R. norvegicus
acaagacactgaagaag

SEQ ID NO: 469517 - DNA, 16 bp, R. norvegicus
acaagaccaaggacct

SEQ ID NO: 469518 - DNA, 16 bp, R. norvegicus
acaagactgcccattc

SEQ ID NO: 469519 - DNA, 16 bp, R. norvegicus
acaagactttcagaat

SEQ ID NO: 469520 - DNA, 16 bp, R. norvegicus
acaagagaagaatgga

SEQ ID NO: 469521 - DNA, 16 bp, R. norvegicus
acaagagacacagaga

SEQ ID NO: 469522 - DNA, 16 bp, R. norvegicus
acaagagatggaggag

SEQ ID NO: 469523 - DNA, 17 bp, R. norvegicus
acaagagattgaagaga

SEQ ID NO: 469524 - DNA, 16 bp, R. norvegicus
acaagaggaaatacag

SEQ ID NO: 469525 - DNA, 16 bp, R. norvegicus
acaagaggaggtcaag

SEQ ID NO: 469526 - DNA, 16 bp, R. norvegicus
acaagaggtcacagag

SEQ ID NO: 469527 - DNA, 16 bp, R. norvegicus
acaagagttgccttgg

SEQ ID NO: 469528 - DNA, 16 bp, R. norvegicus
acaagatgctggaaca

SEQ ID NO: 469529 - DNA, 16 bp, R. norvegicus
acaagatggaacccat

SEQ ID NO: 469530 - DNA, 16 bp, R. norvegicus
acaagatggccacctc

SEQ ID NO: 469531 - DNA, 17 bp, R. norvegicus
acaagattcaacacccc

SEQ ID NO: 469532 - DNA, 16 bp, R. norvegicus
acaagcaacagaaagc

SEQ ID NO: 469533 - DNA, 16 bp, R. norvegicus
acaagcaagcttccag

SEQ ID NO: 469534 - DNA, 16 bp, R. norvegicus
acaagcacacatacaa

SEQ ID NO: 469535 - DNA, 16 bp, R. norvegicus
acaagcagcagcagca

SEQ ID NO: 469536 - DNA, 16 bp, R. norvegicus
acaagcagcatcagac

SEQ ID NO: 469537 - DNA, 16 bp, R. norvegicus
acaagcagctgaatga

SEQ ID NO: 469538 - DNA, 16 bp, R. norvegicus
acaagcagctgactga

SEQ ID NO: 469539 - DNA, 16 bp, R. norvegicus
acaagcagctgattga

SEQ ID NO: 469540 - DNA, 17 bp, R. norvegicus
acaagcagtggttccag

SEQ ID NO: 469541 - DNA, 16 bp, R. norvegicus
acaagcatgaggacct

SEQ ID NO: 469542 - DNA, 16 bp, R. norvegicus
acaagcatgaggactt

SEQ ID NO: 469543 - DNA, 16 bp, R. norvegicus
acaagccatcctctgc

SEQ ID NO: 469544 - DNA, 17 bp, R. norvegicus
acaagccccaggagatg

SEQ ID NO: 469545 - DNA, 16 bp, R. norvegicus
acaagcctgcacatgc

SEQ ID NO: 469546 - DNA, 16 bp, R. norvegicus
acaagctagccaagat

SEQ ID NO: 469547 - DNA, 16 bp, R. norvegicus
acaagctgaaaaagaa

SEQ ID NO: 469548 - DNA, 16 bp, R. norvegicus
acaagctgaaagaaca

SEQ ID NO: 469549 - DNA, 16 bp, R. norvegicus
acaagctgctgcagga

SEQ ID NO: 469550 - DNA, 16 bp, R. norvegicus
acaagctggggtagcc

SEQ ID NO: 469551 - DNA, 16 bp, R. norvegicus
acaagctgtcttctga

SEQ ID NO: 469552 - DNA, 16 bp, R. norvegicus
acaagcttattgagtt

SEQ ID NO: 469553 - DNA, 16 bp, R. norvegicus
acaaggaaaattagaa

SEQ ID NO: 469554 - DNA, 16 bp, R. norvegicus
acaaggaagaaaacta

SEQ ID NO: 469555 - DNA, 16 bp, R. norvegicus
acaaggaagaacctcc

SEQ ID NO: 469556 - DNA, 16 bp, R. norvegicus
acaaggacacaggctc

SEQ ID NO: 469557 - DNA, 16 bp, R. norvegicus
acaaggacacatgctc

SEQ ID NO: 469558 - DNA, 16 bp, R. norvegicus
acaaggacagaaacta

SEQ ID NO: 469559 - DNA, 16 bp, R. norvegicus
acaaggacttcaaaat

SEQ ID NO: 469560 - DNA, 16 bp, R. norvegicus
acaaggagaaaaacta

SEQ ID NO: 469561 - DNA, 16 bp, R. norvegicus
acaaggagaatgaaag

SEQ ID NO: 469562 - DNA, 16 bp, R. norvegicus
acaaggaggagcttcc

SEQ ID NO: 469563 - DNA, 17 bp, R. norvegicus
acaaggatgcctactct

SEQ ID NO: 469564 - DNA, 16 bp, R. norvegicus
acaaggccacacattc

SEQ ID NO: 469565 - DNA, 16 bp, R. norvegicus
acaaggccacctacat

SEQ ID NO: 469566 - DNA, 16 bp, R. norvegicus
acaaggccatgtctcc

SEQ ID NO: 469567 - DNA, 16 bp, R. norvegicus
acaaggccctggattt

SEQ ID NO: 469568 - DNA, 16 bp, R. norvegicus
acaaggccctgggtta

SEQ ID NO: 469569 - DNA, 16 bp, R. norvegicus
acaaggctatcttctg

SEQ ID NO: 469570 - DNA, 16 bp, R. norvegicus
acaaggctggctttga

SEQ ID NO: 469571 - DNA, 16 bp, R. norvegicus
acaagggagaaagcat

SEQ ID NO: 469572 - DNA, 16 bp, R. norvegicus
acaaggtccacttctt

SEQ ID NO: 469573 - DNA, 16 bp, R. norvegicus
acaaggtggctcacag

SEQ ID NO: 469574 - DNA, 16 bp, R. norvegicus
acaagtcacagatcca

SEQ ID NO: 469575 - DNA, 16 bp, R. norvegicus
acaagtcagagaatga

SEQ ID NO: 469576 - DNA, 16 bp, R. norvegicus
acaagtctctgaagaa

SEQ ID NO: 469577 - DNA, 16 bp, R. norvegicus
acaagtggaaggggaa

SEQ ID NO: 469578 - DNA, 16 bp, R. norvegicus
acaagtgtgtgcacat

SEQ ID NO: 469579 - DNA, 16 bp, R. norvegicus
acaagtgttctaccac

SEQ ID NO: 469580 - DNA, 16 bp, R. norvegicus
acaagttcctgaggaa

SEQ ID NO: 469581 - DNA, 16 bp, R. norvegicus
acaagttctctctctc

SEQ ID NO: 469582 - DNA, 16 bp, R. norvegicus
acaagtttgagaccag

SEQ ID NO: 469583 - DNA, 16 bp, R. norvegicus
acaataaaaatgttaa

SEQ ID NO: 469584 - DNA, 16 bp, R. norvegicus
acaataaaagacttat

SEQ ID NO: 469585 - DNA, 16 bp, R. norvegicus
acaataaacagaaagc

SEQ ID NO: 469586 - DNA, 16 bp, R. norvegicus
acaataacagcaacag

SEQ ID NO: 469587 - DNA, 16 bp, R. norvegicus
acaataacagcagcag

SEQ ID NO: 469588 - DNA, 19 bp, R. norvegicus
acaataccacagaaaacaa

SEQ ID NO: 469589 - DNA, 16 bp, R. norvegicus
acaatagaagaaatgg

SEQ ID NO: 469590 - DNA, 16 bp, R. norvegicus
acaatatcttcctaca

SEQ ID NO: 469591 - DNA, 16 bp, R. norvegicus
acaatattcataggag

SEQ ID NO: 469592 - DNA, 16 bp, R. norvegicus
acaatatttgtgtggt

SEQ ID NO: 469593 - DNA, 16 bp, R. norvegicus
acaatattttctaaat

SEQ ID NO: 469594 - DNA, 16 bp, R. norvegicus
acaatctacagattca

SEQ ID NO: 469595 - DNA, 16 bp, R. norvegicus
acaatctgaaatcact

SEQ ID NO: 469596 - DNA, 16 bp, R. norvegicus
acaatgaaaacaacag

SEQ ID NO: 469597 - DNA, 75 bp, R. norvegicus
acaatgaatatcctagtaagagcaccagtggaaggggaagccctgggtcctgctaagactgaacccccagtgaac

SEQ ID NO: 469598 - DNA, 16 bp, R. norvegicus
acaatgacaacaaaac

SEQ ID NO: 469599 - DNA, 16 bp, R. norvegicus
acaatgacgacgatga

SEQ ID NO: 469600 - DNA, 16 bp, R. norvegicus
acaatgactaagacag

SEQ ID NO: 469601 - DNA, 16 bp, R. norvegicus
acaatgactgcagcaa

SEQ ID NO: 469602 - DNA, 16 bp, R. norvegicus
acaatgacttcatcaa

SEQ ID NO: 469603 - DNA, 16 bp, R. norvegicus
acaatgacttcatgat

SEQ ID NO: 469604 - DNA, 31 bp, R. norvegicus
acaatgactttatgaaattcgtaggcaaatg

SEQ ID NO: 469605 - DNA, 16 bp, R. norvegicus
acaatgagaaaaacat

SEQ ID NO: 469606 - DNA, 16 bp, R. norvegicus
acaatgagaagttcaa

SEQ ID NO: 469607 - DNA, 16 bp, R. norvegicus
acaatgaggacccagc

SEQ ID NO: 469608 - DNA, 16 bp, R. norvegicus
acaatgattttttttt

SEQ ID NO: 469609 - DNA, 16 bp, R. norvegicus
acaatgcaaagaatca

SEQ ID NO: 469610 - DNA, 16 bp, R. norvegicus
acaatgcaatactatt

SEQ ID NO: 469611 - DNA, 16 bp, R. norvegicus
acaatgccaacaacca

SEQ ID NO: 469612 - DNA, 16 bp, R. norvegicus
acaatgccaaccaaca

SEQ ID NO: 469613 - DNA, 16 bp, R. norvegicus
acaatgccatcctctg

SEQ ID NO: 469614 - DNA, 16 bp, R. norvegicus
acaatgccatgcttcc

SEQ ID NO: 469615 - DNA, 16 bp, R. norvegicus
acaatggaagaaggaa

SEQ ID NO: 469616 - DNA, 16 bp, R. norvegicus
acaatggagaatgtga

SEQ ID NO: 469617 - DNA, 16 bp, R. norvegicus
acaatggcatcctctg

SEQ ID NO: 469618 - DNA, 16 bp, R. norvegicus
acaatggctttatgaa

SEQ ID NO: 469619 - DNA, 16 bp, R. norvegicus
acaatgggaagatcaa

SEQ ID NO: 469620 - DNA, 16 bp, R. norvegicus
acaatgtcacaaagtc

SEQ ID NO: 469621 - DNA, 16 bp, R. norvegicus
acaatgtgaggaagcc

SEQ ID NO: 469622 - DNA, 16 bp, R. norvegicus
acaatgtgggtcctgg

SEQ ID NO: 469623 - DNA, 16 bp, R. norvegicus
acaattaatgctggtt

SEQ ID NO: 469624 - DNA, 16 bp, R. norvegicus
acaattactcttatcc

SEQ ID NO: 469625 - DNA, 16 bp, R. norvegicus
acaattagaaaataca

SEQ ID NO: 469626 - DNA, 16 bp, R. norvegicus
acaattccatcccaga

SEQ ID NO: 469627 - DNA, 16 bp, R. norvegicus
acaattctcaagacaa

SEQ ID NO: 469628 - DNA, 16 bp, R. norvegicus
acaattctcctgcctc

SEQ ID NO: 469629 - DNA, 16 bp, R. norvegicus
acaattctgaataata

SEQ ID NO: 469630 - DNA, 16 bp, R. norvegicus
acaattggctgtttca

SEQ ID NO: 469631 - DNA, 16 bp, R. norvegicus
acaatttaaatgttat

SEQ ID NO: 469632 - DNA, 16 bp, R. norvegicus
acaatttaatgaaaat

SEQ ID NO: 469633 - DNA, 16 bp, R. norvegicus
acaattttctgaacag

SEQ ID NO: 469634 - DNA, 16 bp, R. norvegicus
acaattttctgaagaa

SEQ ID NO: 469635 - DNA, 16 bp, R. norvegicus
acaattttggaaagtc

SEQ ID NO: 469636 - DNA, 16 bp, R. norvegicus
acaattttgttgtttt

SEQ ID NO: 469637 - DNA, 16 bp, R. norvegicus
acaattttgttttgtt

SEQ ID NO: 469638 - DNA, 16 bp, R. norvegicus
acacaaaagaagatag

SEQ ID NO: 469639 - DNA, 16 bp, R. norvegicus
acacaaaatcctgtac

SEQ ID NO: 469640 - DNA, 16 bp, R. norvegicus
acacaaaatctttcca

SEQ ID NO: 469641 - DNA, 16 bp, R. norvegicus
acacaaaatggttgtt

SEQ ID NO: 469642 - DNA, 16 bp, R. norvegicus
acacaaacaaaactga

SEQ ID NO: 469643 - DNA, 16 bp, R. norvegicus
acacaaactgagagaa

SEQ ID NO: 469644 - DNA, 16 bp, R. norvegicus
acacaaactgagggaa

SEQ ID NO: 469645 - DNA, 16 bp, R. norvegicus
acacaaagaaactgtg

SEQ ID NO: 469646 - DNA, 16 bp, R. norvegicus
acacaaatacagacat

SEQ ID NO: 469647 - DNA, 16 bp, R. norvegicus
acacaaatacatacat

SEQ ID NO: 469648 - DNA, 16 bp, R. norvegicus
acacaaatgaaattgt

SEQ ID NO: 469649 - DNA, 16 bp, R. norvegicus
acacaaatgcacactc

SEQ ID NO: 469650 - DNA, 17 bp, R. norvegicus
acacaaatgccagcaca

SEQ ID NO: 469651 - DNA, 16 bp, R. norvegicus
acacaaattccagccc

SEQ ID NO: 469652 - DNA, 16 bp, R. norvegicus
acacaacaggctgggg

SEQ ID NO: 469653 - DNA, 16 bp, R. norvegicus
acacaaccaaacagat

SEQ ID NO: 469654 - DNA, 16 bp, R. norvegicus
acacaagagcccacag

SEQ ID NO: 469655 - DNA, 16 bp, R. norvegicus
acacaagatcttcatc

SEQ ID NO: 469656 - DNA, 16 bp, R. norvegicus
acacaagcacacagac

SEQ ID NO: 469657 - DNA, 16 bp, R. norvegicus
acacaagcatgcacat

SEQ ID NO: 469658 - DNA, 16 bp, R. norvegicus
acacaagctggagtta

SEQ ID NO: 469659 - DNA, 16 bp, R. norvegicus
acacaaggaggcaagg

SEQ ID NO: 469660 - DNA, 16 bp, R. norvegicus
acacaagtacacaagt

SEQ ID NO: 469661 - DNA, 16 bp, R. norvegicus
acacaatatacacata

SEQ ID NO: 469662 - DNA, 16 bp, R. norvegicus
acacaatcatttcatt

SEQ ID NO: 469663 - DNA, 16 bp, R. norvegicus
acacacaaaaccagct

SEQ ID NO: 469664 - DNA, 16 bp, R. norvegicus
acacacaaaatcctgt

SEQ ID NO: 469665 - DNA, 16 bp, R. norvegicus
acacacaaagacagag

SEQ ID NO: 469666 - DNA, 16 bp, R. norvegicus
acacacaaatgtaaat

SEQ ID NO: 469667 - DNA, 16 bp, R. norvegicus
acacacaaattaaaag

SEQ ID NO: 469668 - DNA, 16 bp, R. norvegicus
acacacaagagagaga

SEQ ID NO: 469669 - DNA, 16 bp, R. norvegicus
acacacacaaaatctc

SEQ ID NO: 469670 - DNA, 16 bp, R. norvegicus
acacacacaaagaata

SEQ ID NO: 469671 - DNA, 16 bp, R. norvegicus
acacacacaaagagat

SEQ ID NO: 469672 - DNA, 16 bp, R. norvegicus
acacacacaaaggcac

SEQ ID NO: 469673 - DNA, 16 bp, R. norvegicus
acacacacaatcatca

SEQ ID NO: 469674 - DNA, 16 bp, R. norvegicus
acacacacaatgacac

SEQ ID NO: 469675 - DNA, 16 bp, R. norvegicus
acacacacaatgtata

SEQ ID NO: 469676 - DNA, 16 bp, R. norvegicus
acacacacaattcttt

SEQ ID NO: 469677 - DNA, 16 bp, R. norvegicus
acacacacacaaattc

SEQ ID NO: 469678 - DNA, 16 bp, R. norvegicus
acacacacacacagat

SEQ ID NO: 469679 - DNA, 16 bp, R. norvegicus
acacacacacagacat

SEQ ID NO: 469680 - DNA, 16 bp, R. norvegicus
acacacacacaggtac

SEQ ID NO: 469681 - DNA, 16 bp, R. norvegicus
acacacacaccaggcc

SEQ ID NO: 469682 - DNA, 16 bp, R. norvegicus
acacacacacctctaa

SEQ ID NO: 469683 - DNA, 16 bp, R. norvegicus
acacacacacgcacat

SEQ ID NO: 469684 - DNA, 16 bp, R. norvegicus
acacacacacgcctct

SEQ ID NO: 469685 - DNA, 16 bp, R. norvegicus
acacacacacgtacat

SEQ ID NO: 469686 - DNA, 16 bp, R. norvegicus
acacacacacgttttc

SEQ ID NO: 469687 - DNA, 16 bp, R. norvegicus
acacacacactcttcc

SEQ ID NO: 469688 - DNA, 16 bp, R. norvegicus
acacacacactgaaat

SEQ ID NO: 469689 - DNA, 16 bp, R. norvegicus
acacacacactgaaga

SEQ ID NO: 469690 - DNA, 16 bp, R. norvegicus
acacacacactgcagc

SEQ ID NO: 469691 - DNA, 16 bp, R. norvegicus
acacacacactgggga

SEQ ID NO: 469692 - DNA, 16 bp, R. norvegicus
acacacacactttaaa

SEQ ID NO: 469693 - DNA, 16 bp, R. norvegicus
acacacacactttcaa

SEQ ID NO: 469694 - DNA, 16 bp, R. norvegicus
acacacacagaagaga

SEQ ID NO: 469695 - DNA, 16 bp, R. norvegicus
acacacacagagacag

SEQ ID NO: 469696 - DNA, 16 bp, R. norvegicus
acacacacagagagag

SEQ ID NO: 469697 - DNA, 16 bp, R. norvegicus
acacacacagaggaga

SEQ ID NO: 469698 - DNA, 16 bp, R. norvegicus
acacacacagaggagg

SEQ ID NO: 469699 - DNA, 16 bp, R. norvegicus
acacacacagagtgct

SEQ ID NO: 469700 - DNA, 16 bp, R. norvegicus
acacacacagctgcac

SEQ ID NO: 469701 - DNA, 16 bp, R. norvegicus
acacacacaggacaga

SEQ ID NO: 469702 - DNA, 16 bp, R. norvegicus
acacacacaggaggga

SEQ ID NO: 469703 - DNA, 16 bp, R. norvegicus
acacacacatccatgc

SEQ ID NO: 469704 - DNA, 16 bp, R. norvegicus
acacacacatctcaaa

SEQ ID NO: 469705 - DNA, 16 bp, R. norvegicus
acacacacatctgtgc

SEQ ID NO: 469706 - DNA, 16 bp, R. norvegicus
acacacacatgaaatt

SEQ ID NO: 469707 - DNA, 16 bp, R. norvegicus
acacacacatgcagac

SEQ ID NO: 469708 - DNA, 16 bp, R. norvegicus
acacacacatgggtac

SEQ ID NO: 469709 - DNA, 16 bp, R. norvegicus
acacacacatgtatat

SEQ ID NO: 469710 - DNA, 16 bp, R. norvegicus
acacacacattaaaga

SEQ ID NO: 469711 - DNA, 16 bp, R. norvegicus
acacacacatttatat

SEQ ID NO: 469712 - DNA, 16 bp, R. norvegicus
acacacacatttatgt

SEQ ID NO: 469713 - DNA, 16 bp, R. norvegicus
acacacaccattttaa

SEQ ID NO: 469714 - DNA, 16 bp, R. norvegicus
acacacacccatgtac

SEQ ID NO: 469715 - DNA, 16 bp, R. norvegicus
acacacacccctcagg

SEQ ID NO: 469716 - DNA, 16 bp, R. norvegicus
acacacacgcatgcac

SEQ ID NO: 469717 - DNA, 16 bp, R. norvegicus
acacacacgggagaga

SEQ ID NO: 469718 - DNA, 16 bp, R. norvegicus
acacacacgtgtgcac

SEQ ID NO: 469719 - DNA, 16 bp, R. norvegicus
acacacactcagagac

SEQ ID NO: 469720 - DNA, 16 bp, R. norvegicus
acacacacttctctct

SEQ ID NO: 469721 - DNA, 16 bp, R. norvegicus
acacacactttatttt

SEQ ID NO: 469722 - DNA, 16 bp, R. norvegicus
acacacagaaaaatga

SEQ ID NO: 469723 - DNA, 16 bp, R. norvegicus
acacacagaaaataat

SEQ ID NO: 469724 - DNA, 16 bp, R. norvegicus
acacacagaagcatgc

SEQ ID NO: 469725 - DNA, 16 bp, R. norvegicus
acacacagacacatgt

SEQ ID NO: 469726 - DNA, 16 bp, R. norvegicus
acacacagacagtgga

SEQ ID NO: 469727 - DNA, 16 bp, R. norvegicus
acacacagactcactc

SEQ ID NO: 469728 - DNA, 16 bp, R. norvegicus
acacacagagaagaga

SEQ ID NO: 469729 - DNA, 16 bp, R. norvegicus
acacacagagacagat

SEQ ID NO: 469730 - DNA, 16 bp, R. norvegicus
acacacagagagaggc

SEQ ID NO: 469731 - DNA, 16 bp, R. norvegicus
acacacagagccctgg

SEQ ID NO: 469732 - DNA, 16 bp, R. norvegicus
acacacagaggagggg

SEQ ID NO: 469733 - DNA, 16 bp, R. norvegicus
acacacagaggggaga

SEQ ID NO: 469734 - DNA, 16 bp, R. norvegicus
acacacagagtatgca

SEQ ID NO: 469735 - DNA, 16 bp, R. norvegicus
acacacagatttaaaa

SEQ ID NO: 469736 - DNA, 16 bp, R. norvegicus
acacacagattttttt

SEQ ID NO: 469737 - DNA, 16 bp, R. norvegicus
acacacagctgcacac

SEQ ID NO: 469738 - DNA, 16 bp, R. norvegicus
acacacaggacacaga

SEQ ID NO: 469739 - DNA, 16 bp, R. norvegicus
acacacaggagagaga

SEQ ID NO: 469740 - DNA, 16 bp, R. norvegicus
acacacaggcatacaa

SEQ ID NO: 469741 - DNA, 16 bp, R. norvegicus
acacacaggtgaaagg

SEQ ID NO: 469742 - DNA, 16 bp, R. norvegicus
acacacaggtgcacac

SEQ ID NO: 469743 - DNA, 16 bp, R. norvegicus
acacacagtatatata

SEQ ID NO: 469744 - DNA, 16 bp, R. norvegicus
acacacatacacacat

SEQ ID NO: 469745 - DNA, 16 bp, R. norvegicus
acacacatatatagat

SEQ ID NO: 469746 - DNA, 16 bp, R. norvegicus
acacacatatatatat

SEQ ID NO: 469747 - DNA, 16 bp, R. norvegicus
acacacatatgaaaat

SEQ ID NO: 469748 - DNA, 16 bp, R. norvegicus
acacacatcccaactc

SEQ ID NO: 469749 - DNA, 16 bp, R. norvegicus
acacacatgatacaca

SEQ ID NO: 469750 - DNA, 16 bp, R. norvegicus
acacacatgcacaata

SEQ ID NO: 469751 - DNA, 16 bp, R. norvegicus
acacacatggtacaca

SEQ ID NO: 469752 - DNA, 16 bp, R. norvegicus
acacacatggtctgca

SEQ ID NO: 469753 - DNA, 16 bp, R. norvegicus
acacacatgtaaaaat

SEQ ID NO: 469754 - DNA, 16 bp, R. norvegicus
acacacatgtgaatat

SEQ ID NO: 469755 - DNA, 16 bp, R. norvegicus
acacacatgtgcacag

SEQ ID NO: 469756 - DNA, 16 bp, R. norvegicus
acacacatgtgcgcac

SEQ ID NO: 469757 - DNA, 16 bp, R. norvegicus
acacacatgtgtacat

SEQ ID NO: 469758 - DNA, 16 bp, R. norvegicus
acacacattcaaacac

SEQ ID NO: 469759 - DNA, 16 bp, R. norvegicus
acacaccatgtacaca

SEQ ID NO: 469760 - DNA, 16 bp, R. norvegicus
acacacccacaggaac

SEQ ID NO: 469761 - DNA, 16 bp, R. norvegicus
acacacctccatgctt

SEQ ID NO: 469762 - DNA, 16 bp, R. norvegicus
acacacctgcatacac

SEQ ID NO: 469763 - DNA, 16 bp, R. norvegicus
acacacctgtgggcac

SEQ ID NO: 469764 - DNA, 16 bp, R. norvegicus
acacacgcacacacag

SEQ ID NO: 469765 - DNA, 16 bp, R. norvegicus
acacacgtacacacag

SEQ ID NO: 469766 - DNA, 16 bp, R. norvegicus
acacacgtatacatat

SEQ ID NO: 469767 - DNA, 16 bp, R. norvegicus
acacacgtgcacacac

SEQ ID NO: 469768 - DNA, 16 bp, R. norvegicus
acacacgtggtgcaca

SEQ ID NO: 469769 - DNA, 16 bp, R. norvegicus
acacactagaagaggg

SEQ ID NO: 469770 - DNA, 16 bp, R. norvegicus
acacactcacacagca

SEQ ID NO: 469771 - DNA, 16 bp, R. norvegicus
acacactcacatacac

SEQ ID NO: 469772 - DNA, 16 bp, R. norvegicus
acacactcttacacac

SEQ ID NO: 469773 - DNA, 16 bp, R. norvegicus
acacactgaacacaca

SEQ ID NO: 469774 - DNA, 16 bp, R. norvegicus
acacactgattttttt

SEQ ID NO: 469775 - DNA, 16 bp, R. norvegicus
acacactgtcctcttt

SEQ ID NO: 469776 - DNA, 16 bp, R. norvegicus
acacacttacacactc

SEQ ID NO: 469777 - DNA, 16 bp, R. norvegicus
acacagaaaagccctg

SEQ ID NO: 469778 - DNA, 16 bp, R. norvegicus
acacagaaacagagag

SEQ ID NO: 469779 - DNA, 16 bp, R. norvegicus
acacagaaatctgcct

SEQ ID NO: 469780 - DNA, 16 bp, R. norvegicus
acacagaaggggaggg

SEQ ID NO: 469781 - DNA, 16 bp, R. norvegicus
acacagaatcaacaaa

SEQ ID NO: 469782 - DNA, 17 bp, R. norvegicus
acacagacacagacaca

SEQ ID NO: 469783 - DNA, 16 bp, R. norvegicus
acacagacacagaggc

SEQ ID NO: 469784 - DNA, 16 bp, R. norvegicus
acacagacacatacag

SEQ ID NO: 469785 - DNA, 16 bp, R. norvegicus
acacagacacatggac

SEQ ID NO: 469786 - DNA, 16 bp, R. norvegicus
acacagacacattcac

SEQ ID NO: 469787 - DNA, 16 bp, R. norvegicus
acacagacacgtgcac

SEQ ID NO: 469788 - DNA, 16 bp, R. norvegicus
acacagacagacagag

SEQ ID NO: 469789 - DNA, 16 bp, R. norvegicus
acacagacagcagaca

SEQ ID NO: 469790 - DNA, 16 bp, R. norvegicus
acacagacataacctc

SEQ ID NO: 469791 - DNA, 16 bp, R. norvegicus
acacagacatgcatgc

SEQ ID NO: 469792 - DNA, 16 bp, R. norvegicus
acacagacccagacac

SEQ ID NO: 469793 - DNA, 16 bp, R. norvegicus
acacagactgaccctg

SEQ ID NO: 469794 - DNA, 16 bp, R. norvegicus
acacagagaaacccta

SEQ ID NO: 469795 - DNA, 16 bp, R. norvegicus
acacagagaaaccctc

SEQ ID NO: 469796 - DNA, 16 bp, R. norvegicus
acacagagaaactctg

SEQ ID NO: 469797 - DNA, 16 bp, R. norvegicus
acacagagaaatgctg

SEQ ID NO: 469798 - DNA, 16 bp, R. norvegicus
acacagagaagcagag

SEQ ID NO: 469799 - DNA, 16 bp, R. norvegicus
acacagagaagctctg

SEQ ID NO: 469800 - DNA, 16 bp, R. norvegicus
acacagagagaggagg

SEQ ID NO: 469801 - DNA, 16 bp, R. norvegicus
acacagagagatggag

SEQ ID NO: 469802 - DNA, 16 bp, R. norvegicus
acacagagagctgaaa

SEQ ID NO: 469803 - DNA, 16 bp, R. norvegicus
acacagagcacacaga

SEQ ID NO: 469804 - DNA, 16 bp, R. norvegicus
acacagaggaacacac

SEQ ID NO: 469805 - DNA, 16 bp, R. norvegicus
acacagaggaaccctg

SEQ ID NO: 469806 - DNA, 16 bp, R. norvegicus
acacagaggaagatgg

SEQ ID NO: 469807 - DNA, 16 bp, R. norvegicus
acacagaggacagaag

SEQ ID NO: 469808 - DNA, 16 bp, R. norvegicus
acacagaggccagaga

SEQ ID NO: 469809 - DNA, 16 bp, R. norvegicus
acacagagtcagagac

SEQ ID NO: 469810 - DNA, 16 bp, R. norvegicus
acacagagttccaggc

SEQ ID NO: 469811 - DNA, 16 bp, R. norvegicus
acacagatacacactc

SEQ ID NO: 469812 - DNA, 16 bp, R. norvegicus
acacagatagagagac

SEQ ID NO: 469813 - DNA, 16 bp, R. norvegicus
acacagatgcacactc

SEQ ID NO: 469814 - DNA, 16 bp, R. norvegicus
acacagcaaatacaga

SEQ ID NO: 469815 - DNA, 18 bp, R. norvegicus
acacagcaatggtgcctt

SEQ ID NO: 469816 - DNA, 16 bp, R. norvegicus
acacagcagaagagag

SEQ ID NO: 469817 - DNA, 16 bp, R. norvegicus
acacagcagaagaggg

SEQ ID NO: 469818 - DNA, 16 bp, R. norvegicus
acacagcagagtccag

SEQ ID NO: 469819 - DNA, 16 bp, R. norvegicus
acacagcagcctctcc

SEQ ID NO: 469820 - DNA, 16 bp, R. norvegicus
acacagcaggaagaga

SEQ ID NO: 469821 - DNA, 16 bp, R. norvegicus
acacagcagtgagaac

SEQ ID NO: 469822 - DNA, 16 bp, R. norvegicus
acacagcatacacaca

SEQ ID NO: 469823 - DNA, 17 bp, R. norvegicus
acacagccacactgtac

SEQ ID NO: 469824 - DNA, 16 bp, R. norvegicus
acacagccagttccag

SEQ ID NO: 469825 - DNA, 16 bp, R. norvegicus
acacagccatcaaaga

SEQ ID NO: 469826 - DNA, 16 bp, R. norvegicus
acacagccatccctta

SEQ ID NO: 469827 - DNA, 16 bp, R. norvegicus
acacagcccagctgca

SEQ ID NO: 469828 - DNA, 16 bp, R. norvegicus
acacagccccacagga

SEQ ID NO: 469829 - DNA, 16 bp, R. norvegicus
acacaggaaaatacaa

SEQ ID NO: 469830 - DNA, 16 bp, R. norvegicus
acacaggaaattatag

SEQ ID NO: 469831 - DNA, 16 bp, R. norvegicus
acacaggagacagaag

SEQ ID NO: 469832 - DNA, 16 bp, R. norvegicus
acacaggagcagtctg

SEQ ID NO: 469833 - DNA, 16 bp, R. norvegicus
acacaggattcagttc

SEQ ID NO: 469834 - DNA, 16 bp, R. norvegicus
acacaggcacaggcac

SEQ ID NO: 469835 - DNA, 16 bp, R. norvegicus
acacaggcttgcagga

SEQ ID NO: 469836 - DNA, 16 bp, R. norvegicus
acacagggcaacaaca

SEQ ID NO: 469837 - DNA, 16 bp, R. norvegicus
acacaggtcttcctgg

SEQ ID NO: 469838 - DNA, 16 bp, R. norvegicus
acacagtgagaccttg

SEQ ID NO: 469839 - DNA, 16 bp, R. norvegicus
acacagtgagactttg

SEQ ID NO: 469840 - DNA, 16 bp, R. norvegicus
acacagtgagatccag

SEQ ID NO: 469841 - DNA, 16 bp, R. norvegicus
acacagtgagatcctg

SEQ ID NO: 469842 - DNA, 16 bp, R. norvegicus
acacagtgagcacaca

SEQ ID NO: 469843 - DNA, 16 bp, R. norvegicus
acacagtgaggccctg

SEQ ID NO: 469844 - DNA, 16 bp, R. norvegicus
acacagtgcacagaca

SEQ ID NO: 469845 - DNA, 16 bp, R. norvegicus
acacagtgcctctgga

SEQ ID NO: 469846 - DNA, 16 bp, R. norvegicus
acacagtgctggagaa

SEQ ID NO: 469847 - DNA, 16 bp, R. norvegicus
acacagtggcacatgc

SEQ ID NO: 469848 - DNA, 16 bp, R. norvegicus
acacagtttttaaaag

SEQ ID NO: 469849 - DNA, 16 bp, R. norvegicus
acacataaatgcacat

SEQ ID NO: 469850 - DNA, 16 bp, R. norvegicus
acacatacacaatgaa

SEQ ID NO: 469851 - DNA, 16 bp, R. norvegicus
acacatacacacacat

SEQ ID NO: 469852 - DNA, 16 bp, R. norvegicus
acacatacacactcat

SEQ ID NO: 469853 - DNA, 16 bp, R. norvegicus
acacatacacagaaga

SEQ ID NO: 469854 - DNA, 16 bp, R. norvegicus
acacatacacatctat

SEQ ID NO: 469855 - DNA, 16 bp, R. norvegicus
acacatacatacactg

SEQ ID NO: 469856 - DNA, 16 bp, R. norvegicus
acacatacatatgcac

SEQ ID NO: 469857 - DNA, 16 bp, R. norvegicus
acacatacatatttat

SEQ ID NO: 469858 - DNA, 16 bp, R. norvegicus
acacataggcacagag

SEQ ID NO: 469859 - DNA, 16 bp, R. norvegicus
acacatatacacatat

SEQ ID NO: 469860 - DNA, 16 bp, R. norvegicus
acacatatacatcata

SEQ ID NO: 469861 - DNA, 16 bp, R. norvegicus
acacatatactctctc

SEQ ID NO: 469862 - DNA, 16 bp, R. norvegicus
acacatatatacatat

SEQ ID NO: 469863 - DNA, 16 bp, R. norvegicus
acacatatatacattt

SEQ ID NO: 469864 - DNA, 16 bp, R. norvegicus
acacatatatttgcat

SEQ ID NO: 469865 - DNA, 16 bp, R. norvegicus
acacatatgcataaat

SEQ ID NO: 469866 - DNA, 16 bp, R. norvegicus
acacatatggtatata

SEQ ID NO: 469867 - DNA, 16 bp, R. norvegicus
acacatattcatgcat

SEQ ID NO: 469868 - DNA, 16 bp, R. norvegicus
acacatcaaaattatc

SEQ ID NO: 469869 - DNA, 16 bp, R. norvegicus
acacatccacagacac

SEQ ID NO: 469870 - DNA, 16 bp, R. norvegicus
acacatccagagcacg

SEQ ID NO: 469871 - DNA, 16 bp, R. norvegicus
acacatctcagagaca

SEQ ID NO: 469872 - DNA, 16 bp, R. norvegicus
acacatctctctcaca

SEQ ID NO: 469873 - DNA, 16 bp, R. norvegicus
acacatctgtgcacac

SEQ ID NO: 469874 - DNA, 16 bp, R. norvegicus
acacatgaaggaatgt

SEQ ID NO: 469875 - DNA, 16 bp, R. norvegicus
acacatgagcatgcac

SEQ ID NO: 469876 - DNA, 16 bp, R. norvegicus
acacatgcacacaagc

SEQ ID NO: 469877 - DNA, 16 bp, R. norvegicus
acacatgcacacacat

SEQ ID NO: 469878 - DNA, 16 bp, R. norvegicus
acacatgcacctgcac

SEQ ID NO: 469879 - DNA, 16 bp, R. norvegicus
acacatgcacgcacat

SEQ ID NO: 469880 - DNA, 16 bp, R. norvegicus
acacatgcagacatat

SEQ ID NO: 469881 - DNA, 16 bp, R. norvegicus
acacatgcatacacaa

SEQ ID NO: 469882 - DNA, 16 bp, R. norvegicus
acacatgcatgcaagc

SEQ ID NO: 469883 - DNA, 16 bp, R. norvegicus
acacatgcccacagga

SEQ ID NO: 469884 - DNA, 16 bp, R. norvegicus
acacatgctctactgt

SEQ ID NO: 469885 - DNA, 16 bp, R. norvegicus
acacatggaaactgaa

SEQ ID NO: 469886 - DNA, 16 bp, R. norvegicus
acacatggaaggaccc

SEQ ID NO: 469887 - DNA, 16 bp, R. norvegicus
acacatggaccgaccc

SEQ ID NO: 469888 - DNA, 16 bp, R. norvegicus
acacatgggcacagag

SEQ ID NO: 469889 - DNA, 16 bp, R. norvegicus
acacatgggcacagga

SEQ ID NO: 469890 - DNA, 16 bp, R. norvegicus
acacatgggctggaga

SEQ ID NO: 469891 - DNA, 17 bp, R. norvegicus
acacatggtggctcaca

SEQ ID NO: 469892 - DNA, 16 bp, R. norvegicus
acacatgtaaacaagt

SEQ ID NO: 469893 - DNA, 16 bp, R. norvegicus
acacatgtatataaat

SEQ ID NO: 469894 - DNA, 16 bp, R. norvegicus
acacatgtcacacaca

SEQ ID NO: 469895 - DNA, 16 bp, R. norvegicus
acacatgtgacccata

SEQ ID NO: 469896 - DNA, 16 bp, R. norvegicus
acacatgtgatacaca

SEQ ID NO: 469897 - DNA, 16 bp, R. norvegicus
acacatgtgcatacat

SEQ ID NO: 469898 - DNA, 16 bp, R. norvegicus
acacatgtggttcaca

SEQ ID NO: 469899 - DNA, 16 bp, R. norvegicus
acacatgtgtatgtgt

SEQ ID NO: 469900 - DNA, 16 bp, R. norvegicus
acacattgggaaaaga

SEQ ID NO: 469901 - DNA, 16 bp, R. norvegicus
acacatttctttctct

SEQ ID NO: 469902 - DNA, 16 bp, R. norvegicus
acaccaaaatgatcat

SEQ ID NO: 469903 - DNA, 16 bp, R. norvegicus
acaccaagccttctcc

SEQ ID NO: 469904 - DNA, 16 bp, R. norvegicus
acaccacaggtgacat

SEQ ID NO: 469905 - DNA, 17 bp, R. norvegicus
acaccaccagaacctga

SEQ ID NO: 469906 - DNA, 16 bp, R. norvegicus
acaccagaagaacatg

SEQ ID NO: 469907 - DNA, 16 bp, R. norvegicus
acaccagaagagagca

SEQ ID NO: 469908 - DNA, 16 bp, R. norvegicus
acaccagaagagggca

SEQ ID NO: 469909 - DNA, 16 bp, R. norvegicus
acaccagaaggaggca

SEQ ID NO: 469910 - DNA, 16 bp, R. norvegicus
acaccagaattctcac

SEQ ID NO: 469911 - DNA, 16 bp, R. norvegicus
acaccagagaagcaag

SEQ ID NO: 469912 - DNA, 16 bp, R. norvegicus
acaccagagacaactc

SEQ ID NO: 469913 - DNA, 16 bp, R. norvegicus
acaccagcaccagcac

SEQ ID NO: 469914 - DNA, 16 bp, R. norvegicus
acaccagctgctcttc

SEQ ID NO: 469915 - DNA, 16 bp, R. norvegicus
acaccagctgggaaca

SEQ ID NO: 469916 - DNA, 16 bp, R. norvegicus
acaccaggagaacaaa

SEQ ID NO: 469917 - DNA, 16 bp, R. norvegicus
acaccagtgtctgctg

SEQ ID NO: 469918 - DNA, 16 bp, R. norvegicus
acaccatgaccaaggc

SEQ ID NO: 469919 - DNA, 16 bp, R. norvegicus
acaccattctgggcta

SEQ ID NO: 469920 - DNA, 16 bp, R. norvegicus
acacccaaaggatgct

SEQ ID NO: 469921 - DNA, 16 bp, R. norvegicus
acacccaagtggagta

SEQ ID NO: 469922 - DNA, 16 bp, R. norvegicus
acacccacagggcagc

SEQ ID NO: 469923 - DNA, 16 bp, R. norvegicus
acacccacagtcaaac

SEQ ID NO: 469924 - DNA, 16 bp, R. norvegicus
acacccacagtgacag

SEQ ID NO: 469925 - DNA, 16 bp, R. norvegicus
acacccacagtgccac

SEQ ID NO: 469926 - DNA, 16 bp, R. norvegicus
acacccacatagcagc

SEQ ID NO: 469927 - DNA, 16 bp, R. norvegicus
acacccactccaacat

SEQ ID NO: 469928 - DNA, 16 bp, R. norvegicus
acacccaggaagcaga

SEQ ID NO: 469929 - DNA, 16 bp, R. norvegicus
acacccaggactttgt

SEQ ID NO: 469930 - DNA, 16 bp, R. norvegicus
acacccaggaggagtg

SEQ ID NO: 469931 - DNA, 16 bp, R. norvegicus
acacccatacagaagg

SEQ ID NO: 469932 - DNA, 17 bp, R. norvegicus
acacccatcaggaaggg

SEQ ID NO: 469933 - DNA, 18 bp, R. norvegicus
acacccattcagatcctg

SEQ ID NO: 469934 - DNA, 16 bp, R. norvegicus
acacccattcaggacc

SEQ ID NO: 469935 - DNA, 16 bp, R. norvegicus
acaccctcacagacat

SEQ ID NO: 469936 - DNA, 16 bp, R. norvegicus
acaccctcattccact

SEQ ID NO: 469937 - DNA, 16 bp, R. norvegicus
acaccgtgtgtgtgtg

SEQ ID NO: 469938 - DNA, 16 bp, R. norvegicus
acacctaaaaggtcta

SEQ ID NO: 469939 - DNA, 16 bp, R. norvegicus
acacctactccaacaa

SEQ ID NO: 469940 - DNA, 16 bp, R. norvegicus
acacctataatcccag

SEQ ID NO: 469941 - DNA, 16 bp, R. norvegicus
acacctatggacattt

SEQ ID NO: 469942 - DNA, 16 bp, R. norvegicus
acacctcacagacaca

SEQ ID NO: 469943 - DNA, 16 bp, R. norvegicus
acacctcagagaaaaa

SEQ ID NO: 469944 - DNA, 16 bp, R. norvegicus
acacctcagagagaaa

SEQ ID NO: 469945 - DNA, 16 bp, R. norvegicus
acacctccagagccag

SEQ ID NO: 469946 - DNA, 16 bp, R. norvegicus
acacctcctaacagtg

SEQ ID NO: 469947 - DNA, 16 bp, R. norvegicus
acacctcctaatagcg

SEQ ID NO: 469948 - DNA, 16 bp, R. norvegicus
acacctctgatcccag

SEQ ID NO: 469949 - DNA, 17 bp, R. norvegicus
acacctgccagagacac

SEQ ID NO: 469950 - DNA, 16 bp, R. norvegicus
acacctgctccaacaa

SEQ ID NO: 469951 - DNA, 16 bp, R. norvegicus
acacctgctgctgcac

SEQ ID NO: 469952 - DNA, 16 bp, R. norvegicus
acacctgtcagaatgg

SEQ ID NO: 469953 - DNA, 16 bp, R. norvegicus
acacctgtggtcactt

SEQ ID NO: 469954 - DNA, 16 bp, R. norvegicus
acacctgtggtcccag

SEQ ID NO: 469955 - DNA, 16 bp, R. norvegicus
acaccttcaacaaagt

SEQ ID NO: 469956 - DNA, 16 bp, R. norvegicus
acaccttcaactcctt

SEQ ID NO: 469957 - DNA, 16 bp, R. norvegicus
acaccttcatagaaga

SEQ ID NO: 469958 - DNA, 16 bp, R. norvegicus
acaccttgatccaaag

SEQ ID NO: 469959 - DNA, 16 bp, R. norvegicus
acaccttttatcccag

SEQ ID NO: 469960 - DNA, 32 bp, R. norvegicus
acacgatccacatatggtttcagaacagaaga

SEQ ID NO: 469961 - DNA, 16 bp, R. norvegicus
acacgcacacacacct

SEQ ID NO: 469962 - DNA, 16 bp, R. norvegicus
acacggagagagagag

SEQ ID NO: 469963 - DNA, 16 bp, R. norvegicus
acacggtaccgagaat

SEQ ID NO: 469964 - DNA, 16 bp, R. norvegicus
acacgtgcacacacat

SEQ ID NO: 469965 - DNA, 16 bp, R. norvegicus
acacgtgtgcatacat

SEQ ID NO: 469966 - DNA, 16 bp, R. norvegicus
acactaaagaaatcac

SEQ ID NO: 469967 - DNA, 16 bp, R. norvegicus
acactaagcagaaaac

SEQ ID NO: 469968 - DNA, 16 bp, R. norvegicus
acactaagccaccaac

SEQ ID NO: 469969 - DNA, 16 bp, R. norvegicus
acactacaaagaaaga

SEQ ID NO: 469970 - DNA, 16 bp, R. norvegicus
acactacctcagaggg

SEQ ID NO: 469971 - DNA, 16 bp, R. norvegicus
acactacctgaggacc

SEQ ID NO: 469972 - DNA, 16 bp, R. norvegicus
acactatctgaaccta

SEQ ID NO: 469973 - DNA, 16 bp, R. norvegicus
acactcacacacacct

SEQ ID NO: 469974 - DNA, 16 bp, R. norvegicus
acactcacacacactc

SEQ ID NO: 469975 - DNA, 16 bp, R. norvegicus
acactcacacactctt

SEQ ID NO: 469976 - DNA, 16 bp, R. norvegicus
acactcacattctctc

SEQ ID NO: 469977 - DNA, 16 bp, R. norvegicus
acactcagaagtgcag

SEQ ID NO: 469978 - DNA, 16 bp, R. norvegicus
acactcagagacacac

SEQ ID NO: 469979 - DNA, 16 bp, R. norvegicus
acactcagccaccaca

SEQ ID NO: 469980 - DNA, 16 bp, R. norvegicus
acactcatagacacac

SEQ ID NO: 469981 - DNA, 16 bp, R. norvegicus
acactcatatacacac

SEQ ID NO: 469982 - DNA, 16 bp, R. norvegicus
acactccaactgcctc

SEQ ID NO: 469983 - DNA, 16 bp, R. norvegicus
acactccagattttat

SEQ ID NO: 469984 - DNA, 16 bp, R. norvegicus
acactcctccactttt

SEQ ID NO: 469985 - DNA, 16 bp, R. norvegicus
acactcctggcccaag

SEQ ID NO: 469986 - DNA, 16 bp, R. norvegicus
acactctctgtgacct

SEQ ID NO: 469987 - DNA, 16 bp, R. norvegicus
acactctctgtgccct

SEQ ID NO: 469988 - DNA, 16 bp, R. norvegicus
acactctcttctggct

SEQ ID NO: 469989 - DNA, 48 bp, R. norvegicus
acactctgattggtatacttgtcccggaggtaagaggacacgggagtg

SEQ ID NO: 469990 - DNA, 16 bp, R. norvegicus
acactctgttcccata

SEQ ID NO: 469991 - DNA, 16 bp, R. norvegicus
acactgaatctaaaag

SEQ ID NO: 469992 - DNA, 16 bp, R. norvegicus
acactgaccttgaact

SEQ ID NO: 469993 - DNA, 16 bp, R. norvegicus
acactgcacacactgc

SEQ ID NO: 469994 - DNA, 16 bp, R. norvegicus
acactgcacacccctg

SEQ ID NO: 469995 - DNA, 16 bp, R. norvegicus
acactgcagcagaagc

SEQ ID NO: 469996 - DNA, 16 bp, R. norvegicus
acactgccaaactcat

SEQ ID NO: 469997 - DNA, 16 bp, R. norvegicus
acactgctcttgcaga

SEQ ID NO: 469998 - DNA, 16 bp, R. norvegicus
acactgctgacatcac

SEQ ID NO: 469999 - DNA, 16 bp, R. norvegicus
acactggaaggtcatg

SEQ ID NO: 470000 - DNA, 16 bp, R. norvegicus
acactggacaatacca

SEQ ID NO: 470001 - DNA, 16 bp, R. norvegicus
acactggagagatggc

SEQ ID NO: 470002 - DNA, 16 bp, R. norvegicus
acactggagagcctct

SEQ ID NO: 470003 - DNA, 16 bp, R. norvegicus
acactggagaggctga

SEQ ID NO: 470004 - DNA, 16 bp, R. norvegicus
acactggaggcagagg

SEQ ID NO: 470005 - DNA, 16 bp, R. norvegicus
acactggatcaccagc

SEQ ID NO: 470006 - DNA, 16 bp, R. norvegicus
acactggcagcactcc

SEQ ID NO: 470007 - DNA, 16 bp, R. norvegicus
acactggcttccaggc

SEQ ID NO: 470008 - DNA, 16 bp, R. norvegicus
acactgggcagaactt

SEQ ID NO: 470009 - DNA, 16 bp, R. norvegicus
acactgggccgccatg

SEQ ID NO: 470010 - DNA, 16 bp, R. norvegicus
acactggggaaaaaaa

SEQ ID NO: 470011 - DNA, 16 bp, R. norvegicus
acactgggggaaaaaa

SEQ ID NO: 470012 - DNA, 16 bp, R. norvegicus
acactgggggtggggt

SEQ ID NO: 470013 - DNA, 16 bp, R. norvegicus
acactggggtccagcc

SEQ ID NO: 470014 - DNA, 16 bp, R. norvegicus
acactggtcaaagaaa

SEQ ID NO: 470015 - DNA, 16 bp, R. norvegicus
acactgtactggctgg

SEQ ID NO: 470016 - DNA, 20 bp, R. norvegicus
acactgtagctgtcttcaga

SEQ ID NO: 470017 - DNA, 16 bp, R. norvegicus
acactgtcctcagaag

SEQ ID NO: 470018 - DNA, 16 bp, R. norvegicus
acactgtctcaacaaa

SEQ ID NO: 470019 - DNA, 16 bp, R. norvegicus
acactgtgggacacac

SEQ ID NO: 470020 - DNA, 16 bp, R. norvegicus
acactgtgtgtgtgtg

SEQ ID NO: 470021 - DNA, 16 bp, R. norvegicus
acacttcatagtcatc

SEQ ID NO: 470022 - DNA, 16 bp, R. norvegicus
acacttcctgttttta

SEQ ID NO: 470023 - DNA, 16 bp, R. norvegicus
acacttgaaactcaag

SEQ ID NO: 470024 - DNA, 16 bp, R. norvegicus
acacttggtattcact

SEQ ID NO: 470025 - DNA, 16 bp, R. norvegicus
acacttgtagtcccag

SEQ ID NO: 470026 - DNA, 16 bp, R. norvegicus
acacttgtgagctgcc

SEQ ID NO: 470027 - DNA, 16 bp, R. norvegicus
acacttgttgctcttc

SEQ ID NO: 470028 - DNA, 16 bp, R. norvegicus
acactttcatcaatgg

SEQ ID NO: 470029 - DNA, 16 bp, R. norvegicus
acactttctcaactat

SEQ ID NO: 470030 - DNA, 16 bp, R. norvegicus
acactttctccaacaa

SEQ ID NO: 470031 - DNA, 16 bp, R. norvegicus
acactttcttcaacaa

SEQ ID NO: 470032 - DNA, 16 bp, R. norvegicus
acactttgctgaagtt

SEQ ID NO: 470033 - DNA, 16 bp, R. norvegicus
acactttggtcttact

SEQ ID NO: 470034 - DNA, 16 bp, R. norvegicus
acactttgttcccata

SEQ ID NO: 470035 - DNA, 16 bp, R. norvegicus
acacttttaatcccag

SEQ ID NO: 470036 - DNA, 16 bp, R. norvegicus
acagaaaaaaaatttt

SEQ ID NO: 470037 - DNA, 16 bp, R. norvegicus
acagaaaaaaatattt

SEQ ID NO: 470038 - DNA, 16 bp, R. norvegicus
acagaaaaacacatat

SEQ ID NO: 470039 - DNA, 16 bp, R. norvegicus
acagaaaaacacattt

SEQ ID NO: 470040 - DNA, 16 bp, R. norvegicus
acagaaaaacagttct

SEQ ID NO: 470041 - DNA, 16 bp, R. norvegicus
acagaaaaaccctgac

SEQ ID NO: 470042 - DNA, 16 bp, R. norvegicus
acagaaaaagcatttg

SEQ ID NO: 470043 - DNA, 16 bp, R. norvegicus
acagaaaaccacagct

SEQ ID NO: 470044 - DNA, 16 bp, R. norvegicus
acagaaaacccaagat

SEQ ID NO: 470045 - DNA, 16 bp, R. norvegicus
acagaaaacccaggat

SEQ ID NO: 470046 - DNA, 16 bp, R. norvegicus
acagaaaactgaagca

SEQ ID NO: 470047 - DNA, 16 bp, R. norvegicus
acagaaaatatggttt

SEQ ID NO: 470048 - DNA, 16 bp, R. norvegicus
acagaaaatccaggat

SEQ ID NO: 470049 - DNA, 16 bp, R. norvegicus
acagaaaatggactaa

SEQ ID NO: 470050 - DNA, 16 bp, R. norvegicus
acagaaaatttaaaat

SEQ ID NO: 470051 - DNA, 16 bp, R. norvegicus
acagaaaccaacagat

SEQ ID NO: 470052 - DNA, 16 bp, R. norvegicus
acagaaactctgtctc

SEQ ID NO: 470053 - DNA, 16 bp, R. norvegicus
acagaaactgaggcag

SEQ ID NO: 470054 - DNA, 16 bp, R. norvegicus
acagaaagaacattgc

SEQ ID NO: 470055 - DNA, 16 bp, R. norvegicus
acagaaagagaaatat

SEQ ID NO: 470056 - DNA, 16 bp, R. norvegicus
acagaaagatctccca

SEQ ID NO: 470057 - DNA, 16 bp, R. norvegicus
acagaaagcagccaca

SEQ ID NO: 470058 - DNA, 16 bp, R. norvegicus
acagaaagccattgaa

SEQ ID NO: 470059 - DNA, 16 bp, R. norvegicus
acagaaagctgtggca

SEQ ID NO: 470060 - DNA, 16 bp, R. norvegicus
acagaaaggagaaaat

SEQ ID NO: 470061 - DNA, 16 bp, R. norvegicus
acagaaaggcagagac

SEQ ID NO: 470062 - DNA, 16 bp, R. norvegicus
acagaaataattttct

SEQ ID NO: 470063 - DNA, 16 bp, R. norvegicus
acagaaatacatacat

SEQ ID NO: 470064 - DNA, 16 bp, R. norvegicus
acagaaatagaagcag

SEQ ID NO: 470065 - DNA, 16 bp, R. norvegicus
acagaaatcttaaaaa

SEQ ID NO: 470066 - DNA, 16 bp, R. norvegicus
acagaaatggaagaaa

SEQ ID NO: 470067 - DNA, 16 bp, R. norvegicus
acagaaatggagacag

SEQ ID NO: 470068 - DNA, 16 bp, R. norvegicus
acagaaattaagaaat

SEQ ID NO: 470069 - DNA, 16 bp, R. norvegicus
acagaaattcatcaac

SEQ ID NO: 470070 - DNA, 16 bp, R. norvegicus
acagaaatttattttt

SEQ ID NO: 470071 - DNA, 16 bp, R. norvegicus
acagaacacatgtaac

SEQ ID NO: 470072 - DNA, 16 bp, R. norvegicus
acagaacagacctggg

SEQ ID NO: 470073 - DNA, 16 bp, R. norvegicus
acagaacattctagaa

SEQ ID NO: 470074 - DNA, 16 bp, R. norvegicus
acagaaccaactccca

SEQ ID NO: 470075 - DNA, 16 bp, R. norvegicus
acagaaccatcaaaga

SEQ ID NO: 470076 - DNA, 16 bp, R. norvegicus
acagaaccatctggaa

SEQ ID NO: 470077 - DNA, 16 bp, R. norvegicus
acagaacccaaagttg

SEQ ID NO: 470078 - DNA, 16 bp, R. norvegicus
acagaacccaagacta

SEQ ID NO: 470079 - DNA, 16 bp, R. norvegicus
acagaaccttccagaa

SEQ ID NO: 470080 - DNA, 16 bp, R. norvegicus
acagaacgaggcctgt

SEQ ID NO: 470081 - DNA, 16 bp, R. norvegicus
acagaactgtgctgtt

SEQ ID NO: 470082 - DNA, 16 bp, R. norvegicus
acagaactttctccaa

SEQ ID NO: 470083 - DNA, 16 bp, R. norvegicus
acagaactttctggaa

SEQ ID NO: 470084 - DNA, 16 bp, R. norvegicus
acagaagaaaaagagt

SEQ ID NO: 470085 - DNA, 16 bp, R. norvegicus
acagaagaaaacattt

SEQ ID NO: 470086 - DNA, 16 bp, R. norvegicus
acagaagaaaatgaag

SEQ ID NO: 470087 - DNA, 16 bp, R. norvegicus
acagaagaaaatgttt

SEQ ID NO: 470088 - DNA, 16 bp, R. norvegicus
acagaagaaacactgc

SEQ ID NO: 470089 - DNA, 16 bp, R. norvegicus
acagaagaaacattgc

SEQ ID NO: 470090 - DNA, 16 bp, R. norvegicus
acagaagaaagaattt

SEQ ID NO: 470091 - DNA, 16 bp, R. norvegicus
acagaagaaattgata

SEQ ID NO: 470092 - DNA, 16 bp, R. norvegicus
acagaagaagcaagtt

SEQ ID NO: 470093 - DNA, 16 bp, R. norvegicus
acagaagacctgagtt

SEQ ID NO: 470094 - DNA, 16 bp, R. norvegicus
acagaagactgacttc

SEQ ID NO: 470095 - DNA, 16 bp, R. norvegicus
acagaagagaagccca

SEQ ID NO: 470096 - DNA, 16 bp, R. norvegicus
acagaagagactgctc

SEQ ID NO: 470097 - DNA, 16 bp, R. norvegicus
acagaagataaaatat

SEQ ID NO: 470098 - DNA, 16 bp, R. norvegicus
acagaagatcagctga

SEQ ID NO: 470099 - DNA, 16 bp, R. norvegicus
acagaagattctagtg

SEQ ID NO: 470100 - DNA, 16 bp, R. norvegicus
acagaagcagagagag

SEQ ID NO: 470101 - DNA, 16 bp, R. norvegicus
acagaagcagaggcag

SEQ ID NO: 470102 - DNA, 16 bp, R. norvegicus
acagaagcagaggcca

SEQ ID NO: 470103 - DNA, 16 bp, R. norvegicus
acagaagcagagggag

SEQ ID NO: 470104 - DNA, 16 bp, R. norvegicus
acagaagcagcaagaa

SEQ ID NO: 470105 - DNA, 16 bp, R. norvegicus
acagaagcagcagcag

SEQ ID NO: 470106 - DNA, 16 bp, R. norvegicus
acagaagcaggcaaaa

SEQ ID NO: 470107 - DNA, 16 bp, R. norvegicus
acagaagccaagagag

SEQ ID NO: 470108 - DNA, 16 bp, R. norvegicus
acagaagccagagacc

SEQ ID NO: 470109 - DNA, 16 bp, R. norvegicus
acagaagccagagatc

SEQ ID NO: 470110 - DNA, 16 bp, R. norvegicus
acagaagccagaggag

SEQ ID NO: 470111 - DNA, 16 bp, R. norvegicus
acagaagcccagctga

SEQ ID NO: 470112 - DNA, 16 bp, R. norvegicus
acagaagctcttcagt

SEQ ID NO: 470113 - DNA, 16 bp, R. norvegicus
acagaagctgctgaac

SEQ ID NO: 470114 - DNA, 16 bp, R. norvegicus
acagaagctgctgacc

SEQ ID NO: 470115 - DNA, 16 bp, R. norvegicus
acagaagctgctgagc

SEQ ID NO: 470116 - DNA, 16 bp, R. norvegicus
acagaagctttccagt

SEQ ID NO: 470117 - DNA, 16 bp, R. norvegicus
acagaagctttgcaga

SEQ ID NO: 470118 - DNA, 16 bp, R. norvegicus
acagaaggcactagaa

SEQ ID NO: 470119 - DNA, 16 bp, R. norvegicus
acagaaggcagaggga

SEQ ID NO: 470120 - DNA, 16 bp, R. norvegicus
acagaaggttgtgagt

SEQ ID NO: 470121 - DNA, 16 bp, R. norvegicus
acagaagtcagaagaa

SEQ ID NO: 470122 - DNA, 16 bp, R. norvegicus
acagaatatctttcca

SEQ ID NO: 470123 - DNA, 16 bp, R. norvegicus
acagaatatttaaaat

SEQ ID NO: 470124 - DNA, 16 bp, R. norvegicus
acagaatcaagaaaat

SEQ ID NO: 470125 - DNA, 16 bp, R. norvegicus
acagaatcacatgatc

SEQ ID NO: 470126 - DNA, 16 bp, R. norvegicus
acagaatgaatgcaaa

SEQ ID NO: 470127 - DNA, 16 bp, R. norvegicus
acagaatgagactgtg

SEQ ID NO: 470128 - DNA, 16 bp, R. norvegicus
acagaatgagaggaaa

SEQ ID NO: 470129 - DNA, 16 bp, R. norvegicus
acagaatgagtcagag

SEQ ID NO: 470130 - DNA, 16 bp, R. norvegicus
acagaatgagttcctg

SEQ ID NO: 470131 - DNA, 16 bp, R. norvegicus
acagaatgggaaaaat

SEQ ID NO: 470132 - DNA, 16 bp, R. norvegicus
acagaatgggaaaaga

SEQ ID NO: 470133 - DNA, 16 bp, R. norvegicus
acagaatgggagaaaa

SEQ ID NO: 470134 - DNA, 16 bp, R. norvegicus
acagaatgttccagaa

SEQ ID NO: 470135 - DNA, 16 bp, R. norvegicus
acagaattaatatagt

SEQ ID NO: 470136 - DNA, 16 bp, R. norvegicus
acagaattacagttat

SEQ ID NO: 470137 - DNA, 16 bp, R. norvegicus
acagaattcaagaagg

SEQ ID NO: 470138 - DNA, 16 bp, R. norvegicus
acagaattctcaacaa

SEQ ID NO: 470139 - DNA, 16 bp, R. norvegicus
acagacaaagacagag

SEQ ID NO: 470140 - DNA, 16 bp, R. norvegicus
acagacaagcacacag

SEQ ID NO: 470141 - DNA, 16 bp, R. norvegicus
acagacacacacacag

SEQ ID NO: 470142 - DNA, 16 bp, R. norvegicus
acagacacacacccag

SEQ ID NO: 470143 - DNA, 16 bp, R. norvegicus
acagacacacagatgc

SEQ ID NO: 470144 - DNA, 17 bp, R. norvegicus
acagacacagacacaga

SEQ ID NO: 470145 - DNA, 16 bp, R. norvegicus
acagacacagagacag

SEQ ID NO: 470146 - DNA, 16 bp, R. norvegicus
acagacacagatacag

SEQ ID NO: 470147 - DNA, 16 bp, R. norvegicus
acagacacaggagaga

SEQ ID NO: 470148 - DNA, 16 bp, R. norvegicus
acagacacaggaggaa

SEQ ID NO: 470149 - DNA, 16 bp, R. norvegicus
acagacacaggcaggt

SEQ ID NO: 470150 - DNA, 16 bp, R. norvegicus
acagacacatggtgtt

SEQ ID NO: 470151 - DNA, 16 bp, R. norvegicus
acagacaccatgacca

SEQ ID NO: 470152 - DNA, 16 bp, R. norvegicus
acagacacccagacac

SEQ ID NO: 470153 - DNA, 16 bp, R. norvegicus
acagacacgacctcag

SEQ ID NO: 470154 - DNA, 16 bp, R. norvegicus
acagacactaaaccca

SEQ ID NO: 470155 - DNA, 16 bp, R. norvegicus
acagacactaccttag

SEQ ID NO: 470156 - DNA, 16 bp, R. norvegicus
acagacactgaaggaa

SEQ ID NO: 470157 - DNA, 16 bp, R. norvegicus
acagacagaaactgga

SEQ ID NO: 470158 - DNA, 16 bp, R. norvegicus
acagacagacaagaga

SEQ ID NO: 470159 - DNA, 16 bp, R. norvegicus
acagacagacagatca

SEQ ID NO: 470160 - DNA, 16 bp, R. norvegicus
acagacagacatgcat

SEQ ID NO: 470161 - DNA, 16 bp, R. norvegicus
acagacagacatggag

SEQ ID NO: 470162 - DNA, 16 bp, R. norvegicus
acagacagagacatgg

SEQ ID NO: 470163 - DNA, 16 bp, R. norvegicus
acagacagagaggcag

SEQ ID NO: 470164 - DNA, 16 bp, R. norvegicus
acagacagaggagaga

SEQ ID NO: 470165 - DNA, 16 bp, R. norvegicus
acagacagatacagag

SEQ ID NO: 470166 - DNA, 16 bp, R. norvegicus
acagacagctcccctg

SEQ ID NO: 470167 - DNA, 18 bp, R. norvegicus
acagacaggaactgtata

SEQ ID NO: 470168 - DNA, 16 bp, R. norvegicus
acagacaggaagacag

SEQ ID NO: 470169 - DNA, 16 bp, R. norvegicus
acagacaggagacaga

SEQ ID NO: 470170 - DNA, 16 bp, R. norvegicus
acagacaggagcctgg

SEQ ID NO: 470171 - DNA, 16 bp, R. norvegicus
acagacagggaaactg

SEQ ID NO: 470172 - DNA, 16 bp, R. norvegicus
acagacagggacagag

SEQ ID NO: 470173 - DNA, 16 bp, R. norvegicus
acagacagtatccaaa

SEQ ID NO: 470174 - DNA, 16 bp, R. norvegicus
acagacagtcagacag

SEQ ID NO: 470175 - DNA, 16 bp, R. norvegicus
acagacagtgacagag

SEQ ID NO: 470176 - DNA, 16 bp, R. norvegicus
acagacatatatgcaa

SEQ ID NO: 470177 - DNA, 16 bp, R. norvegicus
acagacatcacacaca

SEQ ID NO: 470178 - DNA, 16 bp, R. norvegicus
acagacatgagggaag

SEQ ID NO: 470179 - DNA, 16 bp, R. norvegicus
acagaccaagttccag

SEQ ID NO: 470180 - DNA, 16 bp, R. norvegicus
acagacccaaaaggac

SEQ ID NO: 470181 - DNA, 16 bp, R. norvegicus
acagacccagacccag

SEQ ID NO: 470182 - DNA, 16 bp, R. norvegicus
acagacccagggctaa

SEQ ID NO: 470183 - DNA, 16 bp, R. norvegicus
acagacccatcaggaa

SEQ ID NO: 470184 - DNA, 16 bp, R. norvegicus
acagacccttggctcc

SEQ ID NO: 470185 - DNA, 16 bp, R. norvegicus
acagacctacttccac

SEQ ID NO: 470186 - DNA, 16 bp, R. norvegicus
acagacctatggctcc

SEQ ID NO: 470187 - DNA, 16 bp, R. norvegicus
acagacgagcttagct

SEQ ID NO: 470188 - DNA, 18 bp, R. norvegicus
acagactaagagaaatca

SEQ ID NO: 470189 - DNA, 16 bp, R. norvegicus
acagactctgttcaca

SEQ ID NO: 470190 - DNA, 16 bp, R. norvegicus
acagacttggctgagc

SEQ ID NO: 470191 - DNA, 16 bp, R. norvegicus
acagagaaaccttgtt

SEQ ID NO: 470192 - DNA, 16 bp, R. norvegicus
acagagaaagacacac

SEQ ID NO: 470193 - DNA, 16 bp, R. norvegicus
acagagaaaggagact

SEQ ID NO: 470194 - DNA, 16 bp, R. norvegicus
acagagaaaggcagag

SEQ ID NO: 470195 - DNA, 16 bp, R. norvegicus
acagagaaccctgtct

SEQ ID NO: 470196 - DNA, 16 bp, R. norvegicus
acagagaagaagaaat

SEQ ID NO: 470197 - DNA, 16 bp, R. norvegicus
acagagaagacacaga

SEQ ID NO: 470198 - DNA, 16 bp, R. norvegicus
acagagaagcagctgg

SEQ ID NO: 470199 - DNA, 16 bp, R. norvegicus
acagagaagtagagaa

SEQ ID NO: 470200 - DNA, 16 bp, R. norvegicus
acagagacacactgaa

SEQ ID NO: 470201 - DNA, 16 bp, R. norvegicus
acagagacacagaaga

SEQ ID NO: 470202 - DNA, 16 bp, R. norvegicus
acagagacacagagga

SEQ ID NO: 470203 - DNA, 16 bp, R. norvegicus
acagagacagaaagtg

SEQ ID NO: 470204 - DNA, 17 bp, R. norvegicus
acagagacagacagaga

SEQ ID NO: 470205 - DNA, 16 bp, R. norvegicus
acagagacagagaaac

SEQ ID NO: 470206 - DNA, 16 bp, R. norvegicus
acagagacagagaagc

SEQ ID NO: 470207 - DNA, 16 bp, R. norvegicus
acagagacagagaagg

SEQ ID NO: 470208 - DNA, 16 bp, R. norvegicus
acagagacagagacat

SEQ ID NO: 470209 - DNA, 16 bp, R. norvegicus
acagagacagagacca

SEQ ID NO: 470210 - DNA, 16 bp, R. norvegicus
acagagacagagagcc

SEQ ID NO: 470211 - DNA, 16 bp, R. norvegicus
acagagacagaggcag

SEQ ID NO: 470212 - DNA, 16 bp, R. norvegicus
acagagacagcagaga

SEQ ID NO: 470213 - DNA, 16 bp, R. norvegicus
acagagacaggaggct

SEQ ID NO: 470214 - DNA, 16 bp, R. norvegicus
acagagacaggcaaat

SEQ ID NO: 470215 - DNA, 16 bp, R. norvegicus
acagagacagtggcag

SEQ ID NO: 470216 - DNA, 16 bp, R. norvegicus
acagagaccaggctgg

SEQ ID NO: 470217 - DNA, 16 bp, R. norvegicus
acagagaccctgtctc

SEQ ID NO: 470218 - DNA, 16 bp, R. norvegicus
acagagactgaagaga

SEQ ID NO: 470219 - DNA, 16 bp, R. norvegicus
acagagactgagacag

SEQ ID NO: 470220 - DNA, 16 bp, R. norvegicus
acagagactgaggagg

SEQ ID NO: 470221 - DNA, 16 bp, R. norvegicus
acagagactggagcag

SEQ ID NO: 470222 - DNA, 16 bp, R. norvegicus
acagagactggaggaa

SEQ ID NO: 470223 - DNA, 16 bp, R. norvegicus
acagagactgtgacaa

SEQ ID NO: 470224 - DNA, 16 bp, R. norvegicus
acagagactttgtgag

SEQ ID NO: 470225 - DNA, 16 bp, R. norvegicus
acagagagacacagaa

SEQ ID NO: 470226 - DNA, 16 bp, R. norvegicus
acagagagacacagag

SEQ ID NO: 470227 - DNA, 16 bp, R. norvegicus
acagagagacagaggt

SEQ ID NO: 470228 - DNA, 17 bp, R. norvegicus
acagagagagagacaga

SEQ ID NO: 470229 - DNA, 16 bp, R. norvegicus
acagagagaggagaca

SEQ ID NO: 470230 - DNA, 16 bp, R. norvegicus
acagagagccacctgc

SEQ ID NO: 470231 - DNA, 16 bp, R. norvegicus
acagagagctatggca

SEQ ID NO: 470232 - DNA, 16 bp, R. norvegicus
acagagaggtggagag

SEQ ID NO: 470233 - DNA, 16 bp, R. norvegicus
acagagagtcagagac

SEQ ID NO: 470234 - DNA, 16 bp, R. norvegicus
acagagagtgtgtcta

SEQ ID NO: 470235 - DNA, 16 bp, R. norvegicus
acagagagttccagaa

SEQ ID NO: 470236 - DNA, 16 bp, R. norvegicus
acagagatacagacag

SEQ ID NO: 470237 - DNA, 16 bp, R. norvegicus
acagagatagaagaga

SEQ ID NO: 470238 - DNA, 16 bp, R. norvegicus
acagagatgaatgcta

SEQ ID NO: 470239 - DNA, 16 bp, R. norvegicus
acagagatgagagaga

SEQ ID NO: 470240 - DNA, 16 bp, R. norvegicus
acagagatggagaaac

SEQ ID NO: 470241 - DNA, 16 bp, R. norvegicus
acagagcaagttccgg

SEQ ID NO: 470242 - DNA, 16 bp, R. norvegicus
acagagcaagttctag

SEQ ID NO: 470243 - DNA, 16 bp, R. norvegicus
acagagcaatttccag

SEQ ID NO: 470244 - DNA, 16 bp, R. norvegicus
acagagcacacacaga

SEQ ID NO: 470245 - DNA, 16 bp, R. norvegicus
acagagcactcctaca

SEQ ID NO: 470246 - DNA, 16 bp, R. norvegicus
acagagcagaagagac

SEQ ID NO: 470247 - DNA, 16 bp, R. norvegicus
acagagcaggaacctg

SEQ ID NO: 470248 - DNA, 16 bp, R. norvegicus
acagagcaggagcaag

SEQ ID NO: 470249 - DNA, 16 bp, R. norvegicus
acagagcatggaaaca

SEQ ID NO: 470250 - DNA, 16 bp, R. norvegicus
acagagccagagccag

SEQ ID NO: 470251 - DNA, 16 bp, R. norvegicus
acagagctaaagaaaa

SEQ ID NO: 470252 - DNA, 16 bp, R. norvegicus
acagagctcaagtcca

SEQ ID NO: 470253 - DNA, 16 bp, R. norvegicus
acagagctcagctcag

SEQ ID NO: 470254 - DNA, 16 bp, R. norvegicus
acagagctcccaggaa

SEQ ID NO: 470255 - DNA, 16 bp, R. norvegicus
acagagctggagaagt

SEQ ID NO: 470256 - DNA, 16 bp, R. norvegicus
acagaggaaactcaaa

SEQ ID NO: 470257 - DNA, 16 bp, R. norvegicus
acagaggaccaggaag

SEQ ID NO: 470258 - DNA, 16 bp, R. norvegicus
acagaggacctggtac

SEQ ID NO: 470259 - DNA, 16 bp, R. norvegicus
acagaggacctggtgc

SEQ ID NO: 470260 - DNA, 16 bp, R. norvegicus
acagaggagacagagg

SEQ ID NO: 470261 - DNA, 16 bp, R. norvegicus
acagaggagagggtga

SEQ ID NO: 470262 - DNA, 16 bp, R. norvegicus
acagaggcaaagacag

SEQ ID NO: 470263 - DNA, 16 bp, R. norvegicus
acagaggcagaatgaa

SEQ ID NO: 470264 - DNA, 16 bp, R. norvegicus
acagaggcagctgcac

SEQ ID NO: 470265 - DNA, 16 bp, R. norvegicus
acagaggcagggacag

SEQ ID NO: 470266 - DNA, 16 bp, R. norvegicus
acagaggccagaggaa

SEQ ID NO: 470267 - DNA, 16 bp, R. norvegicus
acagaggccagaggag

SEQ ID NO: 470268 - DNA, 16 bp, R. norvegicus
acagaggccagatgag

SEQ ID NO: 470269 - DNA, 16 bp, R. norvegicus
acagaggctgaaggaa

SEQ ID NO: 470270 - DNA, 16 bp, R. norvegicus
acagaggctgaaggag

SEQ ID NO: 470271 - DNA, 16 bp, R. norvegicus
acagagggacagagaa

SEQ ID NO: 470272 - DNA, 16 bp, R. norvegicus
acagagggcaagctta

SEQ ID NO: 470273 - DNA, 16 bp, R. norvegicus
acagagtaagtttcag

SEQ ID NO: 470274 - DNA, 16 bp, R. norvegicus
acagagtcagctctgg

SEQ ID NO: 470275 - DNA, 16 bp, R. norvegicus
acagagtcaggcaggt

SEQ ID NO: 470276 - DNA, 29 bp, R. norvegicus
acagagtcatactgatcagatttgataga

SEQ ID NO: 470277 - DNA, 16 bp, R. norvegicus
acagagtgaagactcc

SEQ ID NO: 470278 - DNA, 16 bp, R. norvegicus
acagagtgcctgctca

SEQ ID NO: 470279 - DNA, 16 bp, R. norvegicus
acagagtggttgtacc

SEQ ID NO: 470280 - DNA, 16 bp, R. norvegicus
acagagttcacagcag

SEQ ID NO: 470281 - DNA, 16 bp, R. norvegicus
acagataaaagaagac

SEQ ID NO: 470282 - DNA, 16 bp, R. norvegicus
acagataaaccaatta

SEQ ID NO: 470283 - DNA, 16 bp, R. norvegicus
acagataactccagag

SEQ ID NO: 470284 - DNA, 16 bp, R. norvegicus
acagataattaaaaat

SEQ ID NO: 470285 - DNA, 16 bp, R. norvegicus
acagatacaagaagtt

SEQ ID NO: 470286 - DNA, 16 bp, R. norvegicus
acagatacaagatgat

SEQ ID NO: 470287 - DNA, 16 bp, R. norvegicus
acagatacaggaaaat

SEQ ID NO: 470288 - DNA, 16 bp, R. norvegicus
acagatacatacaaac

SEQ ID NO: 470289 - DNA, 16 bp, R. norvegicus
acagatacatacagac

SEQ ID NO: 470290 - DNA, 16 bp, R. norvegicus
acagatataggcctta

SEQ ID NO: 470291 - DNA, 16 bp, R. norvegicus
acagatcaggaaaaga

SEQ ID NO: 470292 - DNA, 16 bp, R. norvegicus
acagatgaagaaaatg

SEQ ID NO: 470293 - DNA, 16 bp, R. norvegicus
acagatgaaggaaatg

SEQ ID NO: 470294 - DNA, 16 bp, R. norvegicus
acagatgaatggatga

SEQ ID NO: 470295 - DNA, 16 bp, R. norvegicus
acagatgagagaaaac

SEQ ID NO: 470296 - DNA, 16 bp, R. norvegicus
acagatgatgaaaatg

SEQ ID NO: 470297 - DNA, 16 bp, R. norvegicus
acagatgatgatgatg

SEQ ID NO: 470298 - DNA, 16 bp, R. norvegicus
acagatgcaaatactc

SEQ ID NO: 470299 - DNA, 16 bp, R. norvegicus
acagatgcagagagag

SEQ ID NO: 470300 - DNA, 16 bp, R. norvegicus
acagatgcagatatcc

SEQ ID NO: 470301 - DNA, 16 bp, R. norvegicus
acagatgcagatgctc

SEQ ID NO: 470302 - DNA, 16 bp, R. norvegicus
acagatgccaagaagt

SEQ ID NO: 470303 - DNA, 29 bp, R. norvegicus
acagatgctggcgaggatgcggagaaaga

SEQ ID NO: 470304 - DNA, 21 bp, R. norvegicus
acagatgctggcgaggatgtg

SEQ ID NO: 470305 - DNA, 16 bp, R. norvegicus
acagatgctggggagg

SEQ ID NO: 470306 - DNA, 16 bp, R. norvegicus
acagatggacagaaag

SEQ ID NO: 470307 - DNA, 16 bp, R. norvegicus
acagatggacagacag

SEQ ID NO: 470308 - DNA, 16 bp, R. norvegicus
acagatggagaaactg

SEQ ID NO: 470309 - DNA, 16 bp, R. norvegicus
acagatggagcaatac

SEQ ID NO: 470310 - DNA, 16 bp, R. norvegicus
acagatggatggatgg

SEQ ID NO: 470311 - DNA, 16 bp, R. norvegicus
acagatggtgtgagcc

SEQ ID NO: 470312 - DNA, 16 bp, R. norvegicus
acagatgtcacacaga

SEQ ID NO: 470313 - DNA, 16 bp, R. norvegicus
acagatgtgcactacc

SEQ ID NO: 470314 - DNA, 16 bp, R. norvegicus
acagatgtgcccacag

SEQ ID NO: 470315 - DNA, 16 bp, R. norvegicus
acagatgtgtgtgtgt

SEQ ID NO: 470316 - DNA, 16 bp, R. norvegicus
acagattgagaaacac

SEQ ID NO: 470317 - DNA, 16 bp, R. norvegicus
acagattggaaaataa

SEQ ID NO: 470318 - DNA, 16 bp, R. norvegicus
acagattgggaaaaag

SEQ ID NO: 470319 - DNA, 16 bp, R. norvegicus
acagattgggagaaga

SEQ ID NO: 470320 - DNA, 16 bp, R. norvegicus
acagatttacaatcag

SEQ ID NO: 470321 - DNA, 16 bp, R. norvegicus
acagatttccagaatg

SEQ ID NO: 470322 - DNA, 16 bp, R. norvegicus
acagattttctctgtg

SEQ ID NO: 470323 - DNA, 16 bp, R. norvegicus
acagcaaaaagatagt

SEQ ID NO: 470324 - DNA, 16 bp, R. norvegicus
acagcaaaccaacagc

SEQ ID NO: 470325 - DNA, 16 bp, R. norvegicus
acagcaaaccagaagc

SEQ ID NO: 470326 - DNA, 16 bp, R. norvegicus
acagcaaagaaatcaa

SEQ ID NO: 470327 - DNA, 16 bp, R. norvegicus
acagcaaagcaaagca

SEQ ID NO: 470328 - DNA, 16 bp, R. norvegicus
acagcaaagcagagag

SEQ ID NO: 470329 - DNA, 16 bp, R. norvegicus
acagcaaaggaaacag

SEQ ID NO: 470330 - DNA, 16 bp, R. norvegicus
acagcaaagtggagag

SEQ ID NO: 470331 - DNA, 16 bp, R. norvegicus
acagcaacaaaaacta

SEQ ID NO: 470332 - DNA, 16 bp, R. norvegicus
acagcaacagcagcag

SEQ ID NO: 470333 - DNA, 16 bp, R. norvegicus
acagcaacaggaagag

SEQ ID NO: 470334 - DNA, 16 bp, R. norvegicus
acagcaagcaagcaag

SEQ ID NO: 470335 - DNA, 16 bp, R. norvegicus
acagcaagccctggac

SEQ ID NO: 470336 - DNA, 16 bp, R. norvegicus
acagcaagtcaagaag

SEQ ID NO: 470337 - DNA, 16 bp, R. norvegicus
acagcaagtcctggat

SEQ ID NO: 470338 - DNA, 16 bp, R. norvegicus
acagcaagtgctgtta

SEQ ID NO: 470339 - DNA, 16 bp, R. norvegicus
acagcaagttccagga

SEQ ID NO: 470340 - DNA, 16 bp, R. norvegicus
acagcaataaaacccc

SEQ ID NO: 470341 - DNA, 16 bp, R. norvegicus
acagcaataagaaaag

SEQ ID NO: 470342 - DNA, 16 bp, R. norvegicus
acagcaatggcttatg

SEQ ID NO: 470343 - DNA, 16 bp, R. norvegicus
acagcacacacaggac

SEQ ID NO: 470344 - DNA, 16 bp, R. norvegicus
acagcacacctgaaac

SEQ ID NO: 470345 - DNA, 16 bp, R. norvegicus
acagcacagacacaga

SEQ ID NO: 470346 - DNA, 16 bp, R. norvegicus
acagcacagcacagtc

SEQ ID NO: 470347 - DNA, 16 bp, R. norvegicus
acagcacaggaagaaa

SEQ ID NO: 470348 - DNA, 16 bp, R. norvegicus
acagcacatctaaaag

SEQ ID NO: 470349 - DNA, 16 bp, R. norvegicus
acagcacatgttggca

SEQ ID NO: 470350 - DNA, 16 bp, R. norvegicus
acagcaccaacaggag

SEQ ID NO: 470351 - DNA, 16 bp, R. norvegicus
acagcaccctcagcag

SEQ ID NO: 470352 - DNA, 16 bp, R. norvegicus
acagcactaaaaccct

SEQ ID NO: 470353 - DNA, 16 bp, R. norvegicus
acagcagaaacaacag

SEQ ID NO: 470354 - DNA, 16 bp, R. norvegicus
acagcagaagaatgga

SEQ ID NO: 470355 - DNA, 16 bp, R. norvegicus
acagcagaagaggaca

SEQ ID NO: 470356 - DNA, 16 bp, R. norvegicus
acagcagaagcagcag

SEQ ID NO: 470357 - DNA, 16 bp, R. norvegicus
acagcagagaactcct

SEQ ID NO: 470358 - DNA, 16 bp, R. norvegicus
acagcagaggcagcag

SEQ ID NO: 470359 - DNA, 16 bp, R. norvegicus
acagcagatgctgaag

SEQ ID NO: 470360 - DNA, 16 bp, R. norvegicus
acagcagatgctggaa

SEQ ID NO: 470361 - DNA, 16 bp, R. norvegicus
acagcagatgctggtg

SEQ ID NO: 470362 - DNA, 16 bp, R. norvegicus
acagcagcaaaaccct

SEQ ID NO: 470363 - DNA, 16 bp, R. norvegicus
acagcagcaacaacag

SEQ ID NO: 470364 - DNA, 19 bp, R. norvegicus
acagcagcaacagcagcaa

SEQ ID NO: 470365 - DNA, 16 bp, R. norvegicus
acagcagcaacagtgg

SEQ ID NO: 470366 - DNA, 16 bp, R. norvegicus
acagcagcaagaaaag

SEQ ID NO: 470367 - DNA, 16 bp, R. norvegicus
acagcagcacacacag

SEQ ID NO: 470368 - DNA, 16 bp, R. norvegicus
acagcagcagaagcag

SEQ ID NO: 470369 - DNA, 16 bp, R. norvegicus
acagcagcagcaacaa

SEQ ID NO: 470370 - DNA, 22 bp, R. norvegicus
acagcagcagcaacagcagcaa

SEQ ID NO: 470371 - DNA, 16 bp, R. norvegicus
acagcagcagcaatgg

SEQ ID NO: 470372 - DNA, 16 bp, R. norvegicus
acagcagcagcagaag

SEQ ID NO: 470373 - DNA, 19 bp, R. norvegicus
acagcagcagcagcagcaa

SEQ ID NO: 470374 - DNA, 19 bp, R. norvegicus
acagcagcagcagcagcac

SEQ ID NO: 470375 - DNA, 16 bp, R. norvegicus
acagcagcagcaggag

SEQ ID NO: 470376 - DNA, 16 bp, R. norvegicus
acagcagcagcagtgg

SEQ ID NO: 470377 - DNA, 16 bp, R. norvegicus
acagcagcagcgggtc

SEQ ID NO: 470378 - DNA, 16 bp, R. norvegicus
acagcagcagcttctg

SEQ ID NO: 470379 - DNA, 16 bp, R. norvegicus
acagcagcaggcaggc

SEQ ID NO: 470380 - DNA, 16 bp, R. norvegicus
acagcagcagtaacaa

SEQ ID NO: 470381 - DNA, 16 bp, R. norvegicus
acagcagcagtagcag

SEQ ID NO: 470382 - DNA, 16 bp, R. norvegicus
acagcagctcacaact

SEQ ID NO: 470383 - DNA, 16 bp, R. norvegicus
acagcagcttccagca

SEQ ID NO: 470384 - DNA, 16 bp, R. norvegicus
acagcaggaaaaccct

SEQ ID NO: 470385 - DNA, 16 bp, R. norvegicus
acagcaggaacaacaa

SEQ ID NO: 470386 - DNA, 16 bp, R. norvegicus
acagcaggaggaactg

SEQ ID NO: 470387 - DNA, 16 bp, R. norvegicus
acagcaggcaaaccag

SEQ ID NO: 470388 - DNA, 16 bp, R. norvegicus
acagcagtcaaagaaa

SEQ ID NO: 470389 - DNA, 16 bp, R. norvegicus
acagcagtcacagaca

SEQ ID NO: 470390 - DNA, 16 bp, R. norvegicus
acagcagtgtcctttg

SEQ ID NO: 470391 - DNA, 16 bp, R. norvegicus
acagcatcagaaagca

SEQ ID NO: 470392 - DNA, 16 bp, R. norvegicus
acagcatcatttgttg

SEQ ID NO: 470393 - DNA, 16 bp, R. norvegicus
acagcatcctttgcct

SEQ ID NO: 470394 - DNA, 16 bp, R. norvegicus
acagcatctgctgtca

SEQ ID NO: 470395 - DNA, 16 bp, R. norvegicus
acagcatgaagaactg

SEQ ID NO: 470396 - DNA, 16 bp, R. norvegicus
acagcattttcatcaa

SEQ ID NO: 470397 - DNA, 16 bp, R. norvegicus
acagccaaagctctga

SEQ ID NO: 470398 - DNA, 16 bp, R. norvegicus
acagccaaggctacag

SEQ ID NO: 470399 - DNA, 16 bp, R. norvegicus
acagccaagggctaca

SEQ ID NO: 470400 - DNA, 16 bp, R. norvegicus
acagccacagaaaagt

SEQ ID NO: 470401 - DNA, 16 bp, R. norvegicus
acagccacagctacag

SEQ ID NO: 470402 - DNA, 16 bp, R. norvegicus
acagccacagtgttac

SEQ ID NO: 470403 - DNA, 16 bp, R. norvegicus
acagccactctggaaa

SEQ ID NO: 470404 - DNA, 16 bp, R. norvegicus
acagccagaaaccaga

SEQ ID NO: 470405 - DNA, 16 bp, R. norvegicus
acagccagaagctggg

SEQ ID NO: 470406 - DNA, 16 bp, R. norvegicus
acagccagaagttgga

SEQ ID NO: 470407 - DNA, 16 bp, R. norvegicus
acagccagagaaaccc

SEQ ID NO: 470408 - DNA, 16 bp, R. norvegicus
acagccagagctccac

SEQ ID NO: 470409 - DNA, 16 bp, R. norvegicus
acagccaggaagcaga

SEQ ID NO: 470410 - DNA, 16 bp, R. norvegicus
acagccaggaccacat

SEQ ID NO: 470411 - DNA, 16 bp, R. norvegicus
acagccaggactacac

SEQ ID NO: 470412 - DNA, 16 bp, R. norvegicus
acagccaggcagtggt

SEQ ID NO: 470413 - DNA, 16 bp, R. norvegicus
acagccagggatacag

SEQ ID NO: 470414 - DNA, 16 bp, R. norvegicus
acagccagggccacat

SEQ ID NO: 470415 - DNA, 16 bp, R. norvegicus
acagccagggccatac

SEQ ID NO: 470416 - DNA, 16 bp, R. norvegicus
acagccagggctacat

SEQ ID NO: 470417 - DNA, 16 bp, R. norvegicus
acagccagggctatgc

SEQ ID NO: 470418 - DNA, 16 bp, R. norvegicus
acagccagggctgtgt

SEQ ID NO: 470419 - DNA, 16 bp, R. norvegicus
acagccagtgatctta

SEQ ID NO: 470420 - DNA, 16 bp, R. norvegicus
acagccagtgctctca

SEQ ID NO: 470421 - DNA, 16 bp, R. norvegicus
acagccatcacagaca

SEQ ID NO: 470422 - DNA, 16 bp, R. norvegicus
acagccatcagctcct

SEQ ID NO: 470423 - DNA, 16 bp, R. norvegicus
acagccatctgaaatg

SEQ ID NO: 470424 - DNA, 16 bp, R. norvegicus
acagccatgccaggct

SEQ ID NO: 470425 - DNA, 16 bp, R. norvegicus
acagccatggctacac

SEQ ID NO: 470426 - DNA, 16 bp, R. norvegicus
acagccattttggaaa

SEQ ID NO: 470427 - DNA, 16 bp, R. norvegicus
acagcccactgtgggt

SEQ ID NO: 470428 - DNA, 16 bp, R. norvegicus
acagcccagactggcc

SEQ ID NO: 470429 - DNA, 16 bp, R. norvegicus
acagcccagagtcacc

SEQ ID NO: 470430 - DNA, 16 bp, R. norvegicus
acagcccagcacagcc

SEQ ID NO: 470431 - DNA, 16 bp, R. norvegicus
acagcccaggtacctt

SEQ ID NO: 470432 - DNA, 16 bp, R. norvegicus
acagcccagtcctggg

SEQ ID NO: 470433 - DNA, 16 bp, R. norvegicus
acagccctcaggacca

SEQ ID NO: 470434 - DNA, 16 bp, R. norvegicus
acagccctgagattcc

SEQ ID NO: 470435 - DNA, 16 bp, R. norvegicus
acagccgttgtccagg

SEQ ID NO: 470436 - DNA, 48 bp, R. norvegicus
acagcctgaaggacaaggccaagaacaggctctcactcagggatgcaa

SEQ ID NO: 470437 - DNA, 16 bp, R. norvegicus
acagcctgaaggcatc

SEQ ID NO: 470438 - DNA, 16 bp, R. norvegicus
acagcctgcagacagc

SEQ ID NO: 470439 - DNA, 16 bp, R. norvegicus
acagcctggctggaag

SEQ ID NO: 470440 - DNA, 16 bp, R. norvegicus
acagcctgggctacaa

SEQ ID NO: 470441 - DNA, 18 bp, R. norvegicus
acagccttatttataata

SEQ ID NO: 470442 - DNA, 16 bp, R. norvegicus
acagcgatgtggaagt

SEQ ID NO: 470443 - DNA, 16 bp, R. norvegicus
acagcgccacctgctg

SEQ ID NO: 470444 - DNA, 16 bp, R. norvegicus
acagctaagccaggag

SEQ ID NO: 470445 - DNA, 16 bp, R. norvegicus
acagctagatcaggct

SEQ ID NO: 470446 - DNA, 16 bp, R. norvegicus
acagctatatcaggtt

SEQ ID NO: 470447 - DNA, 16 bp, R. norvegicus
acagctcacaactgtc

SEQ ID NO: 470448 - DNA, 17 bp, R. norvegicus
acagctcagagacaaag

SEQ ID NO: 470449 - DNA, 16 bp, R. norvegicus
acagctcaggaatgcc

SEQ ID NO: 470450 - DNA, 16 bp, R. norvegicus
acagctcagtgggtaa

SEQ ID NO: 470451 - DNA, 16 bp, R. norvegicus
acagctccacctgcct

SEQ ID NO: 470452 - DNA, 16 bp, R. norvegicus
acagctccctgaaccc

SEQ ID NO: 470453 - DNA, 16 bp, R. norvegicus
acagctcctgaggaac

SEQ ID NO: 470454 - DNA, 16 bp, R. norvegicus
acagctccttgcctct

SEQ ID NO: 470455 - DNA, 16 bp, R. norvegicus
acagctgaaggcctgt

SEQ ID NO: 470456 - DNA, 16 bp, R. norvegicus
acagctgaggaatgtc

SEQ ID NO: 470457 - DNA, 16 bp, R. norvegicus
acagctgcaatcccag

SEQ ID NO: 470458 - DNA, 16 bp, R. norvegicus
acagctgcagcacaag

SEQ ID NO: 470459 - DNA, 16 bp, R. norvegicus
acagctgcagcacgag

SEQ ID NO: 470460 - DNA, 16 bp, R. norvegicus
acagctgcagtgtgct

SEQ ID NO: 470461 - DNA, 16 bp, R. norvegicus
acagctgcatcatcaa

SEQ ID NO: 470462 - DNA, 16 bp, R. norvegicus
acagctgccagtaccc

SEQ ID NO: 470463 - DNA, 16 bp, R. norvegicus
acagctgcccaaggag

SEQ ID NO: 470464 - DNA, 16 bp, R. norvegicus
acagctgctgctgacc

SEQ ID NO: 470465 - DNA, 16 bp, R. norvegicus
acagctgctgtccacc

SEQ ID NO: 470466 - DNA, 16 bp, R. norvegicus
acagctggaggaagtg

SEQ ID NO: 470467 - DNA, 16 bp, R. norvegicus
acagctggatctggga

SEQ ID NO: 470468 - DNA, 16 bp, R. norvegicus
acagctggctgtcctg

SEQ ID NO: 470469 - DNA, 16 bp, R. norvegicus
acagctgggtcttcag

SEQ ID NO: 470470 - DNA, 16 bp, R. norvegicus
acagctgtcccctgag

SEQ ID NO: 470471 - DNA, 16 bp, R. norvegicus
acagctgtctcctgaa

SEQ ID NO: 470472 - DNA, 16 bp, R. norvegicus
acagcttctctctctc

SEQ ID NO: 470473 - DNA, 16 bp, R. norvegicus
acagcttcttcttctt

SEQ ID NO: 470474 - DNA, 16 bp, R. norvegicus
acagcttcttgttcca

SEQ ID NO: 470475 - DNA, 16 bp, R. norvegicus
acagcttggtgaagga

SEQ ID NO: 470476 - DNA, 16 bp, R. norvegicus
acagctttcaggagtt

SEQ ID NO: 470477 - DNA, 16 bp, R. norvegicus
acagctttgtggagtt

SEQ ID NO: 470478 - DNA, 16 bp, R. norvegicus
acagcttttcttttct

SEQ ID NO: 470479 - DNA, 16 bp, R. norvegicus
acaggaaaaaatttcc

SEQ ID NO: 470480 - DNA, 19 bp, R. norvegicus
acaggaaaacacaatcaaa

SEQ ID NO: 470481 - DNA, 16 bp, R. norvegicus
acaggaaaatctggag

SEQ ID NO: 470482 - DNA, 16 bp, R. norvegicus
acaggaaacaacaata

SEQ ID NO: 470483 - DNA, 16 bp, R. norvegicus
acaggaaacaatcact

SEQ ID NO: 470484 - DNA, 16 bp, R. norvegicus
acaggaaacactgtcc

SEQ ID NO: 470485 - DNA, 16 bp, R. norvegicus
acaggaaaccaggaag

SEQ ID NO: 470486 - DNA, 16 bp, R. norvegicus
acaggaaactgagaag

SEQ ID NO: 470487 - DNA, 16 bp, R. norvegicus
acaggaaagaggatat

SEQ ID NO: 470488 - DNA, 16 bp, R. norvegicus
acaggaaaggaatttc

SEQ ID NO: 470489 - DNA, 16 bp, R. norvegicus
acaggaaccccagtgg

SEQ ID NO: 470490 - DNA, 16 bp, R. norvegicus
acaggaactaacaatc

SEQ ID NO: 470491 - DNA, 16 bp, R. norvegicus
acaggaactcaagaag

SEQ ID NO: 470492 - DNA, 16 bp, R. norvegicus
acaggaagaattgtgg

SEQ ID NO: 470493 - DNA, 16 bp, R. norvegicus
acaggaagaccaagag

SEQ ID NO: 470494 - DNA, 16 bp, R. norvegicus
acaggaagacccacag

SEQ ID NO: 470495 - DNA, 16 bp, R. norvegicus
acaggaagagcaacag

SEQ ID NO: 470496 - DNA, 16 bp, R. norvegicus
acaggaagctcaagaa

SEQ ID NO: 470497 - DNA, 16 bp, R. norvegicus
acaggaagctgtgcta

SEQ ID NO: 470498 - DNA, 16 bp, R. norvegicus
acaggaaggactgaag

SEQ ID NO: 470499 - DNA, 16 bp, R. norvegicus
acaggaagtagaaaga

SEQ ID NO: 470500 - DNA, 16 bp, R. norvegicus
acaggaagtagaaagg

SEQ ID NO: 470501 - DNA, 16 bp, R. norvegicus
acaggaagttcaagaa

SEQ ID NO: 470502 - DNA, 16 bp, R. norvegicus
acaggaatgactacat

SEQ ID NO: 470503 - DNA, 16 bp, R. norvegicus
acaggacagaaacctg

SEQ ID NO: 470504 - DNA, 16 bp, R. norvegicus
acaggacaggaacctg

SEQ ID NO: 470505 - DNA, 16 bp, R. norvegicus
acaggaccaagtgcct

SEQ ID NO: 470506 - DNA, 16 bp, R. norvegicus
acaggacctgggttca

SEQ ID NO: 470507 - DNA, 17 bp, R. norvegicus
acaggactacagcactc

SEQ ID NO: 470508 - DNA, 16 bp, R. norvegicus
acaggactgtgcacag

SEQ ID NO: 470509 - DNA, 16 bp, R. norvegicus
acaggagagaagccct

SEQ ID NO: 470510 - DNA, 16 bp, R. norvegicus
acaggagagagaccca

SEQ ID NO: 470511 - DNA, 16 bp, R. norvegicus
acaggagagctggtgg

SEQ ID NO: 470512 - DNA, 16 bp, R. norvegicus
acaggagaggtgcaga

SEQ ID NO: 470513 - DNA, 16 bp, R. norvegicus
acaggagcagaggcag

SEQ ID NO: 470514 - DNA, 16 bp, R. norvegicus
acaggagcagctgaag

SEQ ID NO: 470515 - DNA, 16 bp, R. norvegicus
acaggagcctgagagg

SEQ ID NO: 470516 - DNA, 16 bp, R. norvegicus
acaggagcctggtgtg

SEQ ID NO: 470517 - DNA, 16 bp, R. norvegicus
acaggaggaaatgcag

SEQ ID NO: 470518 - DNA, 16 bp, R. norvegicus
acaggaggaagcttct

SEQ ID NO: 470519 - DNA, 16 bp, R. norvegicus
acaggaggattgctga

SEQ ID NO: 470520 - DNA, 16 bp, R. norvegicus
acaggaggcagaggca

SEQ ID NO: 470521 - DNA, 16 bp, R. norvegicus
acaggaggttcttcct

SEQ ID NO: 470522 - DNA, 16 bp, R. norvegicus
acaggatctagaatca

SEQ ID NO: 470523 - DNA, 16 bp, R. norvegicus
acaggatctttccagt

SEQ ID NO: 470524 - DNA, 16 bp, R. norvegicus
acaggatgctacagga

SEQ ID NO: 470525 - DNA, 16 bp, R. norvegicus
acaggatttacttaaa

SEQ ID NO: 470526 - DNA, 16 bp, R. norvegicus
acaggatttgacattt

SEQ ID NO: 470527 - DNA, 16 bp, R. norvegicus
acaggatttggaaaat

SEQ ID NO: 470528 - DNA, 16 bp, R. norvegicus
acaggcaaaacaccca

SEQ ID NO: 470529 - DNA, 16 bp, R. norvegicus
acaggcaacaggaaga

SEQ ID NO: 470530 - DNA, 16 bp, R. norvegicus
acaggcacacacagtc

SEQ ID NO: 470531 - DNA, 16 bp, R. norvegicus
acaggcacacatatat

SEQ ID NO: 470532 - DNA, 16 bp, R. norvegicus
acaggcacagaaggaa

SEQ ID NO: 470533 - DNA, 16 bp, R. norvegicus
acaggcacagccacag

SEQ ID NO: 470534 - DNA, 16 bp, R. norvegicus
acaggcagaaacccaa

SEQ ID NO: 470535 - DNA, 16 bp, R. norvegicus
acaggcagaaactaga

SEQ ID NO: 470536 - DNA, 16 bp, R. norvegicus
acaggcagaagctgga

SEQ ID NO: 470537 - DNA, 16 bp, R. norvegicus
acaggcagacccctgg

SEQ ID NO: 470538 - DNA, 16 bp, R. norvegicus
acaggcagatagatga

SEQ ID NO: 470539 - DNA, 16 bp, R. norvegicus
acaggcagatctctgc

SEQ ID NO: 470540 - DNA, 16 bp, R. norvegicus
acaggcagatggatgg

SEQ ID NO: 470541 - DNA, 16 bp, R. norvegicus
acaggcagctgcccag

SEQ ID NO: 470542 - DNA, 16 bp, R. norvegicus
acaggcatctgcacac

SEQ ID NO: 470543 - DNA, 16 bp, R. norvegicus
acaggcatgtaccact

SEQ ID NO: 470544 - DNA, 16 bp, R. norvegicus
acaggcatgtgtcacc

SEQ ID NO: 470545 - DNA, 16 bp, R. norvegicus
acaggccacacacaca

SEQ ID NO: 470546 - DNA, 16 bp, R. norvegicus
acaggccacaggaagc

SEQ ID NO: 470547 - DNA, 16 bp, R. norvegicus
acaggcctaccaggag

SEQ ID NO: 470548 - DNA, 29 bp, R. norvegicus
acaggcctcaacaggtacagaaagataga

SEQ ID NO: 470549 - DNA, 16 bp, R. norvegicus
acaggcctcaatagat

SEQ ID NO: 470550 - DNA, 16 bp, R. norvegicus
acaggcctgggaaaca

SEQ ID NO: 470551 - DNA, 16 bp, R. norvegicus
acaggccttctctgtg

SEQ ID NO: 470552 - DNA, 16 bp, R. norvegicus
acaggctgagaaagga

SEQ ID NO: 470553 - DNA, 16 bp, R. norvegicus
acaggctgagagagaa

SEQ ID NO: 470554 - DNA, 16 bp, R. norvegicus
acaggctgtggtccag

SEQ ID NO: 470555 - DNA, 16 bp, R. norvegicus
acaggcttcactgtca

SEQ ID NO: 470556 - DNA, 16 bp, R. norvegicus
acagggaagaccaact

SEQ ID NO: 470557 - DNA, 16 bp, R. norvegicus
acagggacagtgtact

SEQ ID NO: 470558 - DNA, 16 bp, R. norvegicus
acagggagaaagacag

SEQ ID NO: 470559 - DNA, 16 bp, R. norvegicus
acagggagaatttttc

SEQ ID NO: 470560 - DNA, 16 bp, R. norvegicus
acagggagacagggaa

SEQ ID NO: 470561 - DNA, 16 bp, R. norvegicus
acagggagagacagaa

SEQ ID NO: 470562 - DNA, 16 bp, R. norvegicus
acagggagcacaggga

SEQ ID NO: 470563 - DNA, 16 bp, R. norvegicus
acagggagctggagag

SEQ ID NO: 470564 - DNA, 16 bp, R. norvegicus
acagggagctgtgggc

SEQ ID NO: 470565 - DNA, 16 bp, R. norvegicus
acagggaggaattagg

SEQ ID NO: 470566 - DNA, 16 bp, R. norvegicus
acagggaggctttctt

SEQ ID NO: 470567 - DNA, 16 bp, R. norvegicus
acagggatatctacag

SEQ ID NO: 470568 - DNA, 16 bp, R. norvegicus
acagggcaacaacaga

SEQ ID NO: 470569 - DNA, 16 bp, R. norvegicus
acagggcaggaagcag

SEQ ID NO: 470570 - DNA, 16 bp, R. norvegicus
acagggcataaaaaca

SEQ ID NO: 470571 - DNA, 16 bp, R. norvegicus
acagggccacaccttc

SEQ ID NO: 470572 - DNA, 16 bp, R. norvegicus
acagggccctgggttt

SEQ ID NO: 470573 - DNA, 16 bp, R. norvegicus
acagggcctctcactg

SEQ ID NO: 470574 - DNA, 16 bp, R. norvegicus
acagggctttgtatgt

SEQ ID NO: 470575 - DNA, 16 bp, R. norvegicus
acaggggaaacaaact

SEQ ID NO: 470576 - DNA, 16 bp, R. norvegicus
acaggggagaaaccct

SEQ ID NO: 470577 - DNA, 16 bp, R. norvegicus
acaggggctggagaga

SEQ ID NO: 470578 - DNA, 16 bp, R. norvegicus
acaggggctgggaaga

SEQ ID NO: 470579 - DNA, 16 bp, R. norvegicus
acaggggtccctttct

SEQ ID NO: 470580 - DNA, 16 bp, R. norvegicus
acagggtcagctccgg

SEQ ID NO: 470581 - DNA, 16 bp, R. norvegicus
acagggtcagctcctg

SEQ ID NO: 470582 - DNA, 16 bp, R. norvegicus
acagggtcagtgtgag

SEQ ID NO: 470583 - DNA, 16 bp, R. norvegicus
acagggtctctccatg

SEQ ID NO: 470584 - DNA, 16 bp, R. norvegicus
acagggtctctccctg

SEQ ID NO: 470585 - DNA, 16 bp, R. norvegicus
acagggttcccaatgg

SEQ ID NO: 470586 - DNA, 16 bp, R. norvegicus
acaggtagaagtcctt

SEQ ID NO: 470587 - DNA, 16 bp, R. norvegicus
acaggtattacaggaa

SEQ ID NO: 470588 - DNA, 16 bp, R. norvegicus
acaggtattattaaaa

SEQ ID NO: 470589 - DNA, 16 bp, R. norvegicus
acaggtcacctctggc

SEQ ID NO: 470590 - DNA, 16 bp, R. norvegicus
acaggtgaacaaattg

SEQ ID NO: 470591 - DNA, 16 bp, R. norvegicus
acaggtgcccacagag

SEQ ID NO: 470592 - DNA, 16 bp, R. norvegicus
acaggtgctgggaatt

SEQ ID NO: 470593 - DNA, 16 bp, R. norvegicus
acaggtgggaactcct

SEQ ID NO: 470594 - DNA, 16 bp, R. norvegicus
acaggtgtgagctgcc

SEQ ID NO: 470595 - DNA, 16 bp, R. norvegicus
acaggttacctcagca

SEQ ID NO: 470596 - DNA, 16 bp, R. norvegicus
acaggttctctctcca

SEQ ID NO: 470597 - DNA, 16 bp, R. norvegicus
acaggtttgtgtgtgt

SEQ ID NO: 470598 - DNA, 16 bp, R. norvegicus
acaggtttttccagta

SEQ ID NO: 470599 - DNA, 16 bp, R. norvegicus
acaggttttttgtttt

SEQ ID NO: 470600 - DNA, 16 bp, R. norvegicus
acaggtttttttgttt

SEQ ID NO: 470601 - DNA, 16 bp, R. norvegicus
acagtaaaggcttgtt

SEQ ID NO: 470602 - DNA, 16 bp, R. norvegicus
acagtaaggaaagaat

SEQ ID NO: 470603 - DNA, 16 bp, R. norvegicus
acagtaatgtgggctg

SEQ ID NO: 470604 - DNA, 16 bp, R. norvegicus
acagtagatgctggtg

SEQ ID NO: 470605 - DNA, 16 bp, R. norvegicus
acagtatcagatggtg

SEQ ID NO: 470606 - DNA, 16 bp, R. norvegicus
acagtattacagagca

SEQ ID NO: 470607 - DNA, 16 bp, R. norvegicus
acagtattactgatgc

SEQ ID NO: 470608 - DNA, 16 bp, R. norvegicus
acagtattttcttttt

SEQ ID NO: 470609 - DNA, 16 bp, R. norvegicus
acagtatttttaaaaa

SEQ ID NO: 470610 - DNA, 16 bp, R. norvegicus
acagtattttttttaa

SEQ ID NO: 470611 - DNA, 16 bp, R. norvegicus
acagtcacaaaggatg

SEQ ID NO: 470612 - DNA, 16 bp, R. norvegicus
acagtcacagaaacta

SEQ ID NO: 470613 - DNA, 16 bp, R. norvegicus
acagtcaccaaaccca

SEQ ID NO: 470614 - DNA, 16 bp, R. norvegicus
acagtcaggagcagag

SEQ ID NO: 470615 - DNA, 16 bp, R. norvegicus
acagtcagggctgtta

SEQ ID NO: 470616 - DNA, 16 bp, R. norvegicus
acagtcataaaagaaa

SEQ ID NO: 470617 - DNA, 16 bp, R. norvegicus
acagtcatacacatac

SEQ ID NO: 470618 - DNA, 23 bp, R. norvegicus
acagtcccctcaagcctggctta

SEQ ID NO: 470619 - DNA, 16 bp, R. norvegicus
acagtcctctgctaca

SEQ ID NO: 470620 - DNA, 16 bp, R. norvegicus
acagtctcaaaaataa

SEQ ID NO: 470621 - DNA, 16 bp, R. norvegicus
acagtctcctcctggc

SEQ ID NO: 470622 - DNA, 16 bp, R. norvegicus
acagtctggactgcag

SEQ ID NO: 470623 - DNA, 16 bp, R. norvegicus
acagtgaaacaaacag

SEQ ID NO: 470624 - DNA, 16 bp, R. norvegicus
acagtgaaactaaaag

SEQ ID NO: 470625 - DNA, 16 bp, R. norvegicus
acagtgaacaaagcat

SEQ ID NO: 470626 - DNA, 16 bp, R. norvegicus
acagtgacactgtact

SEQ ID NO: 470627 - DNA, 16 bp, R. norvegicus
acagtgacagagagag

SEQ ID NO: 470628 - DNA, 16 bp, R. norvegicus
acagtgacagtgacag

SEQ ID NO: 470629 - DNA, 16 bp, R. norvegicus
acagtgaccaaaagca

SEQ ID NO: 470630 - DNA, 16 bp, R. norvegicus
acagtgaccaagacac

SEQ ID NO: 470631 - DNA, 16 bp, R. norvegicus
acagtgagagagacag

SEQ ID NO: 470632 - DNA, 16 bp, R. norvegicus
acagtgagagcctgtg

SEQ ID NO: 470633 - DNA, 16 bp, R. norvegicus
acagtgagctccagga

SEQ ID NO: 470634 - DNA, 16 bp, R. norvegicus
acagtgaggagaggga

SEQ ID NO: 470635 - DNA, 16 bp, R. norvegicus
acagtgagttcaagga

SEQ ID NO: 470636 - DNA, 16 bp, R. norvegicus
acagtgagttccaggg

SEQ ID NO: 470637 - DNA, 16 bp, R. norvegicus
acagtgagtttcaggt

SEQ ID NO: 470638 - DNA, 16 bp, R. norvegicus
acagtgatgatgatga

SEQ ID NO: 470639 - DNA, 16 bp, R. norvegicus
acagtgcaagttccag

SEQ ID NO: 470640 - DNA, 16 bp, R. norvegicus
acagtgcagaggaaca

SEQ ID NO: 470641 - DNA, 16 bp, R. norvegicus
acagtgctatgagttt

SEQ ID NO: 470642 - DNA, 16 bp, R. norvegicus
acagtgctgggactac

SEQ ID NO: 470643 - DNA, 16 bp, R. norvegicus
acagtgcttgcctagg

SEQ ID NO: 470644 - DNA, 16 bp, R. norvegicus
acagtggagcatgtgt

SEQ ID NO: 470645 - DNA, 16 bp, R. norvegicus
acagtggaggtcctgc

SEQ ID NO: 470646 - DNA, 16 bp, R. norvegicus
acagtgggaagaggga

SEQ ID NO: 470647 - DNA, 16 bp, R. norvegicus
acagtgggaagcatgg

SEQ ID NO: 470648 - DNA, 16 bp, R. norvegicus
acagtgggagacaagc

SEQ ID NO: 470649 - DNA, 16 bp, R. norvegicus
acagtggggaaggcat

SEQ ID NO: 470650 - DNA, 16 bp, R. norvegicus
acagtggggagaggta

SEQ ID NO: 470651 - DNA, 16 bp, R. norvegicus
acagtgggtagctgct

SEQ ID NO: 470652 - DNA, 16 bp, R. norvegicus
acagtgtacccacata

SEQ ID NO: 470653 - DNA, 16 bp, R. norvegicus
acagtgtactcataaa

SEQ ID NO: 470654 - DNA, 16 bp, R. norvegicus
acagtgtcactgtctt

SEQ ID NO: 470655 - DNA, 16 bp, R. norvegicus
acagtgtcccaagata

SEQ ID NO: 470656 - DNA, 16 bp, R. norvegicus
acagtgtcctttgtgt

SEQ ID NO: 470657 - DNA, 16 bp, R. norvegicus
acagtgtctctctctc

SEQ ID NO: 470658 - DNA, 16 bp, R. norvegicus
acagtgttctttgcct

SEQ ID NO: 470659 - DNA, 16 bp, R. norvegicus
acagttaaaagcactg

SEQ ID NO: 470660 - DNA, 16 bp, R. norvegicus
acagttcagcagttaa

SEQ ID NO: 470661 - DNA, 16 bp, R. norvegicus
acagttcagttcacag

SEQ ID NO: 470662 - DNA, 16 bp, R. norvegicus
acagttcatgttgtgg

SEQ ID NO: 470663 - DNA, 16 bp, R. norvegicus
acagttcctcatctca

SEQ ID NO: 470664 - DNA, 16 bp, R. norvegicus
acagttcctcatgtcg

SEQ ID NO: 470665 - DNA, 16 bp, R. norvegicus
acagttgcttgaccct

SEQ ID NO: 470666 - DNA, 19 bp, R. norvegicus
acagttgtcaagttatctt

SEQ ID NO: 470667 - DNA, 16 bp, R. norvegicus
acagtttatatatata

SEQ ID NO: 470668 - DNA, 16 bp, R. norvegicus
acagtttcaatgcaat

SEQ ID NO: 470669 - DNA, 16 bp, R. norvegicus
acagtttcctcttggc

SEQ ID NO: 470670 - DNA, 16 bp, R. norvegicus
acagtttcctctttgg

SEQ ID NO: 470671 - DNA, 16 bp, R. norvegicus
acagtttcctgtgcag

SEQ ID NO: 470672 - DNA, 16 bp, R. norvegicus
acagttttattaattt

SEQ ID NO: 470673 - DNA, 16 bp, R. norvegicus
acataaaaagctgggc

SEQ ID NO: 470674 - DNA, 16 bp, R. norvegicus
acataaaactagatat

SEQ ID NO: 470675 - DNA, 16 bp, R. norvegicus
acataaaactatccaa

SEQ ID NO: 470676 - DNA, 16 bp, R. norvegicus
acataaaagagcacac

SEQ ID NO: 470677 - DNA, 16 bp, R. norvegicus
acataaaagtggaagg

SEQ ID NO: 470678 - DNA, 16 bp, R. norvegicus
acataaaataatgcat

SEQ ID NO: 470679 - DNA, 16 bp, R. norvegicus
acataaacaaatgcat

SEQ ID NO: 470680 - DNA, 16 bp, R. norvegicus
acataaagatagaaat

SEQ ID NO: 470681 - DNA, 16 bp, R. norvegicus
acataaataaaatgtt

SEQ ID NO: 470682 - DNA, 16 bp, R. norvegicus
acataaataaatagat

SEQ ID NO: 470683 - DNA, 16 bp, R. norvegicus
acataaatatgtattt

SEQ ID NO: 470684 - DNA, 16 bp, R. norvegicus
acataaatggactcaa

SEQ ID NO: 470685 - DNA, 16 bp, R. norvegicus
acataaggagaccctg

SEQ ID NO: 470686 - DNA, 16 bp, R. norvegicus
acataatcaaagcaat

SEQ ID NO: 470687 - DNA, 16 bp, R. norvegicus
acataattaaagataa

SEQ ID NO: 470688 - DNA, 16 bp, R. norvegicus
acatacaacacagaca

SEQ ID NO: 470689 - DNA, 16 bp, R. norvegicus
acatacaatgaataaa

SEQ ID NO: 470690 - DNA, 16 bp, R. norvegicus
acatacacacaaagca

SEQ ID NO: 470691 - DNA, 16 bp, R. norvegicus
acatacacacacacat

SEQ ID NO: 470692 - DNA, 16 bp, R. norvegicus
acatacacacatacat

SEQ ID NO: 470693 - DNA, 16 bp, R. norvegicus
acatacacagaggacc

SEQ ID NO: 470694 - DNA, 16 bp, R. norvegicus
acatacacatatgcaa

SEQ ID NO: 470695 - DNA, 16 bp, R. norvegicus
acatacacatatttat

SEQ ID NO: 470696 - DNA, 16 bp, R. norvegicus
acatacacatggacac

SEQ ID NO: 470697 - DNA, 16 bp, R. norvegicus
acatacacatgtacat

SEQ ID NO: 470698 - DNA, 16 bp, R. norvegicus
acatacaccatgacca

SEQ ID NO: 470699 - DNA, 16 bp, R. norvegicus
acatacagacatacat

SEQ ID NO: 470700 - DNA, 16 bp, R. norvegicus
acatacagatatacat

SEQ ID NO: 470701 - DNA, 16 bp, R. norvegicus
acatacaggaagccta

SEQ ID NO: 470702 - DNA, 16 bp, R. norvegicus
acatacatacacacac

SEQ ID NO: 470703 - DNA, 16 bp, R. norvegicus
acatacatgtacatgt

SEQ ID NO: 470704 - DNA, 16 bp, R. norvegicus
acatacatgttcacac

SEQ ID NO: 470705 - DNA, 16 bp, R. norvegicus
acatacctgcatacat

SEQ ID NO: 470706 - DNA, 16 bp, R. norvegicus
acatactacagcttcc

SEQ ID NO: 470707 - DNA, 16 bp, R. norvegicus
acatactaggcaagca

SEQ ID NO: 470708 - DNA, 16 bp, R. norvegicus
acatagaaatccttac

SEQ ID NO: 470709 - DNA, 16 bp, R. norvegicus
acatagacaaagagaa

SEQ ID NO: 470710 - DNA, 16 bp, R. norvegicus
acatagacagagagac

SEQ ID NO: 470711 - DNA, 16 bp, R. norvegicus
acatagaggcaaaatt

SEQ ID NO: 470712 - DNA, 16 bp, R. norvegicus
acatagatacaagcat

SEQ ID NO: 470713 - DNA, 16 bp, R. norvegicus
acatagatacacataa

SEQ ID NO: 470714 - DNA, 16 bp, R. norvegicus
acatagctcagttggt

SEQ ID NO: 470715 - DNA, 16 bp, R. norvegicus
acataggaagaccctg

SEQ ID NO: 470716 - DNA, 16 bp, R. norvegicus
acatagtaaaagccct

SEQ ID NO: 470717 - DNA, 16 bp, R. norvegicus
acatagtgaaagccat

SEQ ID NO: 470718 - DNA, 16 bp, R. norvegicus
acatagtggaaagaga

SEQ ID NO: 470719 - DNA, 16 bp, R. norvegicus
acatataaaatagaca

SEQ ID NO: 470720 - DNA, 16 bp, R. norvegicus
acatataaatgtgtgt

SEQ ID NO: 470721 - DNA, 16 bp, R. norvegicus
acatataactatatat

SEQ ID NO: 470722 - DNA, 16 bp, R. norvegicus
acatatacacacacat

SEQ ID NO: 470723 - DNA, 16 bp, R. norvegicus
acatatacatggaaga

SEQ ID NO: 470724 - DNA, 16 bp, R. norvegicus
acatatatacacatat

SEQ ID NO: 470725 - DNA, 16 bp, R. norvegicus
acatatatacaccaca

SEQ ID NO: 470726 - DNA, 16 bp, R. norvegicus
acatatatatacatac

SEQ ID NO: 470727 - DNA, 16 bp, R. norvegicus
acatatatatggagag

SEQ ID NO: 470728 - DNA, 16 bp, R. norvegicus
acatatatgaaagaaa

SEQ ID NO: 470729 - DNA, 16 bp, R. norvegicus
acatatatgcacatat

SEQ ID NO: 470730 - DNA, 16 bp, R. norvegicus
acatatatgcatgtaa

SEQ ID NO: 470731 - DNA, 16 bp, R. norvegicus
acatatcatataaaca

SEQ ID NO: 470732 - DNA, 16 bp, R. norvegicus
acatatctaagcataa

SEQ ID NO: 470733 - DNA, 16 bp, R. norvegicus
acatatctgcatctga

SEQ ID NO: 470734 - DNA, 16 bp, R. norvegicus
acatatgaaaatctgt

SEQ ID NO: 470735 - DNA, 16 bp, R. norvegicus
acatatgaacaacaat

SEQ ID NO: 470736 - DNA, 16 bp, R. norvegicus
acatatgaacacacag

SEQ ID NO: 470737 - DNA, 16 bp, R. norvegicus
acatatgaggctggag

SEQ ID NO: 470738 - DNA, 16 bp, R. norvegicus
acatatgcatatacat

SEQ ID NO: 470739 - DNA, 16 bp, R. norvegicus
acatatgctctctcct

SEQ ID NO: 470740 - DNA, 16 bp, R. norvegicus
acatatggagcagagg

SEQ ID NO: 470741 - DNA, 16 bp, R. norvegicus
acatatgtaaaataaa

SEQ ID NO: 470742 - DNA, 16 bp, R. norvegicus
acatatgtgactggaa

SEQ ID NO: 470743 - DNA, 16 bp, R. norvegicus
acatatgtgcagagag

SEQ ID NO: 470744 - DNA, 16 bp, R. norvegicus
acatattatgtatata

SEQ ID NO: 470745 - DNA, 16 bp, R. norvegicus
acatattcatattcat

SEQ ID NO: 470746 - DNA, 16 bp, R. norvegicus
acatatttacattatg

SEQ ID NO: 470747 - DNA, 16 bp, R. norvegicus
acatatttatgcatat

SEQ ID NO: 470748 - DNA, 16 bp, R. norvegicus
acatatttgtgtttat

SEQ ID NO: 470749 - DNA, 16 bp, R. norvegicus
acatatttttaaaaga

SEQ ID NO: 470750 - DNA, 16 bp, R. norvegicus
acatatttttcaaata

SEQ ID NO: 470751 - DNA, 16 bp, R. norvegicus
acatatttttgttcaa

SEQ ID NO: 470752 - DNA, 16 bp, R. norvegicus
acatcaaaacaattat

SEQ ID NO: 470753 - DNA, 16 bp, R. norvegicus
acatcaaaatgaccat

SEQ ID NO: 470754 - DNA, 17 bp, R. norvegicus
acatcaaaattggagga

SEQ ID NO: 470755 - DNA, 16 bp, R. norvegicus
acatcaaaccagacaa

SEQ ID NO: 470756 - DNA, 16 bp, R. norvegicus
acatcaaaccagataa

SEQ ID NO: 470757 - DNA, 16 bp, R. norvegicus
acatcaaagaagagga

SEQ ID NO: 470758 - DNA, 16 bp, R. norvegicus
acatcaagtggctcac

SEQ ID NO: 470759 - DNA, 16 bp, R. norvegicus
acatcaatagcctcaa

SEQ ID NO: 470760 - DNA, 68 bp, R. norvegicus
acatcaatgcttactgcagttcaacatcaatgcttactgcagttcaacatcaatgcttactgcagttc

SEQ ID NO: 470761 - DNA, 16 bp, R. norvegicus
acatcaattctgatgg

SEQ ID NO: 470762 - DNA, 16 bp, R. norvegicus
acatcaccaagccctt

SEQ ID NO: 470763 - DNA, 16 bp, R. norvegicus
acatcacctgccatct

SEQ ID NO: 470764 - DNA, 16 bp, R. norvegicus
acatcactgctggagg

SEQ ID NO: 470765 - DNA, 16 bp, R. norvegicus
acatcagacaagaata

SEQ ID NO: 470766 - DNA, 16 bp, R. norvegicus
acatcagatccctgga

SEQ ID NO: 470767 - DNA, 16 bp, R. norvegicus
acatcagcagcttgat

SEQ ID NO: 470768 - DNA, 16 bp, R. norvegicus
acatcagggatggtga

SEQ ID NO: 470769 - DNA, 16 bp, R. norvegicus
acatcagtcaaagaaa

SEQ ID NO: 470770 - DNA, 16 bp, R. norvegicus
acatcagtgccacaga

SEQ ID NO: 470771 - DNA, 16 bp, R. norvegicus
acatcatagaagaaaa

SEQ ID NO: 470772 - DNA, 16 bp, R. norvegicus
acatcatcacccacat

SEQ ID NO: 470773 - DNA, 16 bp, R. norvegicus
acatcatcatcatcat

SEQ ID NO: 470774 - DNA, 16 bp, R. norvegicus
acatcatcatctcatt

SEQ ID NO: 470775 - DNA, 16 bp, R. norvegicus
acatcattgccagcat

SEQ ID NO: 470776 - DNA, 16 bp, R. norvegicus
acatccacatgcacat

SEQ ID NO: 470777 - DNA, 18 bp, R. norvegicus
acatccactctatcacca

SEQ ID NO: 470778 - DNA, 16 bp, R. norvegicus
acatccagagcacgtc

SEQ ID NO: 470779 - DNA, 16 bp, R. norvegicus
acatccaggaattcca

SEQ ID NO: 470780 - DNA, 16 bp, R. norvegicus
acatccatacagacat

SEQ ID NO: 470781 - DNA, 16 bp, R. norvegicus
acatccatcagaatgg

SEQ ID NO: 470782 - DNA, 16 bp, R. norvegicus
acatcccattcactgc

SEQ ID NO: 470783 - DNA, 21 bp, R. norvegicus
acatccccatggctctctacc

SEQ ID NO: 470784 - DNA, 16 bp, R. norvegicus
acatccctagaacaaa

SEQ ID NO: 470785 - DNA, 16 bp, R. norvegicus
acatccgtctcctgtc

SEQ ID NO: 470786 - DNA, 16 bp, R. norvegicus
acatcctcaacagcat

SEQ ID NO: 470787 - DNA, 16 bp, R. norvegicus
acatcctcaccaccat

SEQ ID NO: 470788 - DNA, 16 bp, R. norvegicus
acatcctcaccagcat

SEQ ID NO: 470789 - DNA, 16 bp, R. norvegicus
acatcctcaccagctt

SEQ ID NO: 470790 - DNA, 16 bp, R. norvegicus
acatcctccccaacat

SEQ ID NO: 470791 - DNA, 16 bp, R. norvegicus
acatcctccccagcat

SEQ ID NO: 470792 - DNA, 16 bp, R. norvegicus
acatcctcctgcctca

SEQ ID NO: 470793 - DNA, 31 bp, R. norvegicus
acatcctcgccagcatctgctgtcacctgaa

SEQ ID NO: 470794 - DNA, 16 bp, R. norvegicus
acatcctctcacaaga

SEQ ID NO: 470795 - DNA, 16 bp, R. norvegicus
acatcctgatcacagc

SEQ ID NO: 470796 - DNA, 16 bp, R. norvegicus
acatcctgctgactaa

SEQ ID NO: 470797 - DNA, 16 bp, R. norvegicus
acatcctggacagcat

SEQ ID NO: 470798 - DNA, 16 bp, R. norvegicus
acatcctgggctacat

SEQ ID NO: 470799 - DNA, 16 bp, R. norvegicus
acatccttaatcccag

SEQ ID NO: 470800 - DNA, 16 bp, R. norvegicus
acatccttgccagcat

SEQ ID NO: 470801 - DNA, 16 bp, R. norvegicus
acatctaaggctcagg

SEQ ID NO: 470802 - DNA, 16 bp, R. norvegicus
acatctaccccatcaa

SEQ ID NO: 470803 - DNA, 35 bp, R. norvegicus
acatctcaatgcccatgcacagcttgatggagtta

SEQ ID NO: 470804 - DNA, 16 bp, R. norvegicus
acatctctgaagaaag

SEQ ID NO: 470805 - DNA, 16 bp, R. norvegicus
acatctgacatcagga

SEQ ID NO: 470806 - DNA, 16 bp, R. norvegicus
acatctgctacatctg

SEQ ID NO: 470807 - DNA, 16 bp, R. norvegicus
acatctggctcctgtc

SEQ ID NO: 470808 - DNA, 16 bp, R. norvegicus
acatctggggaagaag

SEQ ID NO: 470809 - DNA, 16 bp, R. norvegicus
acatctggtccctgtc

SEQ ID NO: 470810 - DNA, 16 bp, R. norvegicus
acatctgtaaaagaaa

SEQ ID NO: 470811 - DNA, 16 bp, R. norvegicus
acatctgtagtcatca

SEQ ID NO: 470812 - DNA, 16 bp, R. norvegicus
acatctgtgaccccag

SEQ ID NO: 470813 - DNA, 16 bp, R. norvegicus
acatcttcaaagaaga

SEQ ID NO: 470814 - DNA, 16 bp, R. norvegicus
acatcttcaacaaaaa

SEQ ID NO: 470815 - DNA, 16 bp, R. norvegicus
acatcttcatatgaag

SEQ ID NO: 470816 - DNA, 16 bp, R. norvegicus
acatcttccagggctg

SEQ ID NO: 470817 - DNA, 16 bp, R. norvegicus
acatcttgattcacag

SEQ ID NO: 470818 - DNA, 16 bp, R. norvegicus
acatcttgcaggcagg

SEQ ID NO: 470819 - DNA, 16 bp, R. norvegicus
acatctttaacaaatg

SEQ ID NO: 470820 - DNA, 16 bp, R. norvegicus
acatgaaaatggaaat

SEQ ID NO: 470821 - DNA, 16 bp, R. norvegicus
acatgaaagaacacac

SEQ ID NO: 470822 - DNA, 16 bp, R. norvegicus
acatgaaagaacgcac

SEQ ID NO: 470823 - DNA, 16 bp, R. norvegicus
acatgaaaggacacat

SEQ ID NO: 470824 - DNA, 16 bp, R. norvegicus
acatgaaatataaaat

SEQ ID NO: 470825 - DNA, 16 bp, R. norvegicus
acatgaacaaagtggc

SEQ ID NO: 470826 - DNA, 16 bp, R. norvegicus
acatgaacagatccat

SEQ ID NO: 470827 - DNA, 16 bp, R. norvegicus
acatgaacatgaacat

SEQ ID NO: 470828 - DNA, 16 bp, R. norvegicus
acatgaacatgcatgc

SEQ ID NO: 470829 - DNA, 16 bp, R. norvegicus
acatgaagaagaatgc

SEQ ID NO: 470830 - DNA, 16 bp, R. norvegicus
acatgaagaccaagat

SEQ ID NO: 470831 - DNA, 16 bp, R. norvegicus
acatgaagctcaagaa

SEQ ID NO: 470832 - DNA, 16 bp, R. norvegicus
acatgaagttcaagaa

SEQ ID NO: 470833 - DNA, 16 bp, R. norvegicus
acatgaagttggaagg

SEQ ID NO: 470834 - DNA, 16 bp, R. norvegicus
acatgaatgcatacat

SEQ ID NO: 470835 - DNA, 16 bp, R. norvegicus
acatgaatgctgggaa

SEQ ID NO: 470836 - DNA, 16 bp, R. norvegicus
acatgacagaaaaaga

SEQ ID NO: 470837 - DNA, 16 bp, R. norvegicus
acatgagaaaacattc

SEQ ID NO: 470838 - DNA, 16 bp, R. norvegicus
acatgagtattttgtt

SEQ ID NO: 470839 - DNA, 16 bp, R. norvegicus
acatgatcatttcctt

SEQ ID NO: 470840 - DNA, 16 bp, R. norvegicus
acatgatcttctgggc

SEQ ID NO: 470841 - DNA, 16 bp, R. norvegicus
acatgatgcacataca

SEQ ID NO: 470842 - DNA, 16 bp, R. norvegicus
acatgattaaaaataa

SEQ ID NO: 470843 - DNA, 16 bp, R. norvegicus
acatgcaagcagaaca

SEQ ID NO: 470844 - DNA, 16 bp, R. norvegicus
acatgcacacacatat

SEQ ID NO: 470845 - DNA, 16 bp, R. norvegicus
acatgcacacacccac

SEQ ID NO: 470846 - DNA, 16 bp, R. norvegicus
acatgcacacagcaca

SEQ ID NO: 470847 - DNA, 16 bp, R. norvegicus
acatgcacacccacat

SEQ ID NO: 470848 - DNA, 16 bp, R. norvegicus
acatgcacagacatat

SEQ ID NO: 470849 - DNA, 16 bp, R. norvegicus
acatgcacataggcac

SEQ ID NO: 470850 - DNA, 16 bp, R. norvegicus
acatgcagacagagca

SEQ ID NO: 470851 - DNA, 16 bp, R. norvegicus
acatgcagagaccaga

SEQ ID NO: 470852 - DNA, 16 bp, R. norvegicus
acatgcaggaaatcca

SEQ ID NO: 470853 - DNA, 16 bp, R. norvegicus
acatgcaggcaaaaca

SEQ ID NO: 470854 - DNA, 16 bp, R. norvegicus
acatgcagtgcacata

SEQ ID NO: 470855 - DNA, 16 bp, R. norvegicus
acatgcatgcacagag

SEQ ID NO: 470856 - DNA, 16 bp, R. norvegicus
acatgcatttacacac

SEQ ID NO: 470857 - DNA, 16 bp, R. norvegicus
acatgccaggaaagca

SEQ ID NO: 470858 - DNA, 16 bp, R. norvegicus
acatgcccacacacac

SEQ ID NO: 470859 - DNA, 16 bp, R. norvegicus
acatgcctagcaagca

SEQ ID NO: 470860 - DNA, 16 bp, R. norvegicus
acatgcctttaatacc

SEQ ID NO: 470861 - DNA, 16 bp, R. norvegicus
acatgcgcacacagtt

SEQ ID NO: 470862 - DNA, 16 bp, R. norvegicus
acatgctaggcaaatg

SEQ ID NO: 470863 - DNA, 16 bp, R. norvegicus
acatgctgaccaacag

SEQ ID NO: 470864 - DNA, 16 bp, R. norvegicus
acatgctgactgccag

SEQ ID NO: 470865 - DNA, 16 bp, R. norvegicus
acatgctgagaaagaa

SEQ ID NO: 470866 - DNA, 16 bp, R. norvegicus
acatgctgatcctggg

SEQ ID NO: 470867 - DNA, 16 bp, R. norvegicus
acatgctgctgctgct

SEQ ID NO: 470868 - DNA, 16 bp, R. norvegicus
acatgcttgctttagc

SEQ ID NO: 470869 - DNA, 16 bp, R. norvegicus
acatgcttggcccagg

SEQ ID NO: 470870 - DNA, 16 bp, R. norvegicus
acatggaaacagaaac

SEQ ID NO: 470871 - DNA, 16 bp, R. norvegicus
acatggaaactgaaca

SEQ ID NO: 470872 - DNA, 16 bp, R. norvegicus
acatggaaactgaaga

SEQ ID NO: 470873 - DNA, 16 bp, R. norvegicus
acatggaagccagaag

SEQ ID NO: 470874 - DNA, 16 bp, R. norvegicus
acatggaagttgaaca

SEQ ID NO: 470875 - DNA, 16 bp, R. norvegicus
acatggaatctcaggg

SEQ ID NO: 470876 - DNA, 16 bp, R. norvegicus
acatggacagccccat

SEQ ID NO: 470877 - DNA, 16 bp, R. norvegicus
acatggaccacagaca

SEQ ID NO: 470878 - DNA, 16 bp, R. norvegicus
acatggagacaaaaca

SEQ ID NO: 470879 - DNA, 18 bp, R. norvegicus
acatggagagtgcctttg

SEQ ID NO: 470880 - DNA, 16 bp, R. norvegicus
acatggaggagaagga

SEQ ID NO: 470881 - DNA, 16 bp, R. norvegicus
acatggagggagccat

SEQ ID NO: 470882 - DNA, 16 bp, R. norvegicus
acatggatatatacat

SEQ ID NO: 470883 - DNA, 16 bp, R. norvegicus
acatggatgctaggaa

SEQ ID NO: 470884 - DNA, 16 bp, R. norvegicus
acatggatgctgggaa

SEQ ID NO: 470885 - DNA, 16 bp, R. norvegicus
acatggcacacagaca

SEQ ID NO: 470886 - DNA, 16 bp, R. norvegicus
acatggcagctcccag

SEQ ID NO: 470887 - DNA, 16 bp, R. norvegicus
acatggcagtggatgt

SEQ ID NO: 470888 - DNA, 16 bp, R. norvegicus
acatggcatgcactca

SEQ ID NO: 470889 - DNA, 16 bp, R. norvegicus
acatggcctccaagga

SEQ ID NO: 470890 - DNA, 16 bp, R. norvegicus
acatggctcagcagtt

SEQ ID NO: 470891 - DNA, 16 bp, R. norvegicus
acatgggcacacacag

SEQ ID NO: 470892 - DNA, 16 bp, R. norvegicus
acatgggcactgagaa

SEQ ID NO: 470893 - DNA, 16 bp, R. norvegicus
acatgggccctgggga

SEQ ID NO: 470894 - DNA, 16 bp, R. norvegicus
acatgggtcctggaga

SEQ ID NO: 470895 - DNA, 16 bp, R. norvegicus
acatggtaggaagaga

SEQ ID NO: 470896 - DNA, 16 bp, R. norvegicus
acatggtatacagaca

SEQ ID NO: 470897 - DNA, 33 bp, R. norvegicus
acatggtatgcactcattgataagtagctatta

SEQ ID NO: 470898 - DNA, 16 bp, R. norvegicus
acatggtatgccctca

SEQ ID NO: 470899 - DNA, 16 bp, R. norvegicus
acatggtctgtgagtt

SEQ ID NO: 470900 - DNA, 16 bp, R. norvegicus
acatggtgacacacac

SEQ ID NO: 470901 - DNA, 16 bp, R. norvegicus
acatggtgctggaaaa

SEQ ID NO: 470902 - DNA, 16 bp, R. norvegicus
acatggtggaagaaaa

SEQ ID NO: 470903 - DNA, 16 bp, R. norvegicus
acatggtggaagggga

SEQ ID NO: 470904 - DNA, 16 bp, R. norvegicus
acatggtggagggaga

SEQ ID NO: 470905 - DNA, 16 bp, R. norvegicus
acatggtggctcacag

SEQ ID NO: 470906 - DNA, 16 bp, R. norvegicus
acatggtggctgacaa

SEQ ID NO: 470907 - DNA, 16 bp, R. norvegicus
acatggtgggacccat

SEQ ID NO: 470908 - DNA, 16 bp, R. norvegicus
acatggtgggaggaga

SEQ ID NO: 470909 - DNA, 16 bp, R. norvegicus
acatggtggtgcacac

SEQ ID NO: 470910 - DNA, 16 bp, R. norvegicus
acatggttgaacaagt

SEQ ID NO: 470911 - DNA, 16 bp, R. norvegicus
acatggtttatttgtt

SEQ ID NO: 470912 - DNA, 16 bp, R. norvegicus
acatgtaaaaatatat

SEQ ID NO: 470913 - DNA, 16 bp, R. norvegicus
acatgtaaatacacat

SEQ ID NO: 470914 - DNA, 16 bp, R. norvegicus
acatgtaaattaaaaa

SEQ ID NO: 470915 - DNA, 16 bp, R. norvegicus
acatgtacacacacgt

SEQ ID NO: 470916 - DNA, 16 bp, R. norvegicus
acatgtagaagaataa

SEQ ID NO: 470917 - DNA, 16 bp, R. norvegicus
acatgtatataatgca

SEQ ID NO: 470918 - DNA, 16 bp, R. norvegicus
acatgtatatatgtat

SEQ ID NO: 470919 - DNA, 16 bp, R. norvegicus
acatgtatgaaattct

SEQ ID NO: 470920 - DNA, 16 bp, R. norvegicus
acatgtattgtcactt

SEQ ID NO: 470921 - DNA, 16 bp, R. norvegicus
acatgtatttatattt

SEQ ID NO: 470922 - DNA, 16 bp, R. norvegicus
acatgtctgtctgtgt

SEQ ID NO: 470923 - DNA, 16 bp, R. norvegicus
acatgtctttaggtgc

SEQ ID NO: 470924 - DNA, 16 bp, R. norvegicus
acatgtgaattcacag

SEQ ID NO: 470925 - DNA, 16 bp, R. norvegicus
acatgtgagcaaaaca

SEQ ID NO: 470926 - DNA, 16 bp, R. norvegicus
acatgtgcacgtgcac

SEQ ID NO: 470927 - DNA, 16 bp, R. norvegicus
acatgtgcatatgcac

SEQ ID NO: 470928 - DNA, 16 bp, R. norvegicus
acatgtgcatatgtat

SEQ ID NO: 470929 - DNA, 16 bp, R. norvegicus
acatgtggaagttaga

SEQ ID NO: 470930 - DNA, 16 bp, R. norvegicus
acatgtggagcacaga

SEQ ID NO: 470931 - DNA, 16 bp, R. norvegicus
acatgtggtgcacaca

SEQ ID NO: 470932 - DNA, 16 bp, R. norvegicus
acatgtggtgcacata

SEQ ID NO: 470933 - DNA, 16 bp, R. norvegicus
acatgtgtgcagatgt

SEQ ID NO: 470934 - DNA, 16 bp, R. norvegicus
acatgtgtgcatacat

SEQ ID NO: 470935 - DNA, 16 bp, R. norvegicus
acatgtgtgcctggtg

SEQ ID NO: 470936 - DNA, 16 bp, R. norvegicus
acatgtgtgtttgcat

SEQ ID NO: 470937 - DNA, 16 bp, R. norvegicus
acatgttcatgcatgt

SEQ ID NO: 470938 - DNA, 16 bp, R. norvegicus
acatgttccagtatga

SEQ ID NO: 470939 - DNA, 16 bp, R. norvegicus
acatgttctgactgtg

SEQ ID NO: 470940 - DNA, 16 bp, R. norvegicus
acattaatcaagaaaa

SEQ ID NO: 470941 - DNA, 16 bp, R. norvegicus
acattaccattcataa

SEQ ID NO: 470942 - DNA, 16 bp, R. norvegicus
acattcacacagagac

SEQ ID NO: 470943 - DNA, 16 bp, R. norvegicus
acattcacatacatgt

SEQ ID NO: 470944 - DNA, 16 bp, R. norvegicus
acattcagacaaaaca

SEQ ID NO: 470945 - DNA, 16 bp, R. norvegicus
acattcatgcatgcat

SEQ ID NO: 470946 - DNA, 16 bp, R. norvegicus
acattccacaacttga

SEQ ID NO: 470947 - DNA, 16 bp, R. norvegicus
acattccactgcctga

SEQ ID NO: 470948 - DNA, 16 bp, R. norvegicus
acattcctccattgct

SEQ ID NO: 470949 - DNA, 16 bp, R. norvegicus
acattcctgactcaag

SEQ ID NO: 470950 - DNA, 17 bp, R. norvegicus
acattcgccaccacaag

SEQ ID NO: 470951 - DNA, 16 bp, R. norvegicus
acattcttaacaaaat

SEQ ID NO: 470952 - DNA, 16 bp, R. norvegicus
acattgaattcatctg

SEQ ID NO: 470953 - DNA, 16 bp, R. norvegicus
acattgatgaagccaa

SEQ ID NO: 470954 - DNA, 16 bp, R. norvegicus
acattgatgaatttct

SEQ ID NO: 470955 - DNA, 16 bp, R. norvegicus
acattgatttttatgt

SEQ ID NO: 470956 - DNA, 16 bp, R. norvegicus
acattgctgagcggct

SEQ ID NO: 470957 - DNA, 16 bp, R. norvegicus
acattgctgttcgtca

SEQ ID NO: 470958 - DNA, 16 bp, R. norvegicus
acattggaaaggaaaa

SEQ ID NO: 470959 - DNA, 16 bp, R. norvegicus
acattggagcatcttt

SEQ ID NO: 470960 - DNA, 16 bp, R. norvegicus
acattggattccatta

SEQ ID NO: 470961 - DNA, 16 bp, R. norvegicus
acattggcacagggga

SEQ ID NO: 470962 - DNA, 16 bp, R. norvegicus
acattgtagctgtctc

SEQ ID NO: 470963 - DNA, 16 bp, R. norvegicus
acattgtatctgcagt

SEQ ID NO: 470964 - DNA, 16 bp, R. norvegicus
acattgtatgcactca

SEQ ID NO: 470965 - DNA, 16 bp, R. norvegicus
acattgtgctacctga

SEQ ID NO: 470966 - DNA, 16 bp, R. norvegicus
acattgtgttttcttt

SEQ ID NO: 470967 - DNA, 16 bp, R. norvegicus
acattgttacattgtt

SEQ ID NO: 470968 - DNA, 16 bp, R. norvegicus
acattgttttaaaaaa

SEQ ID NO: 470969 - DNA, 16 bp, R. norvegicus
acatttaaaaaaaagt

SEQ ID NO: 470970 - DNA, 16 bp, R. norvegicus
acatttaaagaaatat

SEQ ID NO: 470971 - DNA, 16 bp, R. norvegicus
acatttaatcatttaa

SEQ ID NO: 470972 - DNA, 16 bp, R. norvegicus
acatttacaaaatgga

SEQ ID NO: 470973 - DNA, 16 bp, R. norvegicus
acatttatttaatgtg

SEQ ID NO: 470974 - DNA, 16 bp, R. norvegicus
acatttatttggggct

SEQ ID NO: 470975 - DNA, 16 bp, R. norvegicus
acatttatttgtgtgt

SEQ ID NO: 470976 - DNA, 16 bp, R. norvegicus
acatttcaagtgtcat

SEQ ID NO: 470977 - DNA, 16 bp, R. norvegicus
acatttcacattcaaa

SEQ ID NO: 470978 - DNA, 16 bp, R. norvegicus
acatttcatcctaaag

SEQ ID NO: 470979 - DNA, 16 bp, R. norvegicus
acatttcatctctgct

SEQ ID NO: 470980 - DNA, 16 bp, R. norvegicus
acatttcattcagcct

SEQ ID NO: 470981 - DNA, 16 bp, R. norvegicus
acatttcatttgttat

SEQ ID NO: 470982 - DNA, 16 bp, R. norvegicus
acatttccatttattt

SEQ ID NO: 470983 - DNA, 16 bp, R. norvegicus
acatttcccattcaaa

SEQ ID NO: 470984 - DNA, 16 bp, R. norvegicus
acatttccttcatcca

SEQ ID NO: 470985 - DNA, 16 bp, R. norvegicus
acatttctgttttcat

SEQ ID NO: 470986 - DNA, 16 bp, R. norvegicus
acatttgaaaataaaa

SEQ ID NO: 470987 - DNA, 16 bp, R. norvegicus
acatttgaaaatgaaa

SEQ ID NO: 470988 - DNA, 16 bp, R. norvegicus
acatttgaaatgcaga

SEQ ID NO: 470989 - DNA, 16 bp, R. norvegicus
acatttgggttatttc

SEQ ID NO: 470990 - DNA, 16 bp, R. norvegicus
acatttgggttgcttc

SEQ ID NO: 470991 - DNA, 16 bp, R. norvegicus
acatttgtatatattt

SEQ ID NO: 470992 - DNA, 16 bp, R. norvegicus
acattttaaaaagcaa

SEQ ID NO: 470993 - DNA, 16 bp, R. norvegicus
acattttaaaaatgtt

SEQ ID NO: 470994 - DNA, 16 bp, R. norvegicus
acattttaaaatgtct

SEQ ID NO: 470995 - DNA, 16 bp, R. norvegicus
acattttaaatgtttt

SEQ ID NO: 470996 - DNA, 16 bp, R. norvegicus
acattttagaagaaaa

SEQ ID NO: 470997 - DNA, 16 bp, R. norvegicus
acattttatatgttat

SEQ ID NO: 470998 - DNA, 16 bp, R. norvegicus
acattttattaaatgt

SEQ ID NO: 470999 - DNA, 16 bp, R. norvegicus
acattttcatctgaaa

SEQ ID NO: 471000 - DNA, 16 bp, R. norvegicus
acattttccttatcca

SEQ ID NO: 471001 - DNA, 16 bp, R. norvegicus
acattttctgttttct

SEQ ID NO: 471002 - DNA, 16 bp, R. norvegicus
acattttctttgtcca

SEQ ID NO: 471003 - DNA, 16 bp, R. norvegicus
acattttgaaaaagaa

SEQ ID NO: 471004 - DNA, 16 bp, R. norvegicus
acattttgatcatcta

SEQ ID NO: 471005 - DNA, 16 bp, R. norvegicus
acattttgctgcctac

SEQ ID NO: 471006 - DNA, 16 bp, R. norvegicus
acatttttaaaaagaa

SEQ ID NO: 471007 - DNA, 16 bp, R. norvegicus
acatttttaaagaaaa

SEQ ID NO: 471008 - DNA, 16 bp, R. norvegicus
acatttttaaagaaat

SEQ ID NO: 471009 - DNA, 16 bp, R. norvegicus
acatttttacaatatt

SEQ ID NO: 471010 - DNA, 16 bp, R. norvegicus
acatttttatgaaaat

SEQ ID NO: 471011 - DNA, 16 bp, R. norvegicus
acatttttttctgaat

SEQ ID NO: 471012 - DNA, 16 bp, R. norvegicus
accaaaaacaagttgg

SEQ ID NO: 471013 - DNA, 16 bp, R. norvegicus
accaaaaatagaggag

SEQ ID NO: 471014 - DNA, 16 bp, R. norvegicus
accaaaaatggaggaa

SEQ ID NO: 471015 - DNA, 16 bp, R. norvegicus
accaaaaccttacagc

SEQ ID NO: 471016 - DNA, 16 bp, R. norvegicus
accaaaagcaacttga

SEQ ID NO: 471017 - DNA, 16 bp, R. norvegicus
accaaaagccatcaaa

SEQ ID NO: 471018 - DNA, 16 bp, R. norvegicus
accaaaagctggtttt

SEQ ID NO: 471019 - DNA, 58 bp, R. norvegicus
accaaaagttggttctttgagaaaatcaacaagatagataaacccttagccagactaa

SEQ ID NO: 471020 - DNA, 16 bp, R. norvegicus
accaaaatacaaatgc

SEQ ID NO: 471021 - DNA, 16 bp, R. norvegicus
accaaaatcagaaatg

SEQ ID NO: 471022 - DNA, 16 bp, R. norvegicus
accaaacaagtgaatg

SEQ ID NO: 471023 - DNA, 16 bp, R. norvegicus
accaaacaggaatcag

SEQ ID NO: 471024 - DNA, 16 bp, R. norvegicus
accaaacccagacact

SEQ ID NO: 471025 - DNA, 16 bp, R. norvegicus
accaaaccctaacact

SEQ ID NO: 471026 - DNA, 16 bp, R. norvegicus
accaaagaaaatactg

SEQ ID NO: 471027 - DNA, 16 bp, R. norvegicus
accaaagaacttcttg

SEQ ID NO: 471028 - DNA, 16 bp, R. norvegicus
accaaagagtacacag

SEQ ID NO: 471029 - DNA, 16 bp, R. norvegicus
accaaagcaaacaagg

SEQ ID NO: 471030 - DNA, 16 bp, R. norvegicus
accaaaggcttcttct

SEQ ID NO: 471031 - DNA, 16 bp, R. norvegicus
accaaagtccaacttg

SEQ ID NO: 471032 - DNA, 16 bp, R. norvegicus
accaaagttcaatcag

SEQ ID NO: 471033 - DNA, 16 bp, R. norvegicus
accaaatccaagacca

SEQ ID NO: 471034 - DNA, 16 bp, R. norvegicus
accaaatgaatttaac

SEQ ID NO: 471035 - DNA, 16 bp, R. norvegicus
accaaattacttagat

SEQ ID NO: 471036 - DNA, 16 bp, R. norvegicus
accaaattccttctct

SEQ ID NO: 471037 - DNA, 16 bp, R. norvegicus
accaaattggactttg

SEQ ID NO: 471038 - DNA, 16 bp, R. norvegicus
accaacaaaggaggag

SEQ ID NO: 471039 - DNA, 16 bp, R. norvegicus
accaacaacagcagca

SEQ ID NO: 471040 - DNA, 17 bp, R. norvegicus
accaacaatggaggagc

SEQ ID NO: 471041 - DNA, 16 bp, R. norvegicus
accaacactacatggc

SEQ ID NO: 471042 - DNA, 16 bp, R. norvegicus
accaacactggctact

SEQ ID NO: 471043 - DNA, 16 bp, R. norvegicus
accaacacttctgctc

SEQ ID NO: 471044 - DNA, 16 bp, R. norvegicus
accaacagagagagag

SEQ ID NO: 471045 - DNA, 16 bp, R. norvegicus
accaacagagccaact

SEQ ID NO: 471046 - DNA, 16 bp, R. norvegicus
accaacagagtcaaat

SEQ ID NO: 471047 - DNA, 16 bp, R. norvegicus
accaacagtcaactaa

SEQ ID NO: 471048 - DNA, 16 bp, R. norvegicus
accaacagttgaacca

SEQ ID NO: 471049 - DNA, 16 bp, R. norvegicus
accaaccagatctccc

SEQ ID NO: 471050 - DNA, 16 bp, R. norvegicus
accaaccattgaactg

SEQ ID NO: 471051 - DNA, 16 bp, R. norvegicus
accaacccagctacaa

SEQ ID NO: 471052 - DNA, 16 bp, R. norvegicus
accaaccctgacctca

SEQ ID NO: 471053 - DNA, 16 bp, R. norvegicus
accaacctggcagcat

SEQ ID NO: 471054 - DNA, 16 bp, R. norvegicus
accaactccaccttca

SEQ ID NO: 471055 - DNA, 16 bp, R. norvegicus
accaactgaaccacat

SEQ ID NO: 471056 - DNA, 16 bp, R. norvegicus
accaactggagaccaa

SEQ ID NO: 471057 - DNA, 16 bp, R. norvegicus
accaacttctgtccta

SEQ ID NO: 471058 - DNA, 21 bp, R. norvegicus
accaacttgtctgctgcaaga

SEQ ID NO: 471059 - DNA, 16 bp, R. norvegicus
accaagaaataaaacc

SEQ ID NO: 471060 - DNA, 16 bp, R. norvegicus
accaagaagacctgtg

SEQ ID NO: 471061 - DNA, 16 bp, R. norvegicus
accaagaattcaaaca

SEQ ID NO: 471062 - DNA, 16 bp, R. norvegicus
accaagacaactttta

SEQ ID NO: 471063 - DNA, 16 bp, R. norvegicus
accaagacattttata

SEQ ID NO: 471064 - DNA, 16 bp, R. norvegicus
accaagagcaacttgg

SEQ ID NO: 471065 - DNA, 16 bp, R. norvegicus
accaagagcctctcct

SEQ ID NO: 471066 - DNA, 16 bp, R. norvegicus
accaagagcttcccct

SEQ ID NO: 471067 - DNA, 16 bp, R. norvegicus
accaagaggacatctc

SEQ ID NO: 471068 - DNA, 16 bp, R. norvegicus
accaagaggaggagga

SEQ ID NO: 471069 - DNA, 16 bp, R. norvegicus
accaagatcttccatg

SEQ ID NO: 471070 - DNA, 16 bp, R. norvegicus
accaagatgaactcgc

SEQ ID NO: 471071 - DNA, 58 bp, R. norvegicus
accaagatgaactctcaatcctaaatatctatgccccaaatacaagggcacctacata

SEQ ID NO: 471072 - DNA, 16 bp, R. norvegicus
accaagatgaactctg

SEQ ID NO: 471073 - DNA, 16 bp, R. norvegicus
accaagatggagacag

SEQ ID NO: 471074 - DNA, 17 bp, R. norvegicus
accaagcagtgtccttg

SEQ ID NO: 471075 - DNA, 16 bp, R. norvegicus
accaagccaggcatca

SEQ ID NO: 471076 - DNA, 16 bp, R. norvegicus
accaagcccaggtcct

SEQ ID NO: 471077 - DNA, 16 bp, R. norvegicus
accaagccttcacagg

SEQ ID NO: 471078 - DNA, 16 bp, R. norvegicus
accaagctgcacatat

SEQ ID NO: 471079 - DNA, 16 bp, R. norvegicus
accaagctggacttga

SEQ ID NO: 471080 - DNA, 16 bp, R. norvegicus
accaagctggctttga

SEQ ID NO: 471081 - DNA, 16 bp, R. norvegicus
accaaggacttctcct

SEQ ID NO: 471082 - DNA, 16 bp, R. norvegicus
accaaggagctgattc

SEQ ID NO: 471083 - DNA, 16 bp, R. norvegicus
accaaggatgagtgtg

SEQ ID NO: 471084 - DNA, 16 bp, R. norvegicus
accaaggcagctctga

SEQ ID NO: 471085 - DNA, 16 bp, R. norvegicus
accaaggccagggaag

SEQ ID NO: 471086 - DNA, 16 bp, R. norvegicus
accaaggccatgctgg

SEQ ID NO: 471087 - DNA, 16 bp, R. norvegicus
accaaggctgacctgg

SEQ ID NO: 471088 - DNA, 16 bp, R. norvegicus
accaagggcctcccca

SEQ ID NO: 471089 - DNA, 16 bp, R. norvegicus
accaagggcttcccgt

SEQ ID NO: 471090 - DNA, 16 bp, R. norvegicus
accaagggcttctact

SEQ ID NO: 471091 - DNA, 16 bp, R. norvegicus
accaagggcttcttcc

SEQ ID NO: 471092 - DNA, 16 bp, R. norvegicus
accaaggtcttcccct

SEQ ID NO: 471093 - DNA, 16 bp, R. norvegicus
accaagttccaggaca

SEQ ID NO: 471094 - DNA, 16 bp, R. norvegicus
accaagttttctgctg

SEQ ID NO: 471095 - DNA, 16 bp, R. norvegicus
accaatactatacaaa

SEQ ID NO: 471096 - DNA, 16 bp, R. norvegicus
accaatagctttaaat

SEQ ID NO: 471097 - DNA, 16 bp, R. norvegicus
accaatgactcattgt

SEQ ID NO: 471098 - DNA, 16 bp, R. norvegicus
accaatgactggccca

SEQ ID NO: 471099 - DNA, 16 bp, R. norvegicus
accaatgcacataaaa

SEQ ID NO: 471100 - DNA, 16 bp, R. norvegicus
accaatggcttcccct

SEQ ID NO: 471101 - DNA, 16 bp, R. norvegicus
accaatggcttttcct

SEQ ID NO: 471102 - DNA, 16 bp, R. norvegicus
accaatgggaaaagaa

SEQ ID NO: 471103 - DNA, 16 bp, R. norvegicus
accaatgggaagagaa

SEQ ID NO: 471104 - DNA, 16 bp, R. norvegicus
accaatgtaagaaatt

SEQ ID NO: 471105 - DNA, 16 bp, R. norvegicus
accaatgtgatatttt

SEQ ID NO: 471106 - DNA, 16 bp, R. norvegicus
accaattttctgagga

SEQ ID NO: 471107 - DNA, 16 bp, R. norvegicus
accaatttttccctat

SEQ ID NO: 471108 - DNA, 16 bp, R. norvegicus
accacaacccttgata

SEQ ID NO: 471109 - DNA, 16 bp, R. norvegicus
accacaactggagaca

SEQ ID NO: 471110 - DNA, 16 bp, R. norvegicus
accacaagaaaaccta

SEQ ID NO: 471111 - DNA, 16 bp, R. norvegicus
accacaagatggcact

SEQ ID NO: 471112 - DNA, 16 bp, R. norvegicus
accacaaggctttcca

SEQ ID NO: 471113 - DNA, 16 bp, R. norvegicus
accacacacagctgca

SEQ ID NO: 471114 - DNA, 16 bp, R. norvegicus
accacacagtggctca

SEQ ID NO: 471115 - DNA, 16 bp, R. norvegicus
accacacatccaagaa

SEQ ID NO: 471116 - DNA, 16 bp, R. norvegicus
accacacccagctatg

SEQ ID NO: 471117 - DNA, 16 bp, R. norvegicus
accacacccagctcca

SEQ ID NO: 471118 - DNA, 16 bp, R. norvegicus
accacacccagctctg

SEQ ID NO: 471119 - DNA, 16 bp, R. norvegicus
accacaccctcagcag

SEQ ID NO: 471120 - DNA, 16 bp, R. norvegicus
accacacctggccagt

SEQ ID NO: 471121 - DNA, 16 bp, R. norvegicus
accacagacacagaca

SEQ ID NO: 471122 - DNA, 16 bp, R. norvegicus
accacagacatcaaca

SEQ ID NO: 471123 - DNA, 16 bp, R. norvegicus
accacagagaaaggag

SEQ ID NO: 471124 - DNA, 16 bp, R. norvegicus
accacagatgccagcc

SEQ ID NO: 471125 - DNA, 16 bp, R. norvegicus
accacagcaaatactg

SEQ ID NO: 471126 - DNA, 16 bp, R. norvegicus
accacagcaagtctta

SEQ ID NO: 471127 - DNA, 16 bp, R. norvegicus
accacagcagcagcag

SEQ ID NO: 471128 - DNA, 16 bp, R. norvegicus
accacagccaaggcaa

SEQ ID NO: 471129 - DNA, 16 bp, R. norvegicus
accacagccaccacag

SEQ ID NO: 471130 - DNA, 16 bp, R. norvegicus
accacagcccagcctg

SEQ ID NO: 471131 - DNA, 16 bp, R. norvegicus
accacagcctgaaggc

SEQ ID NO: 471132 - DNA, 16 bp, R. norvegicus
accacaggaacaactt

SEQ ID NO: 471133 - DNA, 16 bp, R. norvegicus
accacaggaagaacaa

SEQ ID NO: 471134 - DNA, 16 bp, R. norvegicus
accacaggcttgccca

SEQ ID NO: 471135 - DNA, 16 bp, R. norvegicus
accacagtatgaggaa

SEQ ID NO: 471136 - DNA, 16 bp, R. norvegicus
accacagtgacctttg

SEQ ID NO: 471137 - DNA, 16 bp, R. norvegicus
accacagtgccccaga

SEQ ID NO: 471138 - DNA, 16 bp, R. norvegicus
accacagtgccccagg

SEQ ID NO: 471139 - DNA, 16 bp, R. norvegicus
accacagtgtcctctg

SEQ ID NO: 471140 - DNA, 16 bp, R. norvegicus
accacatccctggccc

SEQ ID NO: 471141 - DNA, 16 bp, R. norvegicus
accacatctctctctc

SEQ ID NO: 471142 - DNA, 16 bp, R. norvegicus
accacatgaaactcaa

SEQ ID NO: 471143 - DNA, 16 bp, R. norvegicus
accacatgcatacagt

SEQ ID NO: 471144 - DNA, 16 bp, R. norvegicus
accacatgtatgcagt

SEQ ID NO: 471145 - DNA, 16 bp, R. norvegicus
accacattttatttat

SEQ ID NO: 471146 - DNA, 16 bp, R. norvegicus
accacattttctttct

SEQ ID NO: 471147 - DNA, 16 bp, R. norvegicus
accaccaaagaaaatg

SEQ ID NO: 471148 - DNA, 16 bp, R. norvegicus
accaccaaccaagaag

SEQ ID NO: 471149 - DNA, 16 bp, R. norvegicus
accaccaagaacagca

SEQ ID NO: 471150 - DNA, 16 bp, R. norvegicus
accaccacaaccagct

SEQ ID NO: 471151 - DNA, 16 bp, R. norvegicus
accaccaccaccatga

SEQ ID NO: 471152 - DNA, 16 bp, R. norvegicus
accaccaccaccatta

SEQ ID NO: 471153 - DNA, 16 bp, R. norvegicus
accaccaccaccattt

SEQ ID NO: 471154 - DNA, 16 bp, R. norvegicus
accaccaccacccctg

SEQ ID NO: 471155 - DNA, 16 bp, R. norvegicus
accaccaccaccgtca

SEQ ID NO: 471156 - DNA, 16 bp, R. norvegicus
accaccaccacctctg

SEQ ID NO: 471157 - DNA, 16 bp, R. norvegicus
accaccaccactacta

SEQ ID NO: 471158 - DNA, 16 bp, R. norvegicus
accaccaccactgcca

SEQ ID NO: 471159 - DNA, 16 bp, R. norvegicus
accaccaccatcatca

SEQ ID NO: 471160 - DNA, 16 bp, R. norvegicus
accaccaccatgacca

SEQ ID NO: 471161 - DNA, 16 bp, R. norvegicus
accaccacctggctgt

SEQ ID NO: 471162 - DNA, 16 bp, R. norvegicus
accaccactaccatca

SEQ ID NO: 471163 - DNA, 16 bp, R. norvegicus
accaccactgcctggc

SEQ ID NO: 471164 - DNA, 16 bp, R. norvegicus
accaccactggctaaa

SEQ ID NO: 471165 - DNA, 16 bp, R. norvegicus
accaccagaagttctt

SEQ ID NO: 471166 - DNA, 16 bp, R. norvegicus
accaccagcaccagca

SEQ ID NO: 471167 - DNA, 16 bp, R. norvegicus
accaccagcagcacca

SEQ ID NO: 471168 - DNA, 19 bp, R. norvegicus
accaccagcagcagcagca

SEQ ID NO: 471169 - DNA, 16 bp, R. norvegicus
accaccagcatcacca

SEQ ID NO: 471170 - DNA, 16 bp, R. norvegicus
accaccagcccagaga

SEQ ID NO: 471171 - DNA, 16 bp, R. norvegicus
accaccagcctgggga

SEQ ID NO: 471172 - DNA, 16 bp, R. norvegicus
accaccagctggggac

SEQ ID NO: 471173 - DNA, 16 bp, R. norvegicus
accaccaggcctggct

SEQ ID NO: 471174 - DNA, 16 bp, R. norvegicus
accaccatcactgcca

SEQ ID NO: 471175 - DNA, 16 bp, R. norvegicus
accaccatcagcacca

SEQ ID NO: 471176 - DNA, 16 bp, R. norvegicus
accaccatcagcagca

SEQ ID NO: 471177 - DNA, 16 bp, R. norvegicus
accaccatcatcactg

SEQ ID NO: 471178 - DNA, 17 bp, R. norvegicus
accaccatcatcatcac

SEQ ID NO: 471179 - DNA, 16 bp, R. norvegicus
accaccatgccctgct

SEQ ID NO: 471180 - DNA, 16 bp, R. norvegicus
accaccatgcctgact

SEQ ID NO: 471181 - DNA, 16 bp, R. norvegicus
accacccagagctccc

SEQ ID NO: 471182 - DNA, 16 bp, R. norvegicus
accacccgtaactcca

SEQ ID NO: 471183 - DNA, 16 bp, R. norvegicus
accaccctgagtgtgt

SEQ ID NO: 471184 - DNA, 16 bp, R. norvegicus
accacctacaactcca

SEQ ID NO: 471185 - DNA, 16 bp, R. norvegicus
accacctccagcagaa

SEQ ID NO: 471186 - DNA, 16 bp, R. norvegicus
accacctctggtgggt

SEQ ID NO: 471187 - DNA, 16 bp, R. norvegicus
accacctgcccagaga

SEQ ID NO: 471188 - DNA, 16 bp, R. norvegicus
accacctgcccagggt

SEQ ID NO: 471189 - DNA, 16 bp, R. norvegicus
accacctgtcactcca

SEQ ID NO: 471190 - DNA, 16 bp, R. norvegicus
accacgctggcctcaa

SEQ ID NO: 471191 - DNA, 16 bp, R. norvegicus
accacgtgtctgttct

SEQ ID NO: 471192 - DNA, 16 bp, R. norvegicus
accacgttcactgggg

SEQ ID NO: 471193 - DNA, 16 bp, R. norvegicus
accactcagctattaa

SEQ ID NO: 471194 - DNA, 16 bp, R. norvegicus
accactgaccacctgt

SEQ ID NO: 471195 - DNA, 16 bp, R. norvegicus
accactgagccaaacc

SEQ ID NO: 471196 - DNA, 16 bp, R. norvegicus
accactgagccaaatt

SEQ ID NO: 471197 - DNA, 16 bp, R. norvegicus
accactgagccagctc

SEQ ID NO: 471198 - DNA, 28 bp, R. norvegicus
accactgagctaaatccccagccccgag

SEQ ID NO: 471199 - DNA, 16 bp, R. norvegicus
accactgagctaactc

SEQ ID NO: 471200 - DNA, 16 bp, R. norvegicus
accactgagctgcacc

SEQ ID NO: 471201 - DNA, 16 bp, R. norvegicus
accactgagtcacatc

SEQ ID NO: 471202 - DNA, 16 bp, R. norvegicus
accactgcccagctca

SEQ ID NO: 471203 - DNA, 16 bp, R. norvegicus
accactgcctggcctg

SEQ ID NO: 471204 - DNA, 17 bp, R. norvegicus
accactggtgctcttac

SEQ ID NO: 471205 - DNA, 17 bp, R. norvegicus
accactgtcagaaatag

SEQ ID NO: 471206 - DNA, 23 bp, R. norvegicus
accactgttgccttcacacaggt

SEQ ID NO: 471207 - DNA, 17 bp, R. norvegicus
accagaaaagcaagatt

SEQ ID NO: 471208 - DNA, 16 bp, R. norvegicus
accagaaaataaattc

SEQ ID NO: 471209 - DNA, 16 bp, R. norvegicus
accagaaaggcaagat

SEQ ID NO: 471210 - DNA, 16 bp, R. norvegicus
accagaaccacagatt

SEQ ID NO: 471211 - DNA, 16 bp, R. norvegicus
accagaacctgaaggg

SEQ ID NO: 471212 - DNA, 16 bp, R. norvegicus
accagaagacactgca

SEQ ID NO: 471213 - DNA, 16 bp, R. norvegicus
accagaagagcacatc

SEQ ID NO: 471214 - DNA, 16 bp, R. norvegicus
accagaaggaaacaga

SEQ ID NO: 471215 - DNA, 16 bp, R. norvegicus
accagaaggatcctgt

SEQ ID NO: 471216 - DNA, 16 bp, R. norvegicus
accagaagtgcctggt

SEQ ID NO: 471217 - DNA, 16 bp, R. norvegicus
accagaagtttccact

SEQ ID NO: 471218 - DNA, 16 bp, R. norvegicus
accagaatagactgca

SEQ ID NO: 471219 - DNA, 16 bp, R. norvegicus
accagaattttcgcca

SEQ ID NO: 471220 - DNA, 16 bp, R. norvegicus
accagacatttcgcca

SEQ ID NO: 471221 - DNA, 23 bp, R. norvegicus
accagaccaaggcagagggaggc

SEQ ID NO: 471222 - DNA, 16 bp, R. norvegicus
accagaccagaccaaa

SEQ ID NO: 471223 - DNA, 16 bp, R. norvegicus
accagaccagggatgg

SEQ ID NO: 471224 - DNA, 16 bp, R. norvegicus
accagacctctaaact

SEQ ID NO: 471225 - DNA, 16 bp, R. norvegicus
accagacctctcacca

SEQ ID NO: 471226 - DNA, 16 bp, R. norvegicus
accagacctctgaact

SEQ ID NO: 471227 - DNA, 16 bp, R. norvegicus
accagaccttcaatga

SEQ ID NO: 471228 - DNA, 16 bp, R. norvegicus
accagactcctgtcag

SEQ ID NO: 471229 - DNA, 17 bp, R. norvegicus
accagactctctatggg

SEQ ID NO: 471230 - DNA, 16 bp, R. norvegicus
accagagacagcctga

SEQ ID NO: 471231 - DNA, 16 bp, R. norvegicus
accagagacctggaag

SEQ ID NO: 471232 - DNA, 16 bp, R. norvegicus
accagagactctaaaa

SEQ ID NO: 471233 - DNA, 16 bp, R. norvegicus
accagagagaagcaga

SEQ ID NO: 471234 - DNA, 16 bp, R. norvegicus
accagagagatggctc

SEQ ID NO: 471235 - DNA, 16 bp, R. norvegicus
accagagatcccaggg

SEQ ID NO: 471236 - DNA, 16 bp, R. norvegicus
accagagcacaaccat

SEQ ID NO: 471237 - DNA, 16 bp, R. norvegicus
accagagcctccaggg

SEQ ID NO: 471238 - DNA, 16 bp, R. norvegicus
accagagctaccaggg

SEQ ID NO: 471239 - DNA, 16 bp, R. norvegicus
accagagctcccaggt

SEQ ID NO: 471240 - DNA, 16 bp, R. norvegicus
accagagcttccagaa

SEQ ID NO: 471241 - DNA, 16 bp, R. norvegicus
accagagcttccagga

SEQ ID NO: 471242 - DNA, 16 bp, R. norvegicus
accagaggacccagct

SEQ ID NO: 471243 - DNA, 16 bp, R. norvegicus
accagaggagaaaagt

SEQ ID NO: 471244 - DNA, 16 bp, R. norvegicus
accagagtttcaaaga

SEQ ID NO: 471245 - DNA, 31 bp, R. norvegicus
accagataaacagttctctgcacccaaatcc

SEQ ID NO: 471246 - DNA, 16 bp, R. norvegicus
accagatatttataga

SEQ ID NO: 471247 - DNA, 16 bp, R. norvegicus
accagatttttaaaaa

SEQ ID NO: 471248 - DNA, 16 bp, R. norvegicus
accagcaaacaccagg

SEQ ID NO: 471249 - DNA, 16 bp, R. norvegicus
accagcaaagaccagc

SEQ ID NO: 471250 - DNA, 16 bp, R. norvegicus
accagcaaagagtggc

SEQ ID NO: 471251 - DNA, 16 bp, R. norvegicus
accagcaactgaccaa

SEQ ID NO: 471252 - DNA, 16 bp, R. norvegicus
accagcacaccagcac

SEQ ID NO: 471253 - DNA, 16 bp, R. norvegicus
accagcaccaccagca

SEQ ID NO: 471254 - DNA, 16 bp, R. norvegicus
accagcaccagcacca

SEQ ID NO: 471255 - DNA, 16 bp, R. norvegicus
accagcaccatttcct

SEQ ID NO: 471256 - DNA, 16 bp, R. norvegicus
accagcagcaccacca

SEQ ID NO: 471257 - DNA, 16 bp, R. norvegicus
accagcagcaccagca

SEQ ID NO: 471258 - DNA, 17 bp, R. norvegicus
accagcagcagcagcaa

SEQ ID NO: 471259 - DNA, 16 bp, R. norvegicus
accagcagcccagttc

SEQ ID NO: 471260 - DNA, 16 bp, R. norvegicus
accagcagcctccatc

SEQ ID NO: 471261 - DNA, 16 bp, R. norvegicus
accagcaggcaatgga

SEQ ID NO: 471262 - DNA, 16 bp, R. norvegicus
accagcagtagaggag

SEQ ID NO: 471263 - DNA, 16 bp, R. norvegicus
accagcattcaggagg

SEQ ID NO: 471264 - DNA, 16 bp, R. norvegicus
accagccagccagaga

SEQ ID NO: 471265 - DNA, 16 bp, R. norvegicus
accagccagcctgcca

SEQ ID NO: 471266 - DNA, 16 bp, R. norvegicus
accagccagtacacat

SEQ ID NO: 471267 - DNA, 16 bp, R. norvegicus
accagcccagggatga

SEQ ID NO: 471268 - DNA, 16 bp, R. norvegicus
accagcctaagctaca

SEQ ID NO: 471269 - DNA, 16 bp, R. norvegicus
accagcctctgcctcc

SEQ ID NO: 471270 - DNA, 16 bp, R. norvegicus
accagcctggtctaca

SEQ ID NO: 471271 - DNA, 16 bp, R. norvegicus
accagctaacactaga

SEQ ID NO: 471272 - DNA, 16 bp, R. norvegicus
accagctcaggggtgg

SEQ ID NO: 471273 - DNA, 17 bp, R. norvegicus
accagctccgaaaaaaa

SEQ ID NO: 471274 - DNA, 16 bp, R. norvegicus
accagctctctctctc

SEQ ID NO: 471275 - DNA, 16 bp, R. norvegicus
accagctctggctttc

SEQ ID NO: 471276 - DNA, 16 bp, R. norvegicus
accagctgagccacct

SEQ ID NO: 471277 - DNA, 16 bp, R. norvegicus
accaggaaaacaggaa

SEQ ID NO: 471278 - DNA, 16 bp, R. norvegicus
accaggaaagaaattc

SEQ ID NO: 471279 - DNA, 16 bp, R. norvegicus
accaggaagcagaaag

SEQ ID NO: 471280 - DNA, 16 bp, R. norvegicus
accaggaaggaggaca

SEQ ID NO: 471281 - DNA, 16 bp, R. norvegicus
accaggaccaccacca

SEQ ID NO: 471282 - DNA, 16 bp, R. norvegicus
accaggagaaacagca

SEQ ID NO: 471283 - DNA, 16 bp, R. norvegicus
accaggagagagctgg

SEQ ID NO: 471284 - DNA, 16 bp, R. norvegicus
accaggaggccttttt

SEQ ID NO: 471285 - DNA, 16 bp, R. norvegicus
accaggaggctttctt

SEQ ID NO: 471286 - DNA, 16 bp, R. norvegicus
accaggatgttgagaa

SEQ ID NO: 471287 - DNA, 16 bp, R. norvegicus
accaggcacacacaca

SEQ ID NO: 471288 - DNA, 16 bp, R. norvegicus
accaggcacacatggt

SEQ ID NO: 471289 - DNA, 16 bp, R. norvegicus
accaggcacagccagc

SEQ ID NO: 471290 - DNA, 16 bp, R. norvegicus
accaggcaccaggcac

SEQ ID NO: 471291 - DNA, 16 bp, R. norvegicus
accaggcagcagacac

SEQ ID NO: 471292 - DNA, 16 bp, R. norvegicus
accaggcagcatacat

SEQ ID NO: 471293 - DNA, 16 bp, R. norvegicus
accaggcagtcctctg

SEQ ID NO: 471294 - DNA, 16 bp, R. norvegicus
accaggcatacatgtg

SEQ ID NO: 471295 - DNA, 16 bp, R. norvegicus
accaggccaagcagga

SEQ ID NO: 471296 - DNA, 16 bp, R. norvegicus
accaggctgccctgga

SEQ ID NO: 471297 - DNA, 16 bp, R. norvegicus
accaggctgctctcaa

SEQ ID NO: 471298 - DNA, 16 bp, R. norvegicus
accaggctgctttctt

SEQ ID NO: 471299 - DNA, 16 bp, R. norvegicus
accaggctggcactga

SEQ ID NO: 471300 - DNA, 16 bp, R. norvegicus
accaggctggcctccg

SEQ ID NO: 471301 - DNA, 16 bp, R. norvegicus
accaggctggccttca

SEQ ID NO: 471302 - DNA, 16 bp, R. norvegicus
accaggctgtcctgaa

SEQ ID NO: 471303 - DNA, 16 bp, R. norvegicus
accaggctgtccttga

SEQ ID NO: 471304 - DNA, 16 bp, R. norvegicus
accagggagaatggct

SEQ ID NO: 471305 - DNA, 16 bp, R. norvegicus
accagggctatgtaga

SEQ ID NO: 471306 - DNA, 16 bp, R. norvegicus
accagggctgccttct

SEQ ID NO: 471307 - DNA, 16 bp, R. norvegicus
accaggggctggggat

SEQ ID NO: 471308 - DNA, 16 bp, R. norvegicus
accaggtacacacatg

SEQ ID NO: 471309 - DNA, 16 bp, R. norvegicus
accaggtcaaggaaga

SEQ ID NO: 471310 - DNA, 16 bp, R. norvegicus
accaggtcctggtttt

SEQ ID NO: 471311 - DNA, 16 bp, R. norvegicus
accaggtgagagagag

SEQ ID NO: 471312 - DNA, 16 bp, R. norvegicus
accaggtgcaaaaccc

SEQ ID NO: 471313 - DNA, 16 bp, R. norvegicus
accagtaatatcttca

SEQ ID NO: 471314 - DNA, 16 bp, R. norvegicus
accagtagccaaaatc

SEQ ID NO: 471315 - DNA, 16 bp, R. norvegicus
accagtgactatgaaa

SEQ ID NO: 471316 - DNA, 16 bp, R. norvegicus
accagtgcaaaccaag

SEQ ID NO: 471317 - DNA, 16 bp, R. norvegicus
accagtgcactggggt

SEQ ID NO: 471318 - DNA, 16 bp, R. norvegicus
accagtggagaaataa

SEQ ID NO: 471319 - DNA, 16 bp, R. norvegicus
accagtggccttccat

SEQ ID NO: 471320 - DNA, 16 bp, R. norvegicus
accagtttgctatccc

SEQ ID NO: 471321 - DNA, 16 bp, R. norvegicus
accataccacagggac

SEQ ID NO: 471322 - DNA, 16 bp, R. norvegicus
accatagaagaaattg

SEQ ID NO: 471323 - DNA, 16 bp, R. norvegicus
accatagagaacactg

SEQ ID NO: 471324 - DNA, 16 bp, R. norvegicus
accatagcatcagtaa

SEQ ID NO: 471325 - DNA, 16 bp, R. norvegicus
accatatatttggtca

SEQ ID NO: 471326 - DNA, 16 bp, R. norvegicus
accatatctgcctgga

SEQ ID NO: 471327 - DNA, 16 bp, R. norvegicus
accatatgctgaaaat

SEQ ID NO: 471328 - DNA, 16 bp, R. norvegicus
accatatgtgtgcctg

SEQ ID NO: 471329 - DNA, 16 bp, R. norvegicus
accatatgtgtgtggg

SEQ ID NO: 471330 - DNA, 16 bp, R. norvegicus
accatcaaaggccagg

SEQ ID NO: 471331 - DNA, 16 bp, R. norvegicus
accatcaacatcacca

SEQ ID NO: 471332 - DNA, 17 bp, R. norvegicus
accatcaacgtgatccg

SEQ ID NO: 471333 - DNA, 16 bp, R. norvegicus
accatcaccaaggcaa

SEQ ID NO: 471334 - DNA, 16 bp, R. norvegicus
accatcaccgccacca

SEQ ID NO: 471335 - DNA, 16 bp, R. norvegicus
accatcactaccacca

SEQ ID NO: 471336 - DNA, 16 bp, R. norvegicus
accatcactgacctca

SEQ ID NO: 471337 - DNA, 16 bp, R. norvegicus
accatcagcagcagca

SEQ ID NO: 471338 - DNA, 16 bp, R. norvegicus
accatcagcatcatca

SEQ ID NO: 471339 - DNA, 16 bp, R. norvegicus
accatcatcaccatct

SEQ ID NO: 471340 - DNA, 16 bp, R. norvegicus
accatcatcactacca

SEQ ID NO: 471341 - DNA, 16 bp, R. norvegicus
accatcatcagagaag

SEQ ID NO: 471342 - DNA, 16 bp, R. norvegicus
accatcatcatcatcc

SEQ ID NO: 471343 - DNA, 16 bp, R. norvegicus
accatcatggcaggga

SEQ ID NO: 471344 - DNA, 16 bp, R. norvegicus
accatccagttgaaaa

SEQ ID NO: 471345 - DNA, 16 bp, R. norvegicus
accatccctgcatact

SEQ ID NO: 471346 - DNA, 16 bp, R. norvegicus
accatcctggtctaca

SEQ ID NO: 471347 - DNA, 16 bp, R. norvegicus
accatccttgatctca

SEQ ID NO: 471348 - DNA, 16 bp, R. norvegicus
accatcgtcatcatca

SEQ ID NO: 471349 - DNA, 16 bp, R. norvegicus
accatctataacttca

SEQ ID NO: 471350 - DNA, 16 bp, R. norvegicus
accatctcttcttcct

SEQ ID NO: 471351 - DNA, 16 bp, R. norvegicus
accatctggaacactg

SEQ ID NO: 471352 - DNA, 16 bp, R. norvegicus
accatctgtaatgagt

SEQ ID NO: 471353 - DNA, 16 bp, R. norvegicus
accatctgtacatggt

SEQ ID NO: 471354 - DNA, 16 bp, R. norvegicus
accatctgtagtgggg

SEQ ID NO: 471355 - DNA, 16 bp, R. norvegicus
accatctttaatgaga

SEQ ID NO: 471356 - DNA, 16 bp, R. norvegicus
accatgaaaagaccaa

SEQ ID NO: 471357 - DNA, 17 bp, R. norvegicus
accatgaaagctgtgct

SEQ ID NO: 471358 - DNA, 16 bp, R. norvegicus
accatgacaaaggcaa

SEQ ID NO: 471359 - DNA, 16 bp, R. norvegicus
accatgacagggactg

SEQ ID NO: 471360 - DNA, 16 bp, R. norvegicus
accatgaccaagagca

SEQ ID NO: 471361 - DNA, 16 bp, R. norvegicus
accatgaccaatgcag

SEQ ID NO: 471362 - DNA, 16 bp, R. norvegicus
accatgaccatggcaa

SEQ ID NO: 471363 - DNA, 16 bp, R. norvegicus
accatgaggatgctgg

SEQ ID NO: 471364 - DNA, 16 bp, R. norvegicus
accatgatgaactgta

SEQ ID NO: 471365 - DNA, 16 bp, R. norvegicus
accatgatgctggggg

SEQ ID NO: 471366 - DNA, 16 bp, R. norvegicus
accatgatggactgta

SEQ ID NO: 471367 - DNA, 16 bp, R. norvegicus
accatgcatgctcttt

SEQ ID NO: 471368 - DNA, 16 bp, R. norvegicus
accatgcctgcatccc

SEQ ID NO: 471369 - DNA, 16 bp, R. norvegicus
accatgcctgcctgct

SEQ ID NO: 471370 - DNA, 16 bp, R. norvegicus
accatgctggcttcaa

SEQ ID NO: 471371 - DNA, 16 bp, R. norvegicus
accatggaagtggtgg

SEQ ID NO: 471372 - DNA, 16 bp, R. norvegicus
accatggagactggca

SEQ ID NO: 471373 - DNA, 16 bp, R. norvegicus
accatggcaactcttc

SEQ ID NO: 471374 - DNA, 16 bp, R. norvegicus
accatggctccaactg

SEQ ID NO: 471375 - DNA, 16 bp, R. norvegicus
accatgggcttcccct

SEQ ID NO: 471376 - DNA, 16 bp, R. norvegicus
accatggggagcaagc

SEQ ID NO: 471377 - DNA, 16 bp, R. norvegicus
accatggtattttata

SEQ ID NO: 471378 - DNA, 16 bp, R. norvegicus
accatgtagttgctag

SEQ ID NO: 471379 - DNA, 16 bp, R. norvegicus
accatgtctacctgga

SEQ ID NO: 471380 - DNA, 16 bp, R. norvegicus
accatgtctgcctgct

SEQ ID NO: 471381 - DNA, 16 bp, R. norvegicus
accatgtcttgaaaaa

SEQ ID NO: 471382 - DNA, 16 bp, R. norvegicus
accatgtggagctgag

SEQ ID NO: 471383 - DNA, 16 bp, R. norvegicus
accatgtgggcactgg

SEQ ID NO: 471384 - DNA, 16 bp, R. norvegicus
accatgtggttcctga

SEQ ID NO: 471385 - DNA, 16 bp, R. norvegicus
accatgtggttcctgg

SEQ ID NO: 471386 - DNA, 16 bp, R. norvegicus
accatgtggttgatgg

SEQ ID NO: 471387 - DNA, 16 bp, R. norvegicus
accatgtggtttgctg

SEQ ID NO: 471388 - DNA, 16 bp, R. norvegicus
accatgtgtaatgaga

SEQ ID NO: 471389 - DNA, 16 bp, R. norvegicus
accatgttccccacca

SEQ ID NO: 471390 - DNA, 16 bp, R. norvegicus
accattcagagcctga

SEQ ID NO: 471391 - DNA, 16 bp, R. norvegicus
accattcagagcctgc

SEQ ID NO: 471392 - DNA, 16 bp, R. norvegicus
accattcagcattcct

SEQ ID NO: 471393 - DNA, 16 bp, R. norvegicus
accattcctgggcata

SEQ ID NO: 471394 - DNA, 16 bp, R. norvegicus
accattctggaaatct

SEQ ID NO: 471395 - DNA, 16 bp, R. norvegicus
accattgaaggaatca

SEQ ID NO: 471396 - DNA, 16 bp, R. norvegicus
accattgaagtgagaa

SEQ ID NO: 471397 - DNA, 16 bp, R. norvegicus
accattgagccatctc

SEQ ID NO: 471398 - DNA, 16 bp, R. norvegicus
accatttggttggaaa

SEQ ID NO: 471399 - DNA, 16 bp, R. norvegicus
accattttgccaaaag

SEQ ID NO: 471400 - DNA, 17 bp, R. norvegicus
acccaaaagatgcttca

SEQ ID NO: 471401 - DNA, 16 bp, R. norvegicus
acccaaacccagggaa

SEQ ID NO: 471402 - DNA, 16 bp, R. norvegicus
acccaaactaagacag

SEQ ID NO: 471403 - DNA, 16 bp, R. norvegicus
acccaaacttctggga

SEQ ID NO: 471404 - DNA, 17 bp, R. norvegicus
acccaaagactgtacat

SEQ ID NO: 471405 - DNA, 16 bp, R. norvegicus
acccaaaggaagagag

SEQ ID NO: 471406 - DNA, 16 bp, R. norvegicus
acccaaaggatgctct

SEQ ID NO: 471407 - DNA, 16 bp, R. norvegicus
acccaaattccatggg

SEQ ID NO: 471408 - DNA, 16 bp, R. norvegicus
acccaacaaggaaaga

SEQ ID NO: 471409 - DNA, 16 bp, R. norvegicus
acccaagaagcagctg

SEQ ID NO: 471410 - DNA, 16 bp, R. norvegicus
acccaagaaggatgac

SEQ ID NO: 471411 - DNA, 16 bp, R. norvegicus
acccaagactaccagc

SEQ ID NO: 471412 - DNA, 16 bp, R. norvegicus
acccaagaggaataca

SEQ ID NO: 471413 - DNA, 16 bp, R. norvegicus
acccaagaggagtgga

SEQ ID NO: 471414 - DNA, 16 bp, R. norvegicus
acccaagaggctgagg

SEQ ID NO: 471415 - DNA, 16 bp, R. norvegicus
acccaagatattttat

SEQ ID NO: 471416 - DNA, 16 bp, R. norvegicus
acccaagccctttgga

SEQ ID NO: 471417 - DNA, 16 bp, R. norvegicus
acccaaggcaggaagc

SEQ ID NO: 471418 - DNA, 16 bp, R. norvegicus
acccaagtttggatcc

SEQ ID NO: 471419 - DNA, 27 bp, R. norvegicus
acccaatcacagaaagacatacatgtt

SEQ ID NO: 471420 - DNA, 16 bp, R. norvegicus
acccaattccttctct

SEQ ID NO: 471421 - DNA, 16 bp, R. norvegicus
acccaatttttaattg

SEQ ID NO: 471422 - DNA, 16 bp, R. norvegicus
acccacaaaatctatt

SEQ ID NO: 471423 - DNA, 16 bp, R. norvegicus
acccacaaaggatcaa

SEQ ID NO: 471424 - DNA, 16 bp, R. norvegicus
acccacacacctaagg

SEQ ID NO: 471425 - DNA, 16 bp, R. norvegicus
acccacactgggtggc

SEQ ID NO: 471426 - DNA, 16 bp, R. norvegicus
acccacagaaccatct

SEQ ID NO: 471427 - DNA, 16 bp, R. norvegicus
acccacagaggtcaga

SEQ ID NO: 471428 - DNA, 16 bp, R. norvegicus
acccacagggcagctc

SEQ ID NO: 471429 - DNA, 16 bp, R. norvegicus
acccacagtcaggaag

SEQ ID NO: 471430 - DNA, 16 bp, R. norvegicus
acccacagtgacatgc

SEQ ID NO: 471431 - DNA, 16 bp, R. norvegicus
acccacatcaggcaac

SEQ ID NO: 471432 - DNA, 16 bp, R. norvegicus
acccacatgaagaaca

SEQ ID NO: 471433 - DNA, 16 bp, R. norvegicus
acccaccagcagccct

SEQ ID NO: 471434 - DNA, 16 bp, R. norvegicus
acccaccccatcagac

SEQ ID NO: 471435 - DNA, 16 bp, R. norvegicus
acccacggctccaact

SEQ ID NO: 471436 - DNA, 16 bp, R. norvegicus
acccactgagccatct

SEQ ID NO: 471437 - DNA, 16 bp, R. norvegicus
acccacttcaacctca

SEQ ID NO: 471438 - DNA, 16 bp, R. norvegicus
acccacttctacctca

SEQ ID NO: 471439 - DNA, 16 bp, R. norvegicus
acccagaaagacaagc

SEQ ID NO: 471440 - DNA, 16 bp, R. norvegicus
acccagaaagggaata

SEQ ID NO: 471441 - DNA, 16 bp, R. norvegicus
acccagaagcccttca

SEQ ID NO: 471442 - DNA, 16 bp, R. norvegicus
acccagaagctggaaa

SEQ ID NO: 471443 - DNA, 16 bp, R. norvegicus
acccagaaggaagggg

SEQ ID NO: 471444 - DNA, 16 bp, R. norvegicus
acccagaaggacatgc

SEQ ID NO: 471445 - DNA, 16 bp, R. norvegicus
acccagaatagccaaa

SEQ ID NO: 471446 - DNA, 16 bp, R. norvegicus
acccagacaacatggt

SEQ ID NO: 471447 - DNA, 16 bp, R. norvegicus
acccagacaccattgc

SEQ ID NO: 471448 - DNA, 16 bp, R. norvegicus
acccagacacccagac

SEQ ID NO: 471449 - DNA, 16 bp, R. norvegicus
acccagacccagaaaa

SEQ ID NO: 471450 - DNA, 16 bp, R. norvegicus
acccagaccccaggga

SEQ ID NO: 471451 - DNA, 16 bp, R. norvegicus
acccagagccttgggc

SEQ ID NO: 471452 - DNA, 16 bp, R. norvegicus
acccagagctcaccaa

SEQ ID NO: 471453 - DNA, 16 bp, R. norvegicus
acccagagctccaact

SEQ ID NO: 471454 - DNA, 16 bp, R. norvegicus
acccagagctcccaga

SEQ ID NO: 471455 - DNA, 16 bp, R. norvegicus
acccagatgcccttcc

SEQ ID NO: 471456 - DNA, 16 bp, R. norvegicus
acccagatgcccttct

SEQ ID NO: 471457 - DNA, 16 bp, R. norvegicus
acccagatgtcccagg

SEQ ID NO: 471458 - DNA, 16 bp, R. norvegicus
acccagatgttcttca

SEQ ID NO: 471459 - DNA, 16 bp, R. norvegicus
acccagcaacccagca

SEQ ID NO: 471460 - DNA, 16 bp, R. norvegicus
acccagcactttgctg

SEQ ID NO: 471461 - DNA, 17 bp, R. norvegicus
acccagccactttgctg

SEQ ID NO: 471462 - DNA, 16 bp, R. norvegicus
acccagcccagcaagg

SEQ ID NO: 471463 - DNA, 16 bp, R. norvegicus
acccagctaaatttag

SEQ ID NO: 471464 - DNA, 16 bp, R. norvegicus
acccagctccctccct

SEQ ID NO: 471465 - DNA, 16 bp, R. norvegicus
acccagctctcccacc

SEQ ID NO: 471466 - DNA, 16 bp, R. norvegicus
acccagctgcctgagg

SEQ ID NO: 471467 - DNA, 16 bp, R. norvegicus
acccagctggaaggca

SEQ ID NO: 471468 - DNA, 16 bp, R. norvegicus
acccaggaagcagaga

SEQ ID NO: 471469 - DNA, 16 bp, R. norvegicus
acccaggacactaaac

SEQ ID NO: 471470 - DNA, 16 bp, R. norvegicus
acccaggaccaacagc

SEQ ID NO: 471471 - DNA, 16 bp, R. norvegicus
acccaggaccatctgc

SEQ ID NO: 471472 - DNA, 16 bp, R. norvegicus
acccaggacccccagc

SEQ ID NO: 471473 - DNA, 16 bp, R. norvegicus
acccaggagaaagaag

SEQ ID NO: 471474 - DNA, 16 bp, R. norvegicus
acccaggagcagcagg

SEQ ID NO: 471475 - DNA, 16 bp, R. norvegicus
acccaggaggagcaga

SEQ ID NO: 471476 - DNA, 16 bp, R. norvegicus
acccaggaggtgagag

SEQ ID NO: 471477 - DNA, 16 bp, R. norvegicus
acccaggagttctctg

SEQ ID NO: 471478 - DNA, 16 bp, R. norvegicus
acccaggattaccagc

SEQ ID NO: 471479 - DNA, 16 bp, R. norvegicus
acccaggctcagatcc

SEQ ID NO: 471480 - DNA, 16 bp, R. norvegicus
acccagggacttgtgc

SEQ ID NO: 471481 - DNA, 16 bp, R. norvegicus
acccagggcagaagag

SEQ ID NO: 471482 - DNA, 16 bp, R. norvegicus
acccagggcctagcaa

SEQ ID NO: 471483 - DNA, 16 bp, R. norvegicus
acccagggcctgtgca

SEQ ID NO: 471484 - DNA, 16 bp, R. norvegicus
acccagggcctgtgct

SEQ ID NO: 471485 - DNA, 16 bp, R. norvegicus
acccagggccttgaac

SEQ ID NO: 471486 - DNA, 16 bp, R. norvegicus
acccagggccttgctt

SEQ ID NO: 471487 - DNA, 16 bp, R. norvegicus
acccagggctacacag

SEQ ID NO: 471488 - DNA, 16 bp, R. norvegicus
acccagggcttgccct

SEQ ID NO: 471489 - DNA, 16 bp, R. norvegicus
acccagggctttgcac

SEQ ID NO: 471490 - DNA, 16 bp, R. norvegicus
acccagggtcttgggc

SEQ ID NO: 471491 - DNA, 16 bp, R. norvegicus
acccaggtcctctgga

SEQ ID NO: 471492 - DNA, 16 bp, R. norvegicus
acccaggtgtggtcca

SEQ ID NO: 471493 - DNA, 16 bp, R. norvegicus
acccaggttcaagtct

SEQ ID NO: 471494 - DNA, 16 bp, R. norvegicus
acccaggtttggttcc

SEQ ID NO: 471495 - DNA, 16 bp, R. norvegicus
acccagtcagaaaaga

SEQ ID NO: 471496 - DNA, 16 bp, R. norvegicus
acccagtcattttgct

SEQ ID NO: 471497 - DNA, 16 bp, R. norvegicus
acccagtccactgtgg

SEQ ID NO: 471498 - DNA, 16 bp, R. norvegicus
acccagtctcagaaaa

SEQ ID NO: 471499 - DNA, 16 bp, R. norvegicus
acccagtcttttattt

SEQ ID NO: 471500 - DNA, 16 bp, R. norvegicus
acccagtgagagaccc

SEQ ID NO: 471501 - DNA, 16 bp, R. norvegicus
acccagtgtctccacc

SEQ ID NO: 471502 - DNA, 16 bp, R. norvegicus
acccagttctccaacc

SEQ ID NO: 471503 - DNA, 16 bp, R. norvegicus
acccatcaaatcaaag

SEQ ID NO: 471504 - DNA, 16 bp, R. norvegicus
acccatctccaaattt

SEQ ID NO: 471505 - DNA, 16 bp, R. norvegicus
acccatctggacatgg

SEQ ID NO: 471506 - DNA, 16 bp, R. norvegicus
acccatcttccctgct

SEQ ID NO: 471507 - DNA, 16 bp, R. norvegicus
acccatggctcctgct

SEQ ID NO: 471508 - DNA, 16 bp, R. norvegicus
acccatgggctggctg

SEQ ID NO: 471509 - DNA, 16 bp, R. norvegicus
acccatggtcacacag

SEQ ID NO: 471510 - DNA, 16 bp, R. norvegicus
acccatgtgttccaga

SEQ ID NO: 471511 - DNA, 17 bp, R. norvegicus
acccattaggaagggga

SEQ ID NO: 471512 - DNA, 16 bp, R. norvegicus
acccattcagaatctg

SEQ ID NO: 471513 - DNA, 16 bp, R. norvegicus
acccattcccacctca

SEQ ID NO: 471514 - DNA, 16 bp, R. norvegicus
acccattctgtcaaat

SEQ ID NO: 471515 - DNA, 16 bp, R. norvegicus
accccaaagtccaccc

SEQ ID NO: 471516 - DNA, 16 bp, R. norvegicus
accccaacaaggccac

SEQ ID NO: 471517 - DNA, 16 bp, R. norvegicus
accccaactcagtaca

SEQ ID NO: 471518 - DNA, 16 bp, R. norvegicus
accccaagaaaggaaa

SEQ ID NO: 471519 - DNA, 16 bp, R. norvegicus
accccaagcctgggaa

SEQ ID NO: 471520 - DNA, 16 bp, R. norvegicus
accccaagcttgggaa

SEQ ID NO: 471521 - DNA, 16 bp, R. norvegicus
accccaagttgaccag

SEQ ID NO: 471522 - DNA, 18 bp, R. norvegicus
accccaatggaggagtta

SEQ ID NO: 471523 - DNA, 16 bp, R. norvegicus
accccactctgatcaa

SEQ ID NO: 471524 - DNA, 16 bp, R. norvegicus
accccagaacccacat

SEQ ID NO: 471525 - DNA, 28 bp, R. norvegicus
accccagactccgaagaccccttggagg

SEQ ID NO: 471526 - DNA, 16 bp, R. norvegicus
accccagagctcctag

SEQ ID NO: 471527 - DNA, 16 bp, R. norvegicus
accccagcactgggag

SEQ ID NO: 471528 - DNA, 16 bp, R. norvegicus
accccagccctcagga

SEQ ID NO: 471529 - DNA, 16 bp, R. norvegicus
accccagccctttgat

SEQ ID NO: 471530 - DNA, 16 bp, R. norvegicus
accccagctccaggag

SEQ ID NO: 471531 - DNA, 16 bp, R. norvegicus
accccagctcccagac

SEQ ID NO: 471532 - DNA, 16 bp, R. norvegicus
accccagctctcagga

SEQ ID NO: 471533 - DNA, 16 bp, R. norvegicus
accccagtcagaatgg

SEQ ID NO: 471534 - DNA, 16 bp, R. norvegicus
accccagtgacaaaga

SEQ ID NO: 471535 - DNA, 16 bp, R. norvegicus
accccagtggagaagt

SEQ ID NO: 471536 - DNA, 16 bp, R. norvegicus
accccattgctgaaga

SEQ ID NO: 471537 - DNA, 16 bp, R. norvegicus
acccccacagttacct

SEQ ID NO: 471538 - DNA, 16 bp, R. norvegicus
acccccacccccatgt

SEQ ID NO: 471539 - DNA, 16 bp, R. norvegicus
acccccagtgcagtgg

SEQ ID NO: 471540 - DNA, 16 bp, R. norvegicus
acccccagtggaggga

SEQ ID NO: 471541 - DNA, 19 bp, R. norvegicus
acccccgagacatctcatc

SEQ ID NO: 471542 - DNA, 16 bp, R. norvegicus
acccctgagacatctc

SEQ ID NO: 471543 - DNA, 16 bp, R. norvegicus
acccctgcccagccag

SEQ ID NO: 471544 - DNA, 16 bp, R. norvegicus
acccctggaagagcag

SEQ ID NO: 471545 - DNA, 16 bp, R. norvegicus
acccctgtccctgaga

SEQ ID NO: 471546 - DNA, 16 bp, R. norvegicus
accccttcagttcttt

SEQ ID NO: 471547 - DNA, 16 bp, R. norvegicus
accccttcttccaacc

SEQ ID NO: 471548 - DNA, 16 bp, R. norvegicus
acccctttaatcccaa

SEQ ID NO: 471549 - DNA, 16 bp, R. norvegicus
acccctttggggggaa

SEQ ID NO: 471550 - DNA, 16 bp, R. norvegicus
acccgagtttttgatc

SEQ ID NO: 471551 - DNA, 16 bp, R. norvegicus
acccgcagggcagtcg

SEQ ID NO: 471552 - DNA, 16 bp, R. norvegicus
acccggggctggagag

SEQ ID NO: 471553 - DNA, 16 bp, R. norvegicus
accctaaatatctatg

SEQ ID NO: 471554 - DNA, 16 bp, R. norvegicus
accctacctgcccttg

SEQ ID NO: 471555 - DNA, 16 bp, R. norvegicus
accctagaaaaagaaa

SEQ ID NO: 471556 - DNA, 16 bp, R. norvegicus
accctagaactggagt

SEQ ID NO: 471557 - DNA, 16 bp, R. norvegicus
accctagaagaatcaa

SEQ ID NO: 471558 - DNA, 16 bp, R. norvegicus
accctagtaaaagcaa

SEQ ID NO: 471559 - DNA, 16 bp, R. norvegicus
accctatctcaaacaa

SEQ ID NO: 471560 - DNA, 16 bp, R. norvegicus
accctatctcaaagca

SEQ ID NO: 471561 - DNA, 16 bp, R. norvegicus
accctattgctgatgc

SEQ ID NO: 471562 - DNA, 16 bp, R. norvegicus
accctcaaagcccacc

SEQ ID NO: 471563 - DNA, 16 bp, R. norvegicus
accctcaccagcatgt

SEQ ID NO: 471564 - DNA, 16 bp, R. norvegicus
accctcagagccatct

SEQ ID NO: 471565 - DNA, 16 bp, R. norvegicus
accctcagctccttct

SEQ ID NO: 471566 - DNA, 16 bp, R. norvegicus
accctcaggagtgctc

SEQ ID NO: 471567 - DNA, 16 bp, R. norvegicus
accctcaggggctgga

SEQ ID NO: 471568 - DNA, 16 bp, R. norvegicus
accctcagtaccaaga

SEQ ID NO: 471569 - DNA, 16 bp, R. norvegicus
accctcccccccattg

SEQ ID NO: 471570 - DNA, 16 bp, R. norvegicus
accctcctctgcctcc

SEQ ID NO: 471571 - DNA, 16 bp, R. norvegicus
accctctcaaaggaga

SEQ ID NO: 471572 - DNA, 16 bp, R. norvegicus
accctctcttacttct

SEQ ID NO: 471573 - DNA, 16 bp, R. norvegicus
accctctgaagaaaga

SEQ ID NO: 471574 - DNA, 16 bp, R. norvegicus
accctctgacttccac

SEQ ID NO: 471575 - DNA, 16 bp, R. norvegicus
accctctgcctctgcc

SEQ ID NO: 471576 - DNA, 16 bp, R. norvegicus
accctctggttccaga

SEQ ID NO: 471577 - DNA, 21 bp, R. norvegicus
accctctgtgcactgctgctt

SEQ ID NO: 471578 - DNA, 16 bp, R. norvegicus
accctcttctagcctc

SEQ ID NO: 471579 - DNA, 16 bp, R. norvegicus
accctcttttcctcag

SEQ ID NO: 471580 - DNA, 16 bp, R. norvegicus
accctgaaggaggacc

SEQ ID NO: 471581 - DNA, 16 bp, R. norvegicus
accctgaatatagaaa

SEQ ID NO: 471582 - DNA, 16 bp, R. norvegicus
accctgagatctctca

SEQ ID NO: 471583 - DNA, 16 bp, R. norvegicus
accctgaggacctgag

SEQ ID NO: 471584 - DNA, 16 bp, R. norvegicus
accctgatgcactgaa

SEQ ID NO: 471585 - DNA, 16 bp, R. norvegicus
accctgcagcagctgg

SEQ ID NO: 471586 - DNA, 16 bp, R. norvegicus
accctgcagtgccatg

SEQ ID NO: 471587 - DNA, 16 bp, R. norvegicus
accctgcatatcagat

SEQ ID NO: 471588 - DNA, 16 bp, R. norvegicus
accctgcatcctgctg

SEQ ID NO: 471589 - DNA, 16 bp, R. norvegicus
accctgccagcaagat

SEQ ID NO: 471590 - DNA, 16 bp, R. norvegicus
accctgctcctcctca

SEQ ID NO: 471591 - DNA, 16 bp, R. norvegicus
accctggaagaacaga

SEQ ID NO: 471592 - DNA, 16 bp, R. norvegicus
accctggaagaccaga

SEQ ID NO: 471593 - DNA, 16 bp, R. norvegicus
accctggacagatgtc

SEQ ID NO: 471594 - DNA, 16 bp, R. norvegicus
accctggaccacccag

SEQ ID NO: 471595 - DNA, 16 bp, R. norvegicus
accctggagagacttg

SEQ ID NO: 471596 - DNA, 16 bp, R. norvegicus
accctggctggcctgg

SEQ ID NO: 471597 - DNA, 16 bp, R. norvegicus
accctggggctggaga

SEQ ID NO: 471598 - DNA, 16 bp, R. norvegicus
accctggtcctttgca

SEQ ID NO: 471599 - DNA, 16 bp, R. norvegicus
accctgtctcaacaag

SEQ ID NO: 471600 - DNA, 16 bp, R. norvegicus
accctgtctcagaaaa

SEQ ID NO: 471601 - DNA, 16 bp, R. norvegicus
accctgtctcagaaga

SEQ ID NO: 471602 - DNA, 16 bp, R. norvegicus
accctgtctcagagag

SEQ ID NO: 471603 - DNA, 16 bp, R. norvegicus
accctgtctcgaaaca

SEQ ID NO: 471604 - DNA, 16 bp, R. norvegicus
accctgtctgaaaaca

SEQ ID NO: 471605 - DNA, 16 bp, R. norvegicus
accctgtctttgaaaa

SEQ ID NO: 471606 - DNA, 16 bp, R. norvegicus
accctgtggaagagga

SEQ ID NO: 471607 - DNA, 16 bp, R. norvegicus
acccttaaagaagaaa

SEQ ID NO: 471608 - DNA, 16 bp, R. norvegicus
acccttatagatgaag

SEQ ID NO: 471609 - DNA, 16 bp, R. norvegicus
acccttccccactttt

SEQ ID NO: 471610 - DNA, 16 bp, R. norvegicus
acccttggaagagcag

SEQ ID NO: 471611 - DNA, 16 bp, R. norvegicus
acccttggttctgtga

SEQ ID NO: 471612 - DNA, 16 bp, R. norvegicus
accctttcagaagcaa

SEQ ID NO: 471613 - DNA, 16 bp, R. norvegicus
accgagtgaaccaaga

SEQ ID NO: 471614 - DNA, 16 bp, R. norvegicus
accgggaaagggataa

SEQ ID NO: 471615 - DNA, 16 bp, R. norvegicus
accgggtttctctgtg

SEQ ID NO: 471616 - DNA, 16 bp, R. norvegicus
accgtctctgtggctc

SEQ ID NO: 471617 - DNA, 16 bp, R. norvegicus
accgtgtctgcctgtg

SEQ ID NO: 471618 - DNA, 16 bp, R. norvegicus
accgtttgcttggaaa

SEQ ID NO: 471619 - DNA, 17 bp, R. norvegicus
acctaaaagctccagaa

SEQ ID NO: 471620 - DNA, 16 bp, R. norvegicus
acctaaaagtggaaat

SEQ ID NO: 471621 - DNA, 16 bp, R. norvegicus
acctaaacatggtaaa

SEQ ID NO: 471622 - DNA, 16 bp, R. norvegicus
acctaaagaacccaga

SEQ ID NO: 471623 - DNA, 16 bp, R. norvegicus
acctaaagaaggagat

SEQ ID NO: 471624 - DNA, 16 bp, R. norvegicus
acctaaaggacccaga

SEQ ID NO: 471625 - DNA, 16 bp, R. norvegicus
acctaaccctcaagag

SEQ ID NO: 471626 - DNA, 16 bp, R. norvegicus
acctaagaaaaatagg

SEQ ID NO: 471627 - DNA, 16 bp, R. norvegicus
acctaagacaggagca

SEQ ID NO: 471628 - DNA, 16 bp, R. norvegicus
acctaagcaagagaaa

SEQ ID NO: 471629 - DNA, 16 bp, R. norvegicus
acctaaggaaaaattc

SEQ ID NO: 471630 - DNA, 16 bp, R. norvegicus
acctacaccaacaagg

SEQ ID NO: 471631 - DNA, 16 bp, R. norvegicus
acctacagaatgggaa

SEQ ID NO: 471632 - DNA, 16 bp, R. norvegicus
acctacatgccagaag

SEQ ID NO: 471633 - DNA, 16 bp, R. norvegicus
acctacctgcttctgc

SEQ ID NO: 471634 - DNA, 16 bp, R. norvegicus
acctactgaaccatct

SEQ ID NO: 471635 - DNA, 16 bp, R. norvegicus
acctactgtgtgccag

SEQ ID NO: 471636 - DNA, 16 bp, R. norvegicus
acctacttatcagtga

SEQ ID NO: 471637 - DNA, 16 bp, R. norvegicus
acctagaaattttgat

SEQ ID NO: 471638 - DNA, 16 bp, R. norvegicus
acctagacaagacaaa

SEQ ID NO: 471639 - DNA, 16 bp, R. norvegicus
acctagacagaaaatt

SEQ ID NO: 471640 - DNA, 16 bp, R. norvegicus
acctagagctgaaaga

SEQ ID NO: 471641 - DNA, 16 bp, R. norvegicus
acctaggaacacatgg

SEQ ID NO: 471642 - DNA, 16 bp, R. norvegicus
acctagggctggagag

SEQ ID NO: 471643 - DNA, 16 bp, R. norvegicus
acctaggtttgattcc

SEQ ID NO: 471644 - DNA, 16 bp, R. norvegicus
acctatagctccagct

SEQ ID NO: 471645 - DNA, 16 bp, R. norvegicus
acctatgactccagct

SEQ ID NO: 471646 - DNA, 16 bp, R. norvegicus
acctatgaggatggag

SEQ ID NO: 471647 - DNA, 16 bp, R. norvegicus
acctatgaggtaagag

SEQ ID NO: 471648 - DNA, 16 bp, R. norvegicus
acctatgcagatggag

SEQ ID NO: 471649 - DNA, 17 bp, R. norvegicus
acctatggccacttgat

SEQ ID NO: 471650 - DNA, 16 bp, R. norvegicus
acctatggggtcagtg

SEQ ID NO: 471651 - DNA, 16 bp, R. norvegicus
acctatgtctcttctg

SEQ ID NO: 471652 - DNA, 16 bp, R. norvegicus
acctcaaaaatattaa

SEQ ID NO: 471653 - DNA, 16 bp, R. norvegicus
acctcaaagcccacca

SEQ ID NO: 471654 - DNA, 16 bp, R. norvegicus
acctcaaagcctaccc

SEQ ID NO: 471655 - DNA, 16 bp, R. norvegicus
acctcaaagctcagga

SEQ ID NO: 471656 - DNA, 16 bp, R. norvegicus
acctcaaagttcagga

SEQ ID NO: 471657 - DNA, 16 bp, R. norvegicus
acctcaacaacctggc

SEQ ID NO: 471658 - DNA, 16 bp, R. norvegicus
acctcaacatgaggaa

SEQ ID NO: 471659 - DNA, 16 bp, R. norvegicus
acctcaagatccagct

SEQ ID NO: 471660 - DNA, 16 bp, R. norvegicus
acctcacaaaagaata

SEQ ID NO: 471661 - DNA, 16 bp, R. norvegicus
acctcacaccagtcag

SEQ ID NO: 471662 - DNA, 16 bp, R. norvegicus
acctcacagccagagt

SEQ ID NO: 471663 - DNA, 16 bp, R. norvegicus
acctcaccaagatcct

SEQ ID NO: 471664 - DNA, 16 bp, R. norvegicus
acctcaccatggcctc

SEQ ID NO: 471665 - DNA, 16 bp, R. norvegicus
acctcactcagaatgt

SEQ ID NO: 471666 - DNA, 16 bp, R. norvegicus
acctcactcagcatga

SEQ ID NO: 471667 - DNA, 16 bp, R. norvegicus
acctcactcagtgtga

SEQ ID NO: 471668 - DNA, 16 bp, R. norvegicus
acctcactgtcctggc

SEQ ID NO: 471669 - DNA, 18 bp, R. norvegicus
acctcactgtgggaggag

SEQ ID NO: 471670 - DNA, 16 bp, R. norvegicus
acctcagaaacaaaga

SEQ ID NO: 471671 - DNA, 16 bp, R. norvegicus
acctcagatgacagca

SEQ ID NO: 471672 - DNA, 16 bp, R. norvegicus
acctcagcatggtctc

SEQ ID NO: 471673 - DNA, 16 bp, R. norvegicus
acctcaggaggcagaa

SEQ ID NO: 471674 - DNA, 16 bp, R. norvegicus
acctcagggacagaga

SEQ ID NO: 471675 - DNA, 16 bp, R. norvegicus
acctcagtgccctggc

SEQ ID NO: 471676 - DNA, 16 bp, R. norvegicus
acctcagtgtcaaaga

SEQ ID NO: 471677 - DNA, 16 bp, R. norvegicus
acctcataaaactcca

SEQ ID NO: 471678 - DNA, 16 bp, R. norvegicus
acctcatctgtatcag

SEQ ID NO: 471679 - DNA, 16 bp, R. norvegicus
acctcatgaaactgga

SEQ ID NO: 471680 - DNA, 16 bp, R. norvegicus
acctcatgctggcagc

SEQ ID NO: 471681 - DNA, 27 bp, R. norvegicus
acctcatggattaccaatgctttctcc

SEQ ID NO: 471682 - DNA, 16 bp, R. norvegicus
acctcatggtggcttc

SEQ ID NO: 471683 - DNA, 16 bp, R. norvegicus
acctcatttacatatt

SEQ ID NO: 471684 - DNA, 16 bp, R. norvegicus
acctccacacctgtgc

SEQ ID NO: 471685 - DNA, 16 bp, R. norvegicus
acctccacagtgacac

SEQ ID NO: 471686 - DNA, 24 bp, R. norvegicus
acctccacatcaaaccagatacat

SEQ ID NO: 471687 - DNA, 16 bp, R. norvegicus
acctccacttgaacca

SEQ ID NO: 471688 - DNA, 16 bp, R. norvegicus
acctccagccccacct

SEQ ID NO: 471689 - DNA, 16 bp, R. norvegicus
acctccaggctgattt

SEQ ID NO: 471690 - DNA, 16 bp, R. norvegicus
acctccatgtggctaa

SEQ ID NO: 471691 - DNA, 16 bp, R. norvegicus
acctcccaggcctttc

SEQ ID NO: 471692 - DNA, 16 bp, R. norvegicus
acctcccaggtctctg

SEQ ID NO: 471693 - DNA, 16 bp, R. norvegicus
acctcccaggtgctgg

SEQ ID NO: 471694 - DNA, 16 bp, R. norvegicus
acctccccttggttgt

SEQ ID NO: 471695 - DNA, 16 bp, R. norvegicus
acctccctaatgctgg

SEQ ID NO: 471696 - DNA, 16 bp, R. norvegicus
acctccgaagtcaagt

SEQ ID NO: 471697 - DNA, 16 bp, R. norvegicus
acctcctataactcca

SEQ ID NO: 471698 - DNA, 16 bp, R. norvegicus
acctcctatcccatcc

SEQ ID NO: 471699 - DNA, 16 bp, R. norvegicus
acctcctcaccagcat

SEQ ID NO: 471700 - DNA, 16 bp, R. norvegicus
acctcctccaaccagg

SEQ ID NO: 471701 - DNA, 16 bp, R. norvegicus
acctccttgtacaaag

SEQ ID NO: 471702 - DNA, 16 bp, R. norvegicus
acctcctttcactgtc

SEQ ID NO: 471703 - DNA, 20 bp, R. norvegicus
acctcgaccagcaaggaaga

SEQ ID NO: 471704 - DNA, 16 bp, R. norvegicus
acctcggggctggaca

SEQ ID NO: 471705 - DNA, 16 bp, R. norvegicus
acctctactggcacaa

SEQ ID NO: 471706 - DNA, 16 bp, R. norvegicus
acctctcaagtactgg

SEQ ID NO: 471707 - DNA, 16 bp, R. norvegicus
acctctccaaacagtg

SEQ ID NO: 471708 - DNA, 16 bp, R. norvegicus
acctctccagccctat

SEQ ID NO: 471709 - DNA, 16 bp, R. norvegicus
acctctccagccctgt

SEQ ID NO: 471710 - DNA, 16 bp, R. norvegicus
acctctccatggcctc

SEQ ID NO: 471711 - DNA, 16 bp, R. norvegicus
acctctctacaggggt

SEQ ID NO: 471712 - DNA, 16 bp, R. norvegicus
acctctctggctccta

SEQ ID NO: 471713 - DNA, 16 bp, R. norvegicus
acctctgaaactggaa

SEQ ID NO: 471714 - DNA, 16 bp, R. norvegicus
acctctgaaagaacag

SEQ ID NO: 471715 - DNA, 16 bp, R. norvegicus
acctctgacctctcca

SEQ ID NO: 471716 - DNA, 16 bp, R. norvegicus
acctctgagaacctca

SEQ ID NO: 471717 - DNA, 16 bp, R. norvegicus
acctctgagacaaaga

SEQ ID NO: 471718 - DNA, 16 bp, R. norvegicus
acctctgaggagaagc

SEQ ID NO: 471719 - DNA, 16 bp, R. norvegicus
acctctgcaccattcc

SEQ ID NO: 471720 - DNA, 16 bp, R. norvegicus
acctctgcctccagag

SEQ ID NO: 471721 - DNA, 16 bp, R. norvegicus
acctctgcctcccaaa

SEQ ID NO: 471722 - DNA, 16 bp, R. norvegicus
acctctgcctcccaag

SEQ ID NO: 471723 - DNA, 16 bp, R. norvegicus
acctctgcctctggag

SEQ ID NO: 471724 - DNA, 16 bp, R. norvegicus
acctctgcctgctgag

SEQ ID NO: 471725 - DNA, 16 bp, R. norvegicus
acctctgctgggtggt

SEQ ID NO: 471726 - DNA, 16 bp, R. norvegicus
acctctgcttcagttc

SEQ ID NO: 471727 - DNA, 16 bp, R. norvegicus
acctctggaaatgcag

SEQ ID NO: 471728 - DNA, 16 bp, R. norvegicus
acctctggaacagcag

SEQ ID NO: 471729 - DNA, 16 bp, R. norvegicus
acctctggaagcacag

SEQ ID NO: 471730 - DNA, 16 bp, R. norvegicus
acctctggagaagcag

SEQ ID NO: 471731 - DNA, 16 bp, R. norvegicus
acctctggccaccaca

SEQ ID NO: 471732 - DNA, 16 bp, R. norvegicus
acctctggcctcctca

SEQ ID NO: 471733 - DNA, 16 bp, R. norvegicus
acctctgggagagcag

SEQ ID NO: 471734 - DNA, 16 bp, R. norvegicus
acctctgggcatgtct

SEQ ID NO: 471735 - DNA, 16 bp, R. norvegicus
acctctgggtatgtct

SEQ ID NO: 471736 - DNA, 16 bp, R. norvegicus
acctctggtagagcag

SEQ ID NO: 471737 - DNA, 16 bp, R. norvegicus
acctctggtcacttga

SEQ ID NO: 471738 - DNA, 16 bp, R. norvegicus
acctctgtctccagag

SEQ ID NO: 471739 - DNA, 16 bp, R. norvegicus
acctcttcagctcctt

SEQ ID NO: 471740 - DNA, 16 bp, R. norvegicus
acctcttctcccagct

SEQ ID NO: 471741 - DNA, 17 bp, R. norvegicus
acctcttggcatcccca

SEQ ID NO: 471742 - DNA, 16 bp, R. norvegicus
acctcttttctttcag

SEQ ID NO: 471743 - DNA, 16 bp, R. norvegicus
acctgaagagcaagat

SEQ ID NO: 471744 - DNA, 16 bp, R. norvegicus
acctgaaggaaacaca

SEQ ID NO: 471745 - DNA, 16 bp, R. norvegicus
acctgaaggaaacaga

SEQ ID NO: 471746 - DNA, 16 bp, R. norvegicus
acctgaaggaagccag

SEQ ID NO: 471747 - DNA, 16 bp, R. norvegicus
acctgaaggcagaaac

SEQ ID NO: 471748 - DNA, 16 bp, R. norvegicus
acctgaatttgatccc

SEQ ID NO: 471749 - DNA, 16 bp, R. norvegicus
acctgaatttgattcc

SEQ ID NO: 471750 - DNA, 21 bp, R. norvegicus
acctgactgtggttttctgga

SEQ ID NO: 471751 - DNA, 16 bp, R. norvegicus
acctgagacaaagctg

SEQ ID NO: 471752 - DNA, 16 bp, R. norvegicus
acctgagactagataa

SEQ ID NO: 471753 - DNA, 16 bp, R. norvegicus
acctgagagtctctct

SEQ ID NO: 471754 - DNA, 18 bp, R. norvegicus
acctgagatttcacctca

SEQ ID NO: 471755 - DNA, 16 bp, R. norvegicus
acctgagcaacaggaa

SEQ ID NO: 471756 - DNA, 16 bp, R. norvegicus
acctgagcacacagct

SEQ ID NO: 471757 - DNA, 16 bp, R. norvegicus
acctgagcacccagct

SEQ ID NO: 471758 - DNA, 16 bp, R. norvegicus
acctgaggaaccagct

SEQ ID NO: 471759 - DNA, 16 bp, R. norvegicus
acctgaggaccctgct

SEQ ID NO: 471760 - DNA, 16 bp, R. norvegicus
acctgaggttctgagg

SEQ ID NO: 471761 - DNA, 16 bp, R. norvegicus
acctgagtcctgagca

SEQ ID NO: 471762 - DNA, 16 bp, R. norvegicus
acctgagtcttctgga

SEQ ID NO: 471763 - DNA, 16 bp, R. norvegicus
acctgagttcaattcc

SEQ ID NO: 471764 - DNA, 18 bp, R. norvegicus
acctgagttcagttccca

SEQ ID NO: 471765 - DNA, 16 bp, R. norvegicus
acctgagttccaatcc

SEQ ID NO: 471766 - DNA, 16 bp, R. norvegicus
acctgagtttgaatcc

SEQ ID NO: 471767 - DNA, 16 bp, R. norvegicus
acctgagtttgacctc

SEQ ID NO: 471768 - DNA, 16 bp, R. norvegicus
acctgagtttggctcc

SEQ ID NO: 471769 - DNA, 16 bp, R. norvegicus
acctgatcctgtcccc

SEQ ID NO: 471770 - DNA, 16 bp, R. norvegicus
acctgatgacccagct

SEQ ID NO: 471771 - DNA, 16 bp, R. norvegicus
acctgcaagccagccc

SEQ ID NO: 471772 - DNA, 16 bp, R. norvegicus
acctgcaatcctcctg

SEQ ID NO: 471773 - DNA, 16 bp, R. norvegicus
acctgcacaagacctg

SEQ ID NO: 471774 - DNA, 16 bp, R. norvegicus
acctgcagccaggagt

SEQ ID NO: 471775 - DNA, 16 bp, R. norvegicus
acctgcaggcacacag

SEQ ID NO: 471776 - DNA, 16 bp, R. norvegicus
acctgcatgaagacca

SEQ ID NO: 471777 - DNA, 16 bp, R. norvegicus
acctgcatgatgacat

SEQ ID NO: 471778 - DNA, 16 bp, R. norvegicus
acctgcatgtgcacac

SEQ ID NO: 471779 - DNA, 16 bp, R. norvegicus
acctgcattgtctggc

SEQ ID NO: 471780 - DNA, 16 bp, R. norvegicus
acctgccaccaagcct

SEQ ID NO: 471781 - DNA, 16 bp, R. norvegicus
acctgccacctgccac

SEQ ID NO: 471782 - DNA, 16 bp, R. norvegicus
acctgccaggagcaca

SEQ ID NO: 471783 - DNA, 16 bp, R. norvegicus
acctgcccaggagcta

SEQ ID NO: 471784 - DNA, 16 bp, R. norvegicus
acctgcccctgcctct

SEQ ID NO: 471785 - DNA, 16 bp, R. norvegicus
acctgccctgagagag

SEQ ID NO: 471786 - DNA, 16 bp, R. norvegicus
acctgcccttgctgtc

SEQ ID NO: 471787 - DNA, 16 bp, R. norvegicus
acctgcctctctgcct

SEQ ID NO: 471788 - DNA, 16 bp, R. norvegicus
acctgcctctgcctca

SEQ ID NO: 471789 - DNA, 16 bp, R. norvegicus
acctgcctcttgagtg

SEQ ID NO: 471790 - DNA, 16 bp, R. norvegicus
acctgcctgcctctgt

SEQ ID NO: 471791 - DNA, 16 bp, R. norvegicus
acctgcctggaggact

SEQ ID NO: 471792 - DNA, 16 bp, R. norvegicus
acctgcctgtctctgt

SEQ ID NO: 471793 - DNA, 16 bp, R. norvegicus
acctgcctgtttctgt

SEQ ID NO: 471794 - DNA, 16 bp, R. norvegicus
acctgctgagccatct

SEQ ID NO: 471795 - DNA, 16 bp, R. norvegicus
acctgctgctcctggg

SEQ ID NO: 471796 - DNA, 16 bp, R. norvegicus
acctgctggctgctgt

SEQ ID NO: 471797 - DNA, 16 bp, R. norvegicus
acctgcttctgtctct

SEQ ID NO: 471798 - DNA, 16 bp, R. norvegicus
acctgcttggtagctg

SEQ ID NO: 471799 - DNA, 16 bp, R. norvegicus
acctggaagacagagg

SEQ ID NO: 471800 - DNA, 16 bp, R. norvegicus
acctggaagagaatga

SEQ ID NO: 471801 - DNA, 16 bp, R. norvegicus
acctggaagcctcctc

SEQ ID NO: 471802 - DNA, 16 bp, R. norvegicus
acctggaccctcagaa

SEQ ID NO: 471803 - DNA, 16 bp, R. norvegicus
acctggaccctgagat

SEQ ID NO: 471804 - DNA, 16 bp, R. norvegicus
acctggacctttgggg

SEQ ID NO: 471805 - DNA, 16 bp, R. norvegicus
acctggagaaatggct

SEQ ID NO: 471806 - DNA, 16 bp, R. norvegicus
acctggagacagaagc

SEQ ID NO: 471807 - DNA, 16 bp, R. norvegicus
acctggagatagaaaa

SEQ ID NO: 471808 - DNA, 16 bp, R. norvegicus
acctggagctcactga

SEQ ID NO: 471809 - DNA, 16 bp, R. norvegicus
acctggagctcatcaa

SEQ ID NO: 471810 - DNA, 16 bp, R. norvegicus
acctggagctcattga

SEQ ID NO: 471811 - DNA, 16 bp, R. norvegicus
acctggagttcactga

SEQ ID NO: 471812 - DNA, 18 bp, R. norvegicus
acctggcaacagaagaga

SEQ ID NO: 471813 - DNA, 16 bp, R. norvegicus
acctggctggcatttg

SEQ ID NO: 471814 - DNA, 16 bp, R. norvegicus
acctgggaaggaaagg

SEQ ID NO: 471815 - DNA, 16 bp, R. norvegicus
acctgggacctctgca

SEQ ID NO: 471816 - DNA, 16 bp, R. norvegicus
acctgggagaatggag

SEQ ID NO: 471817 - DNA, 16 bp, R. norvegicus
acctgggagaggaagg

SEQ ID NO: 471818 - DNA, 22 bp, R. norvegicus
acctgggcaacctgctggcttc

SEQ ID NO: 471819 - DNA, 16 bp, R. norvegicus
acctgggcatcatggg

SEQ ID NO: 471820 - DNA, 16 bp, R. norvegicus
acctgggctacatgat

SEQ ID NO: 471821 - DNA, 16 bp, R. norvegicus
acctgggctggcaggc

SEQ ID NO: 471822 - DNA, 16 bp, R. norvegicus
acctggggctggagag

SEQ ID NO: 471823 - DNA, 16 bp, R. norvegicus
acctgggtcccctgga

SEQ ID NO: 471824 - DNA, 16 bp, R. norvegicus
acctgggtcctctgct

SEQ ID NO: 471825 - DNA, 16 bp, R. norvegicus
acctgggtcctgtgaa

SEQ ID NO: 471826 - DNA, 16 bp, R. norvegicus
acctgggtcttctgga

SEQ ID NO: 471827 - DNA, 16 bp, R. norvegicus
acctgggttctttttg

SEQ ID NO: 471828 - DNA, 16 bp, R. norvegicus
acctggtactggaaac

SEQ ID NO: 471829 - DNA, 16 bp, R. norvegicus
acctggtccaggaaga

SEQ ID NO: 471830 - DNA, 16 bp, R. norvegicus
acctggtgaaggaaga

SEQ ID NO: 471831 - DNA, 16 bp, R. norvegicus
acctgtacacacacac

SEQ ID NO: 471832 - DNA, 16 bp, R. norvegicus
acctgtagtcccagct

SEQ ID NO: 471833 - DNA, 16 bp, R. norvegicus
acctgtctctgccacc

SEQ ID NO: 471834 - DNA, 17 bp, R. norvegicus
acctgtctgggcagtga

SEQ ID NO: 471835 - DNA, 16 bp, R. norvegicus
acctgtgaagatggtt

SEQ ID NO: 471836 - DNA, 16 bp, R. norvegicus
acctgtgcaggctctg

SEQ ID NO: 471837 - DNA, 16 bp, R. norvegicus
acctgtgcatgtgtgt

SEQ ID NO: 471838 - DNA, 16 bp, R. norvegicus
acctgtgccacagctc

SEQ ID NO: 471839 - DNA, 16 bp, R. norvegicus
acctgtgccctgagca

SEQ ID NO: 471840 - DNA, 16 bp, R. norvegicus
acctgtggaagaacag

SEQ ID NO: 471841 - DNA, 16 bp, R. norvegicus
acctgtggaggaggag

SEQ ID NO: 471842 - DNA, 16 bp, R. norvegicus
acctgtggaggaggga

SEQ ID NO: 471843 - DNA, 16 bp, R. norvegicus
acctgtgggctgtggg

SEQ ID NO: 471844 - DNA, 16 bp, R. norvegicus
acctgtggtcttgagg

SEQ ID NO: 471845 - DNA, 17 bp, R. norvegicus
acctgtgtaaagctaca

SEQ ID NO: 471846 - DNA, 16 bp, R. norvegicus
acctgtgtccctggtt

SEQ ID NO: 471847 - DNA, 16 bp, R. norvegicus
acctgtgtctgtgtgt

SEQ ID NO: 471848 - DNA, 16 bp, R. norvegicus
acctgtgtgccccagc

SEQ ID NO: 471849 - DNA, 16 bp, R. norvegicus
acctgtgtggaggtca

SEQ ID NO: 471850 - DNA, 16 bp, R. norvegicus
acctgttttccttcag

SEQ ID NO: 471851 - DNA, 16 bp, R. norvegicus
accttaaatctgtatc

SEQ ID NO: 471852 - DNA, 16 bp, R. norvegicus
accttagcacaactga

SEQ ID NO: 471853 - DNA, 16 bp, R. norvegicus
accttcaagagagaac

SEQ ID NO: 471854 - DNA, 16 bp, R. norvegicus
accttcaatcagcccc

SEQ ID NO: 471855 - DNA, 16 bp, R. norvegicus
accttcaattccagca

SEQ ID NO: 471856 - DNA, 16 bp, R. norvegicus
accttcagagaggtag

SEQ ID NO: 471857 - DNA, 16 bp, R. norvegicus
accttcagaggccaga

SEQ ID NO: 471858 - DNA, 16 bp, R. norvegicus
accttcagcagagtgg

SEQ ID NO: 471859 - DNA, 16 bp, R. norvegicus
accttcagcatttgga

SEQ ID NO: 471860 - DNA, 16 bp, R. norvegicus
accttcaggacagcct

SEQ ID NO: 471861 - DNA, 63 bp, R. norvegicus
accttcatagaagacctcataccaatattatccaaactattccacaaaattgaaacagatgga

SEQ ID NO: 471862 - DNA, 63 bp, R. norvegicus
accttcatagaagaccttataccaatattatccaaactattccacaaaattgaaacagatgga

SEQ ID NO: 471863 - DNA, 17 bp, R. norvegicus
accttcatagaagatct

SEQ ID NO: 471864 - DNA, 16 bp, R. norvegicus
accttccacactgcag

SEQ ID NO: 471865 - DNA, 16 bp, R. norvegicus
accttccagcactgtg

SEQ ID NO: 471866 - DNA, 16 bp, R. norvegicus
accttcccagtgctgg

SEQ ID NO: 471867 - DNA, 16 bp, R. norvegicus
accttccccccattgc

SEQ ID NO: 471868 - DNA, 16 bp, R. norvegicus
accttcccttcagtct

SEQ ID NO: 471869 - DNA, 16 bp, R. norvegicus
accttcctactccact

SEQ ID NO: 471870 - DNA, 16 bp, R. norvegicus
accttcctgatgctga

SEQ ID NO: 471871 - DNA, 16 bp, R. norvegicus
accttcctgcctcagc

SEQ ID NO: 471872 - DNA, 16 bp, R. norvegicus
accttcctgctgtgtc

SEQ ID NO: 471873 - DNA, 16 bp, R. norvegicus
accttcctgtctctgt

SEQ ID NO: 471874 - DNA, 16 bp, R. norvegicus
accttcctgtgtgttc

SEQ ID NO: 471875 - DNA, 16 bp, R. norvegicus
accttctacttcctgt

SEQ ID NO: 471876 - DNA, 16 bp, R. norvegicus
accttctcaccacctc

SEQ ID NO: 471877 - DNA, 16 bp, R. norvegicus
accttctccaattttg

SEQ ID NO: 471878 - DNA, 16 bp, R. norvegicus
accttgacagcacacc

SEQ ID NO: 471879 - DNA, 16 bp, R. norvegicus
accttgaccaggactg

SEQ ID NO: 471880 - DNA, 16 bp, R. norvegicus
accttgagtgtgtcag

SEQ ID NO: 471881 - DNA, 16 bp, R. norvegicus
accttgatggatttcc

SEQ ID NO: 471882 - DNA, 16 bp, R. norvegicus
accttgatttcttcct

SEQ ID NO: 471883 - DNA, 16 bp, R. norvegicus
accttgggaggaagga

SEQ ID NO: 471884 - DNA, 16 bp, R. norvegicus
accttggtgtgattct

SEQ ID NO: 471885 - DNA, 16 bp, R. norvegicus
accttggtttctccat

SEQ ID NO: 471886 - DNA, 16 bp, R. norvegicus
acctttaatctcagcc

SEQ ID NO: 471887 - DNA, 16 bp, R. norvegicus
acctttaatggctgct

SEQ ID NO: 471888 - DNA, 16 bp, R. norvegicus
acctttaattgcagca

SEQ ID NO: 471889 - DNA, 16 bp, R. norvegicus
acctttcagaatcaca

SEQ ID NO: 471890 - DNA, 16 bp, R. norvegicus
acctttggaaaagcag

SEQ ID NO: 471891 - DNA, 16 bp, R. norvegicus
acctttgtgaaatatg

SEQ ID NO: 471892 - DNA, 16 bp, R. norvegicus
accttttcttcagttc

SEQ ID NO: 471893 - DNA, 16 bp, R. norvegicus
acgaagatgaactctc

SEQ ID NO: 471894 - DNA, 16 bp, R. norvegicus
acgaattaaaaatgga

SEQ ID NO: 471895 - DNA, 16 bp, R. norvegicus
acgacaatgacaatga

SEQ ID NO: 471896 - DNA, 16 bp, R. norvegicus
acgacaatgacgatga

SEQ ID NO: 471897 - DNA, 16 bp, R. norvegicus
acgacaatgatgatga

SEQ ID NO: 471898 - DNA, 16 bp, R. norvegicus
acgacatggtggctca

SEQ ID NO: 471899 - DNA, 16 bp, R. norvegicus
acgaccagaggagatc

SEQ ID NO: 471900 - DNA, 16 bp, R. norvegicus
acgacgacgacgacga

SEQ ID NO: 471901 - DNA, 16 bp, R. norvegicus
acgacgaggaggagga

SEQ ID NO: 471902 - DNA, 16 bp, R. norvegicus
acgagagcttccaggg

SEQ ID NO: 471903 - DNA, 16 bp, R. norvegicus
acgagcagctgaaaga

SEQ ID NO: 471904 - DNA, 16 bp, R. norvegicus
acgagcccaggtccag

SEQ ID NO: 471905 - DNA, 16 bp, R. norvegicus
acgaggaccttgcatt

SEQ ID NO: 471906 - DNA, 16 bp, R. norvegicus
acgagttcaaggccag

SEQ ID NO: 471907 - DNA, 16 bp, R. norvegicus
acgatcaagtaggctt

SEQ ID NO: 471908 - DNA, 16 bp, R. norvegicus
acgatgacgacgacga

SEQ ID NO: 471909 - DNA, 17 bp, R. norvegicus
acgatgacgacgatgac

SEQ ID NO: 471910 - DNA, 17 bp, R. norvegicus
acgatgacgatgatgat

SEQ ID NO: 471911 - DNA, 16 bp, R. norvegicus
acgatgactttatgaa

SEQ ID NO: 471912 - DNA, 16 bp, R. norvegicus
acgatgtgaggaagcc

SEQ ID NO: 471913 - DNA, 16 bp, R. norvegicus
acgcaagcacgcacgc

SEQ ID NO: 471914 - DNA, 16 bp, R. norvegicus
acgcacagacacagac

SEQ ID NO: 471915 - DNA, 16 bp, R. norvegicus
acgcagcctgtccctt

SEQ ID NO: 471916 - DNA, 16 bp, R. norvegicus
acgcatgcacacacat

SEQ ID NO: 471917 - DNA, 16 bp, R. norvegicus
acgcatgcactcacac

SEQ ID NO: 471918 - DNA, 16 bp, R. norvegicus
acgcctttgatcccag

SEQ ID NO: 471919 - DNA, 16 bp, R. norvegicus
acgctgctgctgctgc

SEQ ID NO: 471920 - DNA, 16 bp, R. norvegicus
acggaaatagaaacaa

SEQ ID NO: 471921 - DNA, 16 bp, R. norvegicus
acggaccggataaaca

SEQ ID NO: 471922 - DNA, 16 bp, R. norvegicus
acggaggccagaagaa

SEQ ID NO: 471923 - DNA, 16 bp, R. norvegicus
acggatggctgtgagc

SEQ ID NO: 471924 - DNA, 16 bp, R. norvegicus
acggctggaggaagtg

SEQ ID NO: 471925 - DNA, 30 bp, R. norvegicus
acgggcctcaacaggtacagaaagatagag

SEQ ID NO: 471926 - DNA, 16 bp, R. norvegicus
acgggctggggattta

SEQ ID NO: 471927 - DNA, 16 bp, R. norvegicus
acggggcctggtggcg

SEQ ID NO: 471928 - DNA, 17 bp, R. norvegicus
acggggctggggattta

SEQ ID NO: 471929 - DNA, 16 bp, R. norvegicus
acgtacaacataccca

SEQ ID NO: 471930 - DNA, 16 bp, R. norvegicus
acgtgcgcgcgcgcgc

SEQ ID NO: 471931 - DNA, 16 bp, R. norvegicus
acgtggtgctggagaa

SEQ ID NO: 471932 - DNA, 16 bp, R. norvegicus
acgtggtgctggagag

SEQ ID NO: 471933 - DNA, 16 bp, R. norvegicus
acgtgtatatatatat

SEQ ID NO: 471934 - DNA, 16 bp, R. norvegicus
acgtgtcggcctggag

SEQ ID NO: 471935 - DNA, 16 bp, R. norvegicus
actaaaaagcctatat

SEQ ID NO: 471936 - DNA, 16 bp, R. norvegicus
actaaaatcaagaact

SEQ ID NO: 471937 - DNA, 16 bp, R. norvegicus
actaaaatcaaggact

SEQ ID NO: 471938 - DNA, 16 bp, R. norvegicus
actaaacagaaacata

SEQ ID NO: 471939 - DNA, 16 bp, R. norvegicus
actaaacatggacaga

SEQ ID NO: 471940 - DNA, 16 bp, R. norvegicus
actaaagaagctgaag

SEQ ID NO: 471941 - DNA, 16 bp, R. norvegicus
actaaagatgttgagc

SEQ ID NO: 471942 - DNA, 16 bp, R. norvegicus
actaaaggtcataaaa

SEQ ID NO: 471943 - DNA, 16 bp, R. norvegicus
actaaataatgaaaat

SEQ ID NO: 471944 - DNA, 16 bp, R. norvegicus
actaaatgaatttaca

SEQ ID NO: 471945 - DNA, 59 bp, R. norvegicus
actaacaagcagtacctgcccactaacaagcagtacctgcccactaacaagcagtacct

SEQ ID NO: 471946 - DNA, 17 bp, R. norvegicus
actaacaatggaggagt

SEQ ID NO: 471947 - DNA, 16 bp, R. norvegicus
actaactttggcaata

SEQ ID NO: 471948 - DNA, 16 bp, R. norvegicus
actaagaaaatgccct

SEQ ID NO: 471949 - DNA, 16 bp, R. norvegicus
actaagataaaaaact

SEQ ID NO: 471950 - DNA, 16 bp, R. norvegicus
actaagatcaaaaact

SEQ ID NO: 471951 - DNA, 16 bp, R. norvegicus
actaagcagcacccct

SEQ ID NO: 471952 - DNA, 16 bp, R. norvegicus
actaaggatgctgaac

SEQ ID NO: 471953 - DNA, 16 bp, R. norvegicus
actaatgctcaaaaca

SEQ ID NO: 471954 - DNA, 16 bp, R. norvegicus
actaattgaagaaaaa

SEQ ID NO: 471955 - DNA, 16 bp, R. norvegicus
actacaacacacttct

SEQ ID NO: 471956 - DNA, 16 bp, R. norvegicus
actacaagtctctgaa

SEQ ID NO: 471957 - DNA, 16 bp, R. norvegicus
actacacacctgagag

SEQ ID NO: 471958 - DNA, 16 bp, R. norvegicus
actacaccatacagaa

SEQ ID NO: 471959 - DNA, 16 bp, R. norvegicus
actacactcatgtgca

SEQ ID NO: 471960 - DNA, 16 bp, R. norvegicus
actacagaaaagcttt

SEQ ID NO: 471961 - DNA, 16 bp, R. norvegicus
actacagagcaattgt

SEQ ID NO: 471962 - DNA, 16 bp, R. norvegicus
actacagagccaagag

SEQ ID NO: 471963 - DNA, 16 bp, R. norvegicus
actacatgaaattctc

SEQ ID NO: 471964 - DNA, 16 bp, R. norvegicus
actacatgatcatctc

SEQ ID NO: 471965 - DNA, 16 bp, R. norvegicus
actacatttcccagaa

SEQ ID NO: 471966 - DNA, 16 bp, R. norvegicus
actaccaaaagactgt

SEQ ID NO: 471967 - DNA, 16 bp, R. norvegicus
actaccaccactacca

SEQ ID NO: 471968 - DNA, 16 bp, R. norvegicus
actaccactaccacca

SEQ ID NO: 471969 - DNA, 16 bp, R. norvegicus
actaccatgcctggac

SEQ ID NO: 471970 - DNA, 16 bp, R. norvegicus
actacccaaagagtat

SEQ ID NO: 471971 - DNA, 20 bp, R. norvegicus
actaccgaataccttctaca

SEQ ID NO: 471972 - DNA, 16 bp, R. norvegicus
actacctcagagagaa

SEQ ID NO: 471973 - DNA, 43 bp, R. norvegicus
actacctcgagagtggcctgtccttctactactgctgccttac

SEQ ID NO: 471974 - DNA, 16 bp, R. norvegicus
actacctgaggacaca

SEQ ID NO: 471975 - DNA, 22 bp, R. norvegicus
actacctgcatctggttactat

SEQ ID NO: 471976 - DNA, 16 bp, R. norvegicus
actactactactactc

SEQ ID NO: 471977 - DNA, 16 bp, R. norvegicus
actactgagccatctc

SEQ ID NO: 471978 - DNA, 16 bp, R. norvegicus
actactgtactttatt

SEQ ID NO: 471979 - DNA, 16 bp, R. norvegicus
actacttgagaaggat

SEQ ID NO: 471980 - DNA, 16 bp, R. norvegicus
actagaaaacatcatt

SEQ ID NO: 471981 - DNA, 16 bp, R. norvegicus
actagaaaagcaagat

SEQ ID NO: 471982 - DNA, 16 bp, R. norvegicus
actagaaaatgtcttc

SEQ ID NO: 471983 - DNA, 16 bp, R. norvegicus
actagaaagttccaga

SEQ ID NO: 471984 - DNA, 16 bp, R. norvegicus
actagacagtggatgt

SEQ ID NO: 471985 - DNA, 16 bp, R. norvegicus
actagagaggtggctc

SEQ ID NO: 471986 - DNA, 16 bp, R. norvegicus
actagatatcccaaca

SEQ ID NO: 471987 - DNA, 16 bp, R. norvegicus
actagattggcctgtg

SEQ ID NO: 471988 - DNA, 16 bp, R. norvegicus
actagccttgaacttg

SEQ ID NO: 471989 - DNA, 16 bp, R. norvegicus
actaggcacaaacctt

SEQ ID NO: 471990 - DNA, 16 bp, R. norvegicus
actaggctggcctgga

SEQ ID NO: 471991 - DNA, 16 bp, R. norvegicus
actagtaaacctgata

SEQ ID NO: 471992 - DNA, 16 bp, R. norvegicus
actataaaaacttcat

SEQ ID NO: 471993 - DNA, 16 bp, R. norvegicus
actataaaattatttc

SEQ ID NO: 471994 - DNA, 16 bp, R. norvegicus
actatagctactgaaa

SEQ ID NO: 471995 - DNA, 16 bp, R. norvegicus
actatattgaaaaagt

SEQ ID NO: 471996 - DNA, 16 bp, R. norvegicus
actatcaggaggtgtg

SEQ ID NO: 471997 - DNA, 16 bp, R. norvegicus
actatcccacaaaata

SEQ ID NO: 471998 - DNA, 16 bp, R. norvegicus
actatgaaaagacaaa

SEQ ID NO: 471999 - DNA, 16 bp, R. norvegicus
actatgaaaggcagaa

SEQ ID NO: 472000 - DNA, 16 bp, R. norvegicus
actatgaataaagctg

SEQ ID NO: 472001 - DNA, 16 bp, R. norvegicus
actatgaatttcataa

SEQ ID NO: 472002 - DNA, 16 bp, R. norvegicus
actatgagttttcctt

SEQ ID NO: 472003 - DNA, 16 bp, R. norvegicus
actatggaaacatcaa

SEQ ID NO: 472004 - DNA, 16 bp, R. norvegicus
actatggcactatgac

SEQ ID NO: 472005 - DNA, 16 bp, R. norvegicus
actatggtgtgcttac

SEQ ID NO: 472006 - DNA, 16 bp, R. norvegicus
actatggttggtttgc

SEQ ID NO: 472007 - DNA, 16 bp, R. norvegicus
actatgtagccaagaa

SEQ ID NO: 472008 - DNA, 16 bp, R. norvegicus
actatgtgatgggagg

SEQ ID NO: 472009 - DNA, 16 bp, R. norvegicus
actatgttcattgtgg

SEQ ID NO: 472010 - DNA, 16 bp, R. norvegicus
actattacacaaaata

SEQ ID NO: 472011 - DNA, 16 bp, R. norvegicus
actattccacaaagta

SEQ ID NO: 472012 - DNA, 16 bp, R. norvegicus
actattccagaaaatt

SEQ ID NO: 472013 - DNA, 16 bp, R. norvegicus
actatttagctattaa

SEQ ID NO: 472014 - DNA, 16 bp, R. norvegicus
actatttattgaaaat

SEQ ID NO: 472015 - DNA, 16 bp, R. norvegicus
actatttgctgaaaat

SEQ ID NO: 472016 - DNA, 16 bp, R. norvegicus
actcaaaatattttct

SEQ ID NO: 472017 - DNA, 16 bp, R. norvegicus
actcaaactcaggtca

SEQ ID NO: 472018 - DNA, 59 bp, R. norvegicus
actcaaacttatagaagaaaaactagggaagcatctggaacacatgggcactggaaaaa

SEQ ID NO: 472019 - DNA, 16 bp, R. norvegicus
actcaaagaaataaac

SEQ ID NO: 472020 - DNA, 16 bp, R. norvegicus
actcaaagctctggat

SEQ ID NO: 472021 - DNA, 16 bp, R. norvegicus
actcaacaaggccatc

SEQ ID NO: 472022 - DNA, 25 bp, R. norvegicus
actcaactgtcaaagataatggaaa

SEQ ID NO: 472023 - DNA, 16 bp, R. norvegicus
actcaagaaggaagac

SEQ ID NO: 472024 - DNA, 16 bp, R. norvegicus
actcaagaagttcaac

SEQ ID NO: 472025 - DNA, 16 bp, R. norvegicus
actcaagaccagcctg

SEQ ID NO: 472026 - DNA, 16 bp, R. norvegicus
actcaagaggcagagg

SEQ ID NO: 472027 - DNA, 16 bp, R. norvegicus
actcaagaggctgaag

SEQ ID NO: 472028 - DNA, 16 bp, R. norvegicus
actcaaggagctgaag

SEQ ID NO: 472029 - DNA, 16 bp, R. norvegicus
actcaaggcaggaacc

SEQ ID NO: 472030 - DNA, 16 bp, R. norvegicus
actcaagttccagggg

SEQ ID NO: 472031 - DNA, 16 bp, R. norvegicus
actcacaacaatcctc

SEQ ID NO: 472032 - DNA, 16 bp, R. norvegicus
actcacacacatgaaa

SEQ ID NO: 472033 - DNA, 16 bp, R. norvegicus
actcacacactcaaac

SEQ ID NO: 472034 - DNA, 16 bp, R. norvegicus
actcacagacaatatg

SEQ ID NO: 472035 - DNA, 16 bp, R. norvegicus
actcacagagacccgc

SEQ ID NO: 472036 - DNA, 16 bp, R. norvegicus
actcacagagtccaca

SEQ ID NO: 472037 - DNA, 16 bp, R. norvegicus
actcacagcagtcctc

SEQ ID NO: 472038 - DNA, 16 bp, R. norvegicus
actcacagccaaccat

SEQ ID NO: 472039 - DNA, 16 bp, R. norvegicus
actcacataaagacca

SEQ ID NO: 472040 - DNA, 16 bp, R. norvegicus
actcacatgtgtgtgc

SEQ ID NO: 472041 - DNA, 16 bp, R. norvegicus
actcaccagaagaggg

SEQ ID NO: 472042 - DNA, 16 bp, R. norvegicus
actcaccatgtagcca

SEQ ID NO: 472043 - DNA, 16 bp, R. norvegicus
actcacctccaagggg

SEQ ID NO: 472044 - DNA, 16 bp, R. norvegicus
actcacctgtctctgc

SEQ ID NO: 472045 - DNA, 16 bp, R. norvegicus
actcactctctctctc

SEQ ID NO: 472046 - DNA, 16 bp, R. norvegicus
actcactgacaaatgg

SEQ ID NO: 472047 - DNA, 16 bp, R. norvegicus
actcactgataagtgg

SEQ ID NO: 472048 - DNA, 16 bp, R. norvegicus
actcagaaggcagagg

SEQ ID NO: 472049 - DNA, 16 bp, R. norvegicus
actcagacagacagac

SEQ ID NO: 472050 - DNA, 16 bp, R. norvegicus
actcagactcaaaagg

SEQ ID NO: 472051 - DNA, 16 bp, R. norvegicus
actcagagacctcctt

SEQ ID NO: 472052 - DNA, 16 bp, R. norvegicus
actcagagatcctcct

SEQ ID NO: 472053 - DNA, 16 bp, R. norvegicus
actcagagatctgcct

SEQ ID NO: 472054 - DNA, 16 bp, R. norvegicus
actcagagatgaaatc

SEQ ID NO: 472055 - DNA, 16 bp, R. norvegicus
actcagagctggaatc

SEQ ID NO: 472056 - DNA, 16 bp, R. norvegicus
actcagatcctcatgc

SEQ ID NO: 472057 - DNA, 16 bp, R. norvegicus
actcagatctgcctgc

SEQ ID NO: 472058 - DNA, 16 bp, R. norvegicus
actcagatgacagcaa

SEQ ID NO: 472059 - DNA, 16 bp, R. norvegicus
actcagatgttcttca

SEQ ID NO: 472060 - DNA, 16 bp, R. norvegicus
actcagccattaagaa

SEQ ID NO: 472061 - DNA, 16 bp, R. norvegicus
actcagctatcataaa

SEQ ID NO: 472062 - DNA, 16 bp, R. norvegicus
actcagctattaagga

SEQ ID NO: 472063 - DNA, 17 bp, R. norvegicus
actcagctgcttaagct

SEQ ID NO: 472064 - DNA, 16 bp, R. norvegicus
actcagctgtcctggc

SEQ ID NO: 472065 - DNA, 16 bp, R. norvegicus
actcaggaagcagagg

SEQ ID NO: 472066 - DNA, 16 bp, R. norvegicus
actcaggacctctgtt

SEQ ID NO: 472067 - DNA, 16 bp, R. norvegicus
actcaggaccttggca

SEQ ID NO: 472068 - DNA, 16 bp, R. norvegicus
actcaggacttctggg

SEQ ID NO: 472069 - DNA, 16 bp, R. norvegicus
actcaggagactgagg

SEQ ID NO: 472070 - DNA, 16 bp, R. norvegicus
actcaggagagctggc

SEQ ID NO: 472071 - DNA, 16 bp, R. norvegicus
actcaggagccagagg

SEQ ID NO: 472072 - DNA, 16 bp, R. norvegicus
actcaggagcctgagg

SEQ ID NO: 472073 - DNA, 16 bp, R. norvegicus
actcaggaggcaaaag

SEQ ID NO: 472074 - DNA, 16 bp, R. norvegicus
actcaggaggcaggga

SEQ ID NO: 472075 - DNA, 16 bp, R. norvegicus
actcaggaggcaggtg

SEQ ID NO: 472076 - DNA, 16 bp, R. norvegicus
actcaggagtcagagg

SEQ ID NO: 472077 - DNA, 16 bp, R. norvegicus
actcaggatacagagg

SEQ ID NO: 472078 - DNA, 16 bp, R. norvegicus
actcaggatgatttct

SEQ ID NO: 472079 - DNA, 16 bp, R. norvegicus
actcaggatgtttttt

SEQ ID NO: 472080 - DNA, 16 bp, R. norvegicus
actcaggcagctggca

SEQ ID NO: 472081 - DNA, 16 bp, R. norvegicus
actcaggccccttcag

SEQ ID NO: 472082 - DNA, 16 bp, R. norvegicus
actcaggctggcctgg

SEQ ID NO: 472083 - DNA, 16 bp, R. norvegicus
actcaggctggctttg

SEQ ID NO: 472084 - DNA, 16 bp, R. norvegicus
actcagggtctctgga

SEQ ID NO: 472085 - DNA, 16 bp, R. norvegicus
actcaggtctccaggc

SEQ ID NO: 472086 - DNA, 16 bp, R. norvegicus
actcaggtcttctgaa

SEQ ID NO: 472087 - DNA, 17 bp, R. norvegicus
actcaggtgactttcca

SEQ ID NO: 472088 - DNA, 16 bp, R. norvegicus
actcaggtggcagaga

SEQ ID NO: 472089 - DNA, 16 bp, R. norvegicus
actcagtcacaaaaca

SEQ ID NO: 472090 - DNA, 16 bp, R. norvegicus
actcagtccactgtgg

SEQ ID NO: 472091 - DNA, 16 bp, R. norvegicus
actcagtgtcagctct

SEQ ID NO: 472092 - DNA, 16 bp, R. norvegicus
actcatacacataaaa

SEQ ID NO: 472093 - DNA, 16 bp, R. norvegicus
actcatatgcattaaa

SEQ ID NO: 472094 - DNA, 16 bp, R. norvegicus
actcatcaaaggaaat

SEQ ID NO: 472095 - DNA, 16 bp, R. norvegicus
actcatccactcattc

SEQ ID NO: 472096 - DNA, 16 bp, R. norvegicus
actcatcgataagtgg

SEQ ID NO: 472097 - DNA, 16 bp, R. norvegicus
actcatgaccaaggca

SEQ ID NO: 472098 - DNA, 16 bp, R. norvegicus
actcatgatcttctgg

SEQ ID NO: 472099 - DNA, 16 bp, R. norvegicus
actcatgtaaataaaa

SEQ ID NO: 472100 - DNA, 16 bp, R. norvegicus
actcatgtagaccagg

SEQ ID NO: 472101 - DNA, 16 bp, R. norvegicus
actcattaaagaaaaa

SEQ ID NO: 472102 - DNA, 16 bp, R. norvegicus
actcattcagagcctg

SEQ ID NO: 472103 - DNA, 16 bp, R. norvegicus
actcattgaacacaga

SEQ ID NO: 472104 - DNA, 16 bp, R. norvegicus
actcattgtcagagtc

SEQ ID NO: 472105 - DNA, 16 bp, R. norvegicus
actcatttactcagtc

SEQ ID NO: 472106 - DNA, 16 bp, R. norvegicus
actccaaagttcaaag

SEQ ID NO: 472107 - DNA, 16 bp, R. norvegicus
actccaacaaggcctc

SEQ ID NO: 472108 - DNA, 16 bp, R. norvegicus
actccaacccaaggaa

SEQ ID NO: 472109 - DNA, 16 bp, R. norvegicus
actccacaagaagacc

SEQ ID NO: 472110 - DNA, 16 bp, R. norvegicus
actccacagacccaaa

SEQ ID NO: 472111 - DNA, 16 bp, R. norvegicus
actccacagagtgaca

SEQ ID NO: 472112 - DNA, 16 bp, R. norvegicus
actccaccagagaact

SEQ ID NO: 472113 - DNA, 16 bp, R. norvegicus
actccactatgtttat

SEQ ID NO: 472114 - DNA, 16 bp, R. norvegicus
actccactgcccctgc

SEQ ID NO: 472115 - DNA, 16 bp, R. norvegicus
actccagagaccagca

SEQ ID NO: 472116 - DNA, 16 bp, R. norvegicus
actccagagactgcag

SEQ ID NO: 472117 - DNA, 16 bp, R. norvegicus
actccagaggaaaaga

SEQ ID NO: 472118 - DNA, 16 bp, R. norvegicus
actccagcaagctgtc

SEQ ID NO: 472119 - DNA, 16 bp, R. norvegicus
actccagcagggagga

SEQ ID NO: 472120 - DNA, 16 bp, R. norvegicus
actccagcctgctgca

SEQ ID NO: 472121 - DNA, 16 bp, R. norvegicus
actccagctgcaggag

SEQ ID NO: 472122 - DNA, 16 bp, R. norvegicus
actccaggcaggaacc

SEQ ID NO: 472123 - DNA, 16 bp, R. norvegicus
actccaggctcagcct

SEQ ID NO: 472124 - DNA, 16 bp, R. norvegicus
actccagtcccaggag

SEQ ID NO: 472125 - DNA, 16 bp, R. norvegicus
actccagttccaaggt

SEQ ID NO: 472126 - DNA, 16 bp, R. norvegicus
actccagttccagagg

SEQ ID NO: 472127 - DNA, 16 bp, R. norvegicus
actccagttctgggga

SEQ ID NO: 472128 - DNA, 16 bp, R. norvegicus
actccatcagggccac

SEQ ID NO: 472129 - DNA, 16 bp, R. norvegicus
actccatcatccctgc

SEQ ID NO: 472130 - DNA, 16 bp, R. norvegicus
actccatccctggact

SEQ ID NO: 472131 - DNA, 16 bp, R. norvegicus
actccatcttgtttct

SEQ ID NO: 472132 - DNA, 16 bp, R. norvegicus
actccattctcagttc

SEQ ID NO: 472133 - DNA, 16 bp, R. norvegicus
actccattgtgcagat

SEQ ID NO: 472134 - DNA, 16 bp, R. norvegicus
actccattttagagaa

SEQ ID NO: 472135 - DNA, 16 bp, R. norvegicus
actcccagccttctgg

SEQ ID NO: 472136 - DNA, 16 bp, R. norvegicus
actcccagctcaatgg

SEQ ID NO: 472137 - DNA, 16 bp, R. norvegicus
actcccaggagaccag

SEQ ID NO: 472138 - DNA, 16 bp, R. norvegicus
actcccaggaggccag

SEQ ID NO: 472139 - DNA, 16 bp, R. norvegicus
actcccctgcactggg

SEQ ID NO: 472140 - DNA, 17 bp, R. norvegicus
actccctaataaaaaga

SEQ ID NO: 472141 - DNA, 16 bp, R. norvegicus
actccctcctcaacac

SEQ ID NO: 472142 - DNA, 16 bp, R. norvegicus
actccctctgtgaccc

SEQ ID NO: 472143 - DNA, 28 bp, R. norvegicus
actccctgaggatgggtcatccccctgc

SEQ ID NO: 472144 - DNA, 16 bp, R. norvegicus
actcccttgcagctag

SEQ ID NO: 472145 - DNA, 16 bp, R. norvegicus
actcccttggagaaca

SEQ ID NO: 472146 - DNA, 17 bp, R. norvegicus
actccgtggtggcccag

SEQ ID NO: 472147 - DNA, 16 bp, R. norvegicus
actcctcacccagtga

SEQ ID NO: 472148 - DNA, 16 bp, R. norvegicus
actcctccacagcctc

SEQ ID NO: 472149 - DNA, 16 bp, R. norvegicus
actcctctgttgttgg

SEQ ID NO: 472150 - DNA, 16 bp, R. norvegicus
actcctgaccttcctg

SEQ ID NO: 472151 - DNA, 16 bp, R. norvegicus
actcctgagcctcctg

SEQ ID NO: 472152 - DNA, 16 bp, R. norvegicus
actcctgaggctgcat

SEQ ID NO: 472153 - DNA, 16 bp, R. norvegicus
actcctgatcctcctt

SEQ ID NO: 472154 - DNA, 16 bp, R. norvegicus
actcctgatctttctg

SEQ ID NO: 472155 - DNA, 16 bp, R. norvegicus
actcctgattcttctg

SEQ ID NO: 472156 - DNA, 16 bp, R. norvegicus
actcctgccagccagg

SEQ ID NO: 472157 - DNA, 16 bp, R. norvegicus
actcctgctgctgctg

SEQ ID NO: 472158 - DNA, 16 bp, R. norvegicus
actcctgcttcagcct

SEQ ID NO: 472159 - DNA, 16 bp, R. norvegicus
actcctggaagagcag

SEQ ID NO: 472160 - DNA, 16 bp, R. norvegicus
actcctggagattggc

SEQ ID NO: 472161 - DNA, 16 bp, R. norvegicus
actcctggctgcaggt

SEQ ID NO: 472162 - DNA, 16 bp, R. norvegicus
actcctgggagaccaa

SEQ ID NO: 472163 - DNA, 16 bp, R. norvegicus
actcctgggtgttcag

SEQ ID NO: 472164 - DNA, 16 bp, R. norvegicus
actcctgtgcccctgc

SEQ ID NO: 472165 - DNA, 16 bp, R. norvegicus
actcctgtggaagctg

SEQ ID NO: 472166 - DNA, 16 bp, R. norvegicus
actccttcagctgctt

SEQ ID NO: 472167 - DNA, 16 bp, R. norvegicus
actccttcatattaaa

SEQ ID NO: 472168 - DNA, 16 bp, R. norvegicus
actccttcattgggga

SEQ ID NO: 472169 - DNA, 16 bp, R. norvegicus
actccttcctgcctcc

SEQ ID NO: 472170 - DNA, 16 bp, R. norvegicus
actccttggggcctcc

SEQ ID NO: 472171 - DNA, 16 bp, R. norvegicus
actcgaggcagaggca

SEQ ID NO: 472172 - DNA, 16 bp, R. norvegicus
actctacaaactgagc

SEQ ID NO: 472173 - DNA, 16 bp, R. norvegicus
actctagagaaaaaca

SEQ ID NO: 472174 - DNA, 16 bp, R. norvegicus
actctagcttgtgtca

SEQ ID NO: 472175 - DNA, 16 bp, R. norvegicus
actctatcctacaatt

SEQ ID NO: 472176 - DNA, 16 bp, R. norvegicus
actctatgaagaactg

SEQ ID NO: 472177 - DNA, 16 bp, R. norvegicus
actctcagaggacagt

SEQ ID NO: 472178 - DNA, 16 bp, R. norvegicus
actctcagctcctaca

SEQ ID NO: 472179 - DNA, 16 bp, R. norvegicus
actctcagcttcctct

SEQ ID NO: 472180 - DNA, 16 bp, R. norvegicus
actctcaggacccaaa

SEQ ID NO: 472181 - DNA, 37 bp, R. norvegicus
actctcccacagagccccattagaggataagcccatc

SEQ ID NO: 472182 - DNA, 16 bp, R. norvegicus
actctccgtgtcctct

SEQ ID NO: 472183 - DNA, 16 bp, R. norvegicus
actctctacctactta

SEQ ID NO: 472184 - DNA, 16 bp, R. norvegicus
actctctatgtcaatg

SEQ ID NO: 472185 - DNA, 16 bp, R. norvegicus
actctctattcaatga

SEQ ID NO: 472186 - DNA, 16 bp, R. norvegicus
actctctcaagttctc

SEQ ID NO: 472187 - DNA, 16 bp, R. norvegicus
actctctctgtgccct

SEQ ID NO: 472188 - DNA, 16 bp, R. norvegicus
actctctgcatattgt

SEQ ID NO: 472189 - DNA, 16 bp, R. norvegicus
actctctgcctacatt

SEQ ID NO: 472190 - DNA, 16 bp, R. norvegicus
actctctgctcacatt

SEQ ID NO: 472191 - DNA, 16 bp, R. norvegicus
actctctgctgatggg

SEQ ID NO: 472192 - DNA, 16 bp, R. norvegicus
actctctggaaatcag

SEQ ID NO: 472193 - DNA, 16 bp, R. norvegicus
actctcttctgtacct

SEQ ID NO: 472194 - DNA, 16 bp, R. norvegicus
actctgacacctaaac

SEQ ID NO: 472195 - DNA, 16 bp, R. norvegicus
actctgagatttcatc

SEQ ID NO: 472196 - DNA, 16 bp, R. norvegicus
actctgagctgcagga

SEQ ID NO: 472197 - DNA, 16 bp, R. norvegicus
actctgcatctccata

SEQ ID NO: 472198 - DNA, 17 bp, R. norvegicus
actctgccagttcctta

SEQ ID NO: 472199 - DNA, 16 bp, R. norvegicus
actctgccccacagtt

SEQ ID NO: 472200 - DNA, 16 bp, R. norvegicus
actctgcctcagaaaa

SEQ ID NO: 472201 - DNA, 16 bp, R. norvegicus
actctgctctcaggtg

SEQ ID NO: 472202 - DNA, 16 bp, R. norvegicus
actctggaaatacaga

SEQ ID NO: 472203 - DNA, 16 bp, R. norvegicus
actctggaagcagaag

SEQ ID NO: 472204 - DNA, 16 bp, R. norvegicus
actctggaggcagagg

SEQ ID NO: 472205 - DNA, 16 bp, R. norvegicus
actctggaggtagagg

SEQ ID NO: 472206 - DNA, 16 bp, R. norvegicus
actctggaggtggagg

SEQ ID NO: 472207 - DNA, 16 bp, R. norvegicus
actctggccaaggaca

SEQ ID NO: 472208 - DNA, 16 bp, R. norvegicus
actctggctggcctgg

SEQ ID NO: 472209 - DNA, 16 bp, R. norvegicus
actctgtagatcagtc

SEQ ID NO: 472210 - DNA, 16 bp, R. norvegicus
actctgtagccctggc

SEQ ID NO: 472211 - DNA, 17 bp, R. norvegicus
actctgtgcacatccag

SEQ ID NO: 472212 - DNA, 16 bp, R. norvegicus
actctgttcccatagc

SEQ ID NO: 472213 - DNA, 16 bp, R. norvegicus
actcttaaccactgag

SEQ ID NO: 472214 - DNA, 16 bp, R. norvegicus
actcttaactgctgag

SEQ ID NO: 472215 - DNA, 16 bp, R. norvegicus
actcttataaaggaaa

SEQ ID NO: 472216 - DNA, 16 bp, R. norvegicus
actcttatgaggacaa

SEQ ID NO: 472217 - DNA, 16 bp, R. norvegicus
actcttatggaagaaa

SEQ ID NO: 472218 - DNA, 16 bp, R. norvegicus
actcttcaaactcttc

SEQ ID NO: 472219 - DNA, 16 bp, R. norvegicus
actcttcagctccacc

SEQ ID NO: 472220 - DNA, 16 bp, R. norvegicus
actcttccactgagct

SEQ ID NO: 472221 - DNA, 18 bp, R. norvegicus
actcttccagttctttct

SEQ ID NO: 472222 - DNA, 16 bp, R. norvegicus
actcttccttccacct

SEQ ID NO: 472223 - DNA, 16 bp, R. norvegicus
actcttctgcactggg

SEQ ID NO: 472224 - DNA, 16 bp, R. norvegicus
actcttctgcctcagc

SEQ ID NO: 472225 - DNA, 16 bp, R. norvegicus
actcttggaagaattg

SEQ ID NO: 472226 - DNA, 16 bp, R. norvegicus
actcttgggcatatac

SEQ ID NO: 472227 - DNA, 16 bp, R. norvegicus
actcttgggccaggga

SEQ ID NO: 472228 - DNA, 16 bp, R. norvegicus
actcttgtcttggcat

SEQ ID NO: 472229 - DNA, 16 bp, R. norvegicus
actctttcagcttctt

SEQ ID NO: 472230 - DNA, 16 bp, R. norvegicus
actctttctacctcct

SEQ ID NO: 472231 - DNA, 16 bp, R. norvegicus
actctttgaagaatta

SEQ ID NO: 472232 - DNA, 16 bp, R. norvegicus
actgaaaaaaattaca

SEQ ID NO: 472233 - DNA, 16 bp, R. norvegicus
actgaaaaaatatttt

SEQ ID NO: 472234 - DNA, 16 bp, R. norvegicus
actgaaacattgtttc

SEQ ID NO: 472235 - DNA, 16 bp, R. norvegicus
actgaaactggagctc

SEQ ID NO: 472236 - DNA, 16 bp, R. norvegicus
actgaaacttctagaa

SEQ ID NO: 472237 - DNA, 16 bp, R. norvegicus
actgaaagagctttaa

SEQ ID NO: 472238 - DNA, 16 bp, R. norvegicus
actgaaagagtttgaa

SEQ ID NO: 472239 - DNA, 16 bp, R. norvegicus
actgaaagatgaaaac

SEQ ID NO: 472240 - DNA, 16 bp, R. norvegicus
actgaaaggaaagaaa

SEQ ID NO: 472241 - DNA, 16 bp, R. norvegicus
actgaaatttctccaa

SEQ ID NO: 472242 - DNA, 16 bp, R. norvegicus
actgaacagctactgg

SEQ ID NO: 472243 - DNA, 16 bp, R. norvegicus
actgaaccaaaccaaa

SEQ ID NO: 472244 - DNA, 16 bp, R. norvegicus
actgaactggaagctt

SEQ ID NO: 472245 - DNA, 16 bp, R. norvegicus
actgaacttctgattc

SEQ ID NO: 472246 - DNA, 16 bp, R. norvegicus
actgaacttgggtcct

SEQ ID NO: 472247 - DNA, 16 bp, R. norvegicus
actgaagaaaaagcca

SEQ ID NO: 472248 - DNA, 16 bp, R. norvegicus
actgaagaaaaaggag

SEQ ID NO: 472249 - DNA, 16 bp, R. norvegicus
actgaagaaaacaaag

SEQ ID NO: 472250 - DNA, 16 bp, R. norvegicus
actgaagaaaatgaca

SEQ ID NO: 472251 - DNA, 16 bp, R. norvegicus
actgaagaaaatgttt

SEQ ID NO: 472252 - DNA, 16 bp, R. norvegicus
actgaagaaagaaact

SEQ ID NO: 472253 - DNA, 16 bp, R. norvegicus
actgaagaaattcaaa

SEQ ID NO: 472254 - DNA, 16 bp, R. norvegicus
actgaagaagaagaag

SEQ ID NO: 472255 - DNA, 16 bp, R. norvegicus
actgaagaagacctca

SEQ ID NO: 472256 - DNA, 16 bp, R. norvegicus
actgaagaagatgaag

SEQ ID NO: 472257 - DNA, 16 bp, R. norvegicus
actgaagaagctgaag

SEQ ID NO: 472258 - DNA, 16 bp, R. norvegicus
actgaagacctagaaa

SEQ ID NO: 472259 - DNA, 16 bp, R. norvegicus
actgaagaggaaaaaa

SEQ ID NO: 472260 - DNA, 16 bp, R. norvegicus
actgaagcagaaatca

SEQ ID NO: 472261 - DNA, 16 bp, R. norvegicus
actgaagcagaagcca

SEQ ID NO: 472262 - DNA, 16 bp, R. norvegicus
actgaagcagagacca

SEQ ID NO: 472263 - DNA, 16 bp, R. norvegicus
actgaagcagagagca

SEQ ID NO: 472264 - DNA, 16 bp, R. norvegicus
actgaagcaggagaat

SEQ ID NO: 472265 - DNA, 16 bp, R. norvegicus
actgaaggaaaagcca

SEQ ID NO: 472266 - DNA, 16 bp, R. norvegicus
actgaaggaaaagcta

SEQ ID NO: 472267 - DNA, 16 bp, R. norvegicus
actgaaggaaaggcta

SEQ ID NO: 472268 - DNA, 16 bp, R. norvegicus
actgaaggaactgaaa

SEQ ID NO: 472269 - DNA, 16 bp, R. norvegicus
actgaaggaactgaag

SEQ ID NO: 472270 - DNA, 16 bp, R. norvegicus
actgaaggacctgaag

SEQ ID NO: 472271 - DNA, 16 bp, R. norvegicus
actgaaggagctgaat

SEQ ID NO: 472272 - DNA, 16 bp, R. norvegicus
actgaaggagctgagg

SEQ ID NO: 472273 - DNA, 16 bp, R. norvegicus
actgaaggcagacaag

SEQ ID NO: 472274 - DNA, 16 bp, R. norvegicus
actgaaggcccagaaa

SEQ ID NO: 472275 - DNA, 16 bp, R. norvegicus
actgaatatgcaaaca

SEQ ID NO: 472276 - DNA, 16 bp, R. norvegicus
actgaatctagacaat

SEQ ID NO: 472277 - DNA, 16 bp, R. norvegicus
actgaattcaagaaca

SEQ ID NO: 472278 - DNA, 16 bp, R. norvegicus
actgacagagatccac

SEQ ID NO: 472279 - DNA, 16 bp, R. norvegicus
actgacagcaaggccc

SEQ ID NO: 472280 - DNA, 16 bp, R. norvegicus
actgacagcagcaggg

SEQ ID NO: 472281 - DNA, 16 bp, R. norvegicus
actgacaggaactgga

SEQ ID NO: 472282 - DNA, 16 bp, R. norvegicus
actgacaggagctgga

SEQ ID NO: 472283 - DNA, 16 bp, R. norvegicus
actgacaggatcctga

SEQ ID NO: 472284 - DNA, 16 bp, R. norvegicus
actgaccaaaaccaac

SEQ ID NO: 472285 - DNA, 16 bp, R. norvegicus
actgaccagcaagccc

SEQ ID NO: 472286 - DNA, 16 bp, R. norvegicus
actgaccctgggctca

SEQ ID NO: 472287 - DNA, 16 bp, R. norvegicus
actgactatccaaaca

SEQ ID NO: 472288 - DNA, 16 bp, R. norvegicus
actgactcctaatgac

SEQ ID NO: 472289 - DNA, 16 bp, R. norvegicus
actgactcttcctctc

SEQ ID NO: 472290 - DNA, 16 bp, R. norvegicus
actgactgctgctctt

SEQ ID NO: 472291 - DNA, 16 bp, R. norvegicus
actgactgggtttggt

SEQ ID NO: 472292 - DNA, 16 bp, R. norvegicus
actgacttccacaagt

SEQ ID NO: 472293 - DNA, 16 bp, R. norvegicus
actgacttccagagtg

SEQ ID NO: 472294 - DNA, 16 bp, R. norvegicus
actgacttgggactta

SEQ ID NO: 472295 - DNA, 16 bp, R. norvegicus
actgagaaaggagaaa

SEQ ID NO: 472296 - DNA, 17 bp, R. norvegicus
actgagaacgggaaccc

SEQ ID NO: 472297 - DNA, 16 bp, R. norvegicus
actgagaagaacaatg

SEQ ID NO: 472298 - DNA, 16 bp, R. norvegicus
actgagaaggggaagt

SEQ ID NO: 472299 - DNA, 16 bp, R. norvegicus
actgagaatgatattt

SEQ ID NO: 472300 - DNA, 16 bp, R. norvegicus
actgagacaagaggat

SEQ ID NO: 472301 - DNA, 16 bp, R. norvegicus
actgagacagaagcag

SEQ ID NO: 472302 - DNA, 22 bp, R. norvegicus
actgagacaggtcttaagctcc

SEQ ID NO: 472303 - DNA, 16 bp, R. norvegicus
actgagagaagccaga

SEQ ID NO: 472304 - DNA, 16 bp, R. norvegicus
actgagagacagaaag

SEQ ID NO: 472305 - DNA, 16 bp, R. norvegicus
actgagagagaggaaa

SEQ ID NO: 472306 - DNA, 16 bp, R. norvegicus
actgagcaaaatcccc

SEQ ID NO: 472307 - DNA, 16 bp, R. norvegicus
actgagcacacacact

SEQ ID NO: 472308 - DNA, 16 bp, R. norvegicus
actgagcacagggaca

SEQ ID NO: 472309 - DNA, 16 bp, R. norvegicus
actgagccatctcctc

SEQ ID NO: 472310 - DNA, 23 bp, R. norvegicus
actgagctaaatccccagccccc

SEQ ID NO: 472311 - DNA, 16 bp, R. norvegicus
actgagctctctctct

SEQ ID NO: 472312 - DNA, 16 bp, R. norvegicus
actgagctctggtcct

SEQ ID NO: 472313 - DNA, 16 bp, R. norvegicus
actgaggaaaaaaatt

SEQ ID NO: 472314 - DNA, 16 bp, R. norvegicus
actgaggaaaggccat

SEQ ID NO: 472315 - DNA, 16 bp, R. norvegicus
actgaggaagaggaag

SEQ ID NO: 472316 - DNA, 16 bp, R. norvegicus
actgaggagactgagg

SEQ ID NO: 472317 - DNA, 17 bp, R. norvegicus
actgaggaggaggagga

SEQ ID NO: 472318 - DNA, 16 bp, R. norvegicus
actgaggaggctgaag

SEQ ID NO: 472319 - DNA, 16 bp, R. norvegicus
actgaggcaagaggat

SEQ ID NO: 472320 - DNA, 16 bp, R. norvegicus
actgaggcaggaggat

SEQ ID NO: 472321 - DNA, 16 bp, R. norvegicus
actgaggcaggcagat

SEQ ID NO: 472322 - DNA, 16 bp, R. norvegicus
actgaggccaaacaaa

SEQ ID NO: 472323 - DNA, 16 bp, R. norvegicus
actgaggccaaacaag

SEQ ID NO: 472324 - DNA, 17 bp, R. norvegicus
actgaggcgtcctcact

SEQ ID NO: 472325 - DNA, 16 bp, R. norvegicus
actgaggctcagggaa

SEQ ID NO: 472326 - DNA, 16 bp, R. norvegicus
actgagggaaaggcag

SEQ ID NO: 472327 - DNA, 16 bp, R. norvegicus
actgaggtggctgagg

SEQ ID NO: 472328 - DNA, 16 bp, R. norvegicus
actgaggtttcctcat

SEQ ID NO: 472329 - DNA, 16 bp, R. norvegicus
actgatcttcagctgt

SEQ ID NO: 472330 - DNA, 16 bp, R. norvegicus
actgatgaagctaaga

SEQ ID NO: 472331 - DNA, 16 bp, R. norvegicus
actgatgaatggatat

SEQ ID NO: 472332 - DNA, 16 bp, R. norvegicus
actgatgcagaggcca

SEQ ID NO: 472333 - DNA, 16 bp, R. norvegicus
actgatggaaggaagg

SEQ ID NO: 472334 - DNA, 16 bp, R. norvegicus
actgatggagaaacca

SEQ ID NO: 472335 - DNA, 16 bp, R. norvegicus
actgatgtcagataag

SEQ ID NO: 472336 - DNA, 16 bp, R. norvegicus
actgatttccagagcg

SEQ ID NO: 472337 - DNA, 16 bp, R. norvegicus
actgatttctttcttt

SEQ ID NO: 472338 - DNA, 16 bp, R. norvegicus
actgcaatgaacattt

SEQ ID NO: 472339 - DNA, 16 bp, R. norvegicus
actgcacacactgcac

SEQ ID NO: 472340 - DNA, 16 bp, R. norvegicus
actgcacacatgtggt

SEQ ID NO: 472341 - DNA, 17 bp, R. norvegicus
actgcacctcacacaat

SEQ ID NO: 472342 - DNA, 16 bp, R. norvegicus
actgcactgactccca

SEQ ID NO: 472343 - DNA, 16 bp, R. norvegicus
actgcagacccagaaa

SEQ ID NO: 472344 - DNA, 16 bp, R. norvegicus
actgcagcaacgccaa

SEQ ID NO: 472345 - DNA, 16 bp, R. norvegicus
actgcagcacttggga

SEQ ID NO: 472346 - DNA, 16 bp, R. norvegicus
actgcagccaggagaa

SEQ ID NO: 472347 - DNA, 16 bp, R. norvegicus
actgcagccatgatgt

SEQ ID NO: 472348 - DNA, 16 bp, R. norvegicus
actgcagcttcctcct

SEQ ID NO: 472349 - DNA, 16 bp, R. norvegicus
actgcaggacaccttc

SEQ ID NO: 472350 - DNA, 16 bp, R. norvegicus
actgcaggggacccag

SEQ ID NO: 472351 - DNA, 16 bp, R. norvegicus
actgcaggtcagcatg

SEQ ID NO: 472352 - DNA, 16 bp, R. norvegicus
actgcagtgccggacc

SEQ ID NO: 472353 - DNA, 16 bp, R. norvegicus
actgcagttccaggga

SEQ ID NO: 472354 - DNA, 16 bp, R. norvegicus
actgcatgcacacagt

SEQ ID NO: 472355 - DNA, 16 bp, R. norvegicus
actgccaccaccatca

SEQ ID NO: 472356 - DNA, 16 bp, R. norvegicus
actgccagagacagca

SEQ ID NO: 472357 - DNA, 16 bp, R. norvegicus
actgccagagcatgac

SEQ ID NO: 472358 - DNA, 16 bp, R. norvegicus
actgccagagcctgac

SEQ ID NO: 472359 - DNA, 16 bp, R. norvegicus
actgccagtaactcca

SEQ ID NO: 472360 - DNA, 16 bp, R. norvegicus
actgccatcactgcca

SEQ ID NO: 472361 - DNA, 16 bp, R. norvegicus
actgcccaccccagcc

SEQ ID NO: 472362 - DNA, 16 bp, R. norvegicus
actgcccacccctgac

SEQ ID NO: 472363 - DNA, 16 bp, R. norvegicus
actgcccaccccttcc

SEQ ID NO: 472364 - DNA, 16 bp, R. norvegicus
actgcctacccctgcc

SEQ ID NO: 472365 - DNA, 16 bp, R. norvegicus
actgcctccctgccct

SEQ ID NO: 472366 - DNA, 16 bp, R. norvegicus
actgcctctgggccct

SEQ ID NO: 472367 - DNA, 16 bp, R. norvegicus
actgcctctgtctgct

SEQ ID NO: 472368 - DNA, 17 bp, R. norvegicus
actgcctgcctgcctgc

SEQ ID NO: 472369 - DNA, 16 bp, R. norvegicus
actgcctgttccagga

SEQ ID NO: 472370 - DNA, 17 bp, R. norvegicus
actgctaaaaccattct

SEQ ID NO: 472371 - DNA, 16 bp, R. norvegicus
actgctaaagaaatag

SEQ ID NO: 472372 - DNA, 16 bp, R. norvegicus
actgctactactactg

SEQ ID NO: 472373 - DNA, 16 bp, R. norvegicus
actgctatagactata

SEQ ID NO: 472374 - DNA, 16 bp, R. norvegicus
actgctccagcaccat

SEQ ID NO: 472375 - DNA, 16 bp, R. norvegicus
actgctccagcacctg

SEQ ID NO: 472376 - DNA, 16 bp, R. norvegicus
actgctccattttgga

SEQ ID NO: 472377 - DNA, 16 bp, R. norvegicus
actgctcctatattct

SEQ ID NO: 472378 - DNA, 16 bp, R. norvegicus
actgctcctatgttcc

SEQ ID NO: 472379 - DNA, 16 bp, R. norvegicus
actgctctgccagagg

SEQ ID NO: 472380 - DNA, 16 bp, R. norvegicus
actgctcttcctgaag

SEQ ID NO: 472381 - DNA, 16 bp, R. norvegicus
actgctcttcctgaga

SEQ ID NO: 472382 - DNA, 16 bp, R. norvegicus
actgctgaagacctgt

SEQ ID NO: 472383 - DNA, 16 bp, R. norvegicus
actgctgaataagttc

SEQ ID NO: 472384 - DNA, 16 bp, R. norvegicus
actgctgagccatccc

SEQ ID NO: 472385 - DNA, 16 bp, R. norvegicus
actgctgagccatctt

SEQ ID NO: 472386 - DNA, 16 bp, R. norvegicus
actgctgatgccaaga

SEQ ID NO: 472387 - DNA, 16 bp, R. norvegicus
actgctgccacctgct

SEQ ID NO: 472388 - DNA, 16 bp, R. norvegicus
actgctgccagaaagc

SEQ ID NO: 472389 - DNA, 16 bp, R. norvegicus
actgctgcccactgca

SEQ ID NO: 472390 - DNA, 16 bp, R. norvegicus
actgctgctcctcact

SEQ ID NO: 472391 - DNA, 16 bp, R. norvegicus
actgctgctctattca

SEQ ID NO: 472392 - DNA, 16 bp, R. norvegicus
actgctgctcttccag

SEQ ID NO: 472393 - DNA, 16 bp, R. norvegicus
actgctgctgacccat

SEQ ID NO: 472394 - DNA, 16 bp, R. norvegicus
actgctgctgcttctg

SEQ ID NO: 472395 - DNA, 16 bp, R. norvegicus
actgctgctgtcttca

SEQ ID NO: 472396 - DNA, 16 bp, R. norvegicus
actgctggatgaagcc

SEQ ID NO: 472397 - DNA, 16 bp, R. norvegicus
actgctggtcttccca

SEQ ID NO: 472398 - DNA, 16 bp, R. norvegicus
actgctggtggagcag

SEQ ID NO: 472399 - DNA, 16 bp, R. norvegicus
actgctgtgaagagat

SEQ ID NO: 472400 - DNA, 16 bp, R. norvegicus
actgctgttgctgctg

SEQ ID NO: 472401 - DNA, 16 bp, R. norvegicus
actgcttctatttctg

SEQ ID NO: 472402 - DNA, 16 bp, R. norvegicus
actgctttccaaatcc

SEQ ID NO: 472403 - DNA, 16 bp, R. norvegicus
actgctttccagaggt

SEQ ID NO: 472404 - DNA, 16 bp, R. norvegicus
actgcttttgcaaagg

SEQ ID NO: 472405 - DNA, 16 bp, R. norvegicus
actggaaaaaaaattc

SEQ ID NO: 472406 - DNA, 17 bp, R. norvegicus
actggaaaaaatcatcc

SEQ ID NO: 472407 - DNA, 16 bp, R. norvegicus
actggaaaaaatttca

SEQ ID NO: 472408 - DNA, 16 bp, R. norvegicus
actggaaaaacaaaca

SEQ ID NO: 472409 - DNA, 16 bp, R. norvegicus
actggaaaatgtggat

SEQ ID NO: 472410 - DNA, 16 bp, R. norvegicus
actggaaacaaacaaa

SEQ ID NO: 472411 - DNA, 16 bp, R. norvegicus
actggaaagaaagaag

SEQ ID NO: 472412 - DNA, 16 bp, R. norvegicus
actggaaagatcctgt

SEQ ID NO: 472413 - DNA, 16 bp, R. norvegicus
actggaacggaaagga

SEQ ID NO: 472414 - DNA, 16 bp, R. norvegicus
actggaactaatagaa

SEQ ID NO: 472415 - DNA, 16 bp, R. norvegicus
actggaactcacacag

SEQ ID NO: 472416 - DNA, 16 bp, R. norvegicus
actggaagaagctgag

SEQ ID NO: 472417 - DNA, 16 bp, R. norvegicus
actggaagaatcctgt

SEQ ID NO: 472418 - DNA, 16 bp, R. norvegicus
actggaagagggcatc

SEQ ID NO: 472419 - DNA, 16 bp, R. norvegicus
actggaagctacaggt

SEQ ID NO: 472420 - DNA, 16 bp, R. norvegicus
actggaaggagaggag

SEQ ID NO: 472421 - DNA, 16 bp, R. norvegicus
actggaagttctgcct

SEQ ID NO: 472422 - DNA, 16 bp, R. norvegicus
actggaattacagaca

SEQ ID NO: 472423 - DNA, 16 bp, R. norvegicus
actggaccagaaaaaa

SEQ ID NO: 472424 - DNA, 16 bp, R. norvegicus
actggacctgctggac

SEQ ID NO: 472425 - DNA, 16 bp, R. norvegicus
actggactggactgct

SEQ ID NO: 472426 - DNA, 16 bp, R. norvegicus
actggacttctggtat

SEQ ID NO: 472427 - DNA, 16 bp, R. norvegicus
actggagaaaagaaag

SEQ ID NO: 472428 - DNA, 16 bp, R. norvegicus
actggagaaagcatat

SEQ ID NO: 472429 - DNA, 16 bp, R. norvegicus
actggagaaggagctg

SEQ ID NO: 472430 - DNA, 16 bp, R. norvegicus
actggagagaaacctt

SEQ ID NO: 472431 - DNA, 16 bp, R. norvegicus
actggagagaaactct

SEQ ID NO: 472432 - DNA, 16 bp, R. norvegicus
actggagagaagcctt

SEQ ID NO: 472433 - DNA, 16 bp, R. norvegicus
actggagagagcaaac

SEQ ID NO: 472434 - DNA, 16 bp, R. norvegicus
actggagagatgactc

SEQ ID NO: 472435 - DNA, 16 bp, R. norvegicus
actggagaggctgaga

SEQ ID NO: 472436 - DNA, 16 bp, R. norvegicus
actggagaggtggctc

SEQ ID NO: 472437 - DNA, 16 bp, R. norvegicus
actggagcagaggctg

SEQ ID NO: 472438 - DNA, 16 bp, R. norvegicus
actggagcagcagctg

SEQ ID NO: 472439 - DNA, 16 bp, R. norvegicus
actggagctgcagatg

SEQ ID NO: 472440 - DNA, 16 bp, R. norvegicus
actggagcttccaggg

SEQ ID NO: 472441 - DNA, 17 bp, R. norvegicus
actggaggagcttgaag

SEQ ID NO: 472442 - DNA, 16 bp, R. norvegicus
actggaggccagcatg

SEQ ID NO: 472443 - DNA, 16 bp, R. norvegicus
actggaggccagcctg

SEQ ID NO: 472444 - DNA, 16 bp, R. norvegicus
actggaggccatgcct

SEQ ID NO: 472445 - DNA, 16 bp, R. norvegicus
actggaggccccagga

SEQ ID NO: 472446 - DNA, 16 bp, R. norvegicus
actggaggtcatcatg

SEQ ID NO: 472447 - DNA, 16 bp, R. norvegicus
actggaggtccaacct

SEQ ID NO: 472448 - DNA, 16 bp, R. norvegicus
actggagtcacagatg

SEQ ID NO: 472449 - DNA, 16 bp, R. norvegicus
actggatcccctggga

SEQ ID NO: 472450 - DNA, 16 bp, R. norvegicus
actggatctcctggaa

SEQ ID NO: 472451 - DNA, 16 bp, R. norvegicus
actggatgaagcctct

SEQ ID NO: 472452 - DNA, 16 bp, R. norvegicus
actggatgagaaggaa

SEQ ID NO: 472453 - DNA, 16 bp, R. norvegicus
actggatgcttttcca

SEQ ID NO: 472454 - DNA, 16 bp, R. norvegicus
actggattatgttgat

SEQ ID NO: 472455 - DNA, 16 bp, R. norvegicus
actggatttgtagaaa

SEQ ID NO: 472456 - DNA, 16 bp, R. norvegicus
actggcaaggatgtag

SEQ ID NO: 472457 - DNA, 16 bp, R. norvegicus
actggcacaaaaacag

SEQ ID NO: 472458 - DNA, 16 bp, R. norvegicus
actggcacaaccactc

SEQ ID NO: 472459 - DNA, 16 bp, R. norvegicus
actggcagctcttcca

SEQ ID NO: 472460 - DNA, 16 bp, R. norvegicus
actggcaggaagagag

SEQ ID NO: 472461 - DNA, 16 bp, R. norvegicus
actggccaaagaggga

SEQ ID NO: 472462 - DNA, 16 bp, R. norvegicus
actggccattcagagc

SEQ ID NO: 472463 - DNA, 16 bp, R. norvegicus
actggctaagatcaaa

SEQ ID NO: 472464 - DNA, 16 bp, R. norvegicus
actggctccatcagac

SEQ ID NO: 472465 - DNA, 16 bp, R. norvegicus
actggctgctctcaca

SEQ ID NO: 472466 - DNA, 16 bp, R. norvegicus
actggctgctctgcca

SEQ ID NO: 472467 - DNA, 16 bp, R. norvegicus
actggctgctcttcag

SEQ ID NO: 472468 - DNA, 16 bp, R. norvegicus
actggctggtttttgt

SEQ ID NO: 472469 - DNA, 16 bp, R. norvegicus
actggctgttcttcag

SEQ ID NO: 472470 - DNA, 16 bp, R. norvegicus
actggctttcagctct

SEQ ID NO: 472471 - DNA, 16 bp, R. norvegicus
actgggaaagaggata

SEQ ID NO: 472472 - DNA, 16 bp, R. norvegicus
actgggaaaggaaaaa

SEQ ID NO: 472473 - DNA, 16 bp, R. norvegicus
actgggaaagggaaca

SEQ ID NO: 472474 - DNA, 16 bp, R. norvegicus
actgggaaagggataa

SEQ ID NO: 472475 - DNA, 16 bp, R. norvegicus
actgggaggcagagac

SEQ ID NO: 472476 - DNA, 16 bp, R. norvegicus
actgggaggtgaggag

SEQ ID NO: 472477 - DNA, 16 bp, R. norvegicus
actgggatggaaagga

SEQ ID NO: 472478 - DNA, 16 bp, R. norvegicus
actgggcaattccagg

SEQ ID NO: 472479 - DNA, 16 bp, R. norvegicus
actgggcagcactggg

SEQ ID NO: 472480 - DNA, 16 bp, R. norvegicus
actgggcatcctcagg

SEQ ID NO: 472481 - DNA, 16 bp, R. norvegicus
actggggaattgagcc

SEQ ID NO: 472482 - DNA, 16 bp, R. norvegicus
actggggacattgact

SEQ ID NO: 472483 - DNA, 16 bp, R. norvegicus
actggggagatggctc

SEQ ID NO: 472484 - DNA, 16 bp, R. norvegicus
actggggaggctgaga

SEQ ID NO: 472485 - DNA, 16 bp, R. norvegicus
actggggctggctcac

SEQ ID NO: 472486 - DNA, 16 bp, R. norvegicus
actggggctggggctg

SEQ ID NO: 472487 - DNA, 16 bp, R. norvegicus
actggggggctggaga

SEQ ID NO: 472488 - DNA, 17 bp, R. norvegicus
actgggggttcagactt

SEQ ID NO: 472489 - DNA, 16 bp, R. norvegicus
actggggtccctgggc

SEQ ID NO: 472490 - DNA, 16 bp, R. norvegicus
actggggtctatgctt

SEQ ID NO: 472491 - DNA, 16 bp, R. norvegicus
actgggtcagggaaga

SEQ ID NO: 472492 - DNA, 16 bp, R. norvegicus
actgggtctgggagca

SEQ ID NO: 472493 - DNA, 16 bp, R. norvegicus
actgggtctgtgtgta

SEQ ID NO: 472494 - DNA, 16 bp, R. norvegicus
actgggtgggcttccc

SEQ ID NO: 472495 - DNA, 16 bp, R. norvegicus
actggtaaaactattc

SEQ ID NO: 472496 - DNA, 16 bp, R. norvegicus
actggtccaaagcata

SEQ ID NO: 472497 - DNA, 16 bp, R. norvegicus
actggtgtgaggagaa

SEQ ID NO: 472498 - DNA, 16 bp, R. norvegicus
actggttaacagacaa

SEQ ID NO: 472499 - DNA, 16 bp, R. norvegicus
actggttctgaggttc

SEQ ID NO: 472500 - DNA, 16 bp, R. norvegicus
actggtttccaggcag

SEQ ID NO: 472501 - DNA, 16 bp, R. norvegicus
actgtaaaatctggag

SEQ ID NO: 472502 - DNA, 16 bp, R. norvegicus
actgtaaaccagcccc

SEQ ID NO: 472503 - DNA, 16 bp, R. norvegicus
actgtaacaaaatacc

SEQ ID NO: 472504 - DNA, 16 bp, R. norvegicus
actgtaagagctgaag

SEQ ID NO: 472505 - DNA, 16 bp, R. norvegicus
actgtactgagaatgg

SEQ ID NO: 472506 - DNA, 16 bp, R. norvegicus
actgtatccccttgat

SEQ ID NO: 472507 - DNA, 16 bp, R. norvegicus
actgtatttttaaaaa

SEQ ID NO: 472508 - DNA, 16 bp, R. norvegicus
actgtcaaagttaatg

SEQ ID NO: 472509 - DNA, 16 bp, R. norvegicus
actgtcactgtgttca

SEQ ID NO: 472510 - DNA, 16 bp, R. norvegicus
actgtcagaaacagca

SEQ ID NO: 472511 - DNA, 23 bp, R. norvegicus
actgtcagaaatagcagaacaag

SEQ ID NO: 472512 - DNA, 16 bp, R. norvegicus
actgtcagaaatagga

SEQ ID NO: 472513 - DNA, 16 bp, R. norvegicus
actgtcagggtgggct

SEQ ID NO: 472514 - DNA, 17 bp, R. norvegicus
actgtccctgaactcaa

SEQ ID NO: 472515 - DNA, 16 bp, R. norvegicus
actgtccctgactctg

SEQ ID NO: 472516 - DNA, 19 bp, R. norvegicus
actgtcctataagcctgtg

SEQ ID NO: 472517 - DNA, 16 bp, R. norvegicus
actgtcctggaactca

SEQ ID NO: 472518 - DNA, 16 bp, R. norvegicus
actgtcctggctgtgt

SEQ ID NO: 472519 - DNA, 16 bp, R. norvegicus
actgtcctttgcctta

SEQ ID NO: 472520 - DNA, 16 bp, R. norvegicus
actgtctcagaaacaa

SEQ ID NO: 472521 - DNA, 16 bp, R. norvegicus
actgtctccaaaaaaa

SEQ ID NO: 472522 - DNA, 16 bp, R. norvegicus
actgtctctgtgccat

SEQ ID NO: 472523 - DNA, 16 bp, R. norvegicus
actgtcttccaatgca

SEQ ID NO: 472524 - DNA, 16 bp, R. norvegicus
actgtcttccagttct

SEQ ID NO: 472525 - DNA, 16 bp, R. norvegicus
actgtcttctggacat

SEQ ID NO: 472526 - DNA, 16 bp, R. norvegicus
actgtcttgaaaaacc

SEQ ID NO: 472527 - DNA, 16 bp, R. norvegicus
actgtgaacatagtgg

SEQ ID NO: 472528 - DNA, 16 bp, R. norvegicus
actgtgaaccccgaga

SEQ ID NO: 472529 - DNA, 16 bp, R. norvegicus
actgtgagcatctgcc

SEQ ID NO: 472530 - DNA, 16 bp, R. norvegicus
actgtgaggacagagg

SEQ ID NO: 472531 - DNA, 16 bp, R. norvegicus
actgtgagggtggagc

SEQ ID NO: 472532 - DNA, 17 bp, R. norvegicus
actgtgaggtccccatg

SEQ ID NO: 472533 - DNA, 16 bp, R. norvegicus
actgtgatccctgagg

SEQ ID NO: 472534 - DNA, 16 bp, R. norvegicus
actgtgccaggaaact

SEQ ID NO: 472535 - DNA, 16 bp, R. norvegicus
actgtgctctgtccaa

SEQ ID NO: 472536 - DNA, 16 bp, R. norvegicus
actgtgctgcccagat

SEQ ID NO: 472537 - DNA, 16 bp, R. norvegicus
actgtggaaggagaga

SEQ ID NO: 472538 - DNA, 16 bp, R. norvegicus
actgtggaggctgagg

SEQ ID NO: 472539 - DNA, 16 bp, R. norvegicus
actgtggatgtgatgt

SEQ ID NO: 472540 - DNA, 16 bp, R. norvegicus
actgtgggagggagag

SEQ ID NO: 472541 - DNA, 16 bp, R. norvegicus
actgtgggagtggact

SEQ ID NO: 472542 - DNA, 16 bp, R. norvegicus
actgtgggagtgggtt

SEQ ID NO: 472543 - DNA, 16 bp, R. norvegicus
actgtgggcagaggat

SEQ ID NO: 472544 - DNA, 16 bp, R. norvegicus
actgtgggggcctggc

SEQ ID NO: 472545 - DNA, 16 bp, R. norvegicus
actgtggggtctgata

SEQ ID NO: 472546 - DNA, 16 bp, R. norvegicus
actgtggggtggagca

SEQ ID NO: 472547 - DNA, 16 bp, R. norvegicus
actgtggtggtggtgg

SEQ ID NO: 472548 - DNA, 16 bp, R. norvegicus
actgtggttctcaacc

SEQ ID NO: 472549 - DNA, 16 bp, R. norvegicus
actgtggttgggatgt

SEQ ID NO: 472550 - DNA, 16 bp, R. norvegicus
actgtggtttctcttt

SEQ ID NO: 472551 - DNA, 16 bp, R. norvegicus
actgtgtagaccagac

SEQ ID NO: 472552 - DNA, 16 bp, R. norvegicus
actgtgtagcccaggc

SEQ ID NO: 472553 - DNA, 16 bp, R. norvegicus
actgtgtctctgttca

SEQ ID NO: 472554 - DNA, 16 bp, R. norvegicus
actgtgtggctctggc

SEQ ID NO: 472555 - DNA, 16 bp, R. norvegicus
actgtgtggtattggt

SEQ ID NO: 472556 - DNA, 16 bp, R. norvegicus
actgtgtgtgtgactg

SEQ ID NO: 472557 - DNA, 16 bp, R. norvegicus
actgttctcggaaaga

SEQ ID NO: 472558 - DNA, 16 bp, R. norvegicus
actgttgatgccaaga

SEQ ID NO: 472559 - DNA, 16 bp, R. norvegicus
actgttgatgtcttca

SEQ ID NO: 472560 - DNA, 16 bp, R. norvegicus
actgttgtggatgcca

SEQ ID NO: 472561 - DNA, 16 bp, R. norvegicus
actgtttcacatccca

SEQ ID NO: 472562 - DNA, 16 bp, R. norvegicus
acttaaaactttttaa

SEQ ID NO: 472563 - DNA, 16 bp, R. norvegicus
acttaaagaaggaaag

SEQ ID NO: 472564 - DNA, 16 bp, R. norvegicus
acttaaaggaagaaaa

SEQ ID NO: 472565 - DNA, 16 bp, R. norvegicus
acttaaaggatgcctt

SEQ ID NO: 472566 - DNA, 16 bp, R. norvegicus
acttaacttctgctcc

SEQ ID NO: 472567 - DNA, 16 bp, R. norvegicus
acttaaggaagaaaga

SEQ ID NO: 472568 - DNA, 16 bp, R. norvegicus
acttaatattcctgat

SEQ ID NO: 472569 - DNA, 16 bp, R. norvegicus
acttaatttcatgttt

SEQ ID NO: 472570 - DNA, 16 bp, R. norvegicus
acttaccaaagttaaa

SEQ ID NO: 472571 - DNA, 16 bp, R. norvegicus
acttactctgtagacc

SEQ ID NO: 472572 - DNA, 16 bp, R. norvegicus
acttagagatctgcct

SEQ ID NO: 472573 - DNA, 16 bp, R. norvegicus
acttagaggccagcct

SEQ ID NO: 472574 - DNA, 16 bp, R. norvegicus
acttaggaggcagagg

SEQ ID NO: 472575 - DNA, 16 bp, R. norvegicus
acttagggtttttttt

SEQ ID NO: 472576 - DNA, 16 bp, R. norvegicus
acttcaaaagttccca

SEQ ID NO: 472577 - DNA, 16 bp, R. norvegicus
acttcaaaccagatac

SEQ ID NO: 472578 - DNA, 16 bp, R. norvegicus
acttcaagaacgatat

SEQ ID NO: 472579 - DNA, 16 bp, R. norvegicus
acttcaagaactctat

SEQ ID NO: 472580 - DNA, 16 bp, R. norvegicus
acttcaagaaggacat

SEQ ID NO: 472581 - DNA, 16 bp, R. norvegicus
acttcaagagggaaga

SEQ ID NO: 472582 - DNA, 16 bp, R. norvegicus
acttcactgaaatcaa

SEQ ID NO: 472583 - DNA, 16 bp, R. norvegicus
acttcactgtgtaaat

SEQ ID NO: 472584 - DNA, 16 bp, R. norvegicus
acttcagaccaagttc

SEQ ID NO: 472585 - DNA, 16 bp, R. norvegicus
acttcagcaacgtggc

SEQ ID NO: 472586 - DNA, 16 bp, R. norvegicus
acttcagcatccttat

SEQ ID NO: 472587 - DNA, 16 bp, R. norvegicus
acttcaggaacaaaaa

SEQ ID NO: 472588 - DNA, 16 bp, R. norvegicus
acttcaggccagagac

SEQ ID NO: 472589 - DNA, 16 bp, R. norvegicus
acttcaggcccaagac

SEQ ID NO: 472590 - DNA, 16 bp, R. norvegicus
acttcagggggaaatc

SEQ ID NO: 472591 - DNA, 17 bp, R. norvegicus
acttcaggtaaacacag

SEQ ID NO: 472592 - DNA, 16 bp, R. norvegicus
acttcagtgtttttaa

SEQ ID NO: 472593 - DNA, 16 bp, R. norvegicus
acttcagttccaagga

SEQ ID NO: 472594 - DNA, 16 bp, R. norvegicus
acttcagttctaggga

SEQ ID NO: 472595 - DNA, 16 bp, R. norvegicus
acttcatattcatcga

SEQ ID NO: 472596 - DNA, 16 bp, R. norvegicus
acttcatattctctct

SEQ ID NO: 472597 - DNA, 16 bp, R. norvegicus
acttcatcaaattctt

SEQ ID NO: 472598 - DNA, 16 bp, R. norvegicus
acttcatctacagcct

SEQ ID NO: 472599 - DNA, 16 bp, R. norvegicus
acttcatcttcatcaa

SEQ ID NO: 472600 - DNA, 16 bp, R. norvegicus
acttcatgaacttcat

SEQ ID NO: 472601 - DNA, 16 bp, R. norvegicus
acttcatgaagttcat

SEQ ID NO: 472602 - DNA, 16 bp, R. norvegicus
acttcattacttcatt

SEQ ID NO: 472603 - DNA, 16 bp, R. norvegicus
acttcatttttgacaa

SEQ ID NO: 472604 - DNA, 16 bp, R. norvegicus
acttccacaatctcct

SEQ ID NO: 472605 - DNA, 16 bp, R. norvegicus
acttccagacctgagg

SEQ ID NO: 472606 - DNA, 16 bp, R. norvegicus
acttccaggggatcca

SEQ ID NO: 472607 - DNA, 16 bp, R. norvegicus
acttccagtggagaga

SEQ ID NO: 472608 - DNA, 16 bp, R. norvegicus
acttcccccagcaagg

SEQ ID NO: 472609 - DNA, 16 bp, R. norvegicus
acttccctaaccttaa

SEQ ID NO: 472610 - DNA, 16 bp, R. norvegicus
acttcctaatcctttc

SEQ ID NO: 472611 - DNA, 16 bp, R. norvegicus
acttcctccacaaggc

SEQ ID NO: 472612 - DNA, 16 bp, R. norvegicus
acttcctgaacaaaat

SEQ ID NO: 472613 - DNA, 16 bp, R. norvegicus
acttcctgaatgctgg

SEQ ID NO: 472614 - DNA, 16 bp, R. norvegicus
acttcctgcttcctgc

SEQ ID NO: 472615 - DNA, 16 bp, R. norvegicus
acttcctggtacccct

SEQ ID NO: 472616 - DNA, 16 bp, R. norvegicus
acttcctgtgtttacc

SEQ ID NO: 472617 - DNA, 16 bp, R. norvegicus
acttcctgttttctct

SEQ ID NO: 472618 - DNA, 16 bp, R. norvegicus
acttccttccatgatg

SEQ ID NO: 472619 - DNA, 16 bp, R. norvegicus
acttcgagtctctgaa

SEQ ID NO: 472620 - DNA, 19 bp, R. norvegicus
acttctaggatcaatgtga

SEQ ID NO: 472621 - DNA, 16 bp, R. norvegicus
acttctatctatctat

SEQ ID NO: 472622 - DNA, 16 bp, R. norvegicus
acttctatttccattt

SEQ ID NO: 472623 - DNA, 16 bp, R. norvegicus
acttctcaccagacac

SEQ ID NO: 472624 - DNA, 16 bp, R. norvegicus
acttctcagaagattt

SEQ ID NO: 472625 - DNA, 16 bp, R. norvegicus
acttctccagcatcat

SEQ ID NO: 472626 - DNA, 16 bp, R. norvegicus
acttctccattggagt

SEQ ID NO: 472627 - DNA, 16 bp, R. norvegicus
acttctcctgctctca

SEQ ID NO: 472628 - DNA, 16 bp, R. norvegicus
acttctcctgggcata

SEQ ID NO: 472629 - DNA, 16 bp, R. norvegicus
acttctccttccactg

SEQ ID NO: 472630 - DNA, 16 bp, R. norvegicus
acttctgagagttcag

SEQ ID NO: 472631 - DNA, 16 bp, R. norvegicus
acttctgcaggcacca

SEQ ID NO: 472632 - DNA, 16 bp, R. norvegicus
acttctgcctccccag

SEQ ID NO: 472633 - DNA, 16 bp, R. norvegicus
acttctgctctcaggt

SEQ ID NO: 472634 - DNA, 16 bp, R. norvegicus
acttctgcttgaatga

SEQ ID NO: 472635 - DNA, 16 bp, R. norvegicus
acttctggaaaagcag

SEQ ID NO: 472636 - DNA, 16 bp, R. norvegicus
acttctggagaaatca

SEQ ID NO: 472637 - DNA, 18 bp, R. norvegicus
acttctggctattataaa

SEQ ID NO: 472638 - DNA, 16 bp, R. norvegicus
acttctggggtctcga

SEQ ID NO: 472639 - DNA, 16 bp, R. norvegicus
acttctgggtccctgt

SEQ ID NO: 472640 - DNA, 16 bp, R. norvegicus
acttctggtcctcctg

SEQ ID NO: 472641 - DNA, 16 bp, R. norvegicus
acttctggtggtgttc

SEQ ID NO: 472642 - DNA, 16 bp, R. norvegicus
acttctgtatttgctg

SEQ ID NO: 472643 - DNA, 16 bp, R. norvegicus
acttctgttcattggt

SEQ ID NO: 472644 - DNA, 16 bp, R. norvegicus
acttctgtttctttgt

SEQ ID NO: 472645 - DNA, 16 bp, R. norvegicus
acttctgttttcattt

SEQ ID NO: 472646 - DNA, 16 bp, R. norvegicus
acttcttcatttccaa

SEQ ID NO: 472647 - DNA, 16 bp, R. norvegicus
acttcttcctttccaa

SEQ ID NO: 472648 - DNA, 16 bp, R. norvegicus
acttcttctcccactg

SEQ ID NO: 472649 - DNA, 16 bp, R. norvegicus
acttcttctttgccaa

SEQ ID NO: 472650 - DNA, 16 bp, R. norvegicus
acttcttgatatatat

SEQ ID NO: 472651 - DNA, 16 bp, R. norvegicus
acttcttggcttcagc

SEQ ID NO: 472652 - DNA, 16 bp, R. norvegicus
acttcttggctttatc

SEQ ID NO: 472653 - DNA, 16 bp, R. norvegicus
acttcttgtagtgttt

SEQ ID NO: 472654 - DNA, 16 bp, R. norvegicus
acttctttctttccca

SEQ ID NO: 472655 - DNA, 16 bp, R. norvegicus
acttctttgcatcagc

SEQ ID NO: 472656 - DNA, 16 bp, R. norvegicus
acttctttgtcaaaga

SEQ ID NO: 472657 - DNA, 16 bp, R. norvegicus
acttgaaatatttttt

SEQ ID NO: 472658 - DNA, 16 bp, R. norvegicus
acttgaacccagagct

SEQ ID NO: 472659 - DNA, 16 bp, R. norvegicus
acttgaagaccaagct

SEQ ID NO: 472660 - DNA, 16 bp, R. norvegicus
acttgacatcatcaga

SEQ ID NO: 472661 - DNA, 16 bp, R. norvegicus
acttgagaccaatttc

SEQ ID NO: 472662 - DNA, 16 bp, R. norvegicus
acttgagccagtttgc

SEQ ID NO: 472663 - DNA, 16 bp, R. norvegicus
acttgaggagtgtgct

SEQ ID NO: 472664 - DNA, 16 bp, R. norvegicus
acttgaggctggagag

SEQ ID NO: 472665 - DNA, 16 bp, R. norvegicus
acttgaggtttttttt

SEQ ID NO: 472666 - DNA, 17 bp, R. norvegicus
acttgagtatttcttat

SEQ ID NO: 472667 - DNA, 16 bp, R. norvegicus
acttgatcaagatgga

SEQ ID NO: 472668 - DNA, 16 bp, R. norvegicus
acttgatgaaattcat

SEQ ID NO: 472669 - DNA, 16 bp, R. norvegicus
acttgcagcagaaatg

SEQ ID NO: 472670 - DNA, 16 bp, R. norvegicus
acttgctaggcaagcc

SEQ ID NO: 472671 - DNA, 16 bp, R. norvegicus
acttgctgctcctgtg

SEQ ID NO: 472672 - DNA, 16 bp, R. norvegicus
acttgctgctctggca

SEQ ID NO: 472673 - DNA, 16 bp, R. norvegicus
acttgctgctgctgct

SEQ ID NO: 472674 - DNA, 16 bp, R. norvegicus
acttgctgtgtagact

SEQ ID NO: 472675 - DNA, 16 bp, R. norvegicus
acttgctttttgttca

SEQ ID NO: 472676 - DNA, 16 bp, R. norvegicus
acttggacaaacttct

SEQ ID NO: 472677 - DNA, 16 bp, R. norvegicus
acttggacaaggaaga

SEQ ID NO: 472678 - DNA, 16 bp, R. norvegicus
acttggacaagtcaaa

SEQ ID NO: 472679 - DNA, 16 bp, R. norvegicus
acttggactgaccctg

SEQ ID NO: 472680 - DNA, 16 bp, R. norvegicus
acttggagcagaagag

SEQ ID NO: 472681 - DNA, 16 bp, R. norvegicus
acttggagcaggaagg

SEQ ID NO: 472682 - DNA, 16 bp, R. norvegicus
acttggatcctctgaa

SEQ ID NO: 472683 - DNA, 16 bp, R. norvegicus
acttggatgctgggaa

SEQ ID NO: 472684 - DNA, 16 bp, R. norvegicus
acttggcattcctcag

SEQ ID NO: 472685 - DNA, 16 bp, R. norvegicus
acttggccatggtgga

SEQ ID NO: 472686 - DNA, 16 bp, R. norvegicus
acttgggaagcagagg

SEQ ID NO: 472687 - DNA, 16 bp, R. norvegicus
acttgggagacaaaag

SEQ ID NO: 472688 - DNA, 16 bp, R. norvegicus
acttgggagccagagg

SEQ ID NO: 472689 - DNA, 16 bp, R. norvegicus
acttgggaggcatagg

SEQ ID NO: 472690 - DNA, 16 bp, R. norvegicus
acttgggaggtggagg

SEQ ID NO: 472691 - DNA, 16 bp, R. norvegicus
acttgggatgatattt

SEQ ID NO: 472692 - DNA, 16 bp, R. norvegicus
acttgggcttgagttt

SEQ ID NO: 472693 - DNA, 16 bp, R. norvegicus
acttggggaagaaagg

SEQ ID NO: 472694 - DNA, 16 bp, R. norvegicus
acttggggctgaaatc

SEQ ID NO: 472695 - DNA, 16 bp, R. norvegicus
acttgggtatttcttc

SEQ ID NO: 472696 - DNA, 16 bp, R. norvegicus
acttgggtcctccaga

SEQ ID NO: 472697 - DNA, 16 bp, R. norvegicus
acttgggtcctctgga

SEQ ID NO: 472698 - DNA, 16 bp, R. norvegicus
acttgggtcctttgca

SEQ ID NO: 472699 - DNA, 16 bp, R. norvegicus
acttgggtgattctta

SEQ ID NO: 472700 - DNA, 16 bp, R. norvegicus
acttgggtggtagagg

SEQ ID NO: 472701 - DNA, 16 bp, R. norvegicus
acttgtatgtttgttt

SEQ ID NO: 472702 - DNA, 16 bp, R. norvegicus
acttgtgccagtcctc

SEQ ID NO: 472703 - DNA, 16 bp, R. norvegicus
acttgttgtttttgat

SEQ ID NO: 472704 - DNA, 16 bp, R. norvegicus
acttgtttcaaattca

SEQ ID NO: 472705 - DNA, 16 bp, R. norvegicus
acttgtttctttggac

SEQ ID NO: 472706 - DNA, 16 bp, R. norvegicus
acttgttttgtgtgtg

SEQ ID NO: 472707 - DNA, 16 bp, R. norvegicus
actttaaaacttttac

SEQ ID NO: 472708 - DNA, 16 bp, R. norvegicus
actttaaaagagctct

SEQ ID NO: 472709 - DNA, 16 bp, R. norvegicus
actttaagaaggacaa

SEQ ID NO: 472710 - DNA, 16 bp, R. norvegicus
actttaaggtgatcaa

SEQ ID NO: 472711 - DNA, 16 bp, R. norvegicus
actttacatctcaata

SEQ ID NO: 472712 - DNA, 16 bp, R. norvegicus
actttacttctgcatt

SEQ ID NO: 472713 - DNA, 20 bp, R. norvegicus
actttagaaagggtctctct

SEQ ID NO: 472714 - DNA, 102 bp, R. norvegicus
actttatgaaattcgtaggcaaatggttggaactggaaaacatcatcctgagtgagctaacccaatcacagaaagacatacatggtatgcactcattgataa

SEQ ID NO: 472715 - DNA, 17 bp, R. norvegicus
actttatgagatcctga

SEQ ID NO: 472716 - DNA, 16 bp, R. norvegicus
actttcaaccccaaat

SEQ ID NO: 472717 - DNA, 16 bp, R. norvegicus
actttcagaaggacat

SEQ ID NO: 472718 - DNA, 16 bp, R. norvegicus
actttcagccaaaagt

SEQ ID NO: 472719 - DNA, 16 bp, R. norvegicus
actttcagctccttct

SEQ ID NO: 472720 - DNA, 16 bp, R. norvegicus
actttcagttcctgag

SEQ ID NO: 472721 - DNA, 16 bp, R. norvegicus
actttcatttttaaaa

SEQ ID NO: 472722 - DNA, 16 bp, R. norvegicus
actttcctatcgataa

SEQ ID NO: 472723 - DNA, 16 bp, R. norvegicus
actttcctattgataa

SEQ ID NO: 472724 - DNA, 16 bp, R. norvegicus
actttctcaggaaagg

SEQ ID NO: 472725 - DNA, 16 bp, R. norvegicus
actttctctctgtctc

SEQ ID NO: 472726 - DNA, 16 bp, R. norvegicus
actttctgtagccagg

SEQ ID NO: 472727 - DNA, 16 bp, R. norvegicus
actttcttgttgttct

SEQ ID NO: 472728 - DNA, 16 bp, R. norvegicus
actttcttttcctcag

SEQ ID NO: 472729 - DNA, 16 bp, R. norvegicus
actttgaaaaagaaaa

SEQ ID NO: 472730 - DNA, 16 bp, R. norvegicus
actttgaaagccagaa

SEQ ID NO: 472731 - DNA, 16 bp, R. norvegicus
actttgaactttggaa

SEQ ID NO: 472732 - DNA, 16 bp, R. norvegicus
actttgagaaacaaag

SEQ ID NO: 472733 - DNA, 16 bp, R. norvegicus
actttgagcctgtcac

SEQ ID NO: 472734 - DNA, 16 bp, R. norvegicus
actttgctacactcaa

SEQ ID NO: 472735 - DNA, 16 bp, R. norvegicus
actttgctgaaactgt

SEQ ID NO: 472736 - DNA, 16 bp, R. norvegicus
actttgcttctatatc

SEQ ID NO: 472737 - DNA, 16 bp, R. norvegicus
actttggactaggaaa

SEQ ID NO: 472738 - DNA, 16 bp, R. norvegicus
actttggaggtagagg

SEQ ID NO: 472739 - DNA, 16 bp, R. norvegicus
actttggaggtggagg

SEQ ID NO: 472740 - DNA, 16 bp, R. norvegicus
actttgggcttagcac

SEQ ID NO: 472741 - DNA, 16 bp, R. norvegicus
actttgtagcccaggt

SEQ ID NO: 472742 - DNA, 16 bp, R. norvegicus
actttgtcaaagatca

SEQ ID NO: 472743 - DNA, 16 bp, R. norvegicus
actttgtcctttccaa

SEQ ID NO: 472744 - DNA, 16 bp, R. norvegicus
actttgtctctgtgtt

SEQ ID NO: 472745 - DNA, 16 bp, R. norvegicus
actttgtggaatattt

SEQ ID NO: 472746 - DNA, 16 bp, R. norvegicus
actttgttcctgtatt

SEQ ID NO: 472747 - DNA, 16 bp, R. norvegicus
acttttaaaaaaggaa

SEQ ID NO: 472748 - DNA, 16 bp, R. norvegicus
acttttaaaaaatgtt

SEQ ID NO: 472749 - DNA, 17 bp, R. norvegicus
acttttaacattgttga

SEQ ID NO: 472750 - DNA, 16 bp, R. norvegicus
acttttaatgacttct

SEQ ID NO: 472751 - DNA, 16 bp, R. norvegicus
acttttaattttgaaa

SEQ ID NO: 472752 - DNA, 16 bp, R. norvegicus
acttttataaaggaca

SEQ ID NO: 472753 - DNA, 16 bp, R. norvegicus
acttttatttggaaat

SEQ ID NO: 472754 - DNA, 16 bp, R. norvegicus
acttttccagaagacc

SEQ ID NO: 472755 - DNA, 16 bp, R. norvegicus
acttttgatcctgctg

SEQ ID NO: 472756 - DNA, 16 bp, R. norvegicus
acttttgcctgtgtgt

SEQ ID NO: 472757 - DNA, 16 bp, R. norvegicus
acttttggctgaaagt

SEQ ID NO: 472758 - DNA, 16 bp, R. norvegicus
actttttaaaaattcc

SEQ ID NO: 472759 - DNA, 16 bp, R. norvegicus
actttttaaaacattt

SEQ ID NO: 472760 - DNA, 16 bp, R. norvegicus
actttttaaatgattt

SEQ ID NO: 472761 - DNA, 16 bp, R. norvegicus
actttttagaaattaa

SEQ ID NO: 472762 - DNA, 16 bp, R. norvegicus
actttttcagctgctt

SEQ ID NO: 472763 - DNA, 16 bp, R. norvegicus
actttttccttttcaa

SEQ ID NO: 472764 - DNA, 16 bp, R. norvegicus
actttttcttttccaa

SEQ ID NO: 472765 - DNA, 16 bp, R. norvegicus
actttttgtgtgtgtg

SEQ ID NO: 472766 - DNA, 16 bp, R. norvegicus
acttttttttttaaag

SEQ ID NO: 472767 - DNA, 16 bp, R. norvegicus
agaaaaaaaaatcctg

SEQ ID NO: 472768 - DNA, 16 bp, R. norvegicus
agaaaaaaaatgggtt

SEQ ID NO: 472769 - DNA, 16 bp, R. norvegicus
agaaaaaaataatctt

SEQ ID NO: 472770 - DNA, 16 bp, R. norvegicus
agaaaaaaatatccat

SEQ ID NO: 472771 - DNA, 16 bp, R. norvegicus
agaaaaaaatcaagtt

SEQ ID NO: 472772 - DNA, 16 bp, R. norvegicus
agaaaaaaatccaagt

SEQ ID NO: 472773 - DNA, 16 bp, R. norvegicus
agaaaaaaatccatca

SEQ ID NO: 472774 - DNA, 16 bp, R. norvegicus
agaaaaaaatgtgtct

SEQ ID NO: 472775 - DNA, 16 bp, R. norvegicus
agaaaaaacaatcttt

SEQ ID NO: 472776 - DNA, 16 bp, R. norvegicus
agaaaaaagacagcat

SEQ ID NO: 472777 - DNA, 16 bp, R. norvegicus
agaaaaaagtttattt

SEQ ID NO: 472778 - DNA, 16 bp, R. norvegicus
agaaaaaatcatcctg

SEQ ID NO: 472779 - DNA, 16 bp, R. norvegicus
agaaaaaatgttccag

SEQ ID NO: 472780 - DNA, 16 bp, R. norvegicus
agaaaaaatttacaga

SEQ ID NO: 472781 - DNA, 16 bp, R. norvegicus
agaaaaacatacatgt

SEQ ID NO: 472782 - DNA, 16 bp, R. norvegicus
agaaaaactagagcag

SEQ ID NO: 472783 - DNA, 16 bp, R. norvegicus
agaaaaactcaaagca

SEQ ID NO: 472784 - DNA, 16 bp, R. norvegicus
agaaaaactgagaaag

SEQ ID NO: 472785 - DNA, 16 bp, R. norvegicus
agaaaaacttgaagaa

SEQ ID NO: 472786 - DNA, 16 bp, R. norvegicus
agaaaaagaaaaccct

SEQ ID NO: 472787 - DNA, 16 bp, R. norvegicus
agaaaaagaaaatctg

SEQ ID NO: 472788 - DNA, 16 bp, R. norvegicus
agaaaaagaaacactc

SEQ ID NO: 472789 - DNA, 16 bp, R. norvegicus
agaaaaagaaatctga

SEQ ID NO: 472790 - DNA, 16 bp, R. norvegicus
agaaaaagaactgaag

SEQ ID NO: 472791 - DNA, 16 bp, R. norvegicus
agaaaaagaactggaa

SEQ ID NO: 472792 - DNA, 16 bp, R. norvegicus
agaaaaagaacttcaa

SEQ ID NO: 472793 - DNA, 16 bp, R. norvegicus
agaaaaagaatgtttt

SEQ ID NO: 472794 - DNA, 16 bp, R. norvegicus
agaaaaagatattcca

SEQ ID NO: 472795 - DNA, 16 bp, R. norvegicus
agaaaaagctgagagc

SEQ ID NO: 472796 - DNA, 16 bp, R. norvegicus
agaaaaaggaacactc

SEQ ID NO: 472797 - DNA, 16 bp, R. norvegicus
agaaaaaggaacattt

SEQ ID NO: 472798 - DNA, 16 bp, R. norvegicus
agaaaaagtgggaagc

SEQ ID NO: 472799 - DNA, 16 bp, R. norvegicus
agaaaaagttacagaa

SEQ ID NO: 472800 - DNA, 16 bp, R. norvegicus
agaaaaatcagaagtt

SEQ ID NO: 472801 - DNA, 16 bp, R. norvegicus
agaaaaatcttcaaaa

SEQ ID NO: 472802 - DNA, 16 bp, R. norvegicus
agaaaaatgaaagcat

SEQ ID NO: 472803 - DNA, 16 bp, R. norvegicus
agaaaaatgaatacag

SEQ ID NO: 472804 - DNA, 16 bp, R. norvegicus
agaaaaatgactgaag

SEQ ID NO: 472805 - DNA, 16 bp, R. norvegicus
agaaaaatttaaagca

SEQ ID NO: 472806 - DNA, 16 bp, R. norvegicus
agaaaaatttcacaga

SEQ ID NO: 472807 - DNA, 16 bp, R. norvegicus
agaaaaatttccattt

SEQ ID NO: 472808 - DNA, 16 bp, R. norvegicus
agaaaaatttgaagca

SEQ ID NO: 472809 - DNA, 16 bp, R. norvegicus
agaaaacaaagacatt

SEQ ID NO: 472810 - DNA, 16 bp, R. norvegicus
agaaaacacagacatt

SEQ ID NO: 472811 - DNA, 16 bp, R. norvegicus
agaaaacacagctatt

SEQ ID NO: 472812 - DNA, 16 bp, R. norvegicus
agaaaacagactgaga

SEQ ID NO: 472813 - DNA, 16 bp, R. norvegicus
agaaaacagactgagc

SEQ ID NO: 472814 - DNA, 16 bp, R. norvegicus
agaaaacagagatgaa

SEQ ID NO: 472815 - DNA, 16 bp, R. norvegicus
agaaaacaggaaatga

SEQ ID NO: 472816 - DNA, 16 bp, R. norvegicus
agaaaacaggaagtgg

SEQ ID NO: 472817 - DNA, 16 bp, R. norvegicus
agaaaacaggcttcta

SEQ ID NO: 472818 - DNA, 16 bp, R. norvegicus
agaaaacatatttaat

SEQ ID NO: 472819 - DNA, 16 bp, R. norvegicus
agaaaacatccaagaa

SEQ ID NO: 472820 - DNA, 16 bp, R. norvegicus
agaaaacatccacaca

SEQ ID NO: 472821 - DNA, 16 bp, R. norvegicus
agaaaacatgatacat

SEQ ID NO: 472822 - DNA, 16 bp, R. norvegicus
agaaaacatgcatttt

SEQ ID NO: 472823 - DNA, 16 bp, R. norvegicus
agaaaacatttaataa

SEQ ID NO: 472824 - DNA, 16 bp, R. norvegicus
agaaaacatttaatta

SEQ ID NO: 472825 - DNA, 16 bp, R. norvegicus
agaaaaccacccattt

SEQ ID NO: 472826 - DNA, 16 bp, R. norvegicus
agaaaaccctgggtca

SEQ ID NO: 472827 - DNA, 16 bp, R. norvegicus
agaaaacgtggttcat

SEQ ID NO: 472828 - DNA, 16 bp, R. norvegicus
agaaaacgttgacaca

SEQ ID NO: 472829 - DNA, 16 bp, R. norvegicus
agaaaactacaaccaa

SEQ ID NO: 472830 - DNA, 16 bp, R. norvegicus
agaaaactccaataca

SEQ ID NO: 472831 - DNA, 16 bp, R. norvegicus
agaaaactggaaacag

SEQ ID NO: 472832 - DNA, 16 bp, R. norvegicus
agaaaactgtaatcag

SEQ ID NO: 472833 - DNA, 16 bp, R. norvegicus
agaaaacttaattttt

SEQ ID NO: 472834 - DNA, 16 bp, R. norvegicus
agaaaactttgacaca

SEQ ID NO: 472835 - DNA, 16 bp, R. norvegicus
agaaaagaaaaacctc

SEQ ID NO: 472836 - DNA, 16 bp, R. norvegicus
agaaaagaaaacttca

SEQ ID NO: 472837 - DNA, 16 bp, R. norvegicus
agaaaagaaaagctca

SEQ ID NO: 472838 - DNA, 16 bp, R. norvegicus
agaaaagaaaatgcta

SEQ ID NO: 472839 - DNA, 16 bp, R. norvegicus
agaaaagaaagtcctc

SEQ ID NO: 472840 - DNA, 16 bp, R. norvegicus
agaaaagaaatcagga

SEQ ID NO: 472841 - DNA, 16 bp, R. norvegicus
agaaaagaactggaaa

SEQ ID NO: 472842 - DNA, 16 bp, R. norvegicus
agaaaagaagaggtca

SEQ ID NO: 472843 - DNA, 16 bp, R. norvegicus
agaaaagactgaagaa

SEQ ID NO: 472844 - DNA, 16 bp, R. norvegicus
agaaaagagtgaagcc

SEQ ID NO: 472845 - DNA, 24 bp, R. norvegicus
agaaaagatcctcaacttctaagg

SEQ ID NO: 472846 - DNA, 16 bp, R. norvegicus
agaaaagatggtaaat

SEQ ID NO: 472847 - DNA, 16 bp, R. norvegicus
agaaaagattcaaaga

SEQ ID NO: 472848 - DNA, 16 bp, R. norvegicus
agaaaagcaaaatttg

SEQ ID NO: 472849 - DNA, 16 bp, R. norvegicus
agaaaagcaagacttg

SEQ ID NO: 472850 - DNA, 16 bp, R. norvegicus
agaaaagcaagatctt

SEQ ID NO: 472851 - DNA, 16 bp, R. norvegicus
agaaaagcttctttga

SEQ ID NO: 472852 - DNA, 16 bp, R. norvegicus
agaaaagctttagaga

SEQ ID NO: 472853 - DNA, 16 bp, R. norvegicus
agaaaagctttcttaa

SEQ ID NO: 472854 - DNA, 16 bp, R. norvegicus
agaaaaggaaactgag

SEQ ID NO: 472855 - DNA, 16 bp, R. norvegicus
agaaaaggaagaagtc

SEQ ID NO: 472856 - DNA, 16 bp, R. norvegicus
agaaaaggaagcccag

SEQ ID NO: 472857 - DNA, 16 bp, R. norvegicus
agaaaaggacatcaga

SEQ ID NO: 472858 - DNA, 16 bp, R. norvegicus
agaaaaggacatccag

SEQ ID NO: 472859 - DNA, 16 bp, R. norvegicus
agaaaaggagataaca

SEQ ID NO: 472860 - DNA, 16 bp, R. norvegicus
agaaaaggagtctcag

SEQ ID NO: 472861 - DNA, 16 bp, R. norvegicus
agaaaaggatcctgat

SEQ ID NO: 472862 - DNA, 16 bp, R. norvegicus
agaaaaggcataagaa

SEQ ID NO: 472863 - DNA, 16 bp, R. norvegicus
agaaaaggctgaaaga

SEQ ID NO: 472864 - DNA, 16 bp, R. norvegicus
agaaaaggctgcccac

SEQ ID NO: 472865 - DNA, 16 bp, R. norvegicus
agaaaagggtgtcaga

SEQ ID NO: 472866 - DNA, 16 bp, R. norvegicus
agaaaaggtttctttt

SEQ ID NO: 472867 - DNA, 16 bp, R. norvegicus
agaaaagttattagga

SEQ ID NO: 472868 - DNA, 16 bp, R. norvegicus
agaaaagttttctttt

SEQ ID NO: 472869 - DNA, 16 bp, R. norvegicus
agaaaataatctccag

SEQ ID NO: 472870 - DNA, 16 bp, R. norvegicus
agaaaataatttcttc

SEQ ID NO: 472871 - DNA, 16 bp, R. norvegicus
agaaaatacattttca

SEQ ID NO: 472872 - DNA, 16 bp, R. norvegicus
agaaaatactgaagaa

SEQ ID NO: 472873 - DNA, 16 bp, R. norvegicus
agaaaatactggaaga

SEQ ID NO: 472874 - DNA, 16 bp, R. norvegicus
agaaaatactggatat

SEQ ID NO: 472875 - DNA, 16 bp, R. norvegicus
agaaaatatatacaca

SEQ ID NO: 472876 - DNA, 18 bp, R. norvegicus
agaaaatatcatcctgaa

SEQ ID NO: 472877 - DNA, 23 bp, R. norvegicus
agaaaatatcatcctgagtgagc

SEQ ID NO: 472878 - DNA, 16 bp, R. norvegicus
agaaaatatcatcttt

SEQ ID NO: 472879 - DNA, 16 bp, R. norvegicus
agaaaatatgtcactg

SEQ ID NO: 472880 - DNA, 16 bp, R. norvegicus
agaaaatattgacaaa

SEQ ID NO: 472881 - DNA, 16 bp, R. norvegicus
agaaaatattgctgat

SEQ ID NO: 472882 - DNA, 16 bp, R. norvegicus
agaaaatattttcaat

SEQ ID NO: 472883 - DNA, 16 bp, R. norvegicus
agaaaatcaaaaggat

SEQ ID NO: 472884 - DNA, 16 bp, R. norvegicus
agaaaatcaaacctaa

SEQ ID NO: 472885 - DNA, 16 bp, R. norvegicus
agaaaatcaacttaaa

SEQ ID NO: 472886 - DNA, 16 bp, R. norvegicus
agaaaatcatcctgag

SEQ ID NO: 472887 - DNA, 16 bp, R. norvegicus
agaaaatccaaagaat

SEQ ID NO: 472888 - DNA, 16 bp, R. norvegicus
agaaaatccagagaat

SEQ ID NO: 472889 - DNA, 16 bp, R. norvegicus
agaaaatccctcatag

SEQ ID NO: 472890 - DNA, 16 bp, R. norvegicus
agaaaatctcagaaga

SEQ ID NO: 472891 - DNA, 17 bp, R. norvegicus
agaaaatctcaggggca

SEQ ID NO: 472892 - DNA, 16 bp, R. norvegicus
agaaaatctgaatgaa

SEQ ID NO: 472893 - DNA, 16 bp, R. norvegicus
agaaaatgaaaactgt

SEQ ID NO: 472894 - DNA, 16 bp, R. norvegicus
agaaaatgaagacagg

SEQ ID NO: 472895 - DNA, 16 bp, R. norvegicus
agaaaatgaatgaatg

SEQ ID NO: 472896 - DNA, 16 bp, R. norvegicus
agaaaatgacccacag

SEQ ID NO: 472897 - DNA, 16 bp, R. norvegicus
agaaaatgactgaaga

SEQ ID NO: 472898 - DNA, 16 bp, R. norvegicus
agaaaatgcaaaaagc

SEQ ID NO: 472899 - DNA, 16 bp, R. norvegicus
agaaaatgcaaaatga

SEQ ID NO: 472900 - DNA, 16 bp, R. norvegicus
agaaaatgcttccaga

SEQ ID NO: 472901 - DNA, 16 bp, R. norvegicus
agaaaatggaaagaca

SEQ ID NO: 472902 - DNA, 16 bp, R. norvegicus
agaaaatggacaattt

SEQ ID NO: 472903 - DNA, 16 bp, R. norvegicus
agaaaatggagagatt

SEQ ID NO: 472904 - DNA, 16 bp, R. norvegicus
agaaaatgtaaagcag

SEQ ID NO: 472905 - DNA, 16 bp, R. norvegicus
agaaaatgtctctcct

SEQ ID NO: 472906 - DNA, 16 bp, R. norvegicus
agaaaatgtcttatag

SEQ ID NO: 472907 - DNA, 16 bp, R. norvegicus
agaaaatgtgggaaag

SEQ ID NO: 472908 - DNA, 16 bp, R. norvegicus
agaaaatgtgttatat

SEQ ID NO: 472909 - DNA, 16 bp, R. norvegicus
agaaaatgttcccacc

SEQ ID NO: 472910 - DNA, 16 bp, R. norvegicus
agaaaatgttgtacat

SEQ ID NO: 472911 - DNA, 16 bp, R. norvegicus
agaaaatgttttttaa

SEQ ID NO: 472912 - DNA, 16 bp, R. norvegicus
agaaaattaaagcaat

SEQ ID NO: 472913 - DNA, 16 bp, R. norvegicus
agaaaattaataaatc

SEQ ID NO: 472914 - DNA, 16 bp, R. norvegicus
agaaaattaattcaaa

SEQ ID NO: 472915 - DNA, 16 bp, R. norvegicus
agaaaattatccattt

SEQ ID NO: 472916 - DNA, 16 bp, R. norvegicus
agaaaattcatgccag

SEQ ID NO: 472917 - DNA, 16 bp, R. norvegicus
agaaaattcattttat

SEQ ID NO: 472918 - DNA, 16 bp, R. norvegicus
agaaaattctggcaaa

SEQ ID NO: 472919 - DNA, 16 bp, R. norvegicus
agaaaattggacctag

SEQ ID NO: 472920 - DNA, 16 bp, R. norvegicus
agaaaattgtctcctg

SEQ ID NO: 472921 - DNA, 16 bp, R. norvegicus
agaaaattttaaacaa

SEQ ID NO: 472922 - DNA, 16 bp, R. norvegicus
agaaaatttttctttt

SEQ ID NO: 472923 - DNA, 16 bp, R. norvegicus
agaaacaaaaatttca

SEQ ID NO: 472924 - DNA, 16 bp, R. norvegicus
agaaacaaaacagact

SEQ ID NO: 472925 - DNA, 16 bp, R. norvegicus
agaaacaacagaaagt

SEQ ID NO: 472926 - DNA, 16 bp, R. norvegicus
agaaacaacttcagca

SEQ ID NO: 472927 - DNA, 16 bp, R. norvegicus
agaaacaagctgaagt

SEQ ID NO: 472928 - DNA, 16 bp, R. norvegicus
agaaacaagctggagc

SEQ ID NO: 472929 - DNA, 16 bp, R. norvegicus
agaaacaagtcaagaa

SEQ ID NO: 472930 - DNA, 16 bp, R. norvegicus
agaaacaagttgagaa

SEQ ID NO: 472931 - DNA, 16 bp, R. norvegicus
agaaacacacagagag

SEQ ID NO: 472932 - DNA, 28 bp, R. norvegicus
agaaacacacctcagagacaaagacaga

SEQ ID NO: 472933 - DNA, 16 bp, R. norvegicus
agaaacacagaagcag

SEQ ID NO: 472934 - DNA, 16 bp, R. norvegicus
agaaacacagaagtat

SEQ ID NO: 472935 - DNA, 16 bp, R. norvegicus
agaaacacagccagag

SEQ ID NO: 472936 - DNA, 16 bp, R. norvegicus
agaaacacagcccagc

SEQ ID NO: 472937 - DNA, 16 bp, R. norvegicus
agaaacacatatccca

SEQ ID NO: 472938 - DNA, 16 bp, R. norvegicus
agaaacacctaaacaa

SEQ ID NO: 472939 - DNA, 16 bp, R. norvegicus
agaaacactgtctcaa

SEQ ID NO: 472940 - DNA, 16 bp, R. norvegicus
agaaacagaaatggaa

SEQ ID NO: 472941 - DNA, 16 bp, R. norvegicus
agaaacagaagaaatg

SEQ ID NO: 472942 - DNA, 16 bp, R. norvegicus
agaaacagaagaaatt

SEQ ID NO: 472943 - DNA, 16 bp, R. norvegicus
agaaacagacacacag

SEQ ID NO: 472944 - DNA, 16 bp, R. norvegicus
agaaacagacattaaa

SEQ ID NO: 472945 - DNA, 16 bp, R. norvegicus
agaaacagacggagca

SEQ ID NO: 472946 - DNA, 16 bp, R. norvegicus
agaaacagagaaaatg

SEQ ID NO: 472947 - DNA, 16 bp, R. norvegicus
agaaacagatacagag

SEQ ID NO: 472948 - DNA, 16 bp, R. norvegicus
agaaacagatagagca

SEQ ID NO: 472949 - DNA, 16 bp, R. norvegicus
agaaacagatggagca

SEQ ID NO: 472950 - DNA, 16 bp, R. norvegicus
agaaacagattttttt

SEQ ID NO: 472951 - DNA, 16 bp, R. norvegicus
agaaacagcaagacca

SEQ ID NO: 472952 - DNA, 16 bp, R. norvegicus
agaaacagcagaaagc

SEQ ID NO: 472953 - DNA, 16 bp, R. norvegicus
agaaacagcagctcca

SEQ ID NO: 472954 - DNA, 16 bp, R. norvegicus
agaaacagctgaaaga

SEQ ID NO: 472955 - DNA, 16 bp, R. norvegicus
agaaacaggaaggagc

SEQ ID NO: 472956 - DNA, 16 bp, R. norvegicus
agaaacaggacagagc

SEQ ID NO: 472957 - DNA, 16 bp, R. norvegicus
agaaacaggaggccaa

SEQ ID NO: 472958 - DNA, 16 bp, R. norvegicus
agaaacaggcaacctt

SEQ ID NO: 472959 - DNA, 16 bp, R. norvegicus
agaaacaggcagattt

SEQ ID NO: 472960 - DNA, 16 bp, R. norvegicus
agaaacagtaagacaa

SEQ ID NO: 472961 - DNA, 16 bp, R. norvegicus
agaaacagtctcaaaa

SEQ ID NO: 472962 - DNA, 16 bp, R. norvegicus
agaaacataacaacag

SEQ ID NO: 472963 - DNA, 16 bp, R. norvegicus
agaaacatacacacac

SEQ ID NO: 472964 - DNA, 31 bp, R. norvegicus
agaaacatactctagacaggatttcctttca

SEQ ID NO: 472965 - DNA, 16 bp, R. norvegicus
agaaacatttcttttt

SEQ ID NO: 472966 - DNA, 16 bp, R. norvegicus
agaaacatttgttttt

SEQ ID NO: 472967 - DNA, 16 bp, R. norvegicus
agaaacattttattta

SEQ ID NO: 472968 - DNA, 16 bp, R. norvegicus
agaaaccaagaataca

SEQ ID NO: 472969 - DNA, 18 bp, R. norvegicus
agaaaccaagactacttg

SEQ ID NO: 472970 - DNA, 16 bp, R. norvegicus
agaaaccaccaaattg

SEQ ID NO: 472971 - DNA, 16 bp, R. norvegicus
agaaaccagaaacttc

SEQ ID NO: 472972 - DNA, 16 bp, R. norvegicus
agaaaccagctatccc

SEQ ID NO: 472973 - DNA, 16 bp, R. norvegicus
agaaacccaggtcaaa

SEQ ID NO: 472974 - DNA, 16 bp, R. norvegicus
agaaaccctaactatg

SEQ ID NO: 472975 - DNA, 16 bp, R. norvegicus
agaaaccctatctcaa

SEQ ID NO: 472976 - DNA, 16 bp, R. norvegicus
agaaaccctgtctcaa

SEQ ID NO: 472977 - DNA, 16 bp, R. norvegicus
agaaaccctgtctgaa

SEQ ID NO: 472978 - DNA, 16 bp, R. norvegicus
agaaacccttggttct

SEQ ID NO: 472979 - DNA, 16 bp, R. norvegicus
agaaacctcaaagcct

SEQ ID NO: 472980 - DNA, 16 bp, R. norvegicus
agaaacctgcctggtg

SEQ ID NO: 472981 - DNA, 16 bp, R. norvegicus
agaaaccttatgaatg

SEQ ID NO: 472982 - DNA, 16 bp, R. norvegicus
agaaaccttattaaag

SEQ ID NO: 472983 - DNA, 16 bp, R. norvegicus
agaaaccttccctaac

SEQ ID NO: 472984 - DNA, 16 bp, R. norvegicus
agaaaccttgtctcta

SEQ ID NO: 472985 - DNA, 16 bp, R. norvegicus
agaaacctttaaagag

SEQ ID NO: 472986 - DNA, 16 bp, R. norvegicus
agaaacgcctaaagaa

SEQ ID NO: 472987 - DNA, 16 bp, R. norvegicus
agaaacggccattcag

SEQ ID NO: 472988 - DNA, 16 bp, R. norvegicus
agaaactaaaatattc

SEQ ID NO: 472989 - DNA, 16 bp, R. norvegicus
agaaactaaacacaga

SEQ ID NO: 472990 - DNA, 16 bp, R. norvegicus
agaaactaaagaaatg

SEQ ID NO: 472991 - DNA, 16 bp, R. norvegicus
agaaactaagaaaatt

SEQ ID NO: 472992 - DNA, 16 bp, R. norvegicus
agaaactagaaagaca

SEQ ID NO: 472993 - DNA, 16 bp, R. norvegicus
agaaactagaagtgtc

SEQ ID NO: 472994 - DNA, 16 bp, R. norvegicus
agaaactatggagaaa

SEQ ID NO: 472995 - DNA, 16 bp, R. norvegicus
agaaactcaaaacaat

SEQ ID NO: 472996 - DNA, 16 bp, R. norvegicus
agaaactcaaggcaga

SEQ ID NO: 472997 - DNA, 16 bp, R. norvegicus
agaaactcacagccaa

SEQ ID NO: 472998 - DNA, 16 bp, R. norvegicus
agaaactcaccaaaaa

SEQ ID NO: 472999 - DNA, 16 bp, R. norvegicus
agaaactcaccaaaga

SEQ ID NO: 473000 - DNA, 16 bp, R. norvegicus
agaaactctatctcaa

SEQ ID NO: 473001 - DNA, 16 bp, R. norvegicus
agaaactctcaggact

SEQ ID NO: 473002 - DNA, 16 bp, R. norvegicus
agaaactctgtcttgg

SEQ ID NO: 473003 - DNA, 16 bp, R. norvegicus
agaaactgaaaacaac

SEQ ID NO: 473004 - DNA, 16 bp, R. norvegicus
agaaactgaagaaaca

SEQ ID NO: 473005 - DNA, 16 bp, R. norvegicus
agaaactgaagaaaga

SEQ ID NO: 473006 - DNA, 16 bp, R. norvegicus
agaaactgaagcacag

SEQ ID NO: 473007 - DNA, 16 bp, R. norvegicus
agaaactgaaggaaaa

SEQ ID NO: 473008 - DNA, 16 bp, R. norvegicus
agaaactgagacagag

SEQ ID NO: 473009 - DNA, 16 bp, R. norvegicus
agaaactgatgcagag

SEQ ID NO: 473010 - DNA, 16 bp, R. norvegicus
agaaactgctctctgc

SEQ ID NO: 473011 - DNA, 16 bp, R. norvegicus
agaaactggaaaggaa

SEQ ID NO: 473012 - DNA, 16 bp, R. norvegicus
agaaactggaaagggg

SEQ ID NO: 473013 - DNA, 16 bp, R. norvegicus
agaaactggacagagc

SEQ ID NO: 473014 - DNA, 18 bp, R. norvegicus
agaaactgggcagaggag

SEQ ID NO: 473015 - DNA, 16 bp, R. norvegicus
agaaactgtgaaagcc

SEQ ID NO: 473016 - DNA, 16 bp, R. norvegicus
agaaacttaaaacatt

SEQ ID NO: 473017 - DNA, 16 bp, R. norvegicus
agaaacttcaaggcaa

SEQ ID NO: 473018 - DNA, 16 bp, R. norvegicus
agaaacttctagaaga

SEQ ID NO: 473019 - DNA, 16 bp, R. norvegicus
agaaacttctgcaaga

SEQ ID NO: 473020 - DNA, 19 bp, R. norvegicus
agaaacttgaagcaatcca

SEQ ID NO: 473021 - DNA, 16 bp, R. norvegicus
agaaacttgatgagtt

SEQ ID NO: 473022 - DNA, 16 bp, R. norvegicus
agaaactttattaaag

SEQ ID NO: 473023 - DNA, 16 bp, R. norvegicus
agaaacttttcatttt

SEQ ID NO: 473024 - DNA, 16 bp, R. norvegicus
agaaagaaaaagagct

SEQ ID NO: 473025 - DNA, 16 bp, R. norvegicus
agaaagaaaacatgga

SEQ ID NO: 473026 - DNA, 16 bp, R. norvegicus
agaaagaaaactccaa

SEQ ID NO: 473027 - DNA, 16 bp, R. norvegicus
agaaagaaaagctgac

SEQ ID NO: 473028 - DNA, 16 bp, R. norvegicus
agaaagaaaatcattt

SEQ ID NO: 473029 - DNA, 16 bp, R. norvegicus
agaaagaaaatgaact

SEQ ID NO: 473030 - DNA, 16 bp, R. norvegicus
agaaagaaaatgtcat

SEQ ID NO: 473031 - DNA, 16 bp, R. norvegicus
agaaagaaagaagtca

SEQ ID NO: 473032 - DNA, 16 bp, R. norvegicus
agaaagaaagcatttt

SEQ ID NO: 473033 - DNA, 16 bp, R. norvegicus
agaaagaaatcgagga

SEQ ID NO: 473034 - DNA, 16 bp, R. norvegicus
agaaagaaattcagaa

SEQ ID NO: 473035 - DNA, 16 bp, R. norvegicus
agaaagaaattgacaa

SEQ ID NO: 473036 - DNA, 16 bp, R. norvegicus
agaaagaacatatgga

SEQ ID NO: 473037 - DNA, 16 bp, R. norvegicus
agaaagaactagaaga

SEQ ID NO: 473038 - DNA, 16 bp, R. norvegicus
agaaagaactcaagaa

SEQ ID NO: 473039 - DNA, 16 bp, R. norvegicus
agaaagaactgaaaga

SEQ ID NO: 473040 - DNA, 16 bp, R. norvegicus
agaaagaactgaagga

SEQ ID NO: 473041 - DNA, 18 bp, R. norvegicus
agaaagaactggaagagc

SEQ ID NO: 473042 - DNA, 16 bp, R. norvegicus
agaaagaactggaatt

SEQ ID NO: 473043 - DNA, 16 bp, R. norvegicus
agaaagaactggagaa

SEQ ID NO: 473044 - DNA, 16 bp, R. norvegicus
agaaagaactggagga

SEQ ID NO: 473045 - DNA, 16 bp, R. norvegicus
agaaagaactggcaga

SEQ ID NO: 473046 - DNA, 16 bp, R. norvegicus
agaaagaagaaagctg

SEQ ID NO: 473047 - DNA, 16 bp, R. norvegicus
agaaagaagcctcagt

SEQ ID NO: 473048 - DNA, 16 bp, R. norvegicus
agaaagaagctgagaa

SEQ ID NO: 473049 - DNA, 16 bp, R. norvegicus
agaaagaagtcagaga

SEQ ID NO: 473050 - DNA, 16 bp, R. norvegicus
agaaagaagtcaggga

SEQ ID NO: 473051 - DNA, 16 bp, R. norvegicus
agaaagaatatttgaa

SEQ ID NO: 473052 - DNA, 16 bp, R. norvegicus
agaaagaatattttat

SEQ ID NO: 473053 - DNA, 16 bp, R. norvegicus
agaaagaattcacagc

SEQ ID NO: 473054 - DNA, 16 bp, R. norvegicus
agaaagaatttggaga

SEQ ID NO: 473055 - DNA, 16 bp, R. norvegicus
agaaagacatacttgg

SEQ ID NO: 473056 - DNA, 16 bp, R. norvegicus
agaaagacatagagaa

SEQ ID NO: 473057 - DNA, 16 bp, R. norvegicus
agaaagaccctgcctc

SEQ ID NO: 473058 - DNA, 16 bp, R. norvegicus
agaaagaccctgtctt

SEQ ID NO: 473059 - DNA, 16 bp, R. norvegicus
agaaagacctagaaag

SEQ ID NO: 473060 - DNA, 16 bp, R. norvegicus
agaaagactgaggaag

SEQ ID NO: 473061 - DNA, 16 bp, R. norvegicus
agaaagagaaaactga

SEQ ID NO: 473062 - DNA, 16 bp, R. norvegicus
agaaagagaaagaact

SEQ ID NO: 473063 - DNA, 16 bp, R. norvegicus
agaaagagaaattcag

SEQ ID NO: 473064 - DNA, 16 bp, R. norvegicus
agaaagagaattcaga

SEQ ID NO: 473065 - DNA, 16 bp, R. norvegicus
agaaagagcggcgcag

SEQ ID NO: 473066 - DNA, 16 bp, R. norvegicus
agaaagagctggaaga

SEQ ID NO: 473067 - DNA, 23 bp, R. norvegicus
agaaagaggaacactcctccact

SEQ ID NO: 473068 - DNA, 19 bp, R. norvegicus
agaaagaggaacactcctt

SEQ ID NO: 473069 - DNA, 16 bp, R. norvegicus
agaaagaggaagactc

SEQ ID NO: 473070 - DNA, 16 bp, R. norvegicus
agaaagaggggctggg

SEQ ID NO: 473071 - DNA, 16 bp, R. norvegicus
agaaagagtatttcag

SEQ ID NO: 473072 - DNA, 16 bp, R. norvegicus
agaaagatctggaaga

SEQ ID NO: 473073 - DNA, 16 bp, R. norvegicus
agaaagatgaccaaaa

SEQ ID NO: 473074 - DNA, 16 bp, R. norvegicus
agaaagatgaggcaga

SEQ ID NO: 473075 - DNA, 16 bp, R. norvegicus
agaaagatggctcaga

SEQ ID NO: 473076 - DNA, 16 bp, R. norvegicus
agaaagattggaagag

SEQ ID NO: 473077 - DNA, 16 bp, R. norvegicus
agaaagattttgtctt

SEQ ID NO: 473078 - DNA, 16 bp, R. norvegicus
agaaagcaaaatattc

SEQ ID NO: 473079 - DNA, 16 bp, R. norvegicus
agaaagcaaactaaga

SEQ ID NO: 473080 - DNA, 16 bp, R. norvegicus
agaaagcaagctgaag

SEQ ID NO: 473081 - DNA, 16 bp, R. norvegicus
agaaagcaattgaaga

SEQ ID NO: 473082 - DNA, 16 bp, R. norvegicus
agaaagcagaaagtga

SEQ ID NO: 473083 - DNA, 16 bp, R. norvegicus
agaaagcagcattcct

SEQ ID NO: 473084 - DNA, 16 bp, R. norvegicus
agaaagcatctgcctt

SEQ ID NO: 473085 - DNA, 16 bp, R. norvegicus
agaaagcatctttaat

SEQ ID NO: 473086 - DNA, 16 bp, R. norvegicus
agaaagcatggcagca

SEQ ID NO: 473087 - DNA, 16 bp, R. norvegicus
agaaagcattgacaaa

SEQ ID NO: 473088 - DNA, 16 bp, R. norvegicus
agaaagccagccagcc

SEQ ID NO: 473089 - DNA, 16 bp, R. norvegicus
agaaagcctccctgtg

SEQ ID NO: 473090 - DNA, 16 bp, R. norvegicus
agaaagctctgctagg

SEQ ID NO: 473091 - DNA, 16 bp, R. norvegicus
agaaagctgaggagga

SEQ ID NO: 473092 - DNA, 16 bp, R. norvegicus
agaaagctggagagat

SEQ ID NO: 473093 - DNA, 16 bp, R. norvegicus
agaaagcttctcccag

SEQ ID NO: 473094 - DNA, 16 bp, R. norvegicus
agaaaggaaactaaga

SEQ ID NO: 473095 - DNA, 16 bp, R. norvegicus
agaaaggactgaagaa

SEQ ID NO: 473096 - DNA, 16 bp, R. norvegicus
agaaaggactggaaaa

SEQ ID NO: 473097 - DNA, 16 bp, R. norvegicus
agaaaggggctgggga

SEQ ID NO: 473098 - DNA, 16 bp, R. norvegicus
agaaagggggataaca

SEQ ID NO: 473099 - DNA, 16 bp, R. norvegicus
agaaagggtttctttg

SEQ ID NO: 473100 - DNA, 16 bp, R. norvegicus
agaaagtactggaaga

SEQ ID NO: 473101 - DNA, 16 bp, R. norvegicus
agaaagtacttgaaaa

SEQ ID NO: 473102 - DNA, 16 bp, R. norvegicus
agaaagtatgtgtgtg

SEQ ID NO: 473103 - DNA, 16 bp, R. norvegicus
agaaagtgaaactaaa

SEQ ID NO: 473104 - DNA, 16 bp, R. norvegicus
agaaagtgaacttcag

SEQ ID NO: 473105 - DNA, 16 bp, R. norvegicus
agaaagtgcaagagag

SEQ ID NO: 473106 - DNA, 16 bp, R. norvegicus
agaaagtgcatgctga

SEQ ID NO: 473107 - DNA, 16 bp, R. norvegicus
agaaagtggatgaata

SEQ ID NO: 473108 - DNA, 16 bp, R. norvegicus
agaaagtgtcatcctg

SEQ ID NO: 473109 - DNA, 16 bp, R. norvegicus
agaaagttcaagaatc

SEQ ID NO: 473110 - DNA, 16 bp, R. norvegicus
agaaagttctagaagg

SEQ ID NO: 473111 - DNA, 16 bp, R. norvegicus
agaaagttctggaaaa

SEQ ID NO: 473112 - DNA, 16 bp, R. norvegicus
agaaagttgtcttctg

SEQ ID NO: 473113 - DNA, 16 bp, R. norvegicus
agaaagttgttcagtt

SEQ ID NO: 473114 - DNA, 16 bp, R. norvegicus
agaaagttttcttttt

SEQ ID NO: 473115 - DNA, 16 bp, R. norvegicus
agaaataaaaactttt

SEQ ID NO: 473116 - DNA, 16 bp, R. norvegicus
agaaataaaactacac

SEQ ID NO: 473117 - DNA, 16 bp, R. norvegicus
agaaataaaatttcta

SEQ ID NO: 473118 - DNA, 16 bp, R. norvegicus
agaaataaactgaaga

SEQ ID NO: 473119 - DNA, 16 bp, R. norvegicus
agaaataacttggggc

SEQ ID NO: 473120 - DNA, 16 bp, R. norvegicus
agaaataatcaaactc

SEQ ID NO: 473121 - DNA, 16 bp, R. norvegicus
agaaataatcccatgt

SEQ ID NO: 473122 - DNA, 16 bp, R. norvegicus
agaaatactcaaatta

SEQ ID NO: 473123 - DNA, 16 bp, R. norvegicus
agaaatactcaataaa

SEQ ID NO: 473124 - DNA, 16 bp, R. norvegicus
agaaatagagacagaa

SEQ ID NO: 473125 - DNA, 16 bp, R. norvegicus
agaaatagcaggacaa

SEQ ID NO: 473126 - DNA, 16 bp, R. norvegicus
agaaatatccaattta

SEQ ID NO: 473127 - DNA, 16 bp, R. norvegicus
agaaatatgacaactc

SEQ ID NO: 473128 - DNA, 16 bp, R. norvegicus
agaaatattcaattta

SEQ ID NO: 473129 - DNA, 16 bp, R. norvegicus
agaaatcaaaatattt

SEQ ID NO: 473130 - DNA, 16 bp, R. norvegicus
agaaatcaaagatgat

SEQ ID NO: 473131 - DNA, 16 bp, R. norvegicus
agaaatcaaagatttc

SEQ ID NO: 473132 - DNA, 16 bp, R. norvegicus
agaaatcaaggaagac

SEQ ID NO: 473133 - DNA, 16 bp, R. norvegicus
agaaatcaccaaattg

SEQ ID NO: 473134 - DNA, 16 bp, R. norvegicus
agaaatcagaagacaa

SEQ ID NO: 473135 - DNA, 16 bp, R. norvegicus
agaaatcagagaaaca

SEQ ID NO: 473136 - DNA, 16 bp, R. norvegicus
agaaatcagcacctag

SEQ ID NO: 473137 - DNA, 16 bp, R. norvegicus
agaaatccatcaacct

SEQ ID NO: 473138 - DNA, 16 bp, R. norvegicus
agaaatccatctgcct

SEQ ID NO: 473139 - DNA, 16 bp, R. norvegicus
agaaatcccagaagac

SEQ ID NO: 473140 - DNA, 16 bp, R. norvegicus
agaaatctcaaatggc

SEQ ID NO: 473141 - DNA, 16 bp, R. norvegicus
agaaatctctccagcc

SEQ ID NO: 473142 - DNA, 16 bp, R. norvegicus
agaaatctggaggcag

SEQ ID NO: 473143 - DNA, 16 bp, R. norvegicus
agaaatcttgaaaagt

SEQ ID NO: 473144 - DNA, 16 bp, R. norvegicus
agaaatctttatattt

SEQ ID NO: 473145 - DNA, 16 bp, R. norvegicus
agaaatcttttatttt

SEQ ID NO: 473146 - DNA, 16 bp, R. norvegicus
agaaatgaaaccacat

SEQ ID NO: 473147 - DNA, 16 bp, R. norvegicus
agaaatgaaagacttt

SEQ ID NO: 473148 - DNA, 16 bp, R. norvegicus
agaaatgaaatcattt

SEQ ID NO: 473149 - DNA, 16 bp, R. norvegicus
agaaatgaacccaaat

SEQ ID NO: 473150 - DNA, 16 bp, R. norvegicus
agaaatgaatgaattt

SEQ ID NO: 473151 - DNA, 16 bp, R. norvegicus
agaaatgaccattcag

SEQ ID NO: 473152 - DNA, 16 bp, R. norvegicus
agaaatgactcagagg

SEQ ID NO: 473153 - DNA, 16 bp, R. norvegicus
agaaatgactcctgca

SEQ ID NO: 473154 - DNA, 16 bp, R. norvegicus
agaaatgagggaaaca

SEQ ID NO: 473155 - DNA, 16 bp, R. norvegicus
agaaatgcaaatcaaa

SEQ ID NO: 473156 - DNA, 16 bp, R. norvegicus
agaaatgcaccaaaga

SEQ ID NO: 473157 - DNA, 17 bp, R. norvegicus
agaaatgcaggaaaaca

SEQ ID NO: 473158 - DNA, 16 bp, R. norvegicus
agaaatgcaggcacag

SEQ ID NO: 473159 - DNA, 16 bp, R. norvegicus
agaaatgccaacacat

SEQ ID NO: 473160 - DNA, 16 bp, R. norvegicus
agaaatgcccatcata

SEQ ID NO: 473161 - DNA, 16 bp, R. norvegicus
agaaatggaaatggag

SEQ ID NO: 473162 - DNA, 16 bp, R. norvegicus
agaaatggaagaagac

SEQ ID NO: 473163 - DNA, 16 bp, R. norvegicus
agaaatggaagagctt

SEQ ID NO: 473164 - DNA, 16 bp, R. norvegicus
agaaatggagaaacag

SEQ ID NO: 473165 - DNA, 16 bp, R. norvegicus
agaaatggagaagagc

SEQ ID NO: 473166 - DNA, 16 bp, R. norvegicus
agaaatggagacagaa

SEQ ID NO: 473167 - DNA, 16 bp, R. norvegicus
agaaatggaggacaca

SEQ ID NO: 473168 - DNA, 16 bp, R. norvegicus
agaaatggcagaacaa

SEQ ID NO: 473169 - DNA, 16 bp, R. norvegicus
agaaatggctcaaagg

SEQ ID NO: 473170 - DNA, 16 bp, R. norvegicus
agaaatggctcagagg

SEQ ID NO: 473171 - DNA, 16 bp, R. norvegicus
agaaatggtttttttt

SEQ ID NO: 473172 - DNA, 16 bp, R. norvegicus
agaaatgtcagaagct

SEQ ID NO: 473173 - DNA, 16 bp, R. norvegicus
agaaatgtctcccata

SEQ ID NO: 473174 - DNA, 16 bp, R. norvegicus
agaaatgtgggaagag

SEQ ID NO: 473175 - DNA, 16 bp, R. norvegicus
agaaatgtgggcacag

SEQ ID NO: 473176 - DNA, 16 bp, R. norvegicus
agaaatgttactgaag

SEQ ID NO: 473177 - DNA, 16 bp, R. norvegicus
agaaatgttattttta

SEQ ID NO: 473178 - DNA, 16 bp, R. norvegicus
agaaatgtttctcttt

SEQ ID NO: 473179 - DNA, 16 bp, R. norvegicus
agaaattaatgacttc

SEQ ID NO: 473180 - DNA, 16 bp, R. norvegicus
agaaattagcagtgat

SEQ ID NO: 473181 - DNA, 16 bp, R. norvegicus
agaaattagctcctat

SEQ ID NO: 473182 - DNA, 16 bp, R. norvegicus
agaaattcaagaagac

SEQ ID NO: 473183 - DNA, 16 bp, R. norvegicus
agaaattcaagactct

SEQ ID NO: 473184 - DNA, 16 bp, R. norvegicus
agaaattcaagtttct

SEQ ID NO: 473185 - DNA, 16 bp, R. norvegicus
agaaattgaaaatgga

SEQ ID NO: 473186 - DNA, 16 bp, R. norvegicus
agaaattgaagagatc

SEQ ID NO: 473187 - DNA, 16 bp, R. norvegicus
agaaattgatgaagat

SEQ ID NO: 473188 - DNA, 16 bp, R. norvegicus
agaaatttaaggttgt

SEQ ID NO: 473189 - DNA, 16 bp, R. norvegicus
agaaatttataccaat

SEQ ID NO: 473190 - DNA, 16 bp, R. norvegicus
agaaatttctgtctgg

SEQ ID NO: 473191 - DNA, 16 bp, R. norvegicus
agaaattttagaaatt

SEQ ID NO: 473192 - DNA, 16 bp, R. norvegicus
agaaattttagaattt

SEQ ID NO: 473193 - DNA, 16 bp, R. norvegicus
agaaattttgataaat

SEQ ID NO: 473194 - DNA, 16 bp, R. norvegicus
agaaattttgcagttt

SEQ ID NO: 473195 - DNA, 16 bp, R. norvegicus
agaacaaaaggatata

SEQ ID NO: 473196 - DNA, 16 bp, R. norvegicus
agaacaaaatctatga

SEQ ID NO: 473197 - DNA, 16 bp, R. norvegicus
agaacaaaatggagtt

SEQ ID NO: 473198 - DNA, 16 bp, R. norvegicus
agaacaaacctaagga

SEQ ID NO: 473199 - DNA, 16 bp, R. norvegicus
agaacaaatttaataa

SEQ ID NO: 473200 - DNA, 16 bp, R. norvegicus
agaacaacagtgccaa

SEQ ID NO: 473201 - DNA, 16 bp, R. norvegicus
agaacaacatttaatt

SEQ ID NO: 473202 - DNA, 26 bp, R. norvegicus
agaacaagaaggctcagctggtggtg

SEQ ID NO: 473203 - DNA, 16 bp, R. norvegicus
agaacaagatgttgaa

SEQ ID NO: 473204 - DNA, 16 bp, R. norvegicus
agaacaaggaggccat

SEQ ID NO: 473205 - DNA, 17 bp, R. norvegicus
agaacaaggatgaccaa

SEQ ID NO: 473206 - DNA, 16 bp, R. norvegicus
agaacaattttttaaa

SEQ ID NO: 473207 - DNA, 16 bp, R. norvegicus
agaacacaaatatcag

SEQ ID NO: 473208 - DNA, 16 bp, R. norvegicus
agaacacagaaatctt

SEQ ID NO: 473209 - DNA, 22 bp, R. norvegicus
agaacacagtattttgggagaa

SEQ ID NO: 473210 - DNA, 16 bp, R. norvegicus
agaacacatttttaaa

SEQ ID NO: 473211 - DNA, 16 bp, R. norvegicus
agaacacccttcacaa

SEQ ID NO: 473212 - DNA, 16 bp, R. norvegicus
agaacactcctccatt

SEQ ID NO: 473213 - DNA, 16 bp, R. norvegicus
agaacagaaagtgggg

SEQ ID NO: 473214 - DNA, 16 bp, R. norvegicus
agaacagaacagagca

SEQ ID NO: 473215 - DNA, 16 bp, R. norvegicus
agaacagaagcagcag

SEQ ID NO: 473216 - DNA, 16 bp, R. norvegicus
agaacagaatgaagaa

SEQ ID NO: 473217 - DNA, 16 bp, R. norvegicus
agaacagacactgaag

SEQ ID NO: 473218 - DNA, 16 bp, R. norvegicus
agaacagactgaagga

SEQ ID NO: 473219 - DNA, 16 bp, R. norvegicus
agaacagaggcagaag

SEQ ID NO: 473220 - DNA, 16 bp, R. norvegicus
agaacagaggcaggag

SEQ ID NO: 473221 - DNA, 16 bp, R. norvegicus
agaacagaggctgagg

SEQ ID NO: 473222 - DNA, 16 bp, R. norvegicus
agaacagagtccccat

SEQ ID NO: 473223 - DNA, 16 bp, R. norvegicus
agaacagcaagatcta

SEQ ID NO: 473224 - DNA, 16 bp, R. norvegicus
agaacagcaatgaaca

SEQ ID NO: 473225 - DNA, 16 bp, R. norvegicus
agaacagcagcaacag

SEQ ID NO: 473226 - DNA, 16 bp, R. norvegicus
agaacagcagcagcag

SEQ ID NO: 473227 - DNA, 16 bp, R. norvegicus
agaacagcagtgctct

SEQ ID NO: 473228 - DNA, 16 bp, R. norvegicus
agaacagctgaggctt

SEQ ID NO: 473229 - DNA, 16 bp, R. norvegicus
agaacaggaaccccat

SEQ ID NO: 473230 - DNA, 16 bp, R. norvegicus
agaacaggaactgaaa

SEQ ID NO: 473231 - DNA, 16 bp, R. norvegicus
agaacaggaagcaaca

SEQ ID NO: 473232 - DNA, 16 bp, R. norvegicus
agaacaggaagctgag

SEQ ID NO: 473233 - DNA, 16 bp, R. norvegicus
agaacaggaagtagaa

SEQ ID NO: 473234 - DNA, 16 bp, R. norvegicus
agaacaggaagtgggg

SEQ ID NO: 473235 - DNA, 16 bp, R. norvegicus
agaacaggaattacag

SEQ ID NO: 473236 - DNA, 16 bp, R. norvegicus
agaacaggacccctat

SEQ ID NO: 473237 - DNA, 16 bp, R. norvegicus
agaacaggagagctgg

SEQ ID NO: 473238 - DNA, 16 bp, R. norvegicus
agaacaggccctgcac

SEQ ID NO: 473239 - DNA, 16 bp, R. norvegicus
agaacaggtcctttct

SEQ ID NO: 473240 - DNA, 16 bp, R. norvegicus
agaacagtgcctggca

SEQ ID NO: 473241 - DNA, 16 bp, R. norvegicus
agaacagtgtataagg

SEQ ID NO: 473242 - DNA, 16 bp, R. norvegicus
agaacagttagttttt

SEQ ID NO: 473243 - DNA, 16 bp, R. norvegicus
agaacatcaagcctct

SEQ ID NO: 473244 - DNA, 16 bp, R. norvegicus
agaacatccaggaaat

SEQ ID NO: 473245 - DNA, 16 bp, R. norvegicus
agaacatcccacagag

SEQ ID NO: 473246 - DNA, 17 bp, R. norvegicus
agaacatcctggacaga

SEQ ID NO: 473247 - DNA, 16 bp, R. norvegicus
agaacatctgtccagg

SEQ ID NO: 473248 - DNA, 16 bp, R. norvegicus
agaacatggaggctga

SEQ ID NO: 473249 - DNA, 17 bp, R. norvegicus
agaacatggaggtggat

SEQ ID NO: 473250 - DNA, 16 bp, R. norvegicus
agaacatgtcaaacac

SEQ ID NO: 473251 - DNA, 16 bp, R. norvegicus
agaacattccagaaga

SEQ ID NO: 473252 - DNA, 16 bp, R. norvegicus
agaacattctttccta

SEQ ID NO: 473253 - DNA, 16 bp, R. norvegicus
agaacatttcatcctg

SEQ ID NO: 473254 - DNA, 16 bp, R. norvegicus
agaacatttctttttc

SEQ ID NO: 473255 - DNA, 16 bp, R. norvegicus
agaaccaaacccaggt

SEQ ID NO: 473256 - DNA, 16 bp, R. norvegicus
agaaccaacccctgac

SEQ ID NO: 473257 - DNA, 16 bp, R. norvegicus
agaaccaaggacctct

SEQ ID NO: 473258 - DNA, 16 bp, R. norvegicus
agaaccactgagttaa

SEQ ID NO: 473259 - DNA, 16 bp, R. norvegicus
agaaccactgcactca

SEQ ID NO: 473260 - DNA, 16 bp, R. norvegicus
agaaccactgccctaa

SEQ ID NO: 473261 - DNA, 16 bp, R. norvegicus
agaaccagaaatgaac

SEQ ID NO: 473262 - DNA, 16 bp, R. norvegicus
agaaccagaaccagaa

SEQ ID NO: 473263 - DNA, 16 bp, R. norvegicus
agaaccagaagctaaa

SEQ ID NO: 473264 - DNA, 16 bp, R. norvegicus
agaaccagaggatcag

SEQ ID NO: 473265 - DNA, 16 bp, R. norvegicus
agaaccagatcctggt

SEQ ID NO: 473266 - DNA, 16 bp, R. norvegicus
agaaccagctcctgtt

SEQ ID NO: 473267 - DNA, 16 bp, R. norvegicus
agaaccagcttttgct

SEQ ID NO: 473268 - DNA, 16 bp, R. norvegicus
agaaccaggagctggt

SEQ ID NO: 473269 - DNA, 16 bp, R. norvegicus
agaaccagtcattaaa

SEQ ID NO: 473270 - DNA, 17 bp, R. norvegicus
agaaccagtttctggtt

SEQ ID NO: 473271 - DNA, 16 bp, R. norvegicus
agaacccacacagcag

SEQ ID NO: 473272 - DNA, 16 bp, R. norvegicus
agaacccacataaatg

SEQ ID NO: 473273 - DNA, 16 bp, R. norvegicus
agaacccacctccagc

SEQ ID NO: 473274 - DNA, 16 bp, R. norvegicus
agaacccagaaccacc

SEQ ID NO: 473275 - DNA, 16 bp, R. norvegicus
agaacccagaggcaga

SEQ ID NO: 473276 - DNA, 16 bp, R. norvegicus
agaacccagagtccag

SEQ ID NO: 473277 - DNA, 16 bp, R. norvegicus
agaacccaggaccttg

SEQ ID NO: 473278 - DNA, 16 bp, R. norvegicus
agaacccagggatggc

SEQ ID NO: 473279 - DNA, 16 bp, R. norvegicus
agaacccagggcctca

SEQ ID NO: 473280 - DNA, 16 bp, R. norvegicus
agaaccccccagagct

SEQ ID NO: 473281 - DNA, 16 bp, R. norvegicus
agaaccctcagctctg

SEQ ID NO: 473282 - DNA, 16 bp, R. norvegicus
agaaccgactcctgca

SEQ ID NO: 473283 - DNA, 16 bp, R. norvegicus
agaacctctcagaaga

SEQ ID NO: 473284 - DNA, 16 bp, R. norvegicus
agaacctgaaaggaca

SEQ ID NO: 473285 - DNA, 16 bp, R. norvegicus
agaacctgaaggaaca

SEQ ID NO: 473286 - DNA, 16 bp, R. norvegicus
agaacctgaagggaca

SEQ ID NO: 473287 - DNA, 16 bp, R. norvegicus
agaacctgaattcagt

SEQ ID NO: 473288 - DNA, 16 bp, R. norvegicus
agaacctgagttcaat

SEQ ID NO: 473289 - DNA, 16 bp, R. norvegicus
agaacctgccctacct

SEQ ID NO: 473290 - DNA, 16 bp, R. norvegicus
agaacctggagacagg

SEQ ID NO: 473291 - DNA, 16 bp, R. norvegicus
agaacctgggtttggt

SEQ ID NO: 473292 - DNA, 16 bp, R. norvegicus
agaacctgtagagatc

SEQ ID NO: 473293 - DNA, 16 bp, R. norvegicus
agaacctgtctcaaaa

SEQ ID NO: 473294 - DNA, 16 bp, R. norvegicus
agaacctgttgagacc

SEQ ID NO: 473295 - DNA, 16 bp, R. norvegicus
agaacggccagtattg

SEQ ID NO: 473296 - DNA, 16 bp, R. norvegicus
agaactaataaaatat

SEQ ID NO: 473297 - DNA, 16 bp, R. norvegicus
agaactacaagaacta

SEQ ID NO: 473298 - DNA, 16 bp, R. norvegicus
agaactacacagagaa

SEQ ID NO: 473299 - DNA, 16 bp, R. norvegicus
agaactacacagagag

SEQ ID NO: 473300 - DNA, 16 bp, R. norvegicus
agaactacagggacaa

SEQ ID NO: 473301 - DNA, 16 bp, R. norvegicus
agaactacatagtgaa

SEQ ID NO: 473302 - DNA, 16 bp, R. norvegicus
agaactatattgtata

SEQ ID NO: 473303 - DNA, 16 bp, R. norvegicus
agaactatgcaaagaa

SEQ ID NO: 473304 - DNA, 16 bp, R. norvegicus
agaactcaaagtccta

SEQ ID NO: 473305 - DNA, 16 bp, R. norvegicus
agaactcaagaaactt

SEQ ID NO: 473306 - DNA, 16 bp, R. norvegicus
agaactcactctggag

SEQ ID NO: 473307 - DNA, 16 bp, R. norvegicus
agaactcagaaaggtc

SEQ ID NO: 473308 - DNA, 16 bp, R. norvegicus
agaactcaggaggctg

SEQ ID NO: 473309 - DNA, 16 bp, R. norvegicus
agaactcaggaggtag

SEQ ID NO: 473310 - DNA, 16 bp, R. norvegicus
agaactcaggcaggaa

SEQ ID NO: 473311 - DNA, 16 bp, R. norvegicus
agaactccaaggcaaa

SEQ ID NO: 473312 - DNA, 17 bp, R. norvegicus
agaactcgcttagagaa

SEQ ID NO: 473313 - DNA, 16 bp, R. norvegicus
agaactctcagctaca

SEQ ID NO: 473314 - DNA, 16 bp, R. norvegicus
agaactctcagctcat

SEQ ID NO: 473315 - DNA, 16 bp, R. norvegicus
agaactctgccagtct

SEQ ID NO: 473316 - DNA, 16 bp, R. norvegicus
agaactctgtccccca

SEQ ID NO: 473317 - DNA, 16 bp, R. norvegicus
agaactgaacctggat

SEQ ID NO: 473318 - DNA, 16 bp, R. norvegicus
agaactgaagaagaaa

SEQ ID NO: 473319 - DNA, 16 bp, R. norvegicus
agaactgaagacctag

SEQ ID NO: 473320 - DNA, 16 bp, R. norvegicus
agaactgactccccaa

SEQ ID NO: 473321 - DNA, 16 bp, R. norvegicus
agaactgcaagtctct

SEQ ID NO: 473322 - DNA, 16 bp, R. norvegicus
agaactgcagagacaa

SEQ ID NO: 473323 - DNA, 16 bp, R. norvegicus
agaactgctgggggaa

SEQ ID NO: 473324 - DNA, 16 bp, R. norvegicus
agaactggaagacagt

SEQ ID NO: 473325 - DNA, 16 bp, R. norvegicus
agaactggaagacctt

SEQ ID NO: 473326 - DNA, 16 bp, R. norvegicus
agaactggactctgat

SEQ ID NO: 473327 - DNA, 16 bp, R. norvegicus
agaactggaggagctg

SEQ ID NO: 473328 - DNA, 16 bp, R. norvegicus
agaactggagttacag

SEQ ID NO: 473329 - DNA, 16 bp, R. norvegicus
agaactggctgaaaga

SEQ ID NO: 473330 - DNA, 16 bp, R. norvegicus
agaactgggattaaag

SEQ ID NO: 473331 - DNA, 16 bp, R. norvegicus
agaactgggtccccaa

SEQ ID NO: 473332 - DNA, 16 bp, R. norvegicus
agaactgtggactttg

SEQ ID NO: 473333 - DNA, 16 bp, R. norvegicus
agaacttcaggtctct

SEQ ID NO: 473334 - DNA, 16 bp, R. norvegicus
agaacttctggaagag

SEQ ID NO: 473335 - DNA, 16 bp, R. norvegicus
agaacttctggagaaa

SEQ ID NO: 473336 - DNA, 16 bp, R. norvegicus
agaacttcttcagctg

SEQ ID NO: 473337 - DNA, 16 bp, R. norvegicus
agaactttaccactga

SEQ ID NO: 473338 - DNA, 16 bp, R. norvegicus
agaactttctatccta

SEQ ID NO: 473339 - DNA, 16 bp, R. norvegicus
agaactttctggaaag

SEQ ID NO: 473340 - DNA, 16 bp, R. norvegicus
agaacttttctcaaaa

SEQ ID NO: 473341 - DNA, 16 bp, R. norvegicus
agaagaaaaactaagg

SEQ ID NO: 473342 - DNA, 16 bp, R. norvegicus
agaagaaaaagaagtc

SEQ ID NO: 473343 - DNA, 16 bp, R. norvegicus
agaagaaaaagtccaa

SEQ ID NO: 473344 - DNA, 16 bp, R. norvegicus
agaagaaaaagtgcag

SEQ ID NO: 473345 - DNA, 16 bp, R. norvegicus
agaagaaaaatgccag

SEQ ID NO: 473346 - DNA, 16 bp, R. norvegicus
agaagaaaaatttcaa

SEQ ID NO: 473347 - DNA, 16 bp, R. norvegicus
agaagaaaaatttcct

SEQ ID NO: 473348 - DNA, 16 bp, R. norvegicus
agaagaaaacaatcac

SEQ ID NO: 473349 - DNA, 16 bp, R. norvegicus
agaagaaaacatcaga

SEQ ID NO: 473350 - DNA, 16 bp, R. norvegicus
agaagaaaagaaattc

SEQ ID NO: 473351 - DNA, 16 bp, R. norvegicus
agaagaaaagtttatt

SEQ ID NO: 473352 - DNA, 16 bp, R. norvegicus
agaagaaaattatttt

SEQ ID NO: 473353 - DNA, 16 bp, R. norvegicus
agaagaaaatttcctt

SEQ ID NO: 473354 - DNA, 16 bp, R. norvegicus
agaagaaactgaaaga

SEQ ID NO: 473355 - DNA, 16 bp, R. norvegicus
agaagaaagatagcat

SEQ ID NO: 473356 - DNA, 16 bp, R. norvegicus
agaagaaagatttatt

SEQ ID NO: 473357 - DNA, 16 bp, R. norvegicus
agaagaaagcaaattg

SEQ ID NO: 473358 - DNA, 16 bp, R. norvegicus
agaagaaagcttccct

SEQ ID NO: 473359 - DNA, 16 bp, R. norvegicus
agaagaaaggcacaca

SEQ ID NO: 473360 - DNA, 16 bp, R. norvegicus
agaagaaagttgggga

SEQ ID NO: 473361 - DNA, 16 bp, R. norvegicus
agaagaaatccagaag

SEQ ID NO: 473362 - DNA, 16 bp, R. norvegicus
agaagaaattaataca

SEQ ID NO: 473363 - DNA, 16 bp, R. norvegicus
agaagaacaatatcaa

SEQ ID NO: 473364 - DNA, 16 bp, R. norvegicus
agaagaaccatgagga

SEQ ID NO: 473365 - DNA, 16 bp, R. norvegicus
agaagaacctgaagaa

SEQ ID NO: 473366 - DNA, 16 bp, R. norvegicus
agaagaactcatacca

SEQ ID NO: 473367 - DNA, 16 bp, R. norvegicus
agaagaactggaggag

SEQ ID NO: 473368 - DNA, 16 bp, R. norvegicus
agaagaacttagaagt

SEQ ID NO: 473369 - DNA, 16 bp, R. norvegicus
agaagaactttttttt

SEQ ID NO: 473370 - DNA, 16 bp, R. norvegicus
agaagaagaaatgttt

SEQ ID NO: 473371 - DNA, 16 bp, R. norvegicus
agaagaagaagaaact

SEQ ID NO: 473372 - DNA, 16 bp, R. norvegicus
agaagaagaagaacat

SEQ ID NO: 473373 - DNA, 16 bp, R. norvegicus
agaagaagaagaatca

SEQ ID NO: 473374 - DNA, 16 bp, R. norvegicus
agaagaagaagatgac

SEQ ID NO: 473375 - DNA, 16 bp, R. norvegicus
agaagaagaaggcggc

SEQ ID NO: 473376 - DNA, 16 bp, R. norvegicus
agaagaagaaggtggt

SEQ ID NO: 473377 - DNA, 16 bp, R. norvegicus
agaagaagacctcaga

SEQ ID NO: 473378 - DNA, 16 bp, R. norvegicus
agaagaagatctcaga

SEQ ID NO: 473379 - DNA, 16 bp, R. norvegicus
agaagaagattccata

SEQ ID NO: 473380 - DNA, 16 bp, R. norvegicus
agaagaagcaagcagg

SEQ ID NO: 473381 - DNA, 16 bp, R. norvegicus
agaagaagcccttggt

SEQ ID NO: 473382 - DNA, 16 bp, R. norvegicus
agaagaagctgaggaa

SEQ ID NO: 473383 - DNA, 16 bp, R. norvegicus
agaagaaggaatacca

SEQ ID NO: 473384 - DNA, 16 bp, R. norvegicus
agaagaaggcagatct

SEQ ID NO: 473385 - DNA, 16 bp, R. norvegicus
agaagaaggcatattc

SEQ ID NO: 473386 - DNA, 16 bp, R. norvegicus
agaagaaggcatcgga

SEQ ID NO: 473387 - DNA, 16 bp, R. norvegicus
agaagaaggtgctgga

SEQ ID NO: 473388 - DNA, 16 bp, R. norvegicus
agaagaagtaagctgg

SEQ ID NO: 473389 - DNA, 16 bp, R. norvegicus
agaagaagtcaaatat

SEQ ID NO: 473390 - DNA, 16 bp, R. norvegicus
agaagaagtcattaaa

SEQ ID NO: 473391 - DNA, 16 bp, R. norvegicus
agaagaagtggtggtc

SEQ ID NO: 473392 - DNA, 16 bp, R. norvegicus
agaagaatacagatca

SEQ ID NO: 473393 - DNA, 16 bp, R. norvegicus
agaagaatataaattg

SEQ ID NO: 473394 - DNA, 16 bp, R. norvegicus
agaagaatcagaaacc

SEQ ID NO: 473395 - DNA, 16 bp, R. norvegicus
agaagaatctcaaaca

SEQ ID NO: 473396 - DNA, 16 bp, R. norvegicus
agaagaatgaaatcat

SEQ ID NO: 473397 - DNA, 16 bp, R. norvegicus
agaagaatgaagatca

SEQ ID NO: 473398 - DNA, 16 bp, R. norvegicus
agaagaatgcaaatgg

SEQ ID NO: 473399 - DNA, 16 bp, R. norvegicus
agaagacaccagaaga

SEQ ID NO: 473400 - DNA, 16 bp, R. norvegicus
agaagacactgaagaa

SEQ ID NO: 473401 - DNA, 16 bp, R. norvegicus
agaagacactggagga

SEQ ID NO: 473402 - DNA, 16 bp, R. norvegicus
agaagacagaaataca

SEQ ID NO: 473403 - DNA, 16 bp, R. norvegicus
agaagacagaggacag

SEQ ID NO: 473404 - DNA, 16 bp, R. norvegicus
agaagacagaggcagg

SEQ ID NO: 473405 - DNA, 16 bp, R. norvegicus
agaagacagcattttc

SEQ ID NO: 473406 - DNA, 16 bp, R. norvegicus
agaagacagtgaagat

SEQ ID NO: 473407 - DNA, 16 bp, R. norvegicus
agaagacagtgtcaga

SEQ ID NO: 473408 - DNA, 16 bp, R. norvegicus
agaagacagtttgaat

SEQ ID NO: 473409 - DNA, 16 bp, R. norvegicus
agaagacatcagattc

SEQ ID NO: 473410 - DNA, 16 bp, R. norvegicus
agaagacatgagccaa

SEQ ID NO: 473411 - DNA, 16 bp, R. norvegicus
agaagaccaccaggaa

SEQ ID NO: 473412 - DNA, 16 bp, R. norvegicus
agaagacctcagaaaa

SEQ ID NO: 473413 - DNA, 16 bp, R. norvegicus
agaagactcaagttca

SEQ ID NO: 473414 - DNA, 16 bp, R. norvegicus
agaagactctgagacc

SEQ ID NO: 473415 - DNA, 16 bp, R. norvegicus
agaagactgaggcaag

SEQ ID NO: 473416 - DNA, 16 bp, R. norvegicus
agaagactggggttca

SEQ ID NO: 473417 - DNA, 16 bp, R. norvegicus
agaagactttaaaaag

SEQ ID NO: 473418 - DNA, 16 bp, R. norvegicus
agaagagaaagtggta

SEQ ID NO: 473419 - DNA, 16 bp, R. norvegicus
agaagagaaagttgga

SEQ ID NO: 473420 - DNA, 16 bp, R. norvegicus
agaagagaaatgcaaa

SEQ ID NO: 473421 - DNA, 35 bp, R. norvegicus
agaagagaattcctggctaaagatcagtgtgccta

SEQ ID NO: 473422 - DNA, 16 bp, R. norvegicus
agaagagaccctgtct

SEQ ID NO: 473423 - DNA, 16 bp, R. norvegicus
agaagagactacactc

SEQ ID NO: 473424 - DNA, 16 bp, R. norvegicus
agaagagactgaagga

SEQ ID NO: 473425 - DNA, 16 bp, R. norvegicus
agaagagagctacaca

SEQ ID NO: 473426 - DNA, 16 bp, R. norvegicus
agaagagagtgaaaac

SEQ ID NO: 473427 - DNA, 16 bp, R. norvegicus
agaagagagtgaagat

SEQ ID NO: 473428 - DNA, 16 bp, R. norvegicus
agaagagagtgaggac

SEQ ID NO: 473429 - DNA, 16 bp, R. norvegicus
agaagagagtgggcag

SEQ ID NO: 473430 - DNA, 16 bp, R. norvegicus
agaagagcagcagcag

SEQ ID NO: 473431 - DNA, 16 bp, R. norvegicus
agaagagccagtgctc

SEQ ID NO: 473432 - DNA, 16 bp, R. norvegicus
agaagagcctaaggaa

SEQ ID NO: 473433 - DNA, 16 bp, R. norvegicus
agaagagcctgaggaa

SEQ ID NO: 473434 - DNA, 16 bp, R. norvegicus
agaagagcgacctggg

SEQ ID NO: 473435 - DNA, 16 bp, R. norvegicus
agaagagctgagaaga

SEQ ID NO: 473436 - DNA, 16 bp, R. norvegicus
agaagagctggagaga

SEQ ID NO: 473437 - DNA, 16 bp, R. norvegicus
agaagaggaaatcaga

SEQ ID NO: 473438 - DNA, 16 bp, R. norvegicus
agaagaggaagtcaga

SEQ ID NO: 473439 - DNA, 16 bp, R. norvegicus
agaagaggacatcaca

SEQ ID NO: 473440 - DNA, 16 bp, R. norvegicus
agaagaggacctcaga

SEQ ID NO: 473441 - DNA, 16 bp, R. norvegicus
agaagaggagccagtg

SEQ ID NO: 473442 - DNA, 16 bp, R. norvegicus
agaagaggatgtcaaa

SEQ ID NO: 473443 - DNA, 16 bp, R. norvegicus
agaagaggcaaggagc

SEQ ID NO: 473444 - DNA, 16 bp, R. norvegicus
agaagaggcaggcaga

SEQ ID NO: 473445 - DNA, 16 bp, R. norvegicus
agaagaggccatgaat

SEQ ID NO: 473446 - DNA, 16 bp, R. norvegicus
agaagagggcactgca

SEQ ID NO: 473447 - DNA, 16 bp, R. norvegicus
agaagagggcatccag

SEQ ID NO: 473448 - DNA, 17 bp, R. norvegicus
agaagagggcatcggat

SEQ ID NO: 473449 - DNA, 16 bp, R. norvegicus
agaagagggtactgga

SEQ ID NO: 473450 - DNA, 16 bp, R. norvegicus
agaagagggtgctgga

SEQ ID NO: 473451 - DNA, 16 bp, R. norvegicus
agaagagggtgtcaga

SEQ ID NO: 473452 - DNA, 16 bp, R. norvegicus
agaagagggtgtttga

SEQ ID NO: 473453 - DNA, 16 bp, R. norvegicus
agaagaggttgtcaga

SEQ ID NO: 473454 - DNA, 16 bp, R. norvegicus
agaagataacatagaa

SEQ ID NO: 473455 - DNA, 16 bp, R. norvegicus
agaagataccatagaa

SEQ ID NO: 473456 - DNA, 16 bp, R. norvegicus
agaagataccatgagg

SEQ ID NO: 473457 - DNA, 16 bp, R. norvegicus
agaagatactgtagaa

SEQ ID NO: 473458 - DNA, 16 bp, R. norvegicus
agaagatagaaagatt

SEQ ID NO: 473459 - DNA, 16 bp, R. norvegicus
agaagatatcatgagg

SEQ ID NO: 473460 - DNA, 16 bp, R. norvegicus
agaagatcagggagtt

SEQ ID NO: 473461 - DNA, 17 bp, R. norvegicus
agaagatcatggacaga

SEQ ID NO: 473462 - DNA, 16 bp, R. norvegicus
agaagatcctggagag

SEQ ID NO: 473463 - DNA, 16 bp, R. norvegicus
agaagatcctgtgcag

SEQ ID NO: 473464 - DNA, 17 bp, R. norvegicus
agaagatcgtgagtgga

SEQ ID NO: 473465 - DNA, 16 bp, R. norvegicus
agaagatctcagaaat

SEQ ID NO: 473466 - DNA, 16 bp, R. norvegicus
agaagatctctgaaga

SEQ ID NO: 473467 - DNA, 16 bp, R. norvegicus
agaagatctgaagcat

SEQ ID NO: 473468 - DNA, 16 bp, R. norvegicus
agaagatcttgggcag

SEQ ID NO: 473469 - DNA, 16 bp, R. norvegicus
agaagatgaaaatatc

SEQ ID NO: 473470 - DNA, 16 bp, R. norvegicus
agaagatgcaccaaac

SEQ ID NO: 473471 - DNA, 16 bp, R. norvegicus
agaagatgcagctgtc

SEQ ID NO: 473472 - DNA, 16 bp, R. norvegicus
agaagatgctggcgag

SEQ ID NO: 473473 - DNA, 16 bp, R. norvegicus
agaagatggaaagctc

SEQ ID NO: 473474 - DNA, 16 bp, R. norvegicus
agaagatggagactga

SEQ ID NO: 473475 - DNA, 16 bp, R. norvegicus
agaagatggagagatc

SEQ ID NO: 473476 - DNA, 16 bp, R. norvegicus
agaagatggatggatg

SEQ ID NO: 473477 - DNA, 16 bp, R. norvegicus
agaagatggcaggaaa

SEQ ID NO: 473478 - DNA, 16 bp, R. norvegicus
agaagatgggaagatc

SEQ ID NO: 473479 - DNA, 16 bp, R. norvegicus
agaagattaatatcca

SEQ ID NO: 473480 - DNA, 16 bp, R. norvegicus
agaagattccagaaga

SEQ ID NO: 473481 - DNA, 16 bp, R. norvegicus
agaagatttcacttca

SEQ ID NO: 473482 - DNA, 16 bp, R. norvegicus
agaagcaaaattcctc

SEQ ID NO: 473483 - DNA, 16 bp, R. norvegicus
agaagcaaagcaaagc

SEQ ID NO: 473484 - DNA, 16 bp, R. norvegicus
agaagcaactgcacac

SEQ ID NO: 473485 - DNA, 16 bp, R. norvegicus
agaagcaagaaattaa

SEQ ID NO: 473486 - DNA, 16 bp, R. norvegicus
agaagcacagagaaca

SEQ ID NO: 473487 - DNA, 16 bp, R. norvegicus
agaagcacagggacac

SEQ ID NO: 473488 - DNA, 16 bp, R. norvegicus
agaagcacataaagaa

SEQ ID NO: 473489 - DNA, 16 bp, R. norvegicus
agaagcacctaaagta

SEQ ID NO: 473490 - DNA, 16 bp, R. norvegicus
agaagcacctcaagaa

SEQ ID NO: 473491 - DNA, 16 bp, R. norvegicus
agaagcacttgaagaa

SEQ ID NO: 473492 - DNA, 16 bp, R. norvegicus
agaagcagaaaagaat

SEQ ID NO: 473493 - DNA, 16 bp, R. norvegicus
agaagcagaaatgact

SEQ ID NO: 473494 - DNA, 16 bp, R. norvegicus
agaagcagaaattaaa

SEQ ID NO: 473495 - DNA, 16 bp, R. norvegicus
agaagcagaactacag

SEQ ID NO: 473496 - DNA, 16 bp, R. norvegicus
agaagcagaagcagag

SEQ ID NO: 473497 - DNA, 16 bp, R. norvegicus
agaagcagaagcagca

SEQ ID NO: 473498 - DNA, 16 bp, R. norvegicus
agaagcagaaggagca

SEQ ID NO: 473499 - DNA, 16 bp, R. norvegicus
agaagcagaaggatca

SEQ ID NO: 473500 - DNA, 16 bp, R. norvegicus
agaagcagaggcagag

SEQ ID NO: 473501 - DNA, 16 bp, R. norvegicus
agaagcagaggcaggc

SEQ ID NO: 473502 - DNA, 16 bp, R. norvegicus
agaagcagagggagtg

SEQ ID NO: 473503 - DNA, 16 bp, R. norvegicus
agaagcagagggatgg

SEQ ID NO: 473504 - DNA, 16 bp, R. norvegicus
agaagcagatctctga

SEQ ID NO: 473505 - DNA, 16 bp, R. norvegicus
agaagcagcaacagca

SEQ ID NO: 473506 - DNA, 16 bp, R. norvegicus
agaagcagcaagaagc

SEQ ID NO: 473507 - DNA, 16 bp, R. norvegicus
agaagcagcagaagca

SEQ ID NO: 473508 - DNA, 16 bp, R. norvegicus
agaagcagcaggaagc

SEQ ID NO: 473509 - DNA, 16 bp, R. norvegicus
agaagcagctgaaaga

SEQ ID NO: 473510 - DNA, 16 bp, R. norvegicus
agaagcaggaagctgg

SEQ ID NO: 473511 - DNA, 16 bp, R. norvegicus
agaagcaggagaagca

SEQ ID NO: 473512 - DNA, 16 bp, R. norvegicus
agaagcaggagacagc

SEQ ID NO: 473513 - DNA, 16 bp, R. norvegicus
agaagcaggaggatgt

SEQ ID NO: 473514 - DNA, 16 bp, R. norvegicus
agaagcaggcccacag

SEQ ID NO: 473515 - DNA, 16 bp, R. norvegicus
agaagcaggctgagca

SEQ ID NO: 473516 - DNA, 16 bp, R. norvegicus
agaagcaggctggagt

SEQ ID NO: 473517 - DNA, 16 bp, R. norvegicus
agaagcaggggcagga

SEQ ID NO: 473518 - DNA, 16 bp, R. norvegicus
agaagcaggggctgga

SEQ ID NO: 473519 - DNA, 16 bp, R. norvegicus
agaagcagggggaggt

SEQ ID NO: 473520 - DNA, 16 bp, R. norvegicus
agaagcaggtagatct

SEQ ID NO: 473521 - DNA, 16 bp, R. norvegicus
agaagcaggtggctct

SEQ ID NO: 473522 - DNA, 16 bp, R. norvegicus
agaagcagtggcagga

SEQ ID NO: 473523 - DNA, 16 bp, R. norvegicus
agaagcagttatcaaa

SEQ ID NO: 473524 - DNA, 16 bp, R. norvegicus
agaagcatcaccaaca

SEQ ID NO: 473525 - DNA, 16 bp, R. norvegicus
agaagcatccacattt

SEQ ID NO: 473526 - DNA, 16 bp, R. norvegicus
agaagccaaattgaat

SEQ ID NO: 473527 - DNA, 16 bp, R. norvegicus
agaagccaagaaaagc

SEQ ID NO: 473528 - DNA, 16 bp, R. norvegicus
agaagccaatcactgg

SEQ ID NO: 473529 - DNA, 16 bp, R. norvegicus
agaagccagaagagga

SEQ ID NO: 473530 - DNA, 16 bp, R. norvegicus
agaagccagaagcctt

SEQ ID NO: 473531 - DNA, 16 bp, R. norvegicus
agaagccagaagctgg

SEQ ID NO: 473532 - DNA, 16 bp, R. norvegicus
agaagccagagaagga

SEQ ID NO: 473533 - DNA, 16 bp, R. norvegicus
agaagccagagacctc

SEQ ID NO: 473534 - DNA, 16 bp, R. norvegicus
agaagccagaggaaca

SEQ ID NO: 473535 - DNA, 16 bp, R. norvegicus
agaagccagaggacaa

SEQ ID NO: 473536 - DNA, 16 bp, R. norvegicus
agaagccagaggcagg

SEQ ID NO: 473537 - DNA, 16 bp, R. norvegicus
agaagccaggagaagc

SEQ ID NO: 473538 - DNA, 16 bp, R. norvegicus
agaagccagtattctg

SEQ ID NO: 473539 - DNA, 16 bp, R. norvegicus
agaagccatggaagaa

SEQ ID NO: 473540 - DNA, 16 bp, R. norvegicus
agaagccatggagaaa

SEQ ID NO: 473541 - DNA, 16 bp, R. norvegicus
agaagccatggaggag

SEQ ID NO: 473542 - DNA, 16 bp, R. norvegicus
agaagccattgaagag

SEQ ID NO: 473543 - DNA, 16 bp, R. norvegicus
agaagccatttggaat

SEQ ID NO: 473544 - DNA, 16 bp, R. norvegicus
agaagcccagagggtc

SEQ ID NO: 473545 - DNA, 16 bp, R. norvegicus
agaagcccatggagag

SEQ ID NO: 473546 - DNA, 16 bp, R. norvegicus
agaagccctattcttg

SEQ ID NO: 473547 - DNA, 16 bp, R. norvegicus
agaagcccttgggcct

SEQ ID NO: 473548 - DNA, 16 bp, R. norvegicus
agaagcccttggtcct

SEQ ID NO: 473549 - DNA, 16 bp, R. norvegicus
agaagccgtggcagga

SEQ ID NO: 473550 - DNA, 19 bp, R. norvegicus
agaagcctatagagaagaa

SEQ ID NO: 473551 - DNA, 16 bp, R. norvegicus
agaagcctccagaact

SEQ ID NO: 473552 - DNA, 16 bp, R. norvegicus
agaagcctgcagagag

SEQ ID NO: 473553 - DNA, 16 bp, R. norvegicus
agaagcctgctctttt

SEQ ID NO: 473554 - DNA, 16 bp, R. norvegicus
agaagcctttgaagag

SEQ ID NO: 473555 - DNA, 16 bp, R. norvegicus
agaagcctttgacaaa

SEQ ID NO: 473556 - DNA, 20 bp, R. norvegicus
agaagcgcaaggccctgggt

SEQ ID NO: 473557 - DNA, 16 bp, R. norvegicus
agaagctaaaaccata

SEQ ID NO: 473558 - DNA, 16 bp, R. norvegicus
agaagctaaacaagaa

SEQ ID NO: 473559 - DNA, 16 bp, R. norvegicus
agaagctctaccagca

SEQ ID NO: 473560 - DNA, 16 bp, R. norvegicus
agaagctctcagacaa

SEQ ID NO: 473561 - DNA, 16 bp, R. norvegicus
agaagctctgccagag

SEQ ID NO: 473562 - DNA, 16 bp, R. norvegicus
agaagctcttaaagaa

SEQ ID NO: 473563 - DNA, 16 bp, R. norvegicus
agaagctcttaaagag

SEQ ID NO: 473564 - DNA, 16 bp, R. norvegicus
agaagctgaagcagag

SEQ ID NO: 473565 - DNA, 16 bp, R. norvegicus
agaagctgaagcagga

SEQ ID NO: 473566 - DNA, 16 bp, R. norvegicus
agaagctgaaggaaca

SEQ ID NO: 473567 - DNA, 16 bp, R. norvegicus
agaagctgaagggaag

SEQ ID NO: 473568 - DNA, 16 bp, R. norvegicus
agaagctgaaggggct

SEQ ID NO: 473569 - DNA, 16 bp, R. norvegicus
agaagctgagaagctg

SEQ ID NO: 473570 - DNA, 16 bp, R. norvegicus
agaagctgagaaggag

SEQ ID NO: 473571 - DNA, 16 bp, R. norvegicus
agaagctgagagaagc

SEQ ID NO: 473572 - DNA, 16 bp, R. norvegicus
agaagctgaggagaag

SEQ ID NO: 473573 - DNA, 16 bp, R. norvegicus
agaagctgaggagaga

SEQ ID NO: 473574 - DNA, 16 bp, R. norvegicus
agaagctgaggaggaa

SEQ ID NO: 473575 - DNA, 16 bp, R. norvegicus
agaagctgaggcagaa

SEQ ID NO: 473576 - DNA, 16 bp, R. norvegicus
agaagctgagggggag

SEQ ID NO: 473577 - DNA, 16 bp, R. norvegicus
agaagctgcagagagc

SEQ ID NO: 473578 - DNA, 16 bp, R. norvegicus
agaagctgctgaaccc

SEQ ID NO: 473579 - DNA, 16 bp, R. norvegicus
agaagctgctgaccct

SEQ ID NO: 473580 - DNA, 16 bp, R. norvegicus
agaagctgctggcccc

SEQ ID NO: 473581 - DNA, 16 bp, R. norvegicus
agaagctggagaaatg

SEQ ID NO: 473582 - DNA, 16 bp, R. norvegicus
agaagctggagaagca

SEQ ID NO: 473583 - DNA, 28 bp, R. norvegicus
agaagctggagaagcaacagcaaatgca

SEQ ID NO: 473584 - DNA, 16 bp, R. norvegicus
agaagctggagagaaa

SEQ ID NO: 473585 - DNA, 16 bp, R. norvegicus
agaagctggagagagc

SEQ ID NO: 473586 - DNA, 16 bp, R. norvegicus
agaagctggggttggg

SEQ ID NO: 473587 - DNA, 16 bp, R. norvegicus
agaagctggtgcagag

SEQ ID NO: 473588 - DNA, 16 bp, R. norvegicus
agaagctgtctcaaaa

SEQ ID NO: 473589 - DNA, 16 bp, R. norvegicus
agaagctgtgaagctc

SEQ ID NO: 473590 - DNA, 16 bp, R. norvegicus
agaagctgtgtcccag

SEQ ID NO: 473591 - DNA, 16 bp, R. norvegicus
agaagctgtgtctgca

SEQ ID NO: 473592 - DNA, 16 bp, R. norvegicus
agaagctgtgttctag

SEQ ID NO: 473593 - DNA, 16 bp, R. norvegicus
agaagctgttctctga

SEQ ID NO: 473594 - DNA, 16 bp, R. norvegicus
agaagcttacagaact

SEQ ID NO: 473595 - DNA, 16 bp, R. norvegicus
agaagcttcatccagc

SEQ ID NO: 473596 - DNA, 16 bp, R. norvegicus
agaagcttcatttatt

SEQ ID NO: 473597 - DNA, 16 bp, R. norvegicus
agaagcttccaggcct

SEQ ID NO: 473598 - DNA, 16 bp, R. norvegicus
agaagcttctggaaag

SEQ ID NO: 473599 - DNA, 16 bp, R. norvegicus
agaagcttctggaaga

SEQ ID NO: 473600 - DNA, 16 bp, R. norvegicus
agaagcttcttcttgc

SEQ ID NO: 473601 - DNA, 16 bp, R. norvegicus
agaagcttgaagcaat

SEQ ID NO: 473602 - DNA, 16 bp, R. norvegicus
agaagctttttaaaaa

SEQ ID NO: 473603 - DNA, 16 bp, R. norvegicus
agaaggaaaagataac

SEQ ID NO: 473604 - DNA, 16 bp, R. norvegicus
agaaggaacactacct

SEQ ID NO: 473605 - DNA, 16 bp, R. norvegicus
agaaggaactgaagga

SEQ ID NO: 473606 - DNA, 16 bp, R. norvegicus
agaaggaagaaaatca

SEQ ID NO: 473607 - DNA, 16 bp, R. norvegicus
agaaggaagaatttgt

SEQ ID NO: 473608 - DNA, 16 bp, R. norvegicus
agaaggaagacaggcc

SEQ ID NO: 473609 - DNA, 16 bp, R. norvegicus
agaaggaagacccaag

SEQ ID NO: 473610 - DNA, 16 bp, R. norvegicus
agaaggaagcctcaga

SEQ ID NO: 473611 - DNA, 16 bp, R. norvegicus
agaaggaaggatgagt

SEQ ID NO: 473612 - DNA, 16 bp, R. norvegicus
agaaggaaggatggtg

SEQ ID NO: 473613 - DNA, 16 bp, R. norvegicus
agaaggaaggccaaag

SEQ ID NO: 473614 - DNA, 16 bp, R. norvegicus
agaaggaagggcaggc

SEQ ID NO: 473615 - DNA, 16 bp, R. norvegicus
agaaggaagtagccat

SEQ ID NO: 473616 - DNA, 16 bp, R. norvegicus
agaaggaatgggagca

SEQ ID NO: 473617 - DNA, 16 bp, R. norvegicus
agaaggaattgagtag

SEQ ID NO: 473618 - DNA, 16 bp, R. norvegicus
agaaggacacttcata

SEQ ID NO: 473619 - DNA, 16 bp, R. norvegicus
agaaggacagaaccaa

SEQ ID NO: 473620 - DNA, 16 bp, R. norvegicus
agaaggacagagacag

SEQ ID NO: 473621 - DNA, 16 bp, R. norvegicus
agaaggacatgaagaa

SEQ ID NO: 473622 - DNA, 16 bp, R. norvegicus
agaaggactggaggag

SEQ ID NO: 473623 - DNA, 16 bp, R. norvegicus
agaaggactgggagga

SEQ ID NO: 473624 - DNA, 16 bp, R. norvegicus
agaaggagaacttcag

SEQ ID NO: 473625 - DNA, 16 bp, R. norvegicus
agaaggagaagaccag

SEQ ID NO: 473626 - DNA, 16 bp, R. norvegicus
agaaggagacagacag

SEQ ID NO: 473627 - DNA, 16 bp, R. norvegicus
agaaggagacagagac

SEQ ID NO: 473628 - DNA, 16 bp, R. norvegicus
agaaggagagaactga

SEQ ID NO: 473629 - DNA, 16 bp, R. norvegicus
agaaggagagagctga

SEQ ID NO: 473630 - DNA, 16 bp, R. norvegicus
agaaggagccaagagc

SEQ ID NO: 473631 - DNA, 16 bp, R. norvegicus
agaaggagctagaaga

SEQ ID NO: 473632 - DNA, 16 bp, R. norvegicus
agaaggagctgagact

SEQ ID NO: 473633 - DNA, 16 bp, R. norvegicus
agaaggagctgagtgt

SEQ ID NO: 473634 - DNA, 16 bp, R. norvegicus
agaaggagctggagag

SEQ ID NO: 473635 - DNA, 16 bp, R. norvegicus
agaaggagctgggaga

SEQ ID NO: 473636 - DNA, 16 bp, R. norvegicus
agaaggaggaaatgca

SEQ ID NO: 473637 - DNA, 16 bp, R. norvegicus
agaaggagggtggcct

SEQ ID NO: 473638 - DNA, 16 bp, R. norvegicus
agaaggagtagaagca

SEQ ID NO: 473639 - DNA, 16 bp, R. norvegicus
agaaggatcagaagtt

SEQ ID NO: 473640 - DNA, 16 bp, R. norvegicus
agaaggatctgatgat

SEQ ID NO: 473641 - DNA, 16 bp, R. norvegicus
agaaggatgactcaga

SEQ ID NO: 473642 - DNA, 16 bp, R. norvegicus
agaaggatttgacaga

SEQ ID NO: 473643 - DNA, 16 bp, R. norvegicus
agaaggcaaacaggag

SEQ ID NO: 473644 - DNA, 16 bp, R. norvegicus
agaaggcagagctgga

SEQ ID NO: 473645 - DNA, 16 bp, R. norvegicus
agaaggcagaggcaag

SEQ ID NO: 473646 - DNA, 16 bp, R. norvegicus
agaaggcagaggctgg

SEQ ID NO: 473647 - DNA, 16 bp, R. norvegicus
agaaggcagcatcaga

SEQ ID NO: 473648 - DNA, 16 bp, R. norvegicus
agaaggcagtaaataa

SEQ ID NO: 473649 - DNA, 16 bp, R. norvegicus
agaaggccatagagag

SEQ ID NO: 473650 - DNA, 16 bp, R. norvegicus
agaaggccctgaatat

SEQ ID NO: 473651 - DNA, 16 bp, R. norvegicus
agaaggcctgggttca

SEQ ID NO: 473652 - DNA, 16 bp, R. norvegicus
agaaggctcagtgagt

SEQ ID NO: 473653 - DNA, 16 bp, R. norvegicus
agaaggctcagttggt

SEQ ID NO: 473654 - DNA, 16 bp, R. norvegicus
agaaggctgagcaagc

SEQ ID NO: 473655 - DNA, 16 bp, R. norvegicus
agaagggggaggggct

SEQ ID NO: 473656 - DNA, 16 bp, R. norvegicus
agaagggggctggaga

SEQ ID NO: 473657 - DNA, 16 bp, R. norvegicus
agaagggtcaaggaca

SEQ ID NO: 473658 - DNA, 16 bp, R. norvegicus
agaagggtctcaaagc

SEQ ID NO: 473659 - DNA, 16 bp, R. norvegicus
agaaggtgatggagaa

SEQ ID NO: 473660 - DNA, 16 bp, R. norvegicus
agaaggttcagtgaca

SEQ ID NO: 473661 - DNA, 16 bp, R. norvegicus
agaagtaaagcacaca

SEQ ID NO: 473662 - DNA, 16 bp, R. norvegicus
agaagtacatgctgac

SEQ ID NO: 473663 - DNA, 16 bp, R. norvegicus
agaagtaccaaaagaa

SEQ ID NO: 473664 - DNA, 16 bp, R. norvegicus
agaagtagaggccagc

SEQ ID NO: 473665 - DNA, 16 bp, R. norvegicus
agaagtagcaagaaac

SEQ ID NO: 473666 - DNA, 16 bp, R. norvegicus
agaagtagtagtagta

SEQ ID NO: 473667 - DNA, 16 bp, R. norvegicus
agaagtatcctgtccc

SEQ ID NO: 473668 - DNA, 16 bp, R. norvegicus
agaagtcaaaggacaa

SEQ ID NO: 473669 - DNA, 16 bp, R. norvegicus
agaagtcaaggcagaa

SEQ ID NO: 473670 - DNA, 16 bp, R. norvegicus
agaagtcacagagagt

SEQ ID NO: 473671 - DNA, 16 bp, R. norvegicus
agaagtcagaagacaa

SEQ ID NO: 473672 - DNA, 16 bp, R. norvegicus
agaagtcagaggcctc

SEQ ID NO: 473673 - DNA, 16 bp, R. norvegicus
agaagtcagcatttga

SEQ ID NO: 473674 - DNA, 16 bp, R. norvegicus
agaagtcaggacagga

SEQ ID NO: 473675 - DNA, 16 bp, R. norvegicus
agaagtcagggcagga

SEQ ID NO: 473676 - DNA, 16 bp, R. norvegicus
agaagtcatagacaca

SEQ ID NO: 473677 - DNA, 16 bp, R. norvegicus
agaagtcatgaagcaa

SEQ ID NO: 473678 - DNA, 16 bp, R. norvegicus
agaagtccttggttct

SEQ ID NO: 473679 - DNA, 16 bp, R. norvegicus
agaagtccttttactg

SEQ ID NO: 473680 - DNA, 16 bp, R. norvegicus
agaagtctgaggatga

SEQ ID NO: 473681 - DNA, 16 bp, R. norvegicus
agaagtgaaaatggag

SEQ ID NO: 473682 - DNA, 16 bp, R. norvegicus
agaagtgaagccagcc

SEQ ID NO: 473683 - DNA, 16 bp, R. norvegicus
agaagtgcagaccaac

SEQ ID NO: 473684 - DNA, 16 bp, R. norvegicus
agaagtgcagactgac

SEQ ID NO: 473685 - DNA, 17 bp, R. norvegicus
agaagtgcaggttgaca

SEQ ID NO: 473686 - DNA, 16 bp, R. norvegicus
agaagtgcatgctgat

SEQ ID NO: 473687 - DNA, 16 bp, R. norvegicus
agaagtgctgacaatc

SEQ ID NO: 473688 - DNA, 16 bp, R. norvegicus
agaagtgctttctgac

SEQ ID NO: 473689 - DNA, 16 bp, R. norvegicus
agaagtggagacagga

SEQ ID NO: 473690 - DNA, 16 bp, R. norvegicus
agaagtgggaagatca

SEQ ID NO: 473691 - DNA, 16 bp, R. norvegicus
agaagtgtggaaggca

SEQ ID NO: 473692 - DNA, 16 bp, R. norvegicus
agaagttaggaaccaa

SEQ ID NO: 473693 - DNA, 16 bp, R. norvegicus
agaagttcaagaccat

SEQ ID NO: 473694 - DNA, 16 bp, R. norvegicus
agaagttcaagctcat

SEQ ID NO: 473695 - DNA, 16 bp, R. norvegicus
agaagttcaaggtcag

SEQ ID NO: 473696 - DNA, 16 bp, R. norvegicus
agaagttcaaggttat

SEQ ID NO: 473697 - DNA, 16 bp, R. norvegicus
agaagttcagggtcat

SEQ ID NO: 473698 - DNA, 16 bp, R. norvegicus
agaagttctgaaagac

SEQ ID NO: 473699 - DNA, 16 bp, R. norvegicus
agaagttcttaaagag

SEQ ID NO: 473700 - DNA, 16 bp, R. norvegicus
agaagttgaagaagac

SEQ ID NO: 473701 - DNA, 16 bp, R. norvegicus
agaagttgaagaagat

SEQ ID NO: 473702 - DNA, 16 bp, R. norvegicus
agaagttgaggaagat

SEQ ID NO: 473703 - DNA, 16 bp, R. norvegicus
agaagttgaggatctt

SEQ ID NO: 473704 - DNA, 16 bp, R. norvegicus
agaagtttccacttca

SEQ ID NO: 473705 - DNA, 16 bp, R. norvegicus
agaagtttcttttctg

SEQ ID NO: 473706 - DNA, 16 bp, R. norvegicus
agaataaaatagtcat

SEQ ID NO: 473707 - DNA, 16 bp, R. norvegicus
agaataaagtttattt

SEQ ID NO: 473708 - DNA, 16 bp, R. norvegicus
agaataaggcagaacg

SEQ ID NO: 473709 - DNA, 16 bp, R. norvegicus
agaatacaaaagattg

SEQ ID NO: 473710 - DNA, 16 bp, R. norvegicus
agaatacccaggacac

SEQ ID NO: 473711 - DNA, 16 bp, R. norvegicus
agaatacgaattcaag

SEQ ID NO: 473712 - DNA, 16 bp, R. norvegicus
agaatactaatgaaaa

SEQ ID NO: 473713 - DNA, 16 bp, R. norvegicus
agaatagcttcaggaa

SEQ ID NO: 473714 - DNA, 16 bp, R. norvegicus
agaatagggtgttgaa

SEQ ID NO: 473715 - DNA, 16 bp, R. norvegicus
agaatagtttttgttt

SEQ ID NO: 473716 - DNA, 16 bp, R. norvegicus
agaatataccagagac

SEQ ID NO: 473717 - DNA, 36 bp, R. norvegicus
agaatatacctcataatggagctggtggaaggccaa

SEQ ID NO: 473718 - DNA, 16 bp, R. norvegicus
agaatatcattgggaa

SEQ ID NO: 473719 - DNA, 16 bp, R. norvegicus
agaatatgaggaaatt

SEQ ID NO: 473720 - DNA, 16 bp, R. norvegicus
agaatatgcaaagaac

SEQ ID NO: 473721 - DNA, 16 bp, R. norvegicus
agaatattttgttttc

SEQ ID NO: 473722 - DNA, 16 bp, R. norvegicus
agaatcaaatatccct

SEQ ID NO: 473723 - DNA, 16 bp, R. norvegicus
agaatcaactgacctg

SEQ ID NO: 473724 - DNA, 16 bp, R. norvegicus
agaatcaagatggaga

SEQ ID NO: 473725 - DNA, 16 bp, R. norvegicus
agaatcaagtaaccct

SEQ ID NO: 473726 - DNA, 59 bp, R. norvegicus
agaatcacaccagacttttcgccagaaactatgaaggccagaagatcctggactgatgt

SEQ ID NO: 473727 - DNA, 16 bp, R. norvegicus
agaatcaccccagact

SEQ ID NO: 473728 - DNA, 30 bp, R. norvegicus
agaatcactatccctgaactcaagcagtat

SEQ ID NO: 473729 - DNA, 16 bp, R. norvegicus
agaatcactatggaaa

SEQ ID NO: 473730 - DNA, 16 bp, R. norvegicus
agaatcagagaaagat

SEQ ID NO: 473731 - DNA, 16 bp, R. norvegicus
agaatcagagacagag

SEQ ID NO: 473732 - DNA, 16 bp, R. norvegicus
agaatcagtcattaaa

SEQ ID NO: 473733 - DNA, 16 bp, R. norvegicus
agaatcagttttcttc

SEQ ID NO: 473734 - DNA, 16 bp, R. norvegicus
agaatcatggtgtcat

SEQ ID NO: 473735 - DNA, 16 bp, R. norvegicus
agaatccaattaaaag

SEQ ID NO: 473736 - DNA, 16 bp, R. norvegicus
agaatccaggaccaca

SEQ ID NO: 473737 - DNA, 16 bp, R. norvegicus
agaatcccatggaaaa

SEQ ID NO: 473738 - DNA, 16 bp, R. norvegicus
agaatcctgaagaagt

SEQ ID NO: 473739 - DNA, 16 bp, R. norvegicus
agaatcctgatgctaa

SEQ ID NO: 473740 - DNA, 16 bp, R. norvegicus
agaatcctgtggaaga

SEQ ID NO: 473741 - DNA, 16 bp, R. norvegicus
agaatctcaggaaatt

SEQ ID NO: 473742 - DNA, 16 bp, R. norvegicus
agaatctgacaaatac

SEQ ID NO: 473743 - DNA, 16 bp, R. norvegicus
agaatctgagttcaga

SEQ ID NO: 473744 - DNA, 16 bp, R. norvegicus
agaatctgtgtgtgtg

SEQ ID NO: 473745 - DNA, 16 bp, R. norvegicus
agaatcttctggcttt

SEQ ID NO: 473746 - DNA, 16 bp, R. norvegicus
agaatcttctgtttgt

SEQ ID NO: 473747 - DNA, 16 bp, R. norvegicus
agaatgaaaattgacc

SEQ ID NO: 473748 - DNA, 17 bp, R. norvegicus
agaatgaaattagggaa

SEQ ID NO: 473749 - DNA, 16 bp, R. norvegicus
agaatgaaggagctga

SEQ ID NO: 473750 - DNA, 16 bp, R. norvegicus
agaatgaatagaaatc

SEQ ID NO: 473751 - DNA, 16 bp, R. norvegicus
agaatgaattgggtaa

SEQ ID NO: 473752 - DNA, 16 bp, R. norvegicus
agaatgaccttaaact

SEQ ID NO: 473753 - DNA, 16 bp, R. norvegicus
agaatgagaagatcaa

SEQ ID NO: 473754 - DNA, 16 bp, R. norvegicus
agaatgagagaatgag

SEQ ID NO: 473755 - DNA, 16 bp, R. norvegicus
agaatgaggacatcat

SEQ ID NO: 473756 - DNA, 16 bp, R. norvegicus
agaatgagttcaaggc

SEQ ID NO: 473757 - DNA, 16 bp, R. norvegicus
agaatgagttctagga

SEQ ID NO: 473758 - DNA, 16 bp, R. norvegicus
agaatgatgaccaaag

SEQ ID NO: 473759 - DNA, 16 bp, R. norvegicus
agaatgatggattctg

SEQ ID NO: 473760 - DNA, 16 bp, R. norvegicus
agaatgattgtttcca

SEQ ID NO: 473761 - DNA, 16 bp, R. norvegicus
agaatgcaggctgagc

SEQ ID NO: 473762 - DNA, 16 bp, R. norvegicus
agaatgcagggtactc

SEQ ID NO: 473763 - DNA, 16 bp, R. norvegicus
agaatgccagggtggg

SEQ ID NO: 473764 - DNA, 16 bp, R. norvegicus
agaatgctgagagaaa

SEQ ID NO: 473765 - DNA, 16 bp, R. norvegicus
agaatgctggtcctcc

SEQ ID NO: 473766 - DNA, 16 bp, R. norvegicus
agaatggaacccatca

SEQ ID NO: 473767 - DNA, 16 bp, R. norvegicus
agaatggaatcaaaat

SEQ ID NO: 473768 - DNA, 16 bp, R. norvegicus
agaatggacaaagaaa

SEQ ID NO: 473769 - DNA, 16 bp, R. norvegicus
agaatggagaagagac

SEQ ID NO: 473770 - DNA, 16 bp, R. norvegicus
agaatggatacagaaa

SEQ ID NO: 473771 - DNA, 16 bp, R. norvegicus
agaatggcattgtcca

SEQ ID NO: 473772 - DNA, 19 bp, R. norvegicus
agaatggctaaaatcaaaa

SEQ ID NO: 473773 - DNA, 31 bp, R. norvegicus
agaatggctaagatcaaaaactcaggggaca

SEQ ID NO: 473774 - DNA, 41 bp, R. norvegicus
agaatggctaagatcaaaaactcaggtgacagcaaatgctg

SEQ ID NO: 473775 - DNA, 16 bp, R. norvegicus
agaatggctactgcag

SEQ ID NO: 473776 - DNA, 25 bp, R. norvegicus
agaatggctatgatcaaaaactcag

SEQ ID NO: 473777 - DNA, 16 bp, R. norvegicus
agaatgggggacagga

SEQ ID NO: 473778 - DNA, 16 bp, R. norvegicus
agaatgggttgtcttc

SEQ ID NO: 473779 - DNA, 16 bp, R. norvegicus
agaatggttgttccag

SEQ ID NO: 473780 - DNA, 16 bp, R. norvegicus
agaatgtaccagaggc

SEQ ID NO: 473781 - DNA, 16 bp, R. norvegicus
agaatgtcctataaat

SEQ ID NO: 473782 - DNA, 16 bp, R. norvegicus
agaatgtgaatgcttc

SEQ ID NO: 473783 - DNA, 16 bp, R. norvegicus
agaatgtgaggaaatt

SEQ ID NO: 473784 - DNA, 16 bp, R. norvegicus
agaatgtggtacattt

SEQ ID NO: 473785 - DNA, 16 bp, R. norvegicus
agaatgttccagacat

SEQ ID NO: 473786 - DNA, 16 bp, R. norvegicus
agaatgttctgtaaat

SEQ ID NO: 473787 - DNA, 16 bp, R. norvegicus
agaattaacagaacca

SEQ ID NO: 473788 - DNA, 16 bp, R. norvegicus
agaattaagtatgact

SEQ ID NO: 473789 - DNA, 17 bp, R. norvegicus
agaattacaccagactt

SEQ ID NO: 473790 - DNA, 16 bp, R. norvegicus
agaattacagaaaaac

SEQ ID NO: 473791 - DNA, 16 bp, R. norvegicus
agaattatgccaaata

SEQ ID NO: 473792 - DNA, 16 bp, R. norvegicus
agaattattcatttat

SEQ ID NO: 473793 - DNA, 16 bp, R. norvegicus
agaattatttttcttt

SEQ ID NO: 473794 - DNA, 16 bp, R. norvegicus
agaattcaatgaaagt

SEQ ID NO: 473795 - DNA, 16 bp, R. norvegicus
agaattcacagctggg

SEQ ID NO: 473796 - DNA, 16 bp, R. norvegicus
agaattcataacagag

SEQ ID NO: 473797 - DNA, 16 bp, R. norvegicus
agaattcatacaggag

SEQ ID NO: 473798 - DNA, 16 bp, R. norvegicus
agaattcctaaaattg

SEQ ID NO: 473799 - DNA, 16 bp, R. norvegicus
agaattctcagaagag

SEQ ID NO: 473800 - DNA, 16 bp, R. norvegicus
agaattctctgtttat

SEQ ID NO: 473801 - DNA, 16 bp, R. norvegicus
agaattctgaacagag

SEQ ID NO: 473802 - DNA, 16 bp, R. norvegicus
agaattctgctctaaa

SEQ ID NO: 473803 - DNA, 16 bp, R. norvegicus
agaattctgtttatat

SEQ ID NO: 473804 - DNA, 36 bp, R. norvegicus
agaattgaagacccagaaatgaacccacacacctac

SEQ ID NO: 473805 - DNA, 16 bp, R. norvegicus
agaattgaaggagctg

SEQ ID NO: 473806 - DNA, 16 bp, R. norvegicus
agaattgataaatgtg

SEQ ID NO: 473807 - DNA, 16 bp, R. norvegicus
agaattgcctccatca

SEQ ID NO: 473808 - DNA, 16 bp, R. norvegicus
agaattgctcctgtgt

SEQ ID NO: 473809 - DNA, 16 bp, R. norvegicus
agaattggaaggttca

SEQ ID NO: 473810 - DNA, 16 bp, R. norvegicus
agaattgtattaaagg

SEQ ID NO: 473811 - DNA, 16 bp, R. norvegicus
agaatttatatattga

SEQ ID NO: 473812 - DNA, 16 bp, R. norvegicus
agaatttcagagaaaa

SEQ ID NO: 473813 - DNA, 16 bp, R. norvegicus
agaatttctattgctg

SEQ ID NO: 473814 - DNA, 16 bp, R. norvegicus
agaatttgaggaagat

SEQ ID NO: 473815 - DNA, 16 bp, R. norvegicus
agaatttgccaaagaa

SEQ ID NO: 473816 - DNA, 16 bp, R. norvegicus
agaatttggaaaaata

SEQ ID NO: 473817 - DNA, 16 bp, R. norvegicus
agaattttaaaacttt

SEQ ID NO: 473818 - DNA, 16 bp, R. norvegicus
agaattttcattttaa

SEQ ID NO: 473819 - DNA, 16 bp, R. norvegicus
agaattttcattttct

SEQ ID NO: 473820 - DNA, 16 bp, R. norvegicus
agaattttgagagagt

SEQ ID NO: 473821 - DNA, 16 bp, R. norvegicus
agaattttttctcctt

SEQ ID NO: 473822 - DNA, 16 bp, R. norvegicus
agacaaagagaggcag

SEQ ID NO: 473823 - DNA, 16 bp, R. norvegicus
agacaaagaggcagag

SEQ ID NO: 473824 - DNA, 16 bp, R. norvegicus
agacaaagccaagcag

SEQ ID NO: 473825 - DNA, 16 bp, R. norvegicus
agacaaaggacactgt

SEQ ID NO: 473826 - DNA, 16 bp, R. norvegicus
agacaaaggcatgcag

SEQ ID NO: 473827 - DNA, 16 bp, R. norvegicus
agacaaagtatggagt

SEQ ID NO: 473828 - DNA, 16 bp, R. norvegicus
agacaaagtctggagc

SEQ ID NO: 473829 - DNA, 16 bp, R. norvegicus
agacaaagtggcagcc

SEQ ID NO: 473830 - DNA, 16 bp, R. norvegicus
agacaaatactttctg

SEQ ID NO: 473831 - DNA, 16 bp, R. norvegicus
agacaacaagaccagc

SEQ ID NO: 473832 - DNA, 16 bp, R. norvegicus
agacaacacagcagaa

SEQ ID NO: 473833 - DNA, 16 bp, R. norvegicus
agacaacaggaaataa

SEQ ID NO: 473834 - DNA, 16 bp, R. norvegicus
agacaacagtaccagt

SEQ ID NO: 473835 - DNA, 16 bp, R. norvegicus
agacaacagtgaaggc

SEQ ID NO: 473836 - DNA, 16 bp, R. norvegicus
agacaacatggatgaa

SEQ ID NO: 473837 - DNA, 16 bp, R. norvegicus
agacaacccaggagat

SEQ ID NO: 473838 - DNA, 23 bp, R. norvegicus
agacaaccctggagatagaaaac

SEQ ID NO: 473839 - DNA, 16 bp, R. norvegicus
agacaactgaaggaga

SEQ ID NO: 473840 - DNA, 16 bp, R. norvegicus
agacaagatagaagaa

SEQ ID NO: 473841 - DNA, 16 bp, R. norvegicus
agacaagatggtgaag

SEQ ID NO: 473842 - DNA, 17 bp, R. norvegicus
agacaagattgatgaag

SEQ ID NO: 473843 - DNA, 16 bp, R. norvegicus
agacaagctgcccact

SEQ ID NO: 473844 - DNA, 16 bp, R. norvegicus
agacaaggagctgcag

SEQ ID NO: 473845 - DNA, 16 bp, R. norvegicus
agacaaggagtcatag

SEQ ID NO: 473846 - DNA, 16 bp, R. norvegicus
agacaaggatgcctac

SEQ ID NO: 473847 - DNA, 16 bp, R. norvegicus
agacaaggctgcacac

SEQ ID NO: 473848 - DNA, 16 bp, R. norvegicus
agacaaggctgccccc

SEQ ID NO: 473849 - DNA, 16 bp, R. norvegicus
agacaaggctggcttc

SEQ ID NO: 473850 - DNA, 16 bp, R. norvegicus
agacaaggtctcactg

SEQ ID NO: 473851 - DNA, 17 bp, R. norvegicus
agacaaggtggatgaag

SEQ ID NO: 473852 - DNA, 16 bp, R. norvegicus
agacaaggtttttctg

SEQ ID NO: 473853 - DNA, 16 bp, R. norvegicus
agacaataaaacaatt

SEQ ID NO: 473854 - DNA, 16 bp, R. norvegicus
agacaatatacagcaa

SEQ ID NO: 473855 - DNA, 16 bp, R. norvegicus
agacaatattgaggat

SEQ ID NO: 473856 - DNA, 16 bp, R. norvegicus
agacaatctgaagcag

SEQ ID NO: 473857 - DNA, 16 bp, R. norvegicus
agacaatctgatggtg

SEQ ID NO: 473858 - DNA, 16 bp, R. norvegicus
agacaatgaagaagaa

SEQ ID NO: 473859 - DNA, 17 bp, R. norvegicus
agacaatgaggcaacag

SEQ ID NO: 473860 - DNA, 16 bp, R. norvegicus
agacaatgccagccaa

SEQ ID NO: 473861 - DNA, 16 bp, R. norvegicus
agacacaagaacagag

SEQ ID NO: 473862 - DNA, 16 bp, R. norvegicus
agacacaatgtgacca

SEQ ID NO: 473863 - DNA, 16 bp, R. norvegicus
agacacacacacagac

SEQ ID NO: 473864 - DNA, 16 bp, R. norvegicus
agacacacacagcctt

SEQ ID NO: 473865 - DNA, 16 bp, R. norvegicus
agacacacacataaac

SEQ ID NO: 473866 - DNA, 16 bp, R. norvegicus
agacacacagacacac

SEQ ID NO: 473867 - DNA, 17 bp, R. norvegicus
agacacacagacacaca

SEQ ID NO: 473868 - DNA, 16 bp, R. norvegicus
agacacacagacagac

SEQ ID NO: 473869 - DNA, 16 bp, R. norvegicus
agacacaccagagaag

SEQ ID NO: 473870 - DNA, 16 bp, R. norvegicus
agacacaccatgacca

SEQ ID NO: 473871 - DNA, 16 bp, R. norvegicus
agacacacccagagca

SEQ ID NO: 473872 - DNA, 16 bp, R. norvegicus
agacacacgagaagag

SEQ ID NO: 473873 - DNA, 16 bp, R. norvegicus
agacacacggacacac

SEQ ID NO: 473874 - DNA, 16 bp, R. norvegicus
agacacacgtgcaggc

SEQ ID NO: 473875 - DNA, 16 bp, R. norvegicus
agacacactagaagaa

SEQ ID NO: 473876 - DNA, 16 bp, R. norvegicus
agacacagaaggaaca

SEQ ID NO: 473877 - DNA, 16 bp, R. norvegicus
agacacagacacaccc

SEQ ID NO: 473878 - DNA, 16 bp, R. norvegicus
agacacagacacactc

SEQ ID NO: 473879 - DNA, 16 bp, R. norvegicus
agacacagacagagac

SEQ ID NO: 473880 - DNA, 16 bp, R. norvegicus
agacacagacagagca

SEQ ID NO: 473881 - DNA, 16 bp, R. norvegicus
agacacagagaaagac

SEQ ID NO: 473882 - DNA, 16 bp, R. norvegicus
agacacagagaagctg

SEQ ID NO: 473883 - DNA, 16 bp, R. norvegicus
agacacagagaaggag

SEQ ID NO: 473884 - DNA, 16 bp, R. norvegicus
agacacagagacacag

SEQ ID NO: 473885 - DNA, 16 bp, R. norvegicus
agacacagaggaagag

SEQ ID NO: 473886 - DNA, 16 bp, R. norvegicus
agacacagagggagag

SEQ ID NO: 473887 - DNA, 16 bp, R. norvegicus
agacacagagtcagag

SEQ ID NO: 473888 - DNA, 16 bp, R. norvegicus
agacacagatgcttct

SEQ ID NO: 473889 - DNA, 16 bp, R. norvegicus
agacacagcagaaggg

SEQ ID NO: 473890 - DNA, 16 bp, R. norvegicus
agacacagccagagca

SEQ ID NO: 473891 - DNA, 16 bp, R. norvegicus
agacacagcccctgct

SEQ ID NO: 473892 - DNA, 16 bp, R. norvegicus
agacacagggcccaga

SEQ ID NO: 473893 - DNA, 16 bp, R. norvegicus
agacacaggggacctg

SEQ ID NO: 473894 - DNA, 16 bp, R. norvegicus
agacacatcagaagaa

SEQ ID NO: 473895 - DNA, 16 bp, R. norvegicus
agacacatccaaagca

SEQ ID NO: 473896 - DNA, 16 bp, R. norvegicus
agacaccagcagaagc

SEQ ID NO: 473897 - DNA, 16 bp, R. norvegicus
agacaccagtaccatg

SEQ ID NO: 473898 - DNA, 16 bp, R. norvegicus
agacaccattaccaag

SEQ ID NO: 473899 - DNA, 16 bp, R. norvegicus
agacacccagaggccc

SEQ ID NO: 473900 - DNA, 16 bp, R. norvegicus
agacacctccatggtt

SEQ ID NO: 473901 - DNA, 16 bp, R. norvegicus
agacacctggcctggc

SEQ ID NO: 473902 - DNA, 16 bp, R. norvegicus
agacacgcccacaggc

SEQ ID NO: 473903 - DNA, 16 bp, R. norvegicus
agacactacccaaaga

SEQ ID NO: 473904 - DNA, 16 bp, R. norvegicus
agacactcacagccaa

SEQ ID NO: 473905 - DNA, 16 bp, R. norvegicus
agacactgaaaaagaa

SEQ ID NO: 473906 - DNA, 16 bp, R. norvegicus
agacactgaaaaagga

SEQ ID NO: 473907 - DNA, 16 bp, R. norvegicus
agacactgagaaagca

SEQ ID NO: 473908 - DNA, 16 bp, R. norvegicus
agacactgcctcaaaa

SEQ ID NO: 473909 - DNA, 16 bp, R. norvegicus
agacactggactacca

SEQ ID NO: 473910 - DNA, 16 bp, R. norvegicus
agacactgtacagttt

SEQ ID NO: 473911 - DNA, 16 bp, R. norvegicus
agacactgtatcaaaa

SEQ ID NO: 473912 - DNA, 16 bp, R. norvegicus
agacactgtctcaaaa

SEQ ID NO: 473913 - DNA, 16 bp, R. norvegicus
agacacttgctgatgc

SEQ ID NO: 473914 - DNA, 16 bp, R. norvegicus
agacagaaaaagaagt

SEQ ID NO: 473915 - DNA, 16 bp, R. norvegicus
agacagaaacacagag

SEQ ID NO: 473916 - DNA, 16 bp, R. norvegicus
agacagaaacagtgta

SEQ ID NO: 473917 - DNA, 16 bp, R. norvegicus
agacagaaactggaaa

SEQ ID NO: 473918 - DNA, 16 bp, R. norvegicus
agacagaaagatagac

SEQ ID NO: 473919 - DNA, 16 bp, R. norvegicus
agacagaaagatctcc

SEQ ID NO: 473920 - DNA, 16 bp, R. norvegicus
agacagaaaggggtgg

SEQ ID NO: 473921 - DNA, 16 bp, R. norvegicus
agacagaaatgaagaa

SEQ ID NO: 473922 - DNA, 16 bp, R. norvegicus
agacagaacaatttcc

SEQ ID NO: 473923 - DNA, 16 bp, R. norvegicus
agacagaactacagat

SEQ ID NO: 473924 - DNA, 16 bp, R. norvegicus
agacagaagaactggt

SEQ ID NO: 473925 - DNA, 16 bp, R. norvegicus
agacagaagataaaat

SEQ ID NO: 473926 - DNA, 16 bp, R. norvegicus
agacagaagcaagagg

SEQ ID NO: 473927 - DNA, 16 bp, R. norvegicus
agacagaagcaggaga

SEQ ID NO: 473928 - DNA, 16 bp, R. norvegicus
agacagaaggaaataa

SEQ ID NO: 473929 - DNA, 16 bp, R. norvegicus
agacagaagttggaaa

SEQ ID NO: 473930 - DNA, 16 bp, R. norvegicus
agacagacaaacagac

SEQ ID NO: 473931 - DNA, 16 bp, R. norvegicus
agacagacaacaggcc

SEQ ID NO: 473932 - DNA, 16 bp, R. norvegicus
agacagacacagacag

SEQ ID NO: 473933 - DNA, 16 bp, R. norvegicus
agacagacacagactg

SEQ ID NO: 473934 - DNA, 16 bp, R. norvegicus
agacagacacagagag

SEQ ID NO: 473935 - DNA, 16 bp, R. norvegicus
agacagacagacagaa

SEQ ID NO: 473936 - DNA, 17 bp, R. norvegicus
agacagacagacagaca

SEQ ID NO: 473937 - DNA, 17 bp, R. norvegicus
agacagacagagacaga

SEQ ID NO: 473938 - DNA, 16 bp, R. norvegicus
agacagacagagagac

SEQ ID NO: 473939 - DNA, 16 bp, R. norvegicus
agacagacagagagct

SEQ ID NO: 473940 - DNA, 16 bp, R. norvegicus
agacagacagaggaca

SEQ ID NO: 473941 - DNA, 16 bp, R. norvegicus
agacagacagatctct

SEQ ID NO: 473942 - DNA, 16 bp, R. norvegicus
agacagacaggagaag

SEQ ID NO: 473943 - DNA, 16 bp, R. norvegicus
agacagacagggacag

SEQ ID NO: 473944 - DNA, 16 bp, R. norvegicus
agacagacagggaggg

SEQ ID NO: 473945 - DNA, 16 bp, R. norvegicus
agacagacatatatat

SEQ ID NO: 473946 - DNA, 16 bp, R. norvegicus
agacagacatggccca

SEQ ID NO: 473947 - DNA, 16 bp, R. norvegicus
agacagacggatagac

SEQ ID NO: 473948 - DNA, 16 bp, R. norvegicus
agacagagaaaccaag

SEQ ID NO: 473949 - DNA, 16 bp, R. norvegicus
agacagagaacttcag

SEQ ID NO: 473950 - DNA, 16 bp, R. norvegicus
agacagagaagaaaat

SEQ ID NO: 473951 - DNA, 16 bp, R. norvegicus
agacagagacaaacag

SEQ ID NO: 473952 - DNA, 16 bp, R. norvegicus
agacagagacaacaga

SEQ ID NO: 473953 - DNA, 17 bp, R. norvegicus
agacagagacagacaga

SEQ ID NO: 473954 - DNA, 16 bp, R. norvegicus
agacagagacagagag

SEQ ID NO: 473955 - DNA, 16 bp, R. norvegicus
agacagagacaggagg

SEQ ID NO: 473956 - DNA, 16 bp, R. norvegicus
agacagagacctggaa

SEQ ID NO: 473957 - DNA, 16 bp, R. norvegicus
agacagagagaaatga

SEQ ID NO: 473958 - DNA, 16 bp, R. norvegicus
agacagagagaacaca

SEQ ID NO: 473959 - DNA, 16 bp, R. norvegicus
agacagagagacaagg

SEQ ID NO: 473960 - DNA, 18 bp, R. norvegicus
agacagagagacagagag

SEQ ID NO: 473961 - DNA, 16 bp, R. norvegicus
agacagagagacagat

SEQ ID NO: 473962 - DNA, 16 bp, R. norvegicus
agacagagagacggag

SEQ ID NO: 473963 - DNA, 16 bp, R. norvegicus
agacagagagagacac

SEQ ID NO: 473964 - DNA, 16 bp, R. norvegicus
agacagagagagagat

SEQ ID NO: 473965 - DNA, 16 bp, R. norvegicus
agacagagagagcaga

SEQ ID NO: 473966 - DNA, 16 bp, R. norvegicus
agacagagagatggag

SEQ ID NO: 473967 - DNA, 16 bp, R. norvegicus
agacagagataggaag

SEQ ID NO: 473968 - DNA, 16 bp, R. norvegicus
agacagagcaaccaca

SEQ ID NO: 473969 - DNA, 16 bp, R. norvegicus
agacagaggaagacag

SEQ ID NO: 473970 - DNA, 16 bp, R. norvegicus
agacagaggcaagagg

SEQ ID NO: 473971 - DNA, 16 bp, R. norvegicus
agacagaggcagaagg

SEQ ID NO: 473972 - DNA, 16 bp, R. norvegicus
agacagaggcagcagg

SEQ ID NO: 473973 - DNA, 16 bp, R. norvegicus
agacagaggcaggaag

SEQ ID NO: 473974 - DNA, 16 bp, R. norvegicus
agacagaggctggaag

SEQ ID NO: 473975 - DNA, 16 bp, R. norvegicus
agacagagggaggtgg

SEQ ID NO: 473976 - DNA, 16 bp, R. norvegicus
agacagaggtgggagg

SEQ ID NO: 473977 - DNA, 16 bp, R. norvegicus
agacagagtcagagaa

SEQ ID NO: 473978 - DNA, 16 bp, R. norvegicus
agacagagtctcacta

SEQ ID NO: 473979 - DNA, 16 bp, R. norvegicus
agacagataatcaaaa

SEQ ID NO: 473980 - DNA, 16 bp, R. norvegicus
agacagatacatagat

SEQ ID NO: 473981 - DNA, 16 bp, R. norvegicus
agacagatacctggta

SEQ ID NO: 473982 - DNA, 16 bp, R. norvegicus
agacagatctccattt

SEQ ID NO: 473983 - DNA, 16 bp, R. norvegicus
agacagatgcacatac

SEQ ID NO: 473984 - DNA, 16 bp, R. norvegicus
agacagatggagagag

SEQ ID NO: 473985 - DNA, 16 bp, R. norvegicus
agacagatgggagaga

SEQ ID NO: 473986 - DNA, 16 bp, R. norvegicus
agacagcaacagtgaa

SEQ ID NO: 473987 - DNA, 16 bp, R. norvegicus
agacagcaagacagag

SEQ ID NO: 473988 - DNA, 16 bp, R. norvegicus
agacagcaccacctgc

SEQ ID NO: 473989 - DNA, 16 bp, R. norvegicus
agacagcagaaaataa

SEQ ID NO: 473990 - DNA, 16 bp, R. norvegicus
agacagcagatgctgg

SEQ ID NO: 473991 - DNA, 16 bp, R. norvegicus
agacagcaggcagcag

SEQ ID NO: 473992 - DNA, 16 bp, R. norvegicus
agacagccatgctaga

SEQ ID NO: 473993 - DNA, 16 bp, R. norvegicus
agacagcccctgctct

SEQ ID NO: 473994 - DNA, 16 bp, R. norvegicus
agacagctacagtgca

SEQ ID NO: 473995 - DNA, 16 bp, R. norvegicus
agacagctacctcact

SEQ ID NO: 473996 - DNA, 16 bp, R. norvegicus
agacagctatgagctg

SEQ ID NO: 473997 - DNA, 16 bp, R. norvegicus
agacagctattgttgg

SEQ ID NO: 473998 - DNA, 16 bp, R. norvegicus
agacagctcagtgggt

SEQ ID NO: 473999 - DNA, 16 bp, R. norvegicus
agacagctgcatcttc

SEQ ID NO: 474000 - DNA, 16 bp, R. norvegicus
agacagctgtgagctg

SEQ ID NO: 474001 - DNA, 16 bp, R. norvegicus
agacagcttcctgaac

SEQ ID NO: 474002 - DNA, 16 bp, R. norvegicus
agacagctttttattt

SEQ ID NO: 474003 - DNA, 16 bp, R. norvegicus
agacaggaaaaactac

SEQ ID NO: 474004 - DNA, 16 bp, R. norvegicus
agacaggaaccccagt

SEQ ID NO: 474005 - DNA, 16 bp, R. norvegicus
agacaggaactggatg

SEQ ID NO: 474006 - DNA, 16 bp, R. norvegicus
agacaggaagaactat

SEQ ID NO: 474007 - DNA, 16 bp, R. norvegicus
agacaggaagaccaga

SEQ ID NO: 474008 - DNA, 16 bp, R. norvegicus
agacaggaagccagag

SEQ ID NO: 474009 - DNA, 16 bp, R. norvegicus
agacaggaatgactac

SEQ ID NO: 474010 - DNA, 16 bp, R. norvegicus
agacaggacccccagt

SEQ ID NO: 474011 - DNA, 16 bp, R. norvegicus
agacaggagaattgcc

SEQ ID NO: 474012 - DNA, 16 bp, R. norvegicus
agacaggagagacagg

SEQ ID NO: 474013 - DNA, 16 bp, R. norvegicus
agacaggagagaggcc

SEQ ID NO: 474014 - DNA, 16 bp, R. norvegicus
agacaggagccagatg

SEQ ID NO: 474015 - DNA, 16 bp, R. norvegicus
agacaggagcctatca

SEQ ID NO: 474016 - DNA, 16 bp, R. norvegicus
agacaggaggaggatg

SEQ ID NO: 474017 - DNA, 16 bp, R. norvegicus
agacaggaggatcaca

SEQ ID NO: 474018 - DNA, 16 bp, R. norvegicus
agacaggatctcacat

SEQ ID NO: 474019 - DNA, 16 bp, R. norvegicus
agacaggatttctctg

SEQ ID NO: 474020 - DNA, 16 bp, R. norvegicus
agacaggcacagagag

SEQ ID NO: 474021 - DNA, 16 bp, R. norvegicus
agacaggcagacagac

SEQ ID NO: 474022 - DNA, 16 bp, R. norvegicus
agacaggcagacagag

SEQ ID NO: 474023 - DNA, 16 bp, R. norvegicus
agacaggcaggcaaaa

SEQ ID NO: 474024 - DNA, 16 bp, R. norvegicus
agacagggacagaaac

SEQ ID NO: 474025 - DNA, 16 bp, R. norvegicus
agacagggacagaaag

SEQ ID NO: 474026 - DNA, 16 bp, R. norvegicus
agacagggctggagag

SEQ ID NO: 474027 - DNA, 16 bp, R. norvegicus
agacagggtctcctgt

SEQ ID NO: 474028 - DNA, 16 bp, R. norvegicus
agacagggtctctctg

SEQ ID NO: 474029 - DNA, 16 bp, R. norvegicus
agacagggtttcacat

SEQ ID NO: 474030 - DNA, 16 bp, R. norvegicus
agacagggtttctctg

SEQ ID NO: 474031 - DNA, 16 bp, R. norvegicus
agacagggtttgtctg

SEQ ID NO: 474032 - DNA, 16 bp, R. norvegicus
agacaggtagacagac

SEQ ID NO: 474033 - DNA, 17 bp, R. norvegicus
agacagtagagatcctg

SEQ ID NO: 474034 - DNA, 16 bp, R. norvegicus
agacagtctcacagca

SEQ ID NO: 474035 - DNA, 16 bp, R. norvegicus
agacagtctccagaag

SEQ ID NO: 474036 - DNA, 16 bp, R. norvegicus
agacagtctccaggaa

SEQ ID NO: 474037 - DNA, 16 bp, R. norvegicus
agacagtgacagtgta

SEQ ID NO: 474038 - DNA, 16 bp, R. norvegicus
agacagtggatgatgc

SEQ ID NO: 474039 - DNA, 16 bp, R. norvegicus
agacagtgtctcactg

SEQ ID NO: 474040 - DNA, 16 bp, R. norvegicus
agacagtgtttctttg

SEQ ID NO: 474041 - DNA, 16 bp, R. norvegicus
agacagttcagcaggt

SEQ ID NO: 474042 - DNA, 16 bp, R. norvegicus
agacagtttgatcaat

SEQ ID NO: 474043 - DNA, 16 bp, R. norvegicus
agacataacagaaact

SEQ ID NO: 474044 - DNA, 16 bp, R. norvegicus
agacatacagacagac

SEQ ID NO: 474045 - DNA, 16 bp, R. norvegicus
agacatacatgcagcc

SEQ ID NO: 474046 - DNA, 16 bp, R. norvegicus
agacatacatggagac

SEQ ID NO: 474047 - DNA, 16 bp, R. norvegicus
agacataccacacaca

SEQ ID NO: 474048 - DNA, 16 bp, R. norvegicus
agacataccagaagaa

SEQ ID NO: 474049 - DNA, 16 bp, R. norvegicus
agacatagagacagag

SEQ ID NO: 474050 - DNA, 16 bp, R. norvegicus
agacatcaacatggct

SEQ ID NO: 474051 - DNA, 16 bp, R. norvegicus
agacatcactttcaaa

SEQ ID NO: 474052 - DNA, 16 bp, R. norvegicus
agacatctccaaggtc

SEQ ID NO: 474053 - DNA, 16 bp, R. norvegicus
agacatgcatacacat

SEQ ID NO: 474054 - DNA, 16 bp, R. norvegicus
agacatggaaagagca

SEQ ID NO: 474055 - DNA, 16 bp, R. norvegicus
agacatggaaatgcag

SEQ ID NO: 474056 - DNA, 16 bp, R. norvegicus
agacatggaaggtaat

SEQ ID NO: 474057 - DNA, 16 bp, R. norvegicus
agacatggagatacag

SEQ ID NO: 474058 - DNA, 16 bp, R. norvegicus
agacatggagatgcag

SEQ ID NO: 474059 - DNA, 16 bp, R. norvegicus
agacatggagctggag

SEQ ID NO: 474060 - DNA, 16 bp, R. norvegicus
agacatggcactgttt

SEQ ID NO: 474061 - DNA, 16 bp, R. norvegicus
agacatggccaagtcc

SEQ ID NO: 474062 - DNA, 16 bp, R. norvegicus
agacatggccacaggc

SEQ ID NO: 474063 - DNA, 16 bp, R. norvegicus
agacatggctcagtgg

SEQ ID NO: 474064 - DNA, 16 bp, R. norvegicus
agacatgggagagaaa

SEQ ID NO: 474065 - DNA, 16 bp, R. norvegicus
agacatggtgctaaag

SEQ ID NO: 474066 - DNA, 16 bp, R. norvegicus
agacatggtgctgcag

SEQ ID NO: 474067 - DNA, 16 bp, R. norvegicus
agacatggtgcttgag

SEQ ID NO: 474068 - DNA, 16 bp, R. norvegicus
agacatggtttttctg

SEQ ID NO: 474069 - DNA, 16 bp, R. norvegicus
agacattttcaacaaa

SEQ ID NO: 474070 - DNA, 16 bp, R. norvegicus
agacattttctcattt

SEQ ID NO: 474071 - DNA, 16 bp, R. norvegicus
agacatttttaaatat

SEQ ID NO: 474072 - DNA, 16 bp, R. norvegicus
agacatttttatttat

SEQ ID NO: 474073 - DNA, 16 bp, R. norvegicus
agaccaaactgcacat

SEQ ID NO: 474074 - DNA, 17 bp, R. norvegicus
agaccaaagcccagtct

SEQ ID NO: 474075 - DNA, 16 bp, R. norvegicus
agaccaaaggaagctc

SEQ ID NO: 474076 - DNA, 16 bp, R. norvegicus
agaccaagaagcattg

SEQ ID NO: 474077 - DNA, 31 bp, R. norvegicus
agaccaagacaaagcatcctataaccaattt

SEQ ID NO: 474078 - DNA, 16 bp, R. norvegicus
agaccaagagaccaag

SEQ ID NO: 474079 - DNA, 16 bp, R. norvegicus
agaccaagagttcaag

SEQ ID NO: 474080 - DNA, 16 bp, R. norvegicus
agaccaagatgcacat

SEQ ID NO: 474081 - DNA, 19 bp, R. norvegicus
agaccaagcaaaagttctg

SEQ ID NO: 474082 - DNA, 16 bp, R. norvegicus
agaccaagctagcctt

SEQ ID NO: 474083 - DNA, 16 bp, R. norvegicus
agaccaagctggcttc

SEQ ID NO: 474084 - DNA, 16 bp, R. norvegicus
agaccaagctgtcctc

SEQ ID NO: 474085 - DNA, 27 bp, R. norvegicus
agaccaagggcttccccttccactggt

SEQ ID NO: 474086 - DNA, 16 bp, R. norvegicus
agaccaatttatctta

SEQ ID NO: 474087 - DNA, 16 bp, R. norvegicus
agaccacaccattgtg

SEQ ID NO: 474088 - DNA, 16 bp, R. norvegicus
agaccacacctctgag

SEQ ID NO: 474089 - DNA, 16 bp, R. norvegicus
agaccacaggaagctg

SEQ ID NO: 474090 - DNA, 16 bp, R. norvegicus
agaccacagtgaccat

SEQ ID NO: 474091 - DNA, 16 bp, R. norvegicus
agaccacataccaata

SEQ ID NO: 474092 - DNA, 16 bp, R. norvegicus
agaccacatgaaattc

SEQ ID NO: 474093 - DNA, 16 bp, R. norvegicus
agaccaccaaccctgc

SEQ ID NO: 474094 - DNA, 16 bp, R. norvegicus
agaccaccatggacta

SEQ ID NO: 474095 - DNA, 16 bp, R. norvegicus
agaccaccccacctag

SEQ ID NO: 474096 - DNA, 16 bp, R. norvegicus
agaccacctgaagctc

SEQ ID NO: 474097 - DNA, 16 bp, R. norvegicus
agaccacctgctgcag

SEQ ID NO: 474098 - DNA, 16 bp, R. norvegicus
agaccagacagtcctc

SEQ ID NO: 474099 - DNA, 16 bp, R. norvegicus
agaccagactgacctc

SEQ ID NO: 474100 - DNA, 16 bp, R. norvegicus
agaccagagtttggat

SEQ ID NO: 474101 - DNA, 16 bp, R. norvegicus
agaccagcaaacacta

SEQ ID NO: 474102 - DNA, 16 bp, R. norvegicus
agaccagcaaatcaaa

SEQ ID NO: 474103 - DNA, 16 bp, R. norvegicus
agaccagcatggtcta

SEQ ID NO: 474104 - DNA, 16 bp, R. norvegicus
agaccagcctcatcta

SEQ ID NO: 474105 - DNA, 16 bp, R. norvegicus
agaccagcctggcctc

SEQ ID NO: 474106 - DNA, 16 bp, R. norvegicus
agaccagctctctgca

SEQ ID NO: 474107 - DNA, 16 bp, R. norvegicus
agaccagctctctttg

SEQ ID NO: 474108 - DNA, 16 bp, R. norvegicus
agaccagctgaaacat

SEQ ID NO: 474109 - DNA, 16 bp, R. norvegicus
agaccaggaaagggga

SEQ ID NO: 474110 - DNA, 16 bp, R. norvegicus
agaccaggctgacttc

SEQ ID NO: 474111 - DNA, 17 bp, R. norvegicus
agaccagtcatagacag

SEQ ID NO: 474112 - DNA, 16 bp, R. norvegicus
agaccagtgtcagcaa

SEQ ID NO: 474113 - DNA, 16 bp, R. norvegicus
agaccagttttaggac

SEQ ID NO: 474114 - DNA, 16 bp, R. norvegicus
agaccatcagcccagg

SEQ ID NO: 474115 - DNA, 16 bp, R. norvegicus
agaccatgaaagccag

SEQ ID NO: 474116 - DNA, 17 bp, R. norvegicus
agaccattgttcaactt

SEQ ID NO: 474117 - DNA, 16 bp, R. norvegicus
agacccaaaaggacac

SEQ ID NO: 474118 - DNA, 16 bp, R. norvegicus
agacccaaaaggacat

SEQ ID NO: 474119 - DNA, 16 bp, R. norvegicus
agacccaacagagaaa

SEQ ID NO: 474120 - DNA, 16 bp, R. norvegicus
agacccaagtgacact

SEQ ID NO: 474121 - DNA, 16 bp, R. norvegicus
agacccacaagcattg

SEQ ID NO: 474122 - DNA, 16 bp, R. norvegicus
agacccaccattggag

SEQ ID NO: 474123 - DNA, 16 bp, R. norvegicus
agacccacctgtctct

SEQ ID NO: 474124 - DNA, 16 bp, R. norvegicus
agacccacggctccag

SEQ ID NO: 474125 - DNA, 16 bp, R. norvegicus
agacccacttgcttct

SEQ ID NO: 474126 - DNA, 16 bp, R. norvegicus
agacccagaaataaaa

SEQ ID NO: 474127 - DNA, 16 bp, R. norvegicus
agacccagacccagac

SEQ ID NO: 474128 - DNA, 16 bp, R. norvegicus
agacccagacccaggg

SEQ ID NO: 474129 - DNA, 16 bp, R. norvegicus
agacccagagagagag

SEQ ID NO: 474130 - DNA, 16 bp, R. norvegicus
agacccagcagtcctc

SEQ ID NO: 474131 - DNA, 16 bp, R. norvegicus
agacccagcctcaaaa

SEQ ID NO: 474132 - DNA, 16 bp, R. norvegicus
agacccagctctacca

SEQ ID NO: 474133 - DNA, 16 bp, R. norvegicus
agacccaggtatacca

SEQ ID NO: 474134 - DNA, 16 bp, R. norvegicus
agacccagtctcaaaa

SEQ ID NO: 474135 - DNA, 16 bp, R. norvegicus
agaccccagagctccc

SEQ ID NO: 474136 - DNA, 16 bp, R. norvegicus
agaccccagaggaaaa

SEQ ID NO: 474137 - DNA, 16 bp, R. norvegicus
agaccccaggaagctc

SEQ ID NO: 474138 - DNA, 16 bp, R. norvegicus
agaccccatatgagca

SEQ ID NO: 474139 - DNA, 16 bp, R. norvegicus
agaccccattgctgaa

SEQ ID NO: 474140 - DNA, 16 bp, R. norvegicus
agacccctgctgctgc

SEQ ID NO: 474141 - DNA, 16 bp, R. norvegicus
agacccctggaactgg

SEQ ID NO: 474142 - DNA, 16 bp, R. norvegicus
agacccggaaatgaac

SEQ ID NO: 474143 - DNA, 19 bp, R. norvegicus
agaccctaagagaacacat

SEQ ID NO: 474144 - DNA, 16 bp, R. norvegicus
agaccctacaaagaaa

SEQ ID NO: 474145 - DNA, 16 bp, R. norvegicus
agaccctcctcctggc

SEQ ID NO: 474146 - DNA, 16 bp, R. norvegicus
agaccctctagaaagt

SEQ ID NO: 474147 - DNA, 16 bp, R. norvegicus
agaccctgcctcagtg

SEQ ID NO: 474148 - DNA, 16 bp, R. norvegicus
agaccctggaactgga

SEQ ID NO: 474149 - DNA, 16 bp, R. norvegicus
agaccctggacagcaa

SEQ ID NO: 474150 - DNA, 16 bp, R. norvegicus
agaccctgtcacaaag

SEQ ID NO: 474151 - DNA, 16 bp, R. norvegicus
agaccctgtccaaaaa

SEQ ID NO: 474152 - DNA, 16 bp, R. norvegicus
agaccctgtccccaaa

SEQ ID NO: 474153 - DNA, 16 bp, R. norvegicus
agaccctgtctcaaaa

SEQ ID NO: 474154 - DNA, 16 bp, R. norvegicus
agaccctgtctcagaa

SEQ ID NO: 474155 - DNA, 16 bp, R. norvegicus
agaccctgtctctaaa

SEQ ID NO: 474156 - DNA, 16 bp, R. norvegicus
agaccctgttgcaaaa

SEQ ID NO: 474157 - DNA, 16 bp, R. norvegicus
agaccctgtttcaaaa

SEQ ID NO: 474158 - DNA, 16 bp, R. norvegicus
agacccttcaagctct

SEQ ID NO: 474159 - DNA, 17 bp, R. norvegicus
agacccttctgggtctc

SEQ ID NO: 474160 - DNA, 16 bp, R. norvegicus
agaccgagagagagag

SEQ ID NO: 474161 - DNA, 25 bp, R. norvegicus
agacctatcagaatcacaccagaca

SEQ ID NO: 474162 - DNA, 68 bp, R. norvegicus
agacctatcagaatcacaccagacttctcgccagaaactatgaaggccagaagatcctggactgatgt

SEQ ID NO: 474163 - DNA, 28 bp, R. norvegicus
agacctatcagaatcacaccagactttt

SEQ ID NO: 474164 - DNA, 16 bp, R. norvegicus
agacctcaaagccagc

SEQ ID NO: 474165 - DNA, 16 bp, R. norvegicus
agacctcaaagccctg

SEQ ID NO: 474166 - DNA, 16 bp, R. norvegicus
agacctcagaagatga

SEQ ID NO: 474167 - DNA, 18 bp, R. norvegicus
agacctcagaatatggaa

SEQ ID NO: 474168 - DNA, 16 bp, R. norvegicus
agacctcagatgatgg

SEQ ID NO: 474169 - DNA, 16 bp, R. norvegicus
agacctcagcagatgg

SEQ ID NO: 474170 - DNA, 16 bp, R. norvegicus
agacctcatgaagctc

SEQ ID NO: 474171 - DNA, 16 bp, R. norvegicus
agacctccagagctcc

SEQ ID NO: 474172 - DNA, 16 bp, R. norvegicus
agacctcccccttccc

SEQ ID NO: 474173 - DNA, 16 bp, R. norvegicus
agacctgaagttcttg

SEQ ID NO: 474174 - DNA, 16 bp, R. norvegicus
agacctgagggtccct

SEQ ID NO: 474175 - DNA, 16 bp, R. norvegicus
agacctgcccactgtg

SEQ ID NO: 474176 - DNA, 16 bp, R. norvegicus
agacctgcctgcctct

SEQ ID NO: 474177 - DNA, 16 bp, R. norvegicus
agacctggggctggag

SEQ ID NO: 474178 - DNA, 16 bp, R. norvegicus
agacctgtagagaaga

SEQ ID NO: 474179 - DNA, 16 bp, R. norvegicus
agacctgtggctccag

SEQ ID NO: 474180 - DNA, 16 bp, R. norvegicus
agacctgttttcctgt

SEQ ID NO: 474181 - DNA, 16 bp, R. norvegicus
agacctgttttgtgac

SEQ ID NO: 474182 - DNA, 16 bp, R. norvegicus
agaccttagatgaaat

SEQ ID NO: 474183 - DNA, 16 bp, R. norvegicus
agaccttatctcaaaa

SEQ ID NO: 474184 - DNA, 16 bp, R. norvegicus
agaccttccagagctc

SEQ ID NO: 474185 - DNA, 16 bp, R. norvegicus
agaccttcctggttgc

SEQ ID NO: 474186 - DNA, 16 bp, R. norvegicus
agaccttgaaagaaaa

SEQ ID NO: 474187 - DNA, 16 bp, R. norvegicus
agaccttgaaagaata

SEQ ID NO: 474188 - DNA, 16 bp, R. norvegicus
agaccttgaaaggaca

SEQ ID NO: 474189 - DNA, 16 bp, R. norvegicus
agaccttgagtgcaag

SEQ ID NO: 474190 - DNA, 16 bp, R. norvegicus
agaccttgcttcaaaa

SEQ ID NO: 474191 - DNA, 16 bp, R. norvegicus
agaccttggaggtgag

SEQ ID NO: 474192 - DNA, 16 bp, R. norvegicus
agaccttggtcctgtg

SEQ ID NO: 474193 - DNA, 16 bp, R. norvegicus
agaccttgtcccaaaa

SEQ ID NO: 474194 - DNA, 16 bp, R. norvegicus
agaccttgtttcagaa

SEQ ID NO: 474195 - DNA, 17 bp, R. norvegicus
agacgaatttgcaaatt

SEQ ID NO: 474196 - DNA, 16 bp, R. norvegicus
agacggatggacagac

SEQ ID NO: 474197 - DNA, 16 bp, R. norvegicus
agacggggtttctctg

SEQ ID NO: 474198 - DNA, 16 bp, R. norvegicus
agactaaaacagagac

SEQ ID NO: 474199 - DNA, 16 bp, R. norvegicus
agactaaggctggtct

SEQ ID NO: 474200 - DNA, 16 bp, R. norvegicus
agactactctctgccc

SEQ ID NO: 474201 - DNA, 16 bp, R. norvegicus
agactactttctgctg

SEQ ID NO: 474202 - DNA, 16 bp, R. norvegicus
agactatacagagaaa

SEQ ID NO: 474203 - DNA, 16 bp, R. norvegicus
agactatatggcatca

SEQ ID NO: 474204 - DNA, 16 bp, R. norvegicus
agactatctcaaaaca

SEQ ID NO: 474205 - DNA, 16 bp, R. norvegicus
agactatgagagccag

SEQ ID NO: 474206 - DNA, 16 bp, R. norvegicus
agactcagaaatacaa

SEQ ID NO: 474207 - DNA, 16 bp, R. norvegicus
agactcagttgaggaa

SEQ ID NO: 474208 - DNA, 18 bp, R. norvegicus
agactccactggagtggg

SEQ ID NO: 474209 - DNA, 16 bp, R. norvegicus
agactccagagaaaca

SEQ ID NO: 474210 - DNA, 16 bp, R. norvegicus
agactccagagaacaa

SEQ ID NO: 474211 - DNA, 16 bp, R. norvegicus
agactccagagaccag

SEQ ID NO: 474212 - DNA, 16 bp, R. norvegicus
agactccatagaaatc

SEQ ID NO: 474213 - DNA, 16 bp, R. norvegicus
agactcccttgaggaa

SEQ ID NO: 474214 - DNA, 16 bp, R. norvegicus
agactcctggctgcag

SEQ ID NO: 474215 - DNA, 16 bp, R. norvegicus
agactctacctcaaaa

SEQ ID NO: 474216 - DNA, 16 bp, R. norvegicus
agactctcagaagaca

SEQ ID NO: 474217 - DNA, 16 bp, R. norvegicus
agactctgaagaaagg

SEQ ID NO: 474218 - DNA, 16 bp, R. norvegicus
agactctgaagaagga

SEQ ID NO: 474219 - DNA, 16 bp, R. norvegicus
agactctgaggaaaga

SEQ ID NO: 474220 - DNA, 16 bp, R. norvegicus
agactctgaggaaatt

SEQ ID NO: 474221 - DNA, 16 bp, R. norvegicus
agactctgccagagcc

SEQ ID NO: 474222 - DNA, 16 bp, R. norvegicus
agactctgcctcagaa

SEQ ID NO: 474223 - DNA, 16 bp, R. norvegicus
agactctgctccacac

SEQ ID NO: 474224 - DNA, 16 bp, R. norvegicus
agactctggatcacca

SEQ ID NO: 474225 - DNA, 16 bp, R. norvegicus
agactctggtacacct

SEQ ID NO: 474226 - DNA, 16 bp, R. norvegicus
agactctgtctcaaat

SEQ ID NO: 474227 - DNA, 16 bp, R. norvegicus
agactctgtctttaaa

SEQ ID NO: 474228 - DNA, 16 bp, R. norvegicus
agactctgttttaaaa

SEQ ID NO: 474229 - DNA, 16 bp, R. norvegicus
agactcttcagacaag

SEQ ID NO: 474230 - DNA, 16 bp, R. norvegicus
agactcttgtcttggt

SEQ ID NO: 474231 - DNA, 16 bp, R. norvegicus
agactgaaaaagaaat

SEQ ID NO: 474232 - DNA, 16 bp, R. norvegicus
agactgaaccaccagt

SEQ ID NO: 474233 - DNA, 16 bp, R. norvegicus
agactgaaccagcaac

SEQ ID NO: 474234 - DNA, 16 bp, R. norvegicus
agactgaagactccca

SEQ ID NO: 474235 - DNA, 16 bp, R. norvegicus
agactgaagggaaggt

SEQ ID NO: 474236 - DNA, 16 bp, R. norvegicus
agactgactttgaatt

SEQ ID NO: 474237 - DNA, 16 bp, R. norvegicus
agactgagaaagccat

SEQ ID NO: 474238 - DNA, 16 bp, R. norvegicus
agactgagacagaaag

SEQ ID NO: 474239 - DNA, 16 bp, R. norvegicus
agactgagagagagag

SEQ ID NO: 474240 - DNA, 16 bp, R. norvegicus
agactgagctgcatgt

SEQ ID NO: 474241 - DNA, 16 bp, R. norvegicus
agactgaggaagaaaa

SEQ ID NO: 474242 - DNA, 16 bp, R. norvegicus
agactgaggcagaaga

SEQ ID NO: 474243 - DNA, 16 bp, R. norvegicus
agactgaggcaggaag

SEQ ID NO: 474244 - DNA, 16 bp, R. norvegicus
agactgcaccttcacc

SEQ ID NO: 474245 - DNA, 16 bp, R. norvegicus
agactgcagagcggga

SEQ ID NO: 474246 - DNA, 16 bp, R. norvegicus
agactgcagggagaga

SEQ ID NO: 474247 - DNA, 16 bp, R. norvegicus
agactgcctctgaact

SEQ ID NO: 474248 - DNA, 16 bp, R. norvegicus
agactgctgatcttcc

SEQ ID NO: 474249 - DNA, 16 bp, R. norvegicus
agactggaacaggaag

SEQ ID NO: 474250 - DNA, 17 bp, R. norvegicus
agactggaaggatcctc

SEQ ID NO: 474251 - DNA, 16 bp, R. norvegicus
agactggagagacagc

SEQ ID NO: 474252 - DNA, 16 bp, R. norvegicus
agactggagcaaggag

SEQ ID NO: 474253 - DNA, 16 bp, R. norvegicus
agactggaggcccctg

SEQ ID NO: 474254 - DNA, 16 bp, R. norvegicus
agactggagtgaggga

SEQ ID NO: 474255 - DNA, 16 bp, R. norvegicus
agactggctggccagt

SEQ ID NO: 474256 - DNA, 16 bp, R. norvegicus
agactggcttcaaatt

SEQ ID NO: 474257 - DNA, 16 bp, R. norvegicus
agactggggaactctg

SEQ ID NO: 474258 - DNA, 16 bp, R. norvegicus
agactgtcatataagc

SEQ ID NO: 474259 - DNA, 17 bp, R. norvegicus
agactgtcctcaggcag

SEQ ID NO: 474260 - DNA, 16 bp, R. norvegicus
agactgtccttgctgt

SEQ ID NO: 474261 - DNA, 16 bp, R. norvegicus
agactgtctttcagct

SEQ ID NO: 474262 - DNA, 16 bp, R. norvegicus
agactgtggggccttt

SEQ ID NO: 474263 - DNA, 16 bp, R. norvegicus
agacttaaggcagtca

SEQ ID NO: 474264 - DNA, 16 bp, R. norvegicus
agacttatggctccag

SEQ ID NO: 474265 - DNA, 16 bp, R. norvegicus
agacttatttatttat

SEQ ID NO: 474266 - DNA, 16 bp, R. norvegicus
agacttcaaaccaaaa

SEQ ID NO: 474267 - DNA, 16 bp, R. norvegicus
agacttcatccagcag

SEQ ID NO: 474268 - DNA, 16 bp, R. norvegicus
agacttctcaccagaa

SEQ ID NO: 474269 - DNA, 16 bp, R. norvegicus
agacttctcagctgag

SEQ ID NO: 474270 - DNA, 16 bp, R. norvegicus
agacttctgcattcct

SEQ ID NO: 474271 - DNA, 16 bp, R. norvegicus
agacttctttgaattt

SEQ ID NO: 474272 - DNA, 16 bp, R. norvegicus
agacttgaagtcccag

SEQ ID NO: 474273 - DNA, 16 bp, R. norvegicus
agacttgagttggaat

SEQ ID NO: 474274 - DNA, 16 bp, R. norvegicus
agacttgctgtggtca

SEQ ID NO: 474275 - DNA, 16 bp, R. norvegicus
agacttgggggagggg

SEQ ID NO: 474276 - DNA, 16 bp, R. norvegicus
agacttgtgaaggaac

SEQ ID NO: 474277 - DNA, 16 bp, R. norvegicus
agactttaagaaggat

SEQ ID NO: 474278 - DNA, 16 bp, R. norvegicus
agactttatttattta

SEQ ID NO: 474279 - DNA, 16 bp, R. norvegicus
agactttcaaacaaaa

SEQ ID NO: 474280 - DNA, 16 bp, R. norvegicus
agactttcacagaaga

SEQ ID NO: 474281 - DNA, 16 bp, R. norvegicus
agactttgaattttaa

SEQ ID NO: 474282 - DNA, 16 bp, R. norvegicus
agactttgattttttt

SEQ ID NO: 474283 - DNA, 16 bp, R. norvegicus
agactttgtctcaaaa

SEQ ID NO: 474284 - DNA, 16 bp, R. norvegicus
agacttttcaccagag

SEQ ID NO: 474285 - DNA, 16 bp, R. norvegicus
agacttttcctcaggg

SEQ ID NO: 474286 - DNA, 16 bp, R. norvegicus
agagaaaaacatttaa

SEQ ID NO: 474287 - DNA, 16 bp, R. norvegicus
agagaaaaactggaag

SEQ ID NO: 474288 - DNA, 16 bp, R. norvegicus
agagaaaaagtgtgga

SEQ ID NO: 474289 - DNA, 16 bp, R. norvegicus
agagaaaaatatcaag

SEQ ID NO: 474290 - DNA, 16 bp, R. norvegicus
agagaaaaatgtcaag

SEQ ID NO: 474291 - DNA, 16 bp, R. norvegicus
agagaaaactggaaaa

SEQ ID NO: 474292 - DNA, 16 bp, R. norvegicus
agagaaaagactgagg

SEQ ID NO: 474293 - DNA, 16 bp, R. norvegicus
agagaaaagagcctca

SEQ ID NO: 474294 - DNA, 16 bp, R. norvegicus
agagaaaagctgaaag

SEQ ID NO: 474295 - DNA, 16 bp, R. norvegicus
agagaaaagctggaag

SEQ ID NO: 474296 - DNA, 16 bp, R. norvegicus
agagaaaatatggtac

SEQ ID NO: 474297 - DNA, 16 bp, R. norvegicus
agagaaaatctgatgg

SEQ ID NO: 474298 - DNA, 16 bp, R. norvegicus
agagaaaatgaacaga

SEQ ID NO: 474299 - DNA, 16 bp, R. norvegicus
agagaaaatttcctga

SEQ ID NO: 474300 - DNA, 16 bp, R. norvegicus
agagaaacaacaccct

SEQ ID NO: 474301 - DNA, 16 bp, R. norvegicus
agagaaacaggaagtt

SEQ ID NO: 474302 - DNA, 16 bp, R. norvegicus
agagaaacagtgtttc

SEQ ID NO: 474303 - DNA, 16 bp, R. norvegicus
agagaaaccagaaatt

SEQ ID NO: 474304 - DNA, 16 bp, R. norvegicus
agagaaaccccatctt

SEQ ID NO: 474305 - DNA, 16 bp, R. norvegicus
agagaaaccctatctt

SEQ ID NO: 474306 - DNA, 16 bp, R. norvegicus
agagaaaccctgtgtc

SEQ ID NO: 474307 - DNA, 16 bp, R. norvegicus
agagaaaccttgtctc

SEQ ID NO: 474308 - DNA, 16 bp, R. norvegicus
agagaaaccttgtttt

SEQ ID NO: 474309 - DNA, 16 bp, R. norvegicus
agagaaactaaaagca

SEQ ID NO: 474310 - DNA, 16 bp, R. norvegicus
agagaaactcacagaa

SEQ ID NO: 474311 - DNA, 16 bp, R. norvegicus
agagaaactgaaaaca

SEQ ID NO: 474312 - DNA, 16 bp, R. norvegicus
agagaaactgaaagaa

SEQ ID NO: 474313 - DNA, 16 bp, R. norvegicus
agagaaactgaagaaa

SEQ ID NO: 474314 - DNA, 16 bp, R. norvegicus
agagaaactgaagcaa

SEQ ID NO: 474315 - DNA, 16 bp, R. norvegicus
agagaaactgagagaa

SEQ ID NO: 474316 - DNA, 16 bp, R. norvegicus
agagaaactgaggaag

SEQ ID NO: 474317 - DNA, 16 bp, R. norvegicus
agagaaactgggaaat

SEQ ID NO: 474318 - DNA, 16 bp, R. norvegicus
agagaaacttaaagaa

SEQ ID NO: 474319 - DNA, 16 bp, R. norvegicus
agagaaacttcaaaga

SEQ ID NO: 474320 - DNA, 16 bp, R. norvegicus
agagaaacttgaaaca

SEQ ID NO: 474321 - DNA, 16 bp, R. norvegicus
agagaaagaaaatcat

SEQ ID NO: 474322 - DNA, 16 bp, R. norvegicus
agagaaagaactcgaa

SEQ ID NO: 474323 - DNA, 17 bp, R. norvegicus
agagaaagaagccgaga

SEQ ID NO: 474324 - DNA, 16 bp, R. norvegicus
agagaaagaatgtgtg

SEQ ID NO: 474325 - DNA, 16 bp, R. norvegicus
agagaaagacactggg

SEQ ID NO: 474326 - DNA, 16 bp, R. norvegicus
agagaaagacaggttg

SEQ ID NO: 474327 - DNA, 16 bp, R. norvegicus
agagaaagacctggaa

SEQ ID NO: 474328 - DNA, 16 bp, R. norvegicus
agagaaagactgaagg

SEQ ID NO: 474329 - DNA, 16 bp, R. norvegicus
agagaaagactgagag

SEQ ID NO: 474330 - DNA, 16 bp, R. norvegicus
agagaaagagaatgtg

SEQ ID NO: 474331 - DNA, 16 bp, R. norvegicus
agagaaagagagtcag

SEQ ID NO: 474332 - DNA, 16 bp, R. norvegicus
agagaaagagctgaga

SEQ ID NO: 474333 - DNA, 16 bp, R. norvegicus
agagaaagaggaacat

SEQ ID NO: 474334 - DNA, 16 bp, R. norvegicus
agagaaagagtgtgtg

SEQ ID NO: 474335 - DNA, 16 bp, R. norvegicus
agagaaagataaaact

SEQ ID NO: 474336 - DNA, 16 bp, R. norvegicus
agagaaagatttgaag

SEQ ID NO: 474337 - DNA, 16 bp, R. norvegicus
agagaaagcaaagcca

SEQ ID NO: 474338 - DNA, 16 bp, R. norvegicus
agagaaagcactgaag

SEQ ID NO: 474339 - DNA, 16 bp, R. norvegicus
agagaaagcagtttcc

SEQ ID NO: 474340 - DNA, 16 bp, R. norvegicus
agagaaagccagagag

SEQ ID NO: 474341 - DNA, 16 bp, R. norvegicus
agagaaaggaactgaa

SEQ ID NO: 474342 - DNA, 16 bp, R. norvegicus
agagaaaggactaaag

SEQ ID NO: 474343 - DNA, 16 bp, R. norvegicus
agagaaaggactgagg

SEQ ID NO: 474344 - DNA, 16 bp, R. norvegicus
agagaaaggctggaag

SEQ ID NO: 474345 - DNA, 16 bp, R. norvegicus
agagaaagggctgaaa

SEQ ID NO: 474346 - DNA, 16 bp, R. norvegicus
agagaaagtgggcaag

SEQ ID NO: 474347 - DNA, 16 bp, R. norvegicus
agagaaagttctagaa

SEQ ID NO: 474348 - DNA, 16 bp, R. norvegicus
agagaaagttttgaag

SEQ ID NO: 474349 - DNA, 16 bp, R. norvegicus
agagaaatcaaggaaa

SEQ ID NO: 474350 - DNA, 16 bp, R. norvegicus
agagaaatcctgtctc

SEQ ID NO: 474351 - DNA, 16 bp, R. norvegicus
agagaaatctttgact

SEQ ID NO: 474352 - DNA, 16 bp, R. norvegicus
agagaaatgaaaacca

SEQ ID NO: 474353 - DNA, 16 bp, R. norvegicus
agagaaatgaacccac

SEQ ID NO: 474354 - DNA, 16 bp, R. norvegicus
agagaaatgctgccct

SEQ ID NO: 474355 - DNA, 16 bp, R. norvegicus
agagaaatgtacagca

SEQ ID NO: 474356 - DNA, 16 bp, R. norvegicus
agagaaattaaagact

SEQ ID NO: 474357 - DNA, 16 bp, R. norvegicus
agagaaattctgtttc

SEQ ID NO: 474358 - DNA, 16 bp, R. norvegicus
agagaaattgaagcaa

SEQ ID NO: 474359 - DNA, 16 bp, R. norvegicus
agagaacaactttcag

SEQ ID NO: 474360 - DNA, 16 bp, R. norvegicus
agagaacaagtagaaa

SEQ ID NO: 474361 - DNA, 16 bp, R. norvegicus
agagaacacaaaagcc

SEQ ID NO: 474362 - DNA, 16 bp, R. norvegicus
agagaacacaggaatg

SEQ ID NO: 474363 - DNA, 16 bp, R. norvegicus
agagaacactgcccag

SEQ ID NO: 474364 - DNA, 16 bp, R. norvegicus
agagaacagctttgtg

SEQ ID NO: 474365 - DNA, 16 bp, R. norvegicus
agagaacatatccaga

SEQ ID NO: 474366 - DNA, 16 bp, R. norvegicus
agagaacatggaggcc

SEQ ID NO: 474367 - DNA, 16 bp, R. norvegicus
agagaacattctggaa

SEQ ID NO: 474368 - DNA, 16 bp, R. norvegicus
agagaaccaactccat

SEQ ID NO: 474369 - DNA, 16 bp, R. norvegicus
agagaaccagctcctg

SEQ ID NO: 474370 - DNA, 16 bp, R. norvegicus
agagaaccagttccca

SEQ ID NO: 474371 - DNA, 16 bp, R. norvegicus
agagaaccctggagat

SEQ ID NO: 474372 - DNA, 18 bp, R. norvegicus
agagaacgaactggaaga

SEQ ID NO: 474373 - DNA, 16 bp, R. norvegicus
agagaactcctacacc

SEQ ID NO: 474374 - DNA, 16 bp, R. norvegicus
agagaactgaacaccc

SEQ ID NO: 474375 - DNA, 16 bp, R. norvegicus
agagaactgattccca

SEQ ID NO: 474376 - DNA, 16 bp, R. norvegicus
agagaactgtctatcc

SEQ ID NO: 474377 - DNA, 16 bp, R. norvegicus
agagaactttctggaa

SEQ ID NO: 474378 - DNA, 16 bp, R. norvegicus
agagaagaaatgcaaa

SEQ ID NO: 474379 - DNA, 16 bp, R. norvegicus
agagaagactactctc

SEQ ID NO: 474380 - DNA, 16 bp, R. norvegicus
agagaagataagcaca

SEQ ID NO: 474381 - DNA, 16 bp, R. norvegicus
agagaagatgcagcta

SEQ ID NO: 474382 - DNA, 16 bp, R. norvegicus
agagaagatttttttt

SEQ ID NO: 474383 - DNA, 16 bp, R. norvegicus
agagaagcacagagag

SEQ ID NO: 474384 - DNA, 16 bp, R. norvegicus
agagaagcacagagga

SEQ ID NO: 474385 - DNA, 16 bp, R. norvegicus
agagaagcagagaagc

SEQ ID NO: 474386 - DNA, 16 bp, R. norvegicus
agagaagcagagacag

SEQ ID NO: 474387 - DNA, 16 bp, R. norvegicus
agagaagcagagcaga

SEQ ID NO: 474388 - DNA, 16 bp, R. norvegicus
agagaagcagattgga

SEQ ID NO: 474389 - DNA, 16 bp, R. norvegicus
agagaagcagcagcag

SEQ ID NO: 474390 - DNA, 16 bp, R. norvegicus
agagaagcaggagcag

SEQ ID NO: 474391 - DNA, 16 bp, R. norvegicus
agagaagcaggcagag

SEQ ID NO: 474392 - DNA, 16 bp, R. norvegicus
agagaagccagactga

SEQ ID NO: 474393 - DNA, 16 bp, R. norvegicus
agagaagccagagcag

SEQ ID NO: 474394 - DNA, 16 bp, R. norvegicus
agagaagccagtgctc

SEQ ID NO: 474395 - DNA, 16 bp, R. norvegicus
agagaagctcaccaag

SEQ ID NO: 474396 - DNA, 16 bp, R. norvegicus
agagaaggaatatgtt

SEQ ID NO: 474397 - DNA, 16 bp, R. norvegicus
agagaaggagaagctg

SEQ ID NO: 474398 - DNA, 16 bp, R. norvegicus
agagaaggagttctgg

SEQ ID NO: 474399 - DNA, 16 bp, R. norvegicus
agagaaggcagagatg

SEQ ID NO: 474400 - DNA, 16 bp, R. norvegicus
agagaaggcagggcag

SEQ ID NO: 474401 - DNA, 16 bp, R. norvegicus
agagaaggcctttgcc

SEQ ID NO: 474402 - DNA, 16 bp, R. norvegicus
agagaaggctggagag

SEQ ID NO: 474403 - DNA, 16 bp, R. norvegicus
agagaaggcttagaaa

SEQ ID NO: 474404 - DNA, 16 bp, R. norvegicus
agagaaggggctggag

SEQ ID NO: 474405 - DNA, 16 bp, R. norvegicus
agagaagggggatgct

SEQ ID NO: 474406 - DNA, 16 bp, R. norvegicus
agagaagtcaagagcc

SEQ ID NO: 474407 - DNA, 17 bp, R. norvegicus
agagaagttctttaagg

SEQ ID NO: 474408 - DNA, 16 bp, R. norvegicus
agagaagttgagctgg

SEQ ID NO: 474409 - DNA, 16 bp, R. norvegicus
agagaataagagattg

SEQ ID NO: 474410 - DNA, 16 bp, R. norvegicus
agagaatattttaaat

SEQ ID NO: 474411 - DNA, 16 bp, R. norvegicus
agagaatcccaggagc

SEQ ID NO: 474412 - DNA, 16 bp, R. norvegicus
agagaatctcaggagt

SEQ ID NO: 474413 - DNA, 16 bp, R. norvegicus
agagaatggactggaa

SEQ ID NO: 474414 - DNA, 16 bp, R. norvegicus
agagaatggccttgtc

SEQ ID NO: 474415 - DNA, 16 bp, R. norvegicus
agagaatggctcagca

SEQ ID NO: 474416 - DNA, 16 bp, R. norvegicus
agagaatgtatccaaa

SEQ ID NO: 474417 - DNA, 16 bp, R. norvegicus
agagaatgtgggaaag

SEQ ID NO: 474418 - DNA, 16 bp, R. norvegicus
agagaatgttccagaa

SEQ ID NO: 474419 - DNA, 16 bp, R. norvegicus
agagaatgttctggaa

SEQ ID NO: 474420 - DNA, 16 bp, R. norvegicus
agagaattctcaaatg

SEQ ID NO: 474421 - DNA, 16 bp, R. norvegicus
agagaattgaactcag

SEQ ID NO: 474422 - DNA, 16 bp, R. norvegicus
agagacaaacaaatat

SEQ ID NO: 474423 - DNA, 16 bp, R. norvegicus
agagacaaagatggag

SEQ ID NO: 474424 - DNA, 16 bp, R. norvegicus
agagacaaagccacca

SEQ ID NO: 474425 - DNA, 16 bp, R. norvegicus
agagacaaagccagaa

SEQ ID NO: 474426 - DNA, 16 bp, R. norvegicus
agagacaacagacaca

SEQ ID NO: 474427 - DNA, 16 bp, R. norvegicus
agagacaaccctgaag

SEQ ID NO: 474428 - DNA, 16 bp, R. norvegicus
agagacaaggtttctc

SEQ ID NO: 474429 - DNA, 16 bp, R. norvegicus
agagacaatgtgtgga

SEQ ID NO: 474430 - DNA, 16 bp, R. norvegicus
agagacacacagacat

SEQ ID NO: 474431 - DNA, 16 bp, R. norvegicus
agagacacacctgcct

SEQ ID NO: 474432 - DNA, 16 bp, R. norvegicus
agagacacaccttcac

SEQ ID NO: 474433 - DNA, 16 bp, R. norvegicus
agagacacagaaacag

SEQ ID NO: 474434 - DNA, 16 bp, R. norvegicus
agagacacagaacaga

SEQ ID NO: 474435 - DNA, 16 bp, R. norvegicus
agagacacagacagaa

SEQ ID NO: 474436 - DNA, 16 bp, R. norvegicus
agagacacagacagat

SEQ ID NO: 474437 - DNA, 16 bp, R. norvegicus
agagacacagagagca

SEQ ID NO: 474438 - DNA, 19 bp, R. norvegicus
agagacacagccagaatac

SEQ ID NO: 474439 - DNA, 16 bp, R. norvegicus
agagacacaggaagag

SEQ ID NO: 474440 - DNA, 16 bp, R. norvegicus
agagacaccatgcctg

SEQ ID NO: 474441 - DNA, 16 bp, R. norvegicus
agagacagaaacagca

SEQ ID NO: 474442 - DNA, 16 bp, R. norvegicus
agagacagaaatacag

SEQ ID NO: 474443 - DNA, 16 bp, R. norvegicus
agagacagaagcagag

SEQ ID NO: 474444 - DNA, 16 bp, R. norvegicus
agagacagaaggcaga

SEQ ID NO: 474445 - DNA, 16 bp, R. norvegicus
agagacagacagacgg

SEQ ID NO: 474446 - DNA, 16 bp, R. norvegicus
agagacagacagagga

SEQ ID NO: 474447 - DNA, 16 bp, R. norvegicus
agagacagagaagcag

SEQ ID NO: 474448 - DNA, 16 bp, R. norvegicus
agagacagagaaggac

SEQ ID NO: 474449 - DNA, 17 bp, R. norvegicus
agagacagagacagaga

SEQ ID NO: 474450 - DNA, 17 bp, R. norvegicus
agagacagagagacaga

SEQ ID NO: 474451 - DNA, 16 bp, R. norvegicus
agagacagagagagca

SEQ ID NO: 474452 - DNA, 16 bp, R. norvegicus
agagacagagataaag

SEQ ID NO: 474453 - DNA, 16 bp, R. norvegicus
agagacagaggcagag

SEQ ID NO: 474454 - DNA, 16 bp, R. norvegicus
agagacagcaagaaca

SEQ ID NO: 474455 - DNA, 16 bp, R. norvegicus
agagacagcaagagca

SEQ ID NO: 474456 - DNA, 16 bp, R. norvegicus
agagacagcccagcag

SEQ ID NO: 474457 - DNA, 19 bp, R. norvegicus
agagacagccgcatcttct

SEQ ID NO: 474458 - DNA, 16 bp, R. norvegicus
agagacagctcagctg

SEQ ID NO: 474459 - DNA, 16 bp, R. norvegicus
agagacaggaagatca

SEQ ID NO: 474460 - DNA, 16 bp, R. norvegicus
agagacaggaaggaca

SEQ ID NO: 474461 - DNA, 16 bp, R. norvegicus
agagacaggagacaga

SEQ ID NO: 474462 - DNA, 16 bp, R. norvegicus
agagacaggagggaca

SEQ ID NO: 474463 - DNA, 16 bp, R. norvegicus
agagacaggcaggtgg

SEQ ID NO: 474464 - DNA, 16 bp, R. norvegicus
agagacaggtgggtcc

SEQ ID NO: 474465 - DNA, 16 bp, R. norvegicus
agagacaggttgtaga

SEQ ID NO: 474466 - DNA, 16 bp, R. norvegicus
agagacatggagagag

SEQ ID NO: 474467 - DNA, 16 bp, R. norvegicus
agagacatggctcagc

SEQ ID NO: 474468 - DNA, 16 bp, R. norvegicus
agagaccaacactgag

SEQ ID NO: 474469 - DNA, 16 bp, R. norvegicus
agagaccacagagaaa

SEQ ID NO: 474470 - DNA, 17 bp, R. norvegicus
agagaccacctgtcctc

SEQ ID NO: 474471 - DNA, 16 bp, R. norvegicus
agagaccagaggaagg

SEQ ID NO: 474472 - DNA, 16 bp, R. norvegicus
agagaccagaggaggg

SEQ ID NO: 474473 - DNA, 16 bp, R. norvegicus
agagaccatcacagaa

SEQ ID NO: 474474 - DNA, 16 bp, R. norvegicus
agagaccatggagaaa

SEQ ID NO: 474475 - DNA, 16 bp, R. norvegicus
agagaccatggaggag

SEQ ID NO: 474476 - DNA, 16 bp, R. norvegicus
agagaccctaagagaa

SEQ ID NO: 474477 - DNA, 16 bp, R. norvegicus
agagaccctgtcccca

SEQ ID NO: 474478 - DNA, 16 bp, R. norvegicus
agagaccctgtctcaa

SEQ ID NO: 474479 - DNA, 16 bp, R. norvegicus
agagaccctttctcaa

SEQ ID NO: 474480 - DNA, 16 bp, R. norvegicus
agagaccgccagtact

SEQ ID NO: 474481 - DNA, 16 bp, R. norvegicus
agagacctaggggaga

SEQ ID NO: 474482 - DNA, 17 bp, R. norvegicus
agagacctcaccgcctg

SEQ ID NO: 474483 - DNA, 16 bp, R. norvegicus
agagacctcatctcaa

SEQ ID NO: 474484 - DNA, 16 bp, R. norvegicus
agagacctgaggcccc

SEQ ID NO: 474485 - DNA, 16 bp, R. norvegicus
agagacctgcctggag

SEQ ID NO: 474486 - DNA, 16 bp, R. norvegicus
agagaccttgcttcaa

SEQ ID NO: 474487 - DNA, 16 bp, R. norvegicus
agagacgctgtctcaa

SEQ ID NO: 474488 - DNA, 16 bp, R. norvegicus
agagacggacagagac

SEQ ID NO: 474489 - DNA, 16 bp, R. norvegicus
agagactaaaccacca

SEQ ID NO: 474490 - DNA, 16 bp, R. norvegicus
agagactaagaaagcc

SEQ ID NO: 474491 - DNA, 16 bp, R. norvegicus
agagactatgaaggcc

SEQ ID NO: 474492 - DNA, 16 bp, R. norvegicus
agagactcacagccag

SEQ ID NO: 474493 - DNA, 16 bp, R. norvegicus
agagactccacccagc

SEQ ID NO: 474494 - DNA, 16 bp, R. norvegicus
agagactccctgggca

SEQ ID NO: 474495 - DNA, 16 bp, R. norvegicus
agagactctgacagag

SEQ ID NO: 474496 - DNA, 16 bp, R. norvegicus
agagactgaaacagca

SEQ ID NO: 474497 - DNA, 16 bp, R. norvegicus
agagactgaaatttta

SEQ ID NO: 474498 - DNA, 16 bp, R. norvegicus
agagactgaaccacca

SEQ ID NO: 474499 - DNA, 16 bp, R. norvegicus
agagactgaagaaacg

SEQ ID NO: 474500 - DNA, 16 bp, R. norvegicus
agagactgaaggaaat

SEQ ID NO: 474501 - DNA, 16 bp, R. norvegicus
agagactgaaggaata

SEQ ID NO: 474502 - DNA, 16 bp, R. norvegicus
agagactgaaggcaag

SEQ ID NO: 474503 - DNA, 16 bp, R. norvegicus
agagactgaagggaag

SEQ ID NO: 474504 - DNA, 16 bp, R. norvegicus
agagactgacagagag

SEQ ID NO: 474505 - DNA, 16 bp, R. norvegicus
agagactgagaaacag

SEQ ID NO: 474506 - DNA, 16 bp, R. norvegicus
agagactgaggaaaag

SEQ ID NO: 474507 - DNA, 16 bp, R. norvegicus
agagactgatttccag

SEQ ID NO: 474508 - DNA, 16 bp, R. norvegicus
agagactgcagtttct

SEQ ID NO: 474509 - DNA, 16 bp, R. norvegicus
agagactgccatacat

SEQ ID NO: 474510 - DNA, 16 bp, R. norvegicus
agagactgctcctact

SEQ ID NO: 474511 - DNA, 16 bp, R. norvegicus
agagactggaagaaag

SEQ ID NO: 474512 - DNA, 16 bp, R. norvegicus
agagactggaagttct

SEQ ID NO: 474513 - DNA, 16 bp, R. norvegicus
agagactggagcagca

SEQ ID NO: 474514 - DNA, 16 bp, R. norvegicus
agagactggagggaga

SEQ ID NO: 474515 - DNA, 16 bp, R. norvegicus
agagactggggcagca

SEQ ID NO: 474516 - DNA, 16 bp, R. norvegicus
agagactggggtgggg

SEQ ID NO: 474517 - DNA, 16 bp, R. norvegicus
agagactgtgacagca

SEQ ID NO: 474518 - DNA, 16 bp, R. norvegicus
agagactgtgtgtgtg

SEQ ID NO: 474519 - DNA, 16 bp, R. norvegicus
agagacttgcagttct

SEQ ID NO: 474520 - DNA, 16 bp, R. norvegicus
agagagaaaaatatca

SEQ ID NO: 474521 - DNA, 16 bp, R. norvegicus
agagagaaaccctatc

SEQ ID NO: 474522 - DNA, 16 bp, R. norvegicus
agagagaaactcagga

SEQ ID NO: 474523 - DNA, 16 bp, R. norvegicus
agagagaaactggaag

SEQ ID NO: 474524 - DNA, 16 bp, R. norvegicus
agagagaaagagactg

SEQ ID NO: 474525 - DNA, 16 bp, R. norvegicus
agagagaaagccagag

SEQ ID NO: 474526 - DNA, 16 bp, R. norvegicus
agagagaaatgtgtgt

SEQ ID NO: 474527 - DNA, 16 bp, R. norvegicus
agagagaacatgaagg

SEQ ID NO: 474528 - DNA, 16 bp, R. norvegicus
agagagaaccagtgtg

SEQ ID NO: 474529 - DNA, 16 bp, R. norvegicus
agagagaacccatcac

SEQ ID NO: 474530 - DNA, 16 bp, R. norvegicus
agagagaagactgaag

SEQ ID NO: 474531 - DNA, 16 bp, R. norvegicus
agagagaagaggctgg

SEQ ID NO: 474532 - DNA, 16 bp, R. norvegicus
agagagaagccaagag

SEQ ID NO: 474533 - DNA, 16 bp, R. norvegicus
agagagaagccagact

SEQ ID NO: 474534 - DNA, 16 bp, R. norvegicus
agagagaagccatggc

SEQ ID NO: 474535 - DNA, 16 bp, R. norvegicus
agagagaatctcagta

SEQ ID NO: 474536 - DNA, 16 bp, R. norvegicus
agagagaatgaacaga

SEQ ID NO: 474537 - DNA, 16 bp, R. norvegicus
agagagacaaagacac

SEQ ID NO: 474538 - DNA, 16 bp, R. norvegicus
agagagacaatatcca

SEQ ID NO: 474539 - DNA, 16 bp, R. norvegicus
agagagacactgagag

SEQ ID NO: 474540 - DNA, 16 bp, R. norvegicus
agagagacagagactg

SEQ ID NO: 474541 - DNA, 16 bp, R. norvegicus
agagagacagagatga

SEQ ID NO: 474542 - DNA, 16 bp, R. norvegicus
agagagacagagggca

SEQ ID NO: 474543 - DNA, 16 bp, R. norvegicus
agagagacagtagaac

SEQ ID NO: 474544 - DNA, 16 bp, R. norvegicus
agagagacccagtctc

SEQ ID NO: 474545 - DNA, 16 bp, R. norvegicus
agagagacccatggct

SEQ ID NO: 474546 - DNA, 16 bp, R. norvegicus
agagagaccccaccac

SEQ ID NO: 474547 - DNA, 16 bp, R. norvegicus
agagagaccctgtttc

SEQ ID NO: 474548 - DNA, 30 bp, R. norvegicus
agagagacccttactcaagtcttgggaaat

SEQ ID NO: 474549 - DNA, 16 bp, R. norvegicus
agagagacctgtctca

SEQ ID NO: 474550 - DNA, 16 bp, R. norvegicus
agagagactgagactc

SEQ ID NO: 474551 - DNA, 16 bp, R. norvegicus
agagagagaaaatcaa

SEQ ID NO: 474552 - DNA, 16 bp, R. norvegicus
agagagagaactttaa

SEQ ID NO: 474553 - DNA, 16 bp, R. norvegicus
agagagagaagattca

SEQ ID NO: 474554 - DNA, 16 bp, R. norvegicus
agagagagaagcagtg

SEQ ID NO: 474555 - DNA, 16 bp, R. norvegicus
agagagagaagctcac

SEQ ID NO: 474556 - DNA, 16 bp, R. norvegicus
agagagagaatacaaa

SEQ ID NO: 474557 - DNA, 16 bp, R. norvegicus
agagagagaatacaag

SEQ ID NO: 474558 - DNA, 16 bp, R. norvegicus
agagagagaatgaatg

SEQ ID NO: 474559 - DNA, 16 bp, R. norvegicus
agagagagaatgcaca

SEQ ID NO: 474560 - DNA, 16 bp, R. norvegicus
agagagagaatgtgga

SEQ ID NO: 474561 - DNA, 16 bp, R. norvegicus
agagagagacagacac

SEQ ID NO: 474562 - DNA, 16 bp, R. norvegicus
agagagagacagagat

SEQ ID NO: 474563 - DNA, 16 bp, R. norvegicus
agagagagactgggaa

SEQ ID NO: 474564 - DNA, 16 bp, R. norvegicus
agagagagagaacagc

SEQ ID NO: 474565 - DNA, 16 bp, R. norvegicus
agagagagagaagctg

SEQ ID NO: 474566 - DNA, 16 bp, R. norvegicus
agagagagagaatcag

SEQ ID NO: 474567 - DNA, 16 bp, R. norvegicus
agagagagagaatgct

SEQ ID NO: 474568 - DNA, 16 bp, R. norvegicus
agagagagagaattta

SEQ ID NO: 474569 - DNA, 16 bp, R. norvegicus
agagagagagacactt

SEQ ID NO: 474570 - DNA, 16 bp, R. norvegicus
agagagagagacgcac

SEQ ID NO: 474571 - DNA, 16 bp, R. norvegicus
agagagagagacttta

SEQ ID NO: 474572 - DNA, 16 bp, R. norvegicus
agagagagagagagcc

SEQ ID NO: 474573 - DNA, 16 bp, R. norvegicus
agagagagagagagtt

SEQ ID NO: 474574 - DNA, 16 bp, R. norvegicus
agagagagagagatac

SEQ ID NO: 474575 - DNA, 16 bp, R. norvegicus
agagagagagagatgt

SEQ ID NO: 474576 - DNA, 16 bp, R. norvegicus
agagagagagatccca

SEQ ID NO: 474577 - DNA, 16 bp, R. norvegicus
agagagagagatcctg

SEQ ID NO: 474578 - DNA, 16 bp, R. norvegicus
agagagagagatcctt

SEQ ID NO: 474579 - DNA, 16 bp, R. norvegicus
agagagagagatgatg

SEQ ID NO: 474580 - DNA, 16 bp, R. norvegicus
agagagagagatgcac

SEQ ID NO: 474581 - DNA, 16 bp, R. norvegicus
agagagagagatgtga

SEQ ID NO: 474582 - DNA, 16 bp, R. norvegicus
agagagagagattttg

SEQ ID NO: 474583 - DNA, 16 bp, R. norvegicus
agagagagagcaagct

SEQ ID NO: 474584 - DNA, 16 bp, R. norvegicus
agagagagagcagaca

SEQ ID NO: 474585 - DNA, 16 bp, R. norvegicus
agagagagagcagcct

SEQ ID NO: 474586 - DNA, 16 bp, R. norvegicus
agagagagagcgcctt

SEQ ID NO: 474587 - DNA, 16 bp, R. norvegicus
agagagagaggccttt

SEQ ID NO: 474588 - DNA, 16 bp, R. norvegicus
agagagagaggctaga

SEQ ID NO: 474589 - DNA, 16 bp, R. norvegicus
agagagagaggctgga

SEQ ID NO: 474590 - DNA, 16 bp, R. norvegicus
agagagagagtctttg

SEQ ID NO: 474591 - DNA, 16 bp, R. norvegicus
agagagagagtctttt

SEQ ID NO: 474592 - DNA, 16 bp, R. norvegicus
agagagagagttagtt

SEQ ID NO: 474593 - DNA, 16 bp, R. norvegicus
agagagagatcgagag

SEQ ID NO: 474594 - DNA, 16 bp, R. norvegicus
agagagagatggacag

SEQ ID NO: 474595 - DNA, 16 bp, R. norvegicus
agagagagattaaaat

SEQ ID NO: 474596 - DNA, 16 bp, R. norvegicus
agagagagcaacagag

SEQ ID NO: 474597 - DNA, 16 bp, R. norvegicus
agagagagcacagagc

SEQ ID NO: 474598 - DNA, 16 bp, R. norvegicus
agagagagcagagcag

SEQ ID NO: 474599 - DNA, 16 bp, R. norvegicus
agagagagcagcacag

SEQ ID NO: 474600 - DNA, 16 bp, R. norvegicus
agagagagcaggcagg

SEQ ID NO: 474601 - DNA, 16 bp, R. norvegicus
agagagagcatgtgag

SEQ ID NO: 474602 - DNA, 16 bp, R. norvegicus
agagagagcgagagca

SEQ ID NO: 474603 - DNA, 16 bp, R. norvegicus
agagagagcgcgagag

SEQ ID NO: 474604 - DNA, 16 bp, R. norvegicus
agagagagctagagag

SEQ ID NO: 474605 - DNA, 16 bp, R. norvegicus
agagagagctggagag

SEQ ID NO: 474606 - DNA, 16 bp, R. norvegicus
agagagaggcagagac

SEQ ID NO: 474607 - DNA, 16 bp, R. norvegicus
agagagagggacacag

SEQ ID NO: 474608 - DNA, 16 bp, R. norvegicus
agagagagggctggag

SEQ ID NO: 474609 - DNA, 16 bp, R. norvegicus
agagagaggtcagaag

SEQ ID NO: 474610 - DNA, 16 bp, R. norvegicus
agagagagtcagggag

SEQ ID NO: 474611 - DNA, 16 bp, R. norvegicus
agagagagtgacagag

SEQ ID NO: 474612 - DNA, 16 bp, R. norvegicus
agagagagtgggcagc

SEQ ID NO: 474613 - DNA, 16 bp, R. norvegicus
agagagagtgtatgtg

SEQ ID NO: 474614 - DNA, 16 bp, R. norvegicus
agagagatcagagaga

SEQ ID NO: 474615 - DNA, 16 bp, R. norvegicus
agagagatcctgtctc

SEQ ID NO: 474616 - DNA, 16 bp, R. norvegicus
agagagatgagcagga

SEQ ID NO: 474617 - DNA, 16 bp, R. norvegicus
agagagatgcagagag

SEQ ID NO: 474618 - DNA, 16 bp, R. norvegicus
agagagatggcccagt

SEQ ID NO: 474619 - DNA, 16 bp, R. norvegicus
agagagattgaggaag

SEQ ID NO: 474620 - DNA, 16 bp, R. norvegicus
agagagattgctgaca

SEQ ID NO: 474621 - DNA, 16 bp, R. norvegicus
agagagatttttgagc

SEQ ID NO: 474622 - DNA, 16 bp, R. norvegicus
agagagcagagagcag

SEQ ID NO: 474623 - DNA, 16 bp, R. norvegicus
agagagcagatctctt

SEQ ID NO: 474624 - DNA, 16 bp, R. norvegicus
agagagcagcaagtgc

SEQ ID NO: 474625 - DNA, 16 bp, R. norvegicus
agagagcaggagtcac

SEQ ID NO: 474626 - DNA, 16 bp, R. norvegicus
agagagcatatgccag

SEQ ID NO: 474627 - DNA, 16 bp, R. norvegicus
agagagcatcagaccc

SEQ ID NO: 474628 - DNA, 16 bp, R. norvegicus
agagagcatgagagag

SEQ ID NO: 474629 - DNA, 16 bp, R. norvegicus
agagagcatggcagca

SEQ ID NO: 474630 - DNA, 16 bp, R. norvegicus
agagagcattccagga

SEQ ID NO: 474631 - DNA, 16 bp, R. norvegicus
agagagcccaggagag

SEQ ID NO: 474632 - DNA, 17 bp, R. norvegicus
agagagccccagattat

SEQ ID NO: 474633 - DNA, 16 bp, R. norvegicus
agagagctcaccacca

SEQ ID NO: 474634 - DNA, 17 bp, R. norvegicus
agagagctgctgcaggc

SEQ ID NO: 474635 - DNA, 16 bp, R. norvegicus
agagagcttgcctagc

SEQ ID NO: 474636 - DNA, 16 bp, R. norvegicus
agagaggaactgagct

SEQ ID NO: 474637 - DNA, 16 bp, R. norvegicus
agagaggaagaagctg

SEQ ID NO: 474638 - DNA, 16 bp, R. norvegicus
agagaggactctggga

SEQ ID NO: 474639 - DNA, 16 bp, R. norvegicus
agagaggagagagcct

SEQ ID NO: 474640 - DNA, 16 bp, R. norvegicus
agagaggaggaagctg

SEQ ID NO: 474641 - DNA, 16 bp, R. norvegicus
agagaggaggaggctg

SEQ ID NO: 474642 - DNA, 16 bp, R. norvegicus
agagaggaggagtcag

SEQ ID NO: 474643 - DNA, 16 bp, R. norvegicus
agagaggagtgtgtgt

SEQ ID NO: 474644 - DNA, 16 bp, R. norvegicus
agagaggagtttgagc

SEQ ID NO: 474645 - DNA, 16 bp, R. norvegicus
agagaggcaaaaatta

SEQ ID NO: 474646 - DNA, 16 bp, R. norvegicus
agagaggcaaagatta

SEQ ID NO: 474647 - DNA, 16 bp, R. norvegicus
agagaggcagagaagc

SEQ ID NO: 474648 - DNA, 16 bp, R. norvegicus
agagaggccagaggag

SEQ ID NO: 474649 - DNA, 16 bp, R. norvegicus
agagaggctgaggcag

SEQ ID NO: 474650 - DNA, 16 bp, R. norvegicus
agagaggcttcctcca

SEQ ID NO: 474651 - DNA, 16 bp, R. norvegicus
agagaggcttctttga

SEQ ID NO: 474652 - DNA, 16 bp, R. norvegicus
agagagggacactggg

SEQ ID NO: 474653 - DNA, 16 bp, R. norvegicus
agagagggacaggcag

SEQ ID NO: 474654 - DNA, 16 bp, R. norvegicus
agagagggtgggtcca

SEQ ID NO: 474655 - DNA, 16 bp, R. norvegicus
agagagggttggggat

SEQ ID NO: 474656 - DNA, 16 bp, R. norvegicus
agagaggtagacagaa

SEQ ID NO: 474657 - DNA, 16 bp, R. norvegicus
agagaggtcagaagat

SEQ ID NO: 474658 - DNA, 16 bp, R. norvegicus
agagagtcagagaaag

SEQ ID NO: 474659 - DNA, 16 bp, R. norvegicus
agagagtccctgtctc

SEQ ID NO: 474660 - DNA, 16 bp, R. norvegicus
agagagtgaaaattcc

SEQ ID NO: 474661 - DNA, 16 bp, R. norvegicus
agagagtgaaggaaca

SEQ ID NO: 474662 - DNA, 16 bp, R. norvegicus
agagagtgagcaacct

SEQ ID NO: 474663 - DNA, 16 bp, R. norvegicus
agagagtgagcagcct

SEQ ID NO: 474664 - DNA, 16 bp, R. norvegicus
agagagtgcacagcct

SEQ ID NO: 474665 - DNA, 16 bp, R. norvegicus
agagagtggagcagag

SEQ ID NO: 474666 - DNA, 16 bp, R. norvegicus
agagagtggcagcctt

SEQ ID NO: 474667 - DNA, 16 bp, R. norvegicus
agagagtgttctgctt

SEQ ID NO: 474668 - DNA, 16 bp, R. norvegicus
agagagttccagacca

SEQ ID NO: 474669 - DNA, 17 bp, R. norvegicus
agagataaaagacaaga

SEQ ID NO: 474670 - DNA, 16 bp, R. norvegicus
agagatactgtgacca

SEQ ID NO: 474671 - DNA, 16 bp, R. norvegicus
agagatagagacagag

SEQ ID NO: 474672 - DNA, 16 bp, R. norvegicus
agagatatttgaagca

SEQ ID NO: 474673 - DNA, 16 bp, R. norvegicus
agagatcaagatggag

SEQ ID NO: 474674 - DNA, 16 bp, R. norvegicus
agagatcatggaaaca

SEQ ID NO: 474675 - DNA, 16 bp, R. norvegicus
agagatccacctacct

SEQ ID NO: 474676 - DNA, 16 bp, R. norvegicus
agagatccacctgcat

SEQ ID NO: 474677 - DNA, 16 bp, R. norvegicus
agagatccctgaatct

SEQ ID NO: 474678 - DNA, 16 bp, R. norvegicus
agagatccgcctgctt

SEQ ID NO: 474679 - DNA, 16 bp, R. norvegicus
agagatctacatccaa

SEQ ID NO: 474680 - DNA, 16 bp, R. norvegicus
agagatctacatccgg

SEQ ID NO: 474681 - DNA, 16 bp, R. norvegicus
agagatctgattgcct

SEQ ID NO: 474682 - DNA, 16 bp, R. norvegicus
agagatctgcctgctt

SEQ ID NO: 474683 - DNA, 16 bp, R. norvegicus
agagatctgcctttct

SEQ ID NO: 474684 - DNA, 16 bp, R. norvegicus
agagatctgctttcct

SEQ ID NO: 474685 - DNA, 16 bp, R. norvegicus
agagatcttcctgctt

SEQ ID NO: 474686 - DNA, 16 bp, R. norvegicus
agagatgacattagct

SEQ ID NO: 474687 - DNA, 16 bp, R. norvegicus
agagatgaccactcag

SEQ ID NO: 474688 - DNA, 16 bp, R. norvegicus
agagatgactctgtgg

SEQ ID NO: 474689 - DNA, 16 bp, R. norvegicus
agagatgattcagcag

SEQ ID NO: 474690 - DNA, 16 bp, R. norvegicus
agagatgcagagacag

SEQ ID NO: 474691 - DNA, 16 bp, R. norvegicus
agagatgcttcagcag

SEQ ID NO: 474692 - DNA, 16 bp, R. norvegicus
agagatggaaacagaa

SEQ ID NO: 474693 - DNA, 16 bp, R. norvegicus
agagatggagaaggtg

SEQ ID NO: 474694 - DNA, 16 bp, R. norvegicus
agagatggagacagac

SEQ ID NO: 474695 - DNA, 16 bp, R. norvegicus
agagatggcccagaag

SEQ ID NO: 474696 - DNA, 16 bp, R. norvegicus
agagatggcccagcgg

SEQ ID NO: 474697 - DNA, 16 bp, R. norvegicus
agagatggcccagtgg

SEQ ID NO: 474698 - DNA, 16 bp, R. norvegicus
agagatggctcagaag

SEQ ID NO: 474699 - DNA, 16 bp, R. norvegicus
agagatggctcaggac

SEQ ID NO: 474700 - DNA, 16 bp, R. norvegicus
agagatggctcaggag

SEQ ID NO: 474701 - DNA, 16 bp, R. norvegicus
agagatggctcaggga

SEQ ID NO: 474702 - DNA, 16 bp, R. norvegicus
agagatggctcatggt

SEQ ID NO: 474703 - DNA, 16 bp, R. norvegicus
agagatggctctgctg

SEQ ID NO: 474704 - DNA, 16 bp, R. norvegicus
agagatggctgagcag

SEQ ID NO: 474705 - DNA, 16 bp, R. norvegicus
agagatggctgagggt

SEQ ID NO: 474706 - DNA, 16 bp, R. norvegicus
agagatggtgcagtgg

SEQ ID NO: 474707 - DNA, 16 bp, R. norvegicus
agagatggttctttga

SEQ ID NO: 474708 - DNA, 16 bp, R. norvegicus
agagatgtacatctgg

SEQ ID NO: 474709 - DNA, 16 bp, R. norvegicus
agagatgtatgtgtgt

SEQ ID NO: 474710 - DNA, 16 bp, R. norvegicus
agagatgtctcagagg

SEQ ID NO: 474711 - DNA, 16 bp, R. norvegicus
agagatgtttcagcag

SEQ ID NO: 474712 - DNA, 16 bp, R. norvegicus
agagattaaaacagag

SEQ ID NO: 474713 - DNA, 17 bp, R. norvegicus
agagattatgaaagcca

SEQ ID NO: 474714 - DNA, 16 bp, R. norvegicus
agagattatgaaagct

SEQ ID NO: 474715 - DNA, 16 bp, R. norvegicus
agagattcacctgcct

SEQ ID NO: 474716 - DNA, 16 bp, R. norvegicus
agagattcccaggacc

SEQ ID NO: 474717 - DNA, 16 bp, R. norvegicus
agagattctggctctg

SEQ ID NO: 474718 - DNA, 16 bp, R. norvegicus
agagattcttctgcct

SEQ ID NO: 474719 - DNA, 16 bp, R. norvegicus
agagattgaagagaga

SEQ ID NO: 474720 - DNA, 16 bp, R. norvegicus
agagattgagattgag

SEQ ID NO: 474721 - DNA, 16 bp, R. norvegicus
agagatttcttagtga

SEQ ID NO: 474722 - DNA, 16 bp, R. norvegicus
agagatttgtttttaa

SEQ ID NO: 474723 - DNA, 16 bp, R. norvegicus
agagattttggtattt

SEQ ID NO: 474724 - DNA, 16 bp, R. norvegicus
agagatttttgtttgt

SEQ ID NO: 474725 - DNA, 16 bp, R. norvegicus
agagcaaaaggctgga

SEQ ID NO: 474726 - DNA, 16 bp, R. norvegicus
agagcaaactgtataa

SEQ ID NO: 474727 - DNA, 16 bp, R. norvegicus
agagcaaaggcagaag

SEQ ID NO: 474728 - DNA, 16 bp, R. norvegicus
agagcaagagagcaag

SEQ ID NO: 474729 - DNA, 16 bp, R. norvegicus
agagcaagagagtgag

SEQ ID NO: 474730 - DNA, 16 bp, R. norvegicus
agagcaagagcaagag

SEQ ID NO: 474731 - DNA, 16 bp, R. norvegicus
agagcaagccagagaa

SEQ ID NO: 474732 - DNA, 16 bp, R. norvegicus
agagcaagccaggaag

SEQ ID NO: 474733 - DNA, 16 bp, R. norvegicus
agagcaagccagggga

SEQ ID NO: 474734 - DNA, 16 bp, R. norvegicus
agagcaagctgcacat

SEQ ID NO: 474735 - DNA, 16 bp, R. norvegicus
agagcaatagaaaagt

SEQ ID NO: 474736 - DNA, 16 bp, R. norvegicus
agagcaatggaggaag

SEQ ID NO: 474737 - DNA, 16 bp, R. norvegicus
agagcacagccacaat

SEQ ID NO: 474738 - DNA, 16 bp, R. norvegicus
agagcacatcaaaagg

SEQ ID NO: 474739 - DNA, 16 bp, R. norvegicus
agagcacatcaaatca

SEQ ID NO: 474740 - DNA, 16 bp, R. norvegicus
agagcacatcaacaca

SEQ ID NO: 474741 - DNA, 16 bp, R. norvegicus
agagcacatggaaaca

SEQ ID NO: 474742 - DNA, 16 bp, R. norvegicus
agagcaccagatctca

SEQ ID NO: 474743 - DNA, 16 bp, R. norvegicus
agagcacccagagact

SEQ ID NO: 474744 - DNA, 16 bp, R. norvegicus
agagcacgacaaatac

SEQ ID NO: 474745 - DNA, 16 bp, R. norvegicus
agagcactctgttccc

SEQ ID NO: 474746 - DNA, 16 bp, R. norvegicus
agagcactgactgatc

SEQ ID NO: 474747 - DNA, 16 bp, R. norvegicus
agagcactgactgcag

SEQ ID NO: 474748 - DNA, 16 bp, R. norvegicus
agagcactgactgctc

SEQ ID NO: 474749 - DNA, 16 bp, R. norvegicus
agagcactggccactc

SEQ ID NO: 474750 - DNA, 16 bp, R. norvegicus
agagcactggctactt

SEQ ID NO: 474751 - DNA, 16 bp, R. norvegicus
agagcacttgcctaga

SEQ ID NO: 474752 - DNA, 16 bp, R. norvegicus
agagcacttgtctagc

SEQ ID NO: 474753 - DNA, 16 bp, R. norvegicus
agagcagaaactgaag

SEQ ID NO: 474754 - DNA, 16 bp, R. norvegicus
agagcagaaagcagag

SEQ ID NO: 474755 - DNA, 16 bp, R. norvegicus
agagcagaagcagaag

SEQ ID NO: 474756 - DNA, 16 bp, R. norvegicus
agagcagaccacccag

SEQ ID NO: 474757 - DNA, 16 bp, R. norvegicus
agagcagagaacagag

SEQ ID NO: 474758 - DNA, 16 bp, R. norvegicus
agagcagagagaagat

SEQ ID NO: 474759 - DNA, 16 bp, R. norvegicus
agagcagagagcagag

SEQ ID NO: 474760 - DNA, 16 bp, R. norvegicus
agagcagagcaaagca

SEQ ID NO: 474761 - DNA, 16 bp, R. norvegicus
agagcagagcacagag

SEQ ID NO: 474762 - DNA, 16 bp, R. norvegicus
agagcagagcagaaca

SEQ ID NO: 474763 - DNA, 16 bp, R. norvegicus
agagcagagcaggatg

SEQ ID NO: 474764 - DNA, 16 bp, R. norvegicus
agagcagagcctgagg

SEQ ID NO: 474765 - DNA, 16 bp, R. norvegicus
agagcagagctctctg

SEQ ID NO: 474766 - DNA, 16 bp, R. norvegicus
agagcagagctggaga

SEQ ID NO: 474767 - DNA, 16 bp, R. norvegicus
agagcagaggacaact

SEQ ID NO: 474768 - DNA, 16 bp, R. norvegicus
agagcagaggcagagg

SEQ ID NO: 474769 - DNA, 16 bp, R. norvegicus
agagcagcaaatactt

SEQ ID NO: 474770 - DNA, 16 bp, R. norvegicus
agagcagcaactgaag

SEQ ID NO: 474771 - DNA, 16 bp, R. norvegicus
agagcagcaagccctc

SEQ ID NO: 474772 - DNA, 16 bp, R. norvegicus
agagcagccaggactc

SEQ ID NO: 474773 - DNA, 16 bp, R. norvegicus
agagcagccagtgccc

SEQ ID NO: 474774 - DNA, 16 bp, R. norvegicus
agagcagcctgcacag

SEQ ID NO: 474775 - DNA, 16 bp, R. norvegicus
agagcagctgaggctg

SEQ ID NO: 474776 - DNA, 16 bp, R. norvegicus
agagcagctggaggct

SEQ ID NO: 474777 - DNA, 16 bp, R. norvegicus
agagcagcttgacagc

SEQ ID NO: 474778 - DNA, 16 bp, R. norvegicus
agagcaggaacctgga

SEQ ID NO: 474779 - DNA, 16 bp, R. norvegicus
agagcaggaagtgctt

SEQ ID NO: 474780 - DNA, 16 bp, R. norvegicus
agagcaggagcaggag

SEQ ID NO: 474781 - DNA, 16 bp, R. norvegicus
agagcaggcctcctgt

SEQ ID NO: 474782 - DNA, 16 bp, R. norvegicus
agagcaggctcagtgg

SEQ ID NO: 474783 - DNA, 16 bp, R. norvegicus
agagcagtagaggaag

SEQ ID NO: 474784 - DNA, 16 bp, R. norvegicus
agagcagtcagtgctc

SEQ ID NO: 474785 - DNA, 16 bp, R. norvegicus
agagcagtgagtgctt

SEQ ID NO: 474786 - DNA, 16 bp, R. norvegicus
agagcagttgaggaag

SEQ ID NO: 474787 - DNA, 16 bp, R. norvegicus
agagcatacctggcta

SEQ ID NO: 474788 - DNA, 16 bp, R. norvegicus
agagcatcttcaataa

SEQ ID NO: 474789 - DNA, 16 bp, R. norvegicus
agagcatggctgctct

SEQ ID NO: 474790 - DNA, 37 bp, R. norvegicus
agagcatgtcagaaacggagcagagtgagaaattagg

SEQ ID NO: 474791 - DNA, 16 bp, R. norvegicus
agagcattcacactgg

SEQ ID NO: 474792 - DNA, 16 bp, R. norvegicus
agagcatttgctgctc

SEQ ID NO: 474793 - DNA, 16 bp, R. norvegicus
agagcattttctttct

SEQ ID NO: 474794 - DNA, 16 bp, R. norvegicus
agagccacagagccac

SEQ ID NO: 474795 - DNA, 16 bp, R. norvegicus
agagccacagccagaa

SEQ ID NO: 474796 - DNA, 16 bp, R. norvegicus
agagccactgggcctg

SEQ ID NO: 474797 - DNA, 16 bp, R. norvegicus
agagccagaaactgga

SEQ ID NO: 474798 - DNA, 16 bp, R. norvegicus
agagccagaagagaga

SEQ ID NO: 474799 - DNA, 16 bp, R. norvegicus
agagccagaatctctt

SEQ ID NO: 474800 - DNA, 16 bp, R. norvegicus
agagccagagacagga

SEQ ID NO: 474801 - DNA, 16 bp, R. norvegicus
agagccagagagaaag

SEQ ID NO: 474802 - DNA, 16 bp, R. norvegicus
agagccagagagatgg

SEQ ID NO: 474803 - DNA, 16 bp, R. norvegicus
agagccagagccagag

SEQ ID NO: 474804 - DNA, 16 bp, R. norvegicus
agagccagaggaagag

SEQ ID NO: 474805 - DNA, 16 bp, R. norvegicus
agagccagagggaagg

SEQ ID NO: 474806 - DNA, 16 bp, R. norvegicus
agagccagaggtggtg

SEQ ID NO: 474807 - DNA, 16 bp, R. norvegicus
agagccagcagaaaga

SEQ ID NO: 474808 - DNA, 16 bp, R. norvegicus
agagccagcagcagtg

SEQ ID NO: 474809 - DNA, 16 bp, R. norvegicus
agagccaggcagtggt

SEQ ID NO: 474810 - DNA, 16 bp, R. norvegicus
agagccagggagagag

SEQ ID NO: 474811 - DNA, 16 bp, R. norvegicus
agagccagttctctcc

SEQ ID NO: 474812 - DNA, 17 bp, R. norvegicus
agagccatgaatttgct

SEQ ID NO: 474813 - DNA, 16 bp, R. norvegicus
agagccatgcagatct

SEQ ID NO: 474814 - DNA, 19 bp, R. norvegicus
agagccatggaggggcaga

SEQ ID NO: 474815 - DNA, 16 bp, R. norvegicus
agagccatggatctgt

SEQ ID NO: 474816 - DNA, 16 bp, R. norvegicus
agagcccaagaaaagg

SEQ ID NO: 474817 - DNA, 16 bp, R. norvegicus
agagcccaagagaagg

SEQ ID NO: 474818 - DNA, 16 bp, R. norvegicus
agagcccagaagaggg

SEQ ID NO: 474819 - DNA, 16 bp, R. norvegicus
agagcccagagcccag

SEQ ID NO: 474820 - DNA, 16 bp, R. norvegicus
agagcccagttccccc

SEQ ID NO: 474821 - DNA, 16 bp, R. norvegicus
agagccccaagagtcc

SEQ ID NO: 474822 - DNA, 16 bp, R. norvegicus
agagccctgcttctcc

SEQ ID NO: 474823 - DNA, 16 bp, R. norvegicus
agagccctggctgccc

SEQ ID NO: 474824 - DNA, 16 bp, R. norvegicus
agagcctaatcacctt

SEQ ID NO: 474825 - DNA, 16 bp, R. norvegicus
agagcctcaaacacag

SEQ ID NO: 474826 - DNA, 16 bp, R. norvegicus
agagcctctccagaga

SEQ ID NO: 474827 - DNA, 16 bp, R. norvegicus
agagcctctgggaaca

SEQ ID NO: 474828 - DNA, 16 bp, R. norvegicus
agagcctgaactggcc

SEQ ID NO: 474829 - DNA, 16 bp, R. norvegicus
agagcctgagaaaaag

SEQ ID NO: 474830 - DNA, 16 bp, R. norvegicus
agagcctgagggaaag

SEQ ID NO: 474831 - DNA, 16 bp, R. norvegicus
agagcctgagtttgat

SEQ ID NO: 474832 - DNA, 16 bp, R. norvegicus
agagcctgcagaaaga

SEQ ID NO: 474833 - DNA, 16 bp, R. norvegicus
agagcctgccccacac

SEQ ID NO: 474834 - DNA, 16 bp, R. norvegicus
agagcctgggccacca

SEQ ID NO: 474835 - DNA, 16 bp, R. norvegicus
agagcctgtgacagtg

SEQ ID NO: 474836 - DNA, 16 bp, R. norvegicus
agagcctgtgcaacca

SEQ ID NO: 474837 - DNA, 16 bp, R. norvegicus
agagccttatttataa

SEQ ID NO: 474838 - DNA, 16 bp, R. norvegicus
agagccttgaatgcat

SEQ ID NO: 474839 - DNA, 16 bp, R. norvegicus
agagcgcacacacaca

SEQ ID NO: 474840 - DNA, 18 bp, R. norvegicus
agagctaaaacttcagag

SEQ ID NO: 474841 - DNA, 16 bp, R. norvegicus
agagctaaacagacaa

SEQ ID NO: 474842 - DNA, 16 bp, R. norvegicus
agagctaaacattcag

SEQ ID NO: 474843 - DNA, 17 bp, R. norvegicus
agagctaaactttcaga

SEQ ID NO: 474844 - DNA, 16 bp, R. norvegicus
agagctaagccttcag

SEQ ID NO: 474845 - DNA, 16 bp, R. norvegicus
agagctacacaaagaa

SEQ ID NO: 474846 - DNA, 16 bp, R. norvegicus
agagctagaggaagga

SEQ ID NO: 474847 - DNA, 16 bp, R. norvegicus
agagctaggatttgaa

SEQ ID NO: 474848 - DNA, 16 bp, R. norvegicus
agagctcaaggcagga

SEQ ID NO: 474849 - DNA, 16 bp, R. norvegicus
agagctcacatctgat

SEQ ID NO: 474850 - DNA, 16 bp, R. norvegicus
agagctcactgcccag

SEQ ID NO: 474851 - DNA, 16 bp, R. norvegicus
agagctcagaaagagc

SEQ ID NO: 474852 - DNA, 16 bp, R. norvegicus
agagctcagacagagc

SEQ ID NO: 474853 - DNA, 16 bp, R. norvegicus
agagctcagaggacaa

SEQ ID NO: 474854 - DNA, 17 bp, R. norvegicus
agagctcataagcaaca

SEQ ID NO: 474855 - DNA, 16 bp, R. norvegicus
agagctcattacagat

SEQ ID NO: 474856 - DNA, 16 bp, R. norvegicus
agagctccacctgctt

SEQ ID NO: 474857 - DNA, 16 bp, R. norvegicus
agagctctcagctcct

SEQ ID NO: 474858 - DNA, 16 bp, R. norvegicus
agagctctctctctct

SEQ ID NO: 474859 - DNA, 16 bp, R. norvegicus
agagctgaaagccatt

SEQ ID NO: 474860 - DNA, 16 bp, R. norvegicus
agagctgaacatccag

SEQ ID NO: 474861 - DNA, 16 bp, R. norvegicus
agagctgaagcagagg

SEQ ID NO: 474862 - DNA, 16 bp, R. norvegicus
agagctgaccacccag

SEQ ID NO: 474863 - DNA, 16 bp, R. norvegicus
agagctgaccctgccc

SEQ ID NO: 474864 - DNA, 16 bp, R. norvegicus
agagctgaggttacag

SEQ ID NO: 474865 - DNA, 16 bp, R. norvegicus
agagctgatctcccag

SEQ ID NO: 474866 - DNA, 16 bp, R. norvegicus
agagctgcctgcctct

SEQ ID NO: 474867 - DNA, 17 bp, R. norvegicus
agagctgcctggtgaga

SEQ ID NO: 474868 - DNA, 16 bp, R. norvegicus
agagctgctcttccag

SEQ ID NO: 474869 - DNA, 16 bp, R. norvegicus
agagctgctgctggct

SEQ ID NO: 474870 - DNA, 16 bp, R. norvegicus
agagctggagaaatgg

SEQ ID NO: 474871 - DNA, 16 bp, R. norvegicus
agagctggagaagaga

SEQ ID NO: 474872 - DNA, 16 bp, R. norvegicus
agagctggagaaggga

SEQ ID NO: 474873 - DNA, 16 bp, R. norvegicus
agagctggaggatggg

SEQ ID NO: 474874 - DNA, 16 bp, R. norvegicus
agagctggagttagag

SEQ ID NO: 474875 - DNA, 16 bp, R. norvegicus
agagctggagttccag

SEQ ID NO: 474876 - DNA, 16 bp, R. norvegicus
agagctggatgtggtg

SEQ ID NO: 474877 - DNA, 16 bp, R. norvegicus
agagctggccccacca

SEQ ID NO: 474878 - DNA, 16 bp, R. norvegicus
agagctggccctgctc

SEQ ID NO: 474879 - DNA, 16 bp, R. norvegicus
agagctggccctgtcc

SEQ ID NO: 474880 - DNA, 16 bp, R. norvegicus
agagctggctcagcag

SEQ ID NO: 474881 - DNA, 16 bp, R. norvegicus
agagctggctcagctg

SEQ ID NO: 474882 - DNA, 16 bp, R. norvegicus
agagctgggattaaag

SEQ ID NO: 474883 - DNA, 16 bp, R. norvegicus
agagctggggagacag

SEQ ID NO: 474884 - DNA, 16 bp, R. norvegicus
agagctgggtcctcag

SEQ ID NO: 474885 - DNA, 16 bp, R. norvegicus
agagctgtctcctgag

SEQ ID NO: 474886 - DNA, 16 bp, R. norvegicus
agagctgtgaattttc

SEQ ID NO: 474887 - DNA, 16 bp, R. norvegicus
agagctgtgtcacagg

SEQ ID NO: 474888 - DNA, 16 bp, R. norvegicus
agagctgtgtggttcc

SEQ ID NO: 474889 - DNA, 16 bp, R. norvegicus
agagctgttgcgggcc

SEQ ID NO: 474890 - DNA, 16 bp, R. norvegicus
agagctgttggatcca

SEQ ID NO: 474891 - DNA, 16 bp, R. norvegicus
agagcttaagtccaag

SEQ ID NO: 474892 - DNA, 16 bp, R. norvegicus
agagcttcacctgcct

SEQ ID NO: 474893 - DNA, 16 bp, R. norvegicus
agagcttcagtgcacc

SEQ ID NO: 474894 - DNA, 16 bp, R. norvegicus
agagcttctcaggaaa

SEQ ID NO: 474895 - DNA, 16 bp, R. norvegicus
agagcttctcttccca

SEQ ID NO: 474896 - DNA, 17 bp, R. norvegicus
agagcttgatagctcag

SEQ ID NO: 474897 - DNA, 16 bp, R. norvegicus
agagcttgcctggcat

SEQ ID NO: 474898 - DNA, 16 bp, R. norvegicus
agagcttgctgacagg

SEQ ID NO: 474899 - DNA, 16 bp, R. norvegicus
agagctttcagatgta

SEQ ID NO: 474900 - DNA, 16 bp, R. norvegicus
agaggaaaaaaatctg

SEQ ID NO: 474901 - DNA, 16 bp, R. norvegicus
agaggaaaacaggtgt

SEQ ID NO: 474902 - DNA, 16 bp, R. norvegicus
agaggaaaacgcctag

SEQ ID NO: 474903 - DNA, 16 bp, R. norvegicus
agaggaaaaggaagct

SEQ ID NO: 474904 - DNA, 16 bp, R. norvegicus
agaggaaaaggtcaag

SEQ ID NO: 474905 - DNA, 16 bp, R. norvegicus
agaggaaaatgcctag

SEQ ID NO: 474906 - DNA, 16 bp, R. norvegicus
agaggaaacagaaacc

SEQ ID NO: 474907 - DNA, 16 bp, R. norvegicus
agaggaaactgaatag

SEQ ID NO: 474908 - DNA, 16 bp, R. norvegicus
agaggaaacttcatag

SEQ ID NO: 474909 - DNA, 16 bp, R. norvegicus
agaggaaagagaagct

SEQ ID NO: 474910 - DNA, 16 bp, R. norvegicus
agaggaaagatttatt

SEQ ID NO: 474911 - DNA, 16 bp, R. norvegicus
agaggaaagcaccaaa

SEQ ID NO: 474912 - DNA, 16 bp, R. norvegicus
agaggaaagtcaaaaa

SEQ ID NO: 474913 - DNA, 16 bp, R. norvegicus
agaggaaagtgcagga

SEQ ID NO: 474914 - DNA, 16 bp, R. norvegicus
agaggaaattttaaaa

SEQ ID NO: 474915 - DNA, 16 bp, R. norvegicus
agaggaacacaggaag

SEQ ID NO: 474916 - DNA, 16 bp, R. norvegicus
agaggaacacttctcc

SEQ ID NO: 474917 - DNA, 16 bp, R. norvegicus
agaggaacacttttcc

SEQ ID NO: 474918 - DNA, 16 bp, R. norvegicus
agaggaacaggcctca

SEQ ID NO: 474919 - DNA, 16 bp, R. norvegicus
agaggaacagtcttcc

SEQ ID NO: 474920 - DNA, 16 bp, R. norvegicus
agaggaacctcaactg

SEQ ID NO: 474921 - DNA, 16 bp, R. norvegicus
agaggaaccttaacat

SEQ ID NO: 474922 - DNA, 16 bp, R. norvegicus
agaggaagaactgaag

SEQ ID NO: 474923 - DNA, 16 bp, R. norvegicus
agaggaagaagatgat

SEQ ID NO: 474924 - DNA, 16 bp, R. norvegicus
agaggaagacaccaaa

SEQ ID NO: 474925 - DNA, 16 bp, R. norvegicus
agaggaagacacccag

SEQ ID NO: 474926 - DNA, 16 bp, R. norvegicus
agaggaagacatttga

SEQ ID NO: 474927 - DNA, 16 bp, R. norvegicus
agaggaagagactgga

SEQ ID NO: 474928 - DNA, 16 bp, R. norvegicus
agaggaagagagcttc

SEQ ID NO: 474929 - DNA, 16 bp, R. norvegicus
agaggaagagaggctg

SEQ ID NO: 474930 - DNA, 16 bp, R. norvegicus
agaggaagaggaacac

SEQ ID NO: 474931 - DNA, 16 bp, R. norvegicus
agaggaagcagaggca

SEQ ID NO: 474932 - DNA, 16 bp, R. norvegicus
agaggaagcctggtaa

SEQ ID NO: 474933 - DNA, 16 bp, R. norvegicus
agaggaagctaaggag

SEQ ID NO: 474934 - DNA, 16 bp, R. norvegicus
agaggaaggaactggg

SEQ ID NO: 474935 - DNA, 16 bp, R. norvegicus
agaggaaggactgaag

SEQ ID NO: 474936 - DNA, 16 bp, R. norvegicus
agaggaaggctaccaa

SEQ ID NO: 474937 - DNA, 16 bp, R. norvegicus
agaggaaggggaagcc

SEQ ID NO: 474938 - DNA, 16 bp, R. norvegicus
agaggaaggtggatct

SEQ ID NO: 474939 - DNA, 16 bp, R. norvegicus
agaggaagtcaggact

SEQ ID NO: 474940 - DNA, 16 bp, R. norvegicus
agaggaagtcagggca

SEQ ID NO: 474941 - DNA, 17 bp, R. norvegicus
agaggaatagcaaaaat

SEQ ID NO: 474942 - DNA, 16 bp, R. norvegicus
agaggaatagtgatta

SEQ ID NO: 474943 - DNA, 16 bp, R. norvegicus
agaggaatgaattcaa

SEQ ID NO: 474944 - DNA, 16 bp, R. norvegicus
agaggaatgtcagggt

SEQ ID NO: 474945 - DNA, 16 bp, R. norvegicus
agaggaatttctcttc

SEQ ID NO: 474946 - DNA, 16 bp, R. norvegicus
agaggacaaaagaatt

SEQ ID NO: 474947 - DNA, 16 bp, R. norvegicus
agaggacaaaggactg

SEQ ID NO: 474948 - DNA, 16 bp, R. norvegicus
agaggacacagaaagt

SEQ ID NO: 474949 - DNA, 17 bp, R. norvegicus
agaggacacagagagtg

SEQ ID NO: 474950 - DNA, 16 bp, R. norvegicus
agaggacacagagggt

SEQ ID NO: 474951 - DNA, 16 bp, R. norvegicus
agaggacacagagtgt

SEQ ID NO: 474952 - DNA, 16 bp, R. norvegicus
agaggacacctttcag

SEQ ID NO: 474953 - DNA, 16 bp, R. norvegicus
agaggacagacatgct

SEQ ID NO: 474954 - DNA, 16 bp, R. norvegicus
agaggacagaggacag

SEQ ID NO: 474955 - DNA, 16 bp, R. norvegicus
agaggacagcagccat

SEQ ID NO: 474956 - DNA, 16 bp, R. norvegicus
agaggacagccatgca

SEQ ID NO: 474957 - DNA, 16 bp, R. norvegicus
agaggacaggaaataa

SEQ ID NO: 474958 - DNA, 16 bp, R. norvegicus
agaggacattcctcaa

SEQ ID NO: 474959 - DNA, 16 bp, R. norvegicus
agaggaccagagttct

SEQ ID NO: 474960 - DNA, 17 bp, R. norvegicus
agaggacccagagagtg

SEQ ID NO: 474961 - DNA, 16 bp, R. norvegicus
agaggacccaggtaca

SEQ ID NO: 474962 - DNA, 16 bp, R. norvegicus
agaggacccaggttca

SEQ ID NO: 474963 - DNA, 16 bp, R. norvegicus
agaggacccaggtttg

SEQ ID NO: 474964 - DNA, 16 bp, R. norvegicus
agaggaccctccagaa

SEQ ID NO: 474965 - DNA, 16 bp, R. norvegicus
agaggacctggagcag

SEQ ID NO: 474966 - DNA, 16 bp, R. norvegicus
agaggacctgggtcca

SEQ ID NO: 474967 - DNA, 16 bp, R. norvegicus
agaggacctggttcag

SEQ ID NO: 474968 - DNA, 16 bp, R. norvegicus
agaggacggcctggtc

SEQ ID NO: 474969 - DNA, 16 bp, R. norvegicus
agaggactagggttca

SEQ ID NO: 474970 - DNA, 16 bp, R. norvegicus
agaggactcagattca

SEQ ID NO: 474971 - DNA, 16 bp, R. norvegicus
agaggactcaggttca

SEQ ID NO: 474972 - DNA, 16 bp, R. norvegicus
agaggactttaagaag

SEQ ID NO: 474973 - DNA, 16 bp, R. norvegicus
agaggactttgagaag

SEQ ID NO: 474974 - DNA, 16 bp, R. norvegicus
agaggagaacaaagat

SEQ ID NO: 474975 - DNA, 16 bp, R. norvegicus
agaggagaagatgcca

SEQ ID NO: 474976 - DNA, 16 bp, R. norvegicus
agaggagaagcccttg

SEQ ID NO: 474977 - DNA, 16 bp, R. norvegicus
agaggagaataccctc

SEQ ID NO: 474978 - DNA, 16 bp, R. norvegicus
agaggagaatgccagc

SEQ ID NO: 474979 - DNA, 16 bp, R. norvegicus
agaggagacacagaga

SEQ ID NO: 474980 - DNA, 16 bp, R. norvegicus
agaggagacagacaga

SEQ ID NO: 474981 - DNA, 16 bp, R. norvegicus
agaggagacataaaaa

SEQ ID NO: 474982 - DNA, 16 bp, R. norvegicus
agaggagactggagca

SEQ ID NO: 474983 - DNA, 16 bp, R. norvegicus
agaggagagagaacct

SEQ ID NO: 474984 - DNA, 16 bp, R. norvegicus
agaggagagaggctgg

SEQ ID NO: 474985 - DNA, 16 bp, R. norvegicus
agaggagatggaggac

SEQ ID NO: 474986 - DNA, 22 bp, R. norvegicus
agaggagctgcttgctcaaaga

SEQ ID NO: 474987 - DNA, 16 bp, R. norvegicus
agaggagctgggagaa

SEQ ID NO: 474988 - DNA, 16 bp, R. norvegicus
agaggagctgggagga

SEQ ID NO: 474989 - DNA, 16 bp, R. norvegicus
agaggagctggggaga

SEQ ID NO: 474990 - DNA, 16 bp, R. norvegicus
agaggaggaaactgaa

SEQ ID NO: 474991 - DNA, 16 bp, R. norvegicus
agaggaggaaagggtt

SEQ ID NO: 474992 - DNA, 16 bp, R. norvegicus
agaggaggaagagact

SEQ ID NO: 474993 - DNA, 16 bp, R. norvegicus
agaggaggagactgga

SEQ ID NO: 474994 - DNA, 16 bp, R. norvegicus
agaggaggagctgctg

SEQ ID NO: 474995 - DNA, 16 bp, R. norvegicus
agaggaggaggaagcc

SEQ ID NO: 474996 - DNA, 16 bp, R. norvegicus
agaggaggaggagctg

SEQ ID NO: 474997 - DNA, 16 bp, R. norvegicus
agaggaggagttagag

SEQ ID NO: 474998 - DNA, 16 bp, R. norvegicus
agaggaggctggagag

SEQ ID NO: 474999 - DNA, 16 bp, R. norvegicus
agaggaggggaaactg

SEQ ID NO: 475000 - DNA, 16 bp, R. norvegicus
agaggaggtcagaaga

SEQ ID NO: 475001 - DNA, 16 bp, R. norvegicus
agaggaggtcatgaat

SEQ ID NO: 475002 - DNA, 16 bp, R. norvegicus
agaggaggtgtgtgtg

SEQ ID NO: 475003 - DNA, 17 bp, R. norvegicus
agaggagtcgaccccga

SEQ ID NO: 475004 - DNA, 16 bp, R. norvegicus
agaggagtggacagca

SEQ ID NO: 475005 - DNA, 16 bp, R. norvegicus
agaggatagacaaagg

SEQ ID NO: 475006 - DNA, 16 bp, R. norvegicus
agaggatcaggagttc

SEQ ID NO: 475007 - DNA, 16 bp, R. norvegicus
agaggatcagggagtt

SEQ ID NO: 475008 - DNA, 16 bp, R. norvegicus
agaggatgaccttgct

SEQ ID NO: 475009 - DNA, 16 bp, R. norvegicus
agaggatgaccttgtc

SEQ ID NO: 475010 - DNA, 16 bp, R. norvegicus
agaggatgatgggaaa

SEQ ID NO: 475011 - DNA, 16 bp, R. norvegicus
agaggatgctgggaaa

SEQ ID NO: 475012 - DNA, 16 bp, R. norvegicus
agaggatggcactgtc

SEQ ID NO: 475013 - DNA, 16 bp, R. norvegicus
agaggatggccctatc

SEQ ID NO: 475014 - DNA, 16 bp, R. norvegicus
agaggatggccgtgtt

SEQ ID NO: 475015 - DNA, 16 bp, R. norvegicus
agaggatgtggggaaa

SEQ ID NO: 475016 - DNA, 16 bp, R. norvegicus
agaggattctgggaga

SEQ ID NO: 475017 - DNA, 16 bp, R. norvegicus
agaggcaaaatgtcct

SEQ ID NO: 475018 - DNA, 17 bp, R. norvegicus
agaggcaaaattcctct

SEQ ID NO: 475019 - DNA, 16 bp, R. norvegicus
agaggcaaagcagagg

SEQ ID NO: 475020 - DNA, 16 bp, R. norvegicus
agaggcaaaggcaaga

SEQ ID NO: 475021 - DNA, 16 bp, R. norvegicus
agaggcaaagtggagg

SEQ ID NO: 475022 - DNA, 16 bp, R. norvegicus
agaggcaacagtcttc

SEQ ID NO: 475023 - DNA, 16 bp, R. norvegicus
agaggcaagaacagga

SEQ ID NO: 475024 - DNA, 16 bp, R. norvegicus
agaggcaagagcagga

SEQ ID NO: 475025 - DNA, 16 bp, R. norvegicus
agaggcaagtgcaaaa

SEQ ID NO: 475026 - DNA, 16 bp, R. norvegicus
agaggcaataaagaaa

SEQ ID NO: 475027 - DNA, 16 bp, R. norvegicus
agaggcacacaaacat

SEQ ID NO: 475028 - DNA, 16 bp, R. norvegicus
agaggcacagacagag

SEQ ID NO: 475029 - DNA, 16 bp, R. norvegicus
agaggcacttgctgcc

SEQ ID NO: 475030 - DNA, 16 bp, R. norvegicus
agaggcagaaagaatg

SEQ ID NO: 475031 - DNA, 16 bp, R. norvegicus
agaggcagaaagatta

SEQ ID NO: 475032 - DNA, 16 bp, R. norvegicus
agaggcagaactggag

SEQ ID NO: 475033 - DNA, 16 bp, R. norvegicus
agaggcagaagcaagc

SEQ ID NO: 475034 - DNA, 16 bp, R. norvegicus
agaggcagaagccagc

SEQ ID NO: 475035 - DNA, 16 bp, R. norvegicus
agaggcagaaggatct

SEQ ID NO: 475036 - DNA, 16 bp, R. norvegicus
agaggcagaaggcaca

SEQ ID NO: 475037 - DNA, 16 bp, R. norvegicus
agaggcagacaaacct

SEQ ID NO: 475038 - DNA, 16 bp, R. norvegicus
agaggcagacaggcct

SEQ ID NO: 475039 - DNA, 18 bp, R. norvegicus
agaggcagagaagcagag

SEQ ID NO: 475040 - DNA, 16 bp, R. norvegicus
agaggcagagacatag

SEQ ID NO: 475041 - DNA, 16 bp, R. norvegicus
agaggcagagagagat

SEQ ID NO: 475042 - DNA, 16 bp, R. norvegicus
agaggcagagagagca

SEQ ID NO: 475043 - DNA, 16 bp, R. norvegicus
agaggcagagagagtg

SEQ ID NO: 475044 - DNA, 18 bp, R. norvegicus
agaggcagagaggcagag

SEQ ID NO: 475045 - DNA, 16 bp, R. norvegicus
agaggcagagcagcag

SEQ ID NO: 475046 - DNA, 16 bp, R. norvegicus
agaggcagagccacca

SEQ ID NO: 475047 - DNA, 16 bp, R. norvegicus
agaggcagagccaccg

SEQ ID NO: 475048 - DNA, 16 bp, R. norvegicus
agaggcagaggagcag

SEQ ID NO: 475049 - DNA, 16 bp, R. norvegicus
agaggcagaggcagat

SEQ ID NO: 475050 - DNA, 16 bp, R. norvegicus
agaggcagaggcaggc

SEQ ID NO: 475051 - DNA, 16 bp, R. norvegicus
agaggcagaggcaggt

SEQ ID NO: 475052 - DNA, 16 bp, R. norvegicus
agaggcagaggtagag

SEQ ID NO: 475053 - DNA, 16 bp, R. norvegicus
agaggcagatggagag

SEQ ID NO: 475054 - DNA, 16 bp, R. norvegicus
agaggcagatgtagag

SEQ ID NO: 475055 - DNA, 16 bp, R. norvegicus
agaggcagctcagcag

SEQ ID NO: 475056 - DNA, 16 bp, R. norvegicus
agaggcagctgagaga

SEQ ID NO: 475057 - DNA, 16 bp, R. norvegicus
agaggcaggaagacag

SEQ ID NO: 475058 - DNA, 16 bp, R. norvegicus
agaggcaggaagcaga

SEQ ID NO: 475059 - DNA, 16 bp, R. norvegicus
agaggcaggaagtcca

SEQ ID NO: 475060 - DNA, 16 bp, R. norvegicus
agaggcaggagaggca

SEQ ID NO: 475061 - DNA, 16 bp, R. norvegicus
agaggcaggaggacag

SEQ ID NO: 475062 - DNA, 16 bp, R. norvegicus
agaggcaggaggatgg

SEQ ID NO: 475063 - DNA, 16 bp, R. norvegicus
agaggcaggcaggcag

SEQ ID NO: 475064 - DNA, 16 bp, R. norvegicus
agaggcaggggcatgg

SEQ ID NO: 475065 - DNA, 16 bp, R. norvegicus
agaggcatctggacaa

SEQ ID NO: 475066 - DNA, 16 bp, R. norvegicus
agaggcattggatccc

SEQ ID NO: 475067 - DNA, 16 bp, R. norvegicus
agaggccaaaagagga

SEQ ID NO: 475068 - DNA, 16 bp, R. norvegicus
agaggccacagaaggg

SEQ ID NO: 475069 - DNA, 16 bp, R. norvegicus
agaggccacagaggag

SEQ ID NO: 475070 - DNA, 16 bp, R. norvegicus
agaggccagaagagaa

SEQ ID NO: 475071 - DNA, 16 bp, R. norvegicus
agaggccagaaggcag

SEQ ID NO: 475072 - DNA, 16 bp, R. norvegicus
agaggccagagaagga

SEQ ID NO: 475073 - DNA, 16 bp, R. norvegicus
agaggccagaggagaa

SEQ ID NO: 475074 - DNA, 16 bp, R. norvegicus
agaggccagccatata

SEQ ID NO: 475075 - DNA, 16 bp, R. norvegicus
agaggccatgaaggga

SEQ ID NO: 475076 - DNA, 16 bp, R. norvegicus
agaggccatggaagag

SEQ ID NO: 475077 - DNA, 16 bp, R. norvegicus
agaggccatggaaggc

SEQ ID NO: 475078 - DNA, 16 bp, R. norvegicus
agaggccatggaaggg

SEQ ID NO: 475079 - DNA, 16 bp, R. norvegicus
agaggccatggagaag

SEQ ID NO: 475080 - DNA, 16 bp, R. norvegicus
agaggccattggtgaa

SEQ ID NO: 475081 - DNA, 16 bp, R. norvegicus
agaggcccagagagag

SEQ ID NO: 475082 - DNA, 16 bp, R. norvegicus
agaggccctgccagag

SEQ ID NO: 475083 - DNA, 16 bp, R. norvegicus
agaggccggcagatct

SEQ ID NO: 475084 - DNA, 16 bp, R. norvegicus
agaggccggtggatct

SEQ ID NO: 475085 - DNA, 16 bp, R. norvegicus
agaggcctcatctcag

SEQ ID NO: 475086 - DNA, 16 bp, R. norvegicus
agaggccttcagatga

SEQ ID NO: 475087 - DNA, 16 bp, R. norvegicus
agaggccttcagcagt

SEQ ID NO: 475088 - DNA, 16 bp, R. norvegicus
agaggccttctgtggg

SEQ ID NO: 475089 - DNA, 16 bp, R. norvegicus
agaggccttgaaccag

SEQ ID NO: 475090 - DNA, 16 bp, R. norvegicus
agaggcgggtggatct

SEQ ID NO: 475091 - DNA, 16 bp, R. norvegicus
agaggctaaggcagga

SEQ ID NO: 475092 - DNA, 16 bp, R. norvegicus
agaggctactggtgaa

SEQ ID NO: 475093 - DNA, 16 bp, R. norvegicus
agaggctattggtgaa

SEQ ID NO: 475094 - DNA, 16 bp, R. norvegicus
agaggctccacccagc

SEQ ID NO: 475095 - DNA, 16 bp, R. norvegicus
agaggctcccaggaca

SEQ ID NO: 475096 - DNA, 16 bp, R. norvegicus
agaggctctcagagga

SEQ ID NO: 475097 - DNA, 16 bp, R. norvegicus
agaggctctccctaaa

SEQ ID NO: 475098 - DNA, 16 bp, R. norvegicus
agaggctctgacagag

SEQ ID NO: 475099 - DNA, 16 bp, R. norvegicus
agaggctctgtcagca

SEQ ID NO: 475100 - DNA, 16 bp, R. norvegicus
agaggctgaagaaaag

SEQ ID NO: 475101 - DNA, 16 bp, R. norvegicus
agaggctgaagaaatg

SEQ ID NO: 475102 - DNA, 16 bp, R. norvegicus
agaggctgagaaagaa

SEQ ID NO: 475103 - DNA, 16 bp, R. norvegicus
agaggctgagaaagca

SEQ ID NO: 475104 - DNA, 16 bp, R. norvegicus
agaggctgagaggaag

SEQ ID NO: 475105 - DNA, 16 bp, R. norvegicus
agaggctgaggaaaag

SEQ ID NO: 475106 - DNA, 16 bp, R. norvegicus
agaggctgaggcagga

SEQ ID NO: 475107 - DNA, 16 bp, R. norvegicus
agaggctggagagagg

SEQ ID NO: 475108 - DNA, 16 bp, R. norvegicus
agaggctgggaagatg

SEQ ID NO: 475109 - DNA, 16 bp, R. norvegicus
agaggctggtggatct

SEQ ID NO: 475110 - DNA, 16 bp, R. norvegicus
agaggctgtggaggaa

SEQ ID NO: 475111 - DNA, 16 bp, R. norvegicus
agaggcttcacccaga

SEQ ID NO: 475112 - DNA, 16 bp, R. norvegicus
agaggctttgccagag

SEQ ID NO: 475113 - DNA, 16 bp, R. norvegicus
agagggacagacatgc

SEQ ID NO: 475114 - DNA, 16 bp, R. norvegicus
agagggacagggacag

SEQ ID NO: 475115 - DNA, 16 bp, R. norvegicus
agagggacattaaaat

SEQ ID NO: 475116 - DNA, 16 bp, R. norvegicus
agagggagacaaaggt

SEQ ID NO: 475117 - DNA, 16 bp, R. norvegicus
agagggagacaagcct

SEQ ID NO: 475118 - DNA, 16 bp, R. norvegicus
agagggagagaagctg

SEQ ID NO: 475119 - DNA, 16 bp, R. norvegicus
agagggagctgagagc

SEQ ID NO: 475120 - DNA, 16 bp, R. norvegicus
agagggagggactggg

SEQ ID NO: 475121 - DNA, 16 bp, R. norvegicus
agagggcacagagaga

SEQ ID NO: 475122 - DNA, 16 bp, R. norvegicus
agagggcacagaggca

SEQ ID NO: 475123 - DNA, 16 bp, R. norvegicus
agagggcactggattc

SEQ ID NO: 475124 - DNA, 16 bp, R. norvegicus
agagggcagagctgca

SEQ ID NO: 475125 - DNA, 16 bp, R. norvegicus
agagggcagagctgga

SEQ ID NO: 475126 - DNA, 16 bp, R. norvegicus
agagggcagccatgat

SEQ ID NO: 475127 - DNA, 16 bp, R. norvegicus
agagggcagctgctgc

SEQ ID NO: 475128 - DNA, 16 bp, R. norvegicus
agagggcatcggttcc

SEQ ID NO: 475129 - DNA, 16 bp, R. norvegicus
agagggccaggagagt

SEQ ID NO: 475130 - DNA, 16 bp, R. norvegicus
agagggccatggaaaa

SEQ ID NO: 475131 - DNA, 17 bp, R. norvegicus
agagggcccaggagcgg

SEQ ID NO: 475132 - DNA, 16 bp, R. norvegicus
agagggcgtcagatct

SEQ ID NO: 475133 - DNA, 17 bp, R. norvegicus
agagggctaatatccaa

SEQ ID NO: 475134 - DNA, 16 bp, R. norvegicus
agagggctgaggcagg

SEQ ID NO: 475135 - DNA, 16 bp, R. norvegicus
agagggcttagccaat

SEQ ID NO: 475136 - DNA, 16 bp, R. norvegicus
agaggggaaaccagaa

SEQ ID NO: 475137 - DNA, 16 bp, R. norvegicus
agaggggaacatggtc

SEQ ID NO: 475138 - DNA, 17 bp, R. norvegicus
agaggggacactggaga

SEQ ID NO: 475139 - DNA, 16 bp, R. norvegicus
agaggggagcagagac

SEQ ID NO: 475140 - DNA, 16 bp, R. norvegicus
agaggggcagctggag

SEQ ID NO: 475141 - DNA, 16 bp, R. norvegicus
agaggggcctggcctc

SEQ ID NO: 475142 - DNA, 16 bp, R. norvegicus
agaggggctcacagag

SEQ ID NO: 475143 - DNA, 16 bp, R. norvegicus
agaggggctggaaaga

SEQ ID NO: 475144 - DNA, 16 bp, R. norvegicus
agagggggccctggga

SEQ ID NO: 475145 - DNA, 16 bp, R. norvegicus
agagggggctggagag

SEQ ID NO: 475146 - DNA, 16 bp, R. norvegicus
agagggtacagagaca

SEQ ID NO: 475147 - DNA, 16 bp, R. norvegicus
agagggtgactgggag

SEQ ID NO: 475148 - DNA, 16 bp, R. norvegicus
agagggtggaggaaat

SEQ ID NO: 475149 - DNA, 16 bp, R. norvegicus
agagggtgttccccca

SEQ ID NO: 475150 - DNA, 16 bp, R. norvegicus
agaggtacacccctaa

SEQ ID NO: 475151 - DNA, 16 bp, R. norvegicus
agaggtagaaacagag

SEQ ID NO: 475152 - DNA, 16 bp, R. norvegicus
agaggtagaaagagca

SEQ ID NO: 475153 - DNA, 16 bp, R. norvegicus
agaggtagaggcagag

SEQ ID NO: 475154 - DNA, 16 bp, R. norvegicus
agaggtagtggaaagg

SEQ ID NO: 475155 - DNA, 16 bp, R. norvegicus
agaggtcaaaggtcag

SEQ ID NO: 475156 - DNA, 16 bp, R. norvegicus
agaggtcacagagaat

SEQ ID NO: 475157 - DNA, 16 bp, R. norvegicus
agaggtcacagagagt

SEQ ID NO: 475158 - DNA, 16 bp, R. norvegicus
agaggtcagcagcttc

SEQ ID NO: 475159 - DNA, 16 bp, R. norvegicus
agaggtcatgcagacc

SEQ ID NO: 475160 - DNA, 16 bp, R. norvegicus
agaggtcatggagaag

SEQ ID NO: 475161 - DNA, 16 bp, R. norvegicus
agaggtctcaggggtc

SEQ ID NO: 475162 - DNA, 16 bp, R. norvegicus
agaggtgctggtgttc

SEQ ID NO: 475163 - DNA, 16 bp, R. norvegicus
agaggtggcccagtgg

SEQ ID NO: 475164 - DNA, 16 bp, R. norvegicus
agaggtggctcaggag

SEQ ID NO: 475165 - DNA, 16 bp, R. norvegicus
agaggtggctctgcag

SEQ ID NO: 475166 - DNA, 16 bp, R. norvegicus
agaggtggggacagag

SEQ ID NO: 475167 - DNA, 16 bp, R. norvegicus
agaggtggggctggag

SEQ ID NO: 475168 - DNA, 16 bp, R. norvegicus
agaggtttaatgaaag

SEQ ID NO: 475169 - DNA, 16 bp, R. norvegicus
agaggtttcagagaag

SEQ ID NO: 475170 - DNA, 16 bp, R. norvegicus
agagtaaaaggctgga

SEQ ID NO: 475171 - DNA, 16 bp, R. norvegicus
agagtacctgctgctc

SEQ ID NO: 475172 - DNA, 16 bp, R. norvegicus
agagtagtcaaggttt

SEQ ID NO: 475173 - DNA, 16 bp, R. norvegicus
agagtatgtagtggct

SEQ ID NO: 475174 - DNA, 16 bp, R. norvegicus
agagtatgtcagaagg

SEQ ID NO: 475175 - DNA, 17 bp, R. norvegicus
agagtattcttgttccc

SEQ ID NO: 475176 - DNA, 16 bp, R. norvegicus
agagtcacctgggaaa

SEQ ID NO: 475177 - DNA, 16 bp, R. norvegicus
agagtcacttctctcc

SEQ ID NO: 475178 - DNA, 16 bp, R. norvegicus
agagtcagaggagaga

SEQ ID NO: 475179 - DNA, 16 bp, R. norvegicus
agagtcagagggagag

SEQ ID NO: 475180 - DNA, 16 bp, R. norvegicus
agagtcagagtcagag

SEQ ID NO: 475181 - DNA, 17 bp, R. norvegicus
agagtcatactgattag

SEQ ID NO: 475182 - DNA, 16 bp, R. norvegicus
agagtcatatgcagat

SEQ ID NO: 475183 - DNA, 16 bp, R. norvegicus
agagtcatctgggaaa

SEQ ID NO: 475184 - DNA, 16 bp, R. norvegicus
agagtcattttttttt

SEQ ID NO: 475185 - DNA, 16 bp, R. norvegicus
agagtccagaaaaggg

SEQ ID NO: 475186 - DNA, 16 bp, R. norvegicus
agagtccagaagaggg

SEQ ID NO: 475187 - DNA, 16 bp, R. norvegicus
agagtccagagaacaa

SEQ ID NO: 475188 - DNA, 16 bp, R. norvegicus
agagtcccagtgagga

SEQ ID NO: 475189 - DNA, 16 bp, R. norvegicus
agagtccccaagctcc

SEQ ID NO: 475190 - DNA, 16 bp, R. norvegicus
agagtctcaagagcag

SEQ ID NO: 475191 - DNA, 16 bp, R. norvegicus
agagtctctgttgaga

SEQ ID NO: 475192 - DNA, 16 bp, R. norvegicus
agagtctgaaggaagg

SEQ ID NO: 475193 - DNA, 16 bp, R. norvegicus
agagtctgaggcagag

SEQ ID NO: 475194 - DNA, 16 bp, R. norvegicus
agagtctgcatgacct

SEQ ID NO: 475195 - DNA, 16 bp, R. norvegicus
agagtctgtcttaaaa

SEQ ID NO: 475196 - DNA, 16 bp, R. norvegicus
agagtgaaacaaagaa

SEQ ID NO: 475197 - DNA, 16 bp, R. norvegicus
agagtgaagaatccca

SEQ ID NO: 475198 - DNA, 16 bp, R. norvegicus
agagtgaagactccaa

SEQ ID NO: 475199 - DNA, 16 bp, R. norvegicus
agagtgaagactcccc

SEQ ID NO: 475200 - DNA, 16 bp, R. norvegicus
agagtgaaggctccca

SEQ ID NO: 475201 - DNA, 16 bp, R. norvegicus
agagtgaattccagga

SEQ ID NO: 475202 - DNA, 16 bp, R. norvegicus
agagtgagaccatgtc

SEQ ID NO: 475203 - DNA, 16 bp, R. norvegicus
agagtgagactgtctc

SEQ ID NO: 475204 - DNA, 16 bp, R. norvegicus
agagtgagagagtgag

SEQ ID NO: 475205 - DNA, 16 bp, R. norvegicus
agagtgagagcaagag

SEQ ID NO: 475206 - DNA, 16 bp, R. norvegicus
agagtgagagcgagag

SEQ ID NO: 475207 - DNA, 16 bp, R. norvegicus
agagtgagcaaccttg

SEQ ID NO: 475208 - DNA, 16 bp, R. norvegicus
agagtgagctccaggc

SEQ ID NO: 475209 - DNA, 16 bp, R. norvegicus
agagtgaggagcagca

SEQ ID NO: 475210 - DNA, 16 bp, R. norvegicus
agagtgaggaggagca

SEQ ID NO: 475211 - DNA, 17 bp, R. norvegicus
agagtgagtcttccttc

SEQ ID NO: 475212 - DNA, 16 bp, R. norvegicus
agagtgcatgcctagc

SEQ ID NO: 475213 - DNA, 22 bp, R. norvegicus
agagtgcctttgatcctattcc

SEQ ID NO: 475214 - DNA, 16 bp, R. norvegicus
agagtgctacagaagg

SEQ ID NO: 475215 - DNA, 16 bp, R. norvegicus
agagtgctcttaacca

SEQ ID NO: 475216 - DNA, 16 bp, R. norvegicus
agagtgcttgttgctc

SEQ ID NO: 475217 - DNA, 16 bp, R. norvegicus
agagtggaccagaaaa

SEQ ID NO: 475218 - DNA, 16 bp, R. norvegicus
agagtggagcaaagac

SEQ ID NO: 475219 - DNA, 22 bp, R. norvegicus
agagtggatgtggaatcccact

SEQ ID NO: 475220 - DNA, 16 bp, R. norvegicus
agagtggggaactcat

SEQ ID NO: 475221 - DNA, 16 bp, R. norvegicus
agagtggggtgtggaa

SEQ ID NO: 475222 - DNA, 16 bp, R. norvegicus
agagtggttgtacaag

SEQ ID NO: 475223 - DNA, 16 bp, R. norvegicus
agagtgtcatttcctt

SEQ ID NO: 475224 - DNA, 21 bp, R. norvegicus
agagtgtcctcttgtcctaac

SEQ ID NO: 475225 - DNA, 21 bp, R. norvegicus
agagtgtgcatggcctgactg

SEQ ID NO: 475226 - DNA, 16 bp, R. norvegicus
agagtgtgccagctgc

SEQ ID NO: 475227 - DNA, 16 bp, R. norvegicus
agagtgtggagaaaga

SEQ ID NO: 475228 - DNA, 16 bp, R. norvegicus
agagtgtgtgtgagag

SEQ ID NO: 475229 - DNA, 16 bp, R. norvegicus
agagtgtgtgtgtgag

SEQ ID NO: 475230 - DNA, 16 bp, R. norvegicus
agagtgtgtgttgaca

SEQ ID NO: 475231 - DNA, 16 bp, R. norvegicus
agagtgtttgcttagc

SEQ ID NO: 475232 - DNA, 16 bp, R. norvegicus
agagttaaaaagaaca

SEQ ID NO: 475233 - DNA, 16 bp, R. norvegicus
agagttacaagcagtt

SEQ ID NO: 475234 - DNA, 16 bp, R. norvegicus
agagttacaagtggtt

SEQ ID NO: 475235 - DNA, 16 bp, R. norvegicus
agagttacccaggtgg

SEQ ID NO: 475236 - DNA, 16 bp, R. norvegicus
agagttagaaagagca

SEQ ID NO: 475237 - DNA, 16 bp, R. norvegicus
agagttagaaagggca

SEQ ID NO: 475238 - DNA, 16 bp, R. norvegicus
agagttcaaagacagc

SEQ ID NO: 475239 - DNA, 16 bp, R. norvegicus
agagttcaaagtcagc

SEQ ID NO: 475240 - DNA, 16 bp, R. norvegicus
agagttcaaggccagc

SEQ ID NO: 475241 - DNA, 16 bp, R. norvegicus
agagttcaccaggcag

SEQ ID NO: 475242 - DNA, 16 bp, R. norvegicus
agagttcagaaagaac

SEQ ID NO: 475243 - DNA, 16 bp, R. norvegicus
agagttcatcctggta

SEQ ID NO: 475244 - DNA, 16 bp, R. norvegicus
agagttcatcctggtg

SEQ ID NO: 475245 - DNA, 16 bp, R. norvegicus
agagttcatcttgctg

SEQ ID NO: 475246 - DNA, 16 bp, R. norvegicus
agagttccaggccaac

SEQ ID NO: 475247 - DNA, 16 bp, R. norvegicus
agagttcctcctgcct

SEQ ID NO: 475248 - DNA, 16 bp, R. norvegicus
agagttcctctttctc

SEQ ID NO: 475249 - DNA, 16 bp, R. norvegicus
agagttctacatctgg

SEQ ID NO: 475250 - DNA, 16 bp, R. norvegicus
agagttctcaccagag

SEQ ID NO: 475251 - DNA, 16 bp, R. norvegicus
agagttgagaaccact

SEQ ID NO: 475252 - DNA, 16 bp, R. norvegicus
agagttggaagaagga

SEQ ID NO: 475253 - DNA, 16 bp, R. norvegicus
agagttggaggaagaa

SEQ ID NO: 475254 - DNA, 16 bp, R. norvegicus
agagttgttttggtca

SEQ ID NO: 475255 - DNA, 16 bp, R. norvegicus
agagtttatgaaattc

SEQ ID NO: 475256 - DNA, 16 bp, R. norvegicus
agagtttatttttcat

SEQ ID NO: 475257 - DNA, 18 bp, R. norvegicus
agagtttccagggactaa

SEQ ID NO: 475258 - DNA, 16 bp, R. norvegicus
agagtttgtggagggg

SEQ ID NO: 475259 - DNA, 16 bp, R. norvegicus
agagtttgtggtggct

SEQ ID NO: 475260 - DNA, 16 bp, R. norvegicus
agagttttcctttgat

SEQ ID NO: 475261 - DNA, 16 bp, R. norvegicus
agagttttgttttctt

SEQ ID NO: 475262 - DNA, 16 bp, R. norvegicus
agataaacttgaagca

SEQ ID NO: 475263 - DNA, 16 bp, R. norvegicus
agataacattgatgaa

SEQ ID NO: 475264 - DNA, 16 bp, R. norvegicus
agataacattttaaaa

SEQ ID NO: 475265 - DNA, 16 bp, R. norvegicus
agataaccctatgaaa

SEQ ID NO: 475266 - DNA, 16 bp, R. norvegicus
agataagattgttgaa

SEQ ID NO: 475267 - DNA, 16 bp, R. norvegicus
agataatattgctgat

SEQ ID NO: 475268 - DNA, 16 bp, R. norvegicus
agataatcagatggtg

SEQ ID NO: 475269 - DNA, 16 bp, R. norvegicus
agatacacacatatac

SEQ ID NO: 475270 - DNA, 16 bp, R. norvegicus
agatacagaaagagaa

SEQ ID NO: 475271 - DNA, 16 bp, R. norvegicus
agataccttagaagat

SEQ ID NO: 475272 - DNA, 16 bp, R. norvegicus
agatagaagagaggat

SEQ ID NO: 475273 - DNA, 16 bp, R. norvegicus
agatagaagcatcacc

SEQ ID NO: 475274 - DNA, 16 bp, R. norvegicus
agatagagacagagga

SEQ ID NO: 475275 - DNA, 16 bp, R. norvegicus
agatagatacaaagat

SEQ ID NO: 475276 - DNA, 16 bp, R. norvegicus
agatagatagatggat

SEQ ID NO: 475277 - DNA, 16 bp, R. norvegicus
agatagatggagagat

SEQ ID NO: 475278 - DNA, 16 bp, R. norvegicus
agatagatggatggat

SEQ ID NO: 475279 - DNA, 16 bp, R. norvegicus
agatagcatttcacag

SEQ ID NO: 475280 - DNA, 16 bp, R. norvegicus
agatagcctagaaaaa

SEQ ID NO: 475281 - DNA, 16 bp, R. norvegicus
agataggagagagaat

SEQ ID NO: 475282 - DNA, 16 bp, R. norvegicus
agatataaataactcc

SEQ ID NO: 475283 - DNA, 16 bp, R. norvegicus
agatataaccagatgg

SEQ ID NO: 475284 - DNA, 16 bp, R. norvegicus
agatataagagagaat

SEQ ID NO: 475285 - DNA, 16 bp, R. norvegicus
agatatagacatagac

SEQ ID NO: 475286 - DNA, 16 bp, R. norvegicus
agatatatacatacat

SEQ ID NO: 475287 - DNA, 16 bp, R. norvegicus
agatatatagagatat

SEQ ID NO: 475288 - DNA, 16 bp, R. norvegicus
agatatcagtgtcaga

SEQ ID NO: 475289 - DNA, 16 bp, R. norvegicus
agatatctaccagata

SEQ ID NO: 475290 - DNA, 16 bp, R. norvegicus
agatatcttgggcacc

SEQ ID NO: 475291 - DNA, 16 bp, R. norvegicus
agatatggctttgttg

SEQ ID NO: 475292 - DNA, 16 bp, R. norvegicus
agatattagaagaaat

SEQ ID NO: 475293 - DNA, 16 bp, R. norvegicus
agatattctctctaca

SEQ ID NO: 475294 - DNA, 16 bp, R. norvegicus
agatattctctctata

SEQ ID NO: 475295 - DNA, 16 bp, R. norvegicus
agatatttacactatg

SEQ ID NO: 475296 - DNA, 16 bp, R. norvegicus
agatatttacattgca

SEQ ID NO: 475297 - DNA, 16 bp, R. norvegicus
agatatttagaattga

SEQ ID NO: 475298 - DNA, 18 bp, R. norvegicus
agatatttatagaacatt

SEQ ID NO: 475299 - DNA, 16 bp, R. norvegicus
agatcaaaaactcagt

SEQ ID NO: 475300 - DNA, 16 bp, R. norvegicus
agatcaaggacctcca

SEQ ID NO: 475301 - DNA, 16 bp, R. norvegicus
agatcaatttaaaagt

SEQ ID NO: 475302 - DNA, 16 bp, R. norvegicus
agatcaccaaagacta

SEQ ID NO: 475303 - DNA, 16 bp, R. norvegicus
agatcaccttttttct

SEQ ID NO: 475304 - DNA, 16 bp, R. norvegicus
agatcactatttgcag

SEQ ID NO: 475305 - DNA, 16 bp, R. norvegicus
agatcagaagacaatt

SEQ ID NO: 475306 - DNA, 16 bp, R. norvegicus
agatcagaagtccaag

SEQ ID NO: 475307 - DNA, 16 bp, R. norvegicus
agatcagcaaagatgt

SEQ ID NO: 475308 - DNA, 16 bp, R. norvegicus
agatcagctcctgcag

SEQ ID NO: 475309 - DNA, 16 bp, R. norvegicus
agatcagctgagacat

SEQ ID NO: 475310 - DNA, 16 bp, R. norvegicus
agatcaggacacacag

SEQ ID NO: 475311 - DNA, 16 bp, R. norvegicus
agatcaggagttacag

SEQ ID NO: 475312 - DNA, 16 bp, R. norvegicus
agatcaggttggcctc

SEQ ID NO: 475313 - DNA, 16 bp, R. norvegicus
agatcagtgaagatgt

SEQ ID NO: 475314 - DNA, 16 bp, R. norvegicus
agatcatttatctgat

SEQ ID NO: 475315 - DNA, 16 bp, R. norvegicus
agatccacatgcctct

SEQ ID NO: 475316 - DNA, 16 bp, R. norvegicus
agatccacctacttct

SEQ ID NO: 475317 - DNA, 16 bp, R. norvegicus
agatccacctgcgtct

SEQ ID NO: 475318 - DNA, 16 bp, R. norvegicus
agatccacctgctctg

SEQ ID NO: 475319 - DNA, 16 bp, R. norvegicus
agatccacctgcttct

SEQ ID NO: 475320 - DNA, 16 bp, R. norvegicus
agatccacttgcctct

SEQ ID NO: 475321 - DNA, 16 bp, R. norvegicus
agatccagaaagacaa

SEQ ID NO: 475322 - DNA, 16 bp, R. norvegicus
agatccagaagtgcaa

SEQ ID NO: 475323 - DNA, 16 bp, R. norvegicus
agatccagagctttga

SEQ ID NO: 475324 - DNA, 16 bp, R. norvegicus
agatccagctgaaaga

SEQ ID NO: 475325 - DNA, 16 bp, R. norvegicus
agatccatggggtgta

SEQ ID NO: 475326 - DNA, 16 bp, R. norvegicus
agatcccactgggaga

SEQ ID NO: 475327 - DNA, 16 bp, R. norvegicus
agatcccagagactaa

SEQ ID NO: 475328 - DNA, 16 bp, R. norvegicus
agatccccccagagct

SEQ ID NO: 475329 - DNA, 16 bp, R. norvegicus
agatccctgagttcaa

SEQ ID NO: 475330 - DNA, 16 bp, R. norvegicus
agatccgcctgcctct

SEQ ID NO: 475331 - DNA, 16 bp, R. norvegicus
agatcctcaagcccca

SEQ ID NO: 475332 - DNA, 16 bp, R. norvegicus
agatcctctggaagaa

SEQ ID NO: 475333 - DNA, 16 bp, R. norvegicus
agatcctgggcagaag

SEQ ID NO: 475334 - DNA, 16 bp, R. norvegicus
agatcctgtcccagac

SEQ ID NO: 475335 - DNA, 16 bp, R. norvegicus
agatcctgtcttaaaa

SEQ ID NO: 475336 - DNA, 16 bp, R. norvegicus
agatccttctgcttct

SEQ ID NO: 475337 - DNA, 16 bp, R. norvegicus
agatctacatctgctt

SEQ ID NO: 475338 - DNA, 16 bp, R. norvegicus
agatctaccagcctct

SEQ ID NO: 475339 - DNA, 16 bp, R. norvegicus
agatctattacagaga

SEQ ID NO: 475340 - DNA, 16 bp, R. norvegicus
agatctcagggactaa

SEQ ID NO: 475341 - DNA, 16 bp, R. norvegicus
agatctcatcaagttg

SEQ ID NO: 475342 - DNA, 16 bp, R. norvegicus
agatctccaatttctt

SEQ ID NO: 475343 - DNA, 16 bp, R. norvegicus
agatctccagacagct

SEQ ID NO: 475344 - DNA, 16 bp, R. norvegicus
agatctccctgcctct

SEQ ID NO: 475345 - DNA, 16 bp, R. norvegicus
agatctcggagttcaa

SEQ ID NO: 475346 - DNA, 16 bp, R. norvegicus
agatctctaaactccc

SEQ ID NO: 475347 - DNA, 16 bp, R. norvegicus
agatctctgagctcaa

SEQ ID NO: 475348 - DNA, 16 bp, R. norvegicus
agatctctgaggccag

SEQ ID NO: 475349 - DNA, 16 bp, R. norvegicus
agatctctgagtgtga

SEQ ID NO: 475350 - DNA, 16 bp, R. norvegicus
agatctctggagagca

SEQ ID NO: 475351 - DNA, 16 bp, R. norvegicus
agatctctggggttca

SEQ ID NO: 475352 - DNA, 20 bp, R. norvegicus
agatctgatgccctcttctg

SEQ ID NO: 475353 - DNA, 16 bp, R. norvegicus
agatctgccagcctct

SEQ ID NO: 475354 - DNA, 16 bp, R. norvegicus
agatctgcctcccaag

SEQ ID NO: 475355 - DNA, 16 bp, R. norvegicus
agatctgcctgcctct

SEQ ID NO: 475356 - DNA, 16 bp, R. norvegicus
agatctgcctgctgct

SEQ ID NO: 475357 - DNA, 16 bp, R. norvegicus
agatctgccttcctct

SEQ ID NO: 475358 - DNA, 16 bp, R. norvegicus
agatctgctgccctct

SEQ ID NO: 475359 - DNA, 16 bp, R. norvegicus
agatctgcttggcttt

SEQ ID NO: 475360 - DNA, 16 bp, R. norvegicus
agatctgggagaagtt

SEQ ID NO: 475361 - DNA, 16 bp, R. norvegicus
agatctggtgctctct

SEQ ID NO: 475362 - DNA, 16 bp, R. norvegicus
agatctgtaaagaatt

SEQ ID NO: 475363 - DNA, 16 bp, R. norvegicus
agatctgtcagcctct

SEQ ID NO: 475364 - DNA, 16 bp, R. norvegicus
agatcttagaggagaa

SEQ ID NO: 475365 - DNA, 16 bp, R. norvegicus
agatcttcccacttca

SEQ ID NO: 475366 - DNA, 16 bp, R. norvegicus
agatcttctggagctg

SEQ ID NO: 475367 - DNA, 16 bp, R. norvegicus
agatcttctggccttc

SEQ ID NO: 475368 - DNA, 16 bp, R. norvegicus
agatcttctgggggaa

SEQ ID NO: 475369 - DNA, 20 bp, R. norvegicus
agatcttcttcaagcagttt

SEQ ID NO: 475370 - DNA, 16 bp, R. norvegicus
agatcttgaggctggg

SEQ ID NO: 475371 - DNA, 17 bp, R. norvegicus
agatcttggacagatgt

SEQ ID NO: 475372 - DNA, 16 bp, R. norvegicus
agatcttgtctccaaa

SEQ ID NO: 475373 - DNA, 16 bp, R. norvegicus
agatctttctgaactc

SEQ ID NO: 475374 - DNA, 16 bp, R. norvegicus
agatctttttaaaaat

SEQ ID NO: 475375 - DNA, 16 bp, R. norvegicus
agatgaaaaacctagg

SEQ ID NO: 475376 - DNA, 16 bp, R. norvegicus
agatgaaaaaggagct

SEQ ID NO: 475377 - DNA, 16 bp, R. norvegicus
agatgaaaagattgaa

SEQ ID NO: 475378 - DNA, 16 bp, R. norvegicus
agatgaaagaattgaa

SEQ ID NO: 475379 - DNA, 16 bp, R. norvegicus
agatgaaatccacaga

SEQ ID NO: 475380 - DNA, 16 bp, R. norvegicus
agatgaagaaaaacat

SEQ ID NO: 475381 - DNA, 16 bp, R. norvegicus
agatgaagaaaacaag

SEQ ID NO: 475382 - DNA, 16 bp, R. norvegicus
agatgaagaaacaaag

SEQ ID NO: 475383 - DNA, 16 bp, R. norvegicus
agatgaagaaacagaa

SEQ ID NO: 475384 - DNA, 16 bp, R. norvegicus
agatgaagaaaccaaa

SEQ ID NO: 475385 - DNA, 16 bp, R. norvegicus
agatgaagaaaccaag

SEQ ID NO: 475386 - DNA, 16 bp, R. norvegicus
agatgaagaaatggag

SEQ ID NO: 475387 - DNA, 16 bp, R. norvegicus
agatgaagaagctgag

SEQ ID NO: 475388 - DNA, 16 bp, R. norvegicus
agatgaagacatctac

SEQ ID NO: 475389 - DNA, 16 bp, R. norvegicus
agatgaagatggttgc

SEQ ID NO: 475390 - DNA, 16 bp, R. norvegicus
agatgaagatgtagaa

SEQ ID NO: 475391 - DNA, 16 bp, R. norvegicus
agatgaaggagagcag

SEQ ID NO: 475392 - DNA, 16 bp, R. norvegicus
agatgaatgtgcaaat

SEQ ID NO: 475393 - DNA, 16 bp, R. norvegicus
agatgaattaaatgca

SEQ ID NO: 475394 - DNA, 16 bp, R. norvegicus
agatgaatttaagaat

SEQ ID NO: 475395 - DNA, 16 bp, R. norvegicus
agatgacatgattgta

SEQ ID NO: 475396 - DNA, 16 bp, R. norvegicus
agatgacattgtgttg

SEQ ID NO: 475397 - DNA, 16 bp, R. norvegicus
agatgacctcagaaga

SEQ ID NO: 475398 - DNA, 16 bp, R. norvegicus
agatgacctcatacca

SEQ ID NO: 475399 - DNA, 16 bp, R. norvegicus
agatgactcagtggct

SEQ ID NO: 475400 - DNA, 16 bp, R. norvegicus
agatgactcggtggtt

SEQ ID NO: 475401 - DNA, 16 bp, R. norvegicus
agatgagaaaactgag

SEQ ID NO: 475402 - DNA, 16 bp, R. norvegicus
agatgagaaaatggag

SEQ ID NO: 475403 - DNA, 16 bp, R. norvegicus
agatgagacagagaga

SEQ ID NO: 475404 - DNA, 16 bp, R. norvegicus
agatgagcaaactgag

SEQ ID NO: 475405 - DNA, 16 bp, R. norvegicus
agatgagcagcttggt

SEQ ID NO: 475406 - DNA, 16 bp, R. norvegicus
agatgaggaaattgag

SEQ ID NO: 475407 - DNA, 16 bp, R. norvegicus
agatgaggaagctgag

SEQ ID NO: 475408 - DNA, 16 bp, R. norvegicus
agatgaggcagtctct

SEQ ID NO: 475409 - DNA, 16 bp, R. norvegicus
agatgaggctcccaac

SEQ ID NO: 475410 - DNA, 16 bp, R. norvegicus
agatgagggctggaga

SEQ ID NO: 475411 - DNA, 16 bp, R. norvegicus
agatgagtggattaga

SEQ ID NO: 475412 - DNA, 16 bp, R. norvegicus
agatgataagataata

SEQ ID NO: 475413 - DNA, 16 bp, R. norvegicus
agatgatgaccagggt

SEQ ID NO: 475414 - DNA, 18 bp, R. norvegicus
agatgatgatgatgatgg

SEQ ID NO: 475415 - DNA, 16 bp, R. norvegicus
agatgatgatgatggt

SEQ ID NO: 475416 - DNA, 16 bp, R. norvegicus
agatgatggccttgtt

SEQ ID NO: 475417 - DNA, 16 bp, R. norvegicus
agatgatggtgatggt

SEQ ID NO: 475418 - DNA, 16 bp, R. norvegicus
agatgatgtagatgat

SEQ ID NO: 475419 - DNA, 16 bp, R. norvegicus
agatgatgtttttgat

SEQ ID NO: 475420 - DNA, 16 bp, R. norvegicus
agatgattttaaaaat

SEQ ID NO: 475421 - DNA, 16 bp, R. norvegicus
agatgcaatccacaaa

SEQ ID NO: 475422 - DNA, 16 bp, R. norvegicus
agatgcacagaataca

SEQ ID NO: 475423 - DNA, 16 bp, R. norvegicus
agatgcagagacccac

SEQ ID NO: 475424 - DNA, 16 bp, R. norvegicus
agatgcagagagagac

SEQ ID NO: 475425 - DNA, 16 bp, R. norvegicus
agatgcagatatccac

SEQ ID NO: 475426 - DNA, 16 bp, R. norvegicus
agatgcagctcccagg

SEQ ID NO: 475427 - DNA, 16 bp, R. norvegicus
agatgccaagaagtga

SEQ ID NO: 475428 - DNA, 16 bp, R. norvegicus
agatgccagcaccatg

SEQ ID NO: 475429 - DNA, 16 bp, R. norvegicus
agatgccaggaccatg

SEQ ID NO: 475430 - DNA, 16 bp, R. norvegicus
agatgccagtactatg

SEQ ID NO: 475431 - DNA, 16 bp, R. norvegicus
agatgccatggagcag

SEQ ID NO: 475432 - DNA, 21 bp, R. norvegicus
agatgcccagaagctgctgct

SEQ ID NO: 475433 - DNA, 34 bp, R. norvegicus
agatgcccagaagctgctgctgtagtaggaggca

SEQ ID NO: 475434 - DNA, 16 bp, R. norvegicus
agatgccccaccatgt

SEQ ID NO: 475435 - DNA, 16 bp, R. norvegicus
agatgcccctgcctct

SEQ ID NO: 475436 - DNA, 86 bp, R. norvegicus
agatgcccttcaacagaggaatggatacagaaaatgtggtacatctacacaatggaatattactcagctatcaaaaacaacgagtc

SEQ ID NO: 475437 - DNA, 17 bp, R. norvegicus
agatgcccttcagcaga

SEQ ID NO: 475438 - DNA, 16 bp, R. norvegicus
agatgcccttcatcag

SEQ ID NO: 475439 - DNA, 16 bp, R. norvegicus
agatgcccttgcagca

SEQ ID NO: 475440 - DNA, 16 bp, R. norvegicus
agatgcctgcagccaa

SEQ ID NO: 475441 - DNA, 16 bp, R. norvegicus
agatgcctggaagtca

SEQ ID NO: 475442 - DNA, 16 bp, R. norvegicus
agatgccttcttttgc

SEQ ID NO: 475443 - DNA, 16 bp, R. norvegicus
agatgcgcctgcctct

SEQ ID NO: 475444 - DNA, 16 bp, R. norvegicus
agatgctagagcagtg

SEQ ID NO: 475445 - DNA, 16 bp, R. norvegicus
agatgctcccagccaa

SEQ ID NO: 475446 - DNA, 16 bp, R. norvegicus
agatgctgaaaaatat

SEQ ID NO: 475447 - DNA, 16 bp, R. norvegicus
agatgctgaaaaggca

SEQ ID NO: 475448 - DNA, 16 bp, R. norvegicus
agatgctgaagaggat

SEQ ID NO: 475449 - DNA, 16 bp, R. norvegicus
agatgctgacaaagca

SEQ ID NO: 475450 - DNA, 16 bp, R. norvegicus
agatgctgagaaaaag

SEQ ID NO: 475451 - DNA, 16 bp, R. norvegicus
agatgctgagaaagaa

SEQ ID NO: 475452 - DNA, 16 bp, R. norvegicus
agatgctgagaagaag

SEQ ID NO: 475453 - DNA, 16 bp, R. norvegicus
agatgctgagaatgca

SEQ ID NO: 475454 - DNA, 16 bp, R. norvegicus
agatgctgagggtccc

SEQ ID NO: 475455 - DNA, 16 bp, R. norvegicus
agatgctggagagaat

SEQ ID NO: 475456 - DNA, 16 bp, R. norvegicus
agatgctggagagatg

SEQ ID NO: 475457 - DNA, 16 bp, R. norvegicus
agatgctggtaaggat

SEQ ID NO: 475458 - DNA, 16 bp, R. norvegicus
agatgctggtgaggat

SEQ ID NO: 475459 - DNA, 16 bp, R. norvegicus
agatgctggtgtggat

SEQ ID NO: 475460 - DNA, 16 bp, R. norvegicus
agatgcttctctgatg

SEQ ID NO: 475461 - DNA, 16 bp, R. norvegicus
agatgctttcagccaa

SEQ ID NO: 475462 - DNA, 16 bp, R. norvegicus
agatgcttttcagttt

SEQ ID NO: 475463 - DNA, 16 bp, R. norvegicus
agatggaaaaactgag

SEQ ID NO: 475464 - DNA, 16 bp, R. norvegicus
agatggaaagaaccca

SEQ ID NO: 475465 - DNA, 16 bp, R. norvegicus
agatggaaggcagaga

SEQ ID NO: 475466 - DNA, 16 bp, R. norvegicus
agatggaagggagaat

SEQ ID NO: 475467 - DNA, 16 bp, R. norvegicus
agatggactctacaag

SEQ ID NO: 475468 - DNA, 16 bp, R. norvegicus
agatggagaaaaaaca

SEQ ID NO: 475469 - DNA, 16 bp, R. norvegicus
agatggagaaaaacaa

SEQ ID NO: 475470 - DNA, 16 bp, R. norvegicus
agatggagaaactaaa

SEQ ID NO: 475471 - DNA, 16 bp, R. norvegicus
agatggagaaagatga

SEQ ID NO: 475472 - DNA, 16 bp, R. norvegicus
agatggagaaatggct

SEQ ID NO: 475473 - DNA, 16 bp, R. norvegicus
agatggagacagagag

SEQ ID NO: 475474 - DNA, 16 bp, R. norvegicus
agatggagacagagga

SEQ ID NO: 475475 - DNA, 16 bp, R. norvegicus
agatggagacggagaa

SEQ ID NO: 475476 - DNA, 16 bp, R. norvegicus
agatggagactggaaa

SEQ ID NO: 475477 - DNA, 16 bp, R. norvegicus
agatggagagaaactt

SEQ ID NO: 475478 - DNA, 16 bp, R. norvegicus
agatggagcagaacca

SEQ ID NO: 475479 - DNA, 16 bp, R. norvegicus
agatggagcttgggga

SEQ ID NO: 475480 - DNA, 16 bp, R. norvegicus
agatggaggaagcaaa

SEQ ID NO: 475481 - DNA, 16 bp, R. norvegicus
agatggaggcaggtgg

SEQ ID NO: 475482 - DNA, 16 bp, R. norvegicus
agatggaggtggcaaa

SEQ ID NO: 475483 - DNA, 16 bp, R. norvegicus
agatggagtaaccaag

SEQ ID NO: 475484 - DNA, 16 bp, R. norvegicus
agatggagtccatctg

SEQ ID NO: 475485 - DNA, 16 bp, R. norvegicus
agatggatgaagcaga

SEQ ID NO: 475486 - DNA, 16 bp, R. norvegicus
agatggcaagaagcaa

SEQ ID NO: 475487 - DNA, 16 bp, R. norvegicus
agatggcacagcaggt

SEQ ID NO: 475488 - DNA, 16 bp, R. norvegicus
agatggccagttcagg

SEQ ID NO: 475489 - DNA, 16 bp, R. norvegicus
agatggcccagcagct

SEQ ID NO: 475490 - DNA, 16 bp, R. norvegicus
agatggcctttggtgt

SEQ ID NO: 475491 - DNA, 16 bp, R. norvegicus
agatggctcagcagat

SEQ ID NO: 475492 - DNA, 16 bp, R. norvegicus
agatggctcagtagat

SEQ ID NO: 475493 - DNA, 16 bp, R. norvegicus
agatggctcagtagtt

SEQ ID NO: 475494 - DNA, 16 bp, R. norvegicus
agatggctcagtgggt

SEQ ID NO: 475495 - DNA, 16 bp, R. norvegicus
agatggctccgtggat

SEQ ID NO: 475496 - DNA, 16 bp, R. norvegicus
agatggctctgtggtt

SEQ ID NO: 475497 - DNA, 16 bp, R. norvegicus
agatggctgagtggtt

SEQ ID NO: 475498 - DNA, 16 bp, R. norvegicus
agatggctggagagat

SEQ ID NO: 475499 - DNA, 16 bp, R. norvegicus
agatggctgtgggcca

SEQ ID NO: 475500 - DNA, 16 bp, R. norvegicus
agatggcttaatggtt

SEQ ID NO: 475501 - DNA, 16 bp, R. norvegicus
agatgggaaaccagga

SEQ ID NO: 475502 - DNA, 16 bp, R. norvegicus
agatgggagagagaat

SEQ ID NO: 475503 - DNA, 16 bp, R. norvegicus
agatgggcaggacagg

SEQ ID NO: 475504 - DNA, 16 bp, R. norvegicus
agatgggcaggtagat

SEQ ID NO: 475505 - DNA, 16 bp, R. norvegicus
agatgggctttgaggt

SEQ ID NO: 475506 - DNA, 16 bp, R. norvegicus
agatggggatggagat

SEQ ID NO: 475507 - DNA, 16 bp, R. norvegicus
agatgggggctggaga

SEQ ID NO: 475508 - DNA, 16 bp, R. norvegicus
agatgggtctcaagtt

SEQ ID NO: 475509 - DNA, 16 bp, R. norvegicus
agatgggtgaagcaaa

SEQ ID NO: 475510 - DNA, 16 bp, R. norvegicus
agatgggtgtgtacag

SEQ ID NO: 475511 - DNA, 16 bp, R. norvegicus
agatggtagtgagcca

SEQ ID NO: 475512 - DNA, 16 bp, R. norvegicus
agatggtccagcagtt

SEQ ID NO: 475513 - DNA, 16 bp, R. norvegicus
agatggtcgtgagcca

SEQ ID NO: 475514 - DNA, 16 bp, R. norvegicus
agatggtgaaaccaag

SEQ ID NO: 475515 - DNA, 16 bp, R. norvegicus
agatggtgagaagaag

SEQ ID NO: 475516 - DNA, 16 bp, R. norvegicus
agatggtgcagcagtt

SEQ ID NO: 475517 - DNA, 16 bp, R. norvegicus
agatggttccacagac

SEQ ID NO: 475518 - DNA, 16 bp, R. norvegicus
agatggttgagagcca

SEQ ID NO: 475519 - DNA, 33 bp, R. norvegicus
agatggttgtgagccaccatgtggttgctggga

SEQ ID NO: 475520 - DNA, 16 bp, R. norvegicus
agatggttttcaaaaa

SEQ ID NO: 475521 - DNA, 16 bp, R. norvegicus
agatggttttgagcca

SEQ ID NO: 475522 - DNA, 16 bp, R. norvegicus
agatgtacatgcaggc

SEQ ID NO: 475523 - DNA, 16 bp, R. norvegicus
agatgtagaaaaggcc

SEQ ID NO: 475524 - DNA, 16 bp, R. norvegicus
agatgtagaactctca

SEQ ID NO: 475525 - DNA, 16 bp, R. norvegicus
agatgtagacagaata

SEQ ID NO: 475526 - DNA, 16 bp, R. norvegicus
agatgtagagtttgga

SEQ ID NO: 475527 - DNA, 16 bp, R. norvegicus
agatgtccctaaacag

SEQ ID NO: 475528 - DNA, 16 bp, R. norvegicus
agatgtcctgagttca

SEQ ID NO: 475529 - DNA, 16 bp, R. norvegicus
agatgtccttcaagag

SEQ ID NO: 475530 - DNA, 16 bp, R. norvegicus
agatgtccttcaatgg

SEQ ID NO: 475531 - DNA, 16 bp, R. norvegicus
agatgtctccatccca

SEQ ID NO: 475532 - DNA, 16 bp, R. norvegicus
agatgtctctcaactg

SEQ ID NO: 475533 - DNA, 16 bp, R. norvegicus
agatgtctgtctgtct

SEQ ID NO: 475534 - DNA, 16 bp, R. norvegicus
agatgtgaagttcttg

SEQ ID NO: 475535 - DNA, 16 bp, R. norvegicus
agatgtgatgctggag

SEQ ID NO: 475536 - DNA, 16 bp, R. norvegicus
agatgtgatttttaat

SEQ ID NO: 475537 - DNA, 16 bp, R. norvegicus
agatgtgctcactggc

SEQ ID NO: 475538 - DNA, 16 bp, R. norvegicus
agatgtgctgccaagg

SEQ ID NO: 475539 - DNA, 16 bp, R. norvegicus
agatgtggaaatggca

SEQ ID NO: 475540 - DNA, 16 bp, R. norvegicus
agatgtggatgcttag

SEQ ID NO: 475541 - DNA, 16 bp, R. norvegicus
agatgtggctcagtga

SEQ ID NO: 475542 - DNA, 16 bp, R. norvegicus
agatgtgggccaccac

SEQ ID NO: 475543 - DNA, 16 bp, R. norvegicus
agatgtgggttaaccc

SEQ ID NO: 475544 - DNA, 16 bp, R. norvegicus
agatgtgtaccaggct

SEQ ID NO: 475545 - DNA, 16 bp, R. norvegicus
agatgtgtgtgtgtgt

SEQ ID NO: 475546 - DNA, 16 bp, R. norvegicus
agatgtgtttcttgta

SEQ ID NO: 475547 - DNA, 16 bp, R. norvegicus
agatgtgtttttaaat

SEQ ID NO: 475548 - DNA, 16 bp, R. norvegicus
agatgttaaagatgcc

SEQ ID NO: 475549 - DNA, 16 bp, R. norvegicus
agatgttattttaaat

SEQ ID NO: 475550 - DNA, 16 bp, R. norvegicus
agatgttccacatttt

SEQ ID NO: 475551 - DNA, 16 bp, R. norvegicus
agatgttcctcaactg

SEQ ID NO: 475552 - DNA, 16 bp, R. norvegicus
agatgttctacaaact

SEQ ID NO: 475553 - DNA, 16 bp, R. norvegicus
agatgttgaaaatttc

SEQ ID NO: 475554 - DNA, 16 bp, R. norvegicus
agatgttggagaggat

SEQ ID NO: 475555 - DNA, 16 bp, R. norvegicus
agatgtttcctccagt

SEQ ID NO: 475556 - DNA, 16 bp, R. norvegicus
agatgttttgatttgc

SEQ ID NO: 475557 - DNA, 16 bp, R. norvegicus
agatgtttttcaaaaa

SEQ ID NO: 475558 - DNA, 16 bp, R. norvegicus
agattaaaaaactgga

SEQ ID NO: 475559 - DNA, 17 bp, R. norvegicus
agattaaaagctgcttt

SEQ ID NO: 475560 - DNA, 16 bp, R. norvegicus
agattaaaataaatgg

SEQ ID NO: 475561 - DNA, 16 bp, R. norvegicus
agattaatacagagac

SEQ ID NO: 475562 - DNA, 16 bp, R. norvegicus
agattattacaagatt

SEQ ID NO: 475563 - DNA, 16 bp, R. norvegicus
agattatttttcaaaa

SEQ ID NO: 475564 - DNA, 16 bp, R. norvegicus
agattcaatgcaatgc

SEQ ID NO: 475565 - DNA, 16 bp, R. norvegicus
agattcaatgtgatcc

SEQ ID NO: 475566 - DNA, 16 bp, R. norvegicus
agattcacaggaaatt

SEQ ID NO: 475567 - DNA, 16 bp, R. norvegicus
agattcatgtatttga

SEQ ID NO: 475568 - DNA, 16 bp, R. norvegicus
agattccagagagtca

SEQ ID NO: 475569 - DNA, 16 bp, R. norvegicus
agattccaggaagttt

SEQ ID NO: 475570 - DNA, 16 bp, R. norvegicus
agattcccagaaccca

SEQ ID NO: 475571 - DNA, 16 bp, R. norvegicus
agattccctcttccca

SEQ ID NO: 475572 - DNA, 16 bp, R. norvegicus
agattctaatttaaaa

SEQ ID NO: 475573 - DNA, 16 bp, R. norvegicus
agattctcccagcatc

SEQ ID NO: 475574 - DNA, 16 bp, R. norvegicus
agattctctggaagag

SEQ ID NO: 475575 - DNA, 16 bp, R. norvegicus
agattctggcgaggat

SEQ ID NO: 475576 - DNA, 16 bp, R. norvegicus
agattctgtttccatg

SEQ ID NO: 475577 - DNA, 16 bp, R. norvegicus
agattgacaaaccctt

SEQ ID NO: 475578 - DNA, 16 bp, R. norvegicus
agattgcactggaaga

SEQ ID NO: 475579 - DNA, 16 bp, R. norvegicus
agattgcttctgggtt

SEQ ID NO: 475580 - DNA, 16 bp, R. norvegicus
agattggaaaagagga

SEQ ID NO: 475581 - DNA, 16 bp, R. norvegicus
agattggcctgtgggt

SEQ ID NO: 475582 - DNA, 16 bp, R. norvegicus
agattggccttgaact

SEQ ID NO: 475583 - DNA, 16 bp, R. norvegicus
agattgggaaaaaata

SEQ ID NO: 475584 - DNA, 31 bp, R. norvegicus
agattgggaaaagatcgttaccaatcctaca

SEQ ID NO: 475585 - DNA, 16 bp, R. norvegicus
agattgggaaaatatt

SEQ ID NO: 475586 - DNA, 16 bp, R. norvegicus
agattgggaaagatct

SEQ ID NO: 475587 - DNA, 16 bp, R. norvegicus
agattggggaaaaaac

SEQ ID NO: 475588 - DNA, 16 bp, R. norvegicus
agattggggaaagatc

SEQ ID NO: 475589 - DNA, 16 bp, R. norvegicus
agattgttggacaaaa

SEQ ID NO: 475590 - DNA, 16 bp, R. norvegicus
agattgtttctctttt

SEQ ID NO: 475591 - DNA, 16 bp, R. norvegicus
agatttaaaataacat

SEQ ID NO: 475592 - DNA, 16 bp, R. norvegicus
agatttaaaatcaaat

SEQ ID NO: 475593 - DNA, 16 bp, R. norvegicus
agatttaacattttct

SEQ ID NO: 475594 - DNA, 16 bp, R. norvegicus
agatttaatattttct

SEQ ID NO: 475595 - DNA, 16 bp, R. norvegicus
agatttatttactttt

SEQ ID NO: 475596 - DNA, 16 bp, R. norvegicus
agatttcaacaaccca

SEQ ID NO: 475597 - DNA, 16 bp, R. norvegicus
agatttcaccacccca

SEQ ID NO: 475598 - DNA, 16 bp, R. norvegicus
agatttcatgggtaca

SEQ ID NO: 475599 - DNA, 16 bp, R. norvegicus
agatttcatttttttc

SEQ ID NO: 475600 - DNA, 16 bp, R. norvegicus
agatttccaacttaaa

SEQ ID NO: 475601 - DNA, 16 bp, R. norvegicus
agatttccaatggagg

SEQ ID NO: 475602 - DNA, 16 bp, R. norvegicus
agatttctccattttc

SEQ ID NO: 475603 - DNA, 16 bp, R. norvegicus
agatttctctgagttc

SEQ ID NO: 475604 - DNA, 16 bp, R. norvegicus
agatttctctgttgag

SEQ ID NO: 475605 - DNA, 16 bp, R. norvegicus
agatttctttcttcag

SEQ ID NO: 475606 - DNA, 16 bp, R. norvegicus
agatttggatttaaaa

SEQ ID NO: 475607 - DNA, 16 bp, R. norvegicus
agatttggcccaaact

SEQ ID NO: 475608 - DNA, 16 bp, R. norvegicus
agatttgtgattcttt

SEQ ID NO: 475609 - DNA, 16 bp, R. norvegicus
agatttgtggccatca

SEQ ID NO: 475610 - DNA, 16 bp, R. norvegicus
agattttagccagaga

SEQ ID NO: 475611 - DNA, 16 bp, R. norvegicus
agattttatttccttc

SEQ ID NO: 475612 - DNA, 16 bp, R. norvegicus
agattttcaagaatgt

SEQ ID NO: 475613 - DNA, 16 bp, R. norvegicus
agattttcacttgctt

SEQ ID NO: 475614 - DNA, 16 bp, R. norvegicus
agattttgaaagaaaa

SEQ ID NO: 475615 - DNA, 16 bp, R. norvegicus
agattttgtgaacatg

SEQ ID NO: 475616 - DNA, 16 bp, R. norvegicus
agatttttcagtttta

SEQ ID NO: 475617 - DNA, 16 bp, R. norvegicus
agattttttttctcca

SEQ ID NO: 475618 - DNA, 16 bp, R. norvegicus
agcaaaaacagaggcg

SEQ ID NO: 475619 - DNA, 16 bp, R. norvegicus
agcaaaaatccaccaa

SEQ ID NO: 475620 - DNA, 16 bp, R. norvegicus
agcaaaacaattccta

SEQ ID NO: 475621 - DNA, 16 bp, R. norvegicus
agcaaaaccttcagag

SEQ ID NO: 475622 - DNA, 16 bp, R. norvegicus
agcaaaacttttaatc

SEQ ID NO: 475623 - DNA, 16 bp, R. norvegicus
agcaaaagaaggccta

SEQ ID NO: 475624 - DNA, 16 bp, R. norvegicus
agcaaaagacactgtc

SEQ ID NO: 475625 - DNA, 16 bp, R. norvegicus
agcaaaatttaaatct

SEQ ID NO: 475626 - DNA, 16 bp, R. norvegicus
agcaaacacacccaga

SEQ ID NO: 475627 - DNA, 16 bp, R. norvegicus
agcaaacagcaaacag

SEQ ID NO: 475628 - DNA, 16 bp, R. norvegicus
agcaaacatggaatat

SEQ ID NO: 475629 - DNA, 16 bp, R. norvegicus
agcaaaccagcaagca

SEQ ID NO: 475630 - DNA, 17 bp, R. norvegicus
agcaaaccatcgaactg

SEQ ID NO: 475631 - DNA, 16 bp, R. norvegicus
agcaaacgcaaggccc

SEQ ID NO: 475632 - DNA, 16 bp, R. norvegicus
agcaaactccaggcca

SEQ ID NO: 475633 - DNA, 16 bp, R. norvegicus
agcaaactgaaagaaa

SEQ ID NO: 475634 - DNA, 16 bp, R. norvegicus
agcaaacttgaggctc

SEQ ID NO: 475635 - DNA, 16 bp, R. norvegicus
agcaaagaaatcaaac

SEQ ID NO: 475636 - DNA, 16 bp, R. norvegicus
agcaaagaagtgaaga

SEQ ID NO: 475637 - DNA, 16 bp, R. norvegicus
agcaaagaagtgcagt

SEQ ID NO: 475638 - DNA, 16 bp, R. norvegicus
agcaaagaagtgcata

SEQ ID NO: 475639 - DNA, 16 bp, R. norvegicus
agcaaagaagtggagg

SEQ ID NO: 475640 - DNA, 16 bp, R. norvegicus
agcaaagacatgagac

SEQ ID NO: 475641 - DNA, 16 bp, R. norvegicus
agcaaagcagtgcaga

SEQ ID NO: 475642 - DNA, 16 bp, R. norvegicus
agcaaagcagtgcagg

SEQ ID NO: 475643 - DNA, 16 bp, R. norvegicus
agcaaagcatcatggg

SEQ ID NO: 475644 - DNA, 16 bp, R. norvegicus
agcaaaggcaggagaa

SEQ ID NO: 475645 - DNA, 16 bp, R. norvegicus
agcaaaggggataaca

SEQ ID NO: 475646 - DNA, 16 bp, R. norvegicus
agcaaagtgaagatca

SEQ ID NO: 475647 - DNA, 16 bp, R. norvegicus
agcaaatacatgcaag

SEQ ID NO: 475648 - DNA, 16 bp, R. norvegicus
agcaaatagtcccaag

SEQ ID NO: 475649 - DNA, 16 bp, R. norvegicus
agcaaatccaagaaca

SEQ ID NO: 475650 - DNA, 29 bp, R. norvegicus
agcaaatcgaagaagagagatgctgctga

SEQ ID NO: 475651 - DNA, 16 bp, R. norvegicus
agcaaatgctgttgag

SEQ ID NO: 475652 - DNA, 51 bp, R. norvegicus
agcaaatggatgcaacacctgagctgcctctctctcaagaagaatatgagg

SEQ ID NO: 475653 - DNA, 17 bp, R. norvegicus
agcaaatggatggaact

SEQ ID NO: 475654 - DNA, 16 bp, R. norvegicus
agcaaattccaggaca

SEQ ID NO: 475655 - DNA, 16 bp, R. norvegicus
agcaacaacaacaact

SEQ ID NO: 475656 - DNA, 16 bp, R. norvegicus
agcaacaacagcaata

SEQ ID NO: 475657 - DNA, 16 bp, R. norvegicus
agcaacaagtgctcct

SEQ ID NO: 475658 - DNA, 16 bp, R. norvegicus
agcaacagaaagtaaa

SEQ ID NO: 475659 - DNA, 16 bp, R. norvegicus
agcaacagaaagtaac

SEQ ID NO: 475660 - DNA, 16 bp, R. norvegicus
agcaacagaaatgaag

SEQ ID NO: 475661 - DNA, 16 bp, R. norvegicus
agcaacagaaggaaca

SEQ ID NO: 475662 - DNA, 16 bp, R. norvegicus
agcaacagcagcagaa

SEQ ID NO: 475663 - DNA, 16 bp, R. norvegicus
agcaacagcagcagca

SEQ ID NO: 475664 - DNA, 16 bp, R. norvegicus
agcaacagcagcagct

SEQ ID NO: 475665 - DNA, 16 bp, R. norvegicus
agcaacagcagtgaca

SEQ ID NO: 475666 - DNA, 17 bp, R. norvegicus
agcaacagcttttccag

SEQ ID NO: 475667 - DNA, 16 bp, R. norvegicus
agcaacaggaagcaga

SEQ ID NO: 475668 - DNA, 24 bp, R. norvegicus
agcaacagggtggtggacctcatg

SEQ ID NO: 475669 - DNA, 16 bp, R. norvegicus
agcaacagtgactggg

SEQ ID NO: 475670 - DNA, 16 bp, R. norvegicus
agcaacagtgtactca

SEQ ID NO: 475671 - DNA, 21 bp, R. norvegicus
agcaaccaacagattgggaaa

SEQ ID NO: 475672 - DNA, 16 bp, R. norvegicus
agcaaccaacagtcct

SEQ ID NO: 475673 - DNA, 16 bp, R. norvegicus
agcaaccacacagtga

SEQ ID NO: 475674 - DNA, 16 bp, R. norvegicus
agcaaccagagctcca

SEQ ID NO: 475675 - DNA, 16 bp, R. norvegicus
agcaaccagccaacca

SEQ ID NO: 475676 - DNA, 16 bp, R. norvegicus
agcaaccaggaagatc

SEQ ID NO: 475677 - DNA, 16 bp, R. norvegicus
agcaaccaggaagcct

SEQ ID NO: 475678 - DNA, 17 bp, R. norvegicus
agcaaccaggaagttct

SEQ ID NO: 475679 - DNA, 16 bp, R. norvegicus
agcaaccatagcttcc

SEQ ID NO: 475680 - DNA, 16 bp, R. norvegicus
agcaaccatgaagatc

SEQ ID NO: 475681 - DNA, 16 bp, R. norvegicus
agcaacctggagagga

SEQ ID NO: 475682 - DNA, 16 bp, R. norvegicus
agcaaccttcctgcaa

SEQ ID NO: 475683 - DNA, 16 bp, R. norvegicus
agcaactgaagaagac

SEQ ID NO: 475684 - DNA, 16 bp, R. norvegicus
agcaactgaagcagca

SEQ ID NO: 475685 - DNA, 16 bp, R. norvegicus
agcaacttgggggagg

SEQ ID NO: 475686 - DNA, 16 bp, R. norvegicus
agcaactttgaggcca

SEQ ID NO: 475687 - DNA, 16 bp, R. norvegicus
agcaacttttcatttt

SEQ ID NO: 475688 - DNA, 16 bp, R. norvegicus
agcaagaaaaagctgt

SEQ ID NO: 475689 - DNA, 17 bp, R. norvegicus
agcaagaaactaatcat

SEQ ID NO: 475690 - DNA, 16 bp, R. norvegicus
agcaagaccctgtttc

SEQ ID NO: 475691 - DNA, 16 bp, R. norvegicus
agcaagagagcaagag

SEQ ID NO: 475692 - DNA, 16 bp, R. norvegicus
agcaagagagtgagga

SEQ ID NO: 475693 - DNA, 16 bp, R. norvegicus
agcaagagcaagaaca

SEQ ID NO: 475694 - DNA, 16 bp, R. norvegicus
agcaagagcagctaac

SEQ ID NO: 475695 - DNA, 16 bp, R. norvegicus
agcaagagcaggagga

SEQ ID NO: 475696 - DNA, 16 bp, R. norvegicus
agcaagaggaagcagg

SEQ ID NO: 475697 - DNA, 16 bp, R. norvegicus
agcaagaggcaagtgc

SEQ ID NO: 475698 - DNA, 16 bp, R. norvegicus
agcaagatgcccaaag

SEQ ID NO: 475699 - DNA, 16 bp, R. norvegicus
agcaagatggggagga

SEQ ID NO: 475700 - DNA, 16 bp, R. norvegicus
agcaagcacaaggccc

SEQ ID NO: 475701 - DNA, 16 bp, R. norvegicus
agcaagcacacccaag

SEQ ID NO: 475702 - DNA, 16 bp, R. norvegicus
agcaagcacgaggccc

SEQ ID NO: 475703 - DNA, 16 bp, R. norvegicus
agcaagcagagcaagc

SEQ ID NO: 475704 - DNA, 16 bp, R. norvegicus
agcaagcaggcaaaga

SEQ ID NO: 475705 - DNA, 16 bp, R. norvegicus
agcaagcagtgctctt

SEQ ID NO: 475706 - DNA, 16 bp, R. norvegicus
agcaagccagcaagcc

SEQ ID NO: 475707 - DNA, 16 bp, R. norvegicus
agcaagccagcaggca

SEQ ID NO: 475708 - DNA, 16 bp, R. norvegicus
agcaagccagccagca

SEQ ID NO: 475709 - DNA, 16 bp, R. norvegicus
agcaagccagtaacat

SEQ ID NO: 475710 - DNA, 16 bp, R. norvegicus
agcaagccagtaagca

SEQ ID NO: 475711 - DNA, 16 bp, R. norvegicus
agcaagccagtagcca

SEQ ID NO: 475712 - DNA, 16 bp, R. norvegicus
agcaagccagtcagca

SEQ ID NO: 475713 - DNA, 16 bp, R. norvegicus
agcaagccatggaaag

SEQ ID NO: 475714 - DNA, 16 bp, R. norvegicus
agcaagcccacagcca

SEQ ID NO: 475715 - DNA, 16 bp, R. norvegicus
agcaagccccagggac

SEQ ID NO: 475716 - DNA, 16 bp, R. norvegicus
agcaagccctctacca

SEQ ID NO: 475717 - DNA, 16 bp, R. norvegicus
agcaagccctggatac

SEQ ID NO: 475718 - DNA, 17 bp, R. norvegicus
agcaagcgcaaggacct

SEQ ID NO: 475719 - DNA, 20 bp, R. norvegicus
agcaagcgctctaccactga

SEQ ID NO: 475720 - DNA, 18 bp, R. norvegicus
agcaagctgagcaagcca

SEQ ID NO: 475721 - DNA, 16 bp, R. norvegicus
agcaagctgctgcagg

SEQ ID NO: 475722 - DNA, 16 bp, R. norvegicus
agcaagctggagcagc

SEQ ID NO: 475723 - DNA, 16 bp, R. norvegicus
agcaagctggaggagc

SEQ ID NO: 475724 - DNA, 16 bp, R. norvegicus
agcaaggaagtgcaga

SEQ ID NO: 475725 - DNA, 16 bp, R. norvegicus
agcaaggacacatgtt

SEQ ID NO: 475726 - DNA, 16 bp, R. norvegicus
agcaaggaggagactg

SEQ ID NO: 475727 - DNA, 16 bp, R. norvegicus
agcaaggcagagggag

SEQ ID NO: 475728 - DNA, 16 bp, R. norvegicus
agcaaggccattctct

SEQ ID NO: 475729 - DNA, 16 bp, R. norvegicus
agcaaggctgtcctct

SEQ ID NO: 475730 - DNA, 16 bp, R. norvegicus
agcaagggcttctcct

SEQ ID NO: 475731 - DNA, 16 bp, R. norvegicus
agcaagtaaaagatca

SEQ ID NO: 475732 - DNA, 35 bp, R. norvegicus
agcaagtaaaagatttgtacaataagaacttcaag

SEQ ID NO: 475733 - DNA, 16 bp, R. norvegicus
agcaagtagaaacaaa

SEQ ID NO: 475734 - DNA, 16 bp, R. norvegicus
agcaagtcagtaagca

SEQ ID NO: 475735 - DNA, 16 bp, R. norvegicus
agcaagtgaaagactt

SEQ ID NO: 475736 - DNA, 16 bp, R. norvegicus
agcaagtgaaagctct

SEQ ID NO: 475737 - DNA, 16 bp, R. norvegicus
agcaagtgcagcagag

SEQ ID NO: 475738 - DNA, 16 bp, R. norvegicus
agcaagtgcctttacc

SEQ ID NO: 475739 - DNA, 16 bp, R. norvegicus
agcaagtgtttcttgg

SEQ ID NO: 475740 - DNA, 16 bp, R. norvegicus
agcaagttcaaagcta

SEQ ID NO: 475741 - DNA, 16 bp, R. norvegicus
agcaagttccaggaaa

SEQ ID NO: 475742 - DNA, 16 bp, R. norvegicus
agcaagttggaggcca

SEQ ID NO: 475743 - DNA, 16 bp, R. norvegicus
agcaataaaatatttt

SEQ ID NO: 475744 - DNA, 16 bp, R. norvegicus
agcaataaacttctat

SEQ ID NO: 475745 - DNA, 16 bp, R. norvegicus
agcaatagaaacccta

SEQ ID NO: 475746 - DNA, 16 bp, R. norvegicus
agcaatagcaacaaca

SEQ ID NO: 475747 - DNA, 16 bp, R. norvegicus
agcaatagtggtaaaa

SEQ ID NO: 475748 - DNA, 16 bp, R. norvegicus
agcaatataaaagtaa

SEQ ID NO: 475749 - DNA, 16 bp, R. norvegicus
agcaatcaggaagcag

SEQ ID NO: 475750 - DNA, 16 bp, R. norvegicus
agcaatctctccagct

SEQ ID NO: 475751 - DNA, 16 bp, R. norvegicus
agcaatgaagaaagca

SEQ ID NO: 475752 - DNA, 16 bp, R. norvegicus
agcaatgaagagaaga

SEQ ID NO: 475753 - DNA, 16 bp, R. norvegicus
agcaatgacataattt

SEQ ID NO: 475754 - DNA, 16 bp, R. norvegicus
agcaatgactttgaaa

SEQ ID NO: 475755 - DNA, 16 bp, R. norvegicus
agcaatgccagcccca

SEQ ID NO: 475756 - DNA, 16 bp, R. norvegicus
agcaatggaagagtgt

SEQ ID NO: 475757 - DNA, 16 bp, R. norvegicus
agcaatggacagatca

SEQ ID NO: 475758 - DNA, 17 bp, R. norvegicus
agcaatggaggagtgtt

SEQ ID NO: 475759 - DNA, 16 bp, R. norvegicus
agcaatggatgaatgt

SEQ ID NO: 475760 - DNA, 16 bp, R. norvegicus
agcaatgtggaaatgt

SEQ ID NO: 475761 - DNA, 16 bp, R. norvegicus
agcaatgtggaagtgt

SEQ ID NO: 475762 - DNA, 16 bp, R. norvegicus
agcaattgagaaagat

SEQ ID NO: 475763 - DNA, 16 bp, R. norvegicus
agcaattgaggaagac

SEQ ID NO: 475764 - DNA, 16 bp, R. norvegicus
agcaattgggaggcag

SEQ ID NO: 475765 - DNA, 16 bp, R. norvegicus
agcaatttcctctgaa

SEQ ID NO: 475766 - DNA, 16 bp, R. norvegicus
agcaatttggggagga

SEQ ID NO: 475767 - DNA, 16 bp, R. norvegicus
agcaatttttctttcc

SEQ ID NO: 475768 - DNA, 16 bp, R. norvegicus
agcacaaaagtttgaa

SEQ ID NO: 475769 - DNA, 16 bp, R. norvegicus
agcacaaatgccagcc

SEQ ID NO: 475770 - DNA, 16 bp, R. norvegicus
agcacaacataaggaa

SEQ ID NO: 475771 - DNA, 16 bp, R. norvegicus
agcacaagaacataag

SEQ ID NO: 475772 - DNA, 16 bp, R. norvegicus
agcacaagaccataag

SEQ ID NO: 475773 - DNA, 16 bp, R. norvegicus
agcacaaggtcctgag

SEQ ID NO: 475774 - DNA, 16 bp, R. norvegicus
agcacacacagcacag

SEQ ID NO: 475775 - DNA, 16 bp, R. norvegicus
agcacacacctcactc

SEQ ID NO: 475776 - DNA, 16 bp, R. norvegicus
agcacacagaacacca

SEQ ID NO: 475777 - DNA, 16 bp, R. norvegicus
agcacacagacagaca

SEQ ID NO: 475778 - DNA, 16 bp, R. norvegicus
agcacacagctgctat

SEQ ID NO: 475779 - DNA, 16 bp, R. norvegicus
agcacacaggaggctg

SEQ ID NO: 475780 - DNA, 16 bp, R. norvegicus
agcacacagtaggtgt

SEQ ID NO: 475781 - DNA, 16 bp, R. norvegicus
agcacacatgtggagg

SEQ ID NO: 475782 - DNA, 16 bp, R. norvegicus
agcacaccaaaaagct

SEQ ID NO: 475783 - DNA, 16 bp, R. norvegicus
agcacagaccacagac

SEQ ID NO: 475784 - DNA, 16 bp, R. norvegicus
agcacagcacagcaga

SEQ ID NO: 475785 - DNA, 16 bp, R. norvegicus
agcacagcacagccct

SEQ ID NO: 475786 - DNA, 16 bp, R. norvegicus
agcacagcaggagagt

SEQ ID NO: 475787 - DNA, 16 bp, R. norvegicus
agcacagcccagcaca

SEQ ID NO: 475788 - DNA, 16 bp, R. norvegicus
agcacagctgtcctct

SEQ ID NO: 475789 - DNA, 16 bp, R. norvegicus
agcacaggaaaggaga

SEQ ID NO: 475790 - DNA, 16 bp, R. norvegicus
agcacaggcaggcaga

SEQ ID NO: 475791 - DNA, 16 bp, R. norvegicus
agcacagggatggcac

SEQ ID NO: 475792 - DNA, 16 bp, R. norvegicus
agcacagtgacctggg

SEQ ID NO: 475793 - DNA, 16 bp, R. norvegicus
agcacagtgccccaga

SEQ ID NO: 475794 - DNA, 16 bp, R. norvegicus
agcacagtggctgggt

SEQ ID NO: 475795 - DNA, 16 bp, R. norvegicus
agcacagtgtctgcct

SEQ ID NO: 475796 - DNA, 16 bp, R. norvegicus
agcacatacatggcag

SEQ ID NO: 475797 - DNA, 16 bp, R. norvegicus
agcacatacctataat

SEQ ID NO: 475798 - DNA, 16 bp, R. norvegicus
agcacatcctgcaggc

SEQ ID NO: 475799 - DNA, 16 bp, R. norvegicus
agcacatgaaaggaca

SEQ ID NO: 475800 - DNA, 16 bp, R. norvegicus
agcacatggccctggg

SEQ ID NO: 475801 - DNA, 17 bp, R. norvegicus
agcaccaagaggaccaa

SEQ ID NO: 475802 - DNA, 16 bp, R. norvegicus
agcaccaccatcacca

SEQ ID NO: 475803 - DNA, 16 bp, R. norvegicus
agcaccacccacaagg

SEQ ID NO: 475804 - DNA, 16 bp, R. norvegicus
agcaccagagacaacc

SEQ ID NO: 475805 - DNA, 17 bp, R. norvegicus
agcaccatagagagatt

SEQ ID NO: 475806 - DNA, 16 bp, R. norvegicus
agcaccatcaccacca

SEQ ID NO: 475807 - DNA, 16 bp, R. norvegicus
agcaccatcagcacca

SEQ ID NO: 475808 - DNA, 16 bp, R. norvegicus
agcaccatgaagagag

SEQ ID NO: 475809 - DNA, 16 bp, R. norvegicus
agcaccctcaaagaag

SEQ ID NO: 475810 - DNA, 16 bp, R. norvegicus
agcacctaatgaaatg

SEQ ID NO: 475811 - DNA, 16 bp, R. norvegicus
agcacctcattctaaa

SEQ ID NO: 475812 - DNA, 16 bp, R. norvegicus
agcacctgcctagcat

SEQ ID NO: 475813 - DNA, 16 bp, R. norvegicus
agcacctgctgctcct

SEQ ID NO: 475814 - DNA, 16 bp, R. norvegicus
agcacctgctgtcacc

SEQ ID NO: 475815 - DNA, 16 bp, R. norvegicus
agcacctggaggcaga

SEQ ID NO: 475816 - DNA, 16 bp, R. norvegicus
agcactaccgaatttc

SEQ ID NO: 475817 - DNA, 16 bp, R. norvegicus
agcactagctcggcct

SEQ ID NO: 475818 - DNA, 16 bp, R. norvegicus
agcactcaaacacatg

SEQ ID NO: 475819 - DNA, 16 bp, R. norvegicus
agcactcactggctgc

SEQ ID NO: 475820 - DNA, 16 bp, R. norvegicus
agcactcagaggcaga

SEQ ID NO: 475821 - DNA, 16 bp, R. norvegicus
agcactcaggaagctg

SEQ ID NO: 475822 - DNA, 16 bp, R. norvegicus
agcactcaggacacag

SEQ ID NO: 475823 - DNA, 16 bp, R. norvegicus
agcactcaggaggcag

SEQ ID NO: 475824 - DNA, 16 bp, R. norvegicus
agcactccagagacag

SEQ ID NO: 475825 - DNA, 16 bp, R. norvegicus
agcactcctgagacca

SEQ ID NO: 475826 - DNA, 16 bp, R. norvegicus
agcactcgagaggcag

SEQ ID NO: 475827 - DNA, 16 bp, R. norvegicus
agcactcgggaggaag

SEQ ID NO: 475828 - DNA, 16 bp, R. norvegicus
agcactctactcactg

SEQ ID NO: 475829 - DNA, 16 bp, R. norvegicus
agcactctagcactga

SEQ ID NO: 475830 - DNA, 16 bp, R. norvegicus
agcactctcccaactg

SEQ ID NO: 475831 - DNA, 16 bp, R. norvegicus
agcactgaagggacag

SEQ ID NO: 475832 - DNA, 16 bp, R. norvegicus
agcactgaccactctt

SEQ ID NO: 475833 - DNA, 16 bp, R. norvegicus
agcactgactgctcat

SEQ ID NO: 475834 - DNA, 16 bp, R. norvegicus
agcactgactgctttc

SEQ ID NO: 475835 - DNA, 16 bp, R. norvegicus
agcactgaggaagcag

SEQ ID NO: 475836 - DNA, 16 bp, R. norvegicus
agcactgaggaggcag

SEQ ID NO: 475837 - DNA, 16 bp, R. norvegicus
agcactggagaagcag

SEQ ID NO: 475838 - DNA, 16 bp, R. norvegicus
agcactggaggagtgt

SEQ ID NO: 475839 - DNA, 16 bp, R. norvegicus
agcactggctgctcct

SEQ ID NO: 475840 - DNA, 16 bp, R. norvegicus
agcactggggtggcag

SEQ ID NO: 475841 - DNA, 16 bp, R. norvegicus
agcactgtgcctggag

SEQ ID NO: 475842 - DNA, 16 bp, R. norvegicus
agcactgtgtgctctt

SEQ ID NO: 475843 - DNA, 16 bp, R. norvegicus
agcacttaaaaatgtt

SEQ ID NO: 475844 - DNA, 16 bp, R. norvegicus
agcacttcttggcacc

SEQ ID NO: 475845 - DNA, 16 bp, R. norvegicus
agcacttgagaggcaa

SEQ ID NO: 475846 - DNA, 16 bp, R. norvegicus
agcacttgaggcagag

SEQ ID NO: 475847 - DNA, 16 bp, R. norvegicus
agcacttgatgctttt

SEQ ID NO: 475848 - DNA, 16 bp, R. norvegicus
agcacttgcagctctt

SEQ ID NO: 475849 - DNA, 16 bp, R. norvegicus
agcacttgcctagcat

SEQ ID NO: 475850 - DNA, 16 bp, R. norvegicus
agcacttgctgctctt

SEQ ID NO: 475851 - DNA, 16 bp, R. norvegicus
agcacttgctggtctt

SEQ ID NO: 475852 - DNA, 16 bp, R. norvegicus
agcacttgggagactg

SEQ ID NO: 475853 - DNA, 16 bp, R. norvegicus
agcacttgggcagcag

SEQ ID NO: 475854 - DNA, 16 bp, R. norvegicus
agcacttgtgaggctg

SEQ ID NO: 475855 - DNA, 16 bp, R. norvegicus
agcactttaccagctg

SEQ ID NO: 475856 - DNA, 16 bp, R. norvegicus
agcactttttgctctt

SEQ ID NO: 475857 - DNA, 16 bp, R. norvegicus
agcagaaaacttccat

SEQ ID NO: 475858 - DNA, 16 bp, R. norvegicus
agcagaaaacttccct

SEQ ID NO: 475859 - DNA, 16 bp, R. norvegicus
agcagaaaagttggac

SEQ ID NO: 475860 - DNA, 16 bp, R. norvegicus
agcagaaacaggagga

SEQ ID NO: 475861 - DNA, 16 bp, R. norvegicus
agcagaaacaggcaga

SEQ ID NO: 475862 - DNA, 16 bp, R. norvegicus
agcagaaaccaggaaa

SEQ ID NO: 475863 - DNA, 16 bp, R. norvegicus
agcagaaaccagggaa

SEQ ID NO: 475864 - DNA, 16 bp, R. norvegicus
agcagaaaccatgaaa

SEQ ID NO: 475865 - DNA, 16 bp, R. norvegicus
agcagaaaccatggaa

SEQ ID NO: 475866 - DNA, 16 bp, R. norvegicus
agcagaaactacagca

SEQ ID NO: 475867 - DNA, 16 bp, R. norvegicus
agcagaaactggagga

SEQ ID NO: 475868 - DNA, 16 bp, R. norvegicus
agcagaaagagagggc

SEQ ID NO: 475869 - DNA, 16 bp, R. norvegicus
agcagaaagagatgaa

SEQ ID NO: 475870 - DNA, 16 bp, R. norvegicus
agcagaaatagccagg

SEQ ID NO: 475871 - DNA, 16 bp, R. norvegicus
agcagaacagaacaga

SEQ ID NO: 475872 - DNA, 27 bp, R. norvegicus
agcagaacgaagtaacactagagataa

SEQ ID NO: 475873 - DNA, 16 bp, R. norvegicus
agcagaagactgctgg

SEQ ID NO: 475874 - DNA, 16 bp, R. norvegicus
agcagaagatggactt

SEQ ID NO: 475875 - DNA, 16 bp, R. norvegicus
agcagaagatggcctt

SEQ ID NO: 475876 - DNA, 25 bp, R. norvegicus
agcagaagattccatagaaatcatc

SEQ ID NO: 475877 - DNA, 55 bp, R. norvegicus
agcagaagattccatagaaatcattgactcaactgtcaaagataatgtaaagtgg

SEQ ID NO: 475878 - DNA, 17 bp, R. norvegicus
agcagaagcagaagcag

SEQ ID NO: 475879 - DNA, 16 bp, R. norvegicus
agcagaagcagaagga

SEQ ID NO: 475880 - DNA, 16 bp, R. norvegicus
agcagaagcagcagaa

SEQ ID NO: 475881 - DNA, 16 bp, R. norvegicus
agcagaagcagcagca

SEQ ID NO: 475882 - DNA, 16 bp, R. norvegicus
agcagaagcaggagga

SEQ ID NO: 475883 - DNA, 16 bp, R. norvegicus
agcagaagcaggtgga

SEQ ID NO: 475884 - DNA, 16 bp, R. norvegicus
agcagaagctacagca

SEQ ID NO: 475885 - DNA, 16 bp, R. norvegicus
agcagaagctgaagga

SEQ ID NO: 475886 - DNA, 16 bp, R. norvegicus
agcagaaggagcaggc

SEQ ID NO: 475887 - DNA, 16 bp, R. norvegicus
agcagaagtggcagtc

SEQ ID NO: 475888 - DNA, 16 bp, R. norvegicus
agcagaagtggtggcc

SEQ ID NO: 475889 - DNA, 16 bp, R. norvegicus
agcagaatctgaagga

SEQ ID NO: 475890 - DNA, 16 bp, R. norvegicus
agcagacaagctggtg

SEQ ID NO: 475891 - DNA, 16 bp, R. norvegicus
agcagacaatgctctt

SEQ ID NO: 475892 - DNA, 16 bp, R. norvegicus
agcagacacaggagag

SEQ ID NO: 475893 - DNA, 16 bp, R. norvegicus
agcagacactgaagaa

SEQ ID NO: 475894 - DNA, 16 bp, R. norvegicus
agcagacactggtgtg

SEQ ID NO: 475895 - DNA, 16 bp, R. norvegicus
agcagacagcagacag

SEQ ID NO: 475896 - DNA, 16 bp, R. norvegicus
agcagacagcaggaaa

SEQ ID NO: 475897 - DNA, 16 bp, R. norvegicus
agcagacagtgctcct

SEQ ID NO: 475898 - DNA, 16 bp, R. norvegicus
agcagacattaaatta

SEQ ID NO: 475899 - DNA, 16 bp, R. norvegicus
agcagactgtgctctt

SEQ ID NO: 475900 - DNA, 16 bp, R. norvegicus
agcagagaacaatgaa

SEQ ID NO: 475901 - DNA, 16 bp, R. norvegicus
agcagagaacagcctt

SEQ ID NO: 475902 - DNA, 16 bp, R. norvegicus
agcagagaactgcctt

SEQ ID NO: 475903 - DNA, 16 bp, R. norvegicus
agcagagaacttctcc

SEQ ID NO: 475904 - DNA, 16 bp, R. norvegicus
agcagagacaggaaga

SEQ ID NO: 475905 - DNA, 16 bp, R. norvegicus
agcagagacaggtgga

SEQ ID NO: 475906 - DNA, 16 bp, R. norvegicus
agcagagaccatggag

SEQ ID NO: 475907 - DNA, 16 bp, R. norvegicus
agcagagacgatgaaa

SEQ ID NO: 475908 - DNA, 16 bp, R. norvegicus
agcagagactaaagga

SEQ ID NO: 475909 - DNA, 16 bp, R. norvegicus
agcagagactgaacaa

SEQ ID NO: 475910 - DNA, 17 bp, R. norvegicus
agcagagactgaaggaa

SEQ ID NO: 475911 - DNA, 16 bp, R. norvegicus
agcagagactgatgga

SEQ ID NO: 475912 - DNA, 16 bp, R. norvegicus
agcagagactggagga

SEQ ID NO: 475913 - DNA, 16 bp, R. norvegicus
agcagagagaacagga

SEQ ID NO: 475914 - DNA, 16 bp, R. norvegicus
agcagagagaaggcag

SEQ ID NO: 475915 - DNA, 16 bp, R. norvegicus
agcagagagagacaga

SEQ ID NO: 475916 - DNA, 16 bp, R. norvegicus
agcagagagaggcaga

SEQ ID NO: 475917 - DNA, 16 bp, R. norvegicus
agcagagagccaccag

SEQ ID NO: 475918 - DNA, 16 bp, R. norvegicus
agcagagagtggcctt

SEQ ID NO: 475919 - DNA, 16 bp, R. norvegicus
agcagagatgaaggaa

SEQ ID NO: 475920 - DNA, 16 bp, R. norvegicus
agcagagatggagaaa

SEQ ID NO: 475921 - DNA, 16 bp, R. norvegicus
agcagagatggaggga

SEQ ID NO: 475922 - DNA, 16 bp, R. norvegicus
agcagagcaaagcaaa

SEQ ID NO: 475923 - DNA, 16 bp, R. norvegicus
agcagagcagagcaaa

SEQ ID NO: 475924 - DNA, 16 bp, R. norvegicus
agcagagcagagcaga

SEQ ID NO: 475925 - DNA, 16 bp, R. norvegicus
agcagagccaggagga

SEQ ID NO: 475926 - DNA, 16 bp, R. norvegicus
agcagagccatgaggg

SEQ ID NO: 475927 - DNA, 16 bp, R. norvegicus
agcagagcctgaagga

SEQ ID NO: 475928 - DNA, 16 bp, R. norvegicus
agcagagctggagaag

SEQ ID NO: 475929 - DNA, 16 bp, R. norvegicus
agcagaggaaggcaga

SEQ ID NO: 475930 - DNA, 23 bp, R. norvegicus
agcagaggaatggatacagaaaa

SEQ ID NO: 475931 - DNA, 16 bp, R. norvegicus
agcagaggacacagag

SEQ ID NO: 475932 - DNA, 16 bp, R. norvegicus
agcagaggactgccag

SEQ ID NO: 475933 - DNA, 16 bp, R. norvegicus
agcagaggacttcctg

SEQ ID NO: 475934 - DNA, 16 bp, R. norvegicus
agcagaggatgacttt

SEQ ID NO: 475935 - DNA, 16 bp, R. norvegicus
agcagaggatggacct

SEQ ID NO: 475936 - DNA, 17 bp, R. norvegicus
agcagaggatggccttg

SEQ ID NO: 475937 - DNA, 16 bp, R. norvegicus
agcagaggatggcttt

SEQ ID NO: 475938 - DNA, 16 bp, R. norvegicus
agcagaggatggtcct

SEQ ID NO: 475939 - DNA, 16 bp, R. norvegicus
agcagaggcaagaaga

SEQ ID NO: 475940 - DNA, 16 bp, R. norvegicus
agcagaggcaagcaga

SEQ ID NO: 475941 - DNA, 16 bp, R. norvegicus
agcagaggcagaaaga

SEQ ID NO: 475942 - DNA, 16 bp, R. norvegicus
agcagaggcaggcaga

SEQ ID NO: 475943 - DNA, 16 bp, R. norvegicus
agcagaggccagaaga

SEQ ID NO: 475944 - DNA, 16 bp, R. norvegicus
agcagaggccaggaga

SEQ ID NO: 475945 - DNA, 16 bp, R. norvegicus
agcagaggctgaagaa

SEQ ID NO: 475946 - DNA, 16 bp, R. norvegicus
agcagaggctgaagga

SEQ ID NO: 475947 - DNA, 16 bp, R. norvegicus
agcagaggctggcaga

SEQ ID NO: 475948 - DNA, 16 bp, R. norvegicus
agcagaggctggggag

SEQ ID NO: 475949 - DNA, 16 bp, R. norvegicus
agcagagggaaatgaa

SEQ ID NO: 475950 - DNA, 16 bp, R. norvegicus
agcagagggacattaa

SEQ ID NO: 475951 - DNA, 16 bp, R. norvegicus
agcagagggcacagag

SEQ ID NO: 475952 - DNA, 16 bp, R. norvegicus
agcagagggcaccaga

SEQ ID NO: 475953 - DNA, 16 bp, R. norvegicus
agcagaggggcagctg

SEQ ID NO: 475954 - DNA, 16 bp, R. norvegicus
agcagagggtggcctt

SEQ ID NO: 475955 - DNA, 16 bp, R. norvegicus
agcagaggtcatggaa

SEQ ID NO: 475956 - DNA, 16 bp, R. norvegicus
agcagagtctaaagga

SEQ ID NO: 475957 - DNA, 16 bp, R. norvegicus
agcagagtgaggagga

SEQ ID NO: 475958 - DNA, 16 bp, R. norvegicus
agcagagtgtcattaa

SEQ ID NO: 475959 - DNA, 16 bp, R. norvegicus
agcagagtgtgcaaga

SEQ ID NO: 475960 - DNA, 16 bp, R. norvegicus
agcagatacagaaaga

SEQ ID NO: 475961 - DNA, 16 bp, R. norvegicus
agcagatacaggaaga

SEQ ID NO: 475962 - DNA, 16 bp, R. norvegicus
agcagatactggagag

SEQ ID NO: 475963 - DNA, 16 bp, R. norvegicus
agcagatccctggggc

SEQ ID NO: 475964 - DNA, 34 bp, R. norvegicus
agcagatcgatccatgcttatcaccctgtacaaa

SEQ ID NO: 475965 - DNA, 16 bp, R. norvegicus
agcagatctctgaatt

SEQ ID NO: 475966 - DNA, 16 bp, R. norvegicus
agcagatgaacagctt

SEQ ID NO: 475967 - DNA, 16 bp, R. norvegicus
agcagatgagcagctt

SEQ ID NO: 475968 - DNA, 16 bp, R. norvegicus
agcagatgcagaggcc

SEQ ID NO: 475969 - DNA, 16 bp, R. norvegicus
agcagatgcagagtcc

SEQ ID NO: 475970 - DNA, 16 bp, R. norvegicus
agcagatgctgatgag

SEQ ID NO: 475971 - DNA, 16 bp, R. norvegicus
agcagatggaaagatc

SEQ ID NO: 475972 - DNA, 16 bp, R. norvegicus
agcagatggagaccat

SEQ ID NO: 475973 - DNA, 16 bp, R. norvegicus
agcagatggccttgtt

SEQ ID NO: 475974 - DNA, 16 bp, R. norvegicus
agcagatggtggcaag

SEQ ID NO: 475975 - DNA, 16 bp, R. norvegicus
agcagatgttggagag

SEQ ID NO: 475976 - DNA, 16 bp, R. norvegicus
agcagcaacagaagca

SEQ ID NO: 475977 - DNA, 16 bp, R. norvegicus
agcagcaacagcaaca

SEQ ID NO: 475978 - DNA, 17 bp, R. norvegicus
agcagcaacagcaacaa

SEQ ID NO: 475979 - DNA, 17 bp, R. norvegicus
agcagcaacagcaacag

SEQ ID NO: 475980 - DNA, 17 bp, R. norvegicus
agcagcaactgaaggaa

SEQ ID NO: 475981 - DNA, 16 bp, R. norvegicus
agcagcaagcattctt

SEQ ID NO: 475982 - DNA, 16 bp, R. norvegicus
agcagcaatgaacatg

SEQ ID NO: 475983 - DNA, 16 bp, R. norvegicus
agcagcaatgacaaca

SEQ ID NO: 475984 - DNA, 16 bp, R. norvegicus
agcagcaatgtggaag

SEQ ID NO: 475985 - DNA, 16 bp, R. norvegicus
agcagcacacaggcag

SEQ ID NO: 475986 - DNA, 18 bp, R. norvegicus
agcagcacagcagcagca

SEQ ID NO: 475987 - DNA, 16 bp, R. norvegicus
agcagcaccagcagca

SEQ ID NO: 475988 - DNA, 18 bp, R. norvegicus
agcagcaccagcagcagc

SEQ ID NO: 475989 - DNA, 16 bp, R. norvegicus
agcagcaccagcagtg

SEQ ID NO: 475990 - DNA, 16 bp, R. norvegicus
agcagcacctaaagaa

SEQ ID NO: 475991 - DNA, 16 bp, R. norvegicus
agcagcagaaacaaga

SEQ ID NO: 475992 - DNA, 16 bp, R. norvegicus
agcagcagacaacatc

SEQ ID NO: 475993 - DNA, 16 bp, R. norvegicus
agcagcagagagggag

SEQ ID NO: 475994 - DNA, 16 bp, R. norvegicus
agcagcagagccagga

SEQ ID NO: 475995 - DNA, 16 bp, R. norvegicus
agcagcagaggcagat

SEQ ID NO: 475996 - DNA, 16 bp, R. norvegicus
agcagcagcaacagag

SEQ ID NO: 475997 - DNA, 16 bp, R. norvegicus
agcagcagcaacagcc

SEQ ID NO: 475998 - DNA, 16 bp, R. norvegicus
agcagcagcaccacca

SEQ ID NO: 475999 - DNA, 16 bp, R. norvegicus
agcagcagcagagagc

SEQ ID NO: 476000 - DNA, 16 bp, R. norvegicus
agcagcagcagagcag

SEQ ID NO: 476001 - DNA, 16 bp, R. norvegicus
agcagcagcagaggcc

SEQ ID NO: 476002 - DNA, 16 bp, R. norvegicus
agcagcagcagcaaaa

SEQ ID NO: 476003 - DNA, 16 bp, R. norvegicus
agcagcagcagcaact

SEQ ID NO: 476004 - DNA, 17 bp, R. norvegicus
agcagcagcagcaagaa

SEQ ID NO: 476005 - DNA, 16 bp, R. norvegicus
agcagcagcagcaagc

SEQ ID NO: 476006 - DNA, 16 bp, R. norvegicus
agcagcagcagcacaa

SEQ ID NO: 476007 - DNA, 16 bp, R. norvegicus
agcagcagcagcacct

SEQ ID NO: 476008 - DNA, 16 bp, R. norvegicus
agcagcagcagcactg

SEQ ID NO: 476009 - DNA, 16 bp, R. norvegicus
agcagcagcagcagca

SEQ ID NO: 476010 - DNA, 18 bp, R. norvegicus
agcagcagcagcagcatc

SEQ ID NO: 476011 - DNA, 16 bp, R. norvegicus
agcagcagcagcagcg

SEQ ID NO: 476012 - DNA, 16 bp, R. norvegicus
agcagcagcagcaggc

SEQ ID NO: 476013 - DNA, 16 bp, R. norvegicus
agcagcagcagcagta

SEQ ID NO: 476014 - DNA, 16 bp, R. norvegicus
agcagcagcagcagtt

SEQ ID NO: 476015 - DNA, 16 bp, R. norvegicus
agcagcagcagcatct

SEQ ID NO: 476016 - DNA, 16 bp, R. norvegicus
agcagcagcagcattg

SEQ ID NO: 476017 - DNA, 16 bp, R. norvegicus
agcagcagcagccagc

SEQ ID NO: 476018 - DNA, 16 bp, R. norvegicus
agcagcagcagcctgg

SEQ ID NO: 476019 - DNA, 16 bp, R. norvegicus
agcagcagcagctgcc

SEQ ID NO: 476020 - DNA, 16 bp, R. norvegicus
agcagcagcagctgct

SEQ ID NO: 476021 - DNA, 16 bp, R. norvegicus
agcagcagcagctgtg

SEQ ID NO: 476022 - DNA, 16 bp, R. norvegicus
agcagcagcaggaaca

SEQ ID NO: 476023 - DNA, 16 bp, R. norvegicus
agcagcagcaggaaga

SEQ ID NO: 476024 - DNA, 16 bp, R. norvegicus
agcagcagcaggagca

SEQ ID NO: 476025 - DNA, 16 bp, R. norvegicus
agcagcagcaggagga

SEQ ID NO: 476026 - DNA, 16 bp, R. norvegicus
agcagcagcagtaaca

SEQ ID NO: 476027 - DNA, 16 bp, R. norvegicus
agcagcagcagtagct

SEQ ID NO: 476028 - DNA, 16 bp, R. norvegicus
agcagcagccaccaca

SEQ ID NO: 476029 - DNA, 16 bp, R. norvegicus
agcagcagcgacaaca

SEQ ID NO: 476030 - DNA, 16 bp, R. norvegicus
agcagcagcggcagca

SEQ ID NO: 476031 - DNA, 16 bp, R. norvegicus
agcagcagctacagca

SEQ ID NO: 476032 - DNA, 16 bp, R. norvegicus
agcagcagctgactga

SEQ ID NO: 476033 - DNA, 16 bp, R. norvegicus
agcagcagctgcagcc

SEQ ID NO: 476034 - DNA, 16 bp, R. norvegicus
agcagcagctgtggga

SEQ ID NO: 476035 - DNA, 16 bp, R. norvegicus
agcagcaggaacagca

SEQ ID NO: 476036 - DNA, 16 bp, R. norvegicus
agcagcaggaggagga

SEQ ID NO: 476037 - DNA, 16 bp, R. norvegicus
agcagcaggcacagcc

SEQ ID NO: 476038 - DNA, 16 bp, R. norvegicus
agcagcaggcagagag

SEQ ID NO: 476039 - DNA, 16 bp, R. norvegicus
agcagcagggcagcag

SEQ ID NO: 476040 - DNA, 16 bp, R. norvegicus
agcagcaggtactctt

SEQ ID NO: 476041 - DNA, 16 bp, R. norvegicus
agcagcagtagcaaca

SEQ ID NO: 476042 - DNA, 16 bp, R. norvegicus
agcagcagtagtggag

SEQ ID NO: 476043 - DNA, 16 bp, R. norvegicus
agcagcagtccagttc

SEQ ID NO: 476044 - DNA, 16 bp, R. norvegicus
agcagcagtggcagca

SEQ ID NO: 476045 - DNA, 16 bp, R. norvegicus
agcagcagtggtggca

SEQ ID NO: 476046 - DNA, 16 bp, R. norvegicus
agcagcatcagcagca

SEQ ID NO: 476047 - DNA, 16 bp, R. norvegicus
agcagcatccaggcag

SEQ ID NO: 476048 - DNA, 16 bp, R. norvegicus
agcagcatgcaggcag

SEQ ID NO: 476049 - DNA, 43 bp, R. norvegicus
agcagcatgccctcggacagcagaaggcctcgcactcgactca

SEQ ID NO: 476050 - DNA, 16 bp, R. norvegicus
agcagccacacctgca

SEQ ID NO: 476051 - DNA, 16 bp, R. norvegicus
agcagccacagtccag

SEQ ID NO: 476052 - DNA, 16 bp, R. norvegicus
agcagccacatggcag

SEQ ID NO: 476053 - DNA, 16 bp, R. norvegicus
agcagccactgagcca

SEQ ID NO: 476054 - DNA, 16 bp, R. norvegicus
agcagccagaactctt

SEQ ID NO: 476055 - DNA, 16 bp, R. norvegicus
agcagccagaagctgg

SEQ ID NO: 476056 - DNA, 16 bp, R. norvegicus
agcagccaggaggagg

SEQ ID NO: 476057 - DNA, 16 bp, R. norvegicus
agcagccagggttggg

SEQ ID NO: 476058 - DNA, 16 bp, R. norvegicus
agcagccagtgctcgt

SEQ ID NO: 476059 - DNA, 16 bp, R. norvegicus
agcagccagtgctctt

SEQ ID NO: 476060 - DNA, 16 bp, R. norvegicus
agcagccagtgcttgt

SEQ ID NO: 476061 - DNA, 16 bp, R. norvegicus
agcagccattgctctt

SEQ ID NO: 476062 - DNA, 16 bp, R. norvegicus
agcagccattgctgct

SEQ ID NO: 476063 - DNA, 16 bp, R. norvegicus
agcagcccagctagaa

SEQ ID NO: 476064 - DNA, 16 bp, R. norvegicus
agcagcccctctgctc

SEQ ID NO: 476065 - DNA, 16 bp, R. norvegicus
agcagcctgcatagca

SEQ ID NO: 476066 - DNA, 16 bp, R. norvegicus
agcagcctggaagcca

SEQ ID NO: 476067 - DNA, 16 bp, R. norvegicus
agcagccttcagatga

SEQ ID NO: 476068 - DNA, 16 bp, R. norvegicus
agcagccttcatgctt

SEQ ID NO: 476069 - DNA, 16 bp, R. norvegicus
agcagcgactgaagga

SEQ ID NO: 476070 - DNA, 16 bp, R. norvegicus
agcagcggcagcggca

SEQ ID NO: 476071 - DNA, 16 bp, R. norvegicus
agcagctcagatgagt

SEQ ID NO: 476072 - DNA, 16 bp, R. norvegicus
agcagctcctgacctc

SEQ ID NO: 476073 - DNA, 18 bp, R. norvegicus
agcagctcggcaggcagg

SEQ ID NO: 476074 - DNA, 16 bp, R. norvegicus
agcagctctctgttcc

SEQ ID NO: 476075 - DNA, 17 bp, R. norvegicus
agcagctgaatgagaca

SEQ ID NO: 476076 - DNA, 16 bp, R. norvegicus
agcagctgacagagac

SEQ ID NO: 476077 - DNA, 16 bp, R. norvegicus
agcagctgactatgat

SEQ ID NO: 476078 - DNA, 16 bp, R. norvegicus
agcagctgactgagaa

SEQ ID NO: 476079 - DNA, 16 bp, R. norvegicus
agcagctgagacatcc

SEQ ID NO: 476080 - DNA, 16 bp, R. norvegicus
agcagctgagacttgg

SEQ ID NO: 476081 - DNA, 16 bp, R. norvegicus
agcagctggacagcac

SEQ ID NO: 476082 - DNA, 16 bp, R. norvegicus
agcagctgtggctacc

SEQ ID NO: 476083 - DNA, 24 bp, R. norvegicus
agcagctgtgtgctgcgggaatcc

SEQ ID NO: 476084 - DNA, 27 bp, R. norvegicus
agcagcttagccagttagctggagacc

SEQ ID NO: 476085 - DNA, 16 bp, R. norvegicus
agcagcttcacacaga

SEQ ID NO: 476086 - DNA, 16 bp, R. norvegicus
agcagcttgctggctt

SEQ ID NO: 476087 - DNA, 16 bp, R. norvegicus
agcagctttacagcac

SEQ ID NO: 476088 - DNA, 16 bp, R. norvegicus
agcagctttcagatga

SEQ ID NO: 476089 - DNA, 16 bp, R. norvegicus
agcagctttgcagttt

SEQ ID NO: 476090 - DNA, 16 bp, R. norvegicus
agcagcttttctcagc

SEQ ID NO: 476091 - DNA, 16 bp, R. norvegicus
agcaggaaaccattga

SEQ ID NO: 476092 - DNA, 16 bp, R. norvegicus
agcaggaacagcagca

SEQ ID NO: 476093 - DNA, 16 bp, R. norvegicus
agcaggaacaggaaga

SEQ ID NO: 476094 - DNA, 16 bp, R. norvegicus
agcaggaaccagggct

SEQ ID NO: 476095 - DNA, 16 bp, R. norvegicus
agcaggaactgaagca

SEQ ID NO: 476096 - DNA, 16 bp, R. norvegicus
agcaggaacttgaggc

SEQ ID NO: 476097 - DNA, 16 bp, R. norvegicus
agcaggaagagctgag

SEQ ID NO: 476098 - DNA, 16 bp, R. norvegicus
agcaggaagcaggaag

SEQ ID NO: 476099 - DNA, 16 bp, R. norvegicus
agcaggaagctgggag

SEQ ID NO: 476100 - DNA, 16 bp, R. norvegicus
agcaggaagtggctgc

SEQ ID NO: 476101 - DNA, 16 bp, R. norvegicus
agcaggaatctggagg

SEQ ID NO: 476102 - DNA, 16 bp, R. norvegicus
agcaggaccaaggcct

SEQ ID NO: 476103 - DNA, 16 bp, R. norvegicus
agcaggaccctggagg

SEQ ID NO: 476104 - DNA, 16 bp, R. norvegicus
agcaggactctcagaa

SEQ ID NO: 476105 - DNA, 16 bp, R. norvegicus
agcaggagaagcagga

SEQ ID NO: 476106 - DNA, 16 bp, R. norvegicus
agcaggagaatcagga

SEQ ID NO: 476107 - DNA, 16 bp, R. norvegicus
agcaggagacagagaa

SEQ ID NO: 476108 - DNA, 16 bp, R. norvegicus
agcaggagcaagagga

SEQ ID NO: 476109 - DNA, 16 bp, R. norvegicus
agcaggagcagcagga

SEQ ID NO: 476110 - DNA, 16 bp, R. norvegicus
agcaggagcaggaaca

SEQ ID NO: 476111 - DNA, 16 bp, R. norvegicus
agcaggagcaggagga

SEQ ID NO: 476112 - DNA, 16 bp, R. norvegicus
agcaggagcctgaagc

SEQ ID NO: 476113 - DNA, 16 bp, R. norvegicus
agcaggagcctgaggc

SEQ ID NO: 476114 - DNA, 16 bp, R. norvegicus
agcaggagctgaagca

SEQ ID NO: 476115 - DNA, 16 bp, R. norvegicus
agcaggagctgtccct

SEQ ID NO: 476116 - DNA, 16 bp, R. norvegicus
agcaggaggagctgag

SEQ ID NO: 476117 - DNA, 16 bp, R. norvegicus
agcaggaggcagaggc

SEQ ID NO: 476118 - DNA, 16 bp, R. norvegicus
agcaggaggcagtttg

SEQ ID NO: 476119 - DNA, 16 bp, R. norvegicus
agcaggcaaagttttc

SEQ ID NO: 476120 - DNA, 16 bp, R. norvegicus
agcaggcaagcaggca

SEQ ID NO: 476121 - DNA, 16 bp, R. norvegicus
agcaggcagaagcagg

SEQ ID NO: 476122 - DNA, 16 bp, R. norvegicus
agcaggcagacaggca

SEQ ID NO: 476123 - DNA, 16 bp, R. norvegicus
agcaggcagtgggagc

SEQ ID NO: 476124 - DNA, 16 bp, R. norvegicus
agcaggcatgcatgtg

SEQ ID NO: 476125 - DNA, 16 bp, R. norvegicus
agcaggcctcccagag

SEQ ID NO: 476126 - DNA, 16 bp, R. norvegicus
agcaggctctccaggg

SEQ ID NO: 476127 - DNA, 16 bp, R. norvegicus
agcaggctgaaaggct

SEQ ID NO: 476128 - DNA, 16 bp, R. norvegicus
agcaggctgagaaaac

SEQ ID NO: 476129 - DNA, 16 bp, R. norvegicus
agcaggctgagcaggc

SEQ ID NO: 476130 - DNA, 17 bp, R. norvegicus
agcaggctgaggctatg

SEQ ID NO: 476131 - DNA, 16 bp, R. norvegicus
agcaggctggcctcag

SEQ ID NO: 476132 - DNA, 16 bp, R. norvegicus
agcagggagctatggg

SEQ ID NO: 476133 - DNA, 16 bp, R. norvegicus
agcagggcaggatcct

SEQ ID NO: 476134 - DNA, 16 bp, R. norvegicus
agcagggcatgggcct

SEQ ID NO: 476135 - DNA, 16 bp, R. norvegicus
agcaggggagcagcag

SEQ ID NO: 476136 - DNA, 16 bp, R. norvegicus
agcaggggcaggggca

SEQ ID NO: 476137 - DNA, 22 bp, R. norvegicus
agcaggggtcaatacagtcacc

SEQ ID NO: 476138 - DNA, 16 bp, R. norvegicus
agcagggtgaggagga

SEQ ID NO: 476139 - DNA, 16 bp, R. norvegicus
agcaggtccacttccc

SEQ ID NO: 476140 - DNA, 16 bp, R. norvegicus
agcaggtgatggagca

SEQ ID NO: 476141 - DNA, 16 bp, R. norvegicus
agcaggtgtgtgtgtg

SEQ ID NO: 476142 - DNA, 16 bp, R. norvegicus
agcaggtttctggaag

SEQ ID NO: 476143 - DNA, 16 bp, R. norvegicus
agcagtaaggaaaaag

SEQ ID NO: 476144 - DNA, 16 bp, R. norvegicus
agcagtaagtctcaga

SEQ ID NO: 476145 - DNA, 16 bp, R. norvegicus
agcagtagcaacaaca

SEQ ID NO: 476146 - DNA, 17 bp, R. norvegicus
agcagtagcagtagcag

SEQ ID NO: 476147 - DNA, 16 bp, R. norvegicus
agcagtatacagcaaa

SEQ ID NO: 476148 - DNA, 16 bp, R. norvegicus
agcagtcaaagaaaat

SEQ ID NO: 476149 - DNA, 16 bp, R. norvegicus
agcagtcattaaaact

SEQ ID NO: 476150 - DNA, 16 bp, R. norvegicus
agcagtccagttcagt

SEQ ID NO: 476151 - DNA, 16 bp, R. norvegicus
agcagtcgggaggcag

SEQ ID NO: 476152 - DNA, 16 bp, R. norvegicus
agcagtctctgtaggg

SEQ ID NO: 476153 - DNA, 45 bp, R. norvegicus
agcagtgagctactgccatggaaaggggattgttcaccgagacct

SEQ ID NO: 476154 - DNA, 16 bp, R. norvegicus
agcagtgcacacacag

SEQ ID NO: 476155 - DNA, 16 bp, R. norvegicus
agcagtgccaagagga

SEQ ID NO: 476156 - DNA, 16 bp, R. norvegicus
agcagtgctaagaaga

SEQ ID NO: 476157 - DNA, 16 bp, R. norvegicus
agcagtggaaggggaa

SEQ ID NO: 476158 - DNA, 16 bp, R. norvegicus
agcagtggagagaaca

SEQ ID NO: 476159 - DNA, 16 bp, R. norvegicus
agcagtggcagctcaa

SEQ ID NO: 476160 - DNA, 16 bp, R. norvegicus
agcagtggcagtggag

SEQ ID NO: 476161 - DNA, 16 bp, R. norvegicus
agcagtggctcagtgg

SEQ ID NO: 476162 - DNA, 16 bp, R. norvegicus
agcagtggctctctct

SEQ ID NO: 476163 - DNA, 16 bp, R. norvegicus
agcagtgtacagaggg

SEQ ID NO: 476164 - DNA, 16 bp, R. norvegicus
agcagtgtgggaagat

SEQ ID NO: 476165 - DNA, 16 bp, R. norvegicus
agcagtgtgggacagg

SEQ ID NO: 476166 - DNA, 16 bp, R. norvegicus
agcagtgttcctctgt

SEQ ID NO: 476167 - DNA, 16 bp, R. norvegicus
agcagttaagagcaca

SEQ ID NO: 476168 - DNA, 16 bp, R. norvegicus
agcagttctcagcctt

SEQ ID NO: 476169 - DNA, 16 bp, R. norvegicus
agcagttgaggaagac

SEQ ID NO: 476170 - DNA, 16 bp, R. norvegicus
agcagttgctgctctt

SEQ ID NO: 476171 - DNA, 16 bp, R. norvegicus
agcagttgggaggcag

SEQ ID NO: 476172 - DNA, 16 bp, R. norvegicus
agcagtttctagactt

SEQ ID NO: 476173 - DNA, 16 bp, R. norvegicus
agcatacaccagctga

SEQ ID NO: 476174 - DNA, 18 bp, R. norvegicus
agcatatacccaaaagat

SEQ ID NO: 476175 - DNA, 16 bp, R. norvegicus
agcatatactgaagac

SEQ ID NO: 476176 - DNA, 16 bp, R. norvegicus
agcatatatatatata

SEQ ID NO: 476177 - DNA, 16 bp, R. norvegicus
agcatatgcaaaccat

SEQ ID NO: 476178 - DNA, 16 bp, R. norvegicus
agcatcaaggcaggca

SEQ ID NO: 476179 - DNA, 17 bp, R. norvegicus
agcatcaccaacagaat

SEQ ID NO: 476180 - DNA, 16 bp, R. norvegicus
agcatcaccaacagca

SEQ ID NO: 476181 - DNA, 16 bp, R. norvegicus
agcatcaccatcagaa

SEQ ID NO: 476182 - DNA, 16 bp, R. norvegicus
agcatcagaaccatcc

SEQ ID NO: 476183 - DNA, 16 bp, R. norvegicus
agcatcagaagttcaa

SEQ ID NO: 476184 - DNA, 16 bp, R. norvegicus
agcatcagcagggaca

SEQ ID NO: 476185 - DNA, 16 bp, R. norvegicus
agcatcagccattggt

SEQ ID NO: 476186 - DNA, 16 bp, R. norvegicus
agcatcagtcagtaca

SEQ ID NO: 476187 - DNA, 16 bp, R. norvegicus
agcatccacactttgc

SEQ ID NO: 476188 - DNA, 16 bp, R. norvegicus
agcatccacagcatcc

SEQ ID NO: 476189 - DNA, 16 bp, R. norvegicus
agcatccacatttcag

SEQ ID NO: 476190 - DNA, 16 bp, R. norvegicus
agcatccaggaaggca

SEQ ID NO: 476191 - DNA, 16 bp, R. norvegicus
agcatccaggtagaca

SEQ ID NO: 476192 - DNA, 16 bp, R. norvegicus
agcatccagtggaaaa

SEQ ID NO: 476193 - DNA, 16 bp, R. norvegicus
agcatccctcagttcc

SEQ ID NO: 476194 - DNA, 16 bp, R. norvegicus
agcatccgccccctgt

SEQ ID NO: 476195 - DNA, 16 bp, R. norvegicus
agcatcctcatgtgta

SEQ ID NO: 476196 - DNA, 16 bp, R. norvegicus
agcatcctgagtgagg

SEQ ID NO: 476197 - DNA, 16 bp, R. norvegicus
agcatcctgcagaaaa

SEQ ID NO: 476198 - DNA, 16 bp, R. norvegicus
agcatccttcagatct

SEQ ID NO: 476199 - DNA, 16 bp, R. norvegicus
agcatctacatggcag

SEQ ID NO: 476200 - DNA, 16 bp, R. norvegicus
agcatctctccagtcc

SEQ ID NO: 476201 - DNA, 16 bp, R. norvegicus
agcatctgcggtcacc

SEQ ID NO: 476202 - DNA, 16 bp, R. norvegicus
agcatctgctgccacc

SEQ ID NO: 476203 - DNA, 16 bp, R. norvegicus
agcatctgctttcacc

SEQ ID NO: 476204 - DNA, 16 bp, R. norvegicus
agcatctggtgtcacc

SEQ ID NO: 476205 - DNA, 26 bp, R. norvegicus
agcatcttttgggtatatgcccaaga

SEQ ID NO: 476206 - DNA, 16 bp, R. norvegicus
agcatcttttggttat

SEQ ID NO: 476207 - DNA, 16 bp, R. norvegicus
agcatcttttgtcacc

SEQ ID NO: 476208 - DNA, 16 bp, R. norvegicus
agcatgaagccctgag

SEQ ID NO: 476209 - DNA, 16 bp, R. norvegicus
agcatgaagtcctcag

SEQ ID NO: 476210 - DNA, 16 bp, R. norvegicus
agcatgagaacacaag

SEQ ID NO: 476211 - DNA, 16 bp, R. norvegicus
agcatgagccactgga

SEQ ID NO: 476212 - DNA, 16 bp, R. norvegicus
agcatgaggagctgag

SEQ ID NO: 476213 - DNA, 16 bp, R. norvegicus
agcatgaggaggagga

SEQ ID NO: 476214 - DNA, 16 bp, R. norvegicus
agcatgcacaagacct

SEQ ID NO: 476215 - DNA, 16 bp, R. norvegicus
agcatgcaggagctgg

SEQ ID NO: 476216 - DNA, 16 bp, R. norvegicus
agcatggaagattttt

SEQ ID NO: 476217 - DNA, 16 bp, R. norvegicus
agcatggcagagtgca

SEQ ID NO: 476218 - DNA, 16 bp, R. norvegicus
agcatggcagcaagca

SEQ ID NO: 476219 - DNA, 17 bp, R. norvegicus
agcatggcagcgtgcag

SEQ ID NO: 476220 - DNA, 16 bp, R. norvegicus
agcatgggagaagctg

SEQ ID NO: 476221 - DNA, 16 bp, R. norvegicus
agcatgggaggtcttc

SEQ ID NO: 476222 - DNA, 16 bp, R. norvegicus
agcatggtggcatcca

SEQ ID NO: 476223 - DNA, 16 bp, R. norvegicus
agcatgtcagaaacag

SEQ ID NO: 476224 - DNA, 20 bp, R. norvegicus
agcatgtcagaaacggagcg

SEQ ID NO: 476225 - DNA, 16 bp, R. norvegicus
agcatgtcagaaatgg

SEQ ID NO: 476226 - DNA, 16 bp, R. norvegicus
agcatgtctgatgatg

SEQ ID NO: 476227 - DNA, 16 bp, R. norvegicus
agcatgtcttggcatc

SEQ ID NO: 476228 - DNA, 16 bp, R. norvegicus
agcatgtgtgccacag

SEQ ID NO: 476229 - DNA, 16 bp, R. norvegicus
agcattatcaacaaat

SEQ ID NO: 476230 - DNA, 16 bp, R. norvegicus
agcattatttttaata

SEQ ID NO: 476231 - DNA, 16 bp, R. norvegicus
agcattcacatgtgct

SEQ ID NO: 476232 - DNA, 16 bp, R. norvegicus
agcattcacattttaa

SEQ ID NO: 476233 - DNA, 16 bp, R. norvegicus
agcattcctcaggaac

SEQ ID NO: 476234 - DNA, 16 bp, R. norvegicus
agcattctcaacaaat

SEQ ID NO: 476235 - DNA, 16 bp, R. norvegicus
agcattgctaagagga

SEQ ID NO: 476236 - DNA, 16 bp, R. norvegicus
agcattgttcaccttc

SEQ ID NO: 476237 - DNA, 16 bp, R. norvegicus
agcattgttgttcata

SEQ ID NO: 476238 - DNA, 16 bp, R. norvegicus
agcatttaaaggcaga

SEQ ID NO: 476239 - DNA, 16 bp, R. norvegicus
agcatttcaaatacag

SEQ ID NO: 476240 - DNA, 16 bp, R. norvegicus
agcatttcctcactat

SEQ ID NO: 476241 - DNA, 16 bp, R. norvegicus
agcatttgaaatctca

SEQ ID NO: 476242 - DNA, 16 bp, R. norvegicus
agcatttgacaacatt

SEQ ID NO: 476243 - DNA, 16 bp, R. norvegicus
agcatttgctgctttt

SEQ ID NO: 476244 - DNA, 16 bp, R. norvegicus
agcatttggaaggtgg

SEQ ID NO: 476245 - DNA, 16 bp, R. norvegicus
agcatttgggaaacag

SEQ ID NO: 476246 - DNA, 16 bp, R. norvegicus
agcatttgggagactg

SEQ ID NO: 476247 - DNA, 16 bp, R. norvegicus
agcatttgtgtgtgtg

SEQ ID NO: 476248 - DNA, 16 bp, R. norvegicus
agcatttgttgttgtt

SEQ ID NO: 476249 - DNA, 16 bp, R. norvegicus
agcattttaaatgtaa

SEQ ID NO: 476250 - DNA, 16 bp, R. norvegicus
agcattttaattattt

SEQ ID NO: 476251 - DNA, 16 bp, R. norvegicus
agcattttcaaaagca

SEQ ID NO: 476252 - DNA, 16 bp, R. norvegicus
agcattttctttcttt

SEQ ID NO: 476253 - DNA, 16 bp, R. norvegicus
agccaaaaagtacaaa

SEQ ID NO: 476254 - DNA, 16 bp, R. norvegicus
agccaaaactacacag

SEQ ID NO: 476255 - DNA, 16 bp, R. norvegicus
agccaaaaggcaaggt

SEQ ID NO: 476256 - DNA, 16 bp, R. norvegicus
agccaaaataaacctt

SEQ ID NO: 476257 - DNA, 16 bp, R. norvegicus
agccaaaatggctgag

SEQ ID NO: 476258 - DNA, 16 bp, R. norvegicus
agccaaagaaaaggca

SEQ ID NO: 476259 - DNA, 16 bp, R. norvegicus
agccaaagatgatctt

SEQ ID NO: 476260 - DNA, 16 bp, R. norvegicus
agccaaagcaaaccct

SEQ ID NO: 476261 - DNA, 16 bp, R. norvegicus
agccaaagccatccaa

SEQ ID NO: 476262 - DNA, 16 bp, R. norvegicus
agccaaagggattaaa

SEQ ID NO: 476263 - DNA, 16 bp, R. norvegicus
agccaaatgctgggtc

SEQ ID NO: 476264 - DNA, 16 bp, R. norvegicus
agccaaccattaaact

SEQ ID NO: 476265 - DNA, 16 bp, R. norvegicus
agccaacctttggact

SEQ ID NO: 476266 - DNA, 16 bp, R. norvegicus
agccaacttggtcatg

SEQ ID NO: 476267 - DNA, 16 bp, R. norvegicus
agccaagaagtacatg

SEQ ID NO: 476268 - DNA, 16 bp, R. norvegicus
agccaagaggagactg

SEQ ID NO: 476269 - DNA, 16 bp, R. norvegicus
agccaagcacagtggc

SEQ ID NO: 476270 - DNA, 16 bp, R. norvegicus
agccaagcagatctct

SEQ ID NO: 476271 - DNA, 16 bp, R. norvegicus
agccaaggccctgggt

SEQ ID NO: 476272 - DNA, 16 bp, R. norvegicus
agccaaggctacagag

SEQ ID NO: 476273 - DNA, 16 bp, R. norvegicus
agccaaggctgtacct

SEQ ID NO: 476274 - DNA, 16 bp, R. norvegicus
agccaagtggctggat

SEQ ID NO: 476275 - DNA, 16 bp, R. norvegicus
agccaatcactgaact

SEQ ID NO: 476276 - DNA, 16 bp, R. norvegicus
agccaatcagaaactg

SEQ ID NO: 476277 - DNA, 16 bp, R. norvegicus
agccaatcaggaactg

SEQ ID NO: 476278 - DNA, 16 bp, R. norvegicus
agccaatgagcttccc

SEQ ID NO: 476279 - DNA, 16 bp, R. norvegicus
agccaattatgttaaa

SEQ ID NO: 476280 - DNA, 16 bp, R. norvegicus
agccacaagatcctgg

SEQ ID NO: 476281 - DNA, 17 bp, R. norvegicus
agccacagagatggtgg

SEQ ID NO: 476282 - DNA, 16 bp, R. norvegicus
agccacagcagccaca

SEQ ID NO: 476283 - DNA, 16 bp, R. norvegicus
agccacagccacagtc

SEQ ID NO: 476284 - DNA, 16 bp, R. norvegicus
agccacagccagaaac

SEQ ID NO: 476285 - DNA, 16 bp, R. norvegicus
agccacagccctccat

SEQ ID NO: 476286 - DNA, 16 bp, R. norvegicus
agccacaggcagcagg

SEQ ID NO: 476287 - DNA, 16 bp, R. norvegicus
agccacattgctgaag

SEQ ID NO: 476288 - DNA, 16 bp, R. norvegicus
agccaccacgcccagc

SEQ ID NO: 476289 - DNA, 16 bp, R. norvegicus
agccaccatatgagtg

SEQ ID NO: 476290 - DNA, 16 bp, R. norvegicus
agccaccatgcctgac

SEQ ID NO: 476291 - DNA, 16 bp, R. norvegicus
agccaccatgtgactg

SEQ ID NO: 476292 - DNA, 16 bp, R. norvegicus
agccacccatggctcc

SEQ ID NO: 476293 - DNA, 16 bp, R. norvegicus
agccacccctccagcc

SEQ ID NO: 476294 - DNA, 16 bp, R. norvegicus
agccacccctccagct

SEQ ID NO: 476295 - DNA, 16 bp, R. norvegicus
agccacctcaccagct

SEQ ID NO: 476296 - DNA, 16 bp, R. norvegicus
agccacctccccagct

SEQ ID NO: 476297 - DNA, 16 bp, R. norvegicus
agccacctccccagtc

SEQ ID NO: 476298 - DNA, 16 bp, R. norvegicus
agccacctctgcagcc

SEQ ID NO: 476299 - DNA, 16 bp, R. norvegicus
agccacctcttcagtc

SEQ ID NO: 476300 - DNA, 16 bp, R. norvegicus
agccacctgcctctgc

SEQ ID NO: 476301 - DNA, 16 bp, R. norvegicus
agccacctgtccagcc

SEQ ID NO: 476302 - DNA, 16 bp, R. norvegicus
agccaccttcccagcc

SEQ ID NO: 476303 - DNA, 16 bp, R. norvegicus
agccaccttcctggaa

SEQ ID NO: 476304 - DNA, 16 bp, R. norvegicus
agccactatgtgattg

SEQ ID NO: 476305 - DNA, 16 bp, R. norvegicus
agccactcaccatcct

SEQ ID NO: 476306 - DNA, 17 bp, R. norvegicus
agccactgggaactggg

SEQ ID NO: 476307 - DNA, 16 bp, R. norvegicus
agccactgtctttgct

SEQ ID NO: 476308 - DNA, 16 bp, R. norvegicus
agccacttctccagca

SEQ ID NO: 476309 - DNA, 16 bp, R. norvegicus
agccacttggctgaag

SEQ ID NO: 476310 - DNA, 17 bp, R. norvegicus
agccagaaaacagcaaa

SEQ ID NO: 476311 - DNA, 16 bp, R. norvegicus
agccagaaactagaaa

SEQ ID NO: 476312 - DNA, 16 bp, R. norvegicus
agccagaaccacatag

SEQ ID NO: 476313 - DNA, 16 bp, R. norvegicus
agccagaaccatgtgg

SEQ ID NO: 476314 - DNA, 16 bp, R. norvegicus
agccagaagaacctgg

SEQ ID NO: 476315 - DNA, 16 bp, R. norvegicus
agccagaagagagcat

SEQ ID NO: 476316 - DNA, 16 bp, R. norvegicus
agccagaagatcccag

SEQ ID NO: 476317 - DNA, 16 bp, R. norvegicus
agccagaagatgaaaa

SEQ ID NO: 476318 - DNA, 16 bp, R. norvegicus
agccagaagctgaaag

SEQ ID NO: 476319 - DNA, 16 bp, R. norvegicus
agccagaagctggaag

SEQ ID NO: 476320 - DNA, 16 bp, R. norvegicus
agccagaagctggaca

SEQ ID NO: 476321 - DNA, 16 bp, R. norvegicus
agccagaagctggata

SEQ ID NO: 476322 - DNA, 16 bp, R. norvegicus
agccagaataaactct

SEQ ID NO: 476323 - DNA, 16 bp, R. norvegicus
agccagaataccacaa

SEQ ID NO: 476324 - DNA, 16 bp, R. norvegicus
agccagacaaaccaga

SEQ ID NO: 476325 - DNA, 16 bp, R. norvegicus
agccagactcacagca

SEQ ID NO: 476326 - DNA, 16 bp, R. norvegicus
agccagacttaccaga

SEQ ID NO: 476327 - DNA, 16 bp, R. norvegicus
agccagagaaggagaa

SEQ ID NO: 476328 - DNA, 16 bp, R. norvegicus
agccagagacacatgg

SEQ ID NO: 476329 - DNA, 16 bp, R. norvegicus
agccagagacagaggc

SEQ ID NO: 476330 - DNA, 16 bp, R. norvegicus
agccagagacagcaag

SEQ ID NO: 476331 - DNA, 16 bp, R. norvegicus
agccagagaccttgaa

SEQ ID NO: 476332 - DNA, 16 bp, R. norvegicus
agccagagagagagag

SEQ ID NO: 476333 - DNA, 16 bp, R. norvegicus
agccagagcaacacag

SEQ ID NO: 476334 - DNA, 16 bp, R. norvegicus
agccagagcaatgaga

SEQ ID NO: 476335 - DNA, 16 bp, R. norvegicus
agccagagcatgaaaa

SEQ ID NO: 476336 - DNA, 16 bp, R. norvegicus
agccagagccacatgg

SEQ ID NO: 476337 - DNA, 16 bp, R. norvegicus
agccagagccagagag

SEQ ID NO: 476338 - DNA, 16 bp, R. norvegicus
agccagagccagagcc

SEQ ID NO: 476339 - DNA, 16 bp, R. norvegicus
agccagagccagagct

SEQ ID NO: 476340 - DNA, 16 bp, R. norvegicus
agccagaggaccaaga

SEQ ID NO: 476341 - DNA, 16 bp, R. norvegicus
agccagaggatgggga

SEQ ID NO: 476342 - DNA, 16 bp, R. norvegicus
agccagaggcaggagg

SEQ ID NO: 476343 - DNA, 16 bp, R. norvegicus
agccagaggcatctgg

SEQ ID NO: 476344 - DNA, 16 bp, R. norvegicus
agccagagggcaggag

SEQ ID NO: 476345 - DNA, 16 bp, R. norvegicus
agccagaggggtcaag

SEQ ID NO: 476346 - DNA, 16 bp, R. norvegicus
agccagaggtcaggga

SEQ ID NO: 476347 - DNA, 16 bp, R. norvegicus
agccagagttacaggt

SEQ ID NO: 476348 - DNA, 16 bp, R. norvegicus
agccagatgcagatat

SEQ ID NO: 476349 - DNA, 16 bp, R. norvegicus
agccagcaccatcttg

SEQ ID NO: 476350 - DNA, 17 bp, R. norvegicus
agccagcagcagcagca

SEQ ID NO: 476351 - DNA, 16 bp, R. norvegicus
agccagccagccagac

SEQ ID NO: 476352 - DNA, 16 bp, R. norvegicus
agccagccagccagcc

SEQ ID NO: 476353 - DNA, 16 bp, R. norvegicus
agccagcctgccacca

SEQ ID NO: 476354 - DNA, 16 bp, R. norvegicus
agccagcctgggctac

SEQ ID NO: 476355 - DNA, 16 bp, R. norvegicus
agccagcctgggctgc

SEQ ID NO: 476356 - DNA, 16 bp, R. norvegicus
agccagctctcccagg

SEQ ID NO: 476357 - DNA, 16 bp, R. norvegicus
agccagctgtgcctga

SEQ ID NO: 476358 - DNA, 16 bp, R. norvegicus
agccagcttgctctga

SEQ ID NO: 476359 - DNA, 16 bp, R. norvegicus
agccaggaacagcctc

SEQ ID NO: 476360 - DNA, 16 bp, R. norvegicus
agccaggaagcagaga

SEQ ID NO: 476361 - DNA, 16 bp, R. norvegicus
agccaggacagccagg

SEQ ID NO: 476362 - DNA, 16 bp, R. norvegicus
agccaggacaggagct

SEQ ID NO: 476363 - DNA, 16 bp, R. norvegicus
agccaggactgcacag

SEQ ID NO: 476364 - DNA, 16 bp, R. norvegicus
agccaggaggaacaag

SEQ ID NO: 476365 - DNA, 16 bp, R. norvegicus
agccaggaggaggctc

SEQ ID NO: 476366 - DNA, 16 bp, R. norvegicus
agccaggcaggacccc

SEQ ID NO: 476367 - DNA, 16 bp, R. norvegicus
agccaggcagtgatgg

SEQ ID NO: 476368 - DNA, 16 bp, R. norvegicus
agccaggcagtggtgg

SEQ ID NO: 476369 - DNA, 16 bp, R. norvegicus
agccaggcatgcctga

SEQ ID NO: 476370 - DNA, 16 bp, R. norvegicus
agccaggcatgctggt

SEQ ID NO: 476371 - DNA, 16 bp, R. norvegicus
agccaggcatggaggt

SEQ ID NO: 476372 - DNA, 16 bp, R. norvegicus
agccaggcatggtgca

SEQ ID NO: 476373 - DNA, 16 bp, R. norvegicus
agccaggcattgtggt

SEQ ID NO: 476374 - DNA, 16 bp, R. norvegicus
agccaggccaggccag

SEQ ID NO: 476375 - DNA, 17 bp, R. norvegicus
agccaggcccattcttt

SEQ ID NO: 476376 - DNA, 16 bp, R. norvegicus
agccaggcctcagctg

SEQ ID NO: 476377 - DNA, 16 bp, R. norvegicus
agccaggcggtggtgg

SEQ ID NO: 476378 - DNA, 16 bp, R. norvegicus
agccaggctagcctca

SEQ ID NO: 476379 - DNA, 16 bp, R. norvegicus
agccaggctgacctca

SEQ ID NO: 476380 - DNA, 16 bp, R. norvegicus
agccaggctgtggtgg

SEQ ID NO: 476381 - DNA, 16 bp, R. norvegicus
agccagggcaacacag

SEQ ID NO: 476382 - DNA, 16 bp, R. norvegicus
agccagggctatgcag

SEQ ID NO: 476383 - DNA, 16 bp, R. norvegicus
agccagggctgcacaa

SEQ ID NO: 476384 - DNA, 16 bp, R. norvegicus
agccagggcttcacac

SEQ ID NO: 476385 - DNA, 16 bp, R. norvegicus
agccagggcttcacag

SEQ ID NO: 476386 - DNA, 16 bp, R. norvegicus
agccagggttacaaag

SEQ ID NO: 476387 - DNA, 16 bp, R. norvegicus
agccaggtgtggtggc

SEQ ID NO: 476388 - DNA, 16 bp, R. norvegicus
agccagtaaccagaaa

SEQ ID NO: 476389 - DNA, 16 bp, R. norvegicus
agccagtaccacagcc

SEQ ID NO: 476390 - DNA, 16 bp, R. norvegicus
agccagtcaccaggaa

SEQ ID NO: 476391 - DNA, 16 bp, R. norvegicus
agccagtctccagcat

SEQ ID NO: 476392 - DNA, 16 bp, R. norvegicus
agccagtgagcagcat

SEQ ID NO: 476393 - DNA, 16 bp, R. norvegicus
agccagtgcttttaac

SEQ ID NO: 476394 - DNA, 16 bp, R. norvegicus
agccagtggctgggca

SEQ ID NO: 476395 - DNA, 16 bp, R. norvegicus
agccagtgtgaccatg

SEQ ID NO: 476396 - DNA, 16 bp, R. norvegicus
agccagtgtgttcaca

SEQ ID NO: 476397 - DNA, 16 bp, R. norvegicus
agccagtgttctcaac

SEQ ID NO: 476398 - DNA, 16 bp, R. norvegicus
agccagtgttcttaac

SEQ ID NO: 476399 - DNA, 16 bp, R. norvegicus
agccataaaccatcca

SEQ ID NO: 476400 - DNA, 16 bp, R. norvegicus
agccataccaggctcc

SEQ ID NO: 476401 - DNA, 16 bp, R. norvegicus
agccatagccatagcc

SEQ ID NO: 476402 - DNA, 16 bp, R. norvegicus
agccatatttataata

SEQ ID NO: 476403 - DNA, 16 bp, R. norvegicus
agccatcaccccagcc

SEQ ID NO: 476404 - DNA, 16 bp, R. norvegicus
agccatcatgtggctg

SEQ ID NO: 476405 - DNA, 16 bp, R. norvegicus
agccatcccaccagcc

SEQ ID NO: 476406 - DNA, 16 bp, R. norvegicus
agccatccctctggcc

SEQ ID NO: 476407 - DNA, 16 bp, R. norvegicus
agccatcctcagctac

SEQ ID NO: 476408 - DNA, 16 bp, R. norvegicus
agccatcctgctggcc

SEQ ID NO: 476409 - DNA, 16 bp, R. norvegicus
agccatcgctgtccat

SEQ ID NO: 476410 - DNA, 16 bp, R. norvegicus
agccatctcaccagcc

SEQ ID NO: 476411 - DNA, 16 bp, R. norvegicus
agccatctcaccaggc

SEQ ID NO: 476412 - DNA, 16 bp, R. norvegicus
agccatctcacctgcc

SEQ ID NO: 476413 - DNA, 16 bp, R. norvegicus
agccatctcagcagcc

SEQ ID NO: 476414 - DNA, 16 bp, R. norvegicus
agccatctcccccagc

SEQ ID NO: 476415 - DNA, 16 bp, R. norvegicus
agccatctctccaagc

SEQ ID NO: 476416 - DNA, 18 bp, R. norvegicus
agccatctctccagcccc

SEQ ID NO: 476417 - DNA, 16 bp, R. norvegicus
agccatctctgcatcc

SEQ ID NO: 476418 - DNA, 16 bp, R. norvegicus
agccatctctgtggcc

SEQ ID NO: 476419 - DNA, 16 bp, R. norvegicus
agccatctcttcagac

SEQ ID NO: 476420 - DNA, 16 bp, R. norvegicus
agccatctgatgtggg

SEQ ID NO: 476421 - DNA, 16 bp, R. norvegicus
agccatctggtcaacc

SEQ ID NO: 476422 - DNA, 16 bp, R. norvegicus
agccatctgtaacccc

SEQ ID NO: 476423 - DNA, 16 bp, R. norvegicus
agccatctgtaatgaa

SEQ ID NO: 476424 - DNA, 16 bp, R. norvegicus
agccatcttccagccc

SEQ ID NO: 476425 - DNA, 16 bp, R. norvegicus
agccatcttcccagtc

SEQ ID NO: 476426 - DNA, 16 bp, R. norvegicus
agccatcttccccagc

SEQ ID NO: 476427 - DNA, 16 bp, R. norvegicus
agccatcttgcctgcc

SEQ ID NO: 476428 - DNA, 16 bp, R. norvegicus
agccatgcccccagcc

SEQ ID NO: 476429 - DNA, 16 bp, R. norvegicus
agccatggaggcagtg

SEQ ID NO: 476430 - DNA, 16 bp, R. norvegicus
agccatggctccagct

SEQ ID NO: 476431 - DNA, 16 bp, R. norvegicus
agccatggggagcaag

SEQ ID NO: 476432 - DNA, 16 bp, R. norvegicus
agccatgggtcagtct

SEQ ID NO: 476433 - DNA, 16 bp, R. norvegicus
agccatgggtttgtcc

SEQ ID NO: 476434 - DNA, 16 bp, R. norvegicus
agccatgtccccagcc

SEQ ID NO: 476435 - DNA, 16 bp, R. norvegicus
agccatgtctccaacc

SEQ ID NO: 476436 - DNA, 16 bp, R. norvegicus
agccatgtctccagtc

SEQ ID NO: 476437 - DNA, 16 bp, R. norvegicus
agccatgtggctctgg

SEQ ID NO: 476438 - DNA, 16 bp, R. norvegicus
agccatgtgggtcatg

SEQ ID NO: 476439 - DNA, 18 bp, R. norvegicus
agccattctcactgatgt

SEQ ID NO: 476440 - DNA, 24 bp, R. norvegicus
agccattgaagcaggacagtcccc

SEQ ID NO: 476441 - DNA, 16 bp, R. norvegicus
agccattgatgttctg

SEQ ID NO: 476442 - DNA, 16 bp, R. norvegicus
agccattgctccagct

SEQ ID NO: 476443 - DNA, 16 bp, R. norvegicus
agccattggggttctg

SEQ ID NO: 476444 - DNA, 16 bp, R. norvegicus
agccattggtgctttg

SEQ ID NO: 476445 - DNA, 16 bp, R. norvegicus
agccatttcttcagtc

SEQ ID NO: 476446 - DNA, 16 bp, R. norvegicus
agccatttgatattct

SEQ ID NO: 476447 - DNA, 16 bp, R. norvegicus
agccatttggctttgg

SEQ ID NO: 476448 - DNA, 16 bp, R. norvegicus
agccatttttaatgat

SEQ ID NO: 476449 - DNA, 16 bp, R. norvegicus
agcccaaaagctctga

SEQ ID NO: 476450 - DNA, 16 bp, R. norvegicus
agcccaacttgaaacc

SEQ ID NO: 476451 - DNA, 16 bp, R. norvegicus
agcccaagagaaagaa

SEQ ID NO: 476452 - DNA, 16 bp, R. norvegicus
agcccacaaccacctg

SEQ ID NO: 476453 - DNA, 16 bp, R. norvegicus
agcccacacccgcagt

SEQ ID NO: 476454 - DNA, 16 bp, R. norvegicus
agcccaccacccatca

SEQ ID NO: 476455 - DNA, 16 bp, R. norvegicus
agcccaccacctacca

SEQ ID NO: 476456 - DNA, 16 bp, R. norvegicus
agcccaccatccacca

SEQ ID NO: 476457 - DNA, 16 bp, R. norvegicus
agcccacccccagtga

SEQ ID NO: 476458 - DNA, 17 bp, R. norvegicus
agcccacgcccacagtg

SEQ ID NO: 476459 - DNA, 16 bp, R. norvegicus
agcccactgtggacag

SEQ ID NO: 476460 - DNA, 16 bp, R. norvegicus
agcccacttccagcag

SEQ ID NO: 476461 - DNA, 16 bp, R. norvegicus
agcccagaaagccagc

SEQ ID NO: 476462 - DNA, 16 bp, R. norvegicus
agcccagaaggccagg

SEQ ID NO: 476463 - DNA, 16 bp, R. norvegicus
agcccagacaggcctt

SEQ ID NO: 476464 - DNA, 16 bp, R. norvegicus
agcccagaccagggac

SEQ ID NO: 476465 - DNA, 16 bp, R. norvegicus
agcccagagctgaaag

SEQ ID NO: 476466 - DNA, 16 bp, R. norvegicus
agcccagcccagcagc

SEQ ID NO: 476467 - DNA, 16 bp, R. norvegicus
agcccagcccagcctg

SEQ ID NO: 476468 - DNA, 19 bp, R. norvegicus
agcccaggcacagcaagtg

SEQ ID NO: 476469 - DNA, 16 bp, R. norvegicus
agcccaggcagacctt

SEQ ID NO: 476470 - DNA, 16 bp, R. norvegicus
agcccaggcaggcctc

SEQ ID NO: 476471 - DNA, 16 bp, R. norvegicus
agcccaggcccacctg

SEQ ID NO: 476472 - DNA, 16 bp, R. norvegicus
agcccaggctagccct

SEQ ID NO: 476473 - DNA, 16 bp, R. norvegicus
agcccaggctagcctg

SEQ ID NO: 476474 - DNA, 16 bp, R. norvegicus
agcccaggctgacctt

SEQ ID NO: 476475 - DNA, 16 bp, R. norvegicus
agcccaggctgcccct

SEQ ID NO: 476476 - DNA, 16 bp, R. norvegicus
agcccaggctgccctg

SEQ ID NO: 476477 - DNA, 16 bp, R. norvegicus
agcccaggctgccctt

SEQ ID NO: 476478 - DNA, 16 bp, R. norvegicus
agcccaggctggacca

SEQ ID NO: 476479 - DNA, 16 bp, R. norvegicus
agcccaggctggcccc

SEQ ID NO: 476480 - DNA, 16 bp, R. norvegicus
agcccaggctggcctc

SEQ ID NO: 476481 - DNA, 16 bp, R. norvegicus
agcccaggctggcctt

SEQ ID NO: 476482 - DNA, 16 bp, R. norvegicus
agcccaggctggcttc

SEQ ID NO: 476483 - DNA, 16 bp, R. norvegicus
agcccaggctggtctc

SEQ ID NO: 476484 - DNA, 16 bp, R. norvegicus
agcccaggctggtctt

SEQ ID NO: 476485 - DNA, 16 bp, R. norvegicus
agcccaggctgtccca

SEQ ID NO: 476486 - DNA, 16 bp, R. norvegicus
agcccagggatggtgc

SEQ ID NO: 476487 - DNA, 17 bp, R. norvegicus
agcccagggccagtcca

SEQ ID NO: 476488 - DNA, 16 bp, R. norvegicus
agcccaggttggtctt

SEQ ID NO: 476489 - DNA, 16 bp, R. norvegicus
agcccagtgttctcat

SEQ ID NO: 476490 - DNA, 16 bp, R. norvegicus
agcccagttctcccag

SEQ ID NO: 476491 - DNA, 16 bp, R. norvegicus
agcccataaatataca

SEQ ID NO: 476492 - DNA, 16 bp, R. norvegicus
agcccatcagcagagg

SEQ ID NO: 476493 - DNA, 16 bp, R. norvegicus
agcccatgctggactt

SEQ ID NO: 476494 - DNA, 16 bp, R. norvegicus
agcccatggctccagc

SEQ ID NO: 476495 - DNA, 16 bp, R. norvegicus
agcccatgggtggagg

SEQ ID NO: 476496 - DNA, 16 bp, R. norvegicus
agcccattcagagcct

SEQ ID NO: 476497 - DNA, 16 bp, R. norvegicus
agcccattctttcagc

SEQ ID NO: 476498 - DNA, 16 bp, R. norvegicus
agcccattgtggatga

SEQ ID NO: 476499 - DNA, 16 bp, R. norvegicus
agcccattgtgggcag

SEQ ID NO: 476500 - DNA, 16 bp, R. norvegicus
agccccaaaacttgga

SEQ ID NO: 476501 - DNA, 16 bp, R. norvegicus
agccccaaatcttgga

SEQ ID NO: 476502 - DNA, 16 bp, R. norvegicus
agccccaagagcaggc

SEQ ID NO: 476503 - DNA, 16 bp, R. norvegicus
agccccacctccacag

SEQ ID NO: 476504 - DNA, 16 bp, R. norvegicus
agccccacttccacaa

SEQ ID NO: 476505 - DNA, 16 bp, R. norvegicus
agccccagccccagct

SEQ ID NO: 476506 - DNA, 16 bp, R. norvegicus
agccccaggaagcagc

SEQ ID NO: 476507 - DNA, 21 bp, R. norvegicus
agccccatttcctagccttga

SEQ ID NO: 476508 - DNA, 16 bp, R. norvegicus
agcccccaaattaaat

SEQ ID NO: 476509 - DNA, 16 bp, R. norvegicus
agcccccacaggagcc

SEQ ID NO: 476510 - DNA, 16 bp, R. norvegicus
agcccccaccagacag

SEQ ID NO: 476511 - DNA, 16 bp, R. norvegicus
agcccccatccccttc

SEQ ID NO: 476512 - DNA, 16 bp, R. norvegicus
agcccccatgggccca

SEQ ID NO: 476513 - DNA, 16 bp, R. norvegicus
agccccccaaagtcca

SEQ ID NO: 476514 - DNA, 16 bp, R. norvegicus
agccccgggtcctgct

SEQ ID NO: 476515 - DNA, 16 bp, R. norvegicus
agcccctcagcccctc

SEQ ID NO: 476516 - DNA, 16 bp, R. norvegicus
agcccctccccatcct

SEQ ID NO: 476517 - DNA, 16 bp, R. norvegicus
agcccctccctgggga

SEQ ID NO: 476518 - DNA, 16 bp, R. norvegicus
agcccctgccaaacat

SEQ ID NO: 476519 - DNA, 16 bp, R. norvegicus
agcccctgctcctgct

SEQ ID NO: 476520 - DNA, 16 bp, R. norvegicus
agcccctgctgtcctg

SEQ ID NO: 476521 - DNA, 16 bp, R. norvegicus
agcccctggaagctct

SEQ ID NO: 476522 - DNA, 16 bp, R. norvegicus
agcccctggagagctc

SEQ ID NO: 476523 - DNA, 16 bp, R. norvegicus
agcccctggagctgga

SEQ ID NO: 476524 - DNA, 16 bp, R. norvegicus
agcccctgggaagcac

SEQ ID NO: 476525 - DNA, 16 bp, R. norvegicus
agcccctgggactgga

SEQ ID NO: 476526 - DNA, 16 bp, R. norvegicus
agcccctggtggtctg

SEQ ID NO: 476527 - DNA, 16 bp, R. norvegicus
agcccctgtgcaccag

SEQ ID NO: 476528 - DNA, 16 bp, R. norvegicus
agcccctgttcctgct

SEQ ID NO: 476529 - DNA, 31 bp, R. norvegicus
agccccttcaagctcttccagttctttctct

SEQ ID NO: 476530 - DNA, 16 bp, R. norvegicus
agccccttcagctcat

SEQ ID NO: 476531 - DNA, 16 bp, R. norvegicus
agccccttccagctct

SEQ ID NO: 476532 - DNA, 16 bp, R. norvegicus
agccccttctgctcct

SEQ ID NO: 476533 - DNA, 16 bp, R. norvegicus
agcccgagcccgagcc

SEQ ID NO: 476534 - DNA, 16 bp, R. norvegicus
agccctaactcagcca

SEQ ID NO: 476535 - DNA, 16 bp, R. norvegicus
agccctacagccagga

SEQ ID NO: 476536 - DNA, 16 bp, R. norvegicus
agccctacccacaaag

SEQ ID NO: 476537 - DNA, 16 bp, R. norvegicus
agccctagaaaggata

SEQ ID NO: 476538 - DNA, 16 bp, R. norvegicus
agccctagggatctgc

SEQ ID NO: 476539 - DNA, 16 bp, R. norvegicus
agccctcagcttcctg

SEQ ID NO: 476540 - DNA, 16 bp, R. norvegicus
agccctcaggaggcag

SEQ ID NO: 476541 - DNA, 16 bp, R. norvegicus
agccctccatacccaa

SEQ ID NO: 476542 - DNA, 16 bp, R. norvegicus
agccctcccccagtga

SEQ ID NO: 476543 - DNA, 16 bp, R. norvegicus
agccctcccccatcaa

SEQ ID NO: 476544 - DNA, 16 bp, R. norvegicus
agccctcggtctgtgg

SEQ ID NO: 476545 - DNA, 16 bp, R. norvegicus
agccctctatgagatg

SEQ ID NO: 476546 - DNA, 16 bp, R. norvegicus
agccctctccccagcc

SEQ ID NO: 476547 - DNA, 16 bp, R. norvegicus
agccctctctcctgcc

SEQ ID NO: 476548 - DNA, 16 bp, R. norvegicus
agccctctgtgggtgg

SEQ ID NO: 476549 - DNA, 16 bp, R. norvegicus
agccctgaaagaggaa

SEQ ID NO: 476550 - DNA, 16 bp, R. norvegicus
agccctgacattcccc

SEQ ID NO: 476551 - DNA, 16 bp, R. norvegicus
agccctgagccctgag

SEQ ID NO: 476552 - DNA, 16 bp, R. norvegicus
agccctgcagtccaga

SEQ ID NO: 476553 - DNA, 16 bp, R. norvegicus
agccctggaactggag

SEQ ID NO: 476554 - DNA, 16 bp, R. norvegicus
agccctggacaacagc

SEQ ID NO: 476555 - DNA, 16 bp, R. norvegicus
agccctggctctcctg

SEQ ID NO: 476556 - DNA, 16 bp, R. norvegicus
agccctggctgacctg

SEQ ID NO: 476557 - DNA, 16 bp, R. norvegicus
agccctggctgctctg

SEQ ID NO: 476558 - DNA, 16 bp, R. norvegicus
agccctggctgtccag

SEQ ID NO: 476559 - DNA, 16 bp, R. norvegicus
agccctggcttcaatc

SEQ ID NO: 476560 - DNA, 16 bp, R. norvegicus
agccctggcttttctg

SEQ ID NO: 476561 - DNA, 16 bp, R. norvegicus
agccctgggaccacag

SEQ ID NO: 476562 - DNA, 16 bp, R. norvegicus
agccctgggtcctcct

SEQ ID NO: 476563 - DNA, 16 bp, R. norvegicus
agccctgggtccttct

SEQ ID NO: 476564 - DNA, 16 bp, R. norvegicus
agccctggttgttctg

SEQ ID NO: 476565 - DNA, 16 bp, R. norvegicus
agccctgtgcctggag

SEQ ID NO: 476566 - DNA, 16 bp, R. norvegicus
agccctgttggaggaa

SEQ ID NO: 476567 - DNA, 16 bp, R. norvegicus
agcccttaaaaagaaa

SEQ ID NO: 476568 - DNA, 16 bp, R. norvegicus
agcccttccacatgta

SEQ ID NO: 476569 - DNA, 17 bp, R. norvegicus
agcccttgccagcatgg

SEQ ID NO: 476570 - DNA, 16 bp, R. norvegicus
agcccttggagccctg

SEQ ID NO: 476571 - DNA, 18 bp, R. norvegicus
agccgcagcagcagcagc

SEQ ID NO: 476572 - DNA, 16 bp, R. norvegicus
agccgcagccgcagcc

SEQ ID NO: 476573 - DNA, 28 bp, R. norvegicus
agccggagccggagccggagccggagcc

SEQ ID NO: 476574 - DNA, 16 bp, R. norvegicus
agccgggcatggtggt

SEQ ID NO: 476575 - DNA, 16 bp, R. norvegicus
agccgtctctgcagcc

SEQ ID NO: 476576 - DNA, 16 bp, R. norvegicus
agcctaaagaaagaga

SEQ ID NO: 476577 - DNA, 16 bp, R. norvegicus
agcctaagcaacagaa

SEQ ID NO: 476578 - DNA, 16 bp, R. norvegicus
agcctaatctacacag

SEQ ID NO: 476579 - DNA, 16 bp, R. norvegicus
agcctacagaatgaga

SEQ ID NO: 476580 - DNA, 16 bp, R. norvegicus
agcctacagaatgcca

SEQ ID NO: 476581 - DNA, 16 bp, R. norvegicus
agcctacagagaggag

SEQ ID NO: 476582 - DNA, 16 bp, R. norvegicus
agcctacctgcttccc

SEQ ID NO: 476583 - DNA, 16 bp, R. norvegicus
agcctacttcttcagg

SEQ ID NO: 476584 - DNA, 16 bp, R. norvegicus
agcctagtctgcatag

SEQ ID NO: 476585 - DNA, 16 bp, R. norvegicus
agcctatgccctgggg

SEQ ID NO: 476586 - DNA, 16 bp, R. norvegicus
agcctatgggagccat

SEQ ID NO: 476587 - DNA, 16 bp, R. norvegicus
agcctcaaacacacag

SEQ ID NO: 476588 - DNA, 16 bp, R. norvegicus
agcctcaactaacctg

SEQ ID NO: 476589 - DNA, 16 bp, R. norvegicus
agcctcacaggagaca

SEQ ID NO: 476590 - DNA, 16 bp, R. norvegicus
agcctcacagtttctt

SEQ ID NO: 476591 - DNA, 16 bp, R. norvegicus
agcctcagatgagctc

SEQ ID NO: 476592 - DNA, 16 bp, R. norvegicus
agcctcagcctgctgt

SEQ ID NO: 476593 - DNA, 16 bp, R. norvegicus
agcctcaggaggagga

SEQ ID NO: 476594 - DNA, 16 bp, R. norvegicus
agcctcaggggtgccc

SEQ ID NO: 476595 - DNA, 16 bp, R. norvegicus
agcctcagtgggagag

SEQ ID NO: 476596 - DNA, 16 bp, R. norvegicus
agcctcagtttctcca

SEQ ID NO: 476597 - DNA, 16 bp, R. norvegicus
agcctcatcatcctca

SEQ ID NO: 476598 - DNA, 16 bp, R. norvegicus
agcctccaaaggacca

SEQ ID NO: 476599 - DNA, 16 bp, R. norvegicus
agcctccaagtgctgg

SEQ ID NO: 476600 - DNA, 16 bp, R. norvegicus
agcctccacatgacca

SEQ ID NO: 476601 - DNA, 16 bp, R. norvegicus
agcctccaggttctcc

SEQ ID NO: 476602 - DNA, 16 bp, R. norvegicus
agcctccctagtgctg

SEQ ID NO: 476603 - DNA, 16 bp, R. norvegicus
agcctccctctactca

SEQ ID NO: 476604 - DNA, 16 bp, R. norvegicus
agcctcctcctctgag

SEQ ID NO: 476605 - DNA, 16 bp, R. norvegicus
agcctcctctccagcc

SEQ ID NO: 476606 - DNA, 16 bp, R. norvegicus
agcctcctgagtcctg

SEQ ID NO: 476607 - DNA, 16 bp, R. norvegicus
agcctcctgcctcagc

SEQ ID NO: 476608 - DNA, 16 bp, R. norvegicus
agcctcctgcctctgt

SEQ ID NO: 476609 - DNA, 16 bp, R. norvegicus
agcctctcagaagaga

SEQ ID NO: 476610 - DNA, 16 bp, R. norvegicus
agcctctcagaggaca

SEQ ID NO: 476611 - DNA, 16 bp, R. norvegicus
agcctctcagaggaga

SEQ ID NO: 476612 - DNA, 16 bp, R. norvegicus
agcctctcaggaaaca

SEQ ID NO: 476613 - DNA, 16 bp, R. norvegicus
agcctctcaggagaca

SEQ ID NO: 476614 - DNA, 16 bp, R. norvegicus
agcctctcaggagtca

SEQ ID NO: 476615 - DNA, 16 bp, R. norvegicus
agcctctccttcctgt

SEQ ID NO: 476616 - DNA, 16 bp, R. norvegicus
agcctctgaaactgga

SEQ ID NO: 476617 - DNA, 16 bp, R. norvegicus
agcctctgaaactgta

SEQ ID NO: 476618 - DNA, 16 bp, R. norvegicus
agcctctgaacctgta

SEQ ID NO: 476619 - DNA, 16 bp, R. norvegicus
agcctctgaagagaga

SEQ ID NO: 476620 - DNA, 16 bp, R. norvegicus
agcctctgagaggaca

SEQ ID NO: 476621 - DNA, 16 bp, R. norvegicus
agcctctgaggaaaga

SEQ ID NO: 476622 - DNA, 16 bp, R. norvegicus
agcctctgccagagcc

SEQ ID NO: 476623 - DNA, 16 bp, R. norvegicus
agcctctgctcctgct

SEQ ID NO: 476624 - DNA, 16 bp, R. norvegicus
agcctctgggggacat

SEQ ID NO: 476625 - DNA, 16 bp, R. norvegicus
agcctcttccaggaag

SEQ ID NO: 476626 - DNA, 26 bp, R. norvegicus
agcctcttggtcctagagtgctggct

SEQ ID NO: 476627 - DNA, 16 bp, R. norvegicus
agcctgaagcagctgg

SEQ ID NO: 476628 - DNA, 16 bp, R. norvegicus
agcctgaaggaaaggc

SEQ ID NO: 476629 - DNA, 16 bp, R. norvegicus
agcctgaaggaacacc

SEQ ID NO: 476630 - DNA, 16 bp, R. norvegicus
agcctgaaggagctga

SEQ ID NO: 476631 - DNA, 16 bp, R. norvegicus
agcctgacaacctgaa

SEQ ID NO: 476632 - DNA, 16 bp, R. norvegicus
agcctgagaaaaagaa

SEQ ID NO: 476633 - DNA, 16 bp, R. norvegicus
agcctgaggaaaagaa

SEQ ID NO: 476634 - DNA, 16 bp, R. norvegicus
agcctgaggaaaagga

SEQ ID NO: 476635 - DNA, 16 bp, R. norvegicus
agcctgaggcaggggg

SEQ ID NO: 476636 - DNA, 16 bp, R. norvegicus
agcctgagtctgcaga

SEQ ID NO: 476637 - DNA, 16 bp, R. norvegicus
agcctgcagcagctct

SEQ ID NO: 476638 - DNA, 16 bp, R. norvegicus
agcctgccacctgctg

SEQ ID NO: 476639 - DNA, 16 bp, R. norvegicus
agcctgccccacctag

SEQ ID NO: 476640 - DNA, 16 bp, R. norvegicus
agcctgccccacttgt

SEQ ID NO: 476641 - DNA, 16 bp, R. norvegicus
agcctgccccagcctg

SEQ ID NO: 476642 - DNA, 16 bp, R. norvegicus
agcctgcccccacagt

SEQ ID NO: 476643 - DNA, 16 bp, R. norvegicus
agcctgcccctgacac

SEQ ID NO: 476644 - DNA, 16 bp, R. norvegicus
agcctgccctacctgg

SEQ ID NO: 476645 - DNA, 16 bp, R. norvegicus
agcctgcctcacctgg

SEQ ID NO: 476646 - DNA, 16 bp, R. norvegicus
agcctgcctccagtga

SEQ ID NO: 476647 - DNA, 16 bp, R. norvegicus
agcctgcctgtctctg

SEQ ID NO: 476648 - DNA, 18 bp, R. norvegicus
agcctgccttatctgctg

SEQ ID NO: 476649 - DNA, 16 bp, R. norvegicus
agcctgccttgggaac

SEQ ID NO: 476650 - DNA, 16 bp, R. norvegicus
agcctgctctcccaga

SEQ ID NO: 476651 - DNA, 16 bp, R. norvegicus
agcctgctgcagcctc

SEQ ID NO: 476652 - DNA, 16 bp, R. norvegicus
agcctgctttattata

SEQ ID NO: 476653 - DNA, 16 bp, R. norvegicus
agcctggaaactgttg

SEQ ID NO: 476654 - DNA, 16 bp, R. norvegicus
agcctggagcctggag

SEQ ID NO: 476655 - DNA, 16 bp, R. norvegicus
agcctggagctcattg

SEQ ID NO: 476656 - DNA, 16 bp, R. norvegicus
agcctggaggccccag

SEQ ID NO: 476657 - DNA, 16 bp, R. norvegicus
agcctggcatggcaca

SEQ ID NO: 476658 - DNA, 16 bp, R. norvegicus
agcctggctgtcctgg

SEQ ID NO: 476659 - DNA, 16 bp, R. norvegicus
agcctggcttacatag

SEQ ID NO: 476660 - DNA, 16 bp, R. norvegicus
agcctggcttcaaact

SEQ ID NO: 476661 - DNA, 16 bp, R. norvegicus
agcctgggcaacatag

SEQ ID NO: 476662 - DNA, 16 bp, R. norvegicus
agcctgggctactcag

SEQ ID NO: 476663 - DNA, 16 bp, R. norvegicus
agcctgggctatacat

SEQ ID NO: 476664 - DNA, 16 bp, R. norvegicus
agcctgggctgcatga

SEQ ID NO: 476665 - DNA, 16 bp, R. norvegicus
agcctgggctgcatgg

SEQ ID NO: 476666 - DNA, 16 bp, R. norvegicus
agcctgggctggagct

SEQ ID NO: 476667 - DNA, 16 bp, R. norvegicus
agcctgggctgtgtaa

SEQ ID NO: 476668 - DNA, 16 bp, R. norvegicus
agcctgggcttcatga

SEQ ID NO: 476669 - DNA, 16 bp, R. norvegicus
agcctgggtcctctga

SEQ ID NO: 476670 - DNA, 16 bp, R. norvegicus
agcctgggttatacag

SEQ ID NO: 476671 - DNA, 16 bp, R. norvegicus
agcctggtacttcctc

SEQ ID NO: 476672 - DNA, 16 bp, R. norvegicus
agcctggtctacactg

SEQ ID NO: 476673 - DNA, 17 bp, R. norvegicus
agcctggtctacagaga

SEQ ID NO: 476674 - DNA, 17 bp, R. norvegicus
agcctggtctacatagt

SEQ ID NO: 476675 - DNA, 16 bp, R. norvegicus
agcctgtgcatgctct

SEQ ID NO: 476676 - DNA, 16 bp, R. norvegicus
agcctgtgggcagcac

SEQ ID NO: 476677 - DNA, 16 bp, R. norvegicus
agcctgtgtatcagca

SEQ ID NO: 476678 - DNA, 16 bp, R. norvegicus
agcctgtgtatgctgc

SEQ ID NO: 476679 - DNA, 16 bp, R. norvegicus
agcctgtgtgctacac

SEQ ID NO: 476680 - DNA, 16 bp, R. norvegicus
agcctgtgtgtgagca

SEQ ID NO: 476681 - DNA, 16 bp, R. norvegicus
agccttcacagaacca

SEQ ID NO: 476682 - DNA, 16 bp, R. norvegicus
agccttcagaagaaga

SEQ ID NO: 476683 - DNA, 16 bp, R. norvegicus
agccttccaagtactg

SEQ ID NO: 476684 - DNA, 16 bp, R. norvegicus
agccttccaagtgctg

SEQ ID NO: 476685 - DNA, 16 bp, R. norvegicus
agccttcctcttcctc

SEQ ID NO: 476686 - DNA, 16 bp, R. norvegicus
agccttctgcagctgg

SEQ ID NO: 476687 - DNA, 16 bp, R. norvegicus
agccttgacaggaaca

SEQ ID NO: 476688 - DNA, 16 bp, R. norvegicus
agccttgactatcctg

SEQ ID NO: 476689 - DNA, 16 bp, R. norvegicus
agccttgcacttgcta

SEQ ID NO: 476690 - DNA, 16 bp, R. norvegicus
agccttgctggaagaa

SEQ ID NO: 476691 - DNA, 16 bp, R. norvegicus
agccttggcagcacca

SEQ ID NO: 476692 - DNA, 16 bp, R. norvegicus
agccttggccatcctg

SEQ ID NO: 476693 - DNA, 16 bp, R. norvegicus
agccttggctggacca

SEQ ID NO: 476694 - DNA, 16 bp, R. norvegicus
agccttgggtcctgct

SEQ ID NO: 476695 - DNA, 16 bp, R. norvegicus
agccttgtggactgaa

SEQ ID NO: 476696 - DNA, 16 bp, R. norvegicus
agcctttgatcccagc

SEQ ID NO: 476697 - DNA, 17 bp, R. norvegicus
agcgacttcaggcccga

SEQ ID NO: 476698 - DNA, 18 bp, R. norvegicus
agcgagagcgagagcgag

SEQ ID NO: 476699 - DNA, 16 bp, R. norvegicus
agcgagttcaaggcca

SEQ ID NO: 476700 - DNA, 16 bp, R. norvegicus
agcgcaaggacctggg

SEQ ID NO: 476701 - DNA, 16 bp, R. norvegicus
agcgcaaggccctgcg

SEQ ID NO: 476702 - DNA, 17 bp, R. norvegicus
agcgcaaggccctgggc

SEQ ID NO: 476703 - DNA, 16 bp, R. norvegicus
agcgctcctgtcctca

SEQ ID NO: 476704 - DNA, 16 bp, R. norvegicus
agcggaggagaccacc

SEQ ID NO: 476705 - DNA, 16 bp, R. norvegicus
agcggggctggagaga

SEQ ID NO: 476706 - DNA, 17 bp, R. norvegicus
agcggtgcttctcccag

SEQ ID NO: 476707 - DNA, 17 bp, R. norvegicus
agcgtctcacccgctct

SEQ ID NO: 476708 - DNA, 16 bp, R. norvegicus
agctaacagcagagat

SEQ ID NO: 476709 - DNA, 16 bp, R. norvegicus
agctaaccaaagaatt

SEQ ID NO: 476710 - DNA, 16 bp, R. norvegicus
agctaaccaccaaaac

SEQ ID NO: 476711 - DNA, 16 bp, R. norvegicus
agctaactgaaacaga

SEQ ID NO: 476712 - DNA, 16 bp, R. norvegicus
agctaacttttctcag

SEQ ID NO: 476713 - DNA, 16 bp, R. norvegicus
agctaacttttttttt

SEQ ID NO: 476714 - DNA, 16 bp, R. norvegicus
agctaatgccaatact

SEQ ID NO: 476715 - DNA, 16 bp, R. norvegicus
agctacacagagaaac

SEQ ID NO: 476716 - DNA, 16 bp, R. norvegicus
agctacaggagagaaa

SEQ ID NO: 476717 - DNA, 16 bp, R. norvegicus
agctacagtcagagac

SEQ ID NO: 476718 - DNA, 16 bp, R. norvegicus
agctacagtgtgtgtg

SEQ ID NO: 476719 - DNA, 16 bp, R. norvegicus
agctacatatgcagct

SEQ ID NO: 476720 - DNA, 16 bp, R. norvegicus
agctacatccccagcc

SEQ ID NO: 476721 - DNA, 16 bp, R. norvegicus
agctacatggccaagg

SEQ ID NO: 476722 - DNA, 18 bp, R. norvegicus
agctaccacagctacaat

SEQ ID NO: 476723 - DNA, 16 bp, R. norvegicus
agctactaaaaacaaa

SEQ ID NO: 476724 - DNA, 16 bp, R. norvegicus
agctactctctggccc

SEQ ID NO: 476725 - DNA, 16 bp, R. norvegicus
agctactgctccagca

SEQ ID NO: 476726 - DNA, 16 bp, R. norvegicus
agctactgctccagtg

SEQ ID NO: 476727 - DNA, 16 bp, R. norvegicus
agctactgctgctgct

SEQ ID NO: 476728 - DNA, 16 bp, R. norvegicus
agctagaagctgaaaa

SEQ ID NO: 476729 - DNA, 16 bp, R. norvegicus
agctagagaagaaaag

SEQ ID NO: 476730 - DNA, 16 bp, R. norvegicus
agctagagaatgagaa

SEQ ID NO: 476731 - DNA, 16 bp, R. norvegicus
agctagagagagagag

SEQ ID NO: 476732 - DNA, 16 bp, R. norvegicus
agctagagcaagaaga

SEQ ID NO: 476733 - DNA, 16 bp, R. norvegicus
agctagccagcaggga

SEQ ID NO: 476734 - DNA, 16 bp, R. norvegicus
agctagccagcatcaa

SEQ ID NO: 476735 - DNA, 16 bp, R. norvegicus
agctagctctacaagc

SEQ ID NO: 476736 - DNA, 16 bp, R. norvegicus
agctataatatataca

SEQ ID NO: 476737 - DNA, 16 bp, R. norvegicus
agctatatggccaagg

SEQ ID NO: 476738 - DNA, 16 bp, R. norvegicus
agctatcaaaaacaaa

SEQ ID NO: 476739 - DNA, 16 bp, R. norvegicus
agctatcctcagggac

SEQ ID NO: 476740 - DNA, 16 bp, R. norvegicus
agctatgaatgggaag

SEQ ID NO: 476741 - DNA, 16 bp, R. norvegicus
agctatgattttaaga

SEQ ID NO: 476742 - DNA, 16 bp, R. norvegicus
agctattagaaacaaa

SEQ ID NO: 476743 - DNA, 16 bp, R. norvegicus
agctattccactcttg

SEQ ID NO: 476744 - DNA, 16 bp, R. norvegicus
agctattggagttctg

SEQ ID NO: 476745 - DNA, 16 bp, R. norvegicus
agctcaaaagcagcac

SEQ ID NO: 476746 - DNA, 16 bp, R. norvegicus
agctcaaaagctcaga

SEQ ID NO: 476747 - DNA, 16 bp, R. norvegicus
agctcaaaagcttgga

SEQ ID NO: 476748 - DNA, 16 bp, R. norvegicus
agctcaaagcccaccc

SEQ ID NO: 476749 - DNA, 16 bp, R. norvegicus
agctcaaaggctgggc

SEQ ID NO: 476750 - DNA, 16 bp, R. norvegicus
agctcaaagtcatcct

SEQ ID NO: 476751 - DNA, 16 bp, R. norvegicus
agctcaaatcccagca

SEQ ID NO: 476752 - DNA, 16 bp, R. norvegicus
agctcaacaagaagga

SEQ ID NO: 476753 - DNA, 16 bp, R. norvegicus
agctcaagaacaagga

SEQ ID NO: 476754 - DNA, 16 bp, R. norvegicus
agctcaagaacctaag

SEQ ID NO: 476755 - DNA, 16 bp, R. norvegicus
agctcaagaagaacaa

SEQ ID NO: 476756 - DNA, 16 bp, R. norvegicus
agctcaagaagaagag

SEQ ID NO: 476757 - DNA, 16 bp, R. norvegicus
agctcaagaagcagga

SEQ ID NO: 476758 - DNA, 16 bp, R. norvegicus
agctcaagaaggacaa

SEQ ID NO: 476759 - DNA, 16 bp, R. norvegicus
agctcaagaccctggg

SEQ ID NO: 476760 - DNA, 16 bp, R. norvegicus
agctcaagctggcctt

SEQ ID NO: 476761 - DNA, 16 bp, R. norvegicus
agctcaaggacagcct

SEQ ID NO: 476762 - DNA, 16 bp, R. norvegicus
agctcaaggccaacct

SEQ ID NO: 476763 - DNA, 16 bp, R. norvegicus
agctcaagggagacca

SEQ ID NO: 476764 - DNA, 16 bp, R. norvegicus
agctcaatccatttgc

SEQ ID NO: 476765 - DNA, 16 bp, R. norvegicus
agctcacaactgtcca

SEQ ID NO: 476766 - DNA, 16 bp, R. norvegicus
agctcacagttcaagg

SEQ ID NO: 476767 - DNA, 16 bp, R. norvegicus
agctcacatctgcctg

SEQ ID NO: 476768 - DNA, 17 bp, R. norvegicus
agctcacctccactgta

SEQ ID NO: 476769 - DNA, 16 bp, R. norvegicus
agctcactctggatga

SEQ ID NO: 476770 - DNA, 16 bp, R. norvegicus
agctcactgctgacaa

SEQ ID NO: 476771 - DNA, 16 bp, R. norvegicus
agctcactggccagcc

SEQ ID NO: 476772 - DNA, 16 bp, R. norvegicus
agctcactgtgggtgg

SEQ ID NO: 476773 - DNA, 16 bp, R. norvegicus
agctcagaaccatctg

SEQ ID NO: 476774 - DNA, 16 bp, R. norvegicus
agctcagaagatcatg

SEQ ID NO: 476775 - DNA, 16 bp, R. norvegicus
agctcagaggagaagg

SEQ ID NO: 476776 - DNA, 16 bp, R. norvegicus
agctcagctcagcaca

SEQ ID NO: 476777 - DNA, 16 bp, R. norvegicus
agctcagctcagctcc

SEQ ID NO: 476778 - DNA, 16 bp, R. norvegicus
agctcagctggtagag

SEQ ID NO: 476779 - DNA, 16 bp, R. norvegicus
agctcagctggtgaag

SEQ ID NO: 476780 - DNA, 16 bp, R. norvegicus
agctcagcttctcctg

SEQ ID NO: 476781 - DNA, 16 bp, R. norvegicus
agctcaggagctgctc

SEQ ID NO: 476782 - DNA, 16 bp, R. norvegicus
agctcaggcaaagaaa

SEQ ID NO: 476783 - DNA, 16 bp, R. norvegicus
agctcaggttggcctg

SEQ ID NO: 476784 - DNA, 16 bp, R. norvegicus
agctcagtaccccatt

SEQ ID NO: 476785 - DNA, 16 bp, R. norvegicus
agctcatagaaaagaa

SEQ ID NO: 476786 - DNA, 16 bp, R. norvegicus
agctcatgaagaagga

SEQ ID NO: 476787 - DNA, 16 bp, R. norvegicus
agctcatggccagcct

SEQ ID NO: 476788 - DNA, 16 bp, R. norvegicus
agctcatggtttcaga

SEQ ID NO: 476789 - DNA, 16 bp, R. norvegicus
agctcattccatttgc

SEQ ID NO: 476790 - DNA, 16 bp, R. norvegicus
agctccaaggcctgac

SEQ ID NO: 476791 - DNA, 16 bp, R. norvegicus
agctccaagtgctggc

SEQ ID NO: 476792 - DNA, 16 bp, R. norvegicus
agctccaccagagaac

SEQ ID NO: 476793 - DNA, 16 bp, R. norvegicus
agctccagctccaggg

SEQ ID NO: 476794 - DNA, 16 bp, R. norvegicus
agctccagctgtgtcc

SEQ ID NO: 476795 - DNA, 16 bp, R. norvegicus
agctccaggaaatcca

SEQ ID NO: 476796 - DNA, 16 bp, R. norvegicus
agctccaggacagcct

SEQ ID NO: 476797 - DNA, 16 bp, R. norvegicus
agctccaggagatgag

SEQ ID NO: 476798 - DNA, 16 bp, R. norvegicus
agctccaggctagcca

SEQ ID NO: 476799 - DNA, 16 bp, R. norvegicus
agctccagggaacctg

SEQ ID NO: 476800 - DNA, 16 bp, R. norvegicus
agctccagggcatcca

SEQ ID NO: 476801 - DNA, 16 bp, R. norvegicus
agctccaggggaatct

SEQ ID NO: 476802 - DNA, 16 bp, R. norvegicus
agctccaggggatcca

SEQ ID NO: 476803 - DNA, 16 bp, R. norvegicus
agctccagggggaaaa

SEQ ID NO: 476804 - DNA, 16 bp, R. norvegicus
agctccaggggttctg

SEQ ID NO: 476805 - DNA, 16 bp, R. norvegicus
agctccaggttcccag

SEQ ID NO: 476806 - DNA, 16 bp, R. norvegicus
agctccagttaaatgt

SEQ ID NO: 476807 - DNA, 16 bp, R. norvegicus
agctcccacacagcag

SEQ ID NO: 476808 - DNA, 16 bp, R. norvegicus
agctcccagaggtcca

SEQ ID NO: 476809 - DNA, 16 bp, R. norvegicus
agctcccagggactaa

SEQ ID NO: 476810 - DNA, 16 bp, R. norvegicus
agctcccccaccaggg

SEQ ID NO: 476811 - DNA, 16 bp, R. norvegicus
agctccctggaagcca

SEQ ID NO: 476812 - DNA, 16 bp, R. norvegicus
agctcctacttcctga

SEQ ID NO: 476813 - DNA, 16 bp, R. norvegicus
agctcctccagcacca

SEQ ID NO: 476814 - DNA, 16 bp, R. norvegicus
agctcctccagcccca

SEQ ID NO: 476815 - DNA, 16 bp, R. norvegicus
agctcctccagctcca

SEQ ID NO: 476816 - DNA, 16 bp, R. norvegicus
agctcctcctacacca

SEQ ID NO: 476817 - DNA, 16 bp, R. norvegicus
agctcctcctcctccc

SEQ ID NO: 476818 - DNA, 16 bp, R. norvegicus
agctcctcctggacca

SEQ ID NO: 476819 - DNA, 16 bp, R. norvegicus
agctcctgagctcctg

SEQ ID NO: 476820 - DNA, 16 bp, R. norvegicus
agctcctgctcaagct

SEQ ID NO: 476821 - DNA, 16 bp, R. norvegicus
agctcctgctccagtt

SEQ ID NO: 476822 - DNA, 16 bp, R. norvegicus
agctcctgcttcctgc

SEQ ID NO: 476823 - DNA, 16 bp, R. norvegicus
agctcctgcttcctgt

SEQ ID NO: 476824 - DNA, 16 bp, R. norvegicus
agctcctgcttcttga

SEQ ID NO: 476825 - DNA, 16 bp, R. norvegicus
agctcctggaaagggc

SEQ ID NO: 476826 - DNA, 16 bp, R. norvegicus
agctcctgggcagcac

SEQ ID NO: 476827 - DNA, 16 bp, R. norvegicus
agctcctgtcctggct

SEQ ID NO: 476828 - DNA, 16 bp, R. norvegicus
agctccttaagcagga

SEQ ID NO: 476829 - DNA, 16 bp, R. norvegicus
agctccttcagtactt

SEQ ID NO: 476830 - DNA, 16 bp, R. norvegicus
agctccttcagtattt

SEQ ID NO: 476831 - DNA, 16 bp, R. norvegicus
agctccttcattcttt

SEQ ID NO: 476832 - DNA, 16 bp, R. norvegicus
agctccttctccatca

SEQ ID NO: 476833 - DNA, 16 bp, R. norvegicus
agctccttggtggtct

SEQ ID NO: 476834 - DNA, 18 bp, R. norvegicus
agctcgaggaagggtttg

SEQ ID NO: 476835 - DNA, 17 bp, R. norvegicus
agctcgctgctcccaaa

SEQ ID NO: 476836 - DNA, 16 bp, R. norvegicus
agctctaaatctgatc

SEQ ID NO: 476837 - DNA, 16 bp, R. norvegicus
agctctacaaaggata

SEQ ID NO: 476838 - DNA, 16 bp, R. norvegicus
agctctacacctgcca

SEQ ID NO: 476839 - DNA, 17 bp, R. norvegicus
agctctaggacaaaaag

SEQ ID NO: 476840 - DNA, 16 bp, R. norvegicus
agctctcagaaggcag

SEQ ID NO: 476841 - DNA, 16 bp, R. norvegicus
agctctcagagactga

SEQ ID NO: 476842 - DNA, 16 bp, R. norvegicus
agctctcagctactgc

SEQ ID NO: 476843 - DNA, 16 bp, R. norvegicus
agctctccctcccaca

SEQ ID NO: 476844 - DNA, 24 bp, R. norvegicus
agctctccctcccacgggatttgg

SEQ ID NO: 476845 - DNA, 16 bp, R. norvegicus
agctctcctgagagac

SEQ ID NO: 476846 - DNA, 16 bp, R. norvegicus
agctctcctgcctcag

SEQ ID NO: 476847 - DNA, 16 bp, R. norvegicus
agctctctgatcccag

SEQ ID NO: 476848 - DNA, 16 bp, R. norvegicus
agctctctgcagaggc

SEQ ID NO: 476849 - DNA, 16 bp, R. norvegicus
agctctctgctggcag

SEQ ID NO: 476850 - DNA, 16 bp, R. norvegicus
agctctctggaggcag

SEQ ID NO: 476851 - DNA, 16 bp, R. norvegicus
agctctctgtggtggc

SEQ ID NO: 476852 - DNA, 17 bp, R. norvegicus
agctctctgttcccaga

SEQ ID NO: 476853 - DNA, 16 bp, R. norvegicus
agctctgaagcaggaa

SEQ ID NO: 476854 - DNA, 16 bp, R. norvegicus
agctctgaatcccatt

SEQ ID NO: 476855 - DNA, 16 bp, R. norvegicus
agctctgactgttctt

SEQ ID NO: 476856 - DNA, 16 bp, R. norvegicus
agctctgagagcctgc

SEQ ID NO: 476857 - DNA, 16 bp, R. norvegicus
agctctgagtgcctgt

SEQ ID NO: 476858 - DNA, 16 bp, R. norvegicus
agctctgagttcctgc

SEQ ID NO: 476859 - DNA, 16 bp, R. norvegicus
agctctgcacagccct

SEQ ID NO: 476860 - DNA, 16 bp, R. norvegicus
agctctggaagaaaaa

SEQ ID NO: 476861 - DNA, 16 bp, R. norvegicus
agctctggctgctctt

SEQ ID NO: 476862 - DNA, 16 bp, R. norvegicus
agctctggctgtgtcc

SEQ ID NO: 476863 - DNA, 16 bp, R. norvegicus
agctctgggaaaaaaa

SEQ ID NO: 476864 - DNA, 16 bp, R. norvegicus
agctctgggagctctg

SEQ ID NO: 476865 - DNA, 16 bp, R. norvegicus
agctctggggagacag

SEQ ID NO: 476866 - DNA, 16 bp, R. norvegicus
agctctggggagctgg

SEQ ID NO: 476867 - DNA, 16 bp, R. norvegicus
agctctggggcacaga

SEQ ID NO: 476868 - DNA, 16 bp, R. norvegicus
agctctggggctggag

SEQ ID NO: 476869 - DNA, 16 bp, R. norvegicus
agctctgggtgcaggc

SEQ ID NO: 476870 - DNA, 25 bp, R. norvegicus
agctctggttgcttggcattgttgt

SEQ ID NO: 476871 - DNA, 16 bp, R. norvegicus
agctctggttggcatt

SEQ ID NO: 476872 - DNA, 16 bp, R. norvegicus
agctctggttggttgg

SEQ ID NO: 476873 - DNA, 16 bp, R. norvegicus
agctctggtttcttgg

SEQ ID NO: 476874 - DNA, 16 bp, R. norvegicus
agctctgtacagcaaa

SEQ ID NO: 476875 - DNA, 16 bp, R. norvegicus
agctctgtaccccact

SEQ ID NO: 476876 - DNA, 16 bp, R. norvegicus
agctctgtctccagca

SEQ ID NO: 476877 - DNA, 16 bp, R. norvegicus
agctctgtggtgtctg

SEQ ID NO: 476878 - DNA, 16 bp, R. norvegicus
agctcttcacagttga

SEQ ID NO: 476879 - DNA, 17 bp, R. norvegicus
agctcttccaattcttt

SEQ ID NO: 476880 - DNA, 16 bp, R. norvegicus
agctcttccactcctt

SEQ ID NO: 476881 - DNA, 16 bp, R. norvegicus
agctcttccagacctt

SEQ ID NO: 476882 - DNA, 16 bp, R. norvegicus
agctcttccagttcct

SEQ ID NO: 476883 - DNA, 16 bp, R. norvegicus
agctcttcctgttctt

SEQ ID NO: 476884 - DNA, 16 bp, R. norvegicus
agctcttgcctccaag

SEQ ID NO: 476885 - DNA, 16 bp, R. norvegicus
agctctttactctgag

SEQ ID NO: 476886 - DNA, 16 bp, R. norvegicus
agctctttcaggcctt

SEQ ID NO: 476887 - DNA, 16 bp, R. norvegicus
agctctttgtcaaaga

SEQ ID NO: 476888 - DNA, 16 bp, R. norvegicus
agctgaaacctggctc

SEQ ID NO: 476889 - DNA, 16 bp, R. norvegicus
agctgaaagactcaga

SEQ ID NO: 476890 - DNA, 16 bp, R. norvegicus
agctgaaagctcacat

SEQ ID NO: 476891 - DNA, 16 bp, R. norvegicus
agctgaaagtgtcaga

SEQ ID NO: 476892 - DNA, 16 bp, R. norvegicus
agctgaaatcaatgaa

SEQ ID NO: 476893 - DNA, 16 bp, R. norvegicus
agctgaaatgcccaat

SEQ ID NO: 476894 - DNA, 16 bp, R. norvegicus
agctgaagaagaagaa

SEQ ID NO: 476895 - DNA, 16 bp, R. norvegicus
agctgaagacctgtag

SEQ ID NO: 476896 - DNA, 16 bp, R. norvegicus
agctgaagatgacctt

SEQ ID NO: 476897 - DNA, 16 bp, R. norvegicus
agctgaagcaggagga

SEQ ID NO: 476898 - DNA, 16 bp, R. norvegicus
agctgaaggaaacaga

SEQ ID NO: 476899 - DNA, 16 bp, R. norvegicus
agctgacaaccaagaa

SEQ ID NO: 476900 - DNA, 16 bp, R. norvegicus
agctgacagagaaaca

SEQ ID NO: 476901 - DNA, 16 bp, R. norvegicus
agctgacagagaaaga

SEQ ID NO: 476902 - DNA, 16 bp, R. norvegicus
agctgacagatgctga

SEQ ID NO: 476903 - DNA, 16 bp, R. norvegicus
agctgaccctgatggt

SEQ ID NO: 476904 - DNA, 16 bp, R. norvegicus
agctgaccctgtacca

SEQ ID NO: 476905 - DNA, 16 bp, R. norvegicus
agctgactgttgccag

SEQ ID NO: 476906 - DNA, 16 bp, R. norvegicus
agctgagaaacaactt

SEQ ID NO: 476907 - DNA, 16 bp, R. norvegicus
agctgagaaatgctga

SEQ ID NO: 476908 - DNA, 16 bp, R. norvegicus
agctgagaacttctgg

SEQ ID NO: 476909 - DNA, 16 bp, R. norvegicus
agctgagaaggagggt

SEQ ID NO: 476910 - DNA, 16 bp, R. norvegicus
agctgagagactgccc

SEQ ID NO: 476911 - DNA, 16 bp, R. norvegicus
agctgagagagaaatt

SEQ ID NO: 476912 - DNA, 16 bp, R. norvegicus
agctgagctgaaccag

SEQ ID NO: 476913 - DNA, 16 bp, R. norvegicus
agctgaggaagagggc

SEQ ID NO: 476914 - DNA, 16 bp, R. norvegicus
agctgaggaatacaga

SEQ ID NO: 476915 - DNA, 25 bp, R. norvegicus
agctgaggaccgaacccagggcctt

SEQ ID NO: 476916 - DNA, 16 bp, R. norvegicus
agctgaggactatcga

SEQ ID NO: 476917 - DNA, 16 bp, R. norvegicus
agctgaggagctgctg

SEQ ID NO: 476918 - DNA, 16 bp, R. norvegicus
agctgaggaggaaggt

SEQ ID NO: 476919 - DNA, 16 bp, R. norvegicus
agctgaggaggaccaa

SEQ ID NO: 476920 - DNA, 16 bp, R. norvegicus
agctgaggaggagagc

SEQ ID NO: 476921 - DNA, 16 bp, R. norvegicus
agctgaggaggagagt

SEQ ID NO: 476922 - DNA, 16 bp, R. norvegicus
agctgaggcagaagga

SEQ ID NO: 476923 - DNA, 16 bp, R. norvegicus
agctgaggcagaggcc

SEQ ID NO: 476924 - DNA, 16 bp, R. norvegicus
agctgaggcaggaaga

SEQ ID NO: 476925 - DNA, 16 bp, R. norvegicus
agctgaggctgaggcc

SEQ ID NO: 476926 - DNA, 16 bp, R. norvegicus
agctgatatgaggctc

SEQ ID NO: 476927 - DNA, 16 bp, R. norvegicus
agctgatctcccagga

SEQ ID NO: 476928 - DNA, 16 bp, R. norvegicus
agctgatgaacaactt

SEQ ID NO: 476929 - DNA, 16 bp, R. norvegicus
agctgatgcagaagtc

SEQ ID NO: 476930 - DNA, 16 bp, R. norvegicus
agctgatgcagagatc

SEQ ID NO: 476931 - DNA, 16 bp, R. norvegicus
agctgatgctggcgag

SEQ ID NO: 476932 - DNA, 16 bp, R. norvegicus
agctgatggaagcaga

SEQ ID NO: 476933 - DNA, 16 bp, R. norvegicus
agctgattcttcagct

SEQ ID NO: 476934 - DNA, 16 bp, R. norvegicus
agctgattggcagagt

SEQ ID NO: 476935 - DNA, 16 bp, R. norvegicus
agctgcaatgtactca

SEQ ID NO: 476936 - DNA, 16 bp, R. norvegicus
agctgcacccccagcc

SEQ ID NO: 476937 - DNA, 16 bp, R. norvegicus
agctgcagaaggaaaa

SEQ ID NO: 476938 - DNA, 16 bp, R. norvegicus
agctgcagcagcagac

SEQ ID NO: 476939 - DNA, 16 bp, R. norvegicus
agctgcagccccagcc

SEQ ID NO: 476940 - DNA, 16 bp, R. norvegicus
agctgcagctgctgtg

SEQ ID NO: 476941 - DNA, 16 bp, R. norvegicus
agctgcaggaaccctg

SEQ ID NO: 476942 - DNA, 16 bp, R. norvegicus
agctgcaggagagaaa

SEQ ID NO: 476943 - DNA, 16 bp, R. norvegicus
agctgcaggtcaagtt

SEQ ID NO: 476944 - DNA, 16 bp, R. norvegicus
agctgcaggtccccca

SEQ ID NO: 476945 - DNA, 16 bp, R. norvegicus
agctgcagttacaggc

SEQ ID NO: 476946 - DNA, 16 bp, R. norvegicus
agctgccatgtgggcg

SEQ ID NO: 476947 - DNA, 16 bp, R. norvegicus
agctgcccagaagcta

SEQ ID NO: 476948 - DNA, 16 bp, R. norvegicus
agctgcccctgggatg

SEQ ID NO: 476949 - DNA, 16 bp, R. norvegicus
agctgccgagccatct

SEQ ID NO: 476950 - DNA, 16 bp, R. norvegicus
agctgccgctgcctgc

SEQ ID NO: 476951 - DNA, 16 bp, R. norvegicus
agctgcctcagtttcc

SEQ ID NO: 476952 - DNA, 16 bp, R. norvegicus
agctgcctcctgagag

SEQ ID NO: 476953 - DNA, 16 bp, R. norvegicus
agctgcctgaagatgc

SEQ ID NO: 476954 - DNA, 16 bp, R. norvegicus
agctgcctgaggatgt

SEQ ID NO: 476955 - DNA, 16 bp, R. norvegicus
agctgcctgccctcca

SEQ ID NO: 476956 - DNA, 16 bp, R. norvegicus
agctgcctgctgtggg

SEQ ID NO: 476957 - DNA, 16 bp, R. norvegicus
agctgcctggaagaag

SEQ ID NO: 476958 - DNA, 16 bp, R. norvegicus
agctgcctggaagaca

SEQ ID NO: 476959 - DNA, 16 bp, R. norvegicus
agctgcctggaagagg

SEQ ID NO: 476960 - DNA, 16 bp, R. norvegicus
agctgcctggaggagg

SEQ ID NO: 476961 - DNA, 16 bp, R. norvegicus
agctgcctgggaaaag

SEQ ID NO: 476962 - DNA, 16 bp, R. norvegicus
agctgcctttgagtca

SEQ ID NO: 476963 - DNA, 16 bp, R. norvegicus
agctgcggagctgctg

SEQ ID NO: 476964 - DNA, 16 bp, R. norvegicus
agctgctaatgtatgt

SEQ ID NO: 476965 - DNA, 16 bp, R. norvegicus
agctgctcctccagag

SEQ ID NO: 476966 - DNA, 16 bp, R. norvegicus
agctgctcctgctgct

SEQ ID NO: 476967 - DNA, 16 bp, R. norvegicus
agctgctctcccagga

SEQ ID NO: 476968 - DNA, 16 bp, R. norvegicus
agctgctgacagggag

SEQ ID NO: 476969 - DNA, 16 bp, R. norvegicus
agctgctgagtggagc

SEQ ID NO: 476970 - DNA, 16 bp, R. norvegicus
agctgctgatccctct

SEQ ID NO: 476971 - DNA, 16 bp, R. norvegicus
agctgctgcaggcagg

SEQ ID NO: 476972 - DNA, 17 bp, R. norvegicus
agctgctgcaggctggg

SEQ ID NO: 476973 - DNA, 16 bp, R. norvegicus
agctgctgctccagaa

SEQ ID NO: 476974 - DNA, 16 bp, R. norvegicus
agctgctgctccagca

SEQ ID NO: 476975 - DNA, 16 bp, R. norvegicus
agctgctgctgagggc

SEQ ID NO: 476976 - DNA, 16 bp, R. norvegicus
agctgctgctgctgac

SEQ ID NO: 476977 - DNA, 16 bp, R. norvegicus
agctgctgctgctgct

SEQ ID NO: 476978 - DNA, 16 bp, R. norvegicus
agctgctgctgcttct

SEQ ID NO: 476979 - DNA, 16 bp, R. norvegicus
agctgctgtgaagcag

SEQ ID NO: 476980 - DNA, 16 bp, R. norvegicus
agctgctgtgtggagc

SEQ ID NO: 476981 - DNA, 16 bp, R. norvegicus
agctgctgtgtggatg

SEQ ID NO: 476982 - DNA, 16 bp, R. norvegicus
agctgctgtgtgtcca

SEQ ID NO: 476983 - DNA, 16 bp, R. norvegicus
agctgctgttatggtt

SEQ ID NO: 476984 - DNA, 16 bp, R. norvegicus
agctgcttcctcatct

SEQ ID NO: 476985 - DNA, 16 bp, R. norvegicus
agctgcttcttcttct

SEQ ID NO: 476986 - DNA, 16 bp, R. norvegicus
agctgcttggaagtca

SEQ ID NO: 476987 - DNA, 16 bp, R. norvegicus
agctggaagaaactga

SEQ ID NO: 476988 - DNA, 16 bp, R. norvegicus
agctggacagtcaatg

SEQ ID NO: 476989 - DNA, 16 bp, R. norvegicus
agctggactacagact

SEQ ID NO: 476990 - DNA, 16 bp, R. norvegicus
agctggactacagcct

SEQ ID NO: 476991 - DNA, 16 bp, R. norvegicus
agctggactctgagga

SEQ ID NO: 476992 - DNA, 16 bp, R. norvegicus
agctggactttggtgg

SEQ ID NO: 476993 - DNA, 16 bp, R. norvegicus
agctggagaagcaaca

SEQ ID NO: 476994 - DNA, 16 bp, R. norvegicus
agctggagaagttctc

SEQ ID NO: 476995 - DNA, 16 bp, R. norvegicus
agctggagagagcaga

SEQ ID NO: 476996 - DNA, 16 bp, R. norvegicus
agctggagagggactg

SEQ ID NO: 476997 - DNA, 16 bp, R. norvegicus
agctggagaggtggct

SEQ ID NO: 476998 - DNA, 16 bp, R. norvegicus
agctggagcaggaagc

SEQ ID NO: 476999 - DNA, 16 bp, R. norvegicus
agctggagctaagaaa

SEQ ID NO: 477000 - DNA, 16 bp, R. norvegicus
agctggagctggagag

SEQ ID NO: 477001 - DNA, 16 bp, R. norvegicus
agctggaggaagtagg

SEQ ID NO: 477002 - DNA, 16 bp, R. norvegicus
agctggaggaagtgag

SEQ ID NO: 477003 - DNA, 16 bp, R. norvegicus
agctggaggaagtggg

SEQ ID NO: 477004 - DNA, 16 bp, R. norvegicus
agctggaggagctggg

SEQ ID NO: 477005 - DNA, 16 bp, R. norvegicus
agctggaggcaaagag

SEQ ID NO: 477006 - DNA, 16 bp, R. norvegicus
agctggaggcagggag

SEQ ID NO: 477007 - DNA, 16 bp, R. norvegicus
agctggaggtcaggga

SEQ ID NO: 477008 - DNA, 16 bp, R. norvegicus
agctggagtcatcaca

SEQ ID NO: 477009 - DNA, 16 bp, R. norvegicus
agctggagtgacaggc

SEQ ID NO: 477010 - DNA, 18 bp, R. norvegicus
agctggatcctcaggtat

SEQ ID NO: 477011 - DNA, 16 bp, R. norvegicus
agctggatcctcagtc

SEQ ID NO: 477012 - DNA, 16 bp, R. norvegicus
agctggatctcaagga

SEQ ID NO: 477013 - DNA, 16 bp, R. norvegicus
agctggatctcatgga

SEQ ID NO: 477014 - DNA, 16 bp, R. norvegicus
agctggattttgaggt

SEQ ID NO: 477015 - DNA, 16 bp, R. norvegicus
agctggcaaaaccaca

SEQ ID NO: 477016 - DNA, 26 bp, R. norvegicus
agctggcagcagcctatgccctgggg

SEQ ID NO: 477017 - DNA, 16 bp, R. norvegicus
agctggccagcaagct

SEQ ID NO: 477018 - DNA, 16 bp, R. norvegicus
agctggccagtgagct

SEQ ID NO: 477019 - DNA, 16 bp, R. norvegicus
agctggccccagggtc

SEQ ID NO: 477020 - DNA, 16 bp, R. norvegicus
agctggccctggatgt

SEQ ID NO: 477021 - DNA, 16 bp, R. norvegicus
agctggcctagaactc

SEQ ID NO: 477022 - DNA, 16 bp, R. norvegicus
agctggccttctgtct

SEQ ID NO: 477023 - DNA, 16 bp, R. norvegicus
agctggctccttcccc

SEQ ID NO: 477024 - DNA, 16 bp, R. norvegicus
agctgggaagatggct

SEQ ID NO: 477025 - DNA, 16 bp, R. norvegicus
agctgggagaaggggt

SEQ ID NO: 477026 - DNA, 16 bp, R. norvegicus
agctgggagatggctc

SEQ ID NO: 477027 - DNA, 16 bp, R. norvegicus
agctgggaggagctgg

SEQ ID NO: 477028 - DNA, 16 bp, R. norvegicus
agctgggcagatgtct

SEQ ID NO: 477029 - DNA, 16 bp, R. norvegicus
agctgggccctcccat

SEQ ID NO: 477030 - DNA, 16 bp, R. norvegicus
agctgggctcagcaga

SEQ ID NO: 477031 - DNA, 16 bp, R. norvegicus
agctgggctgcctggt

SEQ ID NO: 477032 - DNA, 16 bp, R. norvegicus
agctgggctgccttgt

SEQ ID NO: 477033 - DNA, 26 bp, R. norvegicus
agctggggaccgaacccagggcctta

SEQ ID NO: 477034 - DNA, 16 bp, R. norvegicus
agctggggagatggct

SEQ ID NO: 477035 - DNA, 16 bp, R. norvegicus
agctggggatatggag

SEQ ID NO: 477036 - DNA, 16 bp, R. norvegicus
agctgggggaagggaa

SEQ ID NO: 477037 - DNA, 16 bp, R. norvegicus
agctgggggcttgggg

SEQ ID NO: 477038 - DNA, 16 bp, R. norvegicus
agctgggtctcgtgga

SEQ ID NO: 477039 - DNA, 16 bp, R. norvegicus
agctgggtgagatctt

SEQ ID NO: 477040 - DNA, 16 bp, R. norvegicus
agctgggtgtggcagt

SEQ ID NO: 477041 - DNA, 16 bp, R. norvegicus
agctggtaaaaccact

SEQ ID NO: 477042 - DNA, 16 bp, R. norvegicus
agctggtctgccagga

SEQ ID NO: 477043 - DNA, 16 bp, R. norvegicus
agctggtgacccctgt

SEQ ID NO: 477044 - DNA, 16 bp, R. norvegicus
agctggtgcctacaca

SEQ ID NO: 477045 - DNA, 16 bp, R. norvegicus
agctggtggcactgtt

SEQ ID NO: 477046 - DNA, 16 bp, R. norvegicus
agctggtggtgctgtt

SEQ ID NO: 477047 - DNA, 16 bp, R. norvegicus
agctggtgtctgctgc

SEQ ID NO: 477048 - DNA, 16 bp, R. norvegicus
agctgtactacaaagc

SEQ ID NO: 477049 - DNA, 17 bp, R. norvegicus
agctgtcaattctcagc

SEQ ID NO: 477050 - DNA, 16 bp, R. norvegicus
agctgtcacctgagag

SEQ ID NO: 477051 - DNA, 16 bp, R. norvegicus
agctgtccaccgtgag

SEQ ID NO: 477052 - DNA, 16 bp, R. norvegicus
agctgtcctctctgga

SEQ ID NO: 477053 - DNA, 16 bp, R. norvegicus
agctgtctcactgaag

SEQ ID NO: 477054 - DNA, 16 bp, R. norvegicus
agctgtctcactgggt

SEQ ID NO: 477055 - DNA, 16 bp, R. norvegicus
agctgtctccctttta

SEQ ID NO: 477056 - DNA, 16 bp, R. norvegicus
agctgtctcctgagaa

SEQ ID NO: 477057 - DNA, 16 bp, R. norvegicus
agctgtctcctgagac

SEQ ID NO: 477058 - DNA, 16 bp, R. norvegicus
agctgtcttcagatgc

SEQ ID NO: 477059 - DNA, 16 bp, R. norvegicus
agctgtgaagatgaag

SEQ ID NO: 477060 - DNA, 16 bp, R. norvegicus
agctgtgaagttgaag

SEQ ID NO: 477061 - DNA, 17 bp, R. norvegicus
agctgtgaatgtttaag

SEQ ID NO: 477062 - DNA, 16 bp, R. norvegicus
agctgtgagctgcctg

SEQ ID NO: 477063 - DNA, 16 bp, R. norvegicus
agctgtgggaccagtt

SEQ ID NO: 477064 - DNA, 16 bp, R. norvegicus
agctgtgggagatgga

SEQ ID NO: 477065 - DNA, 17 bp, R. norvegicus
agctgtggggcaggctc

SEQ ID NO: 477066 - DNA, 16 bp, R. norvegicus
agctgtggtcacctgc

SEQ ID NO: 477067 - DNA, 16 bp, R. norvegicus
agctgtggttacctgc

SEQ ID NO: 477068 - DNA, 16 bp, R. norvegicus
agctgtgtagccagct

SEQ ID NO: 477069 - DNA, 16 bp, R. norvegicus
agctgtgtgactttgg

SEQ ID NO: 477070 - DNA, 16 bp, R. norvegicus
agctgtgttccaaaga

SEQ ID NO: 477071 - DNA, 16 bp, R. norvegicus
agctgtgttggaatat

SEQ ID NO: 477072 - DNA, 16 bp, R. norvegicus
agctgttaaagaggaa

SEQ ID NO: 477073 - DNA, 20 bp, R. norvegicus
agctgttaggacaggtcaga

SEQ ID NO: 477074 - DNA, 16 bp, R. norvegicus
agctgttctggaactt

SEQ ID NO: 477075 - DNA, 16 bp, R. norvegicus
agctgttcttcaagcc

SEQ ID NO: 477076 - DNA, 16 bp, R. norvegicus
agctgttgcctgtgtg

SEQ ID NO: 477077 - DNA, 16 bp, R. norvegicus
agctgttgtctgtctg

SEQ ID NO: 477078 - DNA, 16 bp, R. norvegicus
agctgtttcattgaat

SEQ ID NO: 477079 - DNA, 16 bp, R. norvegicus
agctgtttgaccaggt

SEQ ID NO: 477080 - DNA, 16 bp, R. norvegicus
agctgtttgacctggt

SEQ ID NO: 477081 - DNA, 16 bp, R. norvegicus
agctgtttgagcaaaa

SEQ ID NO: 477082 - DNA, 16 bp, R. norvegicus
agctgtttgagcgaaa

SEQ ID NO: 477083 - DNA, 16 bp, R. norvegicus
agctgtttgattgtgt

SEQ ID NO: 477084 - DNA, 16 bp, R. norvegicus
agcttaaaattagctt

SEQ ID NO: 477085 - DNA, 16 bp, R. norvegicus
agcttaagaaaaagga

SEQ ID NO: 477086 - DNA, 16 bp, R. norvegicus
agcttagtctctggga

SEQ ID NO: 477087 - DNA, 16 bp, R. norvegicus
agcttcagaggttcag

SEQ ID NO: 477088 - DNA, 16 bp, R. norvegicus
agcttcagcccctttc

SEQ ID NO: 477089 - DNA, 16 bp, R. norvegicus
agcttcaggctcagtg

SEQ ID NO: 477090 - DNA, 16 bp, R. norvegicus
agcttcagttcaccag

SEQ ID NO: 477091 - DNA, 16 bp, R. norvegicus
agcttcatgaggtctg

SEQ ID NO: 477092 - DNA, 16 bp, R. norvegicus
agcttccaaaggagag

SEQ ID NO: 477093 - DNA, 35 bp, R. norvegicus
agcttccaccagcttagccagagcacccttgtctt

SEQ ID NO: 477094 - DNA, 16 bp, R. norvegicus
agcttccaggactggg

SEQ ID NO: 477095 - DNA, 16 bp, R. norvegicus
agcttccaggatgaga

SEQ ID NO: 477096 - DNA, 16 bp, R. norvegicus
agcttccattttctct

SEQ ID NO: 477097 - DNA, 16 bp, R. norvegicus
agcttcccttcctgga

SEQ ID NO: 477098 - DNA, 16 bp, R. norvegicus
agcttcctgcttctgc

SEQ ID NO: 477099 - DNA, 16 bp, R. norvegicus
agcttcctggaagaca

SEQ ID NO: 477100 - DNA, 16 bp, R. norvegicus
agcttcctggaagagg

SEQ ID NO: 477101 - DNA, 16 bp, R. norvegicus
agcttcctttcatatt

SEQ ID NO: 477102 - DNA, 16 bp, R. norvegicus
agcttctcactgaatt

SEQ ID NO: 477103 - DNA, 16 bp, R. norvegicus
agcttctcagaaaatt

SEQ ID NO: 477104 - DNA, 16 bp, R. norvegicus
agcttctcaggagata

SEQ ID NO: 477105 - DNA, 16 bp, R. norvegicus
agcttctcctaggacc

SEQ ID NO: 477106 - DNA, 16 bp, R. norvegicus
agcttctctcacaggc

SEQ ID NO: 477107 - DNA, 16 bp, R. norvegicus
agcttctgaaaggcaa

SEQ ID NO: 477108 - DNA, 16 bp, R. norvegicus
agcttctgaagaaaga

SEQ ID NO: 477109 - DNA, 16 bp, R. norvegicus
agcttctgagacctca

SEQ ID NO: 477110 - DNA, 16 bp, R. norvegicus
agcttctgcctccaag

SEQ ID NO: 477111 - DNA, 16 bp, R. norvegicus
agcttctgcctccaga

SEQ ID NO: 477112 - DNA, 17 bp, R. norvegicus
agcttctggaaggcaaa

SEQ ID NO: 477113 - DNA, 16 bp, R. norvegicus
agcttctggagcagct

SEQ ID NO: 477114 - DNA, 16 bp, R. norvegicus
agcttctgggatgctg

SEQ ID NO: 477115 - DNA, 19 bp, R. norvegicus
agcttctggtcagcttctc

SEQ ID NO: 477116 - DNA, 16 bp, R. norvegicus
agcttctggtttcttt

SEQ ID NO: 477117 - DNA, 16 bp, R. norvegicus
agcttctgtaaggaaa

SEQ ID NO: 477118 - DNA, 16 bp, R. norvegicus
agcttctgtttgttgg

SEQ ID NO: 477119 - DNA, 16 bp, R. norvegicus
agcttcttccagcttt

SEQ ID NO: 477120 - DNA, 16 bp, R. norvegicus
agcttcttccagtctt

SEQ ID NO: 477121 - DNA, 16 bp, R. norvegicus
agcttcttctcagctc

SEQ ID NO: 477122 - DNA, 16 bp, R. norvegicus
agcttgaagacctgag

SEQ ID NO: 477123 - DNA, 16 bp, R. norvegicus
agcttgaagtcagaga

SEQ ID NO: 477124 - DNA, 16 bp, R. norvegicus
agcttgagaacctgag

SEQ ID NO: 477125 - DNA, 16 bp, R. norvegicus
agcttgccaccaagcc

SEQ ID NO: 477126 - DNA, 16 bp, R. norvegicus
agcttgcctccttgtg

SEQ ID NO: 477127 - DNA, 16 bp, R. norvegicus
agcttgcttcttcaga

SEQ ID NO: 477128 - DNA, 16 bp, R. norvegicus
agcttgcttcttccca

SEQ ID NO: 477129 - DNA, 16 bp, R. norvegicus
agcttggcctacatag

SEQ ID NO: 477130 - DNA, 16 bp, R. norvegicus
agcttggtctacagtg

SEQ ID NO: 477131 - DNA, 16 bp, R. norvegicus
agctttagccagtggt

SEQ ID NO: 477132 - DNA, 16 bp, R. norvegicus
agctttattaaatact

SEQ ID NO: 477133 - DNA, 29 bp, R. norvegicus
agctttattcaccacttatatacccaagt

SEQ ID NO: 477134 - DNA, 16 bp, R. norvegicus
agctttcacagaacca

SEQ ID NO: 477135 - DNA, 16 bp, R. norvegicus
agctttcctgggtttt

SEQ ID NO: 477136 - DNA, 16 bp, R. norvegicus
agctttctgttgttgt

SEQ ID NO: 477137 - DNA, 16 bp, R. norvegicus
agctttcttcctgaga

SEQ ID NO: 477138 - DNA, 16 bp, R. norvegicus
agctttcttctgacat

SEQ ID NO: 477139 - DNA, 16 bp, R. norvegicus
agctttgaagctgctg

SEQ ID NO: 477140 - DNA, 16 bp, R. norvegicus
agctttgcagatttat

SEQ ID NO: 477141 - DNA, 16 bp, R. norvegicus
agctttggccaccaag

SEQ ID NO: 477142 - DNA, 16 bp, R. norvegicus
agctttggctgacctg

SEQ ID NO: 477143 - DNA, 16 bp, R. norvegicus
agctttggctgtccta

SEQ ID NO: 477144 - DNA, 16 bp, R. norvegicus
agctttggtcagagaa

SEQ ID NO: 477145 - DNA, 16 bp, R. norvegicus
agctttgtccctgcct

SEQ ID NO: 477146 - DNA, 16 bp, R. norvegicus
agctttgtgcaatgtg

SEQ ID NO: 477147 - DNA, 17 bp, R. norvegicus
agctttgttcagggtga

SEQ ID NO: 477148 - DNA, 16 bp, R. norvegicus
agcttttaaaatattt

SEQ ID NO: 477149 - DNA, 16 bp, R. norvegicus
agcttttaccattttt

SEQ ID NO: 477150 - DNA, 16 bp, R. norvegicus
agcttttcagtctcat

SEQ ID NO: 477151 - DNA, 16 bp, R. norvegicus
agcttttcagtttcaa

SEQ ID NO: 477152 - DNA, 16 bp, R. norvegicus
agcttttcatattctt

SEQ ID NO: 477153 - DNA, 16 bp, R. norvegicus
agcttttccttttctt

SEQ ID NO: 477154 - DNA, 16 bp, R. norvegicus
agcttttctttgaagg

SEQ ID NO: 477155 - DNA, 16 bp, R. norvegicus
agcttttgccattaca

SEQ ID NO: 477156 - DNA, 18 bp, R. norvegicus
agcttttgttatcgctca

SEQ ID NO: 477157 - DNA, 16 bp, R. norvegicus
agctttttaaaattat

SEQ ID NO: 477158 - DNA, 16 bp, R. norvegicus
agctttttctttctct

SEQ ID NO: 477159 - DNA, 16 bp, R. norvegicus
agctttttgtggagca

SEQ ID NO: 477160 - DNA, 16 bp, R. norvegicus
agcttttttcttcctg

SEQ ID NO: 477161 - DNA, 16 bp, R. norvegicus
agcttttttttttaaa

SEQ ID NO: 477162 - DNA, 16 bp, R. norvegicus
aggaaaaaaaatctca

SEQ ID NO: 477163 - DNA, 105 bp, R. norvegicus
aggaaaaagctactggtccaaaacatacaggaaatccaggactcaatgagaagatcaaacctaaggataataggtatagaagagagtgaagactcccagctcaaa

SEQ ID NO: 477164 - DNA, 16 bp, R. norvegicus
aggaaaaatacccata

SEQ ID NO: 477165 - DNA, 16 bp, R. norvegicus
aggaaaacaagaggct

SEQ ID NO: 477166 - DNA, 16 bp, R. norvegicus
aggaaaacacaaactg

SEQ ID NO: 477167 - DNA, 16 bp, R. norvegicus
aggaaaacacaaatat

SEQ ID NO: 477168 - DNA, 16 bp, R. norvegicus
aggaaaacacaatgaa

SEQ ID NO: 477169 - DNA, 16 bp, R. norvegicus
aggaaaacacagccaa

SEQ ID NO: 477170 - DNA, 16 bp, R. norvegicus
aggaaaacaccttgtg

SEQ ID NO: 477171 - DNA, 16 bp, R. norvegicus
aggaaaacagaggcag

SEQ ID NO: 477172 - DNA, 16 bp, R. norvegicus
aggaaaacatttgatt

SEQ ID NO: 477173 - DNA, 16 bp, R. norvegicus
aggaaaacctaggaaa

SEQ ID NO: 477174 - DNA, 16 bp, R. norvegicus
aggaaaactggaaatt

SEQ ID NO: 477175 - DNA, 16 bp, R. norvegicus
aggaaaagaagatcca

SEQ ID NO: 477176 - DNA, 16 bp, R. norvegicus
aggaaaagcccttgtt

SEQ ID NO: 477177 - DNA, 16 bp, R. norvegicus
aggaaaagcctttggt

SEQ ID NO: 477178 - DNA, 16 bp, R. norvegicus
aggaaaagctggagga

SEQ ID NO: 477179 - DNA, 16 bp, R. norvegicus
aggaaaaggagatcca

SEQ ID NO: 477180 - DNA, 16 bp, R. norvegicus
aggaaaaggaggatct

SEQ ID NO: 477181 - DNA, 16 bp, R. norvegicus
aggaaaaggcaggcag

SEQ ID NO: 477182 - DNA, 16 bp, R. norvegicus
aggaaaaggcttattt

SEQ ID NO: 477183 - DNA, 16 bp, R. norvegicus
aggaaaataaaatgtg

SEQ ID NO: 477184 - DNA, 16 bp, R. norvegicus
aggaaaatacagtcaa

SEQ ID NO: 477185 - DNA, 16 bp, R. norvegicus
aggaaaatactgactt

SEQ ID NO: 477186 - DNA, 16 bp, R. norvegicus
aggaaaatcaactaaa

SEQ ID NO: 477187 - DNA, 16 bp, R. norvegicus
aggaaaatcagaagtt

SEQ ID NO: 477188 - DNA, 16 bp, R. norvegicus
aggaaaatcccttggt

SEQ ID NO: 477189 - DNA, 16 bp, R. norvegicus
aggaaaatggatacaa

SEQ ID NO: 477190 - DNA, 16 bp, R. norvegicus
aggaaaatgtcaaaat

SEQ ID NO: 477191 - DNA, 16 bp, R. norvegicus
aggaaacacagctcag

SEQ ID NO: 477192 - DNA, 16 bp, R. norvegicus
aggaaacaccagagac

SEQ ID NO: 477193 - DNA, 16 bp, R. norvegicus
aggaaacagaagccaa

SEQ ID NO: 477194 - DNA, 16 bp, R. norvegicus
aggaaacagcagcagc

SEQ ID NO: 477195 - DNA, 16 bp, R. norvegicus
aggaaaccatgaaagg

SEQ ID NO: 477196 - DNA, 16 bp, R. norvegicus
aggaaacccaggacac

SEQ ID NO: 477197 - DNA, 16 bp, R. norvegicus
aggaaaccctgcagaa

SEQ ID NO: 477198 - DNA, 16 bp, R. norvegicus
aggaaacctttaaaaa

SEQ ID NO: 477199 - DNA, 16 bp, R. norvegicus
aggaaactcactgagt

SEQ ID NO: 477200 - DNA, 16 bp, R. norvegicus
aggaaactgaagaaga

SEQ ID NO: 477201 - DNA, 16 bp, R. norvegicus
aggaaactgaagcagg

SEQ ID NO: 477202 - DNA, 16 bp, R. norvegicus
aggaaactgaagctca

SEQ ID NO: 477203 - DNA, 16 bp, R. norvegicus
aggaaactgagactca

SEQ ID NO: 477204 - DNA, 16 bp, R. norvegicus
aggaaactgaggcagg

SEQ ID NO: 477205 - DNA, 16 bp, R. norvegicus
aggaaactttctccag

SEQ ID NO: 477206 - DNA, 16 bp, R. norvegicus
aggaaagaaactgaag

SEQ ID NO: 477207 - DNA, 16 bp, R. norvegicus
aggaaagaacagattc

SEQ ID NO: 477208 - DNA, 16 bp, R. norvegicus
aggaaagaccatccag

SEQ ID NO: 477209 - DNA, 16 bp, R. norvegicus
aggaaagaccattcag

SEQ ID NO: 477210 - DNA, 16 bp, R. norvegicus
aggaaagagatcagca

SEQ ID NO: 477211 - DNA, 16 bp, R. norvegicus
aggaaagagatccctg

SEQ ID NO: 477212 - DNA, 16 bp, R. norvegicus
aggaaagagatctgga

SEQ ID NO: 477213 - DNA, 16 bp, R. norvegicus
aggaaagaggatatgt

SEQ ID NO: 477214 - DNA, 16 bp, R. norvegicus
aggaaagcaagaagct

SEQ ID NO: 477215 - DNA, 16 bp, R. norvegicus
aggaaagcaagatcta

SEQ ID NO: 477216 - DNA, 16 bp, R. norvegicus
aggaaagcactgtgtt

SEQ ID NO: 477217 - DNA, 16 bp, R. norvegicus
aggaaagcaggcagag

SEQ ID NO: 477218 - DNA, 16 bp, R. norvegicus
aggaaagcgggccagc

SEQ ID NO: 477219 - DNA, 16 bp, R. norvegicus
aggaaaggaagaagtc

SEQ ID NO: 477220 - DNA, 16 bp, R. norvegicus
aggaaaggacatccag

SEQ ID NO: 477221 - DNA, 16 bp, R. norvegicus
aggaaaggatacagaa

SEQ ID NO: 477222 - DNA, 16 bp, R. norvegicus
aggaaaggattgaagg

SEQ ID NO: 477223 - DNA, 16 bp, R. norvegicus
aggaaagggttgattt

SEQ ID NO: 477224 - DNA, 16 bp, R. norvegicus
aggaaagggtttgttt

SEQ ID NO: 477225 - DNA, 17 bp, R. norvegicus
aggaaagtgcggctggg

SEQ ID NO: 477226 - DNA, 16 bp, R. norvegicus
aggaaagttcatccag

SEQ ID NO: 477227 - DNA, 16 bp, R. norvegicus
aggaaataaaagcagt

SEQ ID NO: 477228 - DNA, 16 bp, R. norvegicus
aggaaataaagagaca

SEQ ID NO: 477229 - DNA, 16 bp, R. norvegicus
aggaaatacaaattaa

SEQ ID NO: 477230 - DNA, 16 bp, R. norvegicus
aggaaatacagacaca

SEQ ID NO: 477231 - DNA, 16 bp, R. norvegicus
aggaaatacaggagaa

SEQ ID NO: 477232 - DNA, 17 bp, R. norvegicus
aggaaatacagggacaa

SEQ ID NO: 477233 - DNA, 16 bp, R. norvegicus
aggaaatagagacaaa

SEQ ID NO: 477234 - DNA, 16 bp, R. norvegicus
aggaaatagtcaaaat

SEQ ID NO: 477235 - DNA, 16 bp, R. norvegicus
aggaaatatgaagcat

SEQ ID NO: 477236 - DNA, 16 bp, R. norvegicus
aggaaatcaagaggct

SEQ ID NO: 477237 - DNA, 16 bp, R. norvegicus
aggaaatcaaggggat

SEQ ID NO: 477238 - DNA, 16 bp, R. norvegicus
aggaaatcctgtctca

SEQ ID NO: 477239 - DNA, 16 bp, R. norvegicus
aggaaatgaaaacatt

SEQ ID NO: 477240 - DNA, 16 bp, R. norvegicus
aggaaatgaaacagaa

SEQ ID NO: 477241 - DNA, 16 bp, R. norvegicus
aggaaatgatttattt

SEQ ID NO: 477242 - DNA, 16 bp, R. norvegicus
aggaaatgcaaaaaat

SEQ ID NO: 477243 - DNA, 16 bp, R. norvegicus
aggaaatgcaaaaatt

SEQ ID NO: 477244 - DNA, 16 bp, R. norvegicus
aggaaatgcagttgct

SEQ ID NO: 477245 - DNA, 16 bp, R. norvegicus
aggaaatgccaccatg

SEQ ID NO: 477246 - DNA, 16 bp, R. norvegicus
aggaaatggaaaacct

SEQ ID NO: 477247 - DNA, 35 bp, R. norvegicus
aggaaatggacaatttcctagacagataccaggta

SEQ ID NO: 477248 - DNA, 16 bp, R. norvegicus
aggaaatggacagttt

SEQ ID NO: 477249 - DNA, 16 bp, R. norvegicus
aggaaatggagacaga

SEQ ID NO: 477250 - DNA, 16 bp, R. norvegicus
aggaaatggatataga

SEQ ID NO: 477251 - DNA, 16 bp, R. norvegicus
aggaaatggccaattt

SEQ ID NO: 477252 - DNA, 16 bp, R. norvegicus
aggaaattcaaaaagt

SEQ ID NO: 477253 - DNA, 16 bp, R. norvegicus
aggaaattctcaaaga

SEQ ID NO: 477254 - DNA, 16 bp, R. norvegicus
aggaaattgaacagag

SEQ ID NO: 477255 - DNA, 16 bp, R. norvegicus
aggaaattgaacagat

SEQ ID NO: 477256 - DNA, 16 bp, R. norvegicus
aggaaattgtgcattt

SEQ ID NO: 477257 - DNA, 16 bp, R. norvegicus
aggaaatttgcccaat

SEQ ID NO: 477258 - DNA, 16 bp, R. norvegicus
aggaaattttccattt

SEQ ID NO: 477259 - DNA, 16 bp, R. norvegicus
aggaaattttccccaa

SEQ ID NO: 477260 - DNA, 17 bp, R. norvegicus
aggaaattttctccagt

SEQ ID NO: 477261 - DNA, 16 bp, R. norvegicus
aggaaatttttccctg

SEQ ID NO: 477262 - DNA, 16 bp, R. norvegicus
aggaacaaaagcagct

SEQ ID NO: 477263 - DNA, 16 bp, R. norvegicus
aggaacaaagatggag

SEQ ID NO: 477264 - DNA, 16 bp, R. norvegicus
aggaacaaaggcactc

SEQ ID NO: 477265 - DNA, 16 bp, R. norvegicus
aggaacaaaggcagct

SEQ ID NO: 477266 - DNA, 16 bp, R. norvegicus
aggaacaactgaggca

SEQ ID NO: 477267 - DNA, 16 bp, R. norvegicus
aggaacacagagaaac

SEQ ID NO: 477268 - DNA, 23 bp, R. norvegicus
aggaacactcctccattgttggg

SEQ ID NO: 477269 - DNA, 16 bp, R. norvegicus
aggaacacttgctgct

SEQ ID NO: 477270 - DNA, 16 bp, R. norvegicus
aggaacagacattcag

SEQ ID NO: 477271 - DNA, 16 bp, R. norvegicus
aggaacagagacagag

SEQ ID NO: 477272 - DNA, 16 bp, R. norvegicus
aggaacagagagacag

SEQ ID NO: 477273 - DNA, 16 bp, R. norvegicus
aggaacagagctgcca

SEQ ID NO: 477274 - DNA, 16 bp, R. norvegicus
aggaacagataagcca

SEQ ID NO: 477275 - DNA, 16 bp, R. norvegicus
aggaacagcagcagca

SEQ ID NO: 477276 - DNA, 16 bp, R. norvegicus
aggaacagctcaagac

SEQ ID NO: 477277 - DNA, 16 bp, R. norvegicus
aggaacagctgaagaa

SEQ ID NO: 477278 - DNA, 16 bp, R. norvegicus
aggaacagctgaagtc

SEQ ID NO: 477279 - DNA, 16 bp, R. norvegicus
aggaacaggagcagga

SEQ ID NO: 477280 - DNA, 16 bp, R. norvegicus
aggaacaggaggagca

SEQ ID NO: 477281 - DNA, 16 bp, R. norvegicus
aggaacatatactggc

SEQ ID NO: 477282 - DNA, 16 bp, R. norvegicus
aggaacatgaagtaaa

SEQ ID NO: 477283 - DNA, 16 bp, R. norvegicus
aggaacatggaagaca

SEQ ID NO: 477284 - DNA, 16 bp, R. norvegicus
aggaaccagaagggtc

SEQ ID NO: 477285 - DNA, 16 bp, R. norvegicus
aggaaccagctcctgg

SEQ ID NO: 477286 - DNA, 19 bp, R. norvegicus
aggaacccaagcaagagaa

SEQ ID NO: 477287 - DNA, 16 bp, R. norvegicus
aggaacccaaggcagg

SEQ ID NO: 477288 - DNA, 16 bp, R. norvegicus
aggaacccagagacag

SEQ ID NO: 477289 - DNA, 16 bp, R. norvegicus
aggaacccaggaaagg

SEQ ID NO: 477290 - DNA, 16 bp, R. norvegicus
aggaacccccacccag

SEQ ID NO: 477291 - DNA, 16 bp, R. norvegicus
aggaacctcaggagca

SEQ ID NO: 477292 - DNA, 16 bp, R. norvegicus
aggaacctgaggagga

SEQ ID NO: 477293 - DNA, 16 bp, R. norvegicus
aggaacctgatacagc

SEQ ID NO: 477294 - DNA, 16 bp, R. norvegicus
aggaacctggagacag

SEQ ID NO: 477295 - DNA, 16 bp, R. norvegicus
aggaacctggagtcag

SEQ ID NO: 477296 - DNA, 16 bp, R. norvegicus
aggaacctgggaaagg

SEQ ID NO: 477297 - DNA, 16 bp, R. norvegicus
aggaacctgtgcctct

SEQ ID NO: 477298 - DNA, 16 bp, R. norvegicus
aggaactagagaaagg

SEQ ID NO: 477299 - DNA, 16 bp, R. norvegicus
aggaactcaagaagtt

SEQ ID NO: 477300 - DNA, 16 bp, R. norvegicus
aggaactcaagcaaga

SEQ ID NO: 477301 - DNA, 16 bp, R. norvegicus
aggaactgaaacagaa

SEQ ID NO: 477302 - DNA, 16 bp, R. norvegicus
aggaactgaagagatg

SEQ ID NO: 477303 - DNA, 16 bp, R. norvegicus
aggaactgaagcaaaa

SEQ ID NO: 477304 - DNA, 16 bp, R. norvegicus
aggaactgaagcagac

SEQ ID NO: 477305 - DNA, 16 bp, R. norvegicus
aggaactgaaggagaa

SEQ ID NO: 477306 - DNA, 16 bp, R. norvegicus
aggaactgaagggaat

SEQ ID NO: 477307 - DNA, 16 bp, R. norvegicus
aggaactgaagggttt

SEQ ID NO: 477308 - DNA, 16 bp, R. norvegicus
aggaactgatgcagaa

SEQ ID NO: 477309 - DNA, 16 bp, R. norvegicus
aggaactggaagagct

SEQ ID NO: 477310 - DNA, 16 bp, R. norvegicus
aggaactggagcagag

SEQ ID NO: 477311 - DNA, 16 bp, R. norvegicus
aggaactggaggaact

SEQ ID NO: 477312 - DNA, 18 bp, R. norvegicus
aggaactggctgctgtgg

SEQ ID NO: 477313 - DNA, 16 bp, R. norvegicus
aggaactgtgggagag

SEQ ID NO: 477314 - DNA, 16 bp, R. norvegicus
aggaactgtgggagga

SEQ ID NO: 477315 - DNA, 16 bp, R. norvegicus
aggaactgtgtcactg

SEQ ID NO: 477316 - DNA, 16 bp, R. norvegicus
aggaacttcctgaagc

SEQ ID NO: 477317 - DNA, 16 bp, R. norvegicus
aggaacttctggcttt

SEQ ID NO: 477318 - DNA, 16 bp, R. norvegicus
aggaacttggaagata

SEQ ID NO: 477319 - DNA, 16 bp, R. norvegicus
aggaacttggagacag

SEQ ID NO: 477320 - DNA, 16 bp, R. norvegicus
aggaagaaaataatca

SEQ ID NO: 477321 - DNA, 16 bp, R. norvegicus
aggaagaaagaataca

SEQ ID NO: 477322 - DNA, 16 bp, R. norvegicus
aggaagaaatacagaa

SEQ ID NO: 477323 - DNA, 16 bp, R. norvegicus
aggaagaaatcaagaa

SEQ ID NO: 477324 - DNA, 16 bp, R. norvegicus
aggaagaaatgacaga

SEQ ID NO: 477325 - DNA, 16 bp, R. norvegicus
aggaagaaatgggtca

SEQ ID NO: 477326 - DNA, 16 bp, R. norvegicus
aggaagaacaatatat

SEQ ID NO: 477327 - DNA, 16 bp, R. norvegicus
aggaagaacaatatta

SEQ ID NO: 477328 - DNA, 16 bp, R. norvegicus
aggaagaacagggaca

SEQ ID NO: 477329 - DNA, 16 bp, R. norvegicus
aggaagaactctgtga

SEQ ID NO: 477330 - DNA, 16 bp, R. norvegicus
aggaagaactggaaga

SEQ ID NO: 477331 - DNA, 16 bp, R. norvegicus
aggaagaagcaggctg

SEQ ID NO: 477332 - DNA, 16 bp, R. norvegicus
aggaagaagccaaaat

SEQ ID NO: 477333 - DNA, 16 bp, R. norvegicus
aggaagaagccaaagt

SEQ ID NO: 477334 - DNA, 16 bp, R. norvegicus
aggaagaagctgagga

SEQ ID NO: 477335 - DNA, 16 bp, R. norvegicus
aggaagaaggaagcca

SEQ ID NO: 477336 - DNA, 16 bp, R. norvegicus
aggaagaatgaatttc

SEQ ID NO: 477337 - DNA, 16 bp, R. norvegicus
aggaagaatggaaaca

SEQ ID NO: 477338 - DNA, 16 bp, R. norvegicus
aggaagaatggataca

SEQ ID NO: 477339 - DNA, 16 bp, R. norvegicus
aggaagacaaagatga

SEQ ID NO: 477340 - DNA, 16 bp, R. norvegicus
aggaagacaagcagtc

SEQ ID NO: 477341 - DNA, 16 bp, R. norvegicus
aggaagacacaatcaa

SEQ ID NO: 477342 - DNA, 16 bp, R. norvegicus
aggaagacacaggaag

SEQ ID NO: 477343 - DNA, 16 bp, R. norvegicus
aggaagacagaaataa

SEQ ID NO: 477344 - DNA, 16 bp, R. norvegicus
aggaagacagggcagg

SEQ ID NO: 477345 - DNA, 16 bp, R. norvegicus
aggaagaccaaagtgc

SEQ ID NO: 477346 - DNA, 17 bp, R. norvegicus
aggaagacctgtgccac

SEQ ID NO: 477347 - DNA, 55 bp, R. norvegicus
aggaagacggtttggcaggcctggcaaaagaaggccctgctatcagctttcagca

SEQ ID NO: 477348 - DNA, 16 bp, R. norvegicus
aggaagagaaactgag

SEQ ID NO: 477349 - DNA, 16 bp, R. norvegicus
aggaagagacagcaag

SEQ ID NO: 477350 - DNA, 16 bp, R. norvegicus
aggaagagactgtctt

SEQ ID NO: 477351 - DNA, 16 bp, R. norvegicus
aggaagagagactctg

SEQ ID NO: 477352 - DNA, 16 bp, R. norvegicus
aggaagagagcctctg

SEQ ID NO: 477353 - DNA, 16 bp, R. norvegicus
aggaagagatcaggtg

SEQ ID NO: 477354 - DNA, 16 bp, R. norvegicus
aggaagagcagtcagt

SEQ ID NO: 477355 - DNA, 16 bp, R. norvegicus
aggaagagctgaagac

SEQ ID NO: 477356 - DNA, 16 bp, R. norvegicus
aggaagagctgagttc

SEQ ID NO: 477357 - DNA, 16 bp, R. norvegicus
aggaagagcttctggg

SEQ ID NO: 477358 - DNA, 16 bp, R. norvegicus
aggaagaggaagatct

SEQ ID NO: 477359 - DNA, 16 bp, R. norvegicus
aggaagaggaagcagc

SEQ ID NO: 477360 - DNA, 16 bp, R. norvegicus
aggaagaggaagctgc

SEQ ID NO: 477361 - DNA, 16 bp, R. norvegicus
aggaagaggaagtggc

SEQ ID NO: 477362 - DNA, 16 bp, R. norvegicus
aggaagaggacagcag

SEQ ID NO: 477363 - DNA, 17 bp, R. norvegicus
aggaagaggcagccaga

SEQ ID NO: 477364 - DNA, 16 bp, R. norvegicus
aggaagaggcaggtgg

SEQ ID NO: 477365 - DNA, 16 bp, R. norvegicus
aggaagaggctgctca

SEQ ID NO: 477366 - DNA, 16 bp, R. norvegicus
aggaagagggcatcag

SEQ ID NO: 477367 - DNA, 16 bp, R. norvegicus
aggaagagtgatgtgg

SEQ ID NO: 477368 - DNA, 16 bp, R. norvegicus
aggaagagtgtcactg

SEQ ID NO: 477369 - DNA, 16 bp, R. norvegicus
aggaagagttggagga

SEQ ID NO: 477370 - DNA, 16 bp, R. norvegicus
aggaagatcaatggaa

SEQ ID NO: 477371 - DNA, 16 bp, R. norvegicus
aggaagatcacaagtt

SEQ ID NO: 477372 - DNA, 16 bp, R. norvegicus
aggaagatcagaagtc

SEQ ID NO: 477373 - DNA, 16 bp, R. norvegicus
aggaagatctctgaat

SEQ ID NO: 477374 - DNA, 16 bp, R. norvegicus
aggaagatctcttgag

SEQ ID NO: 477375 - DNA, 16 bp, R. norvegicus
aggaagatctggagtt

SEQ ID NO: 477376 - DNA, 16 bp, R. norvegicus
aggaagatcttgagtt

SEQ ID NO: 477377 - DNA, 16 bp, R. norvegicus
aggaagatggagcaga

SEQ ID NO: 477378 - DNA, 16 bp, R. norvegicus
aggaagattgaaaacc

SEQ ID NO: 477379 - DNA, 16 bp, R. norvegicus
aggaagatttgggaag

SEQ ID NO: 477380 - DNA, 16 bp, R. norvegicus
aggaagcaagctggag

SEQ ID NO: 477381 - DNA, 16 bp, R. norvegicus
aggaagcaaggaagca

SEQ ID NO: 477382 - DNA, 16 bp, R. norvegicus
aggaagcacaggcagg

SEQ ID NO: 477383 - DNA, 16 bp, R. norvegicus
aggaagcacctgctgt

SEQ ID NO: 477384 - DNA, 16 bp, R. norvegicus
aggaagcagaaggcag

SEQ ID NO: 477385 - DNA, 16 bp, R. norvegicus
aggaagcagagaaaat

SEQ ID NO: 477386 - DNA, 16 bp, R. norvegicus
aggaagcagagagaat

SEQ ID NO: 477387 - DNA, 16 bp, R. norvegicus
aggaagcagagagata

SEQ ID NO: 477388 - DNA, 16 bp, R. norvegicus
aggaagcagagagtgg

SEQ ID NO: 477389 - DNA, 16 bp, R. norvegicus
aggaagcagaggcagc

SEQ ID NO: 477390 - DNA, 16 bp, R. norvegicus
aggaagcagaggcagg

SEQ ID NO: 477391 - DNA, 16 bp, R. norvegicus
aggaagcagaggccag

SEQ ID NO: 477392 - DNA, 16 bp, R. norvegicus
aggaagcagagggcag

SEQ ID NO: 477393 - DNA, 16 bp, R. norvegicus
aggaagcagcagcagc

SEQ ID NO: 477394 - DNA, 16 bp, R. norvegicus
aggaagcagccatgtt

SEQ ID NO: 477395 - DNA, 16 bp, R. norvegicus
aggaagcaggaagtgg

SEQ ID NO: 477396 - DNA, 16 bp, R. norvegicus
aggaagcaggagccga

SEQ ID NO: 477397 - DNA, 16 bp, R. norvegicus
aggaagcaggaggtga

SEQ ID NO: 477398 - DNA, 16 bp, R. norvegicus
aggaagcaggcagaga

SEQ ID NO: 477399 - DNA, 16 bp, R. norvegicus
aggaagccactgaaga

SEQ ID NO: 477400 - DNA, 16 bp, R. norvegicus
aggaagccagaaacag

SEQ ID NO: 477401 - DNA, 16 bp, R. norvegicus
aggaagccagaggagg

SEQ ID NO: 477402 - DNA, 16 bp, R. norvegicus
aggaagccaggaaaag

SEQ ID NO: 477403 - DNA, 16 bp, R. norvegicus
aggaagccatgaggag

SEQ ID NO: 477404 - DNA, 16 bp, R. norvegicus
aggaagctgaagaaga

SEQ ID NO: 477405 - DNA, 16 bp, R. norvegicus
aggaagctgagaaaga

SEQ ID NO: 477406 - DNA, 16 bp, R. norvegicus
aggaagctgaggaaga

SEQ ID NO: 477407 - DNA, 16 bp, R. norvegicus
aggaagctgaggccag

SEQ ID NO: 477408 - DNA, 16 bp, R. norvegicus
aggaagctggaggcag

SEQ ID NO: 477409 - DNA, 16 bp, R. norvegicus
aggaagctggaggctg

SEQ ID NO: 477410 - DNA, 16 bp, R. norvegicus
aggaagctggagtagc

SEQ ID NO: 477411 - DNA, 16 bp, R. norvegicus
aggaagctgggaagga

SEQ ID NO: 477412 - DNA, 16 bp, R. norvegicus
aggaagctgggaggag

SEQ ID NO: 477413 - DNA, 16 bp, R. norvegicus
aggaagcttttgctct

SEQ ID NO: 477414 - DNA, 16 bp, R. norvegicus
aggaaggacacttcag

SEQ ID NO: 477415 - DNA, 16 bp, R. norvegicus
aggaaggacagagaca

SEQ ID NO: 477416 - DNA, 16 bp, R. norvegicus
aggaaggagaagccac

SEQ ID NO: 477417 - DNA, 16 bp, R. norvegicus
aggaaggagccaagga

SEQ ID NO: 477418 - DNA, 16 bp, R. norvegicus
aggaaggagcctccct

SEQ ID NO: 477419 - DNA, 16 bp, R. norvegicus
aggaaggagctggaga

SEQ ID NO: 477420 - DNA, 16 bp, R. norvegicus
aggaaggatgcttcat

SEQ ID NO: 477421 - DNA, 16 bp, R. norvegicus
aggaaggatttttttt

SEQ ID NO: 477422 - DNA, 16 bp, R. norvegicus
aggaaggcaggcatgg

SEQ ID NO: 477423 - DNA, 16 bp, R. norvegicus
aggaaggcaggctgag

SEQ ID NO: 477424 - DNA, 16 bp, R. norvegicus
aggaaggccagcagtc

SEQ ID NO: 477425 - DNA, 16 bp, R. norvegicus
aggaaggctactattt

SEQ ID NO: 477426 - DNA, 16 bp, R. norvegicus
aggaaggctactgact

SEQ ID NO: 477427 - DNA, 17 bp, R. norvegicus
aggaaggctactggttt

SEQ ID NO: 477428 - DNA, 16 bp, R. norvegicus
aggaagggaactgggt

SEQ ID NO: 477429 - DNA, 16 bp, R. norvegicus
aggaagggaccttaga

SEQ ID NO: 477430 - DNA, 16 bp, R. norvegicus
aggaagggccattcag

SEQ ID NO: 477431 - DNA, 16 bp, R. norvegicus
aggaagggctggggag

SEQ ID NO: 477432 - DNA, 16 bp, R. norvegicus
aggaagggttgaaaga

SEQ ID NO: 477433 - DNA, 42 bp, R. norvegicus
aggaagggtttggctccaggtcacaaggtagcagcatgccct

SEQ ID NO: 477434 - DNA, 16 bp, R. norvegicus
aggaaggtggatctct

SEQ ID NO: 477435 - DNA, 16 bp, R. norvegicus
aggaaggttgaggacc

SEQ ID NO: 477436 - DNA, 16 bp, R. norvegicus
aggaaggttgggaacc

SEQ ID NO: 477437 - DNA, 16 bp, R. norvegicus
aggaagtagcaacaaa

SEQ ID NO: 477438 - DNA, 16 bp, R. norvegicus
aggaagtagctgagga

SEQ ID NO: 477439 - DNA, 16 bp, R. norvegicus
aggaagtatggccttg

SEQ ID NO: 477440 - DNA, 16 bp, R. norvegicus
aggaagtcaaaaggat

SEQ ID NO: 477441 - DNA, 38 bp, R. norvegicus
aggaagtgatgaccgacatgaagaaaatgagcgagcag

SEQ ID NO: 477442 - DNA, 16 bp, R. norvegicus
aggaagtgcttgctga

SEQ ID NO: 477443 - DNA, 16 bp, R. norvegicus
aggaagtgtggcagca

SEQ ID NO: 477444 - DNA, 16 bp, R. norvegicus
aggaagtgtgtgactg

SEQ ID NO: 477445 - DNA, 16 bp, R. norvegicus
aggaagttgtttccct

SEQ ID NO: 477446 - DNA, 16 bp, R. norvegicus
aggaatagtgattatt

SEQ ID NO: 477447 - DNA, 16 bp, R. norvegicus
aggaatatgaagtgtc

SEQ ID NO: 477448 - DNA, 16 bp, R. norvegicus
aggaatcaccatcctg

SEQ ID NO: 477449 - DNA, 16 bp, R. norvegicus
aggaatcagaaaaatc

SEQ ID NO: 477450 - DNA, 16 bp, R. norvegicus
aggaatcagtgaaagg

SEQ ID NO: 477451 - DNA, 16 bp, R. norvegicus
aggaatctgaactcag

SEQ ID NO: 477452 - DNA, 16 bp, R. norvegicus
aggaatgaaaatattt

SEQ ID NO: 477453 - DNA, 16 bp, R. norvegicus
aggaatgatgaatggc

SEQ ID NO: 477454 - DNA, 16 bp, R. norvegicus
aggaatgcatacagaa

SEQ ID NO: 477455 - DNA, 16 bp, R. norvegicus
aggaatggaaaccctg

SEQ ID NO: 477456 - DNA, 16 bp, R. norvegicus
aggaatggatgggtag

SEQ ID NO: 477457 - DNA, 16 bp, R. norvegicus
aggaatggctgcaggt

SEQ ID NO: 477458 - DNA, 16 bp, R. norvegicus
aggaatgggatgagga

SEQ ID NO: 477459 - DNA, 16 bp, R. norvegicus
aggaatggtatatctg

SEQ ID NO: 477460 - DNA, 16 bp, R. norvegicus
aggaatggttcaatat

SEQ ID NO: 477461 - DNA, 16 bp, R. norvegicus
aggaatgtgagcagag

SEQ ID NO: 477462 - DNA, 16 bp, R. norvegicus
aggaatgtgggaagaa

SEQ ID NO: 477463 - DNA, 16 bp, R. norvegicus
aggaattaaagacttc

SEQ ID NO: 477464 - DNA, 16 bp, R. norvegicus
aggaattaaggccaac

SEQ ID NO: 477465 - DNA, 16 bp, R. norvegicus
aggaattccctatgaa

SEQ ID NO: 477466 - DNA, 16 bp, R. norvegicus
aggaattgggacacca

SEQ ID NO: 477467 - DNA, 16 bp, R. norvegicus
aggaatttaaaatgga

SEQ ID NO: 477468 - DNA, 16 bp, R. norvegicus
aggaattttttcatct

SEQ ID NO: 477469 - DNA, 16 bp, R. norvegicus
aggacaaaaatggcaa

SEQ ID NO: 477470 - DNA, 16 bp, R. norvegicus
aggacaaaagaagtaa

SEQ ID NO: 477471 - DNA, 16 bp, R. norvegicus
aggacaaaatggcaat

SEQ ID NO: 477472 - DNA, 16 bp, R. norvegicus
aggacaaacagacaga

SEQ ID NO: 477473 - DNA, 16 bp, R. norvegicus
aggacaaatgctccac

SEQ ID NO: 477474 - DNA, 16 bp, R. norvegicus
aggacaacttccagga

SEQ ID NO: 477475 - DNA, 16 bp, R. norvegicus
aggacaacttctggga

SEQ ID NO: 477476 - DNA, 16 bp, R. norvegicus
aggacaacttgtgaga

SEQ ID NO: 477477 - DNA, 16 bp, R. norvegicus
aggacaactttgagga

SEQ ID NO: 477478 - DNA, 16 bp, R. norvegicus
aggacaagagagatgg

SEQ ID NO: 477479 - DNA, 16 bp, R. norvegicus
aggacaaggacaagga

SEQ ID NO: 477480 - DNA, 16 bp, R. norvegicus
aggacaatgttttgtt

SEQ ID NO: 477481 - DNA, 16 bp, R. norvegicus
aggacacaacagggat

SEQ ID NO: 477482 - DNA, 16 bp, R. norvegicus
aggacacacagaagca

SEQ ID NO: 477483 - DNA, 16 bp, R. norvegicus
aggacacacagaggca

SEQ ID NO: 477484 - DNA, 16 bp, R. norvegicus
aggacacacaggacac

SEQ ID NO: 477485 - DNA, 16 bp, R. norvegicus
aggacacagaagaagg

SEQ ID NO: 477486 - DNA, 16 bp, R. norvegicus
aggacacagagaaaac

SEQ ID NO: 477487 - DNA, 16 bp, R. norvegicus
aggacacagagacagt

SEQ ID NO: 477488 - DNA, 16 bp, R. norvegicus
aggacacagagagaag

SEQ ID NO: 477489 - DNA, 16 bp, R. norvegicus
aggacacagagaggaa

SEQ ID NO: 477490 - DNA, 16 bp, R. norvegicus
aggacacaggacacag

SEQ ID NO: 477491 - DNA, 16 bp, R. norvegicus
aggacacagtgagaag

SEQ ID NO: 477492 - DNA, 16 bp, R. norvegicus
aggacacatgttccac

SEQ ID NO: 477493 - DNA, 16 bp, R. norvegicus
aggacaccaggaaaac

SEQ ID NO: 477494 - DNA, 19 bp, R. norvegicus
aggacacccactgtcctat

SEQ ID NO: 477495 - DNA, 16 bp, R. norvegicus
aggacaccctggagtt

SEQ ID NO: 477496 - DNA, 16 bp, R. norvegicus
aggacaccttcattct

SEQ ID NO: 477497 - DNA, 17 bp, R. norvegicus
aggacacgtgatgaaag

SEQ ID NO: 477498 - DNA, 16 bp, R. norvegicus
aggacacgtgctccat

SEQ ID NO: 477499 - DNA, 16 bp, R. norvegicus
aggacacttgctcagc

SEQ ID NO: 477500 - DNA, 16 bp, R. norvegicus
aggacagaaaagggca

SEQ ID NO: 477501 - DNA, 16 bp, R. norvegicus
aggacagaagaaggca

SEQ ID NO: 477502 - DNA, 16 bp, R. norvegicus
aggacagaagagagca

SEQ ID NO: 477503 - DNA, 16 bp, R. norvegicus
aggacagaagagggca

SEQ ID NO: 477504 - DNA, 16 bp, R. norvegicus
aggacagaaggacagg

SEQ ID NO: 477505 - DNA, 16 bp, R. norvegicus
aggacagaaggaggcc

SEQ ID NO: 477506 - DNA, 16 bp, R. norvegicus
aggacagatggacaga

SEQ ID NO: 477507 - DNA, 16 bp, R. norvegicus
aggacagcacagagaa

SEQ ID NO: 477508 - DNA, 16 bp, R. norvegicus
aggacagcagcagcag

SEQ ID NO: 477509 - DNA, 16 bp, R. norvegicus
aggacagccaaagcca

SEQ ID NO: 477510 - DNA, 16 bp, R. norvegicus
aggacagccaaagctg

SEQ ID NO: 477511 - DNA, 16 bp, R. norvegicus
aggacagccaaggcca

SEQ ID NO: 477512 - DNA, 16 bp, R. norvegicus
aggacagccagggaaa

SEQ ID NO: 477513 - DNA, 16 bp, R. norvegicus
aggacagccagggctg

SEQ ID NO: 477514 - DNA, 16 bp, R. norvegicus
aggacagccatactag

SEQ ID NO: 477515 - DNA, 16 bp, R. norvegicus
aggacagccatgacta

SEQ ID NO: 477516 - DNA, 16 bp, R. norvegicus
aggacagcctgggcta

SEQ ID NO: 477517 - DNA, 16 bp, R. norvegicus
aggacagcctgggctc

SEQ ID NO: 477518 - DNA, 16 bp, R. norvegicus
aggacagcctggtcta

SEQ ID NO: 477519 - DNA, 16 bp, R. norvegicus
aggacagcttttggga

SEQ ID NO: 477520 - DNA, 16 bp, R. norvegicus
aggacaggaactgaag

SEQ ID NO: 477521 - DNA, 16 bp, R. norvegicus
aggacagtcagggcta

SEQ ID NO: 477522 - DNA, 16 bp, R. norvegicus
aggacagtctgccact

SEQ ID NO: 477523 - DNA, 16 bp, R. norvegicus
aggacagtgatggtga

SEQ ID NO: 477524 - DNA, 16 bp, R. norvegicus
aggacagttacagtgt

SEQ ID NO: 477525 - DNA, 16 bp, R. norvegicus
aggacataatcaataa

SEQ ID NO: 477526 - DNA, 16 bp, R. norvegicus
aggacatcaactgaag

SEQ ID NO: 477527 - DNA, 16 bp, R. norvegicus
aggacatcataaattt

SEQ ID NO: 477528 - DNA, 23 bp, R. norvegicus
aggacatccagcccaaaagagat

SEQ ID NO: 477529 - DNA, 16 bp, R. norvegicus
aggacatcctgggcta

SEQ ID NO: 477530 - DNA, 16 bp, R. norvegicus
aggacatctgggctct

SEQ ID NO: 477531 - DNA, 16 bp, R. norvegicus
aggacatctgggttgt

SEQ ID NO: 477532 - DNA, 16 bp, R. norvegicus
aggacatgaccacagg

SEQ ID NO: 477533 - DNA, 16 bp, R. norvegicus
aggacatggagaaatc

SEQ ID NO: 477534 - DNA, 16 bp, R. norvegicus
aggacattgtcccttg

SEQ ID NO: 477535 - DNA, 16 bp, R. norvegicus
aggacattttgcctct

SEQ ID NO: 477536 - DNA, 16 bp, R. norvegicus
aggaccaaagcatcca

SEQ ID NO: 477537 - DNA, 16 bp, R. norvegicus
aggaccaaagggctcc

SEQ ID NO: 477538 - DNA, 16 bp, R. norvegicus
aggaccaagcacctcc

SEQ ID NO: 477539 - DNA, 16 bp, R. norvegicus
aggaccaaggcaactt

SEQ ID NO: 477540 - DNA, 16 bp, R. norvegicus
aggaccaaggccttct

SEQ ID NO: 477541 - DNA, 16 bp, R. norvegicus
aggaccaaggggttcc

SEQ ID NO: 477542 - DNA, 16 bp, R. norvegicus
aggaccaagtgagcct

SEQ ID NO: 477543 - DNA, 16 bp, R. norvegicus
aggaccacaagtaaga

SEQ ID NO: 477544 - DNA, 16 bp, R. norvegicus
aggaccaccagcccgg

SEQ ID NO: 477545 - DNA, 16 bp, R. norvegicus
aggaccagaagtctca

SEQ ID NO: 477546 - DNA, 16 bp, R. norvegicus
aggaccagcagaaaga

SEQ ID NO: 477547 - DNA, 16 bp, R. norvegicus
aggaccagcagcctca

SEQ ID NO: 477548 - DNA, 16 bp, R. norvegicus
aggaccagcagtctca

SEQ ID NO: 477549 - DNA, 16 bp, R. norvegicus
aggaccagcagtttca

SEQ ID NO: 477550 - DNA, 16 bp, R. norvegicus
aggaccagcctgggct

SEQ ID NO: 477551 - DNA, 16 bp, R. norvegicus
aggaccagctcctggt

SEQ ID NO: 477552 - DNA, 16 bp, R. norvegicus
aggaccaggaccagga

SEQ ID NO: 477553 - DNA, 19 bp, R. norvegicus
aggaccaggttgtctcctg

SEQ ID NO: 477554 - DNA, 16 bp, R. norvegicus
aggaccatgagtttga

SEQ ID NO: 477555 - DNA, 16 bp, R. norvegicus
aggaccatttgttgaa

SEQ ID NO: 477556 - DNA, 16 bp, R. norvegicus
aggacccagatgccct

SEQ ID NO: 477557 - DNA, 16 bp, R. norvegicus
aggacccagatgtcct

SEQ ID NO: 477558 - DNA, 16 bp, R. norvegicus
aggacccagctagacc

SEQ ID NO: 477559 - DNA, 16 bp, R. norvegicus
aggacccaggaagttt

SEQ ID NO: 477560 - DNA, 16 bp, R. norvegicus
aggacccaggacccag

SEQ ID NO: 477561 - DNA, 16 bp, R. norvegicus
aggacccaggagcagc

SEQ ID NO: 477562 - DNA, 16 bp, R. norvegicus
aggacccaggcttggt

SEQ ID NO: 477563 - DNA, 16 bp, R. norvegicus
aggacccagggagtgg

SEQ ID NO: 477564 - DNA, 16 bp, R. norvegicus
aggacccccagcccag

SEQ ID NO: 477565 - DNA, 16 bp, R. norvegicus
aggacccccttgaagg

SEQ ID NO: 477566 - DNA, 16 bp, R. norvegicus
aggacccctgagcctg

SEQ ID NO: 477567 - DNA, 16 bp, R. norvegicus
aggacccctgcccctg

SEQ ID NO: 477568 - DNA, 16 bp, R. norvegicus
aggaccctgagattcc

SEQ ID NO: 477569 - DNA, 21 bp, R. norvegicus
aggaccctgcactctgctgcc

SEQ ID NO: 477570 - DNA, 16 bp, R. norvegicus
aggaccgaacccagga

SEQ ID NO: 477571 - DNA, 16 bp, R. norvegicus
aggaccgctggaagag

SEQ ID NO: 477572 - DNA, 16 bp, R. norvegicus
aggacctacaggagca

SEQ ID NO: 477573 - DNA, 16 bp, R. norvegicus
aggacctactgtgtgc

SEQ ID NO: 477574 - DNA, 16 bp, R. norvegicus
aggacctctggaaaaa

SEQ ID NO: 477575 - DNA, 16 bp, R. norvegicus
aggacctctggaaagc

SEQ ID NO: 477576 - DNA, 16 bp, R. norvegicus
aggacctcttctccca

SEQ ID NO: 477577 - DNA, 16 bp, R. norvegicus
aggacctgagctcaga

SEQ ID NO: 477578 - DNA, 16 bp, R. norvegicus
aggacctgaggaccca

SEQ ID NO: 477579 - DNA, 16 bp, R. norvegicus
aggacctgagttttat

SEQ ID NO: 477580 - DNA, 16 bp, R. norvegicus
aggacctggagcctgt

SEQ ID NO: 477581 - DNA, 16 bp, R. norvegicus
aggacctggattcaat

SEQ ID NO: 477582 - DNA, 16 bp, R. norvegicus
aggacctggctttggt

SEQ ID NO: 477583 - DNA, 16 bp, R. norvegicus
aggacctgggttctgt

SEQ ID NO: 477584 - DNA, 16 bp, R. norvegicus
aggaccttcagtgttc

SEQ ID NO: 477585 - DNA, 16 bp, R. norvegicus
aggacgaggacaagga

SEQ ID NO: 477586 - DNA, 16 bp, R. norvegicus
aggacgaggatgagga

SEQ ID NO: 477587 - DNA, 16 bp, R. norvegicus
aggactacacagaaaa

SEQ ID NO: 477588 - DNA, 16 bp, R. norvegicus
aggactacagagagaa

SEQ ID NO: 477589 - DNA, 16 bp, R. norvegicus
aggactacctgcccag

SEQ ID NO: 477590 - DNA, 16 bp, R. norvegicus
aggactcagcagctgc

SEQ ID NO: 477591 - DNA, 17 bp, R. norvegicus
aggactcccagctcaaa

SEQ ID NO: 477592 - DNA, 16 bp, R. norvegicus
aggactcctgggagca

SEQ ID NO: 477593 - DNA, 16 bp, R. norvegicus
aggactctgctccttt

SEQ ID NO: 477594 - DNA, 16 bp, R. norvegicus
aggactcttgactctt

SEQ ID NO: 477595 - DNA, 16 bp, R. norvegicus
aggactgaaagaggtg

SEQ ID NO: 477596 - DNA, 16 bp, R. norvegicus
aggactgaagagcttg

SEQ ID NO: 477597 - DNA, 16 bp, R. norvegicus
aggactgaagcagctg

SEQ ID NO: 477598 - DNA, 16 bp, R. norvegicus
aggactgaagcatgca

SEQ ID NO: 477599 - DNA, 16 bp, R. norvegicus
aggactgaaggaacta

SEQ ID NO: 477600 - DNA, 16 bp, R. norvegicus
aggactgaaggggtca

SEQ ID NO: 477601 - DNA, 16 bp, R. norvegicus
aggactgcagagatgg

SEQ ID NO: 477602 - DNA, 16 bp, R. norvegicus
aggactgcagcatcca

SEQ ID NO: 477603 - DNA, 16 bp, R. norvegicus
aggactgccagcccag

SEQ ID NO: 477604 - DNA, 16 bp, R. norvegicus
aggactgcctggtcta

SEQ ID NO: 477605 - DNA, 16 bp, R. norvegicus
aggactgccttttctg

SEQ ID NO: 477606 - DNA, 16 bp, R. norvegicus
aggactggaagaaact

SEQ ID NO: 477607 - DNA, 16 bp, R. norvegicus
aggactggcacaagtt

SEQ ID NO: 477608 - DNA, 16 bp, R. norvegicus
aggactgtcctgaagg

SEQ ID NO: 477609 - DNA, 16 bp, R. norvegicus
aggactgtgctgtgct

SEQ ID NO: 477610 - DNA, 16 bp, R. norvegicus
aggactgtggaaggac

SEQ ID NO: 477611 - DNA, 16 bp, R. norvegicus
aggacttaaagagctg

SEQ ID NO: 477612 - DNA, 16 bp, R. norvegicus
aggacttaatattcct

SEQ ID NO: 477613 - DNA, 16 bp, R. norvegicus
aggacttcaaaacaaa

SEQ ID NO: 477614 - DNA, 16 bp, R. norvegicus
aggacttcaagaagga

SEQ ID NO: 477615 - DNA, 16 bp, R. norvegicus
aggacttccaggagaa

SEQ ID NO: 477616 - DNA, 16 bp, R. norvegicus
aggacttccgggagaa

SEQ ID NO: 477617 - DNA, 16 bp, R. norvegicus
aggacttctggaagaa

SEQ ID NO: 477618 - DNA, 16 bp, R. norvegicus
aggacttcttggggaa

SEQ ID NO: 477619 - DNA, 16 bp, R. norvegicus
aggacttgggaggaag

SEQ ID NO: 477620 - DNA, 16 bp, R. norvegicus
aggactttaagaaggt

SEQ ID NO: 477621 - DNA, 16 bp, R. norvegicus
aggagaaaaaattctg

SEQ ID NO: 477622 - DNA, 16 bp, R. norvegicus
aggagaaaaccagctc

SEQ ID NO: 477623 - DNA, 16 bp, R. norvegicus
aggagaaaacttccct

SEQ ID NO: 477624 - DNA, 16 bp, R. norvegicus
aggagaaaagaaatca

SEQ ID NO: 477625 - DNA, 16 bp, R. norvegicus
aggagaaacagcaagt

SEQ ID NO: 477626 - DNA, 16 bp, R. norvegicus
aggagaaacagcaata

SEQ ID NO: 477627 - DNA, 16 bp, R. norvegicus
aggagaaaccaggaag

SEQ ID NO: 477628 - DNA, 16 bp, R. norvegicus
aggagaaactgaggca

SEQ ID NO: 477629 - DNA, 16 bp, R. norvegicus
aggagaaactgcacag

SEQ ID NO: 477630 - DNA, 16 bp, R. norvegicus
aggagaaaggaagttg

SEQ ID NO: 477631 - DNA, 16 bp, R. norvegicus
aggagaaatggacaca

SEQ ID NO: 477632 - DNA, 16 bp, R. norvegicus
aggagaacaatgtgtc

SEQ ID NO: 477633 - DNA, 16 bp, R. norvegicus
aggagaacatggccca

SEQ ID NO: 477634 - DNA, 16 bp, R. norvegicus
aggagaactggagcca

SEQ ID NO: 477635 - DNA, 16 bp, R. norvegicus
aggagaagaaatccag

SEQ ID NO: 477636 - DNA, 16 bp, R. norvegicus
aggagaagaagcagca

SEQ ID NO: 477637 - DNA, 16 bp, R. norvegicus
aggagaagacacagag

SEQ ID NO: 477638 - DNA, 16 bp, R. norvegicus
aggagaagatgtgcct

SEQ ID NO: 477639 - DNA, 16 bp, R. norvegicus
aggagaagcagcagag

SEQ ID NO: 477640 - DNA, 16 bp, R. norvegicus
aggagaagcccttgga

SEQ ID NO: 477641 - DNA, 16 bp, R. norvegicus
aggagaagcccttggc

SEQ ID NO: 477642 - DNA, 16 bp, R. norvegicus
aggagaagctggagac

SEQ ID NO: 477643 - DNA, 16 bp, R. norvegicus
aggagaagcttctctg

SEQ ID NO: 477644 - DNA, 16 bp, R. norvegicus
aggagaaggagccaga

SEQ ID NO: 477645 - DNA, 16 bp, R. norvegicus
aggagaagggcaaccc

SEQ ID NO: 477646 - DNA, 17 bp, R. norvegicus
aggagaatcaagatgga

SEQ ID NO: 477647 - DNA, 16 bp, R. norvegicus
aggagaatggatacag

SEQ ID NO: 477648 - DNA, 16 bp, R. norvegicus
aggagaatgtcagagc

SEQ ID NO: 477649 - DNA, 16 bp, R. norvegicus
aggagacaaagccaag

SEQ ID NO: 477650 - DNA, 16 bp, R. norvegicus
aggagacaagcctctg

SEQ ID NO: 477651 - DNA, 16 bp, R. norvegicus
aggagacacccacatc

SEQ ID NO: 477652 - DNA, 16 bp, R. norvegicus
aggagacagagagatg

SEQ ID NO: 477653 - DNA, 16 bp, R. norvegicus
aggagacagagccagg

SEQ ID NO: 477654 - DNA, 16 bp, R. norvegicus
aggagacagaggagtc

SEQ ID NO: 477655 - DNA, 16 bp, R. norvegicus
aggagacagaggcaag

SEQ ID NO: 477656 - DNA, 16 bp, R. norvegicus
aggagacagaggcagg

SEQ ID NO: 477657 - DNA, 16 bp, R. norvegicus
aggagacagaggccag

SEQ ID NO: 477658 - DNA, 16 bp, R. norvegicus
aggagacagggatgat

SEQ ID NO: 477659 - DNA, 16 bp, R. norvegicus
aggagacatcctgcct

SEQ ID NO: 477660 - DNA, 16 bp, R. norvegicus
aggagacccctgtgaa

SEQ ID NO: 477661 - DNA, 16 bp, R. norvegicus
aggagacctcagagcc

SEQ ID NO: 477662 - DNA, 16 bp, R. norvegicus
aggagactactgggac

SEQ ID NO: 477663 - DNA, 16 bp, R. norvegicus
aggagactgaggcagg

SEQ ID NO: 477664 - DNA, 16 bp, R. norvegicus
aggagactggaagaga

SEQ ID NO: 477665 - DNA, 16 bp, R. norvegicus
aggagactggagaaga

SEQ ID NO: 477666 - DNA, 16 bp, R. norvegicus
aggagactgtcttcca

SEQ ID NO: 477667 - DNA, 16 bp, R. norvegicus
aggagactgtcttctg

SEQ ID NO: 477668 - DNA, 16 bp, R. norvegicus
aggagagaaactgcac

SEQ ID NO: 477669 - DNA, 16 bp, R. norvegicus
aggagagaaagggttt

SEQ ID NO: 477670 - DNA, 16 bp, R. norvegicus
aggagagaaccaactc

SEQ ID NO: 477671 - DNA, 16 bp, R. norvegicus
aggagagaagtttgaa

SEQ ID NO: 477672 - DNA, 16 bp, R. norvegicus
aggagagaatctcagg

SEQ ID NO: 477673 - DNA, 16 bp, R. norvegicus
aggagagagaatatgt

SEQ ID NO: 477674 - DNA, 16 bp, R. norvegicus
aggagagagagaagcc

SEQ ID NO: 477675 - DNA, 16 bp, R. norvegicus
aggagagagctggacc

SEQ ID NO: 477676 - DNA, 16 bp, R. norvegicus
aggagagatgccccag

SEQ ID NO: 477677 - DNA, 16 bp, R. norvegicus
aggagagcaaccctgt

SEQ ID NO: 477678 - DNA, 16 bp, R. norvegicus
aggagagcacagtgtg

SEQ ID NO: 477679 - DNA, 16 bp, R. norvegicus
aggagagccactaaag

SEQ ID NO: 477680 - DNA, 16 bp, R. norvegicus
aggagagcccagccca

SEQ ID NO: 477681 - DNA, 16 bp, R. norvegicus
aggagagctaaaacta

SEQ ID NO: 477682 - DNA, 16 bp, R. norvegicus
aggagagctgaatctt

SEQ ID NO: 477683 - DNA, 16 bp, R. norvegicus
aggagagctggagaga

SEQ ID NO: 477684 - DNA, 16 bp, R. norvegicus
aggagagctgtccctg

SEQ ID NO: 477685 - DNA, 16 bp, R. norvegicus
aggagaggaagtgcct

SEQ ID NO: 477686 - DNA, 16 bp, R. norvegicus
aggagaggacacagag

SEQ ID NO: 477687 - DNA, 16 bp, R. norvegicus
aggagaggagagccag

SEQ ID NO: 477688 - DNA, 16 bp, R. norvegicus
aggagaggctcttggt

SEQ ID NO: 477689 - DNA, 16 bp, R. norvegicus
aggagaggctggagag

SEQ ID NO: 477690 - DNA, 16 bp, R. norvegicus
aggagaggctggggaa

SEQ ID NO: 477691 - DNA, 16 bp, R. norvegicus
aggagagggcatctga

SEQ ID NO: 477692 - DNA, 16 bp, R. norvegicus
aggagaggggctggag

SEQ ID NO: 477693 - DNA, 16 bp, R. norvegicus
aggagatagaggcaga

SEQ ID NO: 477694 - DNA, 16 bp, R. norvegicus
aggagatcaaggggac

SEQ ID NO: 477695 - DNA, 16 bp, R. norvegicus
aggagatcaggagtca

SEQ ID NO: 477696 - DNA, 16 bp, R. norvegicus
aggagatccagtgcct

SEQ ID NO: 477697 - DNA, 16 bp, R. norvegicus
aggagatcctgggcag

SEQ ID NO: 477698 - DNA, 16 bp, R. norvegicus
aggagatgaagaggtt

SEQ ID NO: 477699 - DNA, 16 bp, R. norvegicus
aggagatgatgatgat

SEQ ID NO: 477700 - DNA, 16 bp, R. norvegicus
aggagatggaggcagg

SEQ ID NO: 477701 - DNA, 16 bp, R. norvegicus
aggagcaagagagtga

SEQ ID NO: 477702 - DNA, 16 bp, R. norvegicus
aggagcaaggccctag

SEQ ID NO: 477703 - DNA, 16 bp, R. norvegicus
aggagcaattctgggt

SEQ ID NO: 477704 - DNA, 16 bp, R. norvegicus
aggagcactggatgct

SEQ ID NO: 477705 - DNA, 16 bp, R. norvegicus
aggagcagaagatact

SEQ ID NO: 477706 - DNA, 16 bp, R. norvegicus
aggagcagaagcagaa

SEQ ID NO: 477707 - DNA, 16 bp, R. norvegicus
aggagcagaagcagag

SEQ ID NO: 477708 - DNA, 16 bp, R. norvegicus
aggagcagatgcagag

SEQ ID NO: 477709 - DNA, 16 bp, R. norvegicus
aggagcagatggcagg

SEQ ID NO: 477710 - DNA, 16 bp, R. norvegicus
aggagcagcaagcact

SEQ ID NO: 477711 - DNA, 16 bp, R. norvegicus
aggagcagcagatcca

SEQ ID NO: 477712 - DNA, 16 bp, R. norvegicus
aggagcagcagcagga

SEQ ID NO: 477713 - DNA, 16 bp, R. norvegicus
aggagcagcaggtcca

SEQ ID NO: 477714 - DNA, 16 bp, R. norvegicus
aggagcagctggaggc

SEQ ID NO: 477715 - DNA, 16 bp, R. norvegicus
aggagcaggaaatccg

SEQ ID NO: 477716 - DNA, 16 bp, R. norvegicus
aggagcaggaaatctg

SEQ ID NO: 477717 - DNA, 16 bp, R. norvegicus
aggagcaggagagcag

SEQ ID NO: 477718 - DNA, 16 bp, R. norvegicus
aggagcaggagcagca

SEQ ID NO: 477719 - DNA, 16 bp, R. norvegicus
aggagcaggaggagca

SEQ ID NO: 477720 - DNA, 16 bp, R. norvegicus
aggagcaggatgtaga

SEQ ID NO: 477721 - DNA, 16 bp, R. norvegicus
aggagcaggatgtcct

SEQ ID NO: 477722 - DNA, 16 bp, R. norvegicus
aggagcaggatgttgg

SEQ ID NO: 477723 - DNA, 16 bp, R. norvegicus
aggagcaggcagtgct

SEQ ID NO: 477724 - DNA, 16 bp, R. norvegicus
aggagcagggccagct

SEQ ID NO: 477725 - DNA, 16 bp, R. norvegicus
aggagcaggggtcctg

SEQ ID NO: 477726 - DNA, 16 bp, R. norvegicus
aggagcagtcagaggc

SEQ ID NO: 477727 - DNA, 16 bp, R. norvegicus
aggagcagtcagggag

SEQ ID NO: 477728 - DNA, 16 bp, R. norvegicus
aggagcatgaggagga

SEQ ID NO: 477729 - DNA, 16 bp, R. norvegicus
aggagcattcccagtc

SEQ ID NO: 477730 - DNA, 16 bp, R. norvegicus
aggagccaaaaccagc

SEQ ID NO: 477731 - DNA, 16 bp, R. norvegicus
aggagccaaaaccctc

SEQ ID NO: 477732 - DNA, 16 bp, R. norvegicus
aggagccaaagccatc

SEQ ID NO: 477733 - DNA, 16 bp, R. norvegicus
aggagccaagagttct

SEQ ID NO: 477734 - DNA, 16 bp, R. norvegicus
aggagccacagataca

SEQ ID NO: 477735 - DNA, 16 bp, R. norvegicus
aggagccagaagcagg

SEQ ID NO: 477736 - DNA, 16 bp, R. norvegicus
aggagccaggagccag

SEQ ID NO: 477737 - DNA, 16 bp, R. norvegicus
aggagcctgagctgct

SEQ ID NO: 477738 - DNA, 16 bp, R. norvegicus
aggagcctgaggcagc

SEQ ID NO: 477739 - DNA, 16 bp, R. norvegicus
aggagctaaacaaaga

SEQ ID NO: 477740 - DNA, 16 bp, R. norvegicus
aggagctagagaaaga

SEQ ID NO: 477741 - DNA, 16 bp, R. norvegicus
aggagctcaaagggat

SEQ ID NO: 477742 - DNA, 16 bp, R. norvegicus
aggagctcaaggcagg

SEQ ID NO: 477743 - DNA, 16 bp, R. norvegicus
aggagctcaaggccag

SEQ ID NO: 477744 - DNA, 16 bp, R. norvegicus
aggagctgaaacagag

SEQ ID NO: 477745 - DNA, 16 bp, R. norvegicus
aggagctgaagaagtt

SEQ ID NO: 477746 - DNA, 16 bp, R. norvegicus
aggagctgaagagatg

SEQ ID NO: 477747 - DNA, 16 bp, R. norvegicus
aggagctgaagaggct

SEQ ID NO: 477748 - DNA, 16 bp, R. norvegicus
aggagctgaagatgtt

SEQ ID NO: 477749 - DNA, 16 bp, R. norvegicus
aggagctgaagcagaa

SEQ ID NO: 477750 - DNA, 16 bp, R. norvegicus
aggagctgaagcagtt

SEQ ID NO: 477751 - DNA, 17 bp, R. norvegicus
aggagctgaagcggttt

SEQ ID NO: 477752 - DNA, 16 bp, R. norvegicus
aggagctgaaggaatt

SEQ ID NO: 477753 - DNA, 16 bp, R. norvegicus
aggagctgaaggggtc

SEQ ID NO: 477754 - DNA, 16 bp, R. norvegicus
aggagctgaaggtgct

SEQ ID NO: 477755 - DNA, 16 bp, R. norvegicus
aggagctgagaagcag

SEQ ID NO: 477756 - DNA, 16 bp, R. norvegicus
aggagctgaggattct

SEQ ID NO: 477757 - DNA, 16 bp, R. norvegicus
aggagctgagggggat

SEQ ID NO: 477758 - DNA, 16 bp, R. norvegicus
aggagctgatgaagag

SEQ ID NO: 477759 - DNA, 16 bp, R. norvegicus
aggagctgatgcagag

SEQ ID NO: 477760 - DNA, 16 bp, R. norvegicus
aggagctgcaggacac

SEQ ID NO: 477761 - DNA, 16 bp, R. norvegicus
aggagctgctgcagag

SEQ ID NO: 477762 - DNA, 16 bp, R. norvegicus
aggagctgctgctgct

SEQ ID NO: 477763 - DNA, 16 bp, R. norvegicus
aggagctgctggcgcc

SEQ ID NO: 477764 - DNA, 16 bp, R. norvegicus
aggagctggacctaga

SEQ ID NO: 477765 - DNA, 16 bp, R. norvegicus
aggagctggagaaagg

SEQ ID NO: 477766 - DNA, 16 bp, R. norvegicus
aggagctggagaaatg

SEQ ID NO: 477767 - DNA, 16 bp, R. norvegicus
aggagctggaggagga

SEQ ID NO: 477768 - DNA, 16 bp, R. norvegicus
aggagctgggaggagt

SEQ ID NO: 477769 - DNA, 16 bp, R. norvegicus
aggagctgggggtgtg

SEQ ID NO: 477770 - DNA, 16 bp, R. norvegicus
aggagctggttctctc

SEQ ID NO: 477771 - DNA, 16 bp, R. norvegicus
aggagctgtccaagga

SEQ ID NO: 477772 - DNA, 16 bp, R. norvegicus
aggagctgtccacagt

SEQ ID NO: 477773 - DNA, 16 bp, R. norvegicus
aggagctgtgggaggg

SEQ ID NO: 477774 - DNA, 16 bp, R. norvegicus
aggagcttcttggtca

SEQ ID NO: 477775 - DNA, 16 bp, R. norvegicus
aggagcttgcagcccc

SEQ ID NO: 477776 - DNA, 16 bp, R. norvegicus
aggagcttgctgccaa

SEQ ID NO: 477777 - DNA, 16 bp, R. norvegicus
aggaggaaaactccaa

SEQ ID NO: 477778 - DNA, 16 bp, R. norvegicus
aggaggaaaagctctt

SEQ ID NO: 477779 - DNA, 16 bp, R. norvegicus
aggaggaaagggttaa

SEQ ID NO: 477780 - DNA, 16 bp, R. norvegicus
aggaggaaattcagag

SEQ ID NO: 477781 - DNA, 16 bp, R. norvegicus
aggaggaacagaagtt

SEQ ID NO: 477782 - DNA, 16 bp, R. norvegicus
aggaggaactgagttc

SEQ ID NO: 477783 - DNA, 16 bp, R. norvegicus
aggaggaagaaccaca

SEQ ID NO: 477784 - DNA, 16 bp, R. norvegicus
aggaggaagatctcca

SEQ ID NO: 477785 - DNA, 16 bp, R. norvegicus
aggaggaagcagcagc

SEQ ID NO: 477786 - DNA, 16 bp, R. norvegicus
aggaggaagctctctc

SEQ ID NO: 477787 - DNA, 16 bp, R. norvegicus
aggaggaagggatgcc

SEQ ID NO: 477788 - DNA, 16 bp, R. norvegicus
aggaggaaggtgaccc

SEQ ID NO: 477789 - DNA, 16 bp, R. norvegicus
aggaggaagtacagag

SEQ ID NO: 477790 - DNA, 16 bp, R. norvegicus
aggaggaccctctaga

SEQ ID NO: 477791 - DNA, 16 bp, R. norvegicus
aggaggacctaattga

SEQ ID NO: 477792 - DNA, 16 bp, R. norvegicus
aggaggacctgactct

SEQ ID NO: 477793 - DNA, 16 bp, R. norvegicus
aggaggacctgagagt

SEQ ID NO: 477794 - DNA, 16 bp, R. norvegicus
aggaggagaagccctt

SEQ ID NO: 477795 - DNA, 16 bp, R. norvegicus
aggaggagaagtcctt

SEQ ID NO: 477796 - DNA, 16 bp, R. norvegicus
aggaggagacaggaat

SEQ ID NO: 477797 - DNA, 16 bp, R. norvegicus
aggaggagacaggcag

SEQ ID NO: 477798 - DNA, 16 bp, R. norvegicus
aggaggagacccaagc

SEQ ID NO: 477799 - DNA, 16 bp, R. norvegicus
aggaggagactgaaat

SEQ ID NO: 477800 - DNA, 16 bp, R. norvegicus
aggaggagagtctcaa

SEQ ID NO: 477801 - DNA, 16 bp, R. norvegicus
aggaggagcagaagca

SEQ ID NO: 477802 - DNA, 16 bp, R. norvegicus
aggaggagcagagagt

SEQ ID NO: 477803 - DNA, 16 bp, R. norvegicus
aggaggagcagcagca

SEQ ID NO: 477804 - DNA, 16 bp, R. norvegicus
aggaggagcatgagga

SEQ ID NO: 477805 - DNA, 16 bp, R. norvegicus
aggaggagctgagaat

SEQ ID NO: 477806 - DNA, 17 bp, R. norvegicus
aggaggagctgagagct

SEQ ID NO: 477807 - DNA, 16 bp, R. norvegicus
aggaggagctgagggt

SEQ ID NO: 477808 - DNA, 16 bp, R. norvegicus
aggaggagctgatgca

SEQ ID NO: 477809 - DNA, 16 bp, R. norvegicus
aggaggagctggagag

SEQ ID NO: 477810 - DNA, 16 bp, R. norvegicus
aggaggagctggagga

SEQ ID NO: 477811 - DNA, 16 bp, R. norvegicus
aggaggaggaagagtt

SEQ ID NO: 477812 - DNA, 16 bp, R. norvegicus
aggaggaggaagccag

SEQ ID NO: 477813 - DNA, 16 bp, R. norvegicus
aggaggaggacgacga

SEQ ID NO: 477814 - DNA, 16 bp, R. norvegicus
aggaggaggagctggg

SEQ ID NO: 477815 - DNA, 16 bp, R. norvegicus
aggaggaggaggaact

SEQ ID NO: 477816 - DNA, 16 bp, R. norvegicus
aggaggaggaggaatt

SEQ ID NO: 477817 - DNA, 16 bp, R. norvegicus
aggaggaggaggactg

SEQ ID NO: 477818 - DNA, 16 bp, R. norvegicus
aggaggaggagtagca

SEQ ID NO: 477819 - DNA, 16 bp, R. norvegicus
aggaggaggatcagaa

SEQ ID NO: 477820 - DNA, 16 bp, R. norvegicus
aggaggaggatcagga

SEQ ID NO: 477821 - DNA, 16 bp, R. norvegicus
aggaggagtagatggc

SEQ ID NO: 477822 - DNA, 16 bp, R. norvegicus
aggaggagtggaaggc

SEQ ID NO: 477823 - DNA, 16 bp, R. norvegicus
aggaggagttagagaa

SEQ ID NO: 477824 - DNA, 16 bp, R. norvegicus
aggaggagttcaaggc

SEQ ID NO: 477825 - DNA, 16 bp, R. norvegicus
aggaggagttggaaga

SEQ ID NO: 477826 - DNA, 16 bp, R. norvegicus
aggaggatcacaggtt

SEQ ID NO: 477827 - DNA, 16 bp, R. norvegicus
aggaggatcagaagct

SEQ ID NO: 477828 - DNA, 16 bp, R. norvegicus
aggaggatcaggagct

SEQ ID NO: 477829 - DNA, 16 bp, R. norvegicus
aggaggatcaggagtt

SEQ ID NO: 477830 - DNA, 16 bp, R. norvegicus
aggaggatctctgagt

SEQ ID NO: 477831 - DNA, 16 bp, R. norvegicus
aggaggatctctttga

SEQ ID NO: 477832 - DNA, 16 bp, R. norvegicus
aggaggatgacaagtt

SEQ ID NO: 477833 - DNA, 16 bp, R. norvegicus
aggaggatgggaagtt

SEQ ID NO: 477834 - DNA, 16 bp, R. norvegicus
aggaggatgtctgtga

SEQ ID NO: 477835 - DNA, 16 bp, R. norvegicus
aggaggattcagaact

SEQ ID NO: 477836 - DNA, 16 bp, R. norvegicus
aggaggattgagagtt

SEQ ID NO: 477837 - DNA, 16 bp, R. norvegicus
aggaggatttcaagtt

SEQ ID NO: 477838 - DNA, 16 bp, R. norvegicus
aggaggcaaaaacagg

SEQ ID NO: 477839 - DNA, 18 bp, R. norvegicus
aggaggcaagctatacca

SEQ ID NO: 477840 - DNA, 16 bp, R. norvegicus
aggaggcaagctatag

SEQ ID NO: 477841 - DNA, 16 bp, R. norvegicus
aggaggcagaaacaag

SEQ ID NO: 477842 - DNA, 16 bp, R. norvegicus
aggaggcagaagacag

SEQ ID NO: 477843 - DNA, 16 bp, R. norvegicus
aggaggcagaagcaga

SEQ ID NO: 477844 - DNA, 16 bp, R. norvegicus
aggaggcagagacaga

SEQ ID NO: 477845 - DNA, 16 bp, R. norvegicus
aggaggcagagacagg

SEQ ID NO: 477846 - DNA, 16 bp, R. norvegicus
aggaggcagagagcac

SEQ ID NO: 477847 - DNA, 16 bp, R. norvegicus
aggaggcagaggctga

SEQ ID NO: 477848 - DNA, 16 bp, R. norvegicus
aggaggcagatggagg

SEQ ID NO: 477849 - DNA, 16 bp, R. norvegicus
aggaggcaggaggctg

SEQ ID NO: 477850 - DNA, 16 bp, R. norvegicus
aggaggcagtgacagg

SEQ ID NO: 477851 - DNA, 16 bp, R. norvegicus
aggaggccaaggcaga

SEQ ID NO: 477852 - DNA, 16 bp, R. norvegicus
aggaggccaggaggcc

SEQ ID NO: 477853 - DNA, 16 bp, R. norvegicus
aggaggccatgttcca

SEQ ID NO: 477854 - DNA, 16 bp, R. norvegicus
aggaggccccaaggcc

SEQ ID NO: 477855 - DNA, 16 bp, R. norvegicus
aggaggccgaggcagg

SEQ ID NO: 477856 - DNA, 30 bp, R. norvegicus
aggaggccgagttagatgaggaagcagcta

SEQ ID NO: 477857 - DNA, 16 bp, R. norvegicus
aggaggctcaggagtt

SEQ ID NO: 477858 - DNA, 16 bp, R. norvegicus
aggaggctctcttcca

SEQ ID NO: 477859 - DNA, 16 bp, R. norvegicus
aggaggctctgggttc

SEQ ID NO: 477860 - DNA, 16 bp, R. norvegicus
aggaggctgaagcaga

SEQ ID NO: 477861 - DNA, 16 bp, R. norvegicus
aggaggctgagacaga

SEQ ID NO: 477862 - DNA, 16 bp, R. norvegicus
aggaggctgaggaaga

SEQ ID NO: 477863 - DNA, 16 bp, R. norvegicus
aggaggctggaagagg

SEQ ID NO: 477864 - DNA, 16 bp, R. norvegicus
aggaggctggggcaga

SEQ ID NO: 477865 - DNA, 16 bp, R. norvegicus
aggaggcttggcctgg

SEQ ID NO: 477866 - DNA, 17 bp, R. norvegicus
aggaggcttgtttcata

SEQ ID NO: 477867 - DNA, 16 bp, R. norvegicus
aggagggaaagccctt

SEQ ID NO: 477868 - DNA, 16 bp, R. norvegicus
aggagggaagctatac

SEQ ID NO: 477869 - DNA, 16 bp, R. norvegicus
aggagggaccaggaag

SEQ ID NO: 477870 - DNA, 16 bp, R. norvegicus
aggagggcaactctgt

SEQ ID NO: 477871 - DNA, 16 bp, R. norvegicus
aggagggcagccctgt

SEQ ID NO: 477872 - DNA, 17 bp, R. norvegicus
aggagggctgacaccca

SEQ ID NO: 477873 - DNA, 16 bp, R. norvegicus
aggaggggcaagcagc

SEQ ID NO: 477874 - DNA, 16 bp, R. norvegicus
aggagggtgaaggcag

SEQ ID NO: 477875 - DNA, 16 bp, R. norvegicus
aggaggtagagacaag

SEQ ID NO: 477876 - DNA, 16 bp, R. norvegicus
aggaggtagaggcagg

SEQ ID NO: 477877 - DNA, 16 bp, R. norvegicus
aggaggtagaggctgg

SEQ ID NO: 477878 - DNA, 16 bp, R. norvegicus
aggaggtcaaggagat

SEQ ID NO: 477879 - DNA, 16 bp, R. norvegicus
aggaggtcccccaaga

SEQ ID NO: 477880 - DNA, 16 bp, R. norvegicus
aggaggtgaggtctct

SEQ ID NO: 477881 - DNA, 16 bp, R. norvegicus
aggaggtggctcagtg

SEQ ID NO: 477882 - DNA, 16 bp, R. norvegicus
aggaggtgtggccttg

SEQ ID NO: 477883 - DNA, 16 bp, R. norvegicus
aggaggtgtgtcacca

SEQ ID NO: 477884 - DNA, 16 bp, R. norvegicus
aggaggtgtgtctctg

SEQ ID NO: 477885 - DNA, 16 bp, R. norvegicus
aggaggttaggaggac

SEQ ID NO: 477886 - DNA, 16 bp, R. norvegicus
aggaggttcatgagtt

SEQ ID NO: 477887 - DNA, 16 bp, R. norvegicus
aggaggttggaaggac

SEQ ID NO: 477888 - DNA, 16 bp, R. norvegicus
aggagtacacagagaa

SEQ ID NO: 477889 - DNA, 16 bp, R. norvegicus
aggagtacacagcagg

SEQ ID NO: 477890 - DNA, 16 bp, R. norvegicus
aggagtaggagtagga

SEQ ID NO: 477891 - DNA, 16 bp, R. norvegicus
aggagtcagcagagag

SEQ ID NO: 477892 - DNA, 16 bp, R. norvegicus
aggagtcaggggaagg

SEQ ID NO: 477893 - DNA, 17 bp, R. norvegicus
aggagtcatagatacaa

SEQ ID NO: 477894 - DNA, 16 bp, R. norvegicus
aggagtcatagatgca

SEQ ID NO: 477895 - DNA, 16 bp, R. norvegicus
aggagtccagcctgag

SEQ ID NO: 477896 - DNA, 17 bp, R. norvegicus
aggagtcccagtccctt

SEQ ID NO: 477897 - DNA, 16 bp, R. norvegicus
aggagtgaaacatctg

SEQ ID NO: 477898 - DNA, 16 bp, R. norvegicus
aggagtgaagcatcag

SEQ ID NO: 477899 - DNA, 16 bp, R. norvegicus
aggagtgcccatctga

SEQ ID NO: 477900 - DNA, 16 bp, R. norvegicus
aggagtgctgtgaaat

SEQ ID NO: 477901 - DNA, 16 bp, R. norvegicus
aggagtggaagagctt

SEQ ID NO: 477902 - DNA, 16 bp, R. norvegicus
aggagtggggacagct

SEQ ID NO: 477903 - DNA, 16 bp, R. norvegicus
aggagtgggtgggcag

SEQ ID NO: 477904 - DNA, 67 bp, R. norvegicus
aggagtgttcctctttctccacatcctcgccagcatctgctgtcacctgagtttttgatcttagcca

SEQ ID NO: 477905 - DNA, 16 bp, R. norvegicus
aggagtgtttttcttt

SEQ ID NO: 477906 - DNA, 16 bp, R. norvegicus
aggagttagagaagag

SEQ ID NO: 477907 - DNA, 40 bp, R. norvegicus
aggagttagaggctttggggcttgatagttcagaaacaga

SEQ ID NO: 477908 - DNA, 16 bp, R. norvegicus
aggagttagagggatg

SEQ ID NO: 477909 - DNA, 16 bp, R. norvegicus
aggagttcaaggccaa

SEQ ID NO: 477910 - DNA, 16 bp, R. norvegicus
aggagttctctggtgg

SEQ ID NO: 477911 - DNA, 16 bp, R. norvegicus
aggagttctttggtgg

SEQ ID NO: 477912 - DNA, 16 bp, R. norvegicus
aggagttggagccaga

SEQ ID NO: 477913 - DNA, 16 bp, R. norvegicus
aggagttggaggcaga

SEQ ID NO: 477914 - DNA, 16 bp, R. norvegicus
aggagtttgaagccag

SEQ ID NO: 477915 - DNA, 16 bp, R. norvegicus
aggataaacaggatga

SEQ ID NO: 477916 - DNA, 16 bp, R. norvegicus
aggataaccaaagtgc

SEQ ID NO: 477917 - DNA, 16 bp, R. norvegicus
aggataactttcagga

SEQ ID NO: 477918 - DNA, 17 bp, R. norvegicus
aggataatttggatttt

SEQ ID NO: 477919 - DNA, 16 bp, R. norvegicus
aggatacagagaaaga

SEQ ID NO: 477920 - DNA, 16 bp, R. norvegicus
aggatagccagggcta

SEQ ID NO: 477921 - DNA, 16 bp, R. norvegicus
aggatagcttttgcta

SEQ ID NO: 477922 - DNA, 16 bp, R. norvegicus
aggatagtgaaaacaa

SEQ ID NO: 477923 - DNA, 16 bp, R. norvegicus
aggatagttttagtta

SEQ ID NO: 477924 - DNA, 16 bp, R. norvegicus
aggatatctctctctc

SEQ ID NO: 477925 - DNA, 16 bp, R. norvegicus
aggatatggtggtgca

SEQ ID NO: 477926 - DNA, 16 bp, R. norvegicus
aggatattttatgtat

SEQ ID NO: 477927 - DNA, 16 bp, R. norvegicus
aggatcaagccagtca

SEQ ID NO: 477928 - DNA, 16 bp, R. norvegicus
aggatcagaagttcaa

SEQ ID NO: 477929 - DNA, 16 bp, R. norvegicus
aggatcaggaatttga

SEQ ID NO: 477930 - DNA, 16 bp, R. norvegicus
aggatcaggagatcaa

SEQ ID NO: 477931 - DNA, 16 bp, R. norvegicus
aggatcaggaggagga

SEQ ID NO: 477932 - DNA, 16 bp, R. norvegicus
aggatcaggagtttaa

SEQ ID NO: 477933 - DNA, 16 bp, R. norvegicus
aggatccaaggcaaag

SEQ ID NO: 477934 - DNA, 16 bp, R. norvegicus
aggatccagctcaggc

SEQ ID NO: 477935 - DNA, 16 bp, R. norvegicus
aggatcctgcccctga

SEQ ID NO: 477936 - DNA, 16 bp, R. norvegicus
aggatcctggagacag

SEQ ID NO: 477937 - DNA, 16 bp, R. norvegicus
aggatcctggaggcag

SEQ ID NO: 477938 - DNA, 16 bp, R. norvegicus
aggatcctggtgtcca

SEQ ID NO: 477939 - DNA, 16 bp, R. norvegicus
aggatccttctgtctc

SEQ ID NO: 477940 - DNA, 16 bp, R. norvegicus
aggatctgaattcagt

SEQ ID NO: 477941 - DNA, 16 bp, R. norvegicus
aggatctgagttcaga

SEQ ID NO: 477942 - DNA, 16 bp, R. norvegicus
aggatctgagtttgaa

SEQ ID NO: 477943 - DNA, 16 bp, R. norvegicus
aggatctgatgccctc

SEQ ID NO: 477944 - DNA, 16 bp, R. norvegicus
aggatctgggttcagt

SEQ ID NO: 477945 - DNA, 16 bp, R. norvegicus
aggatcttcaggcttt

SEQ ID NO: 477946 - DNA, 16 bp, R. norvegicus
aggatcttttagcttt

SEQ ID NO: 477947 - DNA, 16 bp, R. norvegicus
aggatgaagaggatga

SEQ ID NO: 477948 - DNA, 16 bp, R. norvegicus
aggatgaatatgatca

SEQ ID NO: 477949 - DNA, 16 bp, R. norvegicus
aggatgacctcgaact

SEQ ID NO: 477950 - DNA, 16 bp, R. norvegicus
aggatgaggacgagga

SEQ ID NO: 477951 - DNA, 16 bp, R. norvegicus
aggatgaggaggagca

SEQ ID NO: 477952 - DNA, 16 bp, R. norvegicus
aggatgaggttcttaa

SEQ ID NO: 477953 - DNA, 16 bp, R. norvegicus
aggatgatattttaaa

SEQ ID NO: 477954 - DNA, 16 bp, R. norvegicus
aggatgatgatggtga

SEQ ID NO: 477955 - DNA, 16 bp, R. norvegicus
aggatgatgtcatcac

SEQ ID NO: 477956 - DNA, 16 bp, R. norvegicus
aggatgcctatgacaa

SEQ ID NO: 477957 - DNA, 16 bp, R. norvegicus
aggatgcctttgatga

SEQ ID NO: 477958 - DNA, 16 bp, R. norvegicus
aggatgctccctcacc

SEQ ID NO: 477959 - DNA, 16 bp, R. norvegicus
aggatgctgacatcaa

SEQ ID NO: 477960 - DNA, 16 bp, R. norvegicus
aggatggaacccaggg

SEQ ID NO: 477961 - DNA, 16 bp, R. norvegicus
aggatggaaggagctg

SEQ ID NO: 477962 - DNA, 16 bp, R. norvegicus
aggatggatcccaagt

SEQ ID NO: 477963 - DNA, 16 bp, R. norvegicus
aggatggcactgccca

SEQ ID NO: 477964 - DNA, 16 bp, R. norvegicus
aggatggctcagtggt

SEQ ID NO: 477965 - DNA, 16 bp, R. norvegicus
aggatgtaatgtgaat

SEQ ID NO: 477966 - DNA, 16 bp, R. norvegicus
aggatgtcagttaccc

SEQ ID NO: 477967 - DNA, 16 bp, R. norvegicus
aggatgtcattgtcca

SEQ ID NO: 477968 - DNA, 16 bp, R. norvegicus
aggatgtccccactct

SEQ ID NO: 477969 - DNA, 16 bp, R. norvegicus
aggatgtccccattcc

SEQ ID NO: 477970 - DNA, 16 bp, R. norvegicus
aggatgtgaagaaaga

SEQ ID NO: 477971 - DNA, 16 bp, R. norvegicus
aggatgtgacagagac

SEQ ID NO: 477972 - DNA, 16 bp, R. norvegicus
aggatgtgagctctca

SEQ ID NO: 477973 - DNA, 16 bp, R. norvegicus
aggatgtggagaagag

SEQ ID NO: 477974 - DNA, 16 bp, R. norvegicus
aggatgtggagaagga

SEQ ID NO: 477975 - DNA, 16 bp, R. norvegicus
aggatgtggagaatga

SEQ ID NO: 477976 - DNA, 16 bp, R. norvegicus
aggatgtggagacaga

SEQ ID NO: 477977 - DNA, 16 bp, R. norvegicus
aggatgtgggaaagag

SEQ ID NO: 477978 - DNA, 16 bp, R. norvegicus
aggatgttctgttaaa

SEQ ID NO: 477979 - DNA, 16 bp, R. norvegicus
aggattaccagcccag

SEQ ID NO: 477980 - DNA, 16 bp, R. norvegicus
aggattcaactccatt

SEQ ID NO: 477981 - DNA, 16 bp, R. norvegicus
aggattctacttgttt

SEQ ID NO: 477982 - DNA, 16 bp, R. norvegicus
aggattctggaggcag

SEQ ID NO: 477983 - DNA, 16 bp, R. norvegicus
aggattctgggagaga

SEQ ID NO: 477984 - DNA, 20 bp, R. norvegicus
aggattgagagttcatcttg

SEQ ID NO: 477985 - DNA, 16 bp, R. norvegicus
aggattgccatgaatt

SEQ ID NO: 477986 - DNA, 16 bp, R. norvegicus
aggattgggaggagaa

SEQ ID NO: 477987 - DNA, 47 bp, R. norvegicus
aggattggtaaagatcttttcccaatctgttggttgccgatttgtcc

SEQ ID NO: 477988 - DNA, 16 bp, R. norvegicus
aggattgtgggaggga

SEQ ID NO: 477989 - DNA, 16 bp, R. norvegicus
aggatttagggatagg

SEQ ID NO: 477990 - DNA, 16 bp, R. norvegicus
aggatttcaagaaaga

SEQ ID NO: 477991 - DNA, 16 bp, R. norvegicus
aggatttcatgaagtc

SEQ ID NO: 477992 - DNA, 16 bp, R. norvegicus
aggatttccatgacac

SEQ ID NO: 477993 - DNA, 16 bp, R. norvegicus
aggatttctctgtgta

SEQ ID NO: 477994 - DNA, 16 bp, R. norvegicus
aggatttgaattcagg

SEQ ID NO: 477995 - DNA, 16 bp, R. norvegicus
aggatttgagtacaga

SEQ ID NO: 477996 - DNA, 16 bp, R. norvegicus
aggatttgctgctctt

SEQ ID NO: 477997 - DNA, 16 bp, R. norvegicus
aggatttggagaaaga

SEQ ID NO: 477998 - DNA, 16 bp, R. norvegicus
aggatttgggagttta

SEQ ID NO: 477999 - DNA, 16 bp, R. norvegicus
aggattttcagaagta

SEQ ID NO: 478000 - DNA, 16 bp, R. norvegicus
aggcaaaaaccagaag

SEQ ID NO: 478001 - DNA, 16 bp, R. norvegicus
aggcaaaagagtcaga

SEQ ID NO: 478002 - DNA, 16 bp, R. norvegicus
aggcaaaagccatgga

SEQ ID NO: 478003 - DNA, 19 bp, R. norvegicus
aggcaaaagccgtggaaaa

SEQ ID NO: 478004 - DNA, 16 bp, R. norvegicus
aggcaaacaagtagaa

SEQ ID NO: 478005 - DNA, 16 bp, R. norvegicus
aggcaaaccaacagaa

SEQ ID NO: 478006 - DNA, 16 bp, R. norvegicus
aggcaaagaaaggcag

SEQ ID NO: 478007 - DNA, 16 bp, R. norvegicus
aggcaaagacaggaga

SEQ ID NO: 478008 - DNA, 16 bp, R. norvegicus
aggcaaagagacagag

SEQ ID NO: 478009 - DNA, 16 bp, R. norvegicus
aggcaaaggaaactgt

SEQ ID NO: 478010 - DNA, 16 bp, R. norvegicus
aggcaaaggcaaaggc

SEQ ID NO: 478011 - DNA, 16 bp, R. norvegicus
aggcaaaggcaggagg

SEQ ID NO: 478012 - DNA, 16 bp, R. norvegicus
aggcaaagtttgaagc

SEQ ID NO: 478013 - DNA, 16 bp, R. norvegicus
aggcaaatagttggaa

SEQ ID NO: 478014 - DNA, 16 bp, R. norvegicus
aggcaaatggaataaa

SEQ ID NO: 478015 - DNA, 16 bp, R. norvegicus
aggcaaatggagagaa

SEQ ID NO: 478016 - DNA, 16 bp, R. norvegicus
aggcaaatggatagaa

SEQ ID NO: 478017 - DNA, 16 bp, R. norvegicus
aggcaaattgatggaa

SEQ ID NO: 478018 - DNA, 16 bp, R. norvegicus
aggcaacagagtcaag

SEQ ID NO: 478019 - DNA, 16 bp, R. norvegicus
aggcaaccattgaact

SEQ ID NO: 478020 - DNA, 16 bp, R. norvegicus
aggcaacttagtacaa

SEQ ID NO: 478021 - DNA, 16 bp, R. norvegicus
aggcaagaagatcaga

SEQ ID NO: 478022 - DNA, 16 bp, R. norvegicus
aggcaagagcaagaac

SEQ ID NO: 478023 - DNA, 16 bp, R. norvegicus
aggcaagaggatcaag

SEQ ID NO: 478024 - DNA, 16 bp, R. norvegicus
aggcaagcacctttac

SEQ ID NO: 478025 - DNA, 16 bp, R. norvegicus
aggcaagcactctact

SEQ ID NO: 478026 - DNA, 16 bp, R. norvegicus
aggcaagcactttacc

SEQ ID NO: 478027 - DNA, 16 bp, R. norvegicus
aggcaagcaggagaag

SEQ ID NO: 478028 - DNA, 16 bp, R. norvegicus
aggcaagccacaggct

SEQ ID NO: 478029 - DNA, 16 bp, R. norvegicus
aggcaagcctgtgagg

SEQ ID NO: 478030 - DNA, 16 bp, R. norvegicus
aggcaagccttgaact

SEQ ID NO: 478031 - DNA, 16 bp, R. norvegicus
aggcaaggcccaggag

SEQ ID NO: 478032 - DNA, 16 bp, R. norvegicus
aggcaagtagatggaa

SEQ ID NO: 478033 - DNA, 16 bp, R. norvegicus
aggcaagtgcactacc

SEQ ID NO: 478034 - DNA, 16 bp, R. norvegicus
aggcacaagaatcaga

SEQ ID NO: 478035 - DNA, 16 bp, R. norvegicus
aggcacaaggccctgg

SEQ ID NO: 478036 - DNA, 16 bp, R. norvegicus
aggcacagaaagataa

SEQ ID NO: 478037 - DNA, 16 bp, R. norvegicus
aggcacagaaaggcaa

SEQ ID NO: 478038 - DNA, 16 bp, R. norvegicus
aggcacaggaatcaga

SEQ ID NO: 478039 - DNA, 16 bp, R. norvegicus
aggcacatgcacatac

SEQ ID NO: 478040 - DNA, 16 bp, R. norvegicus
aggcaccaatccctca

SEQ ID NO: 478041 - DNA, 16 bp, R. norvegicus
aggcaccaggcacaca

SEQ ID NO: 478042 - DNA, 16 bp, R. norvegicus
aggcaccatgcaagct

SEQ ID NO: 478043 - DNA, 16 bp, R. norvegicus
aggcactcagagatat

SEQ ID NO: 478044 - DNA, 16 bp, R. norvegicus
aggcactgtccaggag

SEQ ID NO: 478045 - DNA, 16 bp, R. norvegicus
aggcagaaaagaatgt

SEQ ID NO: 478046 - DNA, 16 bp, R. norvegicus
aggcagaaaccaaaag

SEQ ID NO: 478047 - DNA, 16 bp, R. norvegicus
aggcagaaacctgaag

SEQ ID NO: 478048 - DNA, 16 bp, R. norvegicus
aggcagaaactggaag

SEQ ID NO: 478049 - DNA, 16 bp, R. norvegicus
aggcagaaactggaat

SEQ ID NO: 478050 - DNA, 16 bp, R. norvegicus
aggcagaagacagaga

SEQ ID NO: 478051 - DNA, 16 bp, R. norvegicus
aggcagaagcaagaag

SEQ ID NO: 478052 - DNA, 16 bp, R. norvegicus
aggcagaagcagaagc

SEQ ID NO: 478053 - DNA, 16 bp, R. norvegicus
aggcagaagcagcaga

SEQ ID NO: 478054 - DNA, 16 bp, R. norvegicus
aggcagaagcagggag

SEQ ID NO: 478055 - DNA, 16 bp, R. norvegicus
aggcagaagccagcag

SEQ ID NO: 478056 - DNA, 16 bp, R. norvegicus
aggcagaagctgaagc

SEQ ID NO: 478057 - DNA, 16 bp, R. norvegicus
aggcagaagctggcag

SEQ ID NO: 478058 - DNA, 16 bp, R. norvegicus
aggcagaaggattgct

SEQ ID NO: 478059 - DNA, 16 bp, R. norvegicus
aggcagaaggcagagg

SEQ ID NO: 478060 - DNA, 16 bp, R. norvegicus
aggcagaattcctctg

SEQ ID NO: 478061 - DNA, 16 bp, R. norvegicus
aggcagacacaggaag

SEQ ID NO: 478062 - DNA, 16 bp, R. norvegicus
aggcagacaccaggca

SEQ ID NO: 478063 - DNA, 16 bp, R. norvegicus
aggcagacacgcctga

SEQ ID NO: 478064 - DNA, 16 bp, R. norvegicus
aggcagacacgtctgg

SEQ ID NO: 478065 - DNA, 16 bp, R. norvegicus
aggcagacagacagac

SEQ ID NO: 478066 - DNA, 16 bp, R. norvegicus
aggcagacagacagca

SEQ ID NO: 478067 - DNA, 16 bp, R. norvegicus
aggcagacctctatga

SEQ ID NO: 478068 - DNA, 16 bp, R. norvegicus
aggcagagaaagaaat

SEQ ID NO: 478069 - DNA, 17 bp, R. norvegicus
aggcagagaagcagaga

SEQ ID NO: 478070 - DNA, 16 bp, R. norvegicus
aggcagagaaggacag

SEQ ID NO: 478071 - DNA, 16 bp, R. norvegicus
aggcagagacaagcag

SEQ ID NO: 478072 - DNA, 16 bp, R. norvegicus
aggcagagacagatgg

SEQ ID NO: 478073 - DNA, 16 bp, R. norvegicus
aggcagagacagcaga

SEQ ID NO: 478074 - DNA, 16 bp, R. norvegicus
aggcagagagagaata

SEQ ID NO: 478075 - DNA, 16 bp, R. norvegicus
aggcagagagagcaag

SEQ ID NO: 478076 - DNA, 16 bp, R. norvegicus
aggcagagagaggcag

SEQ ID NO: 478077 - DNA, 16 bp, R. norvegicus
aggcagagagcagagg

SEQ ID NO: 478078 - DNA, 16 bp, R. norvegicus
aggcagagaggcaggc

SEQ ID NO: 478079 - DNA, 16 bp, R. norvegicus
aggcagagatagagag

SEQ ID NO: 478080 - DNA, 16 bp, R. norvegicus
aggcagagcaaaccaa

SEQ ID NO: 478081 - DNA, 16 bp, R. norvegicus
aggcagagcaagccag

SEQ ID NO: 478082 - DNA, 16 bp, R. norvegicus
aggcagagcaggagga

SEQ ID NO: 478083 - DNA, 16 bp, R. norvegicus
aggcagagcaggcaga

SEQ ID NO: 478084 - DNA, 16 bp, R. norvegicus
aggcagagcttggaga

SEQ ID NO: 478085 - DNA, 16 bp, R. norvegicus
aggcagaggaagccag

SEQ ID NO: 478086 - DNA, 16 bp, R. norvegicus
aggcagaggaaggtag

SEQ ID NO: 478087 - DNA, 16 bp, R. norvegicus
aggcagaggacactgt

SEQ ID NO: 478088 - DNA, 16 bp, R. norvegicus
aggcagaggagcagga

SEQ ID NO: 478089 - DNA, 16 bp, R. norvegicus
aggcagaggcaaaagg

SEQ ID NO: 478090 - DNA, 16 bp, R. norvegicus
aggcagaggcaaagag

SEQ ID NO: 478091 - DNA, 16 bp, R. norvegicus
aggcagaggcagaggt

SEQ ID NO: 478092 - DNA, 16 bp, R. norvegicus
aggcagaggcagatgg

SEQ ID NO: 478093 - DNA, 16 bp, R. norvegicus
aggcagaggcagccag

SEQ ID NO: 478094 - DNA, 16 bp, R. norvegicus
aggcagaggcagctga

SEQ ID NO: 478095 - DNA, 16 bp, R. norvegicus
aggcagaggcagctgg

SEQ ID NO: 478096 - DNA, 16 bp, R. norvegicus
aggcagaggcaggaga

SEQ ID NO: 478097 - DNA, 16 bp, R. norvegicus
aggcagaggcaggggc

SEQ ID NO: 478098 - DNA, 16 bp, R. norvegicus
aggcagaggccggcag

SEQ ID NO: 478099 - DNA, 16 bp, R. norvegicus
aggcagagggaatggg

SEQ ID NO: 478100 - DNA, 16 bp, R. norvegicus
aggcagagggaggcca

SEQ ID NO: 478101 - DNA, 16 bp, R. norvegicus
aggcagaggtaggcag

SEQ ID NO: 478102 - DNA, 16 bp, R. norvegicus
aggcagaggtaggtag

SEQ ID NO: 478103 - DNA, 16 bp, R. norvegicus
aggcagaggtgggaga

SEQ ID NO: 478104 - DNA, 16 bp, R. norvegicus
aggcagaggtgggtga

SEQ ID NO: 478105 - DNA, 16 bp, R. norvegicus
aggcagagtcagagag

SEQ ID NO: 478106 - DNA, 16 bp, R. norvegicus
aggcagagtcagaggc

SEQ ID NO: 478107 - DNA, 16 bp, R. norvegicus
aggcagagtcaggcag

SEQ ID NO: 478108 - DNA, 16 bp, R. norvegicus
aggcagagtcataggc

SEQ ID NO: 478109 - DNA, 16 bp, R. norvegicus
aggcagatcacttgga

SEQ ID NO: 478110 - DNA, 16 bp, R. norvegicus
aggcagatgcagagac

SEQ ID NO: 478111 - DNA, 16 bp, R. norvegicus
aggcagatgcaggcag

SEQ ID NO: 478112 - DNA, 16 bp, R. norvegicus
aggcagatggagagag

SEQ ID NO: 478113 - DNA, 16 bp, R. norvegicus
aggcagattcctgagt

SEQ ID NO: 478114 - DNA, 16 bp, R. norvegicus
aggcagcaaaaggaga

SEQ ID NO: 478115 - DNA, 16 bp, R. norvegicus
aggcagcaaagataaa

SEQ ID NO: 478116 - DNA, 16 bp, R. norvegicus
aggcagcagaaggaga

SEQ ID NO: 478117 - DNA, 16 bp, R. norvegicus
aggcagcagaaggcag

SEQ ID NO: 478118 - DNA, 16 bp, R. norvegicus
aggcagcagaggagga

SEQ ID NO: 478119 - DNA, 16 bp, R. norvegicus
aggcagcagcaggaga

SEQ ID NO: 478120 - DNA, 16 bp, R. norvegicus
aggcagcagctgatgc

SEQ ID NO: 478121 - DNA, 16 bp, R. norvegicus
aggcagcaggaagaaa

SEQ ID NO: 478122 - DNA, 16 bp, R. norvegicus
aggcagcaggaagaga

SEQ ID NO: 478123 - DNA, 16 bp, R. norvegicus
aggcagcaggaaggga

SEQ ID NO: 478124 - DNA, 16 bp, R. norvegicus
aggcagcaggcagcaa

SEQ ID NO: 478125 - DNA, 16 bp, R. norvegicus
aggcagcagggagaga

SEQ ID NO: 478126 - DNA, 16 bp, R. norvegicus
aggcagcatgtcagaa

SEQ ID NO: 478127 - DNA, 16 bp, R. norvegicus
aggcagccaggagaag

SEQ ID NO: 478128 - DNA, 16 bp, R. norvegicus
aggcagccaggaggag

SEQ ID NO: 478129 - DNA, 16 bp, R. norvegicus
aggcagccctgttggg

SEQ ID NO: 478130 - DNA, 16 bp, R. norvegicus
aggcagctagaagaag

SEQ ID NO: 478131 - DNA, 16 bp, R. norvegicus
aggcaggaaataaact

SEQ ID NO: 478132 - DNA, 16 bp, R. norvegicus
aggcaggaaccaggag

SEQ ID NO: 478133 - DNA, 16 bp, R. norvegicus
aggcaggaacctgaag

SEQ ID NO: 478134 - DNA, 16 bp, R. norvegicus
aggcaggaagatcagg

SEQ ID NO: 478135 - DNA, 16 bp, R. norvegicus
aggcaggaagggggtg

SEQ ID NO: 478136 - DNA, 16 bp, R. norvegicus
aggcaggaagtgggag

SEQ ID NO: 478137 - DNA, 16 bp, R. norvegicus
aggcaggagacagaga

SEQ ID NO: 478138 - DNA, 16 bp, R. norvegicus
aggcaggagatgtcct

SEQ ID NO: 478139 - DNA, 16 bp, R. norvegicus
aggcaggagcagaggc

SEQ ID NO: 478140 - DNA, 16 bp, R. norvegicus
aggcaggagctctacc

SEQ ID NO: 478141 - DNA, 16 bp, R. norvegicus
aggcaggagctgaagt

SEQ ID NO: 478142 - DNA, 16 bp, R. norvegicus
aggcaggaggaacaga

SEQ ID NO: 478143 - DNA, 16 bp, R. norvegicus
aggcaggaggacagca

SEQ ID NO: 478144 - DNA, 16 bp, R. norvegicus
aggcaggaggaccaga

SEQ ID NO: 478145 - DNA, 16 bp, R. norvegicus
aggcaggaggagctca

SEQ ID NO: 478146 - DNA, 16 bp, R. norvegicus
aggcaggaggatcacc

SEQ ID NO: 478147 - DNA, 16 bp, R. norvegicus
aggcaggaggattgcc

SEQ ID NO: 478148 - DNA, 16 bp, R. norvegicus
aggcaggaggctgagg

SEQ ID NO: 478149 - DNA, 16 bp, R. norvegicus
aggcaggaggggctgg

SEQ ID NO: 478150 - DNA, 16 bp, R. norvegicus
aggcaggagtgtgtgg

SEQ ID NO: 478151 - DNA, 16 bp, R. norvegicus
aggcaggcaccaccac

SEQ ID NO: 478152 - DNA, 16 bp, R. norvegicus
aggcaggcacgcaggc

SEQ ID NO: 478153 - DNA, 16 bp, R. norvegicus
aggcaggcactggagc

SEQ ID NO: 478154 - DNA, 16 bp, R. norvegicus
aggcaggcagagaagg

SEQ ID NO: 478155 - DNA, 16 bp, R. norvegicus
aggcaggcagatcgct

SEQ ID NO: 478156 - DNA, 16 bp, R. norvegicus
aggcaggcagcagaca

SEQ ID NO: 478157 - DNA, 17 bp, R. norvegicus
aggcaggcaggcaggca

SEQ ID NO: 478158 - DNA, 16 bp, R. norvegicus
aggcaggcagtgctgt

SEQ ID NO: 478159 - DNA, 16 bp, R. norvegicus
aggcaggcatggtgta

SEQ ID NO: 478160 - DNA, 16 bp, R. norvegicus
aggcaggctgaggcag

SEQ ID NO: 478161 - DNA, 16 bp, R. norvegicus
aggcaggctgatctct

SEQ ID NO: 478162 - DNA, 16 bp, R. norvegicus
aggcaggctggtctct

SEQ ID NO: 478163 - DNA, 16 bp, R. norvegicus
aggcagggctacacag

SEQ ID NO: 478164 - DNA, 16 bp, R. norvegicus
aggcaggggaagcaag

SEQ ID NO: 478165 - DNA, 16 bp, R. norvegicus
aggcagggtttctctg

SEQ ID NO: 478166 - DNA, 16 bp, R. norvegicus
aggcaggtagatctct

SEQ ID NO: 478167 - DNA, 16 bp, R. norvegicus
aggcaggtcacttgga

SEQ ID NO: 478168 - DNA, 16 bp, R. norvegicus
aggcaggtggatctcc

SEQ ID NO: 478169 - DNA, 17 bp, R. norvegicus
aggcaggtggatctctg

SEQ ID NO: 478170 - DNA, 16 bp, R. norvegicus
aggcaggttgcttgga

SEQ ID NO: 478171 - DNA, 16 bp, R. norvegicus
aggcagtcagatctct

SEQ ID NO: 478172 - DNA, 16 bp, R. norvegicus
aggcagtcctttgtcc

SEQ ID NO: 478173 - DNA, 16 bp, R. norvegicus
aggcagtctctggatg

SEQ ID NO: 478174 - DNA, 16 bp, R. norvegicus
aggcagtgcaggccct

SEQ ID NO: 478175 - DNA, 16 bp, R. norvegicus
aggcagtggagggagt

SEQ ID NO: 478176 - DNA, 16 bp, R. norvegicus
aggcagtggtggctca

SEQ ID NO: 478177 - DNA, 16 bp, R. norvegicus
aggcagtgtgagcatc

SEQ ID NO: 478178 - DNA, 16 bp, R. norvegicus
aggcagtgtgtgtgtg

SEQ ID NO: 478179 - DNA, 16 bp, R. norvegicus
aggcagttcaatgacc

SEQ ID NO: 478180 - DNA, 16 bp, R. norvegicus
aggcagttccagggcc

SEQ ID NO: 478181 - DNA, 16 bp, R. norvegicus
aggcatgaacacacac

SEQ ID NO: 478182 - DNA, 16 bp, R. norvegicus
aggcatgagccaccat

SEQ ID NO: 478183 - DNA, 16 bp, R. norvegicus
aggcatgagctaccat

SEQ ID NO: 478184 - DNA, 16 bp, R. norvegicus
aggcatgcatcaccac

SEQ ID NO: 478185 - DNA, 16 bp, R. norvegicus
aggcatgcgtcaccac

SEQ ID NO: 478186 - DNA, 16 bp, R. norvegicus
aggcatggcccctggt

SEQ ID NO: 478187 - DNA, 16 bp, R. norvegicus
aggcatggtgcagcag

SEQ ID NO: 478188 - DNA, 16 bp, R. norvegicus
aggcatggtggcagga

SEQ ID NO: 478189 - DNA, 16 bp, R. norvegicus
aggcatgtagatctct

SEQ ID NO: 478190 - DNA, 16 bp, R. norvegicus
aggcatgtgccaacac

SEQ ID NO: 478191 - DNA, 16 bp, R. norvegicus
aggcatgtgctaccac

SEQ ID NO: 478192 - DNA, 16 bp, R. norvegicus
aggcatgtgtcaccat

SEQ ID NO: 478193 - DNA, 16 bp, R. norvegicus
aggcatgttctccagg

SEQ ID NO: 478194 - DNA, 16 bp, R. norvegicus
aggcatgttttatgac

SEQ ID NO: 478195 - DNA, 16 bp, R. norvegicus
aggcatttcctcaaga

SEQ ID NO: 478196 - DNA, 16 bp, R. norvegicus
aggcattttctcaatt

SEQ ID NO: 478197 - DNA, 16 bp, R. norvegicus
aggccaacctctgcta

SEQ ID NO: 478198 - DNA, 16 bp, R. norvegicus
aggccaacctgggcta

SEQ ID NO: 478199 - DNA, 16 bp, R. norvegicus
aggccaacctggtcta

SEQ ID NO: 478200 - DNA, 16 bp, R. norvegicus
aggccaacttggacta

SEQ ID NO: 478201 - DNA, 16 bp, R. norvegicus
aggccaagaagagcaa

SEQ ID NO: 478202 - DNA, 16 bp, R. norvegicus
aggccaagcagggcaa

SEQ ID NO: 478203 - DNA, 16 bp, R. norvegicus
aggccaagccattcca

SEQ ID NO: 478204 - DNA, 16 bp, R. norvegicus
aggccaagctggcctc

SEQ ID NO: 478205 - DNA, 16 bp, R. norvegicus
aggccaagctggcctt

SEQ ID NO: 478206 - DNA, 16 bp, R. norvegicus
aggccaagctggtcta

SEQ ID NO: 478207 - DNA, 16 bp, R. norvegicus
aggccaaggccagcct

SEQ ID NO: 478208 - DNA, 16 bp, R. norvegicus
aggccaccctgggctg

SEQ ID NO: 478209 - DNA, 16 bp, R. norvegicus
aggccaccctggtcta

SEQ ID NO: 478210 - DNA, 16 bp, R. norvegicus
aggccacgcctcctcc

SEQ ID NO: 478211 - DNA, 16 bp, R. norvegicus
aggccactgggctcca

SEQ ID NO: 478212 - DNA, 16 bp, R. norvegicus
aggccagaaactgcag

SEQ ID NO: 478213 - DNA, 16 bp, R. norvegicus
aggccagaagaagggg

SEQ ID NO: 478214 - DNA, 16 bp, R. norvegicus
aggccagaagaggcag

SEQ ID NO: 478215 - DNA, 16 bp, R. norvegicus
aggccagaagatgctg

SEQ ID NO: 478216 - DNA, 16 bp, R. norvegicus
aggccagaaggctgaa

SEQ ID NO: 478217 - DNA, 16 bp, R. norvegicus
aggccagaaggtcctg

SEQ ID NO: 478218 - DNA, 16 bp, R. norvegicus
aggccagaaggtggca

SEQ ID NO: 478219 - DNA, 16 bp, R. norvegicus
aggccagaccaggaag

SEQ ID NO: 478220 - DNA, 16 bp, R. norvegicus
aggccagagaacaacc

SEQ ID NO: 478221 - DNA, 16 bp, R. norvegicus
aggccagagaaggcat

SEQ ID NO: 478222 - DNA, 16 bp, R. norvegicus
aggccagaggaaaaca

SEQ ID NO: 478223 - DNA, 16 bp, R. norvegicus
aggccagaggagggca

SEQ ID NO: 478224 - DNA, 16 bp, R. norvegicus
aggccagaggccagag

SEQ ID NO: 478225 - DNA, 16 bp, R. norvegicus
aggccagaggccagcc

SEQ ID NO: 478226 - DNA, 16 bp, R. norvegicus
aggccagaggtgtcag

SEQ ID NO: 478227 - DNA, 16 bp, R. norvegicus
aggccagatggtttta

SEQ ID NO: 478228 - DNA, 16 bp, R. norvegicus
aggccagcaccatctt

SEQ ID NO: 478229 - DNA, 16 bp, R. norvegicus
aggccagcatgggctt

SEQ ID NO: 478230 - DNA, 16 bp, R. norvegicus
aggccagccagagcca

SEQ ID NO: 478231 - DNA, 16 bp, R. norvegicus
aggccagccagagcta

SEQ ID NO: 478232 - DNA, 16 bp, R. norvegicus
aggccagccagagtta

SEQ ID NO: 478233 - DNA, 16 bp, R. norvegicus
aggccagccaggacca

SEQ ID NO: 478234 - DNA, 16 bp, R. norvegicus
aggccagccagggcta

SEQ ID NO: 478235 - DNA, 16 bp, R. norvegicus
aggccagccagggtga

SEQ ID NO: 478236 - DNA, 16 bp, R. norvegicus
aggccagccatgagca

SEQ ID NO: 478237 - DNA, 16 bp, R. norvegicus
aggccagcctaggcta

SEQ ID NO: 478238 - DNA, 16 bp, R. norvegicus
aggccagcctaggtta

SEQ ID NO: 478239 - DNA, 16 bp, R. norvegicus
aggccagcctcaccta

SEQ ID NO: 478240 - DNA, 16 bp, R. norvegicus
aggccagcctgctgta

SEQ ID NO: 478241 - DNA, 16 bp, R. norvegicus
aggccagcctggccca

SEQ ID NO: 478242 - DNA, 16 bp, R. norvegicus
aggccagcctggccta

SEQ ID NO: 478243 - DNA, 16 bp, R. norvegicus
aggccagcctgggcca

SEQ ID NO: 478244 - DNA, 16 bp, R. norvegicus
aggccagcctgggcta

SEQ ID NO: 478245 - DNA, 16 bp, R. norvegicus
aggccagcctggtcta

SEQ ID NO: 478246 - DNA, 16 bp, R. norvegicus
aggccagcctggtgta

SEQ ID NO: 478247 - DNA, 16 bp, R. norvegicus
aggccagccttgaatt

SEQ ID NO: 478248 - DNA, 16 bp, R. norvegicus
aggccagccttgccta

SEQ ID NO: 478249 - DNA, 16 bp, R. norvegicus
aggccagccttggcca

SEQ ID NO: 478250 - DNA, 16 bp, R. norvegicus
aggccagctggggcta

SEQ ID NO: 478251 - DNA, 16 bp, R. norvegicus
aggccagcttggacta

SEQ ID NO: 478252 - DNA, 16 bp, R. norvegicus
aggccagcttgggctc

SEQ ID NO: 478253 - DNA, 16 bp, R. norvegicus
aggccagcttgttcta

SEQ ID NO: 478254 - DNA, 16 bp, R. norvegicus
aggccagctttgaact

SEQ ID NO: 478255 - DNA, 16 bp, R. norvegicus
aggccaggaccccacc

SEQ ID NO: 478256 - DNA, 16 bp, R. norvegicus
aggccaggccaggcag

SEQ ID NO: 478257 - DNA, 16 bp, R. norvegicus
aggccaggctggcctc

SEQ ID NO: 478258 - DNA, 16 bp, R. norvegicus
aggccaggctggctca

SEQ ID NO: 478259 - DNA, 16 bp, R. norvegicus
aggccaggctgtcctt

SEQ ID NO: 478260 - DNA, 16 bp, R. norvegicus
aggccagggctggaga

SEQ ID NO: 478261 - DNA, 16 bp, R. norvegicus
aggccaggtggctggg

SEQ ID NO: 478262 - DNA, 16 bp, R. norvegicus
aggccaggttccagct

SEQ ID NO: 478263 - DNA, 16 bp, R. norvegicus
aggccagtcagagctg

SEQ ID NO: 478264 - DNA, 16 bp, R. norvegicus
aggccagtctgggcta

SEQ ID NO: 478265 - DNA, 16 bp, R. norvegicus
aggccagtctggtcta

SEQ ID NO: 478266 - DNA, 16 bp, R. norvegicus
aggccagtttgggcta

SEQ ID NO: 478267 - DNA, 16 bp, R. norvegicus
aggccatacctactct

SEQ ID NO: 478268 - DNA, 16 bp, R. norvegicus
aggccatccagagaca

SEQ ID NO: 478269 - DNA, 16 bp, R. norvegicus
aggccatctttggatc

SEQ ID NO: 478270 - DNA, 16 bp, R. norvegicus
aggccatgcttcctaa

SEQ ID NO: 478271 - DNA, 16 bp, R. norvegicus
aggccatggaagggtg

SEQ ID NO: 478272 - DNA, 16 bp, R. norvegicus
aggccatggagaggtg

SEQ ID NO: 478273 - DNA, 16 bp, R. norvegicus
aggccatggaggagcg

SEQ ID NO: 478274 - DNA, 16 bp, R. norvegicus
aggccatggaggatgc

SEQ ID NO: 478275 - DNA, 16 bp, R. norvegicus
aggccatggtggtctg

SEQ ID NO: 478276 - DNA, 16 bp, R. norvegicus
aggcccagagagagca

SEQ ID NO: 478277 - DNA, 16 bp, R. norvegicus
aggcccagaggaagga

SEQ ID NO: 478278 - DNA, 16 bp, R. norvegicus
aggcccagagggccag

SEQ ID NO: 478279 - DNA, 16 bp, R. norvegicus
aggcccagatccagga

SEQ ID NO: 478280 - DNA, 17 bp, R. norvegicus
aggcccaggcccaggcc

SEQ ID NO: 478281 - DNA, 16 bp, R. norvegicus
aggcccaggcccaggg

SEQ ID NO: 478282 - DNA, 16 bp, R. norvegicus
aggccccaaaggggat

SEQ ID NO: 478283 - DNA, 16 bp, R. norvegicus
aggccccagggagttt

SEQ ID NO: 478284 - DNA, 16 bp, R. norvegicus
aggccccatatgaaca

SEQ ID NO: 478285 - DNA, 16 bp, R. norvegicus
aggccccatgcccagc

SEQ ID NO: 478286 - DNA, 16 bp, R. norvegicus
aggcccctccagctct

SEQ ID NO: 478287 - DNA, 16 bp, R. norvegicus
aggcccctgacacata

SEQ ID NO: 478288 - DNA, 16 bp, R. norvegicus
aggccctaagagaaca

SEQ ID NO: 478289 - DNA, 16 bp, R. norvegicus
aggccctcctggttgc

SEQ ID NO: 478290 - DNA, 16 bp, R. norvegicus
aggccctgatctcctg

SEQ ID NO: 478291 - DNA, 16 bp, R. norvegicus
aggccctggattcaat

SEQ ID NO: 478292 - DNA, 16 bp, R. norvegicus
aggccctgtgcatgct

SEQ ID NO: 478293 - DNA, 16 bp, R. norvegicus
aggcccttccaaggac

SEQ ID NO: 478294 - DNA, 25 bp, R. norvegicus
aggcctaaaactggtcttcaataac

SEQ ID NO: 478295 - DNA, 16 bp, R. norvegicus
aggcctactccatgag

SEQ ID NO: 478296 - DNA, 18 bp, R. norvegicus
aggcctatgcctggttct

SEQ ID NO: 478297 - DNA, 16 bp, R. norvegicus
aggcctccagcagaag

SEQ ID NO: 478298 - DNA, 16 bp, R. norvegicus
aggcctccccttctct

SEQ ID NO: 478299 - DNA, 16 bp, R. norvegicus
aggcctccctgtgctc

SEQ ID NO: 478300 - DNA, 16 bp, R. norvegicus
aggcctcctgtgtccc

SEQ ID NO: 478301 - DNA, 16 bp, R. norvegicus
aggcctctatctgctg

SEQ ID NO: 478302 - DNA, 16 bp, R. norvegicus
aggcctctctgcacat

SEQ ID NO: 478303 - DNA, 16 bp, R. norvegicus
aggcctctggcctctg

SEQ ID NO: 478304 - DNA, 16 bp, R. norvegicus
aggcctctgggctcac

SEQ ID NO: 478305 - DNA, 16 bp, R. norvegicus
aggcctctgggctcct

SEQ ID NO: 478306 - DNA, 16 bp, R. norvegicus
aggcctgaaagcagaa

SEQ ID NO: 478307 - DNA, 16 bp, R. norvegicus
aggcctgaagagggtg

SEQ ID NO: 478308 - DNA, 16 bp, R. norvegicus
aggcctgaccatgttt

SEQ ID NO: 478309 - DNA, 16 bp, R. norvegicus
aggcctgaggttgatg

SEQ ID NO: 478310 - DNA, 16 bp, R. norvegicus
aggcctgcatcaccac

SEQ ID NO: 478311 - DNA, 16 bp, R. norvegicus
aggcctgtcattggac

SEQ ID NO: 478312 - DNA, 16 bp, R. norvegicus
aggcctgtgtatcagg

SEQ ID NO: 478313 - DNA, 16 bp, R. norvegicus
aggccttccagagact

SEQ ID NO: 478314 - DNA, 16 bp, R. norvegicus
aggccttctacaggag

SEQ ID NO: 478315 - DNA, 16 bp, R. norvegicus
aggccttctccatgct

SEQ ID NO: 478316 - DNA, 16 bp, R. norvegicus
aggccttctccatggc

SEQ ID NO: 478317 - DNA, 16 bp, R. norvegicus
aggccttgcccttctc

SEQ ID NO: 478318 - DNA, 16 bp, R. norvegicus
aggcctttaaactgat

SEQ ID NO: 478319 - DNA, 17 bp, R. norvegicus
aggcctttggcagtgtg

SEQ ID NO: 478320 - DNA, 16 bp, R. norvegicus
aggcgcaaggccctgg

SEQ ID NO: 478321 - DNA, 16 bp, R. norvegicus
aggcgtgcatcaccac

SEQ ID NO: 478322 - DNA, 42 bp, R. norvegicus
aggctaaaagacctacaggtgatacagaaagaaatctgctca

SEQ ID NO: 478323 - DNA, 16 bp, R. norvegicus
aggctaaggcaggagg

SEQ ID NO: 478324 - DNA, 16 bp, R. norvegicus
aggctacacagaaacc

SEQ ID NO: 478325 - DNA, 16 bp, R. norvegicus
aggctacacagagaaa

SEQ ID NO: 478326 - DNA, 16 bp, R. norvegicus
aggctacagaaagaaa

SEQ ID NO: 478327 - DNA, 16 bp, R. norvegicus
aggctacatgagaccc

SEQ ID NO: 478328 - DNA, 16 bp, R. norvegicus
aggctactataaccag

SEQ ID NO: 478329 - DNA, 16 bp, R. norvegicus
aggctactgatttgct

SEQ ID NO: 478330 - DNA, 16 bp, R. norvegicus
aggctactgtatccag

SEQ ID NO: 478331 - DNA, 16 bp, R. norvegicus
aggctagaacaaagaa

SEQ ID NO: 478332 - DNA, 16 bp, R. norvegicus
aggctagaagggaggt

SEQ ID NO: 478333 - DNA, 16 bp, R. norvegicus
aggctagcctggtcta

SEQ ID NO: 478334 - DNA, 16 bp, R. norvegicus
aggctagtctcaaact

SEQ ID NO: 478335 - DNA, 16 bp, R. norvegicus
aggctatcctggcctt

SEQ ID NO: 478336 - DNA, 16 bp, R. norvegicus
aggctatctaggtgct

SEQ ID NO: 478337 - DNA, 16 bp, R. norvegicus
aggctatgacagcagc

SEQ ID NO: 478338 - DNA, 16 bp, R. norvegicus
aggctcaagtttgctc

SEQ ID NO: 478339 - DNA, 16 bp, R. norvegicus
aggctcacaggagaga

SEQ ID NO: 478340 - DNA, 16 bp, R. norvegicus
aggctcacctcacact

SEQ ID NO: 478341 - DNA, 16 bp, R. norvegicus
aggctcagagagtagc

SEQ ID NO: 478342 - DNA, 16 bp, R. norvegicus
aggctcagagatcatt

SEQ ID NO: 478343 - DNA, 17 bp, R. norvegicus
aggctcagatctgggga

SEQ ID NO: 478344 - DNA, 16 bp, R. norvegicus
aggctcagggactcag

SEQ ID NO: 478345 - DNA, 16 bp, R. norvegicus
aggctccaaggaccca

SEQ ID NO: 478346 - DNA, 16 bp, R. norvegicus
aggctccactcagcag

SEQ ID NO: 478347 - DNA, 16 bp, R. norvegicus
aggctccagcagagcc

SEQ ID NO: 478348 - DNA, 16 bp, R. norvegicus
aggctccagggaaggg

SEQ ID NO: 478349 - DNA, 16 bp, R. norvegicus
aggctccagggagtgg

SEQ ID NO: 478350 - DNA, 16 bp, R. norvegicus
aggctccatccagcag

SEQ ID NO: 478351 - DNA, 16 bp, R. norvegicus
aggctcccaggaccca

SEQ ID NO: 478352 - DNA, 16 bp, R. norvegicus
aggctcccagtaccca

SEQ ID NO: 478353 - DNA, 16 bp, R. norvegicus
aggctcccggaaaggg

SEQ ID NO: 478354 - DNA, 16 bp, R. norvegicus
aggctcctggaaaggg

SEQ ID NO: 478355 - DNA, 16 bp, R. norvegicus
aggctcctgtctgaaa

SEQ ID NO: 478356 - DNA, 16 bp, R. norvegicus
aggctcctgtcttcaa

SEQ ID NO: 478357 - DNA, 16 bp, R. norvegicus
aggctcctgttagcaa

SEQ ID NO: 478358 - DNA, 16 bp, R. norvegicus
aggctccttcttccca

SEQ ID NO: 478359 - DNA, 16 bp, R. norvegicus
aggctcctttctgtga

SEQ ID NO: 478360 - DNA, 16 bp, R. norvegicus
aggctcgatgcctcag

SEQ ID NO: 478361 - DNA, 16 bp, R. norvegicus
aggctcgggaccacag

SEQ ID NO: 478362 - DNA, 16 bp, R. norvegicus
aggctcggggttgggg

SEQ ID NO: 478363 - DNA, 16 bp, R. norvegicus
aggctctatcagcagc

SEQ ID NO: 478364 - DNA, 16 bp, R. norvegicus
aggctctgaagggcca

SEQ ID NO: 478365 - DNA, 17 bp, R. norvegicus
aggctctgccaaccaaa

SEQ ID NO: 478366 - DNA, 16 bp, R. norvegicus
aggctctggaagcttc

SEQ ID NO: 478367 - DNA, 16 bp, R. norvegicus
aggctctggcagagca

SEQ ID NO: 478368 - DNA, 16 bp, R. norvegicus
aggctctggccgagcc

SEQ ID NO: 478369 - DNA, 16 bp, R. norvegicus
aggctctgtcagagca

SEQ ID NO: 478370 - DNA, 16 bp, R. norvegicus
aggctctgtgggccct

SEQ ID NO: 478371 - DNA, 16 bp, R. norvegicus
aggctcttttctctgt

SEQ ID NO: 478372 - DNA, 16 bp, R. norvegicus
aggctgaaaggaaaca

SEQ ID NO: 478373 - DNA, 16 bp, R. norvegicus
aggctgaacaaggcaa

SEQ ID NO: 478374 - DNA, 19 bp, R. norvegicus
aggctgaatttataccata

SEQ ID NO: 478375 - DNA, 16 bp, R. norvegicus
aggctgacaagaacca

SEQ ID NO: 478376 - DNA, 16 bp, R. norvegicus
aggctgacagcctgag

SEQ ID NO: 478377 - DNA, 16 bp, R. norvegicus
aggctgacaggaactg

SEQ ID NO: 478378 - DNA, 16 bp, R. norvegicus
aggctgacattaagat

SEQ ID NO: 478379 - DNA, 16 bp, R. norvegicus
aggctgaccttgaact

SEQ ID NO: 478380 - DNA, 16 bp, R. norvegicus
aggctgactaccaagg

SEQ ID NO: 478381 - DNA, 16 bp, R. norvegicus
aggctgagccagccat

SEQ ID NO: 478382 - DNA, 16 bp, R. norvegicus
aggctgaggaaagaga

SEQ ID NO: 478383 - DNA, 16 bp, R. norvegicus
aggctgaggaagccag

SEQ ID NO: 478384 - DNA, 16 bp, R. norvegicus
aggctgaggaggctga

SEQ ID NO: 478385 - DNA, 16 bp, R. norvegicus
aggctgaggcaaaagg

SEQ ID NO: 478386 - DNA, 16 bp, R. norvegicus
aggctgaggcagcagg

SEQ ID NO: 478387 - DNA, 16 bp, R. norvegicus
aggctgaggcagggga

SEQ ID NO: 478388 - DNA, 16 bp, R. norvegicus
aggctgaggccagagg

SEQ ID NO: 478389 - DNA, 16 bp, R. norvegicus
aggctgaggctgagga

SEQ ID NO: 478390 - DNA, 16 bp, R. norvegicus
aggctgaggctgaggc

SEQ ID NO: 478391 - DNA, 16 bp, R. norvegicus
aggctgagggaggaag

SEQ ID NO: 478392 - DNA, 16 bp, R. norvegicus
aggctgaggtgggagg

SEQ ID NO: 478393 - DNA, 16 bp, R. norvegicus
aggctgagtgtggtgg

SEQ ID NO: 478394 - DNA, 16 bp, R. norvegicus
aggctgcaaagcggaa

SEQ ID NO: 478395 - DNA, 16 bp, R. norvegicus
aggctgcacaggccct

SEQ ID NO: 478396 - DNA, 16 bp, R. norvegicus
aggctgcagaatgcag

SEQ ID NO: 478397 - DNA, 16 bp, R. norvegicus
aggctgcatcccaggc

SEQ ID NO: 478398 - DNA, 16 bp, R. norvegicus
aggctgcccctctgct

SEQ ID NO: 478399 - DNA, 16 bp, R. norvegicus
aggctgccctcgaact

SEQ ID NO: 478400 - DNA, 16 bp, R. norvegicus
aggctgcctggccagc

SEQ ID NO: 478401 - DNA, 16 bp, R. norvegicus
aggctgccttcaaact

SEQ ID NO: 478402 - DNA, 16 bp, R. norvegicus
aggctgctgctcttcc

SEQ ID NO: 478403 - DNA, 16 bp, R. norvegicus
aggctgctggggaaga

SEQ ID NO: 478404 - DNA, 16 bp, R. norvegicus
aggctgctgtgcaggc

SEQ ID NO: 478405 - DNA, 16 bp, R. norvegicus
aggctggaaaacaagt

SEQ ID NO: 478406 - DNA, 16 bp, R. norvegicus
aggctggacccctcag

SEQ ID NO: 478407 - DNA, 16 bp, R. norvegicus
aggctggacttcaaca

SEQ ID NO: 478408 - DNA, 16 bp, R. norvegicus
aggctggagacttgtt

SEQ ID NO: 478409 - DNA, 16 bp, R. norvegicus
aggctggagagatgac

SEQ ID NO: 478410 - DNA, 16 bp, R. norvegicus
aggctggagcatggca

SEQ ID NO: 478411 - DNA, 16 bp, R. norvegicus
aggctggaggatcatg

SEQ ID NO: 478412 - DNA, 16 bp, R. norvegicus
aggctggaggccccag

SEQ ID NO: 478413 - DNA, 16 bp, R. norvegicus
aggctggaggggcagc

SEQ ID NO: 478414 - DNA, 16 bp, R. norvegicus
aggctggagtggtggg

SEQ ID NO: 478415 - DNA, 16 bp, R. norvegicus
aggctggatgtggtgg

SEQ ID NO: 478416 - DNA, 16 bp, R. norvegicus
aggctggccagccagc

SEQ ID NO: 478417 - DNA, 16 bp, R. norvegicus
aggctggccagtgagc

SEQ ID NO: 478418 - DNA, 16 bp, R. norvegicus
aggctggcctcaaaca

SEQ ID NO: 478419 - DNA, 16 bp, R. norvegicus
aggctggcctcaaact

SEQ ID NO: 478420 - DNA, 16 bp, R. norvegicus
aggctggcctggacct

SEQ ID NO: 478421 - DNA, 16 bp, R. norvegicus
aggctggcctggagtt

SEQ ID NO: 478422 - DNA, 16 bp, R. norvegicus
aggctggccttgtact

SEQ ID NO: 478423 - DNA, 16 bp, R. norvegicus
aggctggcctttaact

SEQ ID NO: 478424 - DNA, 16 bp, R. norvegicus
aggctggctatgaact

SEQ ID NO: 478425 - DNA, 16 bp, R. norvegicus
aggctggctggctagc

SEQ ID NO: 478426 - DNA, 16 bp, R. norvegicus
aggctggctttgaatt

SEQ ID NO: 478427 - DNA, 16 bp, R. norvegicus
aggctggctttgagct

SEQ ID NO: 478428 - DNA, 16 bp, R. norvegicus
aggctggggtttgaga

SEQ ID NO: 478429 - DNA, 16 bp, R. norvegicus
aggctggtcttaaact

SEQ ID NO: 478430 - DNA, 17 bp, R. norvegicus
aggctggtcttcctgga

SEQ ID NO: 478431 - DNA, 16 bp, R. norvegicus
aggctgtcagcatctt

SEQ ID NO: 478432 - DNA, 16 bp, R. norvegicus
aggctgtcctcaaact

SEQ ID NO: 478433 - DNA, 16 bp, R. norvegicus
aggctgtcctggaact

SEQ ID NO: 478434 - DNA, 16 bp, R. norvegicus
aggctgtctggccagc

SEQ ID NO: 478435 - DNA, 16 bp, R. norvegicus
aggctgtgacacaggt

SEQ ID NO: 478436 - DNA, 16 bp, R. norvegicus
aggctgtggaaaagaa

SEQ ID NO: 478437 - DNA, 16 bp, R. norvegicus
aggctgtggaggagtg

SEQ ID NO: 478438 - DNA, 16 bp, R. norvegicus
aggctgtggtggcaca

SEQ ID NO: 478439 - DNA, 16 bp, R. norvegicus
aggctgttgagaagaa

SEQ ID NO: 478440 - DNA, 16 bp, R. norvegicus
aggcttaccttgaact

SEQ ID NO: 478441 - DNA, 16 bp, R. norvegicus
aggcttcatcccaagt

SEQ ID NO: 478442 - DNA, 16 bp, R. norvegicus
aggcttcatctcagga

SEQ ID NO: 478443 - DNA, 16 bp, R. norvegicus
aggcttccacatgcat

SEQ ID NO: 478444 - DNA, 16 bp, R. norvegicus
aggcttcctagattat

SEQ ID NO: 478445 - DNA, 16 bp, R. norvegicus
aggcttcctcctgcag

SEQ ID NO: 478446 - DNA, 16 bp, R. norvegicus
aggcttcctggaggag

SEQ ID NO: 478447 - DNA, 16 bp, R. norvegicus
aggcttccttccttcc

SEQ ID NO: 478448 - DNA, 16 bp, R. norvegicus
aggcttctatttgttt

SEQ ID NO: 478449 - DNA, 16 bp, R. norvegicus
aggcttctctgcctct

SEQ ID NO: 478450 - DNA, 16 bp, R. norvegicus
aggcttcttctatgcc

SEQ ID NO: 478451 - DNA, 16 bp, R. norvegicus
aggcttgatgccacag

SEQ ID NO: 478452 - DNA, 16 bp, R. norvegicus
aggcttgcacagcaag

SEQ ID NO: 478453 - DNA, 16 bp, R. norvegicus
aggcttgcctgcctct

SEQ ID NO: 478454 - DNA, 16 bp, R. norvegicus
aggcttgggaggggaa

SEQ ID NO: 478455 - DNA, 16 bp, R. norvegicus
aggcttgtttcctcaa

SEQ ID NO: 478456 - DNA, 16 bp, R. norvegicus
aggctttcaaccaaaa

SEQ ID NO: 478457 - DNA, 16 bp, R. norvegicus
aggctttgaaaaaaaa

SEQ ID NO: 478458 - DNA, 16 bp, R. norvegicus
aggctttgccagagtc

SEQ ID NO: 478459 - DNA, 16 bp, R. norvegicus
aggctttgtgtgtgtg

SEQ ID NO: 478460 - DNA, 16 bp, R. norvegicus
aggcttttccagagcc

SEQ ID NO: 478461 - DNA, 16 bp, R. norvegicus
aggctttttcagcatt

SEQ ID NO: 478462 - DNA, 16 bp, R. norvegicus
agggaaaaaagtcaag

SEQ ID NO: 478463 - DNA, 16 bp, R. norvegicus
agggaaaacaaaatac

SEQ ID NO: 478464 - DNA, 16 bp, R. norvegicus
agggaaacatttgaaa

SEQ ID NO: 478465 - DNA, 16 bp, R. norvegicus
agggaaacattttaaa

SEQ ID NO: 478466 - DNA, 16 bp, R. norvegicus
agggaaaccttgtctc

SEQ ID NO: 478467 - DNA, 16 bp, R. norvegicus
agggaaactgaggcac

SEQ ID NO: 478468 - DNA, 16 bp, R. norvegicus
agggaaattggtatga

SEQ ID NO: 478469 - DNA, 16 bp, R. norvegicus
agggaaattggtttga

SEQ ID NO: 478470 - DNA, 16 bp, R. norvegicus
agggaacaatttgaag

SEQ ID NO: 478471 - DNA, 16 bp, R. norvegicus
agggaacactgcagaa

SEQ ID NO: 478472 - DNA, 16 bp, R. norvegicus
agggaacactgtggaa

SEQ ID NO: 478473 - DNA, 16 bp, R. norvegicus
agggaacctggagtaa

SEQ ID NO: 478474 - DNA, 16 bp, R. norvegicus
agggaagaagtcaaaa

SEQ ID NO: 478475 - DNA, 16 bp, R. norvegicus
agggaagagacaggca

SEQ ID NO: 478476 - DNA, 16 bp, R. norvegicus
agggaagagagaacct

SEQ ID NO: 478477 - DNA, 16 bp, R. norvegicus
agggaagagtctcaaa

SEQ ID NO: 478478 - DNA, 16 bp, R. norvegicus
agggaagcaccctcat

SEQ ID NO: 478479 - DNA, 16 bp, R. norvegicus
agggaagccaaggcag

SEQ ID NO: 478480 - DNA, 16 bp, R. norvegicus
agggaagccaggaaca

SEQ ID NO: 478481 - DNA, 16 bp, R. norvegicus
agggaagcctctggaa

SEQ ID NO: 478482 - DNA, 16 bp, R. norvegicus
agggaagctgggaagt

SEQ ID NO: 478483 - DNA, 16 bp, R. norvegicus
agggaagcttctggaa

SEQ ID NO: 478484 - DNA, 16 bp, R. norvegicus
agggaaggaagaaatt

SEQ ID NO: 478485 - DNA, 16 bp, R. norvegicus
agggaaggcagacaga

SEQ ID NO: 478486 - DNA, 16 bp, R. norvegicus
agggaagggtttgttt

SEQ ID NO: 478487 - DNA, 16 bp, R. norvegicus
agggaagtcagctttt

SEQ ID NO: 478488 - DNA, 16 bp, R. norvegicus
agggaatgaccaacca

SEQ ID NO: 478489 - DNA, 16 bp, R. norvegicus
agggaattccaggaca

SEQ ID NO: 478490 - DNA, 16 bp, R. norvegicus
agggacaaggctgccc

SEQ ID NO: 478491 - DNA, 16 bp, R. norvegicus
agggacaattctgggt

SEQ ID NO: 478492 - DNA, 16 bp, R. norvegicus
agggacacagagaaac

SEQ ID NO: 478493 - DNA, 16 bp, R. norvegicus
agggacaccaggagaa

SEQ ID NO: 478494 - DNA, 16 bp, R. norvegicus
agggacagacaataga

SEQ ID NO: 478495 - DNA, 16 bp, R. norvegicus
agggacagcacagagt

SEQ ID NO: 478496 - DNA, 17 bp, R. norvegicus
agggacagcaccaccca

SEQ ID NO: 478497 - DNA, 16 bp, R. norvegicus
agggacagcagaaaga

SEQ ID NO: 478498 - DNA, 16 bp, R. norvegicus
agggacagcagcagca

SEQ ID NO: 478499 - DNA, 16 bp, R. norvegicus
agggacagcaggtgca

SEQ ID NO: 478500 - DNA, 16 bp, R. norvegicus
agggacaggaagatga

SEQ ID NO: 478501 - DNA, 16 bp, R. norvegicus
agggacattgggctgt

SEQ ID NO: 478502 - DNA, 16 bp, R. norvegicus
agggaccaaggaggag

SEQ ID NO: 478503 - DNA, 16 bp, R. norvegicus
agggaccaggaggaac

SEQ ID NO: 478504 - DNA, 16 bp, R. norvegicus
agggacccaaggctcc

SEQ ID NO: 478505 - DNA, 16 bp, R. norvegicus
agggacctgggaggga

SEQ ID NO: 478506 - DNA, 16 bp, R. norvegicus
agggactatacaaggc

SEQ ID NO: 478507 - DNA, 16 bp, R. norvegicus
agggactataccacca

SEQ ID NO: 478508 - DNA, 16 bp, R. norvegicus
agggactgaagaaaag

SEQ ID NO: 478509 - DNA, 16 bp, R. norvegicus
agggactgactcctcc

SEQ ID NO: 478510 - DNA, 16 bp, R. norvegicus
agggactgatgcagag

SEQ ID NO: 478511 - DNA, 16 bp, R. norvegicus
agggactggactcagg

SEQ ID NO: 478512 - DNA, 16 bp, R. norvegicus
agggactggagagatg

SEQ ID NO: 478513 - DNA, 16 bp, R. norvegicus
agggacttcctaaagc

SEQ ID NO: 478514 - DNA, 16 bp, R. norvegicus
agggagaaactggaag

SEQ ID NO: 478515 - DNA, 16 bp, R. norvegicus
agggagaagaagccct

SEQ ID NO: 478516 - DNA, 17 bp, R. norvegicus
agggagaagaatctccc

SEQ ID NO: 478517 - DNA, 16 bp, R. norvegicus
agggagaagcaaagat

SEQ ID NO: 478518 - DNA, 16 bp, R. norvegicus
agggagaagcccttgg

SEQ ID NO: 478519 - DNA, 16 bp, R. norvegicus
agggagaaggttctgg

SEQ ID NO: 478520 - DNA, 16 bp, R. norvegicus
agggagacaaataacg

SEQ ID NO: 478521 - DNA, 16 bp, R. norvegicus
agggagacaaggggct

SEQ ID NO: 478522 - DNA, 16 bp, R. norvegicus
agggagacatggtgct

SEQ ID NO: 478523 - DNA, 16 bp, R. norvegicus
agggagaccctatctc

SEQ ID NO: 478524 - DNA, 16 bp, R. norvegicus
agggagacttttctga

SEQ ID NO: 478525 - DNA, 16 bp, R. norvegicus
agggagagaacacaca

SEQ ID NO: 478526 - DNA, 16 bp, R. norvegicus
agggagagaactgact

SEQ ID NO: 478527 - DNA, 16 bp, R. norvegicus
agggagagagtggaca

SEQ ID NO: 478528 - DNA, 16 bp, R. norvegicus
agggagagagtggcca

SEQ ID NO: 478529 - DNA, 16 bp, R. norvegicus
agggagagctgggcct

SEQ ID NO: 478530 - DNA, 16 bp, R. norvegicus
agggagaggcaggcaa

SEQ ID NO: 478531 - DNA, 16 bp, R. norvegicus
agggagaggctggagg

SEQ ID NO: 478532 - DNA, 16 bp, R. norvegicus
agggagcacagagagc

SEQ ID NO: 478533 - DNA, 16 bp, R. norvegicus
agggagcagaagcagg

SEQ ID NO: 478534 - DNA, 16 bp, R. norvegicus
agggagcagctgagag

SEQ ID NO: 478535 - DNA, 16 bp, R. norvegicus
agggagcctgccttat

SEQ ID NO: 478536 - DNA, 16 bp, R. norvegicus
agggagcctggaggcc

SEQ ID NO: 478537 - DNA, 16 bp, R. norvegicus
agggagctgaggagga

SEQ ID NO: 478538 - DNA, 16 bp, R. norvegicus
agggagctggctcagt

SEQ ID NO: 478539 - DNA, 16 bp, R. norvegicus
agggagctgtgggatt

SEQ ID NO: 478540 - DNA, 16 bp, R. norvegicus
agggagcttctatggg

SEQ ID NO: 478541 - DNA, 16 bp, R. norvegicus
agggaggactgggagg

SEQ ID NO: 478542 - DNA, 16 bp, R. norvegicus
agggaggccagaagag

SEQ ID NO: 478543 - DNA, 16 bp, R. norvegicus
agggaggctgaagcag

SEQ ID NO: 478544 - DNA, 16 bp, R. norvegicus
agggaggctgtgagga

SEQ ID NO: 478545 - DNA, 16 bp, R. norvegicus
agggagggacagagac

SEQ ID NO: 478546 - DNA, 16 bp, R. norvegicus
agggagggaccctaga

SEQ ID NO: 478547 - DNA, 16 bp, R. norvegicus
agggagggacctggaa

SEQ ID NO: 478548 - DNA, 16 bp, R. norvegicus
agggagggcagtaatg

SEQ ID NO: 478549 - DNA, 16 bp, R. norvegicus
agggagggcccagctc

SEQ ID NO: 478550 - DNA, 16 bp, R. norvegicus
agggagggcccaggag

SEQ ID NO: 478551 - DNA, 16 bp, R. norvegicus
agggagtagagaggca

SEQ ID NO: 478552 - DNA, 16 bp, R. norvegicus
agggagtagcactgtt

SEQ ID NO: 478553 - DNA, 16 bp, R. norvegicus
agggagtggaaccagc

SEQ ID NO: 478554 - DNA, 16 bp, R. norvegicus
agggagtggcactatt

SEQ ID NO: 478555 - DNA, 16 bp, R. norvegicus
agggagtggtactatt

SEQ ID NO: 478556 - DNA, 16 bp, R. norvegicus
agggataaagatggag

SEQ ID NO: 478557 - DNA, 17 bp, R. norvegicus
agggatagagtcagagc

SEQ ID NO: 478558 - DNA, 16 bp, R. norvegicus
agggatcaagctcagg

SEQ ID NO: 478559 - DNA, 16 bp, R. norvegicus
agggatccatggttcc

SEQ ID NO: 478560 - DNA, 16 bp, R. norvegicus
agggatccttctgcct

SEQ ID NO: 478561 - DNA, 16 bp, R. norvegicus
agggatctgggaagga

SEQ ID NO: 478562 - DNA, 16 bp, R. norvegicus
agggatgagggcaggg

SEQ ID NO: 478563 - DNA, 16 bp, R. norvegicus
agggatgatgatgatg

SEQ ID NO: 478564 - DNA, 16 bp, R. norvegicus
agggatggatgtatat

SEQ ID NO: 478565 - DNA, 16 bp, R. norvegicus
agggatggcaggcaca

SEQ ID NO: 478566 - DNA, 16 bp, R. norvegicus
agggatggggttgcca

SEQ ID NO: 478567 - DNA, 16 bp, R. norvegicus
agggatggtactgccc

SEQ ID NO: 478568 - DNA, 16 bp, R. norvegicus
agggatggttgtgagc

SEQ ID NO: 478569 - DNA, 16 bp, R. norvegicus
agggatgtttgcctgg

SEQ ID NO: 478570 - DNA, 16 bp, R. norvegicus
agggattaaagctgtg

SEQ ID NO: 478571 - DNA, 16 bp, R. norvegicus
agggattggaacacca

SEQ ID NO: 478572 - DNA, 16 bp, R. norvegicus
agggatttcttcatgt

SEQ ID NO: 478573 - DNA, 16 bp, R. norvegicus
agggattttggtatta

SEQ ID NO: 478574 - DNA, 16 bp, R. norvegicus
agggatttttttttct

SEQ ID NO: 478575 - DNA, 16 bp, R. norvegicus
agggcaagatcccacc

SEQ ID NO: 478576 - DNA, 16 bp, R. norvegicus
agggcaatgtcagggt

SEQ ID NO: 478577 - DNA, 16 bp, R. norvegicus
agggcacaatgggggc

SEQ ID NO: 478578 - DNA, 16 bp, R. norvegicus
agggcacctacatagg

SEQ ID NO: 478579 - DNA, 16 bp, R. norvegicus
agggcacctggtcagg

SEQ ID NO: 478580 - DNA, 16 bp, R. norvegicus
agggcacctttgactt

SEQ ID NO: 478581 - DNA, 16 bp, R. norvegicus
agggcactggagcagc

SEQ ID NO: 478582 - DNA, 16 bp, R. norvegicus
agggcacttgctgctc

SEQ ID NO: 478583 - DNA, 16 bp, R. norvegicus
agggcagagcagggca

SEQ ID NO: 478584 - DNA, 16 bp, R. norvegicus
agggcagaggcagaag

SEQ ID NO: 478585 - DNA, 17 bp, R. norvegicus
agggcagagttccccag

SEQ ID NO: 478586 - DNA, 16 bp, R. norvegicus
agggcagcaagcagag

SEQ ID NO: 478587 - DNA, 16 bp, R. norvegicus
agggcagcctaggaca

SEQ ID NO: 478588 - DNA, 16 bp, R. norvegicus
agggcagcctggtcta

SEQ ID NO: 478589 - DNA, 16 bp, R. norvegicus
agggcagctacagtgt

SEQ ID NO: 478590 - DNA, 16 bp, R. norvegicus
agggcaggaacccaag

SEQ ID NO: 478591 - DNA, 16 bp, R. norvegicus
agggcaggaagctgga

SEQ ID NO: 478592 - DNA, 16 bp, R. norvegicus
agggcaggagctggag

SEQ ID NO: 478593 - DNA, 16 bp, R. norvegicus
agggcagtgaggcaga

SEQ ID NO: 478594 - DNA, 16 bp, R. norvegicus
agggcagtggggcagg

SEQ ID NO: 478595 - DNA, 16 bp, R. norvegicus
agggcagtttctgact

SEQ ID NO: 478596 - DNA, 16 bp, R. norvegicus
agggcatcaggtccct

SEQ ID NO: 478597 - DNA, 16 bp, R. norvegicus
agggcatccaatctca

SEQ ID NO: 478598 - DNA, 16 bp, R. norvegicus
agggcatcctgggcta

SEQ ID NO: 478599 - DNA, 16 bp, R. norvegicus
agggcatctcctccca

SEQ ID NO: 478600 - DNA, 16 bp, R. norvegicus
agggcattttcttatt

SEQ ID NO: 478601 - DNA, 16 bp, R. norvegicus
agggccaacagaatga

SEQ ID NO: 478602 - DNA, 16 bp, R. norvegicus
agggccaagggcttcc

SEQ ID NO: 478603 - DNA, 16 bp, R. norvegicus
agggccaccccagtgc

SEQ ID NO: 478604 - DNA, 16 bp, R. norvegicus
agggccacctgcccag

SEQ ID NO: 478605 - DNA, 16 bp, R. norvegicus
agggccagcctgggct

SEQ ID NO: 478606 - DNA, 16 bp, R. norvegicus
agggccagccttggct

SEQ ID NO: 478607 - DNA, 16 bp, R. norvegicus
agggcccaagagagga

SEQ ID NO: 478608 - DNA, 38 bp, R. norvegicus
agggcccaggagcggcaggacccctgtgcctgagacac

SEQ ID NO: 478609 - DNA, 16 bp, R. norvegicus
agggcccaggaggggc

SEQ ID NO: 478610 - DNA, 16 bp, R. norvegicus
agggcccagggagtgg

SEQ ID NO: 478611 - DNA, 16 bp, R. norvegicus
agggcctactgtgtgc

SEQ ID NO: 478612 - DNA, 16 bp, R. norvegicus
agggcctctcctccaa

SEQ ID NO: 478613 - DNA, 16 bp, R. norvegicus
agggcctctcctgcca

SEQ ID NO: 478614 - DNA, 16 bp, R. norvegicus
agggcctgggtttggt

SEQ ID NO: 478615 - DNA, 16 bp, R. norvegicus
agggcctgtgcagcct

SEQ ID NO: 478616 - DNA, 16 bp, R. norvegicus
agggcctgtggcctgt

SEQ ID NO: 478617 - DNA, 16 bp, R. norvegicus
agggccttgcacatgc

SEQ ID NO: 478618 - DNA, 16 bp, R. norvegicus
agggccttgctggagg

SEQ ID NO: 478619 - DNA, 16 bp, R. norvegicus
agggctacaaagtgag

SEQ ID NO: 478620 - DNA, 16 bp, R. norvegicus
agggctacaaggagaa

SEQ ID NO: 478621 - DNA, 16 bp, R. norvegicus
agggctacacagcaag

SEQ ID NO: 478622 - DNA, 16 bp, R. norvegicus
agggctagcagaaaga

SEQ ID NO: 478623 - DNA, 16 bp, R. norvegicus
agggctagcctgggct

SEQ ID NO: 478624 - DNA, 16 bp, R. norvegicus
agggctcagctcactg

SEQ ID NO: 478625 - DNA, 16 bp, R. norvegicus
agggctccaaaagcca

SEQ ID NO: 478626 - DNA, 16 bp, R. norvegicus
agggctgaagagacag

SEQ ID NO: 478627 - DNA, 16 bp, R. norvegicus
agggctgagattaaag

SEQ ID NO: 478628 - DNA, 16 bp, R. norvegicus
agggctggaaagacag

SEQ ID NO: 478629 - DNA, 20 bp, R. norvegicus
agggctggagagatggctca

SEQ ID NO: 478630 - DNA, 16 bp, R. norvegicus
agggctggagagctgg

SEQ ID NO: 478631 - DNA, 16 bp, R. norvegicus
agggctggatttatgg

SEQ ID NO: 478632 - DNA, 16 bp, R. norvegicus
agggctggctgctgcc

SEQ ID NO: 478633 - DNA, 16 bp, R. norvegicus
agggctgggaagacag

SEQ ID NO: 478634 - DNA, 16 bp, R. norvegicus
agggctgtgggacagc

SEQ ID NO: 478635 - DNA, 16 bp, R. norvegicus
agggctgtttccctgt

SEQ ID NO: 478636 - DNA, 16 bp, R. norvegicus
agggcttattttggct

SEQ ID NO: 478637 - DNA, 16 bp, R. norvegicus
agggcttcacagagaa

SEQ ID NO: 478638 - DNA, 52 bp, R. norvegicus
agggcttccccttccactggtgctcttactaggatattcattgctacctatg

SEQ ID NO: 478639 - DNA, 16 bp, R. norvegicus
agggcttccccttcct

SEQ ID NO: 478640 - DNA, 16 bp, R. norvegicus
agggcttctcctcctc

SEQ ID NO: 478641 - DNA, 16 bp, R. norvegicus
agggcttctccttcca

SEQ ID NO: 478642 - DNA, 16 bp, R. norvegicus
agggctttgttctcct

SEQ ID NO: 478643 - DNA, 16 bp, R. norvegicus
aggggaaactccctcc

SEQ ID NO: 478644 - DNA, 16 bp, R. norvegicus
aggggaacacccatca

SEQ ID NO: 478645 - DNA, 16 bp, R. norvegicus
aggggaaggactgagg

SEQ ID NO: 478646 - DNA, 16 bp, R. norvegicus
aggggaaggattgaaa

SEQ ID NO: 478647 - DNA, 16 bp, R. norvegicus
aggggaataaaatctt

SEQ ID NO: 478648 - DNA, 16 bp, R. norvegicus
aggggaataataatcg

SEQ ID NO: 478649 - DNA, 16 bp, R. norvegicus
aggggaataccagggc

SEQ ID NO: 478650 - DNA, 23 bp, R. norvegicus
aggggacccttcagtgtgctgaa

SEQ ID NO: 478651 - DNA, 16 bp, R. norvegicus
aggggactggagagat

SEQ ID NO: 478652 - DNA, 16 bp, R. norvegicus
aggggactggagaggt

SEQ ID NO: 478653 - DNA, 16 bp, R. norvegicus
aggggagaccatcact

SEQ ID NO: 478654 - DNA, 16 bp, R. norvegicus
aggggagcttcctgga

SEQ ID NO: 478655 - DNA, 16 bp, R. norvegicus
aggggaggaacctgga

SEQ ID NO: 478656 - DNA, 16 bp, R. norvegicus
aggggaggagactgga

SEQ ID NO: 478657 - DNA, 16 bp, R. norvegicus
aggggaggctgaggag

SEQ ID NO: 478658 - DNA, 16 bp, R. norvegicus
aggggagggcccagcc

SEQ ID NO: 478659 - DNA, 16 bp, R. norvegicus
aggggagggtccagcc

SEQ ID NO: 478660 - DNA, 16 bp, R. norvegicus
aggggatccaaaggca

SEQ ID NO: 478661 - DNA, 16 bp, R. norvegicus
aggggatccagcaccc

SEQ ID NO: 478662 - DNA, 16 bp, R. norvegicus
aggggatctgacaccc

SEQ ID NO: 478663 - DNA, 16 bp, R. norvegicus
aggggatgctgggaaa

SEQ ID NO: 478664 - DNA, 16 bp, R. norvegicus
aggggcagagaagctg

SEQ ID NO: 478665 - DNA, 16 bp, R. norvegicus
aggggcagaggcagaa

SEQ ID NO: 478666 - DNA, 16 bp, R. norvegicus
aggggcagcagcagca

SEQ ID NO: 478667 - DNA, 18 bp, R. norvegicus
aggggcctcccctgaaat

SEQ ID NO: 478668 - DNA, 17 bp, R. norvegicus
aggggcctgagacccca

SEQ ID NO: 478669 - DNA, 16 bp, R. norvegicus
aggggctccccttcca

SEQ ID NO: 478670 - DNA, 16 bp, R. norvegicus
aggggctcgagaccct

SEQ ID NO: 478671 - DNA, 16 bp, R. norvegicus
aggggctctgtggcat

SEQ ID NO: 478672 - DNA, 16 bp, R. norvegicus
aggggctgcctctgac

SEQ ID NO: 478673 - DNA, 16 bp, R. norvegicus
aggggctgggccagct

SEQ ID NO: 478674 - DNA, 16 bp, R. norvegicus
aggggcttgccacccc

SEQ ID NO: 478675 - DNA, 16 bp, R. norvegicus
agggggaaaatatcca

SEQ ID NO: 478676 - DNA, 16 bp, R. norvegicus
agggggaacaagaata

SEQ ID NO: 478677 - DNA, 16 bp, R. norvegicus
agggggagctggagag

SEQ ID NO: 478678 - DNA, 16 bp, R. norvegicus
agggggatgttggcac

SEQ ID NO: 478679 - DNA, 19 bp, R. norvegicus
agggggatgtttgcccgga

SEQ ID NO: 478680 - DNA, 16 bp, R. norvegicus
agggggcagagtggag

SEQ ID NO: 478681 - DNA, 16 bp, R. norvegicus
agggggcctaggtcca

SEQ ID NO: 478682 - DNA, 17 bp, R. norvegicus
agggggctggggattta

SEQ ID NO: 478683 - DNA, 16 bp, R. norvegicus
aggggggccagctggc

SEQ ID NO: 478684 - DNA, 16 bp, R. norvegicus
aggggtagacaaagtg

SEQ ID NO: 478685 - DNA, 16 bp, R. norvegicus
agggtaaactgaggca

SEQ ID NO: 478686 - DNA, 16 bp, R. norvegicus
agggtaaatatgatca

SEQ ID NO: 478687 - DNA, 16 bp, R. norvegicus
agggtacctttcacag

SEQ ID NO: 478688 - DNA, 16 bp, R. norvegicus
agggtagagctggaga

SEQ ID NO: 478689 - DNA, 21 bp, R. norvegicus
agggtatagcattgttccaca

SEQ ID NO: 478690 - DNA, 16 bp, R. norvegicus
agggtcactcactaac

SEQ ID NO: 478691 - DNA, 16 bp, R. norvegicus
agggtcaggtgacaag

SEQ ID NO: 478692 - DNA, 16 bp, R. norvegicus
agggtccagctttctc

SEQ ID NO: 478693 - DNA, 16 bp, R. norvegicus
agggtccattgtgggt

SEQ ID NO: 478694 - DNA, 16 bp, R. norvegicus
agggtccctgccccca

SEQ ID NO: 478695 - DNA, 16 bp, R. norvegicus
agggtctcaaagtcca

SEQ ID NO: 478696 - DNA, 16 bp, R. norvegicus
agggtctcaccatgta

SEQ ID NO: 478697 - DNA, 16 bp, R. norvegicus
agggtctcactatgta

SEQ ID NO: 478698 - DNA, 16 bp, R. norvegicus
agggtctctcactggg

SEQ ID NO: 478699 - DNA, 16 bp, R. norvegicus
agggtctggagtgggt

SEQ ID NO: 478700 - DNA, 16 bp, R. norvegicus
agggtcttgctatata

SEQ ID NO: 478701 - DNA, 16 bp, R. norvegicus
agggtcttgctgtgta

SEQ ID NO: 478702 - DNA, 16 bp, R. norvegicus
agggtgaccttgaact

SEQ ID NO: 478703 - DNA, 16 bp, R. norvegicus
agggtgaggaggcagg

SEQ ID NO: 478704 - DNA, 16 bp, R. norvegicus
agggtgagtgggagca

SEQ ID NO: 478705 - DNA, 16 bp, R. norvegicus
agggtgctggagaagg

SEQ ID NO: 478706 - DNA, 16 bp, R. norvegicus
agggtgctgggattaa

SEQ ID NO: 478707 - DNA, 16 bp, R. norvegicus
agggtggcaggaaggg

SEQ ID NO: 478708 - DNA, 16 bp, R. norvegicus
agggtggccttgaact

SEQ ID NO: 478709 - DNA, 16 bp, R. norvegicus
agggtgggagggattt

SEQ ID NO: 478710 - DNA, 16 bp, R. norvegicus
agggtgggattcctct

SEQ ID NO: 478711 - DNA, 16 bp, R. norvegicus
agggtgggcaggcagg

SEQ ID NO: 478712 - DNA, 16 bp, R. norvegicus
agggtgtcattggaaa

SEQ ID NO: 478713 - DNA, 16 bp, R. norvegicus
agggtgttggatcccc

SEQ ID NO: 478714 - DNA, 16 bp, R. norvegicus
agggttctccagagga

SEQ ID NO: 478715 - DNA, 16 bp, R. norvegicus
agggttctttccagct

SEQ ID NO: 478716 - DNA, 16 bp, R. norvegicus
agggttggtgattccc

SEQ ID NO: 478717 - DNA, 16 bp, R. norvegicus
agggtttttcctccca

SEQ ID NO: 478718 - DNA, 16 bp, R. norvegicus
aggtaaatggatagag

SEQ ID NO: 478719 - DNA, 16 bp, R. norvegicus
aggtaaccagccacat

SEQ ID NO: 478720 - DNA, 16 bp, R. norvegicus
aggtaactcagaacca

SEQ ID NO: 478721 - DNA, 16 bp, R. norvegicus
aggtacaaaagttaaa

SEQ ID NO: 478722 - DNA, 16 bp, R. norvegicus
aggtacctgtgggcac

SEQ ID NO: 478723 - DNA, 16 bp, R. norvegicus
aggtagaaacaggagg

SEQ ID NO: 478724 - DNA, 16 bp, R. norvegicus
aggtagaggcagggag

SEQ ID NO: 478725 - DNA, 25 bp, R. norvegicus
aggtagcaatgaatagcctagtaag

SEQ ID NO: 478726 - DNA, 71 bp, R. norvegicus
aggtagcaatgaatatcctagtaagagcaccagtggaaggggaagccctgggtcctgctaagactgaaccc

SEQ ID NO: 478727 - DNA, 16 bp, R. norvegicus
aggtagcccagactgg

SEQ ID NO: 478728 - DNA, 16 bp, R. norvegicus
aggtagccctggctgt

SEQ ID NO: 478729 - DNA, 16 bp, R. norvegicus
aggtagctgtgagcca

SEQ ID NO: 478730 - DNA, 16 bp, R. norvegicus
aggtagtatctgtctt

SEQ ID NO: 478731 - DNA, 16 bp, R. norvegicus
aggtagtgtctgtctt

SEQ ID NO: 478732 - DNA, 16 bp, R. norvegicus
aggtagtgtctgtgtt

SEQ ID NO: 478733 - DNA, 16 bp, R. norvegicus
aggtatattcttttgt

SEQ ID NO: 478734 - DNA, 16 bp, R. norvegicus
aggtatcagttgcaaa

SEQ ID NO: 478735 - DNA, 16 bp, R. norvegicus
aggtatgcagatctct

SEQ ID NO: 478736 - DNA, 16 bp, R. norvegicus
aggtatggcagtctct

SEQ ID NO: 478737 - DNA, 16 bp, R. norvegicus
aggtatggccttcttg

SEQ ID NO: 478738 - DNA, 16 bp, R. norvegicus
aggtattttatcttat

SEQ ID NO: 478739 - DNA, 16 bp, R. norvegicus
aggtcaaaggacaact

SEQ ID NO: 478740 - DNA, 16 bp, R. norvegicus
aggtcaacaaaagagt

SEQ ID NO: 478741 - DNA, 16 bp, R. norvegicus
aggtcaacctgggcta

SEQ ID NO: 478742 - DNA, 16 bp, R. norvegicus
aggtcaagaagaagga

SEQ ID NO: 478743 - DNA, 16 bp, R. norvegicus
aggtcaaggaattgaa

SEQ ID NO: 478744 - DNA, 16 bp, R. norvegicus
aggtcaccaggcttga

SEQ ID NO: 478745 - DNA, 16 bp, R. norvegicus
aggtcaccctcagcta

SEQ ID NO: 478746 - DNA, 16 bp, R. norvegicus
aggtcagaaaagggca

SEQ ID NO: 478747 - DNA, 16 bp, R. norvegicus
aggtcagaagaaagtg

SEQ ID NO: 478748 - DNA, 16 bp, R. norvegicus
aggtcagaagtgggtg

SEQ ID NO: 478749 - DNA, 16 bp, R. norvegicus
aggtcagaggaggatg

SEQ ID NO: 478750 - DNA, 16 bp, R. norvegicus
aggtcagaggagggca

SEQ ID NO: 478751 - DNA, 16 bp, R. norvegicus
aggtcagagggcaact

SEQ ID NO: 478752 - DNA, 16 bp, R. norvegicus
aggtcagagtccagga

SEQ ID NO: 478753 - DNA, 16 bp, R. norvegicus
aggtcagcagcagcag

SEQ ID NO: 478754 - DNA, 16 bp, R. norvegicus
aggtcagcctcagctg

SEQ ID NO: 478755 - DNA, 16 bp, R. norvegicus
aggtcagcctggaaca

SEQ ID NO: 478756 - DNA, 16 bp, R. norvegicus
aggtcaggttctctaa

SEQ ID NO: 478757 - DNA, 16 bp, R. norvegicus
aggtcatccagacact

SEQ ID NO: 478758 - DNA, 16 bp, R. norvegicus
aggtcatccatgacaa

SEQ ID NO: 478759 - DNA, 16 bp, R. norvegicus
aggtccagcctgtgtg

SEQ ID NO: 478760 - DNA, 16 bp, R. norvegicus
aggtccagctctccct

SEQ ID NO: 478761 - DNA, 16 bp, R. norvegicus
aggtccagtgaccagc

SEQ ID NO: 478762 - DNA, 16 bp, R. norvegicus
aggtcccaggctgtgt

SEQ ID NO: 478763 - DNA, 16 bp, R. norvegicus
aggtcctcccctccca

SEQ ID NO: 478764 - DNA, 24 bp, R. norvegicus
aggtcctgagttcaattcccagca

SEQ ID NO: 478765 - DNA, 16 bp, R. norvegicus
aggtcctgggttccat

SEQ ID NO: 478766 - DNA, 16 bp, R. norvegicus
aggtcctgggtttggt

SEQ ID NO: 478767 - DNA, 16 bp, R. norvegicus
aggtcctttggaagag

SEQ ID NO: 478768 - DNA, 16 bp, R. norvegicus
aggtctacagcacccc

SEQ ID NO: 478769 - DNA, 16 bp, R. norvegicus
aggtctccaagaagat

SEQ ID NO: 478770 - DNA, 16 bp, R. norvegicus
aggtctctcctgagag

SEQ ID NO: 478771 - DNA, 16 bp, R. norvegicus
aggtctctgaattgat

SEQ ID NO: 478772 - DNA, 16 bp, R. norvegicus
aggtctctggcttctg

SEQ ID NO: 478773 - DNA, 16 bp, R. norvegicus
aggtctgcctttttat

SEQ ID NO: 478774 - DNA, 16 bp, R. norvegicus
aggtctgctgaagagg

SEQ ID NO: 478775 - DNA, 16 bp, R. norvegicus
aggtcttcaatttctt

SEQ ID NO: 478776 - DNA, 16 bp, R. norvegicus
aggtcttcagctgtcc

SEQ ID NO: 478777 - DNA, 16 bp, R. norvegicus
aggtctttctcagcca

SEQ ID NO: 478778 - DNA, 16 bp, R. norvegicus
aggtctttgacccact

SEQ ID NO: 478779 - DNA, 16 bp, R. norvegicus
aggtctttggtccact

SEQ ID NO: 478780 - DNA, 16 bp, R. norvegicus
aggtgaaatctcagag

SEQ ID NO: 478781 - DNA, 16 bp, R. norvegicus
aggtgaagaaaagctt

SEQ ID NO: 478782 - DNA, 16 bp, R. norvegicus
aggtgaagaaactgag

SEQ ID NO: 478783 - DNA, 16 bp, R. norvegicus
aggtgaaggaaatgga

SEQ ID NO: 478784 - DNA, 16 bp, R. norvegicus
aggtgaatttctgtga

SEQ ID NO: 478785 - DNA, 16 bp, R. norvegicus
aggtgacatcagatgc

SEQ ID NO: 478786 - DNA, 16 bp, R. norvegicus
aggtgaccacagctgc

SEQ ID NO: 478787 - DNA, 16 bp, R. norvegicus
aggtgacccctgtgga

SEQ ID NO: 478788 - DNA, 16 bp, R. norvegicus
aggtgagggacaggta

SEQ ID NO: 478789 - DNA, 16 bp, R. norvegicus
aggtgatcatgtgatt

SEQ ID NO: 478790 - DNA, 16 bp, R. norvegicus
aggtgatgacagatgc

SEQ ID NO: 478791 - DNA, 16 bp, R. norvegicus
aggtgatgaggtcagg

SEQ ID NO: 478792 - DNA, 16 bp, R. norvegicus
aggtgatgtctatcct

SEQ ID NO: 478793 - DNA, 16 bp, R. norvegicus
aggtgcaggaggagct

SEQ ID NO: 478794 - DNA, 16 bp, R. norvegicus
aggtgcagggcctgct

SEQ ID NO: 478795 - DNA, 16 bp, R. norvegicus
aggtgcatcttctcct

SEQ ID NO: 478796 - DNA, 16 bp, R. norvegicus
aggtgcccttctgcca

SEQ ID NO: 478797 - DNA, 16 bp, R. norvegicus
aggtgcctgcagaagc

SEQ ID NO: 478798 - DNA, 16 bp, R. norvegicus
aggtgcctggaagcca

SEQ ID NO: 478799 - DNA, 16 bp, R. norvegicus
aggtgcctgtggaggc

SEQ ID NO: 478800 - DNA, 16 bp, R. norvegicus
aggtgctaagaagaaa

SEQ ID NO: 478801 - DNA, 16 bp, R. norvegicus
aggtgctcaataaatg

SEQ ID NO: 478802 - DNA, 16 bp, R. norvegicus
aggtgctcacagccaa

SEQ ID NO: 478803 - DNA, 16 bp, R. norvegicus
aggtgctcctcagcca

SEQ ID NO: 478804 - DNA, 16 bp, R. norvegicus
aggtgctcctggcaac

SEQ ID NO: 478805 - DNA, 16 bp, R. norvegicus
aggtgctgagaaaaag

SEQ ID NO: 478806 - DNA, 16 bp, R. norvegicus
aggtgctgaggagaag

SEQ ID NO: 478807 - DNA, 16 bp, R. norvegicus
aggtgctgctggacat

SEQ ID NO: 478808 - DNA, 16 bp, R. norvegicus
aggtgctggctgaaca

SEQ ID NO: 478809 - DNA, 16 bp, R. norvegicus
aggtgctgggattgca

SEQ ID NO: 478810 - DNA, 16 bp, R. norvegicus
aggtgcttgctgctca

SEQ ID NO: 478811 - DNA, 16 bp, R. norvegicus
aggtgctttttgacca

SEQ ID NO: 478812 - DNA, 17 bp, R. norvegicus
aggtggaaattgaacaa

SEQ ID NO: 478813 - DNA, 16 bp, R. norvegicus
aggtggagaaccactg

SEQ ID NO: 478814 - DNA, 16 bp, R. norvegicus
aggtggagacagagga

SEQ ID NO: 478815 - DNA, 16 bp, R. norvegicus
aggtggagagcaactg

SEQ ID NO: 478816 - DNA, 16 bp, R. norvegicus
aggtggagatggaaga

SEQ ID NO: 478817 - DNA, 16 bp, R. norvegicus
aggtggagcaaaccaa

SEQ ID NO: 478818 - DNA, 16 bp, R. norvegicus
aggtggagtctcaggg

SEQ ID NO: 478819 - DNA, 16 bp, R. norvegicus
aggtggatcagtggaa

SEQ ID NO: 478820 - DNA, 16 bp, R. norvegicus
aggtggatctcagggt

SEQ ID NO: 478821 - DNA, 16 bp, R. norvegicus
aggtggatgctctcag

SEQ ID NO: 478822 - DNA, 16 bp, R. norvegicus
aggtggatggcacctg

SEQ ID NO: 478823 - DNA, 16 bp, R. norvegicus
aggtggatgtctatga

SEQ ID NO: 478824 - DNA, 16 bp, R. norvegicus
aggtggcaggagacag

SEQ ID NO: 478825 - DNA, 16 bp, R. norvegicus
aggtggcaggtggcag

SEQ ID NO: 478826 - DNA, 16 bp, R. norvegicus
aggtggcagtgggtgg

SEQ ID NO: 478827 - DNA, 16 bp, R. norvegicus
aggtggctcagcagtt

SEQ ID NO: 478828 - DNA, 16 bp, R. norvegicus
aggtggctgaggcagg

SEQ ID NO: 478829 - DNA, 16 bp, R. norvegicus
aggtggctgtgaacca

SEQ ID NO: 478830 - DNA, 16 bp, R. norvegicus
aggtgggagcatgaca

SEQ ID NO: 478831 - DNA, 16 bp, R. norvegicus
aggtgggagcctggca

SEQ ID NO: 478832 - DNA, 16 bp, R. norvegicus
aggtggggaggatctg

SEQ ID NO: 478833 - DNA, 16 bp, R. norvegicus
aggtggggcaggccct

SEQ ID NO: 478834 - DNA, 16 bp, R. norvegicus
aggtgggtgagcaccc

SEQ ID NO: 478835 - DNA, 16 bp, R. norvegicus
aggtgggtggggaagc

SEQ ID NO: 478836 - DNA, 16 bp, R. norvegicus
aggtggtcctgggttg

SEQ ID NO: 478837 - DNA, 16 bp, R. norvegicus
aggtggtctgctacag

SEQ ID NO: 478838 - DNA, 16 bp, R. norvegicus
aggtggtgaggtctct

SEQ ID NO: 478839 - DNA, 16 bp, R. norvegicus
aggtggtgcacagaca

SEQ ID NO: 478840 - DNA, 16 bp, R. norvegicus
aggtggttatgagctg

SEQ ID NO: 478841 - DNA, 16 bp, R. norvegicus
aggtgtaccagagtct

SEQ ID NO: 478842 - DNA, 16 bp, R. norvegicus
aggtgtcattctccca

SEQ ID NO: 478843 - DNA, 16 bp, R. norvegicus
aggtgtcctgtcaagc

SEQ ID NO: 478844 - DNA, 16 bp, R. norvegicus
aggtgtgcacaggtgt

SEQ ID NO: 478845 - DNA, 16 bp, R. norvegicus
aggtgtgcaccaccct

SEQ ID NO: 478846 - DNA, 16 bp, R. norvegicus
aggtgtgctcctggga

SEQ ID NO: 478847 - DNA, 16 bp, R. norvegicus
aggtgtggctgctgtg

SEQ ID NO: 478848 - DNA, 16 bp, R. norvegicus
aggtgtggtcttggag

SEQ ID NO: 478849 - DNA, 16 bp, R. norvegicus
aggtgtgtgccaccac

SEQ ID NO: 478850 - DNA, 16 bp, R. norvegicus
aggtgtgtgctgctgc

SEQ ID NO: 478851 - DNA, 16 bp, R. norvegicus
aggtgtgtttcttgta

SEQ ID NO: 478852 - DNA, 16 bp, R. norvegicus
aggtgtgtttggatat

SEQ ID NO: 478853 - DNA, 16 bp, R. norvegicus
aggtgttctctgacct

SEQ ID NO: 478854 - DNA, 16 bp, R. norvegicus
aggtgtttctcagcct

SEQ ID NO: 478855 - DNA, 16 bp, R. norvegicus
aggttaaacttccttt

SEQ ID NO: 478856 - DNA, 16 bp, R. norvegicus
aggttaacaagctgaa

SEQ ID NO: 478857 - DNA, 16 bp, R. norvegicus
aggttacctgcacaca

SEQ ID NO: 478858 - DNA, 16 bp, R. norvegicus
aggttactccccaaca

SEQ ID NO: 478859 - DNA, 16 bp, R. norvegicus
aggttattatgttgtg

SEQ ID NO: 478860 - DNA, 16 bp, R. norvegicus
aggttattccccaaca

SEQ ID NO: 478861 - DNA, 16 bp, R. norvegicus
aggttcaaggagagac

SEQ ID NO: 478862 - DNA, 16 bp, R. norvegicus
aggttcacttcccagc

SEQ ID NO: 478863 - DNA, 16 bp, R. norvegicus
aggttccatctcccca

SEQ ID NO: 478864 - DNA, 16 bp, R. norvegicus
aggttcccaataggat

SEQ ID NO: 478865 - DNA, 16 bp, R. norvegicus
aggttccctctcccca

SEQ ID NO: 478866 - DNA, 16 bp, R. norvegicus
aggttcctcagaaagt

SEQ ID NO: 478867 - DNA, 16 bp, R. norvegicus
aggttcctgccctgtt

SEQ ID NO: 478868 - DNA, 16 bp, R. norvegicus
aggttctcttcaccac

SEQ ID NO: 478869 - DNA, 16 bp, R. norvegicus
aggttctgagttcaat

SEQ ID NO: 478870 - DNA, 16 bp, R. norvegicus
aggttcttgatctact

SEQ ID NO: 478871 - DNA, 16 bp, R. norvegicus
aggttgagaaccactg

SEQ ID NO: 478872 - DNA, 16 bp, R. norvegicus
aggttgagaagcactg

SEQ ID NO: 478873 - DNA, 16 bp, R. norvegicus
aggttgagcaagccat

SEQ ID NO: 478874 - DNA, 16 bp, R. norvegicus
aggttgaggaagagga

SEQ ID NO: 478875 - DNA, 16 bp, R. norvegicus
aggttgaggaccactg

SEQ ID NO: 478876 - DNA, 16 bp, R. norvegicus
aggttgatcaatggaa

SEQ ID NO: 478877 - DNA, 16 bp, R. norvegicus
aggttgatgaagctaa

SEQ ID NO: 478878 - DNA, 17 bp, R. norvegicus
aggttgatgtgtggttc

SEQ ID NO: 478879 - DNA, 16 bp, R. norvegicus
aggttgccatggcaac

SEQ ID NO: 478880 - DNA, 16 bp, R. norvegicus
aggttggagcccaggg

SEQ ID NO: 478881 - DNA, 16 bp, R. norvegicus
aggttggccttgaact

SEQ ID NO: 478882 - DNA, 16 bp, R. norvegicus
aggttgggagaaccct

SEQ ID NO: 478883 - DNA, 26 bp, R. norvegicus
aggttggggatttagctcagtggtag

SEQ ID NO: 478884 - DNA, 16 bp, R. norvegicus
aggttggggctgggga

SEQ ID NO: 478885 - DNA, 25 bp, R. norvegicus
aggttgtggagaaagaggaacactc

SEQ ID NO: 478886 - DNA, 16 bp, R. norvegicus
aggttgttgtgaatgt

SEQ ID NO: 478887 - DNA, 23 bp, R. norvegicus
aggtttattacggagatctatta

SEQ ID NO: 478888 - DNA, 16 bp, R. norvegicus
aggtttattcatttat

SEQ ID NO: 478889 - DNA, 16 bp, R. norvegicus
aggtttattgggaaac

SEQ ID NO: 478890 - DNA, 16 bp, R. norvegicus
aggtttcaaaagccac

SEQ ID NO: 478891 - DNA, 16 bp, R. norvegicus
aggtttcaaaggagaa

SEQ ID NO: 478892 - DNA, 16 bp, R. norvegicus
aggtttcagaggaaaa

SEQ ID NO: 478893 - DNA, 16 bp, R. norvegicus
aggtttcttttctgaa

SEQ ID NO: 478894 - DNA, 16 bp, R. norvegicus
aggtttgaagtctcag

SEQ ID NO: 478895 - DNA, 16 bp, R. norvegicus
aggtttgaccttgttg

SEQ ID NO: 478896 - DNA, 16 bp, R. norvegicus
aggtttgactcaagag

SEQ ID NO: 478897 - DNA, 16 bp, R. norvegicus
aggtttgagctaagga

SEQ ID NO: 478898 - DNA, 16 bp, R. norvegicus
aggtttgccaaaggag

SEQ ID NO: 478899 - DNA, 16 bp, R. norvegicus
aggtttggatttaaaa

SEQ ID NO: 478900 - DNA, 16 bp, R. norvegicus
aggtttgggtatgttg

SEQ ID NO: 478901 - DNA, 16 bp, R. norvegicus
aggtttgttttgtgac

SEQ ID NO: 478902 - DNA, 16 bp, R. norvegicus
aggttttagaaggaaa

SEQ ID NO: 478903 - DNA, 16 bp, R. norvegicus
aggttttctctgtgca

SEQ ID NO: 478904 - DNA, 16 bp, R. norvegicus
aggttttgctgactga

SEQ ID NO: 478905 - DNA, 16 bp, R. norvegicus
aggttttgtgtctttt

SEQ ID NO: 478906 - DNA, 16 bp, R. norvegicus
aggtttttagccagag

SEQ ID NO: 478907 - DNA, 16 bp, R. norvegicus
aggtttttctctttct

SEQ ID NO: 478908 - DNA, 16 bp, R. norvegicus
aggtttttggtgcatt

SEQ ID NO: 478909 - DNA, 16 bp, R. norvegicus
agtaaaaatctaccaa

SEQ ID NO: 478910 - DNA, 16 bp, R. norvegicus
agtaaactgaggcaca

SEQ ID NO: 478911 - DNA, 16 bp, R. norvegicus
agtaaagataacagga

SEQ ID NO: 478912 - DNA, 16 bp, R. norvegicus
agtaaagccatataca

SEQ ID NO: 478913 - DNA, 16 bp, R. norvegicus
agtaacagcagcagca

SEQ ID NO: 478914 - DNA, 16 bp, R. norvegicus
agtaaccaaccatttt

SEQ ID NO: 478915 - DNA, 16 bp, R. norvegicus
agtaacctggcctggc

SEQ ID NO: 478916 - DNA, 16 bp, R. norvegicus
agtaagagcagcagtg

SEQ ID NO: 478917 - DNA, 16 bp, R. norvegicus
agtaaggactgaaaga

SEQ ID NO: 478918 - DNA, 16 bp, R. norvegicus
agtaataacaataaca

SEQ ID NO: 478919 - DNA, 16 bp, R. norvegicus
agtaattcaagcattt

SEQ ID NO: 478920 - DNA, 16 bp, R. norvegicus
agtaattgtgctaaag

SEQ ID NO: 478921 - DNA, 16 bp, R. norvegicus
agtacaatattgaata

SEQ ID NO: 478922 - DNA, 16 bp, R. norvegicus
agtacacacaaacaca

SEQ ID NO: 478923 - DNA, 16 bp, R. norvegicus
agtacacagcagctgc

SEQ ID NO: 478924 - DNA, 16 bp, R. norvegicus
agtacacagcaggaaa

SEQ ID NO: 478925 - DNA, 16 bp, R. norvegicus
agtacacagtggctgc

SEQ ID NO: 478926 - DNA, 16 bp, R. norvegicus
agtacacatggaagga

SEQ ID NO: 478927 - DNA, 16 bp, R. norvegicus
agtacacatgggggaa

SEQ ID NO: 478928 - DNA, 16 bp, R. norvegicus
agtacacttggacaga

SEQ ID NO: 478929 - DNA, 16 bp, R. norvegicus
agtacagccagggcta

SEQ ID NO: 478930 - DNA, 16 bp, R. norvegicus
agtacataataataag

SEQ ID NO: 478931 - DNA, 16 bp, R. norvegicus
agtacatgctgacaga

SEQ ID NO: 478932 - DNA, 16 bp, R. norvegicus
agtacatgtttttaat

SEQ ID NO: 478933 - DNA, 16 bp, R. norvegicus
agtacattctgcccag

SEQ ID NO: 478934 - DNA, 16 bp, R. norvegicus
agtacattctggaggg

SEQ ID NO: 478935 - DNA, 16 bp, R. norvegicus
agtacattgagctcca

SEQ ID NO: 478936 - DNA, 16 bp, R. norvegicus
agtaccaccaccacca

SEQ ID NO: 478937 - DNA, 16 bp, R. norvegicus
agtaccacttcctggg

SEQ ID NO: 478938 - DNA, 16 bp, R. norvegicus
agtaccagctcctggt

SEQ ID NO: 478939 - DNA, 16 bp, R. norvegicus
agtaccaggacagcca

SEQ ID NO: 478940 - DNA, 16 bp, R. norvegicus
agtaccaggaggagct

SEQ ID NO: 478941 - DNA, 16 bp, R. norvegicus
agtaccatgaggagct

SEQ ID NO: 478942 - DNA, 16 bp, R. norvegicus
agtacccttattacaa

SEQ ID NO: 478943 - DNA, 19 bp, R. norvegicus
agtaccgaagttaaatcag

SEQ ID NO: 478944 - DNA, 16 bp, R. norvegicus
agtacctcaacaaaga

SEQ ID NO: 478945 - DNA, 16 bp, R. norvegicus
agtactacacagagaa

SEQ ID NO: 478946 - DNA, 16 bp, R. norvegicus
agtactatattgaaaa

SEQ ID NO: 478947 - DNA, 16 bp, R. norvegicus
agtactatattgaata

SEQ ID NO: 478948 - DNA, 16 bp, R. norvegicus
agtactccaatgtgta

SEQ ID NO: 478949 - DNA, 17 bp, R. norvegicus
agtactccagtaagcag

SEQ ID NO: 478950 - DNA, 16 bp, R. norvegicus
agtactcctttgtgta

SEQ ID NO: 478951 - DNA, 16 bp, R. norvegicus
agtactggaaagaaca

SEQ ID NO: 478952 - DNA, 16 bp, R. norvegicus
agtactggagaaggag

SEQ ID NO: 478953 - DNA, 16 bp, R. norvegicus
agtactggctgctctt

SEQ ID NO: 478954 - DNA, 16 bp, R. norvegicus
agtactgggattaaag

SEQ ID NO: 478955 - DNA, 16 bp, R. norvegicus
agtacttcaagaaaga

SEQ ID NO: 478956 - DNA, 16 bp, R. norvegicus
agtacttctcagccat

SEQ ID NO: 478957 - DNA, 16 bp, R. norvegicus
agtacttgctgctctt

SEQ ID NO: 478958 - DNA, 16 bp, R. norvegicus
agtacttgctgctttt

SEQ ID NO: 478959 - DNA, 16 bp, R. norvegicus
agtacttgggagacag

SEQ ID NO: 478960 - DNA, 16 bp, R. norvegicus
agtacttgttcttgca

SEQ ID NO: 478961 - DNA, 16 bp, R. norvegicus
agtactttggaggcag

SEQ ID NO: 478962 - DNA, 16 bp, R. norvegicus
agtagagacagaagga

SEQ ID NO: 478963 - DNA, 16 bp, R. norvegicus
agtagagacaggcaga

SEQ ID NO: 478964 - DNA, 16 bp, R. norvegicus
agtagagagtggtgat

SEQ ID NO: 478965 - DNA, 16 bp, R. norvegicus
agtagagcacttgcct

SEQ ID NO: 478966 - DNA, 16 bp, R. norvegicus
agtagatggcaagaaa

SEQ ID NO: 478967 - DNA, 16 bp, R. norvegicus
agtagcaaaatgacag

SEQ ID NO: 478968 - DNA, 16 bp, R. norvegicus
agtagcaacaaaaatg

SEQ ID NO: 478969 - DNA, 24 bp, R. norvegicus
agtagcaatgaatagcctagtaag

SEQ ID NO: 478970 - DNA, 80 bp, R. norvegicus
agtagcaatgaatatcctagtaagagcaccagtggaaggggaagccctgggtcctgctaagactgaacccccagtgaact

SEQ ID NO: 478971 - DNA, 16 bp, R. norvegicus
agtagcagcagtagca

SEQ ID NO: 478972 - DNA, 16 bp, R. norvegicus
agtagcagtagtagca

SEQ ID NO: 478973 - DNA, 16 bp, R. norvegicus
agtagcagtggaaata

SEQ ID NO: 478974 - DNA, 17 bp, R. norvegicus
agtagccatggctgaga

SEQ ID NO: 478975 - DNA, 16 bp, R. norvegicus
agtaggactgaagcat

SEQ ID NO: 478976 - DNA, 16 bp, R. norvegicus
agtaggatgtcagttc

SEQ ID NO: 478977 - DNA, 16 bp, R. norvegicus
agtagggagagagagt

SEQ ID NO: 478978 - DNA, 16 bp, R. norvegicus
agtagggagcgagtgg

SEQ ID NO: 478979 - DNA, 16 bp, R. norvegicus
agtaggttttggaaaa

SEQ ID NO: 478980 - DNA, 16 bp, R. norvegicus
agtagtagcagcagca

SEQ ID NO: 478981 - DNA, 16 bp, R. norvegicus
agtagtcaatgctctt

SEQ ID NO: 478982 - DNA, 16 bp, R. norvegicus
agtagtcttgttttct

SEQ ID NO: 478983 - DNA, 16 bp, R. norvegicus
agtagtggacaacagt

SEQ ID NO: 478984 - DNA, 17 bp, R. norvegicus
agtagtgggcacctcat

SEQ ID NO: 478985 - DNA, 16 bp, R. norvegicus
agtagttctccagtgg

SEQ ID NO: 478986 - DNA, 16 bp, R. norvegicus
agtagttctctggggg

SEQ ID NO: 478987 - DNA, 16 bp, R. norvegicus
agtataacattcaagg

SEQ ID NO: 478988 - DNA, 16 bp, R. norvegicus
agtataggagaatgtc

SEQ ID NO: 478989 - DNA, 16 bp, R. norvegicus
agtataggtttttgta

SEQ ID NO: 478990 - DNA, 16 bp, R. norvegicus
agtatatataaatgac

SEQ ID NO: 478991 - DNA, 16 bp, R. norvegicus
agtatatctggtttga

SEQ ID NO: 478992 - DNA, 16 bp, R. norvegicus
agtatatggaaaacca

SEQ ID NO: 478993 - DNA, 16 bp, R. norvegicus
agtatcaggccttgga

SEQ ID NO: 478994 - DNA, 16 bp, R. norvegicus
agtatcctggtgaatt

SEQ ID NO: 478995 - DNA, 16 bp, R. norvegicus
agtatctaaagaaatg

SEQ ID NO: 478996 - DNA, 16 bp, R. norvegicus
agtatctctcccagtg

SEQ ID NO: 478997 - DNA, 16 bp, R. norvegicus
agtatgccattgtgta

SEQ ID NO: 478998 - DNA, 16 bp, R. norvegicus
agtatgtgtccttgtt

SEQ ID NO: 478999 - DNA, 16 bp, R. norvegicus
agtatgtgtggccaag

SEQ ID NO: 479000 - DNA, 16 bp, R. norvegicus
agtatgtgtttgtgtg

SEQ ID NO: 479001 - DNA, 27 bp, R. norvegicus
agtatgtttctttacaaagctgtgtca

SEQ ID NO: 479002 - DNA, 16 bp, R. norvegicus
agtattcaggagacag

SEQ ID NO: 479003 - DNA, 16 bp, R. norvegicus
agtattcatcagaaaa

SEQ ID NO: 479004 - DNA, 16 bp, R. norvegicus
agtattgaagtccagc

SEQ ID NO: 479005 - DNA, 16 bp, R. norvegicus
agtattggtctttctc

SEQ ID NO: 479006 - DNA, 16 bp, R. norvegicus
agtattttgtttccct

SEQ ID NO: 479007 - DNA, 16 bp, R. norvegicus
agtcaaaatacaaaat

SEQ ID NO: 479008 - DNA, 16 bp, R. norvegicus
agtcaaaatatcactg

SEQ ID NO: 479009 - DNA, 16 bp, R. norvegicus
agtcaaacaaacaaac

SEQ ID NO: 479010 - DNA, 16 bp, R. norvegicus
agtcaaacttcttgag

SEQ ID NO: 479011 - DNA, 16 bp, R. norvegicus
agtcaaagaagaaata

SEQ ID NO: 479012 - DNA, 16 bp, R. norvegicus
agtcaaaggacactgt

SEQ ID NO: 479013 - DNA, 16 bp, R. norvegicus
agtcaactaacctgaa

SEQ ID NO: 479014 - DNA, 16 bp, R. norvegicus
agtcaagaagcagaaa

SEQ ID NO: 479015 - DNA, 16 bp, R. norvegicus
agtcaagaatgaccag

SEQ ID NO: 479016 - DNA, 16 bp, R. norvegicus
agtcaagtagaaacaa

SEQ ID NO: 479017 - DNA, 16 bp, R. norvegicus
agtcaatggggagaaa

SEQ ID NO: 479018 - DNA, 16 bp, R. norvegicus
agtcacaaagcagcca

SEQ ID NO: 479019 - DNA, 16 bp, R. norvegicus
agtcacagacacagtc

SEQ ID NO: 479020 - DNA, 16 bp, R. norvegicus
agtcacagatgtgagc

SEQ ID NO: 479021 - DNA, 16 bp, R. norvegicus
agtcacaggaagggac

SEQ ID NO: 479022 - DNA, 16 bp, R. norvegicus
agtcacatcctctccc

SEQ ID NO: 479023 - DNA, 16 bp, R. norvegicus
agtcacctgagaagag

SEQ ID NO: 479024 - DNA, 16 bp, R. norvegicus
agtcacctgcctggtg

SEQ ID NO: 479025 - DNA, 16 bp, R. norvegicus
agtcactgcaggactg

SEQ ID NO: 479026 - DNA, 16 bp, R. norvegicus
agtcactggagaggag

SEQ ID NO: 479027 - DNA, 16 bp, R. norvegicus
agtcacttggaaagga

SEQ ID NO: 479028 - DNA, 16 bp, R. norvegicus
agtcagaaagtgaaaa

SEQ ID NO: 479029 - DNA, 16 bp, R. norvegicus
agtcagaagacagcct

SEQ ID NO: 479030 - DNA, 16 bp, R. norvegicus
agtcagaagaggatgt

SEQ ID NO: 479031 - DNA, 16 bp, R. norvegicus
agtcagaagctgaaaa

SEQ ID NO: 479032 - DNA, 16 bp, R. norvegicus
agtcagactgcaggga

SEQ ID NO: 479033 - DNA, 16 bp, R. norvegicus
agtcagagaagaagca

SEQ ID NO: 479034 - DNA, 16 bp, R. norvegicus
agtcagagaataagaa

SEQ ID NO: 479035 - DNA, 16 bp, R. norvegicus
agtcagagacagagaa

SEQ ID NO: 479036 - DNA, 16 bp, R. norvegicus
agtcagagagagaaag

SEQ ID NO: 479037 - DNA, 16 bp, R. norvegicus
agtcagagatgtgggc

SEQ ID NO: 479038 - DNA, 16 bp, R. norvegicus
agtcagaggacaatgt

SEQ ID NO: 479039 - DNA, 16 bp, R. norvegicus
agtcagaggagctgag

SEQ ID NO: 479040 - DNA, 16 bp, R. norvegicus
agtcagagttttgact

SEQ ID NO: 479041 - DNA, 35 bp, R. norvegicus
agtcagcacacacaattctcctgcacatccaatgc

SEQ ID NO: 479042 - DNA, 16 bp, R. norvegicus
agtcagcaggcagcag

SEQ ID NO: 479043 - DNA, 16 bp, R. norvegicus
agtcaggaagaagaga

SEQ ID NO: 479044 - DNA, 16 bp, R. norvegicus
agtcaggaagcagagg

SEQ ID NO: 479045 - DNA, 16 bp, R. norvegicus
agtcaggacaggaacc

SEQ ID NO: 479046 - DNA, 16 bp, R. norvegicus
agtcaggaggcagagg

SEQ ID NO: 479047 - DNA, 17 bp, R. norvegicus
agtcaggatcagataaa

SEQ ID NO: 479048 - DNA, 16 bp, R. norvegicus
agtcaggccttattga

SEQ ID NO: 479049 - DNA, 16 bp, R. norvegicus
agtcaggctggccttg

SEQ ID NO: 479050 - DNA, 16 bp, R. norvegicus
agtcagggagggaggg

SEQ ID NO: 479051 - DNA, 19 bp, R. norvegicus
agtcaggtcctcctgactg

SEQ ID NO: 479052 - DNA, 16 bp, R. norvegicus
agtcaggtgtggtggt

SEQ ID NO: 479053 - DNA, 16 bp, R. norvegicus
agtcagtattctgcta

SEQ ID NO: 479054 - DNA, 16 bp, R. norvegicus
agtcagtcagtcagtc

SEQ ID NO: 479055 - DNA, 16 bp, R. norvegicus
agtcagtcagtctgtc

SEQ ID NO: 479056 - DNA, 16 bp, R. norvegicus
agtcagtgagtgctct

SEQ ID NO: 479057 - DNA, 16 bp, R. norvegicus
agtcagtgctctcagc

SEQ ID NO: 479058 - DNA, 16 bp, R. norvegicus
agtcagttctcacctt

SEQ ID NO: 479059 - DNA, 17 bp, R. norvegicus
agtcagttctggggaca

SEQ ID NO: 479060 - DNA, 16 bp, R. norvegicus
agtcatactgattaga

SEQ ID NO: 479061 - DNA, 16 bp, R. norvegicus
agtcatcaaaaaaaag

SEQ ID NO: 479062 - DNA, 16 bp, R. norvegicus
agtcatcagagaagag

SEQ ID NO: 479063 - DNA, 16 bp, R. norvegicus
agtcatcagagagaaa

SEQ ID NO: 479064 - DNA, 16 bp, R. norvegicus
agtcatccctccagcc

SEQ ID NO: 479065 - DNA, 16 bp, R. norvegicus
agtcatcggagaggag

SEQ ID NO: 479066 - DNA, 16 bp, R. norvegicus
agtcatctgagaaaag

SEQ ID NO: 479067 - DNA, 16 bp, R. norvegicus
agtcatctgagaggag

SEQ ID NO: 479068 - DNA, 16 bp, R. norvegicus
agtcatgaacaaagtc

SEQ ID NO: 479069 - DNA, 16 bp, R. norvegicus
agtcatgcctgtgtgc

SEQ ID NO: 479070 - DNA, 16 bp, R. norvegicus
agtcattaaaaatctt

SEQ ID NO: 479071 - DNA, 16 bp, R. norvegicus
agtcattattttggga

SEQ ID NO: 479072 - DNA, 16 bp, R. norvegicus
agtcatttctctagcc

SEQ ID NO: 479073 - DNA, 16 bp, R. norvegicus
agtcatttctgctcct

SEQ ID NO: 479074 - DNA, 16 bp, R. norvegicus
agtcatttcttttctt

SEQ ID NO: 479075 - DNA, 16 bp, R. norvegicus
agtcatttgagaagag

SEQ ID NO: 479076 - DNA, 16 bp, R. norvegicus
agtcattttaatttgc

SEQ ID NO: 479077 - DNA, 16 bp, R. norvegicus
agtcattttggaaaag

SEQ ID NO: 479078 - DNA, 16 bp, R. norvegicus
agtcattttggaagag

SEQ ID NO: 479079 - DNA, 16 bp, R. norvegicus
agtccaaggtcattct

SEQ ID NO: 479080 - DNA, 16 bp, R. norvegicus
agtccaagtggaccaa

SEQ ID NO: 479081 - DNA, 16 bp, R. norvegicus
agtccacagaccacat

SEQ ID NO: 479082 - DNA, 16 bp, R. norvegicus
agtccacagcagcttc

SEQ ID NO: 479083 - DNA, 16 bp, R. norvegicus
agtccagaagaaggtg

SEQ ID NO: 479084 - DNA, 16 bp, R. norvegicus
agtccagcagcagctg

SEQ ID NO: 479085 - DNA, 16 bp, R. norvegicus
agtccagcctaggcta

SEQ ID NO: 479086 - DNA, 16 bp, R. norvegicus
agtccagcttgtttct

SEQ ID NO: 479087 - DNA, 16 bp, R. norvegicus
agtccaggagcagctg

SEQ ID NO: 479088 - DNA, 16 bp, R. norvegicus
agtccaggctgacctc

SEQ ID NO: 479089 - DNA, 16 bp, R. norvegicus
agtccaggctgacctg

SEQ ID NO: 479090 - DNA, 16 bp, R. norvegicus
agtccaggctggcttt

SEQ ID NO: 479091 - DNA, 16 bp, R. norvegicus
agtccagttcagtagt

SEQ ID NO: 479092 - DNA, 16 bp, R. norvegicus
agtccagttgcagcag

SEQ ID NO: 479093 - DNA, 16 bp, R. norvegicus
agtccatagagaggag

SEQ ID NO: 479094 - DNA, 16 bp, R. norvegicus
agtccatgccatcact

SEQ ID NO: 479095 - DNA, 16 bp, R. norvegicus
agtccatggtgggtgg

SEQ ID NO: 479096 - DNA, 16 bp, R. norvegicus
agtccatggttttaag

SEQ ID NO: 479097 - DNA, 16 bp, R. norvegicus
agtccattgatgtgaa

SEQ ID NO: 479098 - DNA, 16 bp, R. norvegicus
agtccattggttgggt

SEQ ID NO: 479099 - DNA, 18 bp, R. norvegicus
agtcccaccaacaatgga

SEQ ID NO: 479100 - DNA, 16 bp, R. norvegicus
agtcccacttgggaga

SEQ ID NO: 479101 - DNA, 16 bp, R. norvegicus
agtcccagatccagga

SEQ ID NO: 479102 - DNA, 16 bp, R. norvegicus
agtcccagcaacccca

SEQ ID NO: 479103 - DNA, 16 bp, R. norvegicus
agtcccagcactcagg

SEQ ID NO: 479104 - DNA, 16 bp, R. norvegicus
agtcccatgctcccag

SEQ ID NO: 479105 - DNA, 16 bp, R. norvegicus
agtcccctaacccctc

SEQ ID NO: 479106 - DNA, 16 bp, R. norvegicus
agtcccctggaactgg

SEQ ID NO: 479107 - DNA, 16 bp, R. norvegicus
agtccctgaagaaaaa

SEQ ID NO: 479108 - DNA, 16 bp, R. norvegicus
agtccctgagatctct

SEQ ID NO: 479109 - DNA, 16 bp, R. norvegicus
agtccctgataccaac

SEQ ID NO: 479110 - DNA, 16 bp, R. norvegicus
agtccctgatattagt

SEQ ID NO: 479111 - DNA, 16 bp, R. norvegicus
agtccctggaggctct

SEQ ID NO: 479112 - DNA, 16 bp, R. norvegicus
agtccctgggagcttc

SEQ ID NO: 479113 - DNA, 19 bp, R. norvegicus
agtcctagagggaaatcag

SEQ ID NO: 479114 - DNA, 16 bp, R. norvegicus
agtcctcacacttgca

SEQ ID NO: 479115 - DNA, 16 bp, R. norvegicus
agtcctcagaagcagc

SEQ ID NO: 479116 - DNA, 16 bp, R. norvegicus
agtcctcaggacacag

SEQ ID NO: 479117 - DNA, 16 bp, R. norvegicus
agtcctccatcatcac

SEQ ID NO: 479118 - DNA, 16 bp, R. norvegicus
agtcctccattattat

SEQ ID NO: 479119 - DNA, 16 bp, R. norvegicus
agtcctcctacctcag

SEQ ID NO: 479120 - DNA, 16 bp, R. norvegicus
agtcctgagagtctct

SEQ ID NO: 479121 - DNA, 16 bp, R. norvegicus
agtcctgcctactcct

SEQ ID NO: 479122 - DNA, 17 bp, R. norvegicus
agtcctggaagctctgg

SEQ ID NO: 479123 - DNA, 16 bp, R. norvegicus
agtcctggatatcctg

SEQ ID NO: 479124 - DNA, 16 bp, R. norvegicus
agtcctggatgtcctg

SEQ ID NO: 479125 - DNA, 16 bp, R. norvegicus
agtcctggccatcctg

SEQ ID NO: 479126 - DNA, 16 bp, R. norvegicus
agtcctggctgacctg

SEQ ID NO: 479127 - DNA, 16 bp, R. norvegicus
agtcctggctgccctg

SEQ ID NO: 479128 - DNA, 16 bp, R. norvegicus
agtcctgggaattgaa

SEQ ID NO: 479129 - DNA, 16 bp, R. norvegicus
agtcctggggctgggg

SEQ ID NO: 479130 - DNA, 16 bp, R. norvegicus
agtcctggtagcctct

SEQ ID NO: 479131 - DNA, 16 bp, R. norvegicus
agtcctggtttgataa

SEQ ID NO: 479132 - DNA, 16 bp, R. norvegicus
agtcctgttctatgtc

SEQ ID NO: 479133 - DNA, 16 bp, R. norvegicus
agtccttccattttcc

SEQ ID NO: 479134 - DNA, 16 bp, R. norvegicus
agtcctttatccactt

SEQ ID NO: 479135 - DNA, 16 bp, R. norvegicus
agtcctttggaggagc

SEQ ID NO: 479136 - DNA, 16 bp, R. norvegicus
agtccttttggttcat

SEQ ID NO: 479137 - DNA, 16 bp, R. norvegicus
agtctatatctttttt

SEQ ID NO: 479138 - DNA, 16 bp, R. norvegicus
agtctatgatgggcat

SEQ ID NO: 479139 - DNA, 16 bp, R. norvegicus
agtctatgggggaggg

SEQ ID NO: 479140 - DNA, 16 bp, R. norvegicus
agtctatttaagtgat

SEQ ID NO: 479141 - DNA, 16 bp, R. norvegicus
agtctcaggacaggga

SEQ ID NO: 479142 - DNA, 16 bp, R. norvegicus
agtctccagaattcca

SEQ ID NO: 479143 - DNA, 16 bp, R. norvegicus
agtctccagcttctcc

SEQ ID NO: 479144 - DNA, 16 bp, R. norvegicus
agtctcctggctgcct

SEQ ID NO: 479145 - DNA, 16 bp, R. norvegicus
agtctctcacctccca

SEQ ID NO: 479146 - DNA, 16 bp, R. norvegicus
agtctctccaggactt

SEQ ID NO: 479147 - DNA, 16 bp, R. norvegicus
agtctctgaagaagaa

SEQ ID NO: 479148 - DNA, 16 bp, R. norvegicus
agtctctgaagaagga

SEQ ID NO: 479149 - DNA, 16 bp, R. norvegicus
agtctctgaagcaaga

SEQ ID NO: 479150 - DNA, 16 bp, R. norvegicus
agtctctgctccaagc

SEQ ID NO: 479151 - DNA, 16 bp, R. norvegicus
agtctctgctctacat

SEQ ID NO: 479152 - DNA, 16 bp, R. norvegicus
agtctctggagagaag

SEQ ID NO: 479153 - DNA, 16 bp, R. norvegicus
agtctctggatggcct

SEQ ID NO: 479154 - DNA, 16 bp, R. norvegicus
agtctctgtgtctctg

SEQ ID NO: 479155 - DNA, 16 bp, R. norvegicus
agtctctgttcagaag

SEQ ID NO: 479156 - DNA, 16 bp, R. norvegicus
agtctcttcctcttcc

SEQ ID NO: 479157 - DNA, 16 bp, R. norvegicus
agtctcttcctgctgc

SEQ ID NO: 479158 - DNA, 16 bp, R. norvegicus
agtctcttgtagccca

SEQ ID NO: 479159 - DNA, 16 bp, R. norvegicus
agtctgagaccagtct

SEQ ID NO: 479160 - DNA, 16 bp, R. norvegicus
agtctgaggccagact

SEQ ID NO: 479161 - DNA, 16 bp, R. norvegicus
agtctggaaatggtga

SEQ ID NO: 479162 - DNA, 16 bp, R. norvegicus
agtctggacctgggct

SEQ ID NO: 479163 - DNA, 16 bp, R. norvegicus
agtctggaggtgcctc

SEQ ID NO: 479164 - DNA, 16 bp, R. norvegicus
agtctggatattcctc

SEQ ID NO: 479165 - DNA, 16 bp, R. norvegicus
agtctggcctcagtgg

SEQ ID NO: 479166 - DNA, 16 bp, R. norvegicus
agtctggcctggaact

SEQ ID NO: 479167 - DNA, 16 bp, R. norvegicus
agtctgtctccagacc

SEQ ID NO: 479168 - DNA, 16 bp, R. norvegicus
agtctgtggatgacct

SEQ ID NO: 479169 - DNA, 17 bp, R. norvegicus
agtctgtggattttgaa

SEQ ID NO: 479170 - DNA, 16 bp, R. norvegicus
agtctgtggtgacctg

SEQ ID NO: 479171 - DNA, 16 bp, R. norvegicus
agtctgtggtggtctg

SEQ ID NO: 479172 - DNA, 16 bp, R. norvegicus
agtcttaccctccacc

SEQ ID NO: 479173 - DNA, 16 bp, R. norvegicus
agtcttacttcttgag

SEQ ID NO: 479174 - DNA, 16 bp, R. norvegicus
agtcttatttataata

SEQ ID NO: 479175 - DNA, 16 bp, R. norvegicus
agtcttccccagcaag

SEQ ID NO: 479176 - DNA, 16 bp, R. norvegicus
agtcttcctcagggaa

SEQ ID NO: 479177 - DNA, 16 bp, R. norvegicus
agtcttctggaagagc

SEQ ID NO: 479178 - DNA, 16 bp, R. norvegicus
agtcttgtggaagagt

SEQ ID NO: 479179 - DNA, 16 bp, R. norvegicus
agtcttgtggttcctc

SEQ ID NO: 479180 - DNA, 16 bp, R. norvegicus
agtcttttgagggtta

SEQ ID NO: 479181 - DNA, 16 bp, R. norvegicus
agtgaaaaaggtcaag

SEQ ID NO: 479182 - DNA, 16 bp, R. norvegicus
agtgaaaaatattctc

SEQ ID NO: 479183 - DNA, 16 bp, R. norvegicus
agtgaaagacctgtat

SEQ ID NO: 479184 - DNA, 16 bp, R. norvegicus
agtgaaatcaggaaca

SEQ ID NO: 479185 - DNA, 16 bp, R. norvegicus
agtgaaatccccatca

SEQ ID NO: 479186 - DNA, 16 bp, R. norvegicus
agtgaaattgctttga

SEQ ID NO: 479187 - DNA, 16 bp, R. norvegicus
agtgaacatgattctt

SEQ ID NO: 479188 - DNA, 16 bp, R. norvegicus
agtgaacgtgatggtt

SEQ ID NO: 479189 - DNA, 16 bp, R. norvegicus
agtgaagaccagcaaa

SEQ ID NO: 479190 - DNA, 17 bp, R. norvegicus
agtgaagactcccaact

SEQ ID NO: 479191 - DNA, 16 bp, R. norvegicus
agtgaagactcccagt

SEQ ID NO: 479192 - DNA, 16 bp, R. norvegicus
agtgaagacttccagc

SEQ ID NO: 479193 - DNA, 16 bp, R. norvegicus
agtgaagagtcccagc

SEQ ID NO: 479194 - DNA, 16 bp, R. norvegicus
agtgaagcatacacat

SEQ ID NO: 479195 - DNA, 16 bp, R. norvegicus
agtgaagcatcctcat

SEQ ID NO: 479196 - DNA, 16 bp, R. norvegicus
agtgaaggaaaggtca

SEQ ID NO: 479197 - DNA, 16 bp, R. norvegicus
agtgaaggagttagag

SEQ ID NO: 479198 - DNA, 16 bp, R. norvegicus
agtgaaggggctgggg

SEQ ID NO: 479199 - DNA, 16 bp, R. norvegicus
agtgaaggtgcagcct

SEQ ID NO: 479200 - DNA, 16 bp, R. norvegicus
agtgaagtaactcaga

SEQ ID NO: 479201 - DNA, 16 bp, R. norvegicus
agtgaagtgaagtgaa

SEQ ID NO: 479202 - DNA, 16 bp, R. norvegicus
agtgaagtttttttcc

SEQ ID NO: 479203 - DNA, 16 bp, R. norvegicus
agtgaatctgaggcca

SEQ ID NO: 479204 - DNA, 16 bp, R. norvegicus
agtgaatgagtggatg

SEQ ID NO: 479205 - DNA, 16 bp, R. norvegicus
agtgaatgcataccat

SEQ ID NO: 479206 - DNA, 16 bp, R. norvegicus
agtgaatggaattctt

SEQ ID NO: 479207 - DNA, 16 bp, R. norvegicus
agtgaatgtgacaaat

SEQ ID NO: 479208 - DNA, 16 bp, R. norvegicus
agtgacaaaaactgta

SEQ ID NO: 479209 - DNA, 16 bp, R. norvegicus
agtgacaaagacagag

SEQ ID NO: 479210 - DNA, 16 bp, R. norvegicus
agtgacacacttcatc

SEQ ID NO: 479211 - DNA, 16 bp, R. norvegicus
agtgacacagttcttc

SEQ ID NO: 479212 - DNA, 16 bp, R. norvegicus
agtgacagagacacag

SEQ ID NO: 479213 - DNA, 16 bp, R. norvegicus
agtgacagaggaagac

SEQ ID NO: 479214 - DNA, 16 bp, R. norvegicus
agtgacagaggcagag

SEQ ID NO: 479215 - DNA, 16 bp, R. norvegicus
agtgacagtgacagtg

SEQ ID NO: 479216 - DNA, 16 bp, R. norvegicus
agtgactacacacctg

SEQ ID NO: 479217 - DNA, 16 bp, R. norvegicus
agtgactcaaagacag

SEQ ID NO: 479218 - DNA, 17 bp, R. norvegicus
agtgactccaaaaagaa

SEQ ID NO: 479219 - DNA, 16 bp, R. norvegicus
agtgactctgagattc

SEQ ID NO: 479220 - DNA, 16 bp, R. norvegicus
agtgactctgggctgt

SEQ ID NO: 479221 - DNA, 16 bp, R. norvegicus
agtgactgggtttggt

SEQ ID NO: 479222 - DNA, 16 bp, R. norvegicus
agtgacttcaggcctg

SEQ ID NO: 479223 - DNA, 16 bp, R. norvegicus
agtgacttccaggcca

SEQ ID NO: 479224 - DNA, 16 bp, R. norvegicus
agtgagaacctgtttc

SEQ ID NO: 479225 - DNA, 32 bp, R. norvegicus
agtgagaactctgaagctctggaaggagagtg

SEQ ID NO: 479226 - DNA, 16 bp, R. norvegicus
agtgagaacttgagag

SEQ ID NO: 479227 - DNA, 16 bp, R. norvegicus
agtgagaagatcttat

SEQ ID NO: 479228 - DNA, 16 bp, R. norvegicus
agtgagactttgtctc

SEQ ID NO: 479229 - DNA, 16 bp, R. norvegicus
agtgagagactgtctc

SEQ ID NO: 479230 - DNA, 16 bp, R. norvegicus
agtgagagcactcctg

SEQ ID NO: 479231 - DNA, 16 bp, R. norvegicus
agtgagaggctcccag

SEQ ID NO: 479232 - DNA, 16 bp, R. norvegicus
agtgagaggctttcag

SEQ ID NO: 479233 - DNA, 16 bp, R. norvegicus
agtgagataactcaga

SEQ ID NO: 479234 - DNA, 16 bp, R. norvegicus
agtgagcaagaaagtt

SEQ ID NO: 479235 - DNA, 16 bp, R. norvegicus
agtgagcacacacaca

SEQ ID NO: 479236 - DNA, 16 bp, R. norvegicus
agtgagctgagcacaa

SEQ ID NO: 479237 - DNA, 16 bp, R. norvegicus
agtgagctgagtacca

SEQ ID NO: 479238 - DNA, 33 bp, R. norvegicus
agtgagcttcaacaaggaataacctatcttaaa

SEQ ID NO: 479239 - DNA, 16 bp, R. norvegicus
agtgaggaaactcaga

SEQ ID NO: 479240 - DNA, 16 bp, R. norvegicus
agtgaggagacagcct

SEQ ID NO: 479241 - DNA, 19 bp, R. norvegicus
agtgaggaggtgcaggagt

SEQ ID NO: 479242 - DNA, 16 bp, R. norvegicus
agtgaggatatggaga

SEQ ID NO: 479243 - DNA, 16 bp, R. norvegicus
agtgaggatgtggaga

SEQ ID NO: 479244 - DNA, 16 bp, R. norvegicus
agtgaggtagcccaga

SEQ ID NO: 479245 - DNA, 16 bp, R. norvegicus
agtgaggtgacccaga

SEQ ID NO: 479246 - DNA, 16 bp, R. norvegicus
agtgagtgagtgagtg

SEQ ID NO: 479247 - DNA, 16 bp, R. norvegicus
agtgagtgagtggatg

SEQ ID NO: 479248 - DNA, 16 bp, R. norvegicus
agtgagtgctgttcag

SEQ ID NO: 479249 - DNA, 16 bp, R. norvegicus
agtgagtggatggatg

SEQ ID NO: 479250 - DNA, 16 bp, R. norvegicus
agtgagtgtgtgagtg

SEQ ID NO: 479251 - DNA, 16 bp, R. norvegicus
agtgagtgtgtgctgg

SEQ ID NO: 479252 - DNA, 16 bp, R. norvegicus
agtgagttccaggacc

SEQ ID NO: 479253 - DNA, 16 bp, R. norvegicus
agtgagttcctggaca

SEQ ID NO: 479254 - DNA, 16 bp, R. norvegicus
agtgagttctaggaca

SEQ ID NO: 479255 - DNA, 16 bp, R. norvegicus
agtgagtttgaggcca

SEQ ID NO: 479256 - DNA, 16 bp, R. norvegicus
agtgatcatccaagaa

SEQ ID NO: 479257 - DNA, 16 bp, R. norvegicus
agtgatgagtcagaga

SEQ ID NO: 479258 - DNA, 16 bp, R. norvegicus
agtgatggaaatggag

SEQ ID NO: 479259 - DNA, 16 bp, R. norvegicus
agtgatggactgtaac

SEQ ID NO: 479260 - DNA, 16 bp, R. norvegicus
agtgatggagagagag

SEQ ID NO: 479261 - DNA, 16 bp, R. norvegicus
agtgatggaggaagac

SEQ ID NO: 479262 - DNA, 16 bp, R. norvegicus
agtgatgtggaatctg

SEQ ID NO: 479263 - DNA, 16 bp, R. norvegicus
agtgattgaaagtttt

SEQ ID NO: 479264 - DNA, 16 bp, R. norvegicus
agtgatttctaggaca

SEQ ID NO: 479265 - DNA, 16 bp, R. norvegicus
agtgcaaaaataaata

SEQ ID NO: 479266 - DNA, 16 bp, R. norvegicus
agtgcaaagccctggg

SEQ ID NO: 479267 - DNA, 16 bp, R. norvegicus
agtgcaagctgagcaa

SEQ ID NO: 479268 - DNA, 17 bp, R. norvegicus
agtgcaaggggaagccc

SEQ ID NO: 479269 - DNA, 16 bp, R. norvegicus
agtgcaatgtacaatt

SEQ ID NO: 479270 - DNA, 16 bp, R. norvegicus
agtgcacacacacaca

SEQ ID NO: 479271 - DNA, 16 bp, R. norvegicus
agtgcactaccactga

SEQ ID NO: 479272 - DNA, 16 bp, R. norvegicus
agtgcactgaagctcc

SEQ ID NO: 479273 - DNA, 16 bp, R. norvegicus
agtgcagagaggcctt

SEQ ID NO: 479274 - DNA, 16 bp, R. norvegicus
agtgcagatactcctg

SEQ ID NO: 479275 - DNA, 16 bp, R. norvegicus
agtgcagatgattcac

SEQ ID NO: 479276 - DNA, 16 bp, R. norvegicus
agtgcagcctcccctg

SEQ ID NO: 479277 - DNA, 16 bp, R. norvegicus
agtgcaggaagctagg

SEQ ID NO: 479278 - DNA, 16 bp, R. norvegicus
agtgcaggaggagctg

SEQ ID NO: 479279 - DNA, 16 bp, R. norvegicus
agtgcagggaaatatg

SEQ ID NO: 479280 - DNA, 16 bp, R. norvegicus
agtgcaggtgcctgtg

SEQ ID NO: 479281 - DNA, 16 bp, R. norvegicus
agtgcagtggagatgg

SEQ ID NO: 479282 - DNA, 16 bp, R. norvegicus
agtgcatcttctccca

SEQ ID NO: 479283 - DNA, 16 bp, R. norvegicus
agtgcatggtattggt

SEQ ID NO: 479284 - DNA, 16 bp, R. norvegicus
agtgcattctcttctg

SEQ ID NO: 479285 - DNA, 16 bp, R. norvegicus
agtgccaccagctggg

SEQ ID NO: 479286 - DNA, 16 bp, R. norvegicus
agtgccactccctggc

SEQ ID NO: 479287 - DNA, 16 bp, R. norvegicus
agtgccactccgtggg

SEQ ID NO: 479288 - DNA, 16 bp, R. norvegicus
agtgccactgctgctg

SEQ ID NO: 479289 - DNA, 16 bp, R. norvegicus
agtgccagctgtgccc

SEQ ID NO: 479290 - DNA, 16 bp, R. norvegicus
agtgccatctgggccc

SEQ ID NO: 479291 - DNA, 16 bp, R. norvegicus
agtgcccacatggtgg

SEQ ID NO: 479292 - DNA, 16 bp, R. norvegicus
agtgcccacctgacta

SEQ ID NO: 479293 - DNA, 16 bp, R. norvegicus
agtgcccatagatgtg

SEQ ID NO: 479294 - DNA, 17 bp, R. norvegicus
agtgccccagagtacag

SEQ ID NO: 479295 - DNA, 16 bp, R. norvegicus
agtgccctgtcccaga

SEQ ID NO: 479296 - DNA, 16 bp, R. norvegicus
agtgcctactgtgtgc

SEQ ID NO: 479297 - DNA, 16 bp, R. norvegicus
agtgcctcacaaccat

SEQ ID NO: 479298 - DNA, 16 bp, R. norvegicus
agtgcctctagacaca

SEQ ID NO: 479299 - DNA, 16 bp, R. norvegicus
agtgcctctccctatg

SEQ ID NO: 479300 - DNA, 16 bp, R. norvegicus
agtgcctgaggaggcc

SEQ ID NO: 479301 - DNA, 16 bp, R. norvegicus
agtgcctgcagaaaga

SEQ ID NO: 479302 - DNA, 16 bp, R. norvegicus
agtgcctgtggaggcc

SEQ ID NO: 479303 - DNA, 16 bp, R. norvegicus
agtgccttccaggcct

SEQ ID NO: 479304 - DNA, 17 bp, R. norvegicus
agtgccttccaggcctt

SEQ ID NO: 479305 - DNA, 16 bp, R. norvegicus
agtgccttgaacacat

SEQ ID NO: 479306 - DNA, 16 bp, R. norvegicus
agtgctagaactaaag

SEQ ID NO: 479307 - DNA, 16 bp, R. norvegicus
agtgctagagagatgg

SEQ ID NO: 479308 - DNA, 16 bp, R. norvegicus
agtgctaggattaaag

SEQ ID NO: 479309 - DNA, 16 bp, R. norvegicus
agtgctaggattatag

SEQ ID NO: 479310 - DNA, 16 bp, R. norvegicus
agtgctcactgctctt

SEQ ID NO: 479311 - DNA, 16 bp, R. norvegicus
agtgctcaggagacag

SEQ ID NO: 479312 - DNA, 16 bp, R. norvegicus
agtgctccctcagaca

SEQ ID NO: 479313 - DNA, 16 bp, R. norvegicus
agtgctcctccatggt

SEQ ID NO: 479314 - DNA, 16 bp, R. norvegicus
agtgctcctggagact

SEQ ID NO: 479315 - DNA, 16 bp, R. norvegicus
agtgctgaaattaaag

SEQ ID NO: 479316 - DNA, 16 bp, R. norvegicus
agtgctgaatttgtag

SEQ ID NO: 479317 - DNA, 16 bp, R. norvegicus
agtgctgacacagagg

SEQ ID NO: 479318 - DNA, 16 bp, R. norvegicus
agtgctgagaagaagg

SEQ ID NO: 479319 - DNA, 16 bp, R. norvegicus
agtgctgagattaaag

SEQ ID NO: 479320 - DNA, 16 bp, R. norvegicus
agtgctgaggttaaag

SEQ ID NO: 479321 - DNA, 16 bp, R. norvegicus
agtgctgcagccagca

SEQ ID NO: 479322 - DNA, 16 bp, R. norvegicus
agtgctgcagcctgtg

SEQ ID NO: 479323 - DNA, 16 bp, R. norvegicus
agtgctgcccacagtg

SEQ ID NO: 479324 - DNA, 16 bp, R. norvegicus
agtgctggaactaaag

SEQ ID NO: 479325 - DNA, 16 bp, R. norvegicus
agtgctggaattaaag

SEQ ID NO: 479326 - DNA, 16 bp, R. norvegicus
agtgctggatttgcag

SEQ ID NO: 479327 - DNA, 16 bp, R. norvegicus
agtgctggcatcacag

SEQ ID NO: 479328 - DNA, 16 bp, R. norvegicus
agtgctgggaacccaa

SEQ ID NO: 479329 - DNA, 16 bp, R. norvegicus
agtgctgggaataaag

SEQ ID NO: 479330 - DNA, 16 bp, R. norvegicus
agtgctgggatgacag

SEQ ID NO: 479331 - DNA, 16 bp, R. norvegicus
agtgctgggattaaaa

SEQ ID NO: 479332 - DNA, 16 bp, R. norvegicus
agtgctgggattaaag

SEQ ID NO: 479333 - DNA, 16 bp, R. norvegicus
agtgctgggattacag

SEQ ID NO: 479334 - DNA, 16 bp, R. norvegicus
agtgctgggattatag

SEQ ID NO: 479335 - DNA, 16 bp, R. norvegicus
agtgctgggattgaag

SEQ ID NO: 479336 - DNA, 16 bp, R. norvegicus
agtgctgggattttag

SEQ ID NO: 479337 - DNA, 16 bp, R. norvegicus
agtgctgggcttaaag

SEQ ID NO: 479338 - DNA, 16 bp, R. norvegicus
agtgctggggtcaaag

SEQ ID NO: 479339 - DNA, 16 bp, R. norvegicus
agtgctgtctgctctt

SEQ ID NO: 479340 - DNA, 16 bp, R. norvegicus
agtgctgtgtgacagt

SEQ ID NO: 479341 - DNA, 16 bp, R. norvegicus
agtgctgtgtgcctgc

SEQ ID NO: 479342 - DNA, 16 bp, R. norvegicus
agtgcttctcagccat

SEQ ID NO: 479343 - DNA, 16 bp, R. norvegicus
agtgcttgaagtctta

SEQ ID NO: 479344 - DNA, 16 bp, R. norvegicus
agtgcttgcctagcat

SEQ ID NO: 479345 - DNA, 16 bp, R. norvegicus
agtgcttgtggaggcc

SEQ ID NO: 479346 - DNA, 16 bp, R. norvegicus
agtgctttgctgctag

SEQ ID NO: 479347 - DNA, 16 bp, R. norvegicus
agtgcttttccagagg

SEQ ID NO: 479348 - DNA, 16 bp, R. norvegicus
agtggaaaaacaagtt

SEQ ID NO: 479349 - DNA, 16 bp, R. norvegicus
agtggaaacaggagga

SEQ ID NO: 479350 - DNA, 16 bp, R. norvegicus
agtggaaactgggaag

SEQ ID NO: 479351 - DNA, 16 bp, R. norvegicus
agtggaacatgtaccc

SEQ ID NO: 479352 - DNA, 16 bp, R. norvegicus
agtggaaccagctcag

SEQ ID NO: 479353 - DNA, 16 bp, R. norvegicus
agtggaagactgacat

SEQ ID NO: 479354 - DNA, 16 bp, R. norvegicus
agtggaagagtggaag

SEQ ID NO: 479355 - DNA, 16 bp, R. norvegicus
agtggaagcagaagcc

SEQ ID NO: 479356 - DNA, 16 bp, R. norvegicus
agtggaaggagaagcc

SEQ ID NO: 479357 - DNA, 16 bp, R. norvegicus
agtggacactgaggaa

SEQ ID NO: 479358 - DNA, 16 bp, R. norvegicus
agtggacttcacagag

SEQ ID NO: 479359 - DNA, 16 bp, R. norvegicus
agtggagaagagactg

SEQ ID NO: 479360 - DNA, 16 bp, R. norvegicus
agtggagaagagcctt

SEQ ID NO: 479361 - DNA, 16 bp, R. norvegicus
agtggagacaggagaa

SEQ ID NO: 479362 - DNA, 16 bp, R. norvegicus
agtggagagaagcaga

SEQ ID NO: 479363 - DNA, 16 bp, R. norvegicus
agtggagcagaaactg

SEQ ID NO: 479364 - DNA, 16 bp, R. norvegicus
agtggagcagagacca

SEQ ID NO: 479365 - DNA, 16 bp, R. norvegicus
agtggagcaggggctg

SEQ ID NO: 479366 - DNA, 16 bp, R. norvegicus
agtggagcctgtgtcc

SEQ ID NO: 479367 - DNA, 16 bp, R. norvegicus
agtggagctgaccctg

SEQ ID NO: 479368 - DNA, 16 bp, R. norvegicus
agtggagctggctctg

SEQ ID NO: 479369 - DNA, 23 bp, R. norvegicus
agtggaggagtgttcctctttct

SEQ ID NO: 479370 - DNA, 16 bp, R. norvegicus
agtggaggctgacagg

SEQ ID NO: 479371 - DNA, 16 bp, R. norvegicus
agtggatataagccaa

SEQ ID NO: 479372 - DNA, 16 bp, R. norvegicus
agtggatcaaggccct

SEQ ID NO: 479373 - DNA, 17 bp, R. norvegicus
agtggatcatggacctc

SEQ ID NO: 479374 - DNA, 16 bp, R. norvegicus
agtggatcctctggta

SEQ ID NO: 479375 - DNA, 16 bp, R. norvegicus
agtggatctgggagag

SEQ ID NO: 479376 - DNA, 16 bp, R. norvegicus
agtggatgcagagcca

SEQ ID NO: 479377 - DNA, 16 bp, R. norvegicus
agtggatggagaccat

SEQ ID NO: 479378 - DNA, 16 bp, R. norvegicus
agtggatggatagatg

SEQ ID NO: 479379 - DNA, 16 bp, R. norvegicus
agtggatggatgagtg

SEQ ID NO: 479380 - DNA, 16 bp, R. norvegicus
agtggattacagtgat

SEQ ID NO: 479381 - DNA, 16 bp, R. norvegicus
agtggcactattagaa

SEQ ID NO: 479382 - DNA, 16 bp, R. norvegicus
agtggcactattagga

SEQ ID NO: 479383 - DNA, 16 bp, R. norvegicus
agtggcagagagagag

SEQ ID NO: 479384 - DNA, 16 bp, R. norvegicus
agtggcagagcgcttg

SEQ ID NO: 479385 - DNA, 16 bp, R. norvegicus
agtggcagaggcagag

SEQ ID NO: 479386 - DNA, 16 bp, R. norvegicus
agtggcagccttgtct

SEQ ID NO: 479387 - DNA, 16 bp, R. norvegicus
agtggccactgctctg

SEQ ID NO: 479388 - DNA, 16 bp, R. norvegicus
agtggccatggtggcc

SEQ ID NO: 479389 - DNA, 16 bp, R. norvegicus
agtggccattccttca

SEQ ID NO: 479390 - DNA, 16 bp, R. norvegicus
agtggctactccagct

SEQ ID NO: 479391 - DNA, 16 bp, R. norvegicus
agtggctatgcaggag

SEQ ID NO: 479392 - DNA, 16 bp, R. norvegicus
agtggctcacaaccat

SEQ ID NO: 479393 - DNA, 16 bp, R. norvegicus
agtggctctgccagag

SEQ ID NO: 479394 - DNA, 16 bp, R. norvegicus
agtggctgcagcagca

SEQ ID NO: 479395 - DNA, 16 bp, R. norvegicus
agtggctgtggccttg

SEQ ID NO: 479396 - DNA, 16 bp, R. norvegicus
agtgggaagggaggcc

SEQ ID NO: 479397 - DNA, 16 bp, R. norvegicus
agtgggagaagatgaa

SEQ ID NO: 479398 - DNA, 16 bp, R. norvegicus
agtgggagagagacct

SEQ ID NO: 479399 - DNA, 16 bp, R. norvegicus
agtgggagagctggct

SEQ ID NO: 479400 - DNA, 16 bp, R. norvegicus
agtgggagaggatgtg

SEQ ID NO: 479401 - DNA, 16 bp, R. norvegicus
agtgggagaggatttg

SEQ ID NO: 479402 - DNA, 16 bp, R. norvegicus
agtgggagcaggagct

SEQ ID NO: 479403 - DNA, 16 bp, R. norvegicus
agtgggaggagaagtc

SEQ ID NO: 479404 - DNA, 16 bp, R. norvegicus
agtgggaggagcagga

SEQ ID NO: 479405 - DNA, 16 bp, R. norvegicus
agtgggaggcagaggc

SEQ ID NO: 479406 - DNA, 16 bp, R. norvegicus
agtgggaggggaagcc

SEQ ID NO: 479407 - DNA, 16 bp, R. norvegicus
agtgggattgaagtat

SEQ ID NO: 479408 - DNA, 16 bp, R. norvegicus
agtgggccctcagatg

SEQ ID NO: 479409 - DNA, 16 bp, R. norvegicus
agtgggccttaagtcc

SEQ ID NO: 479410 - DNA, 16 bp, R. norvegicus
agtgggctctcactgt

SEQ ID NO: 479411 - DNA, 16 bp, R. norvegicus
agtgggcttctctggg

SEQ ID NO: 479412 - DNA, 16 bp, R. norvegicus
agtggggaaaagcctc

SEQ ID NO: 479413 - DNA, 16 bp, R. norvegicus
agtggggaaaagcctt

SEQ ID NO: 479414 - DNA, 16 bp, R. norvegicus
agtggggaaaagtctc

SEQ ID NO: 479415 - DNA, 16 bp, R. norvegicus
agtggggaagaatctg

SEQ ID NO: 479416 - DNA, 18 bp, R. norvegicus
agtggggacccagttatt

SEQ ID NO: 479417 - DNA, 16 bp, R. norvegicus
agtggggactggagag

SEQ ID NO: 479418 - DNA, 16 bp, R. norvegicus
agtggggagaaggaac

SEQ ID NO: 479419 - DNA, 16 bp, R. norvegicus
agtggggaggcctggc

SEQ ID NO: 479420 - DNA, 16 bp, R. norvegicus
agtggggctggggaga

SEQ ID NO: 479421 - DNA, 16 bp, R. norvegicus
agtgggtgaaggagca

SEQ ID NO: 479422 - DNA, 16 bp, R. norvegicus
agtgggtgctgggaac

SEQ ID NO: 479423 - DNA, 16 bp, R. norvegicus
agtgggtgtggcctca

SEQ ID NO: 479424 - DNA, 16 bp, R. norvegicus
agtgggtgtggccttg

SEQ ID NO: 479425 - DNA, 16 bp, R. norvegicus
agtggtagagcctttg

SEQ ID NO: 479426 - DNA, 16 bp, R. norvegicus
agtggtagagtgcatg

SEQ ID NO: 479427 - DNA, 16 bp, R. norvegicus
agtggtcacttcccag

SEQ ID NO: 479428 - DNA, 16 bp, R. norvegicus
agtggtcagtcctgaa

SEQ ID NO: 479429 - DNA, 16 bp, R. norvegicus
agtggtcctgggttct

SEQ ID NO: 479430 - DNA, 16 bp, R. norvegicus
agtggtgaatcagaga

SEQ ID NO: 479431 - DNA, 16 bp, R. norvegicus
agtggtgatgatggtg

SEQ ID NO: 479432 - DNA, 16 bp, R. norvegicus
agtggtggggcaggag

SEQ ID NO: 479433 - DNA, 16 bp, R. norvegicus
agtggtggtctcacct

SEQ ID NO: 479434 - DNA, 16 bp, R. norvegicus
agtggtgtatgccttt

SEQ ID NO: 479435 - DNA, 16 bp, R. norvegicus
agtggttaagagctca

SEQ ID NO: 479436 - DNA, 16 bp, R. norvegicus
agtggttaagagtgat

SEQ ID NO: 479437 - DNA, 16 bp, R. norvegicus
agtggttaggagcatg

SEQ ID NO: 479438 - DNA, 16 bp, R. norvegicus
agtggttaggagtact

SEQ ID NO: 479439 - DNA, 16 bp, R. norvegicus
agtggttctcagcctg

SEQ ID NO: 479440 - DNA, 16 bp, R. norvegicus
agtgtaagccaaataa

SEQ ID NO: 479441 - DNA, 16 bp, R. norvegicus
agtgtactcatataca

SEQ ID NO: 479442 - DNA, 16 bp, R. norvegicus
agtgtacttatataga

SEQ ID NO: 479443 - DNA, 16 bp, R. norvegicus
agtgtagggagatgct

SEQ ID NO: 479444 - DNA, 16 bp, R. norvegicus
agtgtataaggaagaa

SEQ ID NO: 479445 - DNA, 16 bp, R. norvegicus
agtgtatgtgggcatt

SEQ ID NO: 479446 - DNA, 16 bp, R. norvegicus
agtgtcagggattgct

SEQ ID NO: 479447 - DNA, 16 bp, R. norvegicus
agtgtccaagaggaag

SEQ ID NO: 479448 - DNA, 16 bp, R. norvegicus
agtgtccacccagcat

SEQ ID NO: 479449 - DNA, 18 bp, R. norvegicus
agtgtcccacatgcagag

SEQ ID NO: 479450 - DNA, 16 bp, R. norvegicus
agtgtcctcatataca

SEQ ID NO: 479451 - DNA, 16 bp, R. norvegicus
agtgtcctgccaccac

SEQ ID NO: 479452 - DNA, 16 bp, R. norvegicus
agtgtccttctttgtc

SEQ ID NO: 479453 - DNA, 16 bp, R. norvegicus
agtgtctgcctttgtc

SEQ ID NO: 479454 - DNA, 16 bp, R. norvegicus
agtgtctgggattgcc

SEQ ID NO: 479455 - DNA, 16 bp, R. norvegicus
agtgtcttctggtttc

SEQ ID NO: 479456 - DNA, 16 bp, R. norvegicus
agtgtgaaggaagagg

SEQ ID NO: 479457 - DNA, 16 bp, R. norvegicus
agtgtgaagtgtcctt

SEQ ID NO: 479458 - DNA, 16 bp, R. norvegicus
agtgtgaggcagtgtg

SEQ ID NO: 479459 - DNA, 16 bp, R. norvegicus
agtgtgagtgtgagtg

SEQ ID NO: 479460 - DNA, 16 bp, R. norvegicus
agtgtgattttctgtg

SEQ ID NO: 479461 - DNA, 16 bp, R. norvegicus
agtgtgcagggcatcc

SEQ ID NO: 479462 - DNA, 16 bp, R. norvegicus
agtgtgcagtgtgtga

SEQ ID NO: 479463 - DNA, 16 bp, R. norvegicus
agtgtgcgtgtgagtg

SEQ ID NO: 479464 - DNA, 16 bp, R. norvegicus
agtgtgctctctctct

SEQ ID NO: 479465 - DNA, 16 bp, R. norvegicus
agtgtgctgcagtgtg

SEQ ID NO: 479466 - DNA, 16 bp, R. norvegicus
agtgtgctgggggctg

SEQ ID NO: 479467 - DNA, 16 bp, R. norvegicus
agtgtgcttttctgtg

SEQ ID NO: 479468 - DNA, 16 bp, R. norvegicus
agtgtggacattcctg

SEQ ID NO: 479469 - DNA, 16 bp, R. norvegicus
agtgtggatggttcag

SEQ ID NO: 479470 - DNA, 16 bp, R. norvegicus
agtgtgggtgcttgga

SEQ ID NO: 479471 - DNA, 16 bp, R. norvegicus
agtgtggtctcttctg

SEQ ID NO: 479472 - DNA, 16 bp, R. norvegicus
agtgtgtaaatgtgtg

SEQ ID NO: 479473 - DNA, 16 bp, R. norvegicus
agtgtgtataagtgtg

SEQ ID NO: 479474 - DNA, 16 bp, R. norvegicus
agtgtgtatgaatgtg

SEQ ID NO: 479475 - DNA, 16 bp, R. norvegicus
agtgtgtatgtgtgtg

SEQ ID NO: 479476 - DNA, 16 bp, R. norvegicus
agtgtgtatttatgta

SEQ ID NO: 479477 - DNA, 16 bp, R. norvegicus
agtgtgtctggattga

SEQ ID NO: 479478 - DNA, 16 bp, R. norvegicus
agtgtgtgcagtgtgt

SEQ ID NO: 479479 - DNA, 16 bp, R. norvegicus
agtgtgtgtgctcagt

SEQ ID NO: 479480 - DNA, 16 bp, R. norvegicus
agtgttaagagaaaaa

SEQ ID NO: 479481 - DNA, 16 bp, R. norvegicus
agtgttcctcttcctc

SEQ ID NO: 479482 - DNA, 16 bp, R. norvegicus
agtgttcctctttcct

SEQ ID NO: 479483 - DNA, 16 bp, R. norvegicus
agtgttcctttgttct

SEQ ID NO: 479484 - DNA, 16 bp, R. norvegicus
agtgttctaccactga

SEQ ID NO: 479485 - DNA, 19 bp, R. norvegicus
agtgttctgctttcgggca

SEQ ID NO: 479486 - DNA, 16 bp, R. norvegicus
agtgttctttgccttt

SEQ ID NO: 479487 - DNA, 16 bp, R. norvegicus
agtgttgatgaaggga

SEQ ID NO: 479488 - DNA, 16 bp, R. norvegicus
agtgttgggatcacag

SEQ ID NO: 479489 - DNA, 16 bp, R. norvegicus
agtgttgggattaaag

SEQ ID NO: 479490 - DNA, 16 bp, R. norvegicus
agtgttgggattatag

SEQ ID NO: 479491 - DNA, 16 bp, R. norvegicus
agtgttggggttacag

SEQ ID NO: 479492 - DNA, 16 bp, R. norvegicus
agtgttggtgaggatg

SEQ ID NO: 479493 - DNA, 16 bp, R. norvegicus
agtgttggtgttctct

SEQ ID NO: 479494 - DNA, 16 bp, R. norvegicus
agtgtttaaataaaat

SEQ ID NO: 479495 - DNA, 16 bp, R. norvegicus
agtgtttagcactgga

SEQ ID NO: 479496 - DNA, 16 bp, R. norvegicus
agtgtttgcctagaat

SEQ ID NO: 479497 - DNA, 16 bp, R. norvegicus
agtgtttgtgtgtgag

SEQ ID NO: 479498 - DNA, 16 bp, R. norvegicus
agtgttttgcctgcct

SEQ ID NO: 479499 - DNA, 16 bp, R. norvegicus
agtgttttgctggata

SEQ ID NO: 479500 - DNA, 16 bp, R. norvegicus
agttaaaaggcctttt

SEQ ID NO: 479501 - DNA, 16 bp, R. norvegicus
agttaaagaaaatgca

SEQ ID NO: 479502 - DNA, 16 bp, R. norvegicus
agttaacatggaccaa

SEQ ID NO: 479503 - DNA, 16 bp, R. norvegicus
agttaacttagaatgg

SEQ ID NO: 479504 - DNA, 16 bp, R. norvegicus
agttacaggacagcca

SEQ ID NO: 479505 - DNA, 16 bp, R. norvegicus
agttacttttctcatc

SEQ ID NO: 479506 - DNA, 16 bp, R. norvegicus
agttagaaattatatt

SEQ ID NO: 479507 - DNA, 16 bp, R. norvegicus
agttagactacaggga

SEQ ID NO: 479508 - DNA, 16 bp, R. norvegicus
agttagaggccagact

SEQ ID NO: 479509 - DNA, 16 bp, R. norvegicus
agttagaggtggctgt

SEQ ID NO: 479510 - DNA, 16 bp, R. norvegicus
agttaggctccagaga

SEQ ID NO: 479511 - DNA, 16 bp, R. norvegicus
agttagggcaggaaca

SEQ ID NO: 479512 - DNA, 16 bp, R. norvegicus
agttaggggaaaggaa

SEQ ID NO: 479513 - DNA, 16 bp, R. norvegicus
agttataccaagatat

SEQ ID NO: 479514 - DNA, 32 bp, R. norvegicus
agttatagcgacccaaccaatttctccagaga

SEQ ID NO: 479515 - DNA, 16 bp, R. norvegicus
agttataggacagcca

SEQ ID NO: 479516 - DNA, 16 bp, R. norvegicus
agttatatacatatat

SEQ ID NO: 479517 - DNA, 16 bp, R. norvegicus
agttatctcctgagtc

SEQ ID NO: 479518 - DNA, 19 bp, R. norvegicus
agttatctgtattttgatg

SEQ ID NO: 479519 - DNA, 16 bp, R. norvegicus
agttatgaagacttct

SEQ ID NO: 479520 - DNA, 16 bp, R. norvegicus
agttatgaagtagcaa

SEQ ID NO: 479521 - DNA, 16 bp, R. norvegicus
agttatgagctgcctg

SEQ ID NO: 479522 - DNA, 16 bp, R. norvegicus
agttatttatagaaca

SEQ ID NO: 479523 - DNA, 16 bp, R. norvegicus
agttatttatgtcctt

SEQ ID NO: 479524 - DNA, 16 bp, R. norvegicus
agttatttttctattg

SEQ ID NO: 479525 - DNA, 16 bp, R. norvegicus
agttcaaaacacacat

SEQ ID NO: 479526 - DNA, 16 bp, R. norvegicus
agttcaaaatctcagg

SEQ ID NO: 479527 - DNA, 16 bp, R. norvegicus
agttcaaaatttaaaa

SEQ ID NO: 479528 - DNA, 16 bp, R. norvegicus
agttcaaagccagcct

SEQ ID NO: 479529 - DNA, 16 bp, R. norvegicus
agttcaaagccatctt

SEQ ID NO: 479530 - DNA, 16 bp, R. norvegicus
agttcaaagcctgcct

SEQ ID NO: 479531 - DNA, 16 bp, R. norvegicus
agttcaaagctagctt

SEQ ID NO: 479532 - DNA, 16 bp, R. norvegicus
agttcaaatcctgcct

SEQ ID NO: 479533 - DNA, 16 bp, R. norvegicus
agttcaacaacaacaa

SEQ ID NO: 479534 - DNA, 16 bp, R. norvegicus
agttcaacaccagcct

SEQ ID NO: 479535 - DNA, 16 bp, R. norvegicus
agttcaaccagcacca

SEQ ID NO: 479536 - DNA, 16 bp, R. norvegicus
agttcaagaacagcct

SEQ ID NO: 479537 - DNA, 16 bp, R. norvegicus
agttcaagaccagcct

SEQ ID NO: 479538 - DNA, 16 bp, R. norvegicus
agttcaagaccagtgt

SEQ ID NO: 479539 - DNA, 16 bp, R. norvegicus
agttcaagaccatcct

SEQ ID NO: 479540 - DNA, 16 bp, R. norvegicus
agttcaagatcagcct

SEQ ID NO: 479541 - DNA, 16 bp, R. norvegicus
agttcaagccagagca

SEQ ID NO: 479542 - DNA, 16 bp, R. norvegicus
agttcaagcccagcct

SEQ ID NO: 479543 - DNA, 16 bp, R. norvegicus
agttcaaggacaacct

SEQ ID NO: 479544 - DNA, 16 bp, R. norvegicus
agttcaaggcagcctg

SEQ ID NO: 479545 - DNA, 16 bp, R. norvegicus
agttcaaggccaacct

SEQ ID NO: 479546 - DNA, 16 bp, R. norvegicus
agttcaaggccaagtt

SEQ ID NO: 479547 - DNA, 16 bp, R. norvegicus
agttcaaggccagcca

SEQ ID NO: 479548 - DNA, 16 bp, R. norvegicus
agttcaaggccagcct

SEQ ID NO: 479549 - DNA, 16 bp, R. norvegicus
agttcaaggctaacct

SEQ ID NO: 479550 - DNA, 16 bp, R. norvegicus
agttcaaggctaccct

SEQ ID NO: 479551 - DNA, 16 bp, R. norvegicus
agttcaaggctagcct

SEQ ID NO: 479552 - DNA, 16 bp, R. norvegicus
agttcaaggtcagcct

SEQ ID NO: 479553 - DNA, 16 bp, R. norvegicus
agttcaaggtcatcct

SEQ ID NO: 479554 - DNA, 16 bp, R. norvegicus
agttcaaggttatcct

SEQ ID NO: 479555 - DNA, 16 bp, R. norvegicus
agttcaagtcagcctg

SEQ ID NO: 479556 - DNA, 16 bp, R. norvegicus
agttcaagtccaccct

SEQ ID NO: 479557 - DNA, 16 bp, R. norvegicus
agttcaagtccagctt

SEQ ID NO: 479558 - DNA, 16 bp, R. norvegicus
agttcaagtctcagaa

SEQ ID NO: 479559 - DNA, 16 bp, R. norvegicus
agttcaagttcatcct

SEQ ID NO: 479560 - DNA, 16 bp, R. norvegicus
agttcaatggtgtgct

SEQ ID NO: 479561 - DNA, 16 bp, R. norvegicus
agttcaatgtgtgttt

SEQ ID NO: 479562 - DNA, 16 bp, R. norvegicus
agttcaattcccagaa

SEQ ID NO: 479563 - DNA, 16 bp, R. norvegicus
agttcacatggacaga

SEQ ID NO: 479564 - DNA, 16 bp, R. norvegicus
agttcagatcccagta

SEQ ID NO: 479565 - DNA, 16 bp, R. norvegicus
agttcagatcctcagc

SEQ ID NO: 479566 - DNA, 16 bp, R. norvegicus
agttcagctcccagca

SEQ ID NO: 479567 - DNA, 16 bp, R. norvegicus
agttcagctctctccc

SEQ ID NO: 479568 - DNA, 16 bp, R. norvegicus
agttcagggatttcta

SEQ ID NO: 479569 - DNA, 16 bp, R. norvegicus
agttcagggccagcca

SEQ ID NO: 479570 - DNA, 16 bp, R. norvegicus
agttcagggtcagtct

SEQ ID NO: 479571 - DNA, 16 bp, R. norvegicus
agttcaggtgctggga

SEQ ID NO: 479572 - DNA, 16 bp, R. norvegicus
agttcagtcctcagaa

SEQ ID NO: 479573 - DNA, 16 bp, R. norvegicus
agttcagtcgtttgct

SEQ ID NO: 479574 - DNA, 16 bp, R. norvegicus
agttcatcttgatgga

SEQ ID NO: 479575 - DNA, 16 bp, R. norvegicus
agttcatcttggagga

SEQ ID NO: 479576 - DNA, 16 bp, R. norvegicus
agttcatcttggcaga

SEQ ID NO: 479577 - DNA, 16 bp, R. norvegicus
agttcatggccaacct

SEQ ID NO: 479578 - DNA, 16 bp, R. norvegicus
agttccaaaccagcca

SEQ ID NO: 479579 - DNA, 17 bp, R. norvegicus
agttccaaccatttgtc

SEQ ID NO: 479580 - DNA, 16 bp, R. norvegicus
agttccaagacagcca

SEQ ID NO: 479581 - DNA, 16 bp, R. norvegicus
agttccacatcacagt

SEQ ID NO: 479582 - DNA, 16 bp, R. norvegicus
agttccacatctggat

SEQ ID NO: 479583 - DNA, 16 bp, R. norvegicus
agttccaccagaaaac

SEQ ID NO: 479584 - DNA, 16 bp, R. norvegicus
agttccagaacagcca

SEQ ID NO: 479585 - DNA, 16 bp, R. norvegicus
agttccagaacagtca

SEQ ID NO: 479586 - DNA, 16 bp, R. norvegicus
agttccagagaagcaa

SEQ ID NO: 479587 - DNA, 16 bp, R. norvegicus
agttccagaggacctg

SEQ ID NO: 479588 - DNA, 16 bp, R. norvegicus
agttccagaggattca

SEQ ID NO: 479589 - DNA, 16 bp, R. norvegicus
agttccagcacagcca

SEQ ID NO: 479590 - DNA, 16 bp, R. norvegicus
agttccagctcagggg

SEQ ID NO: 479591 - DNA, 16 bp, R. norvegicus
agttccaggaaaacca

SEQ ID NO: 479592 - DNA, 16 bp, R. norvegicus
agttccaggacagcca

SEQ ID NO: 479593 - DNA, 16 bp, R. norvegicus
agttccaggacagcct

SEQ ID NO: 479594 - DNA, 16 bp, R. norvegicus
agttccaggagattca

SEQ ID NO: 479595 - DNA, 16 bp, R. norvegicus
agttccaggatagcca

SEQ ID NO: 479596 - DNA, 16 bp, R. norvegicus
agttccaggccaactt

SEQ ID NO: 479597 - DNA, 16 bp, R. norvegicus
agttccaggccaatga

SEQ ID NO: 479598 - DNA, 16 bp, R. norvegicus
agttccaggccaccca

SEQ ID NO: 479599 - DNA, 16 bp, R. norvegicus
agttccaggccagctt

SEQ ID NO: 479600 - DNA, 16 bp, R. norvegicus
agttccaggccatcca

SEQ ID NO: 479601 - DNA, 16 bp, R. norvegicus
agttccaggctagcca

SEQ ID NO: 479602 - DNA, 16 bp, R. norvegicus
agttccagggcagcca

SEQ ID NO: 479603 - DNA, 16 bp, R. norvegicus
agttccagggcatcca

SEQ ID NO: 479604 - DNA, 16 bp, R. norvegicus
agttccaggggaccca

SEQ ID NO: 479605 - DNA, 16 bp, R. norvegicus
agttccaggggatgtg

SEQ ID NO: 479606 - DNA, 16 bp, R. norvegicus
agttccaggtcagcca

SEQ ID NO: 479607 - DNA, 16 bp, R. norvegicus
agttccaggtcggaga

SEQ ID NO: 479608 - DNA, 16 bp, R. norvegicus
agttccaggttcagag

SEQ ID NO: 479609 - DNA, 16 bp, R. norvegicus
agttccatgccagcca

SEQ ID NO: 479610 - DNA, 16 bp, R. norvegicus
agttcccaagacaggt

SEQ ID NO: 479611 - DNA, 16 bp, R. norvegicus
agttcccagaacccaa

SEQ ID NO: 479612 - DNA, 16 bp, R. norvegicus
agttcccagcaccagc

SEQ ID NO: 479613 - DNA, 16 bp, R. norvegicus
agttcccaggacccac

SEQ ID NO: 479614 - DNA, 16 bp, R. norvegicus
agttcccagggactaa

SEQ ID NO: 479615 - DNA, 16 bp, R. norvegicus
agttccctgagctctg

SEQ ID NO: 479616 - DNA, 16 bp, R. norvegicus
agttcctagaagctct

SEQ ID NO: 479617 - DNA, 16 bp, R. norvegicus
agttcctagaagcttc

SEQ ID NO: 479618 - DNA, 16 bp, R. norvegicus
agttcctcagttgagg

SEQ ID NO: 479619 - DNA, 16 bp, R. norvegicus
agttcctgcagttctg

SEQ ID NO: 479620 - DNA, 16 bp, R. norvegicus
agttcctgcccccagg

SEQ ID NO: 479621 - DNA, 16 bp, R. norvegicus
agttcctgcctcaagt

SEQ ID NO: 479622 - DNA, 16 bp, R. norvegicus
agttcctgccttagct

SEQ ID NO: 479623 - DNA, 16 bp, R. norvegicus
agttcctggagcaact

SEQ ID NO: 479624 - DNA, 16 bp, R. norvegicus
agttcctgtcctgcct

SEQ ID NO: 479625 - DNA, 16 bp, R. norvegicus
agttcctgtcctgttt

SEQ ID NO: 479626 - DNA, 16 bp, R. norvegicus
agttcgaggccagctt

SEQ ID NO: 479627 - DNA, 16 bp, R. norvegicus
agttctaagaggaaaa

SEQ ID NO: 479628 - DNA, 16 bp, R. norvegicus
agttctacaccttgtt

SEQ ID NO: 479629 - DNA, 16 bp, R. norvegicus
agttctacatcaagac

SEQ ID NO: 479630 - DNA, 16 bp, R. norvegicus
agttctacatccagat

SEQ ID NO: 479631 - DNA, 16 bp, R. norvegicus
agttctacattcagat

SEQ ID NO: 479632 - DNA, 16 bp, R. norvegicus
agttctaccttaagac

SEQ ID NO: 479633 - DNA, 16 bp, R. norvegicus
agttctaggacagcca

SEQ ID NO: 479634 - DNA, 16 bp, R. norvegicus
agttctaggttagcct

SEQ ID NO: 479635 - DNA, 16 bp, R. norvegicus
agttctcaaaggaaga

SEQ ID NO: 479636 - DNA, 16 bp, R. norvegicus
agttctcagcacccac

SEQ ID NO: 479637 - DNA, 16 bp, R. norvegicus
agttctccaagtccta

SEQ ID NO: 479638 - DNA, 16 bp, R. norvegicus
agttctccatgcccac

SEQ ID NO: 479639 - DNA, 16 bp, R. norvegicus
agttctccttgtaaca

SEQ ID NO: 479640 - DNA, 17 bp, R. norvegicus
agttctctacacccaaa

SEQ ID NO: 479641 - DNA, 16 bp, R. norvegicus
agttctctccccttca

SEQ ID NO: 479642 - DNA, 16 bp, R. norvegicus
agttctctctctctct

SEQ ID NO: 479643 - DNA, 16 bp, R. norvegicus
agttctctgaaagagc

SEQ ID NO: 479644 - DNA, 22 bp, R. norvegicus
agttctctggtggaacttttgg

SEQ ID NO: 479645 - DNA, 16 bp, R. norvegicus
agttctgcttcttgct

SEQ ID NO: 479646 - DNA, 16 bp, R. norvegicus
agttctggaaaaaaaa

SEQ ID NO: 479647 - DNA, 16 bp, R. norvegicus
agttctggctgctctt

SEQ ID NO: 479648 - DNA, 16 bp, R. norvegicus
agttctggctggcctg

SEQ ID NO: 479649 - DNA, 16 bp, R. norvegicus
agttctgggattaaag

SEQ ID NO: 479650 - DNA, 16 bp, R. norvegicus
agttctgggattccag

SEQ ID NO: 479651 - DNA, 16 bp, R. norvegicus
agttctggggagtctg

SEQ ID NO: 479652 - DNA, 16 bp, R. norvegicus
agttcttcaaagagtt

SEQ ID NO: 479653 - DNA, 16 bp, R. norvegicus
agttcttcacagagat

SEQ ID NO: 479654 - DNA, 16 bp, R. norvegicus
agttcttggggggttg

SEQ ID NO: 479655 - DNA, 16 bp, R. norvegicus
agttcttgtcatgcag

SEQ ID NO: 479656 - DNA, 25 bp, R. norvegicus
agttctttagcctttgccttttcca

SEQ ID NO: 479657 - DNA, 16 bp, R. norvegicus
agttctttgtacattt

SEQ ID NO: 479658 - DNA, 16 bp, R. norvegicus
agttctttgtctttct

SEQ ID NO: 479659 - DNA, 16 bp, R. norvegicus
agttgaactacagact

SEQ ID NO: 479660 - DNA, 17 bp, R. norvegicus
agttgaagaaattaaaa

SEQ ID NO: 479661 - DNA, 16 bp, R. norvegicus
agttgaagacccagaa

SEQ ID NO: 479662 - DNA, 16 bp, R. norvegicus
agttgaaggcccagga

SEQ ID NO: 479663 - DNA, 16 bp, R. norvegicus
agttgacacccaaaac

SEQ ID NO: 479664 - DNA, 16 bp, R. norvegicus
agttgacactgttgtt

SEQ ID NO: 479665 - DNA, 16 bp, R. norvegicus
agttgacagccaagaa

SEQ ID NO: 479666 - DNA, 16 bp, R. norvegicus
agttgactctgtaagt

SEQ ID NO: 479667 - DNA, 16 bp, R. norvegicus
agttgagaaaaaccaa

SEQ ID NO: 479668 - DNA, 16 bp, R. norvegicus
agttgagaattcttag

SEQ ID NO: 479669 - DNA, 16 bp, R. norvegicus
agttgatccaggaaga

SEQ ID NO: 479670 - DNA, 16 bp, R. norvegicus
agttgatctgaaagaa

SEQ ID NO: 479671 - DNA, 16 bp, R. norvegicus
agttgatgctgttggt

SEQ ID NO: 479672 - DNA, 16 bp, R. norvegicus
agttgattatccttcc

SEQ ID NO: 479673 - DNA, 16 bp, R. norvegicus
agttgcagcagaagat

SEQ ID NO: 479674 - DNA, 16 bp, R. norvegicus
agttgccatggccatg

SEQ ID NO: 479675 - DNA, 16 bp, R. norvegicus
agttgctttgatcatg

SEQ ID NO: 479676 - DNA, 16 bp, R. norvegicus
agttggaaaacatttt

SEQ ID NO: 479677 - DNA, 16 bp, R. norvegicus
agttggaagtcagcct

SEQ ID NO: 479678 - DNA, 16 bp, R. norvegicus
agttggaccgcaggga

SEQ ID NO: 479679 - DNA, 16 bp, R. norvegicus
agttggactctcagaa

SEQ ID NO: 479680 - DNA, 16 bp, R. norvegicus
agttgggcactcctga

SEQ ID NO: 479681 - DNA, 16 bp, R. norvegicus
agttggggaccaaacc

SEQ ID NO: 479682 - DNA, 16 bp, R. norvegicus
agttggttcttgcctt

SEQ ID NO: 479683 - DNA, 16 bp, R. norvegicus
agttggttttctttaa

SEQ ID NO: 479684 - DNA, 16 bp, R. norvegicus
agttgtacaagtttgc

SEQ ID NO: 479685 - DNA, 16 bp, R. norvegicus
agttgtcatctgactt

SEQ ID NO: 479686 - DNA, 16 bp, R. norvegicus
agttgtcctttgacct

SEQ ID NO: 479687 - DNA, 16 bp, R. norvegicus
agttgtctctgatgca

SEQ ID NO: 479688 - DNA, 17 bp, R. norvegicus
agttgtggctgtgctct

SEQ ID NO: 479689 - DNA, 16 bp, R. norvegicus
agttgtgggtgctggg

SEQ ID NO: 479690 - DNA, 16 bp, R. norvegicus
agttgttcagtttcca

SEQ ID NO: 479691 - DNA, 16 bp, R. norvegicus
agttgttctccagcct

SEQ ID NO: 479692 - DNA, 16 bp, R. norvegicus
agttgtttaccaggct

SEQ ID NO: 479693 - DNA, 16 bp, R. norvegicus
agttgtttcctctgag

SEQ ID NO: 479694 - DNA, 16 bp, R. norvegicus
agtttaaggccaacct

SEQ ID NO: 479695 - DNA, 16 bp, R. norvegicus
agtttacttatatata

SEQ ID NO: 479696 - DNA, 16 bp, R. norvegicus
agtttagaacacaggc

SEQ ID NO: 479697 - DNA, 16 bp, R. norvegicus
agtttatgcagtgctg

SEQ ID NO: 479698 - DNA, 16 bp, R. norvegicus
agtttattcagagcat

SEQ ID NO: 479699 - DNA, 16 bp, R. norvegicus
agtttattttagacat

SEQ ID NO: 479700 - DNA, 16 bp, R. norvegicus
agtttcaagccagcct

SEQ ID NO: 479701 - DNA, 17 bp, R. norvegicus
agtttcaatcagccctt

SEQ ID NO: 479702 - DNA, 16 bp, R. norvegicus
agtttcacatggcctt

SEQ ID NO: 479703 - DNA, 16 bp, R. norvegicus
agtttcagaagagact

SEQ ID NO: 479704 - DNA, 16 bp, R. norvegicus
agtttcagagagtgag

SEQ ID NO: 479705 - DNA, 16 bp, R. norvegicus
agtttcaggccagtga

SEQ ID NO: 479706 - DNA, 16 bp, R. norvegicus
agtttcaggggatcca

SEQ ID NO: 479707 - DNA, 16 bp, R. norvegicus
agtttcagggtatctg

SEQ ID NO: 479708 - DNA, 16 bp, R. norvegicus
agtttcagtgtatatg

SEQ ID NO: 479709 - DNA, 16 bp, R. norvegicus
agtttcagtgtgtctc

SEQ ID NO: 479710 - DNA, 16 bp, R. norvegicus
agtttcatttattaat

SEQ ID NO: 479711 - DNA, 16 bp, R. norvegicus
agtttcattttttaaa

SEQ ID NO: 479712 - DNA, 16 bp, R. norvegicus
agtttccagagcctaa

SEQ ID NO: 479713 - DNA, 16 bp, R. norvegicus
agtttccattttcttc

SEQ ID NO: 479714 - DNA, 16 bp, R. norvegicus
agtttccctggaagga

SEQ ID NO: 479715 - DNA, 16 bp, R. norvegicus
agtttcccttctgcaa

SEQ ID NO: 479716 - DNA, 16 bp, R. norvegicus
agtttcctttctctgt

SEQ ID NO: 479717 - DNA, 16 bp, R. norvegicus
agtttcctttcttctt

SEQ ID NO: 479718 - DNA, 16 bp, R. norvegicus
agtttccttttctgta

SEQ ID NO: 479719 - DNA, 16 bp, R. norvegicus
agtttctaaagaaaga

SEQ ID NO: 479720 - DNA, 16 bp, R. norvegicus
agtttctcagaagatt

SEQ ID NO: 479721 - DNA, 16 bp, R. norvegicus
agtttctcagaggaca

SEQ ID NO: 479722 - DNA, 16 bp, R. norvegicus
agtttctccatctgtg

SEQ ID NO: 479723 - DNA, 16 bp, R. norvegicus
agtttctctatgtctt

SEQ ID NO: 479724 - DNA, 16 bp, R. norvegicus
agtttctctctctttc

SEQ ID NO: 479725 - DNA, 16 bp, R. norvegicus
agtttctctgtgtagc

SEQ ID NO: 479726 - DNA, 16 bp, R. norvegicus
agtttctgcacagcaa

SEQ ID NO: 479727 - DNA, 16 bp, R. norvegicus
agtttctgcctgtgct

SEQ ID NO: 479728 - DNA, 16 bp, R. norvegicus
agtttctgccttcagg

SEQ ID NO: 479729 - DNA, 16 bp, R. norvegicus
agtttctgctccacat

SEQ ID NO: 479730 - DNA, 16 bp, R. norvegicus
agtttctggaagctct

SEQ ID NO: 479731 - DNA, 20 bp, R. norvegicus
agtttctggcgagaagtctg

SEQ ID NO: 479732 - DNA, 16 bp, R. norvegicus
agtttctggggaaaag

SEQ ID NO: 479733 - DNA, 16 bp, R. norvegicus
agtttctggtgaagtc

SEQ ID NO: 479734 - DNA, 16 bp, R. norvegicus
agtttctgttgctgtg

SEQ ID NO: 479735 - DNA, 16 bp, R. norvegicus
agtttcttgggttctt

SEQ ID NO: 479736 - DNA, 16 bp, R. norvegicus
agtttctttttggaga

SEQ ID NO: 479737 - DNA, 16 bp, R. norvegicus
agtttcttttttaaaa

SEQ ID NO: 479738 - DNA, 16 bp, R. norvegicus
agtttgaaaatatttt

SEQ ID NO: 479739 - DNA, 16 bp, R. norvegicus
agtttgaaaatgaaat

SEQ ID NO: 479740 - DNA, 16 bp, R. norvegicus
agtttgaagccagact

SEQ ID NO: 479741 - DNA, 16 bp, R. norvegicus
agtttgaagccagcct

SEQ ID NO: 479742 - DNA, 16 bp, R. norvegicus
agtttgaagcctgcct

SEQ ID NO: 479743 - DNA, 16 bp, R. norvegicus
agtttgaataagaatg

SEQ ID NO: 479744 - DNA, 16 bp, R. norvegicus
agtttgacccctggga

SEQ ID NO: 479745 - DNA, 16 bp, R. norvegicus
agtttgactcccagga

SEQ ID NO: 479746 - DNA, 16 bp, R. norvegicus
agtttgagaaacactg

SEQ ID NO: 479747 - DNA, 16 bp, R. norvegicus
agtttgagacaagcct

SEQ ID NO: 479748 - DNA, 16 bp, R. norvegicus
agtttgagaccagcct

SEQ ID NO: 479749 - DNA, 16 bp, R. norvegicus
agtttgagaccagctt

SEQ ID NO: 479750 - DNA, 16 bp, R. norvegicus
agtttgaggacaacct

SEQ ID NO: 479751 - DNA, 16 bp, R. norvegicus
agtttgaggcagcctg

SEQ ID NO: 479752 - DNA, 16 bp, R. norvegicus
agtttgaggctggtct

SEQ ID NO: 479753 - DNA, 16 bp, R. norvegicus
agtttgagggaggagg

SEQ ID NO: 479754 - DNA, 16 bp, R. norvegicus
agtttgaggtcatcct

SEQ ID NO: 479755 - DNA, 16 bp, R. norvegicus
agtttgagtgtgcctg

SEQ ID NO: 479756 - DNA, 16 bp, R. norvegicus
agtttgatccccagga

SEQ ID NO: 479757 - DNA, 16 bp, R. norvegicus
agtttgatcttcacca

SEQ ID NO: 479758 - DNA, 16 bp, R. norvegicus
agtttgatgaagctaa

SEQ ID NO: 479759 - DNA, 16 bp, R. norvegicus
agtttgatgccagcct

SEQ ID NO: 479760 - DNA, 16 bp, R. norvegicus
agtttgatttccagga

SEQ ID NO: 479761 - DNA, 16 bp, R. norvegicus
agtttgcagaggggaa

SEQ ID NO: 479762 - DNA, 16 bp, R. norvegicus
agtttgcagccagcct

SEQ ID NO: 479763 - DNA, 16 bp, R. norvegicus
agtttgcccagatggt

SEQ ID NO: 479764 - DNA, 16 bp, R. norvegicus
agtttgcccagctggc

SEQ ID NO: 479765 - DNA, 16 bp, R. norvegicus
agtttggaggctgtat

SEQ ID NO: 479766 - DNA, 16 bp, R. norvegicus
agtttggatctcagca

SEQ ID NO: 479767 - DNA, 16 bp, R. norvegicus
agtttggctgccagca

SEQ ID NO: 479768 - DNA, 16 bp, R. norvegicus
agtttgggccaaatct

SEQ ID NO: 479769 - DNA, 16 bp, R. norvegicus
agtttggtgttcttgt

SEQ ID NO: 479770 - DNA, 16 bp, R. norvegicus
agtttgtagaagaaaa

SEQ ID NO: 479771 - DNA, 16 bp, R. norvegicus
agtttgtggagaacaa

SEQ ID NO: 479772 - DNA, 16 bp, R. norvegicus
agtttgtgtcaagctg

SEQ ID NO: 479773 - DNA, 16 bp, R. norvegicus
agtttgttttaaggag

SEQ ID NO: 479774 - DNA, 16 bp, R. norvegicus
agttttaatttcattt

SEQ ID NO: 479775 - DNA, 16 bp, R. norvegicus
agttttacagagagag

SEQ ID NO: 479776 - DNA, 16 bp, R. norvegicus
agttttattgggatta

SEQ ID NO: 479777 - DNA, 16 bp, R. norvegicus
agttttatttcataga

SEQ ID NO: 479778 - DNA, 16 bp, R. norvegicus
agttttatttctggga

SEQ ID NO: 479779 - DNA, 16 bp, R. norvegicus
agttttattttataca

SEQ ID NO: 479780 - DNA, 16 bp, R. norvegicus
agttttcccctgtgcc

SEQ ID NO: 479781 - DNA, 16 bp, R. norvegicus
agttttctcctagcag

SEQ ID NO: 479782 - DNA, 16 bp, R. norvegicus
agttttctgctttcag

SEQ ID NO: 479783 - DNA, 16 bp, R. norvegicus
agttttcttatttaaa

SEQ ID NO: 479784 - DNA, 16 bp, R. norvegicus
agttttcttcaatgga

SEQ ID NO: 479785 - DNA, 16 bp, R. norvegicus
agttttcttctaaaat

SEQ ID NO: 479786 - DNA, 16 bp, R. norvegicus
agttttcttcttagca

SEQ ID NO: 479787 - DNA, 16 bp, R. norvegicus
agttttctttctatta

SEQ ID NO: 479788 - DNA, 16 bp, R. norvegicus
agttttgatcactatt

SEQ ID NO: 479789 - DNA, 16 bp, R. norvegicus
agttttgatggctgta

SEQ ID NO: 479790 - DNA, 16 bp, R. norvegicus
agttttgcagacaaat

SEQ ID NO: 479791 - DNA, 16 bp, R. norvegicus
agttttgctggctgta

SEQ ID NO: 479792 - DNA, 16 bp, R. norvegicus
agttttggaggataca

SEQ ID NO: 479793 - DNA, 16 bp, R. norvegicus
agttttgtcatggaat

SEQ ID NO: 479794 - DNA, 16 bp, R. norvegicus
agttttgtggactgta

SEQ ID NO: 479795 - DNA, 16 bp, R. norvegicus
agttttgttctttcag

SEQ ID NO: 479796 - DNA, 16 bp, R. norvegicus
agttttgttgaataca

SEQ ID NO: 479797 - DNA, 16 bp, R. norvegicus
agtttttaaaaataca

SEQ ID NO: 479798 - DNA, 16 bp, R. norvegicus
agtttttattttaact

SEQ ID NO: 479799 - DNA, 16 bp, R. norvegicus
agtttttcatcctggg

SEQ ID NO: 479800 - DNA, 16 bp, R. norvegicus
agtttttcccagaaga

SEQ ID NO: 479801 - DNA, 16 bp, R. norvegicus
agttttttatctcagc

SEQ ID NO: 479802 - DNA, 16 bp, R. norvegicus
agtttttttttcaaaa

SEQ ID NO: 479803 - DNA, 16 bp, R. norvegicus
ataaaaaataaggctc

SEQ ID NO: 479804 - DNA, 16 bp, R. norvegicus
ataaaaacaatgccaa

SEQ ID NO: 479805 - DNA, 16 bp, R. norvegicus
ataaaaacagacacat

SEQ ID NO: 479806 - DNA, 16 bp, R. norvegicus
ataaaaacattccttt

SEQ ID NO: 479807 - DNA, 16 bp, R. norvegicus
ataaaaaggctgagaa

SEQ ID NO: 479808 - DNA, 16 bp, R. norvegicus
ataaaaataaaactgg

SEQ ID NO: 479809 - DNA, 16 bp, R. norvegicus
ataaaaataaaatctg

SEQ ID NO: 479810 - DNA, 16 bp, R. norvegicus
ataaaaatgatttctt

SEQ ID NO: 479811 - DNA, 16 bp, R. norvegicus
ataaaaatgccagcag

SEQ ID NO: 479812 - DNA, 16 bp, R. norvegicus
ataaaaatgctgtctt

SEQ ID NO: 479813 - DNA, 16 bp, R. norvegicus
ataaaaatggattgat

SEQ ID NO: 479814 - DNA, 16 bp, R. norvegicus
ataaaaatgtcacaaa

SEQ ID NO: 479815 - DNA, 16 bp, R. norvegicus
ataaaacagcaaagct

SEQ ID NO: 479816 - DNA, 16 bp, R. norvegicus
ataaaacatccaggaa

SEQ ID NO: 479817 - DNA, 16 bp, R. norvegicus
ataaaacatgttttat

SEQ ID NO: 479818 - DNA, 16 bp, R. norvegicus
ataaaacatttcaccc

SEQ ID NO: 479819 - DNA, 16 bp, R. norvegicus
ataaaactatttcatt

SEQ ID NO: 479820 - DNA, 16 bp, R. norvegicus
ataaaactgaaatgaa

SEQ ID NO: 479821 - DNA, 16 bp, R. norvegicus
ataaaactgcagagct

SEQ ID NO: 479822 - DNA, 16 bp, R. norvegicus
ataaaagaaatgcagg

SEQ ID NO: 479823 - DNA, 16 bp, R. norvegicus
ataaaagaacacacag

SEQ ID NO: 479824 - DNA, 16 bp, R. norvegicus
ataaaagagcttctgg

SEQ ID NO: 479825 - DNA, 16 bp, R. norvegicus
ataaaagcagcaaaat

SEQ ID NO: 479826 - DNA, 16 bp, R. norvegicus
ataaaagctctagaac

SEQ ID NO: 479827 - DNA, 16 bp, R. norvegicus
ataaaagtaacattat

SEQ ID NO: 479828 - DNA, 16 bp, R. norvegicus
ataaaagtcctgaaaa

SEQ ID NO: 479829 - DNA, 16 bp, R. norvegicus
ataaaataaaattcag

SEQ ID NO: 479830 - DNA, 16 bp, R. norvegicus
ataaaataaatgttct

SEQ ID NO: 479831 - DNA, 16 bp, R. norvegicus
ataaaatacagttttt

SEQ ID NO: 479832 - DNA, 16 bp, R. norvegicus
ataaaatacatcttta

SEQ ID NO: 479833 - DNA, 16 bp, R. norvegicus
ataaaatactggcaaa

SEQ ID NO: 479834 - DNA, 16 bp, R. norvegicus
ataaaatagagtttat

SEQ ID NO: 479835 - DNA, 16 bp, R. norvegicus
ataaaataggggttgg

SEQ ID NO: 479836 - DNA, 16 bp, R. norvegicus
ataaaatatgtatttc

SEQ ID NO: 479837 - DNA, 16 bp, R. norvegicus
ataaaatcattatcag

SEQ ID NO: 479838 - DNA, 16 bp, R. norvegicus
ataaaatcctggcaaa

SEQ ID NO: 479839 - DNA, 16 bp, R. norvegicus
ataaaatcttgagtgt

SEQ ID NO: 479840 - DNA, 16 bp, R. norvegicus
ataaaatgaaaattca

SEQ ID NO: 479841 - DNA, 16 bp, R. norvegicus
ataaaatggaatttta

SEQ ID NO: 479842 - DNA, 16 bp, R. norvegicus
ataaaatgtgatttta

SEQ ID NO: 479843 - DNA, 16 bp, R. norvegicus
ataaaatgttttctaa

SEQ ID NO: 479844 - DNA, 16 bp, R. norvegicus
ataaaattaatgcaaa

SEQ ID NO: 479845 - DNA, 16 bp, R. norvegicus
ataaaattattctgtt

SEQ ID NO: 479846 - DNA, 16 bp, R. norvegicus
ataaaattctcaagga

SEQ ID NO: 479847 - DNA, 16 bp, R. norvegicus
ataaaattctccaaaa

SEQ ID NO: 479848 - DNA, 16 bp, R. norvegicus
ataaaattcttgaaaa

SEQ ID NO: 479849 - DNA, 16 bp, R. norvegicus
ataaacaacttcttaa

SEQ ID NO: 479850 - DNA, 16 bp, R. norvegicus
ataaacaatttcagca

SEQ ID NO: 479851 - DNA, 16 bp, R. norvegicus
ataaacacagacacac

SEQ ID NO: 479852 - DNA, 16 bp, R. norvegicus
ataaacaccttcatca

SEQ ID NO: 479853 - DNA, 16 bp, R. norvegicus
ataaacagactgaaaa

SEQ ID NO: 479854 - DNA, 17 bp, R. norvegicus
ataaacagcaaaccagt

SEQ ID NO: 479855 - DNA, 16 bp, R. norvegicus
ataaacaggcttctaa

SEQ ID NO: 479856 - DNA, 16 bp, R. norvegicus
ataaacagttctctga

SEQ ID NO: 479857 - DNA, 16 bp, R. norvegicus
ataaacccttcctttc

SEQ ID NO: 479858 - DNA, 16 bp, R. norvegicus
ataaactcacagcagc

SEQ ID NO: 479859 - DNA, 16 bp, R. norvegicus
ataaactgggcatggt

SEQ ID NO: 479860 - DNA, 16 bp, R. norvegicus
ataaactgtaatttat

SEQ ID NO: 479861 - DNA, 16 bp, R. norvegicus
ataaagaaaacacagt

SEQ ID NO: 479862 - DNA, 16 bp, R. norvegicus
ataaagaaaatatgca

SEQ ID NO: 479863 - DNA, 16 bp, R. norvegicus
ataaagaaaatatggt

SEQ ID NO: 479864 - DNA, 16 bp, R. norvegicus
ataaagaaaatgtgct

SEQ ID NO: 479865 - DNA, 16 bp, R. norvegicus
ataaagaaaatgtggt

SEQ ID NO: 479866 - DNA, 16 bp, R. norvegicus
ataaagaaaatgttcc

SEQ ID NO: 479867 - DNA, 16 bp, R. norvegicus
ataaagaaatcatgaa

SEQ ID NO: 479868 - DNA, 16 bp, R. norvegicus
ataaagaagacattat

SEQ ID NO: 479869 - DNA, 16 bp, R. norvegicus
ataaagaagtcaagaa

SEQ ID NO: 479870 - DNA, 16 bp, R. norvegicus
ataaagaattcaagaa

SEQ ID NO: 479871 - DNA, 16 bp, R. norvegicus
ataaagacagagagag

SEQ ID NO: 479872 - DNA, 16 bp, R. norvegicus
ataaagacattaaaga

SEQ ID NO: 479873 - DNA, 16 bp, R. norvegicus
ataaagacattgtttt

SEQ ID NO: 479874 - DNA, 16 bp, R. norvegicus
ataaagatgagcccat

SEQ ID NO: 479875 - DNA, 16 bp, R. norvegicus
ataaagcattttaaaa

SEQ ID NO: 479876 - DNA, 16 bp, R. norvegicus
ataaagctacaggaga

SEQ ID NO: 479877 - DNA, 16 bp, R. norvegicus
ataaagctgtcctctg

SEQ ID NO: 479878 - DNA, 16 bp, R. norvegicus
ataaaggctattttaa

SEQ ID NO: 479879 - DNA, 16 bp, R. norvegicus
ataaaggctgttgaga

SEQ ID NO: 479880 - DNA, 16 bp, R. norvegicus
ataaagtcaaaatcat

SEQ ID NO: 479881 - DNA, 16 bp, R. norvegicus
ataaagtgtgtgtgtg

SEQ ID NO: 479882 - DNA, 16 bp, R. norvegicus
ataaagtttgaaatgt

SEQ ID NO: 479883 - DNA, 16 bp, R. norvegicus
ataaataaaattttgg

SEQ ID NO: 479884 - DNA, 16 bp, R. norvegicus
ataaataaagatgttt

SEQ ID NO: 479885 - DNA, 16 bp, R. norvegicus
ataaataaatatgcaa

SEQ ID NO: 479886 - DNA, 16 bp, R. norvegicus
ataaataaatctatct

SEQ ID NO: 479887 - DNA, 16 bp, R. norvegicus
ataaatacacacatat

SEQ ID NO: 479888 - DNA, 16 bp, R. norvegicus
ataaatacatgaaaat

SEQ ID NO: 479889 - DNA, 16 bp, R. norvegicus
ataaatatacctatat

SEQ ID NO: 479890 - DNA, 18 bp, R. norvegicus
ataaatatcttcaacaaa

SEQ ID NO: 479891 - DNA, 16 bp, R. norvegicus
ataaatctttaaagaa

SEQ ID NO: 479892 - DNA, 16 bp, R. norvegicus
ataaatctttcctctt

SEQ ID NO: 479893 - DNA, 16 bp, R. norvegicus
ataaatgaaaatgttt

SEQ ID NO: 479894 - DNA, 16 bp, R. norvegicus
ataaatgaagaaactg

SEQ ID NO: 479895 - DNA, 16 bp, R. norvegicus
ataaatgaatgaatga

SEQ ID NO: 479896 - DNA, 16 bp, R. norvegicus
ataaatgaatgcagta

SEQ ID NO: 479897 - DNA, 16 bp, R. norvegicus
ataaatgattgataga

SEQ ID NO: 479898 - DNA, 16 bp, R. norvegicus
ataaatgctttaaaaa

SEQ ID NO: 479899 - DNA, 16 bp, R. norvegicus
ataaatgggcagagaa

SEQ ID NO: 479900 - DNA, 16 bp, R. norvegicus
ataaatgtaaacagtg

SEQ ID NO: 479901 - DNA, 16 bp, R. norvegicus
ataaatgtataaatgt

SEQ ID NO: 479902 - DNA, 16 bp, R. norvegicus
ataaatgtatttatgt

SEQ ID NO: 479903 - DNA, 16 bp, R. norvegicus
ataaatgtatttgaaa

SEQ ID NO: 479904 - DNA, 16 bp, R. norvegicus
ataaatgtctgttaaa

SEQ ID NO: 479905 - DNA, 16 bp, R. norvegicus
ataaatgtgtgtattt

SEQ ID NO: 479906 - DNA, 16 bp, R. norvegicus
ataaattgacttaatt

SEQ ID NO: 479907 - DNA, 16 bp, R. norvegicus
ataaattgtcctctga

SEQ ID NO: 479908 - DNA, 16 bp, R. norvegicus
ataaattttccataaa

SEQ ID NO: 479909 - DNA, 16 bp, R. norvegicus
ataacaaagcaggctg

SEQ ID NO: 479910 - DNA, 16 bp, R. norvegicus
ataacaacctgtatct

SEQ ID NO: 479911 - DNA, 16 bp, R. norvegicus
ataacaacttcagcaa

SEQ ID NO: 479912 - DNA, 16 bp, R. norvegicus
ataacagcaaaattat

SEQ ID NO: 479913 - DNA, 16 bp, R. norvegicus
ataacatacatgcaga

SEQ ID NO: 479914 - DNA, 16 bp, R. norvegicus
ataaccaatatataca

SEQ ID NO: 479915 - DNA, 16 bp, R. norvegicus
ataaccactgtggaaa

SEQ ID NO: 479916 - DNA, 16 bp, R. norvegicus
ataacccagttaaaaa

SEQ ID NO: 479917 - DNA, 17 bp, R. norvegicus
ataaccctggatataga

SEQ ID NO: 479918 - DNA, 17 bp, R. norvegicus
ataacctggccaaggaa

SEQ ID NO: 479919 - DNA, 16 bp, R. norvegicus
ataaccttttgcttta

SEQ ID NO: 479920 - DNA, 16 bp, R. norvegicus
ataacgtttgaaatgt

SEQ ID NO: 479921 - DNA, 16 bp, R. norvegicus
ataactccagcttggg

SEQ ID NO: 479922 - DNA, 16 bp, R. norvegicus
ataactccctgtcaga

SEQ ID NO: 479923 - DNA, 16 bp, R. norvegicus
ataactgtcaaagaaa

SEQ ID NO: 479924 - DNA, 16 bp, R. norvegicus
ataacttaaatatact

SEQ ID NO: 479925 - DNA, 16 bp, R. norvegicus
ataagaaagcagctga

SEQ ID NO: 479926 - DNA, 23 bp, R. norvegicus
ataagaaatactcaagttaataa

SEQ ID NO: 479927 - DNA, 20 bp, R. norvegicus
ataagaaccaagtgcaaatg

SEQ ID NO: 479928 - DNA, 16 bp, R. norvegicus
ataagaagcctacaga

SEQ ID NO: 479929 - DNA, 18 bp, R. norvegicus
ataagaaggcaattatgc

SEQ ID NO: 479930 - DNA, 16 bp, R. norvegicus
ataagaatatttacat

SEQ ID NO: 479931 - DNA, 16 bp, R. norvegicus
ataagaattccataaa

SEQ ID NO: 479932 - DNA, 16 bp, R. norvegicus
ataagacttgatatca

SEQ ID NO: 479933 - DNA, 16 bp, R. norvegicus
ataagagaaagcattt

SEQ ID NO: 479934 - DNA, 16 bp, R. norvegicus
ataagagaagacataa

SEQ ID NO: 479935 - DNA, 16 bp, R. norvegicus
ataagagggcattgga

SEQ ID NO: 479936 - DNA, 16 bp, R. norvegicus
ataagatccagctgta

SEQ ID NO: 479937 - DNA, 16 bp, R. norvegicus
ataagatcctggacag

SEQ ID NO: 479938 - DNA, 16 bp, R. norvegicus
ataagcaaaataaacc

SEQ ID NO: 479939 - DNA, 16 bp, R. norvegicus
ataagcaatttaaaca

SEQ ID NO: 479940 - DNA, 16 bp, R. norvegicus
ataagcacacacatat

SEQ ID NO: 479941 - DNA, 16 bp, R. norvegicus
ataagcagttggagcc

SEQ ID NO: 479942 - DNA, 16 bp, R. norvegicus
ataagcttgggtatgt

SEQ ID NO: 479943 - DNA, 16 bp, R. norvegicus
ataaggaaaacatttc

SEQ ID NO: 479944 - DNA, 16 bp, R. norvegicus
ataaggaactgtggga

SEQ ID NO: 479945 - DNA, 16 bp, R. norvegicus
ataaggaaggacatgt

SEQ ID NO: 479946 - DNA, 16 bp, R. norvegicus
ataaggaaggggatgg

SEQ ID NO: 479947 - DNA, 16 bp, R. norvegicus
ataaggacatcctgag

SEQ ID NO: 479948 - DNA, 16 bp, R. norvegicus
ataaggacattggaaa

SEQ ID NO: 479949 - DNA, 16 bp, R. norvegicus
ataaggatataaacca

SEQ ID NO: 479950 - DNA, 16 bp, R. norvegicus
ataaggattaataaag

SEQ ID NO: 479951 - DNA, 16 bp, R. norvegicus
ataaggccacaccccc

SEQ ID NO: 479952 - DNA, 16 bp, R. norvegicus
ataagggcacctacat

SEQ ID NO: 479953 - DNA, 16 bp, R. norvegicus
ataaggtaaatgcaaa

SEQ ID NO: 479954 - DNA, 16 bp, R. norvegicus
ataagtaaataaaatc

SEQ ID NO: 479955 - DNA, 16 bp, R. norvegicus
ataagtatgtatatgt

SEQ ID NO: 479956 - DNA, 16 bp, R. norvegicus
ataagtgacagcacaa

SEQ ID NO: 479957 - DNA, 19 bp, R. norvegicus
ataagtgatgccatggaga

SEQ ID NO: 479958 - DNA, 16 bp, R. norvegicus
ataagtgtgtatatat

SEQ ID NO: 479959 - DNA, 16 bp, R. norvegicus
ataagttgggagagag

SEQ ID NO: 479960 - DNA, 16 bp, R. norvegicus
ataagtttgaaggaag

SEQ ID NO: 479961 - DNA, 16 bp, R. norvegicus
ataataaaaactgcat

SEQ ID NO: 479962 - DNA, 16 bp, R. norvegicus
ataataaaaatcagag

SEQ ID NO: 479963 - DNA, 16 bp, R. norvegicus
ataatacagattttaa

SEQ ID NO: 479964 - DNA, 30 bp, R. norvegicus
ataatactgccactagtacttcagtatgtg

SEQ ID NO: 479965 - DNA, 16 bp, R. norvegicus
ataatagcaaaattac

SEQ ID NO: 479966 - DNA, 18 bp, R. norvegicus
ataataggtatagaagaa

SEQ ID NO: 479967 - DNA, 20 bp, R. norvegicus
ataataggtatagaagagaa

SEQ ID NO: 479968 - DNA, 16 bp, R. norvegicus
ataatagtcaaaacat

SEQ ID NO: 479969 - DNA, 16 bp, R. norvegicus
ataatatatatgtaca

SEQ ID NO: 479970 - DNA, 16 bp, R. norvegicus
ataatatgataaaaca

SEQ ID NO: 479971 - DNA, 16 bp, R. norvegicus
ataatcacagtcaaag

SEQ ID NO: 479972 - DNA, 16 bp, R. norvegicus
ataatccagacatttt

SEQ ID NO: 479973 - DNA, 16 bp, R. norvegicus
ataatcccagcactca

SEQ ID NO: 479974 - DNA, 53 bp, R. norvegicus
ataatcccatgcatgctatcggaccaccacggcctaaaactggtcttcaataa

SEQ ID NO: 479975 - DNA, 16 bp, R. norvegicus
ataatctactacataa

SEQ ID NO: 479976 - DNA, 16 bp, R. norvegicus
ataatctcacatacaa

SEQ ID NO: 479977 - DNA, 16 bp, R. norvegicus
ataatcttagcactca

SEQ ID NO: 479978 - DNA, 16 bp, R. norvegicus
ataatgaaaatatggt

SEQ ID NO: 479979 - DNA, 16 bp, R. norvegicus
ataatgaattcttttg

SEQ ID NO: 479980 - DNA, 16 bp, R. norvegicus
ataatgacatcatcct

SEQ ID NO: 479981 - DNA, 16 bp, R. norvegicus
ataatgagaccctatc

SEQ ID NO: 479982 - DNA, 16 bp, R. norvegicus
ataatgaggaggagga

SEQ ID NO: 479983 - DNA, 16 bp, R. norvegicus
ataatgccacttcctg

SEQ ID NO: 479984 - DNA, 16 bp, R. norvegicus
ataatgcctctatctg

SEQ ID NO: 479985 - DNA, 16 bp, R. norvegicus
ataatggaagagtgtt

SEQ ID NO: 479986 - DNA, 16 bp, R. norvegicus
ataatggaatctgatg

SEQ ID NO: 479987 - DNA, 16 bp, R. norvegicus
ataatgtatgatatat

SEQ ID NO: 479988 - DNA, 16 bp, R. norvegicus
ataatgtttaaaatgt

SEQ ID NO: 479989 - DNA, 16 bp, R. norvegicus
ataattcagctcaaaa

SEQ ID NO: 479990 - DNA, 18 bp, R. norvegicus
ataatttggagaaacctc

SEQ ID NO: 479991 - DNA, 16 bp, R. norvegicus
ataattttctgaattt

SEQ ID NO: 479992 - DNA, 16 bp, R. norvegicus
ataattttctgaggaa

SEQ ID NO: 479993 - DNA, 16 bp, R. norvegicus
ataattttgatgaaga

SEQ ID NO: 479994 - DNA, 16 bp, R. norvegicus
ataattttgttgaaaa

SEQ ID NO: 479995 - DNA, 16 bp, R. norvegicus
ataatttttaaagtgt

SEQ ID NO: 479996 - DNA, 16 bp, R. norvegicus
ataatttttggttgaa

SEQ ID NO: 479997 - DNA, 16 bp, R. norvegicus
atacaaatcatcacaa

SEQ ID NO: 479998 - DNA, 16 bp, R. norvegicus
atacaagaaaactgaa

SEQ ID NO: 479999 - DNA, 16 bp, R. norvegicus
atacaagaatattgaa

SEQ ID NO: 480000 - DNA, 16 bp, R. norvegicus
atacaatagaaaacat

SEQ ID NO: 480001 - DNA, 16 bp, R. norvegicus
atacaatatattttga

SEQ ID NO: 480002 - DNA, 16 bp, R. norvegicus
atacacacacacctac

SEQ ID NO: 480003 - DNA, 16 bp, R. norvegicus
atacacacacagaggc

SEQ ID NO: 480004 - DNA, 16 bp, R. norvegicus
atacacacatacacag

SEQ ID NO: 480005 - DNA, 16 bp, R. norvegicus
atacacacatacatac

SEQ ID NO: 480006 - DNA, 16 bp, R. norvegicus
atacacacatgcactc

SEQ ID NO: 480007 - DNA, 16 bp, R. norvegicus
atacacactacataca

SEQ ID NO: 480008 - DNA, 16 bp, R. norvegicus
atacacagtcactttg

SEQ ID NO: 480009 - DNA, 16 bp, R. norvegicus
atacacagtgtgtgtg

SEQ ID NO: 480010 - DNA, 16 bp, R. norvegicus
atacacatatatgtat

SEQ ID NO: 480011 - DNA, 16 bp, R. norvegicus
atacacatattcacat

SEQ ID NO: 480012 - DNA, 16 bp, R. norvegicus
atacacatggacaaac

SEQ ID NO: 480013 - DNA, 16 bp, R. norvegicus
atacacatgtataaaa

SEQ ID NO: 480014 - DNA, 16 bp, R. norvegicus
atacaccaacacacct

SEQ ID NO: 480015 - DNA, 16 bp, R. norvegicus
atacacctgcctctgc

SEQ ID NO: 480016 - DNA, 16 bp, R. norvegicus
atacacgggctggacc

SEQ ID NO: 480017 - DNA, 16 bp, R. norvegicus
atacactagctggtct

SEQ ID NO: 480018 - DNA, 16 bp, R. norvegicus
atacactgaaactaat

SEQ ID NO: 480019 - DNA, 16 bp, R. norvegicus
atacacttggacttga

SEQ ID NO: 480020 - DNA, 16 bp, R. norvegicus
atacacttgtaatccc

SEQ ID NO: 480021 - DNA, 16 bp, R. norvegicus
atacagaaagcacaaa

SEQ ID NO: 480022 - DNA, 16 bp, R. norvegicus
atacagaaatccatca

SEQ ID NO: 480023 - DNA, 16 bp, R. norvegicus
atacagacacaaagag

SEQ ID NO: 480024 - DNA, 16 bp, R. norvegicus
atacagacagccagtt

SEQ ID NO: 480025 - DNA, 16 bp, R. norvegicus
atacagacatatatac

SEQ ID NO: 480026 - DNA, 40 bp, R. norvegicus
atacagaccctaagagaacacaaatgccagcccaggttaa

SEQ ID NO: 480027 - DNA, 47 bp, R. norvegicus
atacagaccctaagagaacacaaatgccagcccaggttactgtatcc

SEQ ID NO: 480028 - DNA, 16 bp, R. norvegicus
atacagagagagagag

SEQ ID NO: 480029 - DNA, 16 bp, R. norvegicus
atacagagtggaatct

SEQ ID NO: 480030 - DNA, 16 bp, R. norvegicus
atacagatgctcacag

SEQ ID NO: 480031 - DNA, 16 bp, R. norvegicus
atacagcaagttcaag

SEQ ID NO: 480032 - DNA, 16 bp, R. norvegicus
atacagcagaggatgg

SEQ ID NO: 480033 - DNA, 16 bp, R. norvegicus
atacagccaccaaact

SEQ ID NO: 480034 - DNA, 17 bp, R. norvegicus
atacagccacctaatta

SEQ ID NO: 480035 - DNA, 16 bp, R. norvegicus
atacagctaccaaacc

SEQ ID NO: 480036 - DNA, 16 bp, R. norvegicus
atacaggaacctagga

SEQ ID NO: 480037 - DNA, 16 bp, R. norvegicus
atacaggagaaaaacc

SEQ ID NO: 480038 - DNA, 16 bp, R. norvegicus
atacagggacaaatag

SEQ ID NO: 480039 - DNA, 16 bp, R. norvegicus
atacaggtgaggggca

SEQ ID NO: 480040 - DNA, 16 bp, R. norvegicus
atacagtgagttccaa

SEQ ID NO: 480041 - DNA, 16 bp, R. norvegicus
atacataaaagaagcc

SEQ ID NO: 480042 - DNA, 16 bp, R. norvegicus
atacataaaagaatcc

SEQ ID NO: 480043 - DNA, 16 bp, R. norvegicus
atacataatgcacaca

SEQ ID NO: 480044 - DNA, 16 bp, R. norvegicus
atacatacacacctac

SEQ ID NO: 480045 - DNA, 16 bp, R. norvegicus
atacatacacagacac

SEQ ID NO: 480046 - DNA, 16 bp, R. norvegicus
atacatacacattttt

SEQ ID NO: 480047 - DNA, 16 bp, R. norvegicus
atacatacaggcaaaa

SEQ ID NO: 480048 - DNA, 16 bp, R. norvegicus
atacatacatacacag

SEQ ID NO: 480049 - DNA, 17 bp, R. norvegicus
atacatacatacataca

SEQ ID NO: 480050 - DNA, 16 bp, R. norvegicus
atacatacatacatat

SEQ ID NO: 480051 - DNA, 16 bp, R. norvegicus
atacatacatatacac

SEQ ID NO: 480052 - DNA, 16 bp, R. norvegicus
atacatacatatatat

SEQ ID NO: 480053 - DNA, 16 bp, R. norvegicus
atacatacatatgtat

SEQ ID NO: 480054 - DNA, 16 bp, R. norvegicus
atacatagatgataga

SEQ ID NO: 480055 - DNA, 16 bp, R. norvegicus
atacatataagcaaaa

SEQ ID NO: 480056 - DNA, 16 bp, R. norvegicus
atacatatatatttct

SEQ ID NO: 480057 - DNA, 16 bp, R. norvegicus
atacatatatgtgtat

SEQ ID NO: 480058 - DNA, 16 bp, R. norvegicus
atacatattttattgg

SEQ ID NO: 480059 - DNA, 16 bp, R. norvegicus
atacatcagctgagat

SEQ ID NO: 480060 - DNA, 16 bp, R. norvegicus
atacatgaaagaaacc

SEQ ID NO: 480061 - DNA, 16 bp, R. norvegicus
atacatgcacacgcac

SEQ ID NO: 480062 - DNA, 16 bp, R. norvegicus
atacatgcaggccaaa

SEQ ID NO: 480063 - DNA, 16 bp, R. norvegicus
atacatgcatatatat

SEQ ID NO: 480064 - DNA, 16 bp, R. norvegicus
atacatgtaaatatat

SEQ ID NO: 480065 - DNA, 16 bp, R. norvegicus
atacatgtacacaaac

SEQ ID NO: 480066 - DNA, 16 bp, R. norvegicus
atacatgtacatgtat

SEQ ID NO: 480067 - DNA, 16 bp, R. norvegicus
atacatgtgaaataaa

SEQ ID NO: 480068 - DNA, 16 bp, R. norvegicus
atacatgtgcatgtat

SEQ ID NO: 480069 - DNA, 16 bp, R. norvegicus
atacattgtgtacatg

SEQ ID NO: 480070 - DNA, 16 bp, R. norvegicus
ataccaagaagcactt

SEQ ID NO: 480071 - DNA, 16 bp, R. norvegicus
ataccaatggctcagg

SEQ ID NO: 480072 - DNA, 16 bp, R. norvegicus
ataccacaaagtcaca

SEQ ID NO: 480073 - DNA, 16 bp, R. norvegicus
ataccaccctgagtga

SEQ ID NO: 480074 - DNA, 16 bp, R. norvegicus
ataccagaagaggaca

SEQ ID NO: 480075 - DNA, 16 bp, R. norvegicus
ataccagcaaccacat

SEQ ID NO: 480076 - DNA, 16 bp, R. norvegicus
ataccagtctcctgtc

SEQ ID NO: 480077 - DNA, 16 bp, R. norvegicus
ataccatttaaaatgt

SEQ ID NO: 480078 - DNA, 16 bp, R. norvegicus
atacccaaaagatgcg

SEQ ID NO: 480079 - DNA, 16 bp, R. norvegicus
atacccaggaatggta

SEQ ID NO: 480080 - DNA, 16 bp, R. norvegicus
atacccctccccctgc

SEQ ID NO: 480081 - DNA, 16 bp, R. norvegicus
atacccctgcctcagc

SEQ ID NO: 480082 - DNA, 16 bp, R. norvegicus
ataccctcttctggcc

SEQ ID NO: 480083 - DNA, 17 bp, R. norvegicus
atacccttggcagggaa

SEQ ID NO: 480084 - DNA, 16 bp, R. norvegicus
atacccttttgtttta

SEQ ID NO: 480085 - DNA, 17 bp, R. norvegicus
ataccgaattccttcta

SEQ ID NO: 480086 - DNA, 16 bp, R. norvegicus
atacctcactctcatc

SEQ ID NO: 480087 - DNA, 16 bp, R. norvegicus
atacctcagagacaaa

SEQ ID NO: 480088 - DNA, 16 bp, R. norvegicus
atacctcattagcatg

SEQ ID NO: 480089 - DNA, 16 bp, R. norvegicus
atacctgacaagaaac

SEQ ID NO: 480090 - DNA, 16 bp, R. norvegicus
atactaactctcagca

SEQ ID NO: 480091 - DNA, 16 bp, R. norvegicus
atactacccagctatt

SEQ ID NO: 480092 - DNA, 16 bp, R. norvegicus
atactatacatataca

SEQ ID NO: 480093 - DNA, 16 bp, R. norvegicus
atactatgtatgtcct

SEQ ID NO: 480094 - DNA, 16 bp, R. norvegicus
atactcaggtgatttc

SEQ ID NO: 480095 - DNA, 16 bp, R. norvegicus
atactcatggactacc

SEQ ID NO: 480096 - DNA, 16 bp, R. norvegicus
atactcatttttaaaa

SEQ ID NO: 480097 - DNA, 16 bp, R. norvegicus
atactccaaatacaag

SEQ ID NO: 480098 - DNA, 16 bp, R. norvegicus
atactccattgtataa

SEQ ID NO: 480099 - DNA, 16 bp, R. norvegicus
atactcccactcccac

SEQ ID NO: 480100 - DNA, 16 bp, R. norvegicus
atactcctcagctgag

SEQ ID NO: 480101 - DNA, 16 bp, R. norvegicus
atactgcaaaactctc

SEQ ID NO: 480102 - DNA, 16 bp, R. norvegicus
atactggaaacctagc

SEQ ID NO: 480103 - DNA, 16 bp, R. norvegicus
atactgggcctggctt

SEQ ID NO: 480104 - DNA, 16 bp, R. norvegicus
atactgtcttcagaca

SEQ ID NO: 480105 - DNA, 16 bp, R. norvegicus
atactgtttaaatttg

SEQ ID NO: 480106 - DNA, 16 bp, R. norvegicus
atacttgcaaaccaaa

SEQ ID NO: 480107 - DNA, 16 bp, R. norvegicus
atactttaaaaaatga

SEQ ID NO: 480108 - DNA, 16 bp, R. norvegicus
atagaaaacattgaca

SEQ ID NO: 480109 - DNA, 16 bp, R. norvegicus
atagaaaatatcaaca

SEQ ID NO: 480110 - DNA, 16 bp, R. norvegicus
atagaaaatatcatcc

SEQ ID NO: 480111 - DNA, 16 bp, R. norvegicus
atagaaaatattatcc

SEQ ID NO: 480112 - DNA, 16 bp, R. norvegicus
atagaaacttgaagca

SEQ ID NO: 480113 - DNA, 16 bp, R. norvegicus
atagaaagttccagaa

SEQ ID NO: 480114 - DNA, 16 bp, R. norvegicus
atagaaatcattgagt

SEQ ID NO: 480115 - DNA, 16 bp, R. norvegicus
atagaaatggctaaga

SEQ ID NO: 480116 - DNA, 16 bp, R. norvegicus
atagaacatttcatct

SEQ ID NO: 480117 - DNA, 16 bp, R. norvegicus
atagaactctcagcta

SEQ ID NO: 480118 - DNA, 16 bp, R. norvegicus
atagaactcttggctc

SEQ ID NO: 480119 - DNA, 16 bp, R. norvegicus
atagaagaaaatgttc

SEQ ID NO: 480120 - DNA, 16 bp, R. norvegicus
atagaagaaaatttcc

SEQ ID NO: 480121 - DNA, 16 bp, R. norvegicus
atagaagaaagggttt

SEQ ID NO: 480122 - DNA, 16 bp, R. norvegicus
atagaagaagaactag

SEQ ID NO: 480123 - DNA, 16 bp, R. norvegicus
atagaagacctcaaag

SEQ ID NO: 480124 - DNA, 16 bp, R. norvegicus
atagaagacctcctac

SEQ ID NO: 480125 - DNA, 16 bp, R. norvegicus
atagaagagaaaaatc

SEQ ID NO: 480126 - DNA, 16 bp, R. norvegicus
atagaagagaaaattt

SEQ ID NO: 480127 - DNA, 16 bp, R. norvegicus
atagaagagaaagcag

SEQ ID NO: 480128 - DNA, 16 bp, R. norvegicus
atagaagagaaattga

SEQ ID NO: 480129 - DNA, 17 bp, R. norvegicus
atagaaggggatatgga

SEQ ID NO: 480130 - DNA, 16 bp, R. norvegicus
atagaatagtttattt

SEQ ID NO: 480131 - DNA, 16 bp, R. norvegicus
atagaatctgaagaaa

SEQ ID NO: 480132 - DNA, 16 bp, R. norvegicus
atagaatttttttctt

SEQ ID NO: 480133 - DNA, 16 bp, R. norvegicus
atagacaaactcaaag

SEQ ID NO: 480134 - DNA, 16 bp, R. norvegicus
atagacacacacacag

SEQ ID NO: 480135 - DNA, 16 bp, R. norvegicus
atagacacacacagac

SEQ ID NO: 480136 - DNA, 16 bp, R. norvegicus
atagacagacttcttc

SEQ ID NO: 480137 - DNA, 16 bp, R. norvegicus
atagacaggaaaccag

SEQ ID NO: 480138 - DNA, 16 bp, R. norvegicus
atagacatttttattt

SEQ ID NO: 480139 - DNA, 16 bp, R. norvegicus
atagaccccagagttc

SEQ ID NO: 480140 - DNA, 16 bp, R. norvegicus
atagagaaaatatggt

SEQ ID NO: 480141 - DNA, 16 bp, R. norvegicus
atagagaatctcagga

SEQ ID NO: 480142 - DNA, 16 bp, R. norvegicus
atagagaggggaacac

SEQ ID NO: 480143 - DNA, 16 bp, R. norvegicus
atagagatggagaagg

SEQ ID NO: 480144 - DNA, 16 bp, R. norvegicus
atagaggggctggaga

SEQ ID NO: 480145 - DNA, 16 bp, R. norvegicus
atagagtactactcag

SEQ ID NO: 480146 - DNA, 16 bp, R. norvegicus
atagataaacacttag

SEQ ID NO: 480147 - DNA, 16 bp, R. norvegicus
atagataaacccatag

SEQ ID NO: 480148 - DNA, 16 bp, R. norvegicus
atagataaggatattg

SEQ ID NO: 480149 - DNA, 16 bp, R. norvegicus
atagatacagaaaaat

SEQ ID NO: 480150 - DNA, 19 bp, R. norvegicus
atagatacatagatacata

SEQ ID NO: 480151 - DNA, 16 bp, R. norvegicus
atagatagatatacat

SEQ ID NO: 480152 - DNA, 16 bp, R. norvegicus
atagatgacatagata

SEQ ID NO: 480153 - DNA, 16 bp, R. norvegicus
atagatgactgtgagc

SEQ ID NO: 480154 - DNA, 16 bp, R. norvegicus
atagatgatgatgata

SEQ ID NO: 480155 - DNA, 16 bp, R. norvegicus
atagatgcaagcatta

SEQ ID NO: 480156 - DNA, 16 bp, R. norvegicus
atagatgcatagatag

SEQ ID NO: 480157 - DNA, 16 bp, R. norvegicus
atagatggagaaaatg

SEQ ID NO: 480158 - DNA, 16 bp, R. norvegicus
atagatgtggatgctc

SEQ ID NO: 480159 - DNA, 16 bp, R. norvegicus
atagatttagaggatt

SEQ ID NO: 480160 - DNA, 16 bp, R. norvegicus
atagatttgtggccat

SEQ ID NO: 480161 - DNA, 16 bp, R. norvegicus
atagattttgttctct

SEQ ID NO: 480162 - DNA, 17 bp, R. norvegicus
atagcaaatgctggcga

SEQ ID NO: 480163 - DNA, 16 bp, R. norvegicus
atagcaacaacaacaa

SEQ ID NO: 480164 - DNA, 16 bp, R. norvegicus
atagcaagccctggat

SEQ ID NO: 480165 - DNA, 16 bp, R. norvegicus
atagcaattctcctgc

SEQ ID NO: 480166 - DNA, 16 bp, R. norvegicus
atagcacatgtgtgga

SEQ ID NO: 480167 - DNA, 16 bp, R. norvegicus
atagcagcaacaacaa

SEQ ID NO: 480168 - DNA, 16 bp, R. norvegicus
atagcagtggttctca

SEQ ID NO: 480169 - DNA, 16 bp, R. norvegicus
atagctaagatcaata

SEQ ID NO: 480170 - DNA, 16 bp, R. norvegicus
atagctggatccccag

SEQ ID NO: 480171 - DNA, 22 bp, R. norvegicus
atagctggatcctcaggtagtg

SEQ ID NO: 480172 - DNA, 16 bp, R. norvegicus
atagctgggaagaaga

SEQ ID NO: 480173 - DNA, 16 bp, R. norvegicus
atagctgggtcctcgg

SEQ ID NO: 480174 - DNA, 16 bp, R. norvegicus
atagctgtctcctaag

SEQ ID NO: 480175 - DNA, 16 bp, R. norvegicus
atagctgtgttctcag

SEQ ID NO: 480176 - DNA, 16 bp, R. norvegicus
ataggaaaaacagcaa

SEQ ID NO: 480177 - DNA, 16 bp, R. norvegicus
ataggaagaacaacat

SEQ ID NO: 480178 - DNA, 16 bp, R. norvegicus
ataggacaaggggatg

SEQ ID NO: 480179 - DNA, 16 bp, R. norvegicus
ataggagtggtcttgt

SEQ ID NO: 480180 - DNA, 16 bp, R. norvegicus
ataggcaagcattcta

SEQ ID NO: 480181 - DNA, 16 bp, R. norvegicus
ataggcagatagatga

SEQ ID NO: 480182 - DNA, 16 bp, R. norvegicus
ataggcataaaagaag

SEQ ID NO: 480183 - DNA, 20 bp, R. norvegicus
ataggctagctatggaggat

SEQ ID NO: 480184 - DNA, 16 bp, R. norvegicus
ataggggctggagaga

SEQ ID NO: 480185 - DNA, 16 bp, R. norvegicus
ataggtgttccttctg

SEQ ID NO: 480186 - DNA, 16 bp, R. norvegicus
atagtagcacccagca

SEQ ID NO: 480187 - DNA, 16 bp, R. norvegicus
atagtatgtttaagtg

SEQ ID NO: 480188 - DNA, 16 bp, R. norvegicus
atagtcaacaaaatta

SEQ ID NO: 480189 - DNA, 26 bp, R. norvegicus
atagtgacagcctgtctgcatgaccc

SEQ ID NO: 480190 - DNA, 16 bp, R. norvegicus
atagtgagttccagga

SEQ ID NO: 480191 - DNA, 16 bp, R. norvegicus
atagtgataaaaacaa

SEQ ID NO: 480192 - DNA, 16 bp, R. norvegicus
atagtgatatgttgac

SEQ ID NO: 480193 - DNA, 16 bp, R. norvegicus
atagtgatgatgatga

SEQ ID NO: 480194 - DNA, 16 bp, R. norvegicus
atagtgccaccagctg

SEQ ID NO: 480195 - DNA, 16 bp, R. norvegicus
atagtgtcacttgggt

SEQ ID NO: 480196 - DNA, 16 bp, R. norvegicus
atagttcaatcctgaa

SEQ ID NO: 480197 - DNA, 16 bp, R. norvegicus
atagttctttttgtct

SEQ ID NO: 480198 - DNA, 16 bp, R. norvegicus
atagtttggacagtac

SEQ ID NO: 480199 - DNA, 16 bp, R. norvegicus
atagttttaaatcaag

SEQ ID NO: 480200 - DNA, 16 bp, R. norvegicus
atagttttgaaatatt

SEQ ID NO: 480201 - DNA, 16 bp, R. norvegicus
atataaaaaatgtggt

SEQ ID NO: 480202 - DNA, 16 bp, R. norvegicus
atataaacagactcaa

SEQ ID NO: 480203 - DNA, 16 bp, R. norvegicus
atataaacatgcatac

SEQ ID NO: 480204 - DNA, 16 bp, R. norvegicus
atataaagaagtcaag

SEQ ID NO: 480205 - DNA, 16 bp, R. norvegicus
atataaatgtatacac

SEQ ID NO: 480206 - DNA, 16 bp, R. norvegicus
atataaattcagcctt

SEQ ID NO: 480207 - DNA, 16 bp, R. norvegicus
atataacagagacaca

SEQ ID NO: 480208 - DNA, 16 bp, R. norvegicus
atataagcacactgtc

SEQ ID NO: 480209 - DNA, 16 bp, R. norvegicus
atataattgcccattt

SEQ ID NO: 480210 - DNA, 16 bp, R. norvegicus
atatacaaagaacaca

SEQ ID NO: 480211 - DNA, 16 bp, R. norvegicus
atatacaaagaactta

SEQ ID NO: 480212 - DNA, 16 bp, R. norvegicus
atatacaaatatgtat

SEQ ID NO: 480213 - DNA, 16 bp, R. norvegicus
atatacacacaaagaa

SEQ ID NO: 480214 - DNA, 16 bp, R. norvegicus
atatacacacaagcaa

SEQ ID NO: 480215 - DNA, 16 bp, R. norvegicus
atatacacacataaat

SEQ ID NO: 480216 - DNA, 16 bp, R. norvegicus
atatacacacatgcac

SEQ ID NO: 480217 - DNA, 16 bp, R. norvegicus
atatacacagatatat

SEQ ID NO: 480218 - DNA, 16 bp, R. norvegicus
atatacacatacatat

SEQ ID NO: 480219 - DNA, 16 bp, R. norvegicus
atatacacatatacat

SEQ ID NO: 480220 - DNA, 16 bp, R. norvegicus
atatacacattacata

SEQ ID NO: 480221 - DNA, 16 bp, R. norvegicus
atatacagacatacac

SEQ ID NO: 480222 - DNA, 16 bp, R. norvegicus
atatacagatatattt

SEQ ID NO: 480223 - DNA, 16 bp, R. norvegicus
atatacagcaaaccaa

SEQ ID NO: 480224 - DNA, 18 bp, R. norvegicus
atatacagcaaaccagta

SEQ ID NO: 480225 - DNA, 16 bp, R. norvegicus
atatacagcaaaccat

SEQ ID NO: 480226 - DNA, 16 bp, R. norvegicus
atatacatatatatgt

SEQ ID NO: 480227 - DNA, 16 bp, R. norvegicus
atatacatgtacatgt

SEQ ID NO: 480228 - DNA, 17 bp, R. norvegicus
atatacccaaaagatgt

SEQ ID NO: 480229 - DNA, 16 bp, R. norvegicus
atatacccaaatggtg

SEQ ID NO: 480230 - DNA, 16 bp, R. norvegicus
atatacccacaaggtg

SEQ ID NO: 480231 - DNA, 16 bp, R. norvegicus
atatactcaaatgatg

SEQ ID NO: 480232 - DNA, 16 bp, R. norvegicus
atatactctttggttg

SEQ ID NO: 480233 - DNA, 16 bp, R. norvegicus
atatactgtataaaaa

SEQ ID NO: 480234 - DNA, 16 bp, R. norvegicus
atatagaaaatgtggc

SEQ ID NO: 480235 - DNA, 16 bp, R. norvegicus
atatagaagagaaggg

SEQ ID NO: 480236 - DNA, 16 bp, R. norvegicus
atatagaaggggagga

SEQ ID NO: 480237 - DNA, 16 bp, R. norvegicus
atatagatacacacac

SEQ ID NO: 480238 - DNA, 16 bp, R. norvegicus
atatagatatagacag

SEQ ID NO: 480239 - DNA, 16 bp, R. norvegicus
atatagatgatatata

SEQ ID NO: 480240 - DNA, 16 bp, R. norvegicus
atatagcagacacatg

SEQ ID NO: 480241 - DNA, 16 bp, R. norvegicus
atatagcagaggatgg

SEQ ID NO: 480242 - DNA, 16 bp, R. norvegicus
atatagtaccctgggc

SEQ ID NO: 480243 - DNA, 16 bp, R. norvegicus
atatataaaagaactc

SEQ ID NO: 480244 - DNA, 16 bp, R. norvegicus
atatatacatacatgt

SEQ ID NO: 480245 - DNA, 16 bp, R. norvegicus
atatatacatatgtaa

SEQ ID NO: 480246 - DNA, 16 bp, R. norvegicus
atatatacatatgtac

SEQ ID NO: 480247 - DNA, 16 bp, R. norvegicus
atatatacatatgtat

SEQ ID NO: 480248 - DNA, 16 bp, R. norvegicus
atatatacatgaaaat

SEQ ID NO: 480249 - DNA, 16 bp, R. norvegicus
atatatacatgtatat

SEQ ID NO: 480250 - DNA, 16 bp, R. norvegicus
atatataccaaaacta

SEQ ID NO: 480251 - DNA, 16 bp, R. norvegicus
atatatagagatatat

SEQ ID NO: 480252 - DNA, 16 bp, R. norvegicus
atatatagagggtcag

SEQ ID NO: 480253 - DNA, 16 bp, R. norvegicus
atatatagtcttttgg

SEQ ID NO: 480254 - DNA, 17 bp, R. norvegicus
atatatatagagagaga

SEQ ID NO: 480255 - DNA, 16 bp, R. norvegicus
atatatatatacagcc

SEQ ID NO: 480256 - DNA, 16 bp, R. norvegicus
atatatatatacatgt

SEQ ID NO: 480257 - DNA, 16 bp, R. norvegicus
atatatatatagtaag

SEQ ID NO: 480258 - DNA, 16 bp, R. norvegicus
atatatatatatatgc

SEQ ID NO: 480259 - DNA, 16 bp, R. norvegicus
atatatatatatatgg

SEQ ID NO: 480260 - DNA, 16 bp, R. norvegicus
atatatatattacttg

SEQ ID NO: 480261 - DNA, 16 bp, R. norvegicus
atatatatattcttca

SEQ ID NO: 480262 - DNA, 16 bp, R. norvegicus
atatatatattttcca

SEQ ID NO: 480263 - DNA, 16 bp, R. norvegicus
atatatatgaacatat

SEQ ID NO: 480264 - DNA, 16 bp, R. norvegicus
atatatatgcaagtat

SEQ ID NO: 480265 - DNA, 16 bp, R. norvegicus
atatatatgtataatg

SEQ ID NO: 480266 - DNA, 16 bp, R. norvegicus
atatatatgtatgtat

SEQ ID NO: 480267 - DNA, 16 bp, R. norvegicus
atatatatgtggatat

SEQ ID NO: 480268 - DNA, 17 bp, R. norvegicus
atatatatgtgtatatg

SEQ ID NO: 480269 - DNA, 16 bp, R. norvegicus
atatatatgtgtgtgt

SEQ ID NO: 480270 - DNA, 16 bp, R. norvegicus
atatatattcacattt

SEQ ID NO: 480271 - DNA, 16 bp, R. norvegicus
atatatattcctacat

SEQ ID NO: 480272 - DNA, 16 bp, R. norvegicus
atatatgaaatgtata

SEQ ID NO: 480273 - DNA, 16 bp, R. norvegicus
atatatgacatatata

SEQ ID NO: 480274 - DNA, 16 bp, R. norvegicus
atatatgatgagtaca

SEQ ID NO: 480275 - DNA, 16 bp, R. norvegicus
atatatgcaaaagacc

SEQ ID NO: 480276 - DNA, 16 bp, R. norvegicus
atatatgcaaaagatg

SEQ ID NO: 480277 - DNA, 16 bp, R. norvegicus
atatatgcaggcaaca

SEQ ID NO: 480278 - DNA, 16 bp, R. norvegicus
atatatgcatatttgt

SEQ ID NO: 480279 - DNA, 16 bp, R. norvegicus
atatatgtaaaaatgt

SEQ ID NO: 480280 - DNA, 16 bp, R. norvegicus
atatatgtacacatat

SEQ ID NO: 480281 - DNA, 16 bp, R. norvegicus
atatatgtacatatat

SEQ ID NO: 480282 - DNA, 16 bp, R. norvegicus
atatatgtatatatac

SEQ ID NO: 480283 - DNA, 16 bp, R. norvegicus
atatatgtatatctta

SEQ ID NO: 480284 - DNA, 16 bp, R. norvegicus
atatatgtatgtgtgt

SEQ ID NO: 480285 - DNA, 16 bp, R. norvegicus
atatatgtgtatatat

SEQ ID NO: 480286 - DNA, 16 bp, R. norvegicus
atatatgtgtgtctgt

SEQ ID NO: 480287 - DNA, 16 bp, R. norvegicus
atatatgtgtgtgtta

SEQ ID NO: 480288 - DNA, 16 bp, R. norvegicus
atatattacatgtata

SEQ ID NO: 480289 - DNA, 16 bp, R. norvegicus
atatattctatacttc

SEQ ID NO: 480290 - DNA, 16 bp, R. norvegicus
atatatttctatatgt

SEQ ID NO: 480291 - DNA, 16 bp, R. norvegicus
atatatttgcattctt

SEQ ID NO: 480292 - DNA, 16 bp, R. norvegicus
atatattttattgcat

SEQ ID NO: 480293 - DNA, 16 bp, R. norvegicus
atatcaaagaaaatca

SEQ ID NO: 480294 - DNA, 16 bp, R. norvegicus
atatcaaagcaaaaat

SEQ ID NO: 480295 - DNA, 16 bp, R. norvegicus
atatcaatgaactcaa

SEQ ID NO: 480296 - DNA, 16 bp, R. norvegicus
atatcaatgctccaaa

SEQ ID NO: 480297 - DNA, 16 bp, R. norvegicus
atatcacaaagggaga

SEQ ID NO: 480298 - DNA, 16 bp, R. norvegicus
atatcacctcacacca

SEQ ID NO: 480299 - DNA, 16 bp, R. norvegicus
atatcagcagcaagaa

SEQ ID NO: 480300 - DNA, 16 bp, R. norvegicus
atatcagcctgagtga

SEQ ID NO: 480301 - DNA, 16 bp, R. norvegicus
atatcagtgaacagta

SEQ ID NO: 480302 - DNA, 16 bp, R. norvegicus
atatcatatcatataa

SEQ ID NO: 480303 - DNA, 16 bp, R. norvegicus
atatcatctgtgaata

SEQ ID NO: 480304 - DNA, 16 bp, R. norvegicus
atatcatgctgaatga

SEQ ID NO: 480305 - DNA, 16 bp, R. norvegicus
atatcatgttttaatt

SEQ ID NO: 480306 - DNA, 16 bp, R. norvegicus
atatcatttgaaattt

SEQ ID NO: 480307 - DNA, 16 bp, R. norvegicus
atatcattttcaaata

SEQ ID NO: 480308 - DNA, 16 bp, R. norvegicus
atatccaaagaactca

SEQ ID NO: 480309 - DNA, 16 bp, R. norvegicus
atatccagtgtttgct

SEQ ID NO: 480310 - DNA, 16 bp, R. norvegicus
atatccatatccatat

SEQ ID NO: 480311 - DNA, 16 bp, R. norvegicus
atatccctgggatgaa

SEQ ID NO: 480312 - DNA, 16 bp, R. norvegicus
atatcctctgcaaata

SEQ ID NO: 480313 - DNA, 16 bp, R. norvegicus
atatcctgccactttg

SEQ ID NO: 480314 - DNA, 16 bp, R. norvegicus
atatcctgcttatcag

SEQ ID NO: 480315 - DNA, 17 bp, R. norvegicus
atatccttgggagggaa

SEQ ID NO: 480316 - DNA, 16 bp, R. norvegicus
atatctatatacaaat

SEQ ID NO: 480317 - DNA, 16 bp, R. norvegicus
atatctgcctgcatgc

SEQ ID NO: 480318 - DNA, 16 bp, R. norvegicus
atatctgtgttttctg

SEQ ID NO: 480319 - DNA, 16 bp, R. norvegicus
atatcttgaaaattat

SEQ ID NO: 480320 - DNA, 16 bp, R. norvegicus
atatcttggggcacta

SEQ ID NO: 480321 - DNA, 16 bp, R. norvegicus
atatcttggtttcctc

SEQ ID NO: 480322 - DNA, 16 bp, R. norvegicus
atatctttaaaaaaga

SEQ ID NO: 480323 - DNA, 16 bp, R. norvegicus
atatctttcctcctca

SEQ ID NO: 480324 - DNA, 16 bp, R. norvegicus
atatctttctctgatt

SEQ ID NO: 480325 - DNA, 16 bp, R. norvegicus
atatgaaaaaaatctt

SEQ ID NO: 480326 - DNA, 16 bp, R. norvegicus
atatgaaaatccacca

SEQ ID NO: 480327 - DNA, 16 bp, R. norvegicus
atatgaaactcaagaa

SEQ ID NO: 480328 - DNA, 16 bp, R. norvegicus
atatgaaagaaaacat

SEQ ID NO: 480329 - DNA, 16 bp, R. norvegicus
atatgaaatccaagaa

SEQ ID NO: 480330 - DNA, 16 bp, R. norvegicus
atatgaacaaactcaa

SEQ ID NO: 480331 - DNA, 16 bp, R. norvegicus
atatgaacaatgccaa

SEQ ID NO: 480332 - DNA, 16 bp, R. norvegicus
atatgaacttacagag

SEQ ID NO: 480333 - DNA, 16 bp, R. norvegicus
atatgaacttcaagac

SEQ ID NO: 480334 - DNA, 16 bp, R. norvegicus
atatgaagaatcaaca

SEQ ID NO: 480335 - DNA, 16 bp, R. norvegicus
atatgaagacaaaatt

SEQ ID NO: 480336 - DNA, 16 bp, R. norvegicus
atatgaagttatgttt

SEQ ID NO: 480337 - DNA, 16 bp, R. norvegicus
atatgaatgtgtgtgt

SEQ ID NO: 480338 - DNA, 16 bp, R. norvegicus
atatgagagaaaacat

SEQ ID NO: 480339 - DNA, 16 bp, R. norvegicus
atatgagttaatttta

SEQ ID NO: 480340 - DNA, 16 bp, R. norvegicus
atatgatagatatata

SEQ ID NO: 480341 - DNA, 16 bp, R. norvegicus
atatgatgaagaaact

SEQ ID NO: 480342 - DNA, 16 bp, R. norvegicus
atatgatgtatatgca

SEQ ID NO: 480343 - DNA, 16 bp, R. norvegicus
atatgattttgaaagt

SEQ ID NO: 480344 - DNA, 16 bp, R. norvegicus
atatgcaaatacatat

SEQ ID NO: 480345 - DNA, 16 bp, R. norvegicus
atatgcaaatgtatat

SEQ ID NO: 480346 - DNA, 16 bp, R. norvegicus
atatgcaaattcactt

SEQ ID NO: 480347 - DNA, 16 bp, R. norvegicus
atatgcacacacagag

SEQ ID NO: 480348 - DNA, 16 bp, R. norvegicus
atatgcacactcacat

SEQ ID NO: 480349 - DNA, 22 bp, R. norvegicus
atatgcactcattgataagtgg

SEQ ID NO: 480350 - DNA, 16 bp, R. norvegicus
atatgcagaacactgt

SEQ ID NO: 480351 - DNA, 16 bp, R. norvegicus
atatgcagacaaaata

SEQ ID NO: 480352 - DNA, 16 bp, R. norvegicus
atatgcagccaccaaa

SEQ ID NO: 480353 - DNA, 16 bp, R. norvegicus
atatgcagccagcaaa

SEQ ID NO: 480354 - DNA, 16 bp, R. norvegicus
atatgcagctggaatc

SEQ ID NO: 480355 - DNA, 16 bp, R. norvegicus
atatgcagttgcagcc

SEQ ID NO: 480356 - DNA, 16 bp, R. norvegicus
atatgcatatatacat

SEQ ID NO: 480357 - DNA, 16 bp, R. norvegicus
atatgcatatatgtgt

SEQ ID NO: 480358 - DNA, 16 bp, R. norvegicus
atatgcccaagagtgt

SEQ ID NO: 480359 - DNA, 16 bp, R. norvegicus
atatgcctctgtgtgt

SEQ ID NO: 480360 - DNA, 16 bp, R. norvegicus
atatgcctgcctctgc

SEQ ID NO: 480361 - DNA, 16 bp, R. norvegicus
atatgccttcttctca

SEQ ID NO: 480362 - DNA, 16 bp, R. norvegicus
atatgctgccaccaaa

SEQ ID NO: 480363 - DNA, 16 bp, R. norvegicus
atatggaaaaacaaat

SEQ ID NO: 480364 - DNA, 16 bp, R. norvegicus
atatggaaatattttt

SEQ ID NO: 480365 - DNA, 16 bp, R. norvegicus
atatggaaatccatca

SEQ ID NO: 480366 - DNA, 16 bp, R. norvegicus
atatggaaattcatca

SEQ ID NO: 480367 - DNA, 16 bp, R. norvegicus
atatggaacacacaca

SEQ ID NO: 480368 - DNA, 16 bp, R. norvegicus
atatggaagattttgt

SEQ ID NO: 480369 - DNA, 16 bp, R. norvegicus
atatggacaatttcct

SEQ ID NO: 480370 - DNA, 16 bp, R. norvegicus
atatggacaattttct

SEQ ID NO: 480371 - DNA, 16 bp, R. norvegicus
atatggatatatatgt

SEQ ID NO: 480372 - DNA, 16 bp, R. norvegicus
atatgggaaggatccc

SEQ ID NO: 480373 - DNA, 16 bp, R. norvegicus
atatgggacaggctct

SEQ ID NO: 480374 - DNA, 16 bp, R. norvegicus
atatgggatggatccc

SEQ ID NO: 480375 - DNA, 16 bp, R. norvegicus
atatgggtctgttttc

SEQ ID NO: 480376 - DNA, 16 bp, R. norvegicus
atatggtatatattta

SEQ ID NO: 480377 - DNA, 16 bp, R. norvegicus
atatggtctctatagg

SEQ ID NO: 480378 - DNA, 16 bp, R. norvegicus
atatggtggattacat

SEQ ID NO: 480379 - DNA, 16 bp, R. norvegicus
atatggtggcagtggg

SEQ ID NO: 480380 - DNA, 16 bp, R. norvegicus
atatgtacaaacacac

SEQ ID NO: 480381 - DNA, 16 bp, R. norvegicus
atatgtacatatatgt

SEQ ID NO: 480382 - DNA, 16 bp, R. norvegicus
atatgtacatgtacat

SEQ ID NO: 480383 - DNA, 16 bp, R. norvegicus
atatgtagaagaggat

SEQ ID NO: 480384 - DNA, 16 bp, R. norvegicus
atatgtagcagaggat

SEQ ID NO: 480385 - DNA, 16 bp, R. norvegicus
atatgtatatatctgt

SEQ ID NO: 480386 - DNA, 16 bp, R. norvegicus
atatgtatatgtacat

SEQ ID NO: 480387 - DNA, 16 bp, R. norvegicus
atatgtatatgtgtat

SEQ ID NO: 480388 - DNA, 16 bp, R. norvegicus
atatgtatattcatat

SEQ ID NO: 480389 - DNA, 16 bp, R. norvegicus
atatgtatctctgtgt

SEQ ID NO: 480390 - DNA, 17 bp, R. norvegicus
atatgtatgagccacat

SEQ ID NO: 480391 - DNA, 16 bp, R. norvegicus
atatgtatgtatatat

SEQ ID NO: 480392 - DNA, 16 bp, R. norvegicus
atatgtatgtttgtgt

SEQ ID NO: 480393 - DNA, 16 bp, R. norvegicus
atatgtatttatgtgt

SEQ ID NO: 480394 - DNA, 16 bp, R. norvegicus
atatgtctcaaaaaaa

SEQ ID NO: 480395 - DNA, 16 bp, R. norvegicus
atatgtctgtatgtgt

SEQ ID NO: 480396 - DNA, 16 bp, R. norvegicus
atatgtgcaggggacc

SEQ ID NO: 480397 - DNA, 16 bp, R. norvegicus
atatgtggatatatgt

SEQ ID NO: 480398 - DNA, 16 bp, R. norvegicus
atatgtggctgaagcc

SEQ ID NO: 480399 - DNA, 16 bp, R. norvegicus
atatgtggtacattta

SEQ ID NO: 480400 - DNA, 16 bp, R. norvegicus
atatgtgtatatacat

SEQ ID NO: 480401 - DNA, 16 bp, R. norvegicus
atatgtgtggatgttt

SEQ ID NO: 480402 - DNA, 16 bp, R. norvegicus
atatgtgtgtataaat

SEQ ID NO: 480403 - DNA, 16 bp, R. norvegicus
atatgtgtgtatatat

SEQ ID NO: 480404 - DNA, 16 bp, R. norvegicus
atatgtgtgtatatgt

SEQ ID NO: 480405 - DNA, 16 bp, R. norvegicus
atatgtgtgtgtctgt

SEQ ID NO: 480406 - DNA, 16 bp, R. norvegicus
atatgtgtgtgtgtgt

SEQ ID NO: 480407 - DNA, 16 bp, R. norvegicus
atatgttcctgaccca

SEQ ID NO: 480408 - DNA, 16 bp, R. norvegicus
atattaaagggtcata

SEQ ID NO: 480409 - DNA, 16 bp, R. norvegicus
atattaacctttaaat

SEQ ID NO: 480410 - DNA, 16 bp, R. norvegicus
atattaatatatgcat

SEQ ID NO: 480411 - DNA, 16 bp, R. norvegicus
atattactgctttgat

SEQ ID NO: 480412 - DNA, 16 bp, R. norvegicus
atattagcaataaaat

SEQ ID NO: 480413 - DNA, 16 bp, R. norvegicus
atattcaaagaagaaa

SEQ ID NO: 480414 - DNA, 16 bp, R. norvegicus
atattcaacatcttta

SEQ ID NO: 480415 - DNA, 16 bp, R. norvegicus
atattcagaaaagaaa

SEQ ID NO: 480416 - DNA, 16 bp, R. norvegicus
atattcagaaaataaa

SEQ ID NO: 480417 - DNA, 17 bp, R. norvegicus
atattcagcaaaccagt

SEQ ID NO: 480418 - DNA, 16 bp, R. norvegicus
atattcagcagaggac

SEQ ID NO: 480419 - DNA, 16 bp, R. norvegicus
atattcagccaccaaa

SEQ ID NO: 480420 - DNA, 16 bp, R. norvegicus
atattcagttggagcc

SEQ ID NO: 480421 - DNA, 16 bp, R. norvegicus
atattcataaagaaaa

SEQ ID NO: 480422 - DNA, 16 bp, R. norvegicus
atattcataaaggaaa

SEQ ID NO: 480423 - DNA, 16 bp, R. norvegicus
atattcatcaaggaaa

SEQ ID NO: 480424 - DNA, 16 bp, R. norvegicus
atattccaggacaaaa

SEQ ID NO: 480425 - DNA, 16 bp, R. norvegicus
atattcctccattgct

SEQ ID NO: 480426 - DNA, 16 bp, R. norvegicus
atattcctctctctct

SEQ ID NO: 480427 - DNA, 16 bp, R. norvegicus
atattctcaaaagatg

SEQ ID NO: 480428 - DNA, 16 bp, R. norvegicus
atattctctctctgtc

SEQ ID NO: 480429 - DNA, 16 bp, R. norvegicus
atattctgagaacaga

SEQ ID NO: 480430 - DNA, 16 bp, R. norvegicus
atattctggctatgtc

SEQ ID NO: 480431 - DNA, 16 bp, R. norvegicus
atattcttctcctctg

SEQ ID NO: 480432 - DNA, 16 bp, R. norvegicus
atattgaagttggaca

SEQ ID NO: 480433 - DNA, 16 bp, R. norvegicus
atattgatgcaaaaaa

SEQ ID NO: 480434 - DNA, 16 bp, R. norvegicus
atattgatttgcattt

SEQ ID NO: 480435 - DNA, 16 bp, R. norvegicus
atattggcatgatcct

SEQ ID NO: 480436 - DNA, 16 bp, R. norvegicus
atattggcatggaaac

SEQ ID NO: 480437 - DNA, 16 bp, R. norvegicus
atattgttgtactttt

SEQ ID NO: 480438 - DNA, 16 bp, R. norvegicus
atatttaaagaaaaac

SEQ ID NO: 480439 - DNA, 16 bp, R. norvegicus
atatttagaaatatgt

SEQ ID NO: 480440 - DNA, 16 bp, R. norvegicus
atatttagcagaggac

SEQ ID NO: 480441 - DNA, 16 bp, R. norvegicus
atatttatgtgtgaat

SEQ ID NO: 480442 - DNA, 16 bp, R. norvegicus
atatttattgctacct

SEQ ID NO: 480443 - DNA, 16 bp, R. norvegicus
atatttcatgaagtca

SEQ ID NO: 480444 - DNA, 16 bp, R. norvegicus
atatttcctagttcat

SEQ ID NO: 480445 - DNA, 16 bp, R. norvegicus
atatttctaaaagaaa

SEQ ID NO: 480446 - DNA, 16 bp, R. norvegicus
atatttgaaaactatt

SEQ ID NO: 480447 - DNA, 16 bp, R. norvegicus
atatttgatgatgatg

SEQ ID NO: 480448 - DNA, 16 bp, R. norvegicus
atatttgctctcttct

SEQ ID NO: 480449 - DNA, 16 bp, R. norvegicus
atatttgtaatgaaaa

SEQ ID NO: 480450 - DNA, 16 bp, R. norvegicus
atatttgtcaaatatt

SEQ ID NO: 480451 - DNA, 16 bp, R. norvegicus
atattttaaaacaaga

SEQ ID NO: 480452 - DNA, 16 bp, R. norvegicus
atattttaaaagaact

SEQ ID NO: 480453 - DNA, 16 bp, R. norvegicus
atattttacacatcaa

SEQ ID NO: 480454 - DNA, 16 bp, R. norvegicus
atattttagatataag

SEQ ID NO: 480455 - DNA, 16 bp, R. norvegicus
atattttataacaaca

SEQ ID NO: 480456 - DNA, 16 bp, R. norvegicus
atattttatactgttt

SEQ ID NO: 480457 - DNA, 16 bp, R. norvegicus
atattttatgctattt

SEQ ID NO: 480458 - DNA, 16 bp, R. norvegicus
atattttcaaagaaca

SEQ ID NO: 480459 - DNA, 16 bp, R. norvegicus
atattttcaatgttat

SEQ ID NO: 480460 - DNA, 16 bp, R. norvegicus
atattttccagttctg

SEQ ID NO: 480461 - DNA, 16 bp, R. norvegicus
atattttctgtatatt

SEQ ID NO: 480462 - DNA, 18 bp, R. norvegicus
atattttctgtatccatt

SEQ ID NO: 480463 - DNA, 16 bp, R. norvegicus
atattttctgtattta

SEQ ID NO: 480464 - DNA, 16 bp, R. norvegicus
atattttgaaaaatgt

SEQ ID NO: 480465 - DNA, 16 bp, R. norvegicus
atattttgatcatctg

SEQ ID NO: 480466 - DNA, 16 bp, R. norvegicus
atattttgatgaaatt

SEQ ID NO: 480467 - DNA, 16 bp, R. norvegicus
atattttgtcttctgt

SEQ ID NO: 480468 - DNA, 16 bp, R. norvegicus
atattttgtgaaaata

SEQ ID NO: 480469 - DNA, 16 bp, R. norvegicus
atattttgtgtatgtg

SEQ ID NO: 480470 - DNA, 16 bp, R. norvegicus
atatttttcaaagaaa

SEQ ID NO: 480471 - DNA, 16 bp, R. norvegicus
atatttttgtacatat

SEQ ID NO: 480472 - DNA, 16 bp, R. norvegicus
atatttttgtgactat

SEQ ID NO: 480473 - DNA, 16 bp, R. norvegicus
atattttttaaaggaa

SEQ ID NO: 480474 - DNA, 16 bp, R. norvegicus
atcaaaaaagagaagg

SEQ ID NO: 480475 - DNA, 16 bp, R. norvegicus
atcaaaaacacaggtg

SEQ ID NO: 480476 - DNA, 16 bp, R. norvegicus
atcaaaaacattattc

SEQ ID NO: 480477 - DNA, 22 bp, R. norvegicus
atcaaaaactcaggggacagca

SEQ ID NO: 480478 - DNA, 16 bp, R. norvegicus
atcaaaaactcatggg

SEQ ID NO: 480479 - DNA, 16 bp, R. norvegicus
atcaaaacaactgtca

SEQ ID NO: 480480 - DNA, 16 bp, R. norvegicus
atcaaaatgaacctga

SEQ ID NO: 480481 - DNA, 16 bp, R. norvegicus
atcaaaatgcagaact

SEQ ID NO: 480482 - DNA, 17 bp, R. norvegicus
atcaaaattccaaccca

SEQ ID NO: 480483 - DNA, 16 bp, R. norvegicus
atcaaaattcctactt

SEQ ID NO: 480484 - DNA, 16 bp, R. norvegicus
atcaaaatttctactc

SEQ ID NO: 480485 - DNA, 17 bp, R. norvegicus
atcaaacacagcatcct

SEQ ID NO: 480486 - DNA, 16 bp, R. norvegicus
atcaaacacctcaaca

SEQ ID NO: 480487 - DNA, 16 bp, R. norvegicus
atcaaacctaagtata

SEQ ID NO: 480488 - DNA, 16 bp, R. norvegicus
atcaaagaaaaaatcc

SEQ ID NO: 480489 - DNA, 16 bp, R. norvegicus
atcaaagaaaatgtca

SEQ ID NO: 480490 - DNA, 16 bp, R. norvegicus
atcaaagaacacatca

SEQ ID NO: 480491 - DNA, 16 bp, R. norvegicus
atcaaaggaaaaacca

SEQ ID NO: 480492 - DNA, 16 bp, R. norvegicus
atcaaaggcatcctcc

SEQ ID NO: 480493 - DNA, 16 bp, R. norvegicus
atcaaatcaccacaga

SEQ ID NO: 480494 - DNA, 16 bp, R. norvegicus
atcaaatccagggcct

SEQ ID NO: 480495 - DNA, 16 bp, R. norvegicus
atcaaatggaaaaaga

SEQ ID NO: 480496 - DNA, 16 bp, R. norvegicus
atcaacaaaaaccagg

SEQ ID NO: 480497 - DNA, 16 bp, R. norvegicus
atcaacaaaaccagca

SEQ ID NO: 480498 - DNA, 16 bp, R. norvegicus
atcaacaaactggata

SEQ ID NO: 480499 - DNA, 16 bp, R. norvegicus
atcaacaaagatgaaa

SEQ ID NO: 480500 - DNA, 16 bp, R. norvegicus
atcaacaaagccagga

SEQ ID NO: 480501 - DNA, 16 bp, R. norvegicus
atcaacaagagccagg

SEQ ID NO: 480502 - DNA, 20 bp, R. norvegicus
atcaacaatggaggagtgtt

SEQ ID NO: 480503 - DNA, 16 bp, R. norvegicus
atcaacagaggaatgg

SEQ ID NO: 480504 - DNA, 16 bp, R. norvegicus
atcaacagtcttaccc

SEQ ID NO: 480505 - DNA, 16 bp, R. norvegicus
atcaacatgttatttt

SEQ ID NO: 480506 - DNA, 16 bp, R. norvegicus
atcaaccaaccagcca

SEQ ID NO: 480507 - DNA, 16 bp, R. norvegicus
atcaactaagcaaggt

SEQ ID NO: 480508 - DNA, 16 bp, R. norvegicus
atcaactatataaaca

SEQ ID NO: 480509 - DNA, 16 bp, R. norvegicus
atcaactctaacaaac

SEQ ID NO: 480510 - DNA, 16 bp, R. norvegicus
atcaacttggcagttt

SEQ ID NO: 480511 - DNA, 16 bp, R. norvegicus
atcaagaaaaccagga

SEQ ID NO: 480512 - DNA, 16 bp, R. norvegicus
atcaagaaaatatttt

SEQ ID NO: 480513 - DNA, 16 bp, R. norvegicus
atcaagaaaatcatcc

SEQ ID NO: 480514 - DNA, 16 bp, R. norvegicus
atcaagaaaatgccac

SEQ ID NO: 480515 - DNA, 16 bp, R. norvegicus
atcaagaaaatgtacc

SEQ ID NO: 480516 - DNA, 16 bp, R. norvegicus
atcaagaactgataaa

SEQ ID NO: 480517 - DNA, 16 bp, R. norvegicus
atcaagaatctccaca

SEQ ID NO: 480518 - DNA, 16 bp, R. norvegicus
atcaagaattcacaaa

SEQ ID NO: 480519 - DNA, 16 bp, R. norvegicus
atcaagatggagaact

SEQ ID NO: 480520 - DNA, 16 bp, R. norvegicus
atcaagatgggaacat

SEQ ID NO: 480521 - DNA, 16 bp, R. norvegicus
atcaagatgtagacct

SEQ ID NO: 480522 - DNA, 16 bp, R. norvegicus
atcaagcacatcctgt

SEQ ID NO: 480523 - DNA, 16 bp, R. norvegicus
atcaaggaaaacattc

SEQ ID NO: 480524 - DNA, 16 bp, R. norvegicus
atcaaggaaaacattt

SEQ ID NO: 480525 - DNA, 18 bp, R. norvegicus
atcaaggacctccacatt

SEQ ID NO: 480526 - DNA, 16 bp, R. norvegicus
atcaaggacttcccct

SEQ ID NO: 480527 - DNA, 16 bp, R. norvegicus
atcaaggctattctct

SEQ ID NO: 480528 - DNA, 16 bp, R. norvegicus
atcaaggctggagcat

SEQ ID NO: 480529 - DNA, 16 bp, R. norvegicus
atcaagggcttctcct

SEQ ID NO: 480530 - DNA, 16 bp, R. norvegicus
atcaagggcttcttct

SEQ ID NO: 480531 - DNA, 16 bp, R. norvegicus
atcaagtaggctttat

SEQ ID NO: 480532 - DNA, 16 bp, R. norvegicus
atcaagtcactgcaga

SEQ ID NO: 480533 - DNA, 16 bp, R. norvegicus
atcaagtcagcttcat

SEQ ID NO: 480534 - DNA, 16 bp, R. norvegicus
atcaagtggaaaaaag

SEQ ID NO: 480535 - DNA, 16 bp, R. norvegicus
atcaagtggctcacaa

SEQ ID NO: 480536 - DNA, 16 bp, R. norvegicus
atcaagttgacaatta

SEQ ID NO: 480537 - DNA, 16 bp, R. norvegicus
atcaagtttctgcagg

SEQ ID NO: 480538 - DNA, 16 bp, R. norvegicus
atcaataaaagtatta

SEQ ID NO: 480539 - DNA, 16 bp, R. norvegicus
atcaataaagatgcca

SEQ ID NO: 480540 - DNA, 16 bp, R. norvegicus
atcaatagaataaaat

SEQ ID NO: 480541 - DNA, 16 bp, R. norvegicus
atcaatatatcatcca

SEQ ID NO: 480542 - DNA, 16 bp, R. norvegicus
atcaatatgaagatga

SEQ ID NO: 480543 - DNA, 16 bp, R. norvegicus
atcaatcctgccaatc

SEQ ID NO: 480544 - DNA, 16 bp, R. norvegicus
atcaatgacctccaca

SEQ ID NO: 480545 - DNA, 16 bp, R. norvegicus
atcaatgagtgcattc

SEQ ID NO: 480546 - DNA, 16 bp, R. norvegicus
atcaatgagtgcctac

SEQ ID NO: 480547 - DNA, 16 bp, R. norvegicus
atcaattagaaataaa

SEQ ID NO: 480548 - DNA, 16 bp, R. norvegicus
atcaattctaaaacca

SEQ ID NO: 480549 - DNA, 16 bp, R. norvegicus
atcaattctacatctg

SEQ ID NO: 480550 - DNA, 16 bp, R. norvegicus
atcacaaagggagata

SEQ ID NO: 480551 - DNA, 16 bp, R. norvegicus
atcacaactttaaaaa

SEQ ID NO: 480552 - DNA, 16 bp, R. norvegicus
atcacaagaaaaccta

SEQ ID NO: 480553 - DNA, 16 bp, R. norvegicus
atcacaagaaggacag

SEQ ID NO: 480554 - DNA, 16 bp, R. norvegicus
atcacacccctgccag

SEQ ID NO: 480555 - DNA, 16 bp, R. norvegicus
atcacagacatcaaca

SEQ ID NO: 480556 - DNA, 16 bp, R. norvegicus
atcacagcaaaaggaa

SEQ ID NO: 480557 - DNA, 16 bp, R. norvegicus
atcacaggagaggcca

SEQ ID NO: 480558 - DNA, 16 bp, R. norvegicus
atcacaggcctgtgcc

SEQ ID NO: 480559 - DNA, 16 bp, R. norvegicus
atcacaggtgagacca

SEQ ID NO: 480560 - DNA, 16 bp, R. norvegicus
atcacagttatgaagt

SEQ ID NO: 480561 - DNA, 16 bp, R. norvegicus
atcacatcaacagaaa

SEQ ID NO: 480562 - DNA, 16 bp, R. norvegicus
atcacatcaatagaaa

SEQ ID NO: 480563 - DNA, 16 bp, R. norvegicus
atcacatctccacagg

SEQ ID NO: 480564 - DNA, 16 bp, R. norvegicus
atcacatgcatgcctg

SEQ ID NO: 480565 - DNA, 16 bp, R. norvegicus
atcacattttcaataa

SEQ ID NO: 480566 - DNA, 16 bp, R. norvegicus
atcacatttttttaaa

SEQ ID NO: 480567 - DNA, 16 bp, R. norvegicus
atcaccaaagaagtca

SEQ ID NO: 480568 - DNA, 16 bp, R. norvegicus
atcaccaaaggaaatc

SEQ ID NO: 480569 - DNA, 16 bp, R. norvegicus
atcaccaacatcacca

SEQ ID NO: 480570 - DNA, 16 bp, R. norvegicus
atcaccaacatcatca

SEQ ID NO: 480571 - DNA, 16 bp, R. norvegicus
atcaccaaccaaagag

SEQ ID NO: 480572 - DNA, 16 bp, R. norvegicus
atcaccacagagaaag

SEQ ID NO: 480573 - DNA, 16 bp, R. norvegicus
atcaccaccatcacca

SEQ ID NO: 480574 - DNA, 16 bp, R. norvegicus
atcaccaccatcatca

SEQ ID NO: 480575 - DNA, 16 bp, R. norvegicus
atcaccactaccacca

SEQ ID NO: 480576 - DNA, 16 bp, R. norvegicus
atcaccagcagcagca

SEQ ID NO: 480577 - DNA, 16 bp, R. norvegicus
atcaccagcatcatca

SEQ ID NO: 480578 - DNA, 16 bp, R. norvegicus
atcaccatcaccaaca

SEQ ID NO: 480579 - DNA, 16 bp, R. norvegicus
atcaccatcaccatca

SEQ ID NO: 480580 - DNA, 16 bp, R. norvegicus
atcaccatggaaacag

SEQ ID NO: 480581 - DNA, 16 bp, R. norvegicus
atcaccatggtgggaa

SEQ ID NO: 480582 - DNA, 16 bp, R. norvegicus
atcaccatgtctgcct

SEQ ID NO: 480583 - DNA, 16 bp, R. norvegicus
atcaccctcagcacca

SEQ ID NO: 480584 - DNA, 16 bp, R. norvegicus
atcaccctgaatgagg

SEQ ID NO: 480585 - DNA, 16 bp, R. norvegicus
atcacctgagattttg

SEQ ID NO: 480586 - DNA, 16 bp, R. norvegicus
atcacctggagctgga

SEQ ID NO: 480587 - DNA, 16 bp, R. norvegicus
atcactatcatcacca

SEQ ID NO: 480588 - DNA, 16 bp, R. norvegicus
atcactctgtacaaag

SEQ ID NO: 480589 - DNA, 20 bp, R. norvegicus
atcactgagctaaatcccca

SEQ ID NO: 480590 - DNA, 16 bp, R. norvegicus
atcactgtaaatgtat

SEQ ID NO: 480591 - DNA, 16 bp, R. norvegicus
atcactgtggtggttt

SEQ ID NO: 480592 - DNA, 16 bp, R. norvegicus
atcactttttaaaatt

SEQ ID NO: 480593 - DNA, 16 bp, R. norvegicus
atcagaaaaacacaca

SEQ ID NO: 480594 - DNA, 16 bp, R. norvegicus
atcagaaaacacacac

SEQ ID NO: 480595 - DNA, 16 bp, R. norvegicus
atcagaaaagaagtca

SEQ ID NO: 480596 - DNA, 16 bp, R. norvegicus
atcagaaagcaggctg

SEQ ID NO: 480597 - DNA, 16 bp, R. norvegicus
atcagaaatctgggaa

SEQ ID NO: 480598 - DNA, 16 bp, R. norvegicus
atcagaaattcaagac

SEQ ID NO: 480599 - DNA, 16 bp, R. norvegicus
atcagaagaaattcaa

SEQ ID NO: 480600 - DNA, 16 bp, R. norvegicus
atcagaagagggtgtt

SEQ ID NO: 480601 - DNA, 16 bp, R. norvegicus
atcagaagctacaccc

SEQ ID NO: 480602 - DNA, 16 bp, R. norvegicus
atcagaaggaggagga

SEQ ID NO: 480603 - DNA, 16 bp, R. norvegicus
atcagaaggtcaaggt

SEQ ID NO: 480604 - DNA, 16 bp, R. norvegicus
atcagaagttcaagat

SEQ ID NO: 480605 - DNA, 16 bp, R. norvegicus
atcagacagacagaca

SEQ ID NO: 480606 - DNA, 16 bp, R. norvegicus
atcagaccttcacaga

SEQ ID NO: 480607 - DNA, 16 bp, R. norvegicus
atcagagaaaaacaca

SEQ ID NO: 480608 - DNA, 16 bp, R. norvegicus
atcagagaaagaaatg

SEQ ID NO: 480609 - DNA, 16 bp, R. norvegicus
atcagagaaaggactt

SEQ ID NO: 480610 - DNA, 16 bp, R. norvegicus
atcagagacaaactga

SEQ ID NO: 480611 - DNA, 16 bp, R. norvegicus
atcagagactagacaa

SEQ ID NO: 480612 - DNA, 16 bp, R. norvegicus
atcagagagtgcatac

SEQ ID NO: 480613 - DNA, 16 bp, R. norvegicus
atcagagcagctcaga

SEQ ID NO: 480614 - DNA, 16 bp, R. norvegicus
atcagagcaggaagag

SEQ ID NO: 480615 - DNA, 16 bp, R. norvegicus
atcagagcctgcccca

SEQ ID NO: 480616 - DNA, 16 bp, R. norvegicus
atcagatccctggagc

SEQ ID NO: 480617 - DNA, 16 bp, R. norvegicus
atcagattttctctgg

SEQ ID NO: 480618 - DNA, 16 bp, R. norvegicus
atcagatttttattga

SEQ ID NO: 480619 - DNA, 16 bp, R. norvegicus
atcagcaagaggttta

SEQ ID NO: 480620 - DNA, 16 bp, R. norvegicus
atcagcaaggagtatg

SEQ ID NO: 480621 - DNA, 16 bp, R. norvegicus
atcagcacaggggaaa

SEQ ID NO: 480622 - DNA, 16 bp, R. norvegicus
atcagcaccagcacca

SEQ ID NO: 480623 - DNA, 16 bp, R. norvegicus
atcagcagaaccaaaa

SEQ ID NO: 480624 - DNA, 16 bp, R. norvegicus
atcagcagcagcaaca

SEQ ID NO: 480625 - DNA, 16 bp, R. norvegicus
atcagcagggctctgg

SEQ ID NO: 480626 - DNA, 16 bp, R. norvegicus
atcagcccaagtctgc

SEQ ID NO: 480627 - DNA, 16 bp, R. norvegicus
atcagcctcatcatcc

SEQ ID NO: 480628 - DNA, 16 bp, R. norvegicus
atcagcgagtgcatac

SEQ ID NO: 480629 - DNA, 16 bp, R. norvegicus
atcagctgaaggagtt

SEQ ID NO: 480630 - DNA, 16 bp, R. norvegicus
atcagctgtaggtgtt

SEQ ID NO: 480631 - DNA, 16 bp, R. norvegicus
atcaggaaaatacaaa

SEQ ID NO: 480632 - DNA, 16 bp, R. norvegicus
atcaggaagcaaagag

SEQ ID NO: 480633 - DNA, 16 bp, R. norvegicus
atcaggaagcacaggt

SEQ ID NO: 480634 - DNA, 16 bp, R. norvegicus
atcaggaagctgaggg

SEQ ID NO: 480635 - DNA, 16 bp, R. norvegicus
atcaggaaggaagaga

SEQ ID NO: 480636 - DNA, 16 bp, R. norvegicus
atcaggaatttgaggc

SEQ ID NO: 480637 - DNA, 16 bp, R. norvegicus
atcaggagaaaggaag

SEQ ID NO: 480638 - DNA, 16 bp, R. norvegicus
atcaggatctggagga

SEQ ID NO: 480639 - DNA, 16 bp, R. norvegicus
atcaggcatgcatgtg

SEQ ID NO: 480640 - DNA, 16 bp, R. norvegicus
atcaggctggcctcag

SEQ ID NO: 480641 - DNA, 16 bp, R. norvegicus
atcagggaaatataaa

SEQ ID NO: 480642 - DNA, 16 bp, R. norvegicus
atcagggaaatgcaaa

SEQ ID NO: 480643 - DNA, 16 bp, R. norvegicus
atcagggaatattcca

SEQ ID NO: 480644 - DNA, 16 bp, R. norvegicus
atcagggactagacca

SEQ ID NO: 480645 - DNA, 16 bp, R. norvegicus
atcagggagctccagg

SEQ ID NO: 480646 - DNA, 16 bp, R. norvegicus
atcaggttcctgtcag

SEQ ID NO: 480647 - DNA, 16 bp, R. norvegicus
atcagtaaatatcttc

SEQ ID NO: 480648 - DNA, 16 bp, R. norvegicus
atcagtagagtattat

SEQ ID NO: 480649 - DNA, 16 bp, R. norvegicus
atcagtaggaggaaaa

SEQ ID NO: 480650 - DNA, 16 bp, R. norvegicus
atcagtcagtcagtca

SEQ ID NO: 480651 - DNA, 16 bp, R. norvegicus
atcagtctctctctct

SEQ ID NO: 480652 - DNA, 16 bp, R. norvegicus
atcagtgaagaccagc

SEQ ID NO: 480653 - DNA, 16 bp, R. norvegicus
atcagtgacaaagaca

SEQ ID NO: 480654 - DNA, 16 bp, R. norvegicus
atcagtgccacagatg

SEQ ID NO: 480655 - DNA, 16 bp, R. norvegicus
atcagtggccttcctc

SEQ ID NO: 480656 - DNA, 16 bp, R. norvegicus
atcagtgtttctcaac

SEQ ID NO: 480657 - DNA, 16 bp, R. norvegicus
atcagttcctcagaaa

SEQ ID NO: 480658 - DNA, 16 bp, R. norvegicus
atcagtttccagactt

SEQ ID NO: 480659 - DNA, 16 bp, R. norvegicus
atcagtttggaagttc

SEQ ID NO: 480660 - DNA, 16 bp, R. norvegicus
atcagttttctttaag

SEQ ID NO: 480661 - DNA, 16 bp, R. norvegicus
atcataaggctagtca

SEQ ID NO: 480662 - DNA, 16 bp, R. norvegicus
atcatatcatcctcaa

SEQ ID NO: 480663 - DNA, 16 bp, R. norvegicus
atcatatttggtgttt

SEQ ID NO: 480664 - DNA, 16 bp, R. norvegicus
atcatcaaagcagaaa

SEQ ID NO: 480665 - DNA, 16 bp, R. norvegicus
atcatcaaagtgggaa

SEQ ID NO: 480666 - DNA, 16 bp, R. norvegicus
atcatcaaatgtgatt

SEQ ID NO: 480667 - DNA, 16 bp, R. norvegicus
atcatcaagacagaaa

SEQ ID NO: 480668 - DNA, 16 bp, R. norvegicus
atcatcaaggcaggga

SEQ ID NO: 480669 - DNA, 16 bp, R. norvegicus
atcatcaccagcagca

SEQ ID NO: 480670 - DNA, 16 bp, R. norvegicus
atcatcaccatcacaa

SEQ ID NO: 480671 - DNA, 16 bp, R. norvegicus
atcatcaccatcatca

SEQ ID NO: 480672 - DNA, 16 bp, R. norvegicus
atcatcactaccacca

SEQ ID NO: 480673 - DNA, 16 bp, R. norvegicus
atcatcagattctatt

SEQ ID NO: 480674 - DNA, 16 bp, R. norvegicus
atcatcagcatcatca

SEQ ID NO: 480675 - DNA, 16 bp, R. norvegicus
atcatcatcatcacca

SEQ ID NO: 480676 - DNA, 16 bp, R. norvegicus
atcatcatcatcacta

SEQ ID NO: 480677 - DNA, 16 bp, R. norvegicus
atcatcatcatcatca

SEQ ID NO: 480678 - DNA, 16 bp, R. norvegicus
atcatcatcatcatcg

SEQ ID NO: 480679 - DNA, 16 bp, R. norvegicus
atcatcatcatcccca

SEQ ID NO: 480680 - DNA, 16 bp, R. norvegicus
atcatcatcatcttct

SEQ ID NO: 480681 - DNA, 16 bp, R. norvegicus
atcatcatcatgaaat

SEQ ID NO: 480682 - DNA, 16 bp, R. norvegicus
atcatcatcatgatca

SEQ ID NO: 480683 - DNA, 16 bp, R. norvegicus
atcatcatcttcatct

SEQ ID NO: 480684 - DNA, 16 bp, R. norvegicus
atcatcatggcaggaa

SEQ ID NO: 480685 - DNA, 16 bp, R. norvegicus
atcatccagacaaaaa

SEQ ID NO: 480686 - DNA, 16 bp, R. norvegicus
atcatccatcaagaaa

SEQ ID NO: 480687 - DNA, 16 bp, R. norvegicus
atcatccatgcatcca

SEQ ID NO: 480688 - DNA, 16 bp, R. norvegicus
atcatccctgcatcca

SEQ ID NO: 480689 - DNA, 16 bp, R. norvegicus
atcatcctcaccatca

SEQ ID NO: 480690 - DNA, 16 bp, R. norvegicus
atcatcctgaatgagg

SEQ ID NO: 480691 - DNA, 45 bp, R. norvegicus
atcatcctgagtgagctaacccaatcacagaaagacatacatggc

SEQ ID NO: 480692 - DNA, 44 bp, R. norvegicus
atcatcctgagtgagctaacccaatcacagaaagacatacatgt

SEQ ID NO: 480693 - DNA, 16 bp, R. norvegicus
atcatcctggcaggaa

SEQ ID NO: 480694 - DNA, 16 bp, R. norvegicus
atcatcgtcgtcgtca

SEQ ID NO: 480695 - DNA, 16 bp, R. norvegicus
atcatctacagcttta

SEQ ID NO: 480696 - DNA, 16 bp, R. norvegicus
atcatctatttatata

SEQ ID NO: 480697 - DNA, 16 bp, R. norvegicus
atcatctcagtagatg

SEQ ID NO: 480698 - DNA, 16 bp, R. norvegicus
atcatctcattagttg

SEQ ID NO: 480699 - DNA, 16 bp, R. norvegicus
atcatcttgaacctga

SEQ ID NO: 480700 - DNA, 16 bp, R. norvegicus
atcatgaaaatgaaaa

SEQ ID NO: 480701 - DNA, 22 bp, R. norvegicus
atcatgaacctgttgactttaa

SEQ ID NO: 480702 - DNA, 16 bp, R. norvegicus
atcatgaagggtgttg

SEQ ID NO: 480703 - DNA, 16 bp, R. norvegicus
atcatgaccaaatatg

SEQ ID NO: 480704 - DNA, 17 bp, R. norvegicus
atcatgaccaagaagca

SEQ ID NO: 480705 - DNA, 16 bp, R. norvegicus
atcatgaggagctgag

SEQ ID NO: 480706 - DNA, 16 bp, R. norvegicus
atcatgagtacctgct

SEQ ID NO: 480707 - DNA, 16 bp, R. norvegicus
atcatgatcaagaagc

SEQ ID NO: 480708 - DNA, 16 bp, R. norvegicus
atcatgatgatgatga

SEQ ID NO: 480709 - DNA, 16 bp, R. norvegicus
atcatgatgctggaga

SEQ ID NO: 480710 - DNA, 16 bp, R. norvegicus
atcatgattgatgatc

SEQ ID NO: 480711 - DNA, 16 bp, R. norvegicus
atcatggaaacagtaa

SEQ ID NO: 480712 - DNA, 16 bp, R. norvegicus
atcatggaacagaaat

SEQ ID NO: 480713 - DNA, 16 bp, R. norvegicus
atcatggagaagtctc

SEQ ID NO: 480714 - DNA, 16 bp, R. norvegicus
atcatggtggatgact

SEQ ID NO: 480715 - DNA, 16 bp, R. norvegicus
atcatggtgggaagca

SEQ ID NO: 480716 - DNA, 16 bp, R. norvegicus
atcatgtatttatttt

SEQ ID NO: 480717 - DNA, 16 bp, R. norvegicus
atcatgtcaggaagca

SEQ ID NO: 480718 - DNA, 16 bp, R. norvegicus
atcatgtctttgtttc

SEQ ID NO: 480719 - DNA, 16 bp, R. norvegicus
atcatgtgatattttt

SEQ ID NO: 480720 - DNA, 16 bp, R. norvegicus
atcattaaccaagaaa

SEQ ID NO: 480721 - DNA, 16 bp, R. norvegicus
atcattaatcaagaga

SEQ ID NO: 480722 - DNA, 16 bp, R. norvegicus
atcattaggacaaaat

SEQ ID NO: 480723 - DNA, 16 bp, R. norvegicus
atcattatcaccatca

SEQ ID NO: 480724 - DNA, 16 bp, R. norvegicus
atcattcactgtgatc

SEQ ID NO: 480725 - DNA, 16 bp, R. norvegicus
atcattccattcattt

SEQ ID NO: 480726 - DNA, 16 bp, R. norvegicus
atcattgacaaagaag

SEQ ID NO: 480727 - DNA, 16 bp, R. norvegicus
atcattgagcagagag

SEQ ID NO: 480728 - DNA, 16 bp, R. norvegicus
atcattgccagcatct

SEQ ID NO: 480729 - DNA, 16 bp, R. norvegicus
atcattggaggaagtc

SEQ ID NO: 480730 - DNA, 16 bp, R. norvegicus
atcattgtcaccatca

SEQ ID NO: 480731 - DNA, 16 bp, R. norvegicus
atcattgttggcatta

SEQ ID NO: 480732 - DNA, 16 bp, R. norvegicus
atcatttctataaaga

SEQ ID NO: 480733 - DNA, 16 bp, R. norvegicus
atcatttctccctccc

SEQ ID NO: 480734 - DNA, 16 bp, R. norvegicus
atcatttctccttccc

SEQ ID NO: 480735 - DNA, 16 bp, R. norvegicus
atcatttggcaaaatt

SEQ ID NO: 480736 - DNA, 16 bp, R. norvegicus
atcatttgggtatatg

SEQ ID NO: 480737 - DNA, 16 bp, R. norvegicus
atcattttaattttag

SEQ ID NO: 480738 - DNA, 16 bp, R. norvegicus
atcattttgatgtttt

SEQ ID NO: 480739 - DNA, 26 bp, R. norvegicus
atccaaaacatacaggaaatccagga

SEQ ID NO: 480740 - DNA, 16 bp, R. norvegicus
atccaaaactcttcaa

SEQ ID NO: 480741 - DNA, 16 bp, R. norvegicus
atccaaaagattggac

SEQ ID NO: 480742 - DNA, 16 bp, R. norvegicus
atccaaaagcaggtag

SEQ ID NO: 480743 - DNA, 16 bp, R. norvegicus
atccaaaattatggga

SEQ ID NO: 480744 - DNA, 16 bp, R. norvegicus
atccaaagagtccaca

SEQ ID NO: 480745 - DNA, 16 bp, R. norvegicus
atccaaaggaagccag

SEQ ID NO: 480746 - DNA, 16 bp, R. norvegicus
atccaaagtctcaaaa

SEQ ID NO: 480747 - DNA, 16 bp, R. norvegicus
atccaaatacaccaga

SEQ ID NO: 480748 - DNA, 16 bp, R. norvegicus
atccaaatcttggttt

SEQ ID NO: 480749 - DNA, 16 bp, R. norvegicus
atccaaatgaacaaaa

SEQ ID NO: 480750 - DNA, 16 bp, R. norvegicus
atccaacagagggcta

SEQ ID NO: 480751 - DNA, 16 bp, R. norvegicus
atccaacatatacaaa

SEQ ID NO: 480752 - DNA, 16 bp, R. norvegicus
atccaacattttgctg

SEQ ID NO: 480753 - DNA, 16 bp, R. norvegicus
atccaactcaggtcct

SEQ ID NO: 480754 - DNA, 16 bp, R. norvegicus
atccaactgaaagaaa

SEQ ID NO: 480755 - DNA, 16 bp, R. norvegicus
atccaactgcagccag

SEQ ID NO: 480756 - DNA, 16 bp, R. norvegicus
atccaagaaattaatc

SEQ ID NO: 480757 - DNA, 16 bp, R. norvegicus
atccaagaatccagta

SEQ ID NO: 480758 - DNA, 16 bp, R. norvegicus
atccaagacattgaaa

SEQ ID NO: 480759 - DNA, 18 bp, R. norvegicus
atccaagagaacatcaaa

SEQ ID NO: 480760 - DNA, 16 bp, R. norvegicus
atccaataaagagatt

SEQ ID NO: 480761 - DNA, 16 bp, R. norvegicus
atccaattaaacaaga

SEQ ID NO: 480762 - DNA, 16 bp, R. norvegicus
atccaattcctcagag

SEQ ID NO: 480763 - DNA, 16 bp, R. norvegicus
atccacaacagtgtct

SEQ ID NO: 480764 - DNA, 16 bp, R. norvegicus
atccacacttctgagg

SEQ ID NO: 480765 - DNA, 16 bp, R. norvegicus
atccacactttgctct

SEQ ID NO: 480766 - DNA, 16 bp, R. norvegicus
atccacagaacccatg

SEQ ID NO: 480767 - DNA, 16 bp, R. norvegicus
atccacagactcagag

SEQ ID NO: 480768 - DNA, 16 bp, R. norvegicus
atccacagccaggaag

SEQ ID NO: 480769 - DNA, 16 bp, R. norvegicus
atccacagtcacctct

SEQ ID NO: 480770 - DNA, 16 bp, R. norvegicus
atccacagttcagaac

SEQ ID NO: 480771 - DNA, 16 bp, R. norvegicus
atccacatcaaaccag

SEQ ID NO: 480772 - DNA, 16 bp, R. norvegicus
atccacatgcctctgt

SEQ ID NO: 480773 - DNA, 16 bp, R. norvegicus
atccaccaagaggaac

SEQ ID NO: 480774 - DNA, 16 bp, R. norvegicus
atccaccagagaactc

SEQ ID NO: 480775 - DNA, 16 bp, R. norvegicus
atccaccaggatgaac

SEQ ID NO: 480776 - DNA, 16 bp, R. norvegicus
atccaccatgatcaaa

SEQ ID NO: 480777 - DNA, 16 bp, R. norvegicus
atccaccatgatcgag

SEQ ID NO: 480778 - DNA, 16 bp, R. norvegicus
atccacctgcctctgt

SEQ ID NO: 480779 - DNA, 16 bp, R. norvegicus
atccacctgcctcttg

SEQ ID NO: 480780 - DNA, 16 bp, R. norvegicus
atccacctgctcctgc

SEQ ID NO: 480781 - DNA, 16 bp, R. norvegicus
atccactggcctctgc

SEQ ID NO: 480782 - DNA, 16 bp, R. norvegicus
atccacttgcctgtga

SEQ ID NO: 480783 - DNA, 16 bp, R. norvegicus
atccagacacactcaa

SEQ ID NO: 480784 - DNA, 16 bp, R. norvegicus
atccagacagaaacta

SEQ ID NO: 480785 - DNA, 16 bp, R. norvegicus
atccagactgatttcc

SEQ ID NO: 480786 - DNA, 16 bp, R. norvegicus
atccagagacttcccc

SEQ ID NO: 480787 - DNA, 16 bp, R. norvegicus
atccagatgaaagaaa

SEQ ID NO: 480788 - DNA, 16 bp, R. norvegicus
atccagatgggttcag

SEQ ID NO: 480789 - DNA, 17 bp, R. norvegicus
atccagcaaaactctcc

SEQ ID NO: 480790 - DNA, 16 bp, R. norvegicus
atccagcactacaaac

SEQ ID NO: 480791 - DNA, 16 bp, R. norvegicus
atccagcagaaacagc

SEQ ID NO: 480792 - DNA, 16 bp, R. norvegicus
atccagcagcagcagc

SEQ ID NO: 480793 - DNA, 16 bp, R. norvegicus
atccagcagtggatgg

SEQ ID NO: 480794 - DNA, 16 bp, R. norvegicus
atccagcatttgggag

SEQ ID NO: 480795 - DNA, 16 bp, R. norvegicus
atccagccagccagcc

SEQ ID NO: 480796 - DNA, 16 bp, R. norvegicus
atccagccccacaaag

SEQ ID NO: 480797 - DNA, 16 bp, R. norvegicus
atccagctataccttt

SEQ ID NO: 480798 - DNA, 16 bp, R. norvegicus
atccagctcaaggaga

SEQ ID NO: 480799 - DNA, 16 bp, R. norvegicus
atccaggaaatcaagg

SEQ ID NO: 480800 - DNA, 16 bp, R. norvegicus
atccaggaagcagaaa

SEQ ID NO: 480801 - DNA, 16 bp, R. norvegicus
atccaggacagatgtc

SEQ ID NO: 480802 - DNA, 16 bp, R. norvegicus
atccaggaggcagagg

SEQ ID NO: 480803 - DNA, 16 bp, R. norvegicus
atccaggctggcatgg

SEQ ID NO: 480804 - DNA, 16 bp, R. norvegicus
atccagtctctccaaa

SEQ ID NO: 480805 - DNA, 16 bp, R. norvegicus
atccagtgggaaaaag

SEQ ID NO: 480806 - DNA, 16 bp, R. norvegicus
atccagtgtctgagag

SEQ ID NO: 480807 - DNA, 16 bp, R. norvegicus
atccagtgtcttcctc

SEQ ID NO: 480808 - DNA, 16 bp, R. norvegicus
atccatactttggtct

SEQ ID NO: 480809 - DNA, 16 bp, R. norvegicus
atccatcatgatccag

SEQ ID NO: 480810 - DNA, 16 bp, R. norvegicus
atccatccacctgccc

SEQ ID NO: 480811 - DNA, 16 bp, R. norvegicus
atccatccatcccttc

SEQ ID NO: 480812 - DNA, 16 bp, R. norvegicus
atccatcccatatgca

SEQ ID NO: 480813 - DNA, 16 bp, R. norvegicus
atccatcccatcttca

SEQ ID NO: 480814 - DNA, 16 bp, R. norvegicus
atccatcccccttact

SEQ ID NO: 480815 - DNA, 16 bp, R. norvegicus
atccatctggacctgg

SEQ ID NO: 480816 - DNA, 16 bp, R. norvegicus
atccatctggtggcag

SEQ ID NO: 480817 - DNA, 16 bp, R. norvegicus
atccatgaaagaattc

SEQ ID NO: 480818 - DNA, 16 bp, R. norvegicus
atccatgaagtgtttg

SEQ ID NO: 480819 - DNA, 20 bp, R. norvegicus
atccatgacaactttggcat

SEQ ID NO: 480820 - DNA, 16 bp, R. norvegicus
atccatgactccagtt

SEQ ID NO: 480821 - DNA, 16 bp, R. norvegicus
atccatgaggtgtttg

SEQ ID NO: 480822 - DNA, 16 bp, R. norvegicus
atccatgccttaagaa

SEQ ID NO: 480823 - DNA, 16 bp, R. norvegicus
atccatgcttattacc

SEQ ID NO: 480824 - DNA, 16 bp, R. norvegicus
atccatgggtccagga

SEQ ID NO: 480825 - DNA, 18 bp, R. norvegicus
atccattcctctgttgag

SEQ ID NO: 480826 - DNA, 16 bp, R. norvegicus
atccattcttctgtca

SEQ ID NO: 480827 - DNA, 16 bp, R. norvegicus
atccattctttcattg

SEQ ID NO: 480828 - DNA, 16 bp, R. norvegicus
atccatttatttatct

SEQ ID NO: 480829 - DNA, 16 bp, R. norvegicus
atcccaaaagcttgga

SEQ ID NO: 480830 - DNA, 16 bp, R. norvegicus
atcccaacaaggccac

SEQ ID NO: 480831 - DNA, 16 bp, R. norvegicus
atcccaagaaacattg

SEQ ID NO: 480832 - DNA, 16 bp, R. norvegicus
atcccaagtggtcagc

SEQ ID NO: 480833 - DNA, 16 bp, R. norvegicus
atcccaataaatgaga

SEQ ID NO: 480834 - DNA, 16 bp, R. norvegicus
atcccaatcacagaaa

SEQ ID NO: 480835 - DNA, 16 bp, R. norvegicus
atcccaatggaagagt

SEQ ID NO: 480836 - DNA, 16 bp, R. norvegicus
atcccacagctctcag

SEQ ID NO: 480837 - DNA, 16 bp, R. norvegicus
atcccacatcacactg

SEQ ID NO: 480838 - DNA, 16 bp, R. norvegicus
atcccaccactcagaa

SEQ ID NO: 480839 - DNA, 16 bp, R. norvegicus
atcccacccccacagt

SEQ ID NO: 480840 - DNA, 16 bp, R. norvegicus
atcccacttaggaggg

SEQ ID NO: 480841 - DNA, 16 bp, R. norvegicus
atcccagacccagaaa

SEQ ID NO: 480842 - DNA, 16 bp, R. norvegicus
atcccagagctggaga

SEQ ID NO: 480843 - DNA, 16 bp, R. norvegicus
atcccagcaccaagga

SEQ ID NO: 480844 - DNA, 16 bp, R. norvegicus
atcccagcacccagga

SEQ ID NO: 480845 - DNA, 16 bp, R. norvegicus
atcccagcaccgagga

SEQ ID NO: 480846 - DNA, 16 bp, R. norvegicus
atcccagcacctggga

SEQ ID NO: 480847 - DNA, 16 bp, R. norvegicus
atcccagcactgggga

SEQ ID NO: 480848 - DNA, 16 bp, R. norvegicus
atcccagcactggtga

SEQ ID NO: 480849 - DNA, 16 bp, R. norvegicus
atcccagcacttcaga

SEQ ID NO: 480850 - DNA, 16 bp, R. norvegicus
atcccagcacttgaga

SEQ ID NO: 480851 - DNA, 16 bp, R. norvegicus
atcccagcatggagga

SEQ ID NO: 480852 - DNA, 16 bp, R. norvegicus
atcccagcattcagga

SEQ ID NO: 480853 - DNA, 16 bp, R. norvegicus
atcccagcattccaga

SEQ ID NO: 480854 - DNA, 16 bp, R. norvegicus
atcccagcatttgaga

SEQ ID NO: 480855 - DNA, 16 bp, R. norvegicus
atcccagcccacagca

SEQ ID NO: 480856 - DNA, 16 bp, R. norvegicus
atcccagccctccaga

SEQ ID NO: 480857 - DNA, 16 bp, R. norvegicus
atcccagctactcaag

SEQ ID NO: 480858 - DNA, 16 bp, R. norvegicus
atcccagctctgggaa

SEQ ID NO: 480859 - DNA, 16 bp, R. norvegicus
atcccaggactcggga

SEQ ID NO: 480860 - DNA, 16 bp, R. norvegicus
atcccaggactctgga

SEQ ID NO: 480861 - DNA, 16 bp, R. norvegicus
atcccaggagacagga

SEQ ID NO: 480862 - DNA, 16 bp, R. norvegicus
atcccaggctggtctt

SEQ ID NO: 480863 - DNA, 16 bp, R. norvegicus
atcccaggtctctgga

SEQ ID NO: 480864 - DNA, 16 bp, R. norvegicus
atcccagtatttggga

SEQ ID NO: 480865 - DNA, 16 bp, R. norvegicus
atcccagtgctgggga

SEQ ID NO: 480866 - DNA, 16 bp, R. norvegicus
atcccatatcacactg

SEQ ID NO: 480867 - DNA, 16 bp, R. norvegicus
atcccatctgcagcca

SEQ ID NO: 480868 - DNA, 16 bp, R. norvegicus
atcccatggaactgga

SEQ ID NO: 480869 - DNA, 16 bp, R. norvegicus
atcccatgggagaaag

SEQ ID NO: 480870 - DNA, 16 bp, R. norvegicus
atcccattctcaattc

SEQ ID NO: 480871 - DNA, 16 bp, R. norvegicus
atccccaacccaagac

SEQ ID NO: 480872 - DNA, 16 bp, R. norvegicus
atccccaaccccaagc

SEQ ID NO: 480873 - DNA, 16 bp, R. norvegicus
atccccaacccgagaa

SEQ ID NO: 480874 - DNA, 16 bp, R. norvegicus
atccccaaggacaagg

SEQ ID NO: 480875 - DNA, 16 bp, R. norvegicus
atccccaaggtcaagg

SEQ ID NO: 480876 - DNA, 16 bp, R. norvegicus
atccccaccaaaatcc

SEQ ID NO: 480877 - DNA, 16 bp, R. norvegicus
atccccaccctggaaa

SEQ ID NO: 480878 - DNA, 16 bp, R. norvegicus
atccccagaacctgtg

SEQ ID NO: 480879 - DNA, 16 bp, R. norvegicus
atccccagaactcaca

SEQ ID NO: 480880 - DNA, 16 bp, R. norvegicus
atccccagagctcaca

SEQ ID NO: 480881 - DNA, 16 bp, R. norvegicus
atccccagcaccatat

SEQ ID NO: 480882 - DNA, 16 bp, R. norvegicus
atccccagcactgaga

SEQ ID NO: 480883 - DNA, 16 bp, R. norvegicus
atccccagcactgcct

SEQ ID NO: 480884 - DNA, 16 bp, R. norvegicus
atccccagccccaaat

SEQ ID NO: 480885 - DNA, 16 bp, R. norvegicus
atccccagccccaaga

SEQ ID NO: 480886 - DNA, 16 bp, R. norvegicus
atccccagccccatga

SEQ ID NO: 480887 - DNA, 16 bp, R. norvegicus
atccccagccccattc

SEQ ID NO: 480888 - DNA, 16 bp, R. norvegicus
atccccagcccccaac

SEQ ID NO: 480889 - DNA, 16 bp, R. norvegicus
atccccagccccctga

SEQ ID NO: 480890 - DNA, 16 bp, R. norvegicus
atccccagcccccttg

SEQ ID NO: 480891 - DNA, 16 bp, R. norvegicus
atccccagccccggag

SEQ ID NO: 480892 - DNA, 16 bp, R. norvegicus
atccccagcccctgcc

SEQ ID NO: 480893 - DNA, 16 bp, R. norvegicus
atccccagcccctggc

SEQ ID NO: 480894 - DNA, 16 bp, R. norvegicus
atccccagccctgcag

SEQ ID NO: 480895 - DNA, 16 bp, R. norvegicus
atccccagctcccaca

SEQ ID NO: 480896 - DNA, 16 bp, R. norvegicus
atccccagctgagctg

SEQ ID NO: 480897 - DNA, 16 bp, R. norvegicus
atccccctaatccctc

SEQ ID NO: 480898 - DNA, 16 bp, R. norvegicus
atccccctgtctcagc

SEQ ID NO: 480899 - DNA, 16 bp, R. norvegicus
atcccctagaactgga

SEQ ID NO: 480900 - DNA, 16 bp, R. norvegicus
atcccctttcccagtt

SEQ ID NO: 480901 - DNA, 16 bp, R. norvegicus
atccctcctctcctgg

SEQ ID NO: 480902 - DNA, 16 bp, R. norvegicus
atccctgacttcaagg

SEQ ID NO: 480903 - DNA, 16 bp, R. norvegicus
atccctgcacctgaga

SEQ ID NO: 480904 - DNA, 16 bp, R. norvegicus
atccctggaacccaca

SEQ ID NO: 480905 - DNA, 16 bp, R. norvegicus
atccctggagctggag

SEQ ID NO: 480906 - DNA, 16 bp, R. norvegicus
atccctggcccaacag

SEQ ID NO: 480907 - DNA, 16 bp, R. norvegicus
atccctggcccaaggg

SEQ ID NO: 480908 - DNA, 16 bp, R. norvegicus
atccctgggatgcagg

SEQ ID NO: 480909 - DNA, 16 bp, R. norvegicus
atccctgggccaagca

SEQ ID NO: 480910 - DNA, 16 bp, R. norvegicus
atccctgggccaaggg

SEQ ID NO: 480911 - DNA, 16 bp, R. norvegicus
atccctgtggaagcaa

SEQ ID NO: 480912 - DNA, 16 bp, R. norvegicus
atccctttgttctcct

SEQ ID NO: 480913 - DNA, 16 bp, R. norvegicus
atccgcctgcctctac

SEQ ID NO: 480914 - DNA, 31 bp, R. norvegicus
atcctaaactgtcctgggaaagaccttgtta

SEQ ID NO: 480915 - DNA, 16 bp, R. norvegicus
atcctaaagcagaagg

SEQ ID NO: 480916 - DNA, 16 bp, R. norvegicus
atcctacccagctaaa

SEQ ID NO: 480917 - DNA, 16 bp, R. norvegicus
atcctactacaaaact

SEQ ID NO: 480918 - DNA, 16 bp, R. norvegicus
atcctagaactcatta

SEQ ID NO: 480919 - DNA, 16 bp, R. norvegicus
atcctagcactccaga

SEQ ID NO: 480920 - DNA, 16 bp, R. norvegicus
atcctagccattctga

SEQ ID NO: 480921 - DNA, 29 bp, R. norvegicus
atcctatgccatggcatggaggctcccaa

SEQ ID NO: 480922 - DNA, 16 bp, R. norvegicus
atcctatgtcctcttc

SEQ ID NO: 480923 - DNA, 16 bp, R. norvegicus
atcctcaagcagttca

SEQ ID NO: 480924 - DNA, 16 bp, R. norvegicus
atcctcaaggccaagg

SEQ ID NO: 480925 - DNA, 49 bp, R. norvegicus
atcctcacagtctgtggtcacggccttggaaacagtgttaaagcagagg

SEQ ID NO: 480926 - DNA, 16 bp, R. norvegicus
atcctcaccaataaaa

SEQ ID NO: 480927 - DNA, 16 bp, R. norvegicus
atcctcaccagcaccc

SEQ ID NO: 480928 - DNA, 16 bp, R. norvegicus
atcctcaccagcatct

SEQ ID NO: 480929 - DNA, 16 bp, R. norvegicus
atcctcagctacatat

SEQ ID NO: 480930 - DNA, 16 bp, R. norvegicus
atcctcaggtgaggca

SEQ ID NO: 480931 - DNA, 16 bp, R. norvegicus
atcctcatagaagaaa

SEQ ID NO: 480932 - DNA, 16 bp, R. norvegicus
atcctcatagaagaag

SEQ ID NO: 480933 - DNA, 16 bp, R. norvegicus
atcctcatctgcatca

SEQ ID NO: 480934 - DNA, 16 bp, R. norvegicus
atcctcatctgtttca

SEQ ID NO: 480935 - DNA, 16 bp, R. norvegicus
atcctccccccgttac

SEQ ID NO: 480936 - DNA, 16 bp, R. norvegicus
atcctccccccttgtt

SEQ ID NO: 480937 - DNA, 16 bp, R. norvegicus
atcctcctagaagcag

SEQ ID NO: 480938 - DNA, 16 bp, R. norvegicus
atcctcctctgtatca

SEQ ID NO: 480939 - DNA, 16 bp, R. norvegicus
atcctcctgcatcagc

SEQ ID NO: 480940 - DNA, 16 bp, R. norvegicus
atcctcctgcatcagt

SEQ ID NO: 480941 - DNA, 16 bp, R. norvegicus
atcctcctgcctcagc

SEQ ID NO: 480942 - DNA, 16 bp, R. norvegicus
atcctcctgcctcagt

SEQ ID NO: 480943 - DNA, 16 bp, R. norvegicus
atcctcctgcctccac

SEQ ID NO: 480944 - DNA, 16 bp, R. norvegicus
atcctcctgcctctac

SEQ ID NO: 480945 - DNA, 16 bp, R. norvegicus
atcctcctgcctctgc

SEQ ID NO: 480946 - DNA, 16 bp, R. norvegicus
atcctcctgctccagc

SEQ ID NO: 480947 - DNA, 16 bp, R. norvegicus
atcctcctgcttcagc

SEQ ID NO: 480948 - DNA, 16 bp, R. norvegicus
atcctcctgcttccac

SEQ ID NO: 480949 - DNA, 16 bp, R. norvegicus
atcctcctggagctgg

SEQ ID NO: 480950 - DNA, 16 bp, R. norvegicus
atcctcctgtctcagc

SEQ ID NO: 480951 - DNA, 16 bp, R. norvegicus
atcctctccagcatct

SEQ ID NO: 480952 - DNA, 16 bp, R. norvegicus
atcctctgctacatat

SEQ ID NO: 480953 - DNA, 16 bp, R. norvegicus
atcctctggaagaata

SEQ ID NO: 480954 - DNA, 16 bp, R. norvegicus
atcctctgtctctgtc

SEQ ID NO: 480955 - DNA, 16 bp, R. norvegicus
atcctcttggacttga

SEQ ID NO: 480956 - DNA, 16 bp, R. norvegicus
atcctcttggagatga

SEQ ID NO: 480957 - DNA, 16 bp, R. norvegicus
atcctgacctccagtt

SEQ ID NO: 480958 - DNA, 16 bp, R. norvegicus
atcctgaccttggcca

SEQ ID NO: 480959 - DNA, 16 bp, R. norvegicus
atcctgagaacacagg

SEQ ID NO: 480960 - DNA, 16 bp, R. norvegicus
atcctgaggcatacca

SEQ ID NO: 480961 - DNA, 16 bp, R. norvegicus
atcctgaggtggggca

SEQ ID NO: 480962 - DNA, 16 bp, R. norvegicus
atcctgagtgaagtaa

SEQ ID NO: 480963 - DNA, 16 bp, R. norvegicus
atcctgagtgaggaaa

SEQ ID NO: 480964 - DNA, 16 bp, R. norvegicus
atcctgagtgaggtat

SEQ ID NO: 480965 - DNA, 16 bp, R. norvegicus
atcctgagtgaggtca

SEQ ID NO: 480966 - DNA, 16 bp, R. norvegicus
atcctgagtgtggtaa

SEQ ID NO: 480967 - DNA, 19 bp, R. norvegicus
atcctgagttcaattccca

SEQ ID NO: 480968 - DNA, 16 bp, R. norvegicus
atcctgatcctcctgc

SEQ ID NO: 480969 - DNA, 16 bp, R. norvegicus
atcctgatgatgaaga

SEQ ID NO: 480970 - DNA, 16 bp, R. norvegicus
atcctgcagaagaggg

SEQ ID NO: 480971 - DNA, 16 bp, R. norvegicus
atcctgcaggagttgg

SEQ ID NO: 480972 - DNA, 16 bp, R. norvegicus
atcctgccaagccatg

SEQ ID NO: 480973 - DNA, 16 bp, R. norvegicus
atcctgccagcattta

SEQ ID NO: 480974 - DNA, 16 bp, R. norvegicus
atcctgccccctgtgg

SEQ ID NO: 480975 - DNA, 16 bp, R. norvegicus
atcctgcctgctgcct

SEQ ID NO: 480976 - DNA, 16 bp, R. norvegicus
atcctgcctttcctga

SEQ ID NO: 480977 - DNA, 19 bp, R. norvegicus
atcctgcgcaggagacaga

SEQ ID NO: 480978 - DNA, 16 bp, R. norvegicus
atcctgctcactgtcc

SEQ ID NO: 480979 - DNA, 16 bp, R. norvegicus
atcctgctgcctctgc

SEQ ID NO: 480980 - DNA, 16 bp, R. norvegicus
atcctgctgggagaaa

SEQ ID NO: 480981 - DNA, 16 bp, R. norvegicus
atcctgctgggggttt

SEQ ID NO: 480982 - DNA, 16 bp, R. norvegicus
atcctggatggatttg

SEQ ID NO: 480983 - DNA, 16 bp, R. norvegicus
atcctggcactgggga

SEQ ID NO: 480984 - DNA, 16 bp, R. norvegicus
atcctgggacccacat

SEQ ID NO: 480985 - DNA, 16 bp, R. norvegicus
atcctgggccagaagg

SEQ ID NO: 480986 - DNA, 16 bp, R. norvegicus
atcctgggccctcccc

SEQ ID NO: 480987 - DNA, 16 bp, R. norvegicus
atcctgggttcaatcc

SEQ ID NO: 480988 - DNA, 16 bp, R. norvegicus
atcctgggtttttgtt

SEQ ID NO: 480989 - DNA, 16 bp, R. norvegicus
atcctgtccctggctg

SEQ ID NO: 480990 - DNA, 16 bp, R. norvegicus
atcctgtgatgttgga

SEQ ID NO: 480991 - DNA, 16 bp, R. norvegicus
atcctgtgtgtgctgc

SEQ ID NO: 480992 - DNA, 16 bp, R. norvegicus
atcctgttcactgggg

SEQ ID NO: 480993 - DNA, 16 bp, R. norvegicus
atcctgttcctgtcag

SEQ ID NO: 480994 - DNA, 16 bp, R. norvegicus
atccttacagagcaac

SEQ ID NO: 480995 - DNA, 16 bp, R. norvegicus
atccttagctacatat

SEQ ID NO: 480996 - DNA, 16 bp, R. norvegicus
atccttagtcatcagg

SEQ ID NO: 480997 - DNA, 16 bp, R. norvegicus
atccttcccagtgtct

SEQ ID NO: 480998 - DNA, 16 bp, R. norvegicus
atccttctgcagaaat

SEQ ID NO: 480999 - DNA, 16 bp, R. norvegicus
atccttctgcctccag

SEQ ID NO: 481000 - DNA, 16 bp, R. norvegicus
atccttgtgtgtgtgt

SEQ ID NO: 481001 - DNA, 16 bp, R. norvegicus
atcctttcacaaaaca

SEQ ID NO: 481002 - DNA, 16 bp, R. norvegicus
atcctttcacctgtgt

SEQ ID NO: 481003 - DNA, 16 bp, R. norvegicus
atcctttctacctgcc

SEQ ID NO: 481004 - DNA, 16 bp, R. norvegicus
atccttttgctttagc

SEQ ID NO: 481005 - DNA, 16 bp, R. norvegicus
atcgacagattcaatg

SEQ ID NO: 481006 - DNA, 16 bp, R. norvegicus
atcgagctgccgctgc

SEQ ID NO: 481007 - DNA, 16 bp, R. norvegicus
atcgctgacctcaagc

SEQ ID NO: 481008 - DNA, 16 bp, R. norvegicus
atctaaaaatgggaat

SEQ ID NO: 481009 - DNA, 16 bp, R. norvegicus
atctaaacaaactcaa

SEQ ID NO: 481010 - DNA, 16 bp, R. norvegicus
atctaaacaaagaatt

SEQ ID NO: 481011 - DNA, 16 bp, R. norvegicus
atctaaacaaccacat

SEQ ID NO: 481012 - DNA, 16 bp, R. norvegicus
atctaaacagcacaaa

SEQ ID NO: 481013 - DNA, 16 bp, R. norvegicus
atctaaagaacatttc

SEQ ID NO: 481014 - DNA, 16 bp, R. norvegicus
atctaaatgaaatgaa

SEQ ID NO: 481015 - DNA, 16 bp, R. norvegicus
atctaaatgaaattgt

SEQ ID NO: 481016 - DNA, 16 bp, R. norvegicus
atctaacagatgtctt

SEQ ID NO: 481017 - DNA, 16 bp, R. norvegicus
atctaagaaaaaaatt

SEQ ID NO: 481018 - DNA, 16 bp, R. norvegicus
atctaatagtgccact

SEQ ID NO: 481019 - DNA, 16 bp, R. norvegicus
atctacaaaaccttcc

SEQ ID NO: 481020 - DNA, 16 bp, R. norvegicus
atctacaacacaattc

SEQ ID NO: 481021 - DNA, 16 bp, R. norvegicus
atctacagattcagag

SEQ ID NO: 481022 - DNA, 16 bp, R. norvegicus
atctacagattcagtg

SEQ ID NO: 481023 - DNA, 19 bp, R. norvegicus
atctacagctccttgtctt

SEQ ID NO: 481024 - DNA, 16 bp, R. norvegicus
atctacaggcagcagg

SEQ ID NO: 481025 - DNA, 16 bp, R. norvegicus
atctacatccagttct

SEQ ID NO: 481026 - DNA, 22 bp, R. norvegicus
atctacatccggctcctgtcgg

SEQ ID NO: 481027 - DNA, 16 bp, R. norvegicus
atctaccaagatgaat

SEQ ID NO: 481028 - DNA, 16 bp, R. norvegicus
atctaccactgagcta

SEQ ID NO: 481029 - DNA, 16 bp, R. norvegicus
atctacctgcctctga

SEQ ID NO: 481030 - DNA, 16 bp, R. norvegicus
atctactcatcagcaa

SEQ ID NO: 481031 - DNA, 16 bp, R. norvegicus
atctactggagatggt

SEQ ID NO: 481032 - DNA, 16 bp, R. norvegicus
atctactggatatggt

SEQ ID NO: 481033 - DNA, 16 bp, R. norvegicus
atctacttgcttctgc

SEQ ID NO: 481034 - DNA, 16 bp, R. norvegicus
atctaggttctttcca

SEQ ID NO: 481035 - DNA, 16 bp, R. norvegicus
atctagtgtctgagag

SEQ ID NO: 481036 - DNA, 39 bp, R. norvegicus
atctatacaatggaatattactcagctatcaaaaacaat

SEQ ID NO: 481037 - DNA, 18 bp, R. norvegicus
atctatatctatatctat

SEQ ID NO: 481038 - DNA, 16 bp, R. norvegicus
atctatatctgtatct

SEQ ID NO: 481039 - DNA, 16 bp, R. norvegicus
atctatcagtaaagat

SEQ ID NO: 481040 - DNA, 16 bp, R. norvegicus
atctatccatccattc

SEQ ID NO: 481041 - DNA, 16 bp, R. norvegicus
atctatgaaggccaga

SEQ ID NO: 481042 - DNA, 16 bp, R. norvegicus
atctatgagagtgacc

SEQ ID NO: 481043 - DNA, 16 bp, R. norvegicus
atctatgtatctgtct

SEQ ID NO: 481044 - DNA, 16 bp, R. norvegicus
atctattcattcattt

SEQ ID NO: 481045 - DNA, 16 bp, R. norvegicus
atctattcttcagttg

SEQ ID NO: 481046 - DNA, 16 bp, R. norvegicus
atctatttatctgtct

SEQ ID NO: 481047 - DNA, 16 bp, R. norvegicus
atctatttggtgttct

SEQ ID NO: 481048 - DNA, 16 bp, R. norvegicus
atctcaagccaaaatt

SEQ ID NO: 481049 - DNA, 16 bp, R. norvegicus
atctcaaggacaaagg

SEQ ID NO: 481050 - DNA, 16 bp, R. norvegicus
atctcacaccctcttc

SEQ ID NO: 481051 - DNA, 16 bp, R. norvegicus
atctcaccagccccag

SEQ ID NO: 481052 - DNA, 16 bp, R. norvegicus
atctcactggccccaa

SEQ ID NO: 481053 - DNA, 16 bp, R. norvegicus
atctcacttagaaggg

SEQ ID NO: 481054 - DNA, 16 bp, R. norvegicus
atctcagaagataaaa

SEQ ID NO: 481055 - DNA, 17 bp, R. norvegicus
atctcagaagatggaaa

SEQ ID NO: 481056 - DNA, 16 bp, R. norvegicus
atctcagagctctgga

SEQ ID NO: 481057 - DNA, 16 bp, R. norvegicus
atctcagcaaaatggt

SEQ ID NO: 481058 - DNA, 16 bp, R. norvegicus
atctcagcacttcaga

SEQ ID NO: 481059 - DNA, 16 bp, R. norvegicus
atctcagcatgtggga

SEQ ID NO: 481060 - DNA, 17 bp, R. norvegicus
atctcaggagcggaaga

SEQ ID NO: 481061 - DNA, 16 bp, R. norvegicus
atctcaggagtggtct

SEQ ID NO: 481062 - DNA, 16 bp, R. norvegicus
atctcaggatcagaag

SEQ ID NO: 481063 - DNA, 16 bp, R. norvegicus
atctcatgaaactgca

SEQ ID NO: 481064 - DNA, 16 bp, R. norvegicus
atctcattataggtgg

SEQ ID NO: 481065 - DNA, 17 bp, R. norvegicus
atctcattatggatggt

SEQ ID NO: 481066 - DNA, 16 bp, R. norvegicus
atctcattcctcctcc

SEQ ID NO: 481067 - DNA, 16 bp, R. norvegicus
atctccaccaaaacta

SEQ ID NO: 481068 - DNA, 16 bp, R. norvegicus
atctccagggaggaga

SEQ ID NO: 481069 - DNA, 16 bp, R. norvegicus
atctccatccccatct

SEQ ID NO: 481070 - DNA, 16 bp, R. norvegicus
atctcccaaccaaaaa

SEQ ID NO: 481071 - DNA, 16 bp, R. norvegicus
atctccccagcctcag

SEQ ID NO: 481072 - DNA, 16 bp, R. norvegicus
atctccccccagaaat

SEQ ID NO: 481073 - DNA, 16 bp, R. norvegicus
atctccctgctgttgg

SEQ ID NO: 481074 - DNA, 16 bp, R. norvegicus
atctcctacctcctga

SEQ ID NO: 481075 - DNA, 16 bp, R. norvegicus
atctcctatgctcaag

SEQ ID NO: 481076 - DNA, 16 bp, R. norvegicus
atctcctcaggaaaag

SEQ ID NO: 481077 - DNA, 16 bp, R. norvegicus
atctcctcctctgaat

SEQ ID NO: 481078 - DNA, 16 bp, R. norvegicus
atctcctctggctctt

SEQ ID NO: 481079 - DNA, 16 bp, R. norvegicus
atctcctggctccttc

SEQ ID NO: 481080 - DNA, 16 bp, R. norvegicus
atctcctgtagaaggc

SEQ ID NO: 481081 - DNA, 16 bp, R. norvegicus
atctcctgtgattatt

SEQ ID NO: 481082 - DNA, 16 bp, R. norvegicus
atctccttatataccc

SEQ ID NO: 481083 - DNA, 16 bp, R. norvegicus
atctcctttccctgtt

SEQ ID NO: 481084 - DNA, 16 bp, R. norvegicus
atctcgcctgagagac

SEQ ID NO: 481085 - DNA, 16 bp, R. norvegicus
atctctcagactctga

SEQ ID NO: 481086 - DNA, 16 bp, R. norvegicus
atctctccagcccatg

SEQ ID NO: 481087 - DNA, 16 bp, R. norvegicus
atctctccagcccctc

SEQ ID NO: 481088 - DNA, 16 bp, R. norvegicus
atctctccagctccct

SEQ ID NO: 481089 - DNA, 16 bp, R. norvegicus
atctctccagctctta

SEQ ID NO: 481090 - DNA, 16 bp, R. norvegicus
atctctccagtcttct

SEQ ID NO: 481091 - DNA, 16 bp, R. norvegicus
atctctccagttccag

SEQ ID NO: 481092 - DNA, 16 bp, R. norvegicus
atctctcctgccccag

SEQ ID NO: 481093 - DNA, 16 bp, R. norvegicus
atctctgaaccccatt

SEQ ID NO: 481094 - DNA, 16 bp, R. norvegicus
atctctgaattcaagg

SEQ ID NO: 481095 - DNA, 16 bp, R. norvegicus
atctctgagctcgagg

SEQ ID NO: 481096 - DNA, 16 bp, R. norvegicus
atctctgagtctgagg

SEQ ID NO: 481097 - DNA, 16 bp, R. norvegicus
atctctgagtttgaga

SEQ ID NO: 481098 - DNA, 16 bp, R. norvegicus
atctctgagtttgagg

SEQ ID NO: 481099 - DNA, 16 bp, R. norvegicus
atctctgcaagtttga

SEQ ID NO: 481100 - DNA, 16 bp, R. norvegicus
atctctgctaccttgc

SEQ ID NO: 481101 - DNA, 16 bp, R. norvegicus
atctctgcttcccaag

SEQ ID NO: 481102 - DNA, 16 bp, R. norvegicus
atctctggatggtctt

SEQ ID NO: 481103 - DNA, 16 bp, R. norvegicus
atctctggcctccaca

SEQ ID NO: 481104 - DNA, 16 bp, R. norvegicus
atctctgggaatctca

SEQ ID NO: 481105 - DNA, 16 bp, R. norvegicus
atctctgtgtctttct

SEQ ID NO: 481106 - DNA, 16 bp, R. norvegicus
atctctgtgttttcca

SEQ ID NO: 481107 - DNA, 16 bp, R. norvegicus
atctcttcagccccac

SEQ ID NO: 481108 - DNA, 16 bp, R. norvegicus
atctcttcagccctga

SEQ ID NO: 481109 - DNA, 16 bp, R. norvegicus
atctcttcccaatctg

SEQ ID NO: 481110 - DNA, 16 bp, R. norvegicus
atctcttctgagggat

SEQ ID NO: 481111 - DNA, 16 bp, R. norvegicus
atctctttcctcctga

SEQ ID NO: 481112 - DNA, 16 bp, R. norvegicus
atctcttttgttctgt

SEQ ID NO: 481113 - DNA, 16 bp, R. norvegicus
atctcttttttaaaaa

SEQ ID NO: 481114 - DNA, 16 bp, R. norvegicus
atctgaaaataatgat

SEQ ID NO: 481115 - DNA, 16 bp, R. norvegicus
atctgaactcagggcc

SEQ ID NO: 481116 - DNA, 16 bp, R. norvegicus
atctgaagaggtttgc

SEQ ID NO: 481117 - DNA, 16 bp, R. norvegicus
atctgaatgaaatgga

SEQ ID NO: 481118 - DNA, 16 bp, R. norvegicus
atctgacaggagtcag

SEQ ID NO: 481119 - DNA, 16 bp, R. norvegicus
atctgacatcactggg

SEQ ID NO: 481120 - DNA, 16 bp, R. norvegicus
atctgactcttttagc

SEQ ID NO: 481121 - DNA, 16 bp, R. norvegicus
atctgactgtctctgt

SEQ ID NO: 481122 - DNA, 16 bp, R. norvegicus
atctgagggctgctag

SEQ ID NO: 481123 - DNA, 16 bp, R. norvegicus
atctgagttcaagacc

SEQ ID NO: 481124 - DNA, 16 bp, R. norvegicus
atctgagttctgttcc

SEQ ID NO: 481125 - DNA, 16 bp, R. norvegicus
atctgagttctttcca

SEQ ID NO: 481126 - DNA, 16 bp, R. norvegicus
atctgataaacacctt

SEQ ID NO: 481127 - DNA, 16 bp, R. norvegicus
atctgatgcttctggc

SEQ ID NO: 481128 - DNA, 16 bp, R. norvegicus
atctgatggttcctca

SEQ ID NO: 481129 - DNA, 16 bp, R. norvegicus
atctgatgtgcaggat

SEQ ID NO: 481130 - DNA, 16 bp, R. norvegicus
atctgcaactccagct

SEQ ID NO: 481131 - DNA, 16 bp, R. norvegicus
atctgcaagcagaaga

SEQ ID NO: 481132 - DNA, 16 bp, R. norvegicus
atctgcaagcagcagg

SEQ ID NO: 481133 - DNA, 18 bp, R. norvegicus
atctgcaggactccaggg

SEQ ID NO: 481134 - DNA, 16 bp, R. norvegicus
atctgcagtcacctga

SEQ ID NO: 481135 - DNA, 16 bp, R. norvegicus
atctgcatatgtgtgt

SEQ ID NO: 481136 - DNA, 16 bp, R. norvegicus
atctgcatgcacacct

SEQ ID NO: 481137 - DNA, 16 bp, R. norvegicus
atctgcctatctctgt

SEQ ID NO: 481138 - DNA, 16 bp, R. norvegicus
atctgcctgcctctgc

SEQ ID NO: 481139 - DNA, 16 bp, R. norvegicus
atctgcctgtctctct

SEQ ID NO: 481140 - DNA, 16 bp, R. norvegicus
atctgctccagctcag

SEQ ID NO: 481141 - DNA, 16 bp, R. norvegicus
atctgctgcaaagaga

SEQ ID NO: 481142 - DNA, 16 bp, R. norvegicus
atctgctgcagaagga

SEQ ID NO: 481143 - DNA, 16 bp, R. norvegicus
atctgctgcctacagg

SEQ ID NO: 481144 - DNA, 16 bp, R. norvegicus
atctgctgctgctgct

SEQ ID NO: 481145 - DNA, 16 bp, R. norvegicus
atctgctggcctctgc

SEQ ID NO: 481146 - DNA, 16 bp, R. norvegicus
atctggaaacctctag

SEQ ID NO: 481147 - DNA, 16 bp, R. norvegicus
atctggaaagagagaa

SEQ ID NO: 481148 - DNA, 16 bp, R. norvegicus
atctggaaggaaggaa

SEQ ID NO: 481149 - DNA, 16 bp, R. norvegicus
atctggaaggagggaa

SEQ ID NO: 481150 - DNA, 16 bp, R. norvegicus
atctggaggaaaagga

SEQ ID NO: 481151 - DNA, 16 bp, R. norvegicus
atctggaggcagaggc

SEQ ID NO: 481152 - DNA, 16 bp, R. norvegicus
atctggatgaaatgaa

SEQ ID NO: 481153 - DNA, 16 bp, R. norvegicus
atctggattctttcca

SEQ ID NO: 481154 - DNA, 16 bp, R. norvegicus
atctggcagtttctca

SEQ ID NO: 481155 - DNA, 16 bp, R. norvegicus
atctggctcctgctcc

SEQ ID NO: 481156 - DNA, 16 bp, R. norvegicus
atctggctcctgttag

SEQ ID NO: 481157 - DNA, 16 bp, R. norvegicus
atctgggacaagacaa

SEQ ID NO: 481158 - DNA, 16 bp, R. norvegicus
atctgggattttctgg

SEQ ID NO: 481159 - DNA, 16 bp, R. norvegicus
atctgggatttttttt

SEQ ID NO: 481160 - DNA, 16 bp, R. norvegicus
atctggggctcagtgt

SEQ ID NO: 481161 - DNA, 16 bp, R. norvegicus
atctggggtgtgtgtg

SEQ ID NO: 481162 - DNA, 16 bp, R. norvegicus
atctgggttcagttcc

SEQ ID NO: 481163 - DNA, 16 bp, R. norvegicus
atctgggttcttccag

SEQ ID NO: 481164 - DNA, 16 bp, R. norvegicus
atctgggttcttttca

SEQ ID NO: 481165 - DNA, 16 bp, R. norvegicus
atctgggttgcttcta

SEQ ID NO: 481166 - DNA, 16 bp, R. norvegicus
atctgggttgtttcca

SEQ ID NO: 481167 - DNA, 16 bp, R. norvegicus
atctggtcctggcctc

SEQ ID NO: 481168 - DNA, 16 bp, R. norvegicus
atctggttctctctgg

SEQ ID NO: 481169 - DNA, 16 bp, R. norvegicus
atctggtttcaaaatc

SEQ ID NO: 481170 - DNA, 16 bp, R. norvegicus
atctggttttatgggg

SEQ ID NO: 481171 - DNA, 16 bp, R. norvegicus
atctgtaaaatgggag

SEQ ID NO: 481172 - DNA, 16 bp, R. norvegicus
atctgtaaccccttga

SEQ ID NO: 481173 - DNA, 16 bp, R. norvegicus
atctgtaattccagtg

SEQ ID NO: 481174 - DNA, 16 bp, R. norvegicus
atctgtagactgcttt

SEQ ID NO: 481175 - DNA, 16 bp, R. norvegicus
atctgtatagaaaatt

SEQ ID NO: 481176 - DNA, 17 bp, R. norvegicus
atctgtatccaccacct

SEQ ID NO: 481177 - DNA, 16 bp, R. norvegicus
atctgtatctgtatct

SEQ ID NO: 481178 - DNA, 16 bp, R. norvegicus
atctgtatgagaagaa

SEQ ID NO: 481179 - DNA, 16 bp, R. norvegicus
atctgtctctgtctct

SEQ ID NO: 481180 - DNA, 16 bp, R. norvegicus
atctgtctgtccctgt

SEQ ID NO: 481181 - DNA, 32 bp, R. norvegicus
atctgtggaatgtatagcttctcagttaggag

SEQ ID NO: 481182 - DNA, 16 bp, R. norvegicus
atctgtgtgcctctgc

SEQ ID NO: 481183 - DNA, 16 bp, R. norvegicus
atctgtgtggtgtgtg

SEQ ID NO: 481184 - DNA, 16 bp, R. norvegicus
atctgtgtgtatctgt

SEQ ID NO: 481185 - DNA, 16 bp, R. norvegicus
atctgtgttctttcca

SEQ ID NO: 481186 - DNA, 16 bp, R. norvegicus
atctgtgttttcctat

SEQ ID NO: 481187 - DNA, 16 bp, R. norvegicus
atctgttctctccttc

SEQ ID NO: 481188 - DNA, 16 bp, R. norvegicus
atctgttgtcatctga

SEQ ID NO: 481189 - DNA, 16 bp, R. norvegicus
atctgttgtcgcctga

SEQ ID NO: 481190 - DNA, 16 bp, R. norvegicus
atctgtttcaaatttg

SEQ ID NO: 481191 - DNA, 16 bp, R. norvegicus
atcttagaaaatggag

SEQ ID NO: 481192 - DNA, 16 bp, R. norvegicus
atcttagaagatgaaa

SEQ ID NO: 481193 - DNA, 16 bp, R. norvegicus
atcttagccattctga

SEQ ID NO: 481194 - DNA, 16 bp, R. norvegicus
atcttagctagagcaa

SEQ ID NO: 481195 - DNA, 23 bp, R. norvegicus
atcttatggtatcttgccaaaat

SEQ ID NO: 481196 - DNA, 16 bp, R. norvegicus
atcttcaaagtcaact

SEQ ID NO: 481197 - DNA, 16 bp, R. norvegicus
atcttcaacatcttta

SEQ ID NO: 481198 - DNA, 16 bp, R. norvegicus
atcttcagattttgaa

SEQ ID NO: 481199 - DNA, 16 bp, R. norvegicus
atcttcaggaaatgaa

SEQ ID NO: 481200 - DNA, 16 bp, R. norvegicus
atcttcaggcagcaga

SEQ ID NO: 481201 - DNA, 16 bp, R. norvegicus
atcttcaggctttcat

SEQ ID NO: 481202 - DNA, 16 bp, R. norvegicus
atcttcatcatcacca

SEQ ID NO: 481203 - DNA, 16 bp, R. norvegicus
atcttcccagtgctgg

SEQ ID NO: 481204 - DNA, 16 bp, R. norvegicus
atcttcctcagtttct

SEQ ID NO: 481205 - DNA, 16 bp, R. norvegicus
atcttcctcatcttcc

SEQ ID NO: 481206 - DNA, 16 bp, R. norvegicus
atcttcctggtggctg

SEQ ID NO: 481207 - DNA, 17 bp, R. norvegicus
atcttcctggttgctgc

SEQ ID NO: 481208 - DNA, 16 bp, R. norvegicus
atcttcctggtttctg

SEQ ID NO: 481209 - DNA, 16 bp, R. norvegicus
atcttctccatttttg

SEQ ID NO: 481210 - DNA, 16 bp, R. norvegicus
atcttctctgaatgaa

SEQ ID NO: 481211 - DNA, 16 bp, R. norvegicus
atcttctgatcctgag

SEQ ID NO: 481212 - DNA, 16 bp, R. norvegicus
atcttctggagctgga

SEQ ID NO: 481213 - DNA, 16 bp, R. norvegicus
atcttctggcttccat

SEQ ID NO: 481214 - DNA, 17 bp, R. norvegicus
atcttctggctttcata

SEQ ID NO: 481215 - DNA, 16 bp, R. norvegicus
atcttctgtttgcctt

SEQ ID NO: 481216 - DNA, 16 bp, R. norvegicus
atcttcttcaatctct

SEQ ID NO: 481217 - DNA, 18 bp, R. norvegicus
atcttcttctcagctcct

SEQ ID NO: 481218 - DNA, 16 bp, R. norvegicus
atcttcttggagatgg

SEQ ID NO: 481219 - DNA, 16 bp, R. norvegicus
atcttctttgaagaaa

SEQ ID NO: 481220 - DNA, 16 bp, R. norvegicus
atcttgaaaagcacac

SEQ ID NO: 481221 - DNA, 16 bp, R. norvegicus
atcttgaggtagatct

SEQ ID NO: 481222 - DNA, 16 bp, R. norvegicus
atcttgatgattttct

SEQ ID NO: 481223 - DNA, 16 bp, R. norvegicus
atcttgcagaaagcaa

SEQ ID NO: 481224 - DNA, 16 bp, R. norvegicus
atcttggctgaatatt

SEQ ID NO: 481225 - DNA, 16 bp, R. norvegicus
atcttggctgtcctgg

SEQ ID NO: 481226 - DNA, 16 bp, R. norvegicus
atcttgggaacaaaac

SEQ ID NO: 481227 - DNA, 16 bp, R. norvegicus
atcttggttctttcca

SEQ ID NO: 481228 - DNA, 16 bp, R. norvegicus
atcttggtttctgcat

SEQ ID NO: 481229 - DNA, 16 bp, R. norvegicus
atcttgtaaatattgt

SEQ ID NO: 481230 - DNA, 16 bp, R. norvegicus
atcttgtaatggagtt

SEQ ID NO: 481231 - DNA, 16 bp, R. norvegicus
atcttgtagcccaggc

SEQ ID NO: 481232 - DNA, 16 bp, R. norvegicus
atcttgttcagaaggc

SEQ ID NO: 481233 - DNA, 16 bp, R. norvegicus
atcttgtttgataact

SEQ ID NO: 481234 - DNA, 16 bp, R. norvegicus
atcttgttttatgtga

SEQ ID NO: 481235 - DNA, 16 bp, R. norvegicus
atctttaaaaaacatt

SEQ ID NO: 481236 - DNA, 16 bp, R. norvegicus
atctttaaaagaataa

SEQ ID NO: 481237 - DNA, 16 bp, R. norvegicus
atctttaaagatttat

SEQ ID NO: 481238 - DNA, 16 bp, R. norvegicus
atctttacaatattaa

SEQ ID NO: 481239 - DNA, 16 bp, R. norvegicus
atctttaccaactcta

SEQ ID NO: 481240 - DNA, 16 bp, R. norvegicus
atctttaccaatcctc

SEQ ID NO: 481241 - DNA, 16 bp, R. norvegicus
atctttatcaattcta

SEQ ID NO: 481242 - DNA, 16 bp, R. norvegicus
atctttattaaatttg

SEQ ID NO: 481243 - DNA, 16 bp, R. norvegicus
atctttcagtttattt

SEQ ID NO: 481244 - DNA, 16 bp, R. norvegicus
atctttccaagtcttt

SEQ ID NO: 481245 - DNA, 16 bp, R. norvegicus
atctttccaggatttt

SEQ ID NO: 481246 - DNA, 16 bp, R. norvegicus
atctttcctcctttaa

SEQ ID NO: 481247 - DNA, 16 bp, R. norvegicus
atctttcctttgatga

SEQ ID NO: 481248 - DNA, 16 bp, R. norvegicus
atctttctgcttctgc

SEQ ID NO: 481249 - DNA, 16 bp, R. norvegicus
atctttctgggtctga

SEQ ID NO: 481250 - DNA, 16 bp, R. norvegicus
atctttctgtgcctgt

SEQ ID NO: 481251 - DNA, 16 bp, R. norvegicus
atctttgaaaaaagaa

SEQ ID NO: 481252 - DNA, 16 bp, R. norvegicus
atctttgacaatgaag

SEQ ID NO: 481253 - DNA, 16 bp, R. norvegicus
atctttgacagttttg

SEQ ID NO: 481254 - DNA, 16 bp, R. norvegicus
atctttgccaatccta

SEQ ID NO: 481255 - DNA, 16 bp, R. norvegicus
atctttgctgatcttc

SEQ ID NO: 481256 - DNA, 16 bp, R. norvegicus
atctttgcttccctga

SEQ ID NO: 481257 - DNA, 16 bp, R. norvegicus
atctttggagaccctg

SEQ ID NO: 481258 - DNA, 16 bp, R. norvegicus
atctttgtccctgaat

SEQ ID NO: 481259 - DNA, 16 bp, R. norvegicus
atctttgttgccctgg

SEQ ID NO: 481260 - DNA, 16 bp, R. norvegicus
atcttttaaaaaaaga

SEQ ID NO: 481261 - DNA, 16 bp, R. norvegicus
atcttttgaaaacttt

SEQ ID NO: 481262 - DNA, 28 bp, R. norvegicus
atcttttgggtatatgcccaagagagct

SEQ ID NO: 481263 - DNA, 34 bp, R. norvegicus
atcttttgggtatatgcccaagagaggtataact

SEQ ID NO: 481264 - DNA, 73 bp, R. norvegicus
atcttttgggtatatgcccaagagaggtatagctggatcatcaggcagttcaatgtccaattttctgaggaac

SEQ ID NO: 481265 - DNA, 71 bp, R. norvegicus
atcttttgggtatatgcccaagagaggtatagctggatcctcaggcagttcaatgtccaattttctgagga

SEQ ID NO: 481266 - DNA, 71 bp, R. norvegicus
atcttttgggtatatgcccaagagaggtatggctggatcctcaggcagttcaatgtccaattttctgagga

SEQ ID NO: 481267 - DNA, 16 bp, R. norvegicus
atcttttggttgccat

SEQ ID NO: 481268 - DNA, 16 bp, R. norvegicus
atcttttttaaaaaag

SEQ ID NO: 481269 - DNA, 16 bp, R. norvegicus
atcttttttgaaaact

SEQ ID NO: 481270 - DNA, 16 bp, R. norvegicus
atctttttttctactg

SEQ ID NO: 481271 - DNA, 16 bp, R. norvegicus
atgaaaaagaaggcac

SEQ ID NO: 481272 - DNA, 16 bp, R. norvegicus
atgaaaaatacatttt

SEQ ID NO: 481273 - DNA, 16 bp, R. norvegicus
atgaaaaatattcaga

SEQ ID NO: 481274 - DNA, 16 bp, R. norvegicus
atgaaaaatcattttt

SEQ ID NO: 481275 - DNA, 16 bp, R. norvegicus
atgaaaacaaacacat

SEQ ID NO: 481276 - DNA, 16 bp, R. norvegicus
atgaaaacaaccctgg

SEQ ID NO: 481277 - DNA, 16 bp, R. norvegicus
atgaaaacaataacca

SEQ ID NO: 481278 - DNA, 16 bp, R. norvegicus
atgaaaacattaagaa

SEQ ID NO: 481279 - DNA, 16 bp, R. norvegicus
atgaaaacctggtcaa

SEQ ID NO: 481280 - DNA, 16 bp, R. norvegicus
atgaaaagaaattcaa

SEQ ID NO: 481281 - DNA, 16 bp, R. norvegicus
atgaaaagcaacttgg

SEQ ID NO: 481282 - DNA, 16 bp, R. norvegicus
atgaaaagcaagccag

SEQ ID NO: 481283 - DNA, 16 bp, R. norvegicus
atgaaaaggaaggcat

SEQ ID NO: 481284 - DNA, 16 bp, R. norvegicus
atgaaaaggacaattt

SEQ ID NO: 481285 - DNA, 16 bp, R. norvegicus
atgaaaagggagatgt

SEQ ID NO: 481286 - DNA, 16 bp, R. norvegicus
atgaaaataaatgcat

SEQ ID NO: 481287 - DNA, 16 bp, R. norvegicus
atgaaaataacatcaa

SEQ ID NO: 481288 - DNA, 16 bp, R. norvegicus
atgaaaatagttttat

SEQ ID NO: 481289 - DNA, 16 bp, R. norvegicus
atgaaaatattcatag

SEQ ID NO: 481290 - DNA, 16 bp, R. norvegicus
atgaaaatattttcat

SEQ ID NO: 481291 - DNA, 16 bp, R. norvegicus
atgaaaatcaaaatga

SEQ ID NO: 481292 - DNA, 16 bp, R. norvegicus
atgaaaatcaatcaat

SEQ ID NO: 481293 - DNA, 16 bp, R. norvegicus
atgaaaatctcaaaga

SEQ ID NO: 481294 - DNA, 16 bp, R. norvegicus
atgaaaatgaaaatca

SEQ ID NO: 481295 - DNA, 16 bp, R. norvegicus
atgaaaatgaagacaa

SEQ ID NO: 481296 - DNA, 16 bp, R. norvegicus
atgaaaatgaagacat

SEQ ID NO: 481297 - DNA, 16 bp, R. norvegicus
atgaaaatgaaggcaa

SEQ ID NO: 481298 - DNA, 16 bp, R. norvegicus
atgaaaatgaaggcac

SEQ ID NO: 481299 - DNA, 16 bp, R. norvegicus
atgaaaatgaaggttc

SEQ ID NO: 481300 - DNA, 16 bp, R. norvegicus
atgaaaatgaggacat

SEQ ID NO: 481301 - DNA, 16 bp, R. norvegicus
atgaaaatggcatctg

SEQ ID NO: 481302 - DNA, 16 bp, R. norvegicus
atgaaaatgtcataaa

SEQ ID NO: 481303 - DNA, 16 bp, R. norvegicus
atgaaacacaagaagg

SEQ ID NO: 481304 - DNA, 16 bp, R. norvegicus
atgaaacacacacaca

SEQ ID NO: 481305 - DNA, 16 bp, R. norvegicus
atgaaacccaagaaga

SEQ ID NO: 481306 - DNA, 16 bp, R. norvegicus
atgaaactagaaaggg

SEQ ID NO: 481307 - DNA, 16 bp, R. norvegicus
atgaaactcaagaaaa

SEQ ID NO: 481308 - DNA, 16 bp, R. norvegicus
atgaaactcaagatga

SEQ ID NO: 481309 - DNA, 16 bp, R. norvegicus
atgaaactgaaaagtt

SEQ ID NO: 481310 - DNA, 16 bp, R. norvegicus
atgaaactgaagaagg

SEQ ID NO: 481311 - DNA, 18 bp, R. norvegicus
atgaaacttttgatgaaa

SEQ ID NO: 481312 - DNA, 16 bp, R. norvegicus
atgaaagaacttctgg

SEQ ID NO: 481313 - DNA, 16 bp, R. norvegicus
atgaaagaatggatac

SEQ ID NO: 481314 - DNA, 16 bp, R. norvegicus
atgaaagaatgttgaa

SEQ ID NO: 481315 - DNA, 16 bp, R. norvegicus
atgaaagcagtgctga

SEQ ID NO: 481316 - DNA, 16 bp, R. norvegicus
atgaaagccagaagac

SEQ ID NO: 481317 - DNA, 16 bp, R. norvegicus
atgaaagctgtgctga

SEQ ID NO: 481318 - DNA, 16 bp, R. norvegicus
atgaaaggaaaacact

SEQ ID NO: 481319 - DNA, 16 bp, R. norvegicus
atgaaaggacacagag

SEQ ID NO: 481320 - DNA, 16 bp, R. norvegicus
atgaaagtaacaggaa

SEQ ID NO: 481321 - DNA, 16 bp, R. norvegicus
atgaaagtggggtgtt

SEQ ID NO: 481322 - DNA, 16 bp, R. norvegicus
atgaaataatcaaact

SEQ ID NO: 481323 - DNA, 16 bp, R. norvegicus
atgaaatagatgattt

SEQ ID NO: 481324 - DNA, 16 bp, R. norvegicus
atgaaatcattatttt

SEQ ID NO: 481325 - DNA, 17 bp, R. norvegicus
atgaaatccgtaggcaa

SEQ ID NO: 481326 - DNA, 16 bp, R. norvegicus
atgaaatggaaatgaa

SEQ ID NO: 481327 - DNA, 16 bp, R. norvegicus
atgaaattatgaaact

SEQ ID NO: 481328 - DNA, 16 bp, R. norvegicus
atgaaattcacaaaaa

SEQ ID NO: 481329 - DNA, 16 bp, R. norvegicus
atgaaattcagaaaaa

SEQ ID NO: 481330 - DNA, 19 bp, R. norvegicus
atgaaattcatagacaaat

SEQ ID NO: 481331 - DNA, 19 bp, R. norvegicus
atgaaattcataggcaaat

SEQ ID NO: 481332 - DNA, 20 bp, R. norvegicus
atgaaattcgtaggcaaata

SEQ ID NO: 481333 - DNA, 59 bp, R. norvegicus
atgaaattcgtaggcaaatggttggaactggaaaatatcatcctgagtgagctaaccga

SEQ ID NO: 481334 - DNA, 16 bp, R. norvegicus
atgaaattctcaacaa

SEQ ID NO: 481335 - DNA, 16 bp, R. norvegicus
atgaaattctcaagaa

SEQ ID NO: 481336 - DNA, 16 bp, R. norvegicus
atgaaattgccaaata

SEQ ID NO: 481337 - DNA, 20 bp, R. norvegicus
atgaaatttgtaggcaaatg

SEQ ID NO: 481338 - DNA, 16 bp, R. norvegicus
atgaaattttaaaaca

SEQ ID NO: 481339 - DNA, 16 bp, R. norvegicus
atgaaattttccccag

SEQ ID NO: 481340 - DNA, 16 bp, R. norvegicus
atgaacaacaatgcaa

SEQ ID NO: 481341 - DNA, 17 bp, R. norvegicus
atgaacaatttcctaga

SEQ ID NO: 481342 - DNA, 16 bp, R. norvegicus
atgaacaccatgacca

SEQ ID NO: 481343 - DNA, 16 bp, R. norvegicus
atgaacactggctgct

SEQ ID NO: 481344 - DNA, 16 bp, R. norvegicus
atgaacagagagagag

SEQ ID NO: 481345 - DNA, 16 bp, R. norvegicus
atgaacagcaatgcca

SEQ ID NO: 481346 - DNA, 16 bp, R. norvegicus
atgaacagtgtgtgtg

SEQ ID NO: 481347 - DNA, 17 bp, R. norvegicus
atgaacatagtggagca

SEQ ID NO: 481348 - DNA, 16 bp, R. norvegicus
atgaacatgggagatc

SEQ ID NO: 481349 - DNA, 16 bp, R. norvegicus
atgaaccaaccagacc

SEQ ID NO: 481350 - DNA, 16 bp, R. norvegicus
atgaacccacacgcct

SEQ ID NO: 481351 - DNA, 16 bp, R. norvegicus
atgaactctcaattct

SEQ ID NO: 481352 - DNA, 16 bp, R. norvegicus
atgaactgaccctgga

SEQ ID NO: 481353 - DNA, 16 bp, R. norvegicus
atgaactttctcaaat

SEQ ID NO: 481354 - DNA, 16 bp, R. norvegicus
atgaagaaaaacttga

SEQ ID NO: 481355 - DNA, 16 bp, R. norvegicus
atgaagaaaatggcag

SEQ ID NO: 481356 - DNA, 16 bp, R. norvegicus
atgaagaaacaaagat

SEQ ID NO: 481357 - DNA, 16 bp, R. norvegicus
atgaagaaacaacata

SEQ ID NO: 481358 - DNA, 16 bp, R. norvegicus
atgaagaaacagaaga

SEQ ID NO: 481359 - DNA, 16 bp, R. norvegicus
atgaagaaactgaggc

SEQ ID NO: 481360 - DNA, 16 bp, R. norvegicus
atgaagaacaatgcca

SEQ ID NO: 481361 - DNA, 16 bp, R. norvegicus
atgaagaacctgatca

SEQ ID NO: 481362 - DNA, 16 bp, R. norvegicus
atgaagaactccaggt

SEQ ID NO: 481363 - DNA, 16 bp, R. norvegicus
atgaagaactcttgga

SEQ ID NO: 481364 - DNA, 16 bp, R. norvegicus
atgaagaacttcctta

SEQ ID NO: 481365 - DNA, 16 bp, R. norvegicus
atgaagaagagactga

SEQ ID NO: 481366 - DNA, 16 bp, R. norvegicus
atgaagaagctgaagg

SEQ ID NO: 481367 - DNA, 16 bp, R. norvegicus
atgaagaaggaaattg

SEQ ID NO: 481368 - DNA, 16 bp, R. norvegicus
atgaagacagtgacag

SEQ ID NO: 481369 - DNA, 16 bp, R. norvegicus
atgaagaccattctca

SEQ ID NO: 481370 - DNA, 16 bp, R. norvegicus
atgaagacccagaaat

SEQ ID NO: 481371 - DNA, 16 bp, R. norvegicus
atgaagacctgagctc

SEQ ID NO: 481372 - DNA, 16 bp, R. norvegicus
atgaagagaaacttaa

SEQ ID NO: 481373 - DNA, 17 bp, R. norvegicus
atgaagagagcctgtga

SEQ ID NO: 481374 - DNA, 16 bp, R. norvegicus
atgaagagaggcagaa

SEQ ID NO: 481375 - DNA, 16 bp, R. norvegicus
atgaagatgaagaact

SEQ ID NO: 481376 - DNA, 16 bp, R. norvegicus
atgaagatgatgatgg

SEQ ID NO: 481377 - DNA, 16 bp, R. norvegicus
atgaagatgtggagaa

SEQ ID NO: 481378 - DNA, 16 bp, R. norvegicus
atgaagcaaaagaagt

SEQ ID NO: 481379 - DNA, 16 bp, R. norvegicus
atgaagcaaggaagtg

SEQ ID NO: 481380 - DNA, 16 bp, R. norvegicus
atgaagcagagagaaa

SEQ ID NO: 481381 - DNA, 16 bp, R. norvegicus
atgaagcagaggatga

SEQ ID NO: 481382 - DNA, 16 bp, R. norvegicus
atgaagcagcaatgaa

SEQ ID NO: 481383 - DNA, 16 bp, R. norvegicus
atgaagcagctctctg

SEQ ID NO: 481384 - DNA, 16 bp, R. norvegicus
atgaagccatagttac

SEQ ID NO: 481385 - DNA, 16 bp, R. norvegicus
atgaagcccaggctgg

SEQ ID NO: 481386 - DNA, 16 bp, R. norvegicus
atgaagccctgtctca

SEQ ID NO: 481387 - DNA, 16 bp, R. norvegicus
atgaagcctacgtgat

SEQ ID NO: 481388 - DNA, 16 bp, R. norvegicus
atgaagctaaaacatg

SEQ ID NO: 481389 - DNA, 16 bp, R. norvegicus
atgaagctcaagaaaa

SEQ ID NO: 481390 - DNA, 16 bp, R. norvegicus
atgaagctcaagaaga

SEQ ID NO: 481391 - DNA, 16 bp, R. norvegicus
atgaaggacatagaga

SEQ ID NO: 481392 - DNA, 16 bp, R. norvegicus
atgaaggacatggaga

SEQ ID NO: 481393 - DNA, 16 bp, R. norvegicus
atgaaggactctttgc

SEQ ID NO: 481394 - DNA, 16 bp, R. norvegicus
atgaaggactgataga

SEQ ID NO: 481395 - DNA, 16 bp, R. norvegicus
atgaaggcaaagttag

SEQ ID NO: 481396 - DNA, 16 bp, R. norvegicus
atgaaggcacaatata

SEQ ID NO: 481397 - DNA, 16 bp, R. norvegicus
atgaaggcttgtttcc

SEQ ID NO: 481398 - DNA, 16 bp, R. norvegicus
atgaaggggtttgtaa

SEQ ID NO: 481399 - DNA, 16 bp, R. norvegicus
atgaaggtgcagcctc

SEQ ID NO: 481400 - DNA, 16 bp, R. norvegicus
atgaagtagcaatgaa

SEQ ID NO: 481401 - DNA, 16 bp, R. norvegicus
atgaagtcacaattac

SEQ ID NO: 481402 - DNA, 16 bp, R. norvegicus
atgaagtcactgtttt

SEQ ID NO: 481403 - DNA, 16 bp, R. norvegicus
atgaagtgcatgctga

SEQ ID NO: 481404 - DNA, 16 bp, R. norvegicus
atgaagttcaagaaga

SEQ ID NO: 481405 - DNA, 16 bp, R. norvegicus
atgaagttctcaaaaa

SEQ ID NO: 481406 - DNA, 16 bp, R. norvegicus
atgaatacatgaatga

SEQ ID NO: 481407 - DNA, 16 bp, R. norvegicus
atgaataccatgtgtg

SEQ ID NO: 481408 - DNA, 17 bp, R. norvegicus
atgaatataacgggaag

SEQ ID NO: 481409 - DNA, 16 bp, R. norvegicus
atgaatatgaatgaga

SEQ ID NO: 481410 - DNA, 16 bp, R. norvegicus
atgaatatgatcaaaa

SEQ ID NO: 481411 - DNA, 16 bp, R. norvegicus
atgaatatggacacaa

SEQ ID NO: 481412 - DNA, 16 bp, R. norvegicus
atgaatattttagttc

SEQ ID NO: 481413 - DNA, 16 bp, R. norvegicus
atgaatctcactcaga

SEQ ID NO: 481414 - DNA, 16 bp, R. norvegicus
atgaatgaagttctca

SEQ ID NO: 481415 - DNA, 16 bp, R. norvegicus
atgaatgatatgataa

SEQ ID NO: 481416 - DNA, 16 bp, R. norvegicus
atgaatgcagcaaaga

SEQ ID NO: 481417 - DNA, 16 bp, R. norvegicus
atgaatggaatcaaaa

SEQ ID NO: 481418 - DNA, 16 bp, R. norvegicus
atgaatggcttatgct

SEQ ID NO: 481419 - DNA, 16 bp, R. norvegicus
atgaatgtatgtatgt

SEQ ID NO: 481420 - DNA, 16 bp, R. norvegicus
atgaatgtttttgttc

SEQ ID NO: 481421 - DNA, 16 bp, R. norvegicus
atgaattcaactgctg

SEQ ID NO: 481422 - DNA, 16 bp, R. norvegicus
atgaattcaaggccaa

SEQ ID NO: 481423 - DNA, 16 bp, R. norvegicus
atgaatttattttctt

SEQ ID NO: 481424 - DNA, 16 bp, R. norvegicus
atgaatttcagaaagt

SEQ ID NO: 481425 - DNA, 16 bp, R. norvegicus
atgaatttgagaggga

SEQ ID NO: 481426 - DNA, 16 bp, R. norvegicus
atgaatttgcaatttg

SEQ ID NO: 481427 - DNA, 19 bp, R. norvegicus
atgacaaaaccaaatttat

SEQ ID NO: 481428 - DNA, 16 bp, R. norvegicus
atgacaaaacttcaag

SEQ ID NO: 481429 - DNA, 16 bp, R. norvegicus
atgacaacaatgatga

SEQ ID NO: 481430 - DNA, 16 bp, R. norvegicus
atgacaagtacttcaa

SEQ ID NO: 481431 - DNA, 16 bp, R. norvegicus
atgacaatgatgacaa

SEQ ID NO: 481432 - DNA, 16 bp, R. norvegicus
atgacacaaccaaatt

SEQ ID NO: 481433 - DNA, 16 bp, R. norvegicus
atgacacacctcctcc

SEQ ID NO: 481434 - DNA, 16 bp, R. norvegicus
atgacacctgaacaag

SEQ ID NO: 481435 - DNA, 16 bp, R. norvegicus
atgacagagactccca

SEQ ID NO: 481436 - DNA, 16 bp, R. norvegicus
atgacaggaaacagag

SEQ ID NO: 481437 - DNA, 16 bp, R. norvegicus
atgacaggtgtgtgcc

SEQ ID NO: 481438 - DNA, 16 bp, R. norvegicus
atgacatcaagaaggt

SEQ ID NO: 481439 - DNA, 16 bp, R. norvegicus
atgacatcatcatcat

SEQ ID NO: 481440 - DNA, 16 bp, R. norvegicus
atgacatcatgaaaat

SEQ ID NO: 481441 - DNA, 16 bp, R. norvegicus
atgacatgaacttcaa

SEQ ID NO: 481442 - DNA, 16 bp, R. norvegicus
atgacattagtccagg

SEQ ID NO: 481443 - DNA, 16 bp, R. norvegicus
atgacattggtacaga

SEQ ID NO: 481444 - DNA, 16 bp, R. norvegicus
atgacattttcaaata

SEQ ID NO: 481445 - DNA, 16 bp, R. norvegicus
atgacattttgcaaag

SEQ ID NO: 481446 - DNA, 16 bp, R. norvegicus
atgaccaaagcaactg

SEQ ID NO: 481447 - DNA, 16 bp, R. norvegicus
atgaccaagaagaaag

SEQ ID NO: 481448 - DNA, 16 bp, R. norvegicus
atgaccaagaagcaag

SEQ ID NO: 481449 - DNA, 16 bp, R. norvegicus
atgaccagcaaagagt

SEQ ID NO: 481450 - DNA, 16 bp, R. norvegicus
atgaccaggatattgg

SEQ ID NO: 481451 - DNA, 16 bp, R. norvegicus
atgaccataggtatgt

SEQ ID NO: 481452 - DNA, 16 bp, R. norvegicus
atgaccatgaccatga

SEQ ID NO: 481453 - DNA, 16 bp, R. norvegicus
atgaccatgagtttga

SEQ ID NO: 481454 - DNA, 16 bp, R. norvegicus
atgaccctcagacatt

SEQ ID NO: 481455 - DNA, 16 bp, R. norvegicus
atgaccctgagatttc

SEQ ID NO: 481456 - DNA, 16 bp, R. norvegicus
atgaccctgctctgag

SEQ ID NO: 481457 - DNA, 16 bp, R. norvegicus
atgaccctgtacaaag

SEQ ID NO: 481458 - DNA, 16 bp, R. norvegicus
atgacctacaggttga

SEQ ID NO: 481459 - DNA, 16 bp, R. norvegicus
atgacctcaccagcca

SEQ ID NO: 481460 - DNA, 16 bp, R. norvegicus
atgacctgaattcagt

SEQ ID NO: 481461 - DNA, 16 bp, R. norvegicus
atgaccttaaatttct

SEQ ID NO: 481462 - DNA, 17 bp, R. norvegicus
atgacgacgacgacgat

SEQ ID NO: 481463 - DNA, 17 bp, R. norvegicus
atgacgacgatgatgat

SEQ ID NO: 481464 - DNA, 16 bp, R. norvegicus
atgacgatgacgatga

SEQ ID NO: 481465 - DNA, 16 bp, R. norvegicus
atgacgatgatgacga

SEQ ID NO: 481466 - DNA, 16 bp, R. norvegicus
atgactaccctccaaa

SEQ ID NO: 481467 - DNA, 16 bp, R. norvegicus
atgactacttcagctt

SEQ ID NO: 481468 - DNA, 16 bp, R. norvegicus
atgactatatgaaatt

SEQ ID NO: 481469 - DNA, 16 bp, R. norvegicus
atgactattccagctt

SEQ ID NO: 481470 - DNA, 16 bp, R. norvegicus
atgactcagctattaa

SEQ ID NO: 481471 - DNA, 16 bp, R. norvegicus
atgactccatccaaat

SEQ ID NO: 481472 - DNA, 16 bp, R. norvegicus
atgactcccagcacca

SEQ ID NO: 481473 - DNA, 16 bp, R. norvegicus
atgactcggtgggtaa

SEQ ID NO: 481474 - DNA, 16 bp, R. norvegicus
atgactgctttccaaa

SEQ ID NO: 481475 - DNA, 16 bp, R. norvegicus
atgactggactgtaaa

SEQ ID NO: 481476 - DNA, 16 bp, R. norvegicus
atgactgtaatctcag

SEQ ID NO: 481477 - DNA, 16 bp, R. norvegicus
atgactgttctccaaa

SEQ ID NO: 481478 - DNA, 16 bp, R. norvegicus
atgacttcagggaccc

SEQ ID NO: 481479 - DNA, 16 bp, R. norvegicus
atgactttgaaagaga

SEQ ID NO: 481480 - DNA, 16 bp, R. norvegicus
atgactttgaggccag

SEQ ID NO: 481481 - DNA, 16 bp, R. norvegicus
atgactttgtaaagct

SEQ ID NO: 481482 - DNA, 16 bp, R. norvegicus
atgactttttttaaaa

SEQ ID NO: 481483 - DNA, 16 bp, R. norvegicus
atgagaaaagtactct

SEQ ID NO: 481484 - DNA, 16 bp, R. norvegicus
atgagaaaattgaaat

SEQ ID NO: 481485 - DNA, 16 bp, R. norvegicus
atgagaaacagaaagg

SEQ ID NO: 481486 - DNA, 16 bp, R. norvegicus
atgagaaacctccttt

SEQ ID NO: 481487 - DNA, 16 bp, R. norvegicus
atgagaaactgggaaa

SEQ ID NO: 481488 - DNA, 16 bp, R. norvegicus
atgagaaagtaacttt

SEQ ID NO: 481489 - DNA, 21 bp, R. norvegicus
atgagaacagggagcttctat

SEQ ID NO: 481490 - DNA, 16 bp, R. norvegicus
atgagaacatcatgaa

SEQ ID NO: 481491 - DNA, 16 bp, R. norvegicus
atgagaacttggtcaa

SEQ ID NO: 481492 - DNA, 16 bp, R. norvegicus
atgagaactttactca

SEQ ID NO: 481493 - DNA, 16 bp, R. norvegicus
atgagaagaaggtata

SEQ ID NO: 481494 - DNA, 16 bp, R. norvegicus
atgagaagcagagaga

SEQ ID NO: 481495 - DNA, 16 bp, R. norvegicus
atgagaagctgagaga

SEQ ID NO: 481496 - DNA, 16 bp, R. norvegicus
atgagaaggaaagatg

SEQ ID NO: 481497 - DNA, 16 bp, R. norvegicus
atgagaagttctttgg

SEQ ID NO: 481498 - DNA, 16 bp, R. norvegicus
atgagactggagagat

SEQ ID NO: 481499 - DNA, 16 bp, R. norvegicus
atgagaggaaacagag

SEQ ID NO: 481500 - DNA, 16 bp, R. norvegicus
atgagagtgttccccc

SEQ ID NO: 481501 - DNA, 16 bp, R. norvegicus
atgagatatatatata

SEQ ID NO: 481502 - DNA, 16 bp, R. norvegicus
atgagatcagcacgga

SEQ ID NO: 481503 - DNA, 16 bp, R. norvegicus
atgagatccagctgaa

SEQ ID NO: 481504 - DNA, 16 bp, R. norvegicus
atgagatccagctgta

SEQ ID NO: 481505 - DNA, 16 bp, R. norvegicus
atgagatgctgagaag

SEQ ID NO: 481506 - DNA, 16 bp, R. norvegicus
atgagatggatcccca

SEQ ID NO: 481507 - DNA, 16 bp, R. norvegicus
atgagattctcaaaga

SEQ ID NO: 481508 - DNA, 16 bp, R. norvegicus
atgagcaaaatgtgaa

SEQ ID NO: 481509 - DNA, 16 bp, R. norvegicus
atgagcaagtaggctt

SEQ ID NO: 481510 - DNA, 23 bp, R. norvegicus
atgagcatagcctggagatggaa

SEQ ID NO: 481511 - DNA, 16 bp, R. norvegicus
atgagccaatgggggc

SEQ ID NO: 481512 - DNA, 19 bp, R. norvegicus
atgagcctcgggaccacag

SEQ ID NO: 481513 - DNA, 16 bp, R. norvegicus
atgagctccaggccag

SEQ ID NO: 481514 - DNA, 16 bp, R. norvegicus
atgagctctccatggc

SEQ ID NO: 481515 - DNA, 16 bp, R. norvegicus
atgagctgagaaagaa

SEQ ID NO: 481516 - DNA, 16 bp, R. norvegicus
atgagctgaggcagaa

SEQ ID NO: 481517 - DNA, 16 bp, R. norvegicus
atgagctgggccctcc

SEQ ID NO: 481518 - DNA, 16 bp, R. norvegicus
atgagctgggtcctcc

SEQ ID NO: 481519 - DNA, 16 bp, R. norvegicus
atgagctgtgtgtggt

SEQ ID NO: 481520 - DNA, 16 bp, R. norvegicus
atgagcttcagggatc

SEQ ID NO: 481521 - DNA, 16 bp, R. norvegicus
atgagctttaacattt

SEQ ID NO: 481522 - DNA, 16 bp, R. norvegicus
atgaggaaaccaaggc

SEQ ID NO: 481523 - DNA, 21 bp, R. norvegicus
atgaggaaatggcaacttatt

SEQ ID NO: 481524 - DNA, 16 bp, R. norvegicus
atgaggaacaagaata

SEQ ID NO: 481525 - DNA, 16 bp, R. norvegicus
atgaggaaccgtatta

SEQ ID NO: 481526 - DNA, 16 bp, R. norvegicus
atgaggaacctgcatt

SEQ ID NO: 481527 - DNA, 16 bp, R. norvegicus
atgaggaagagagata

SEQ ID NO: 481528 - DNA, 16 bp, R. norvegicus
atgaggacacatgctc

SEQ ID NO: 481529 - DNA, 16 bp, R. norvegicus
atgaggaggagcagga

SEQ ID NO: 481530 - DNA, 16 bp, R. norvegicus
atgaggaggaggatga

SEQ ID NO: 481531 - DNA, 16 bp, R. norvegicus
atgaggaggtgtggcc

SEQ ID NO: 481532 - DNA, 16 bp, R. norvegicus
atgaggagttcaaggc

SEQ ID NO: 481533 - DNA, 16 bp, R. norvegicus
atgaggatatccccac

SEQ ID NO: 481534 - DNA, 16 bp, R. norvegicus
atgaggatgaggagga

SEQ ID NO: 481535 - DNA, 16 bp, R. norvegicus
atgaggatgatgatga

SEQ ID NO: 481536 - DNA, 16 bp, R. norvegicus
atgaggatgcttcccc

SEQ ID NO: 481537 - DNA, 16 bp, R. norvegicus
atgaggatgcttgcag

SEQ ID NO: 481538 - DNA, 16 bp, R. norvegicus
atgaggatggcttcca

SEQ ID NO: 481539 - DNA, 16 bp, R. norvegicus
atgaggcagtggagca

SEQ ID NO: 481540 - DNA, 16 bp, R. norvegicus
atgaggccagagtcca

SEQ ID NO: 481541 - DNA, 16 bp, R. norvegicus
atgagggaggcagcaa

SEQ ID NO: 481542 - DNA, 16 bp, R. norvegicus
atgagggccttaaagc

SEQ ID NO: 481543 - DNA, 16 bp, R. norvegicus
atgaggtcacatttgt

SEQ ID NO: 481544 - DNA, 16 bp, R. norvegicus
atgaggtcatctatga

SEQ ID NO: 481545 - DNA, 16 bp, R. norvegicus
atgaggtcttcaatga

SEQ ID NO: 481546 - DNA, 16 bp, R. norvegicus
atgaggtgcttagaag

SEQ ID NO: 481547 - DNA, 16 bp, R. norvegicus
atgaggtggtgagaag

SEQ ID NO: 481548 - DNA, 16 bp, R. norvegicus
atgaggttctgggttc

SEQ ID NO: 481549 - DNA, 16 bp, R. norvegicus
atgagtaaatgagtaa

SEQ ID NO: 481550 - DNA, 16 bp, R. norvegicus
atgagtacactgcagc

SEQ ID NO: 481551 - DNA, 16 bp, R. norvegicus
atgagtagagagattg

SEQ ID NO: 481552 - DNA, 16 bp, R. norvegicus
atgagtcagagaaaga

SEQ ID NO: 481553 - DNA, 16 bp, R. norvegicus
atgagtggatgaatga

SEQ ID NO: 481554 - DNA, 16 bp, R. norvegicus
atgagtgtgggagagc

SEQ ID NO: 481555 - DNA, 16 bp, R. norvegicus
atgagttcaagaccag

SEQ ID NO: 481556 - DNA, 16 bp, R. norvegicus
atgagtttcttttctg

SEQ ID NO: 481557 - DNA, 16 bp, R. norvegicus
atgagtttgtaggttt

SEQ ID NO: 481558 - DNA, 16 bp, R. norvegicus
atgagtttttctttta

SEQ ID NO: 481559 - DNA, 51 bp, R. norvegicus
atgataaaagtcctggaaagaataggtattcaaggcccatacctaaacata

SEQ ID NO: 481560 - DNA, 16 bp, R. norvegicus
atgataaaattcttgg

SEQ ID NO: 481561 - DNA, 16 bp, R. norvegicus
atgataacaacaataa

SEQ ID NO: 481562 - DNA, 16 bp, R. norvegicus
atgataatgtactgaa

SEQ ID NO: 481563 - DNA, 16 bp, R. norvegicus
atgatagagatagaga

SEQ ID NO: 481564 - DNA, 16 bp, R. norvegicus
atgatagaggacttca

SEQ ID NO: 481565 - DNA, 17 bp, R. norvegicus
atgatagtatatttaaa

SEQ ID NO: 481566 - DNA, 50 bp, R. norvegicus
atgatagtatatttaagtgatcccaaaagttccaccagagaactactaaa

SEQ ID NO: 481567 - DNA, 16 bp, R. norvegicus
atgatatcccatttgt

SEQ ID NO: 481568 - DNA, 16 bp, R. norvegicus
atgatatctcacttcc

SEQ ID NO: 481569 - DNA, 16 bp, R. norvegicus
atgatattctgatata

SEQ ID NO: 481570 - DNA, 16 bp, R. norvegicus
atgatattctttctga

SEQ ID NO: 481571 - DNA, 16 bp, R. norvegicus
atgatattttcttttc

SEQ ID NO: 481572 - DNA, 16 bp, R. norvegicus
atgatattttttactt

SEQ ID NO: 481573 - DNA, 16 bp, R. norvegicus
atgatcaagtagtctt

SEQ ID NO: 481574 - DNA, 16 bp, R. norvegicus
atgatcaccaagaaca

SEQ ID NO: 481575 - DNA, 16 bp, R. norvegicus
atgatcatgatcatga

SEQ ID NO: 481576 - DNA, 16 bp, R. norvegicus
atgatcatgtggtatt

SEQ ID NO: 481577 - DNA, 16 bp, R. norvegicus
atgatcatttcaatag

SEQ ID NO: 481578 - DNA, 16 bp, R. norvegicus
atgatcattttgattt

SEQ ID NO: 481579 - DNA, 16 bp, R. norvegicus
atgatctctccattga

SEQ ID NO: 481580 - DNA, 16 bp, R. norvegicus
atgatgaaaaggggaa

SEQ ID NO: 481581 - DNA, 16 bp, R. norvegicus
atgatgaagaagatga

SEQ ID NO: 481582 - DNA, 16 bp, R. norvegicus
atgatgaagatgaaga

SEQ ID NO: 481583 - DNA, 16 bp, R. norvegicus
atgatgaagcaaagaa

SEQ ID NO: 481584 - DNA, 16 bp, R. norvegicus
atgatgacgacgatga

SEQ ID NO: 481585 - DNA, 16 bp, R. norvegicus
atgatgactctgagac

SEQ ID NO: 481586 - DNA, 16 bp, R. norvegicus
atgatgatgaagaaga

SEQ ID NO: 481587 - DNA, 16 bp, R. norvegicus
atgatgatgacaacaa

SEQ ID NO: 481588 - DNA, 16 bp, R. norvegicus
atgatgatgacaatga

SEQ ID NO: 481589 - DNA, 16 bp, R. norvegicus
atgatgatgacagtga

SEQ ID NO: 481590 - DNA, 16 bp, R. norvegicus
atgatgatgacgatga

SEQ ID NO: 481591 - DNA, 16 bp, R. norvegicus
atgatgatgaggatga

SEQ ID NO: 481592 - DNA, 16 bp, R. norvegicus
atgatgatgataaaca

SEQ ID NO: 481593 - DNA, 16 bp, R. norvegicus
atgatgatgatgaaag

SEQ ID NO: 481594 - DNA, 16 bp, R. norvegicus
atgatgatgatgaact

SEQ ID NO: 481595 - DNA, 16 bp, R. norvegicus
atgatgatgatgaagg

SEQ ID NO: 481596 - DNA, 16 bp, R. norvegicus
atgatgatgatgaagt

SEQ ID NO: 481597 - DNA, 16 bp, R. norvegicus
atgatgatgatgacag

SEQ ID NO: 481598 - DNA, 16 bp, R. norvegicus
atgatgatgatgacta

SEQ ID NO: 481599 - DNA, 16 bp, R. norvegicus
atgatgatgatgatac

SEQ ID NO: 481600 - DNA, 16 bp, R. norvegicus
atgatgatgatgatct

SEQ ID NO: 481601 - DNA, 16 bp, R. norvegicus
atgatgatgatgatga

SEQ ID NO: 481602 - DNA, 17 bp, R. norvegicus
atgatgatgatgatggg

SEQ ID NO: 481603 - DNA, 16 bp, R. norvegicus
atgatgatgatgatta

SEQ ID NO: 481604 - DNA, 16 bp, R. norvegicus
atgatgatgatgattc

SEQ ID NO: 481605 - DNA, 16 bp, R. norvegicus
atgatgatgatggagg

SEQ ID NO: 481606 - DNA, 16 bp, R. norvegicus
atgatgatgatgtttg

SEQ ID NO: 481607 - DNA, 16 bp, R. norvegicus
atgatgatggtgtgtg

SEQ ID NO: 481608 - DNA, 16 bp, R. norvegicus
atgatgatgttgatga

SEQ ID NO: 481609 - DNA, 16 bp, R. norvegicus
atgatgattatggact

SEQ ID NO: 481610 - DNA, 16 bp, R. norvegicus
atgatgccatccctgg

SEQ ID NO: 481611 - DNA, 16 bp, R. norvegicus
atgatgccatttagtc

SEQ ID NO: 481612 - DNA, 33 bp, R. norvegicus
atgatgctggaggacttcaagaaagacatgaaa

SEQ ID NO: 481613 - DNA, 16 bp, R. norvegicus
atgatgctgtgtttga

SEQ ID NO: 481614 - DNA, 16 bp, R. norvegicus
atgatggaagacttca

SEQ ID NO: 481615 - DNA, 16 bp, R. norvegicus
atgatggaaggagaga

SEQ ID NO: 481616 - DNA, 16 bp, R. norvegicus
atgatggagatgatgg

SEQ ID NO: 481617 - DNA, 16 bp, R. norvegicus
atgatggaggaattta

SEQ ID NO: 481618 - DNA, 16 bp, R. norvegicus
atgatggaggacttca

SEQ ID NO: 481619 - DNA, 16 bp, R. norvegicus
atgatggatggatgga

SEQ ID NO: 481620 - DNA, 16 bp, R. norvegicus
atgatggtacacacct

SEQ ID NO: 481621 - DNA, 19 bp, R. norvegicus
atgatggtgatgatgatgg

SEQ ID NO: 481622 - DNA, 18 bp, R. norvegicus
atgatggtgatgatggtg

SEQ ID NO: 481623 - DNA, 16 bp, R. norvegicus
atgatggtgatggtaa

SEQ ID NO: 481624 - DNA, 16 bp, R. norvegicus
atgatggtggagcaaa

SEQ ID NO: 481625 - DNA, 16 bp, R. norvegicus
atgatggtggggaaca

SEQ ID NO: 481626 - DNA, 16 bp, R. norvegicus
atgatgtatatgatat

SEQ ID NO: 481627 - DNA, 16 bp, R. norvegicus
atgatgtcctcattct

SEQ ID NO: 481628 - DNA, 16 bp, R. norvegicus
atgatgtggagaaaga

SEQ ID NO: 481629 - DNA, 16 bp, R. norvegicus
atgattatagccaaaa

SEQ ID NO: 481630 - DNA, 16 bp, R. norvegicus
atgattatctcattag

SEQ ID NO: 481631 - DNA, 16 bp, R. norvegicus
atgattatgttgaaga

SEQ ID NO: 481632 - DNA, 16 bp, R. norvegicus
atgattctctggattt

SEQ ID NO: 481633 - DNA, 16 bp, R. norvegicus
atgattgttgcaggaa

SEQ ID NO: 481634 - DNA, 16 bp, R. norvegicus
atgatttcagtgaaaa

SEQ ID NO: 481635 - DNA, 16 bp, R. norvegicus
atgattttcaaaaact

SEQ ID NO: 481636 - DNA, 16 bp, R. norvegicus
atgattttgaacttct

SEQ ID NO: 481637 - DNA, 16 bp, R. norvegicus
atgattttgagccacc

SEQ ID NO: 481638 - DNA, 16 bp, R. norvegicus
atgattttgatgtgtt

SEQ ID NO: 481639 - DNA, 16 bp, R. norvegicus
atgattttttccagtt

SEQ ID NO: 481640 - DNA, 16 bp, R. norvegicus
atgcaaacatgtatac

SEQ ID NO: 481641 - DNA, 16 bp, R. norvegicus
atgcaaagaagaagca

SEQ ID NO: 481642 - DNA, 16 bp, R. norvegicus
atgcaaagtttagagc

SEQ ID NO: 481643 - DNA, 16 bp, R. norvegicus
atgcaaataaaaatat

SEQ ID NO: 481644 - DNA, 16 bp, R. norvegicus
atgcaaataaaaatga

SEQ ID NO: 481645 - DNA, 16 bp, R. norvegicus
atgcaaataaatacat

SEQ ID NO: 481646 - DNA, 16 bp, R. norvegicus
atgcaaatagagcact

SEQ ID NO: 481647 - DNA, 16 bp, R. norvegicus
atgcaaatcaaaacga

SEQ ID NO: 481648 - DNA, 16 bp, R. norvegicus
atgcaaattgatccat

SEQ ID NO: 481649 - DNA, 59 bp, R. norvegicus
atgcaacacctgagctgcctctctctcaagaagaatatgaggctctgctggatattctc

SEQ ID NO: 481650 - DNA, 16 bp, R. norvegicus
atgcaagattggttca

SEQ ID NO: 481651 - DNA, 16 bp, R. norvegicus
atgcaagtggtgcaca

SEQ ID NO: 481652 - DNA, 16 bp, R. norvegicus
atgcaatccccatcac

SEQ ID NO: 481653 - DNA, 16 bp, R. norvegicus
atgcaatctacagacc

SEQ ID NO: 481654 - DNA, 16 bp, R. norvegicus
atgcacaaaaccaaga

SEQ ID NO: 481655 - DNA, 16 bp, R. norvegicus
atgcacacacatgcat

SEQ ID NO: 481656 - DNA, 16 bp, R. norvegicus
atgcacacagtacaca

SEQ ID NO: 481657 - DNA, 16 bp, R. norvegicus
atgcacacatatgcag

SEQ ID NO: 481658 - DNA, 16 bp, R. norvegicus
atgcacacccatgcac

SEQ ID NO: 481659 - DNA, 16 bp, R. norvegicus
atgcacacctacacac

SEQ ID NO: 481660 - DNA, 16 bp, R. norvegicus
atgcacagagagagac

SEQ ID NO: 481661 - DNA, 16 bp, R. norvegicus
atgcacagagagataa

SEQ ID NO: 481662 - DNA, 16 bp, R. norvegicus
atgcacagagccctgg

SEQ ID NO: 481663 - DNA, 16 bp, R. norvegicus
atgcacaggacctgca

SEQ ID NO: 481664 - DNA, 16 bp, R. norvegicus
atgcacatacccacat

SEQ ID NO: 481665 - DNA, 16 bp, R. norvegicus
atgcacatatgtgtat

SEQ ID NO: 481666 - DNA, 16 bp, R. norvegicus
atgcacatcttggcat

SEQ ID NO: 481667 - DNA, 16 bp, R. norvegicus
atgcacatgtacacat

SEQ ID NO: 481668 - DNA, 16 bp, R. norvegicus
atgcacatgtgttcac

SEQ ID NO: 481669 - DNA, 16 bp, R. norvegicus
atgcaccacacataca

SEQ ID NO: 481670 - DNA, 16 bp, R. norvegicus
atgcacccaagaagag

SEQ ID NO: 481671 - DNA, 16 bp, R. norvegicus
atgcacgcacacatgc

SEQ ID NO: 481672 - DNA, 16 bp, R. norvegicus
atgcactacatgcact

SEQ ID NO: 481673 - DNA, 16 bp, R. norvegicus
atgcactgcatgctgg

SEQ ID NO: 481674 - DNA, 16 bp, R. norvegicus
atgcacttctttgcat

SEQ ID NO: 481675 - DNA, 16 bp, R. norvegicus
atgcacttggagccca

SEQ ID NO: 481676 - DNA, 16 bp, R. norvegicus
atgcactttttaaaaa

SEQ ID NO: 481677 - DNA, 16 bp, R. norvegicus
atgcagaaaaggcatt

SEQ ID NO: 481678 - DNA, 16 bp, R. norvegicus
atgcagaaagaaagtc

SEQ ID NO: 481679 - DNA, 16 bp, R. norvegicus
atgcagaagccagaag

SEQ ID NO: 481680 - DNA, 16 bp, R. norvegicus
atgcagacaaacactc

SEQ ID NO: 481681 - DNA, 16 bp, R. norvegicus
atgcagacaaagcacc

SEQ ID NO: 481682 - DNA, 16 bp, R. norvegicus
atgcagacagaacacc

SEQ ID NO: 481683 - DNA, 16 bp, R. norvegicus
atgcagacatgtgcac

SEQ ID NO: 481684 - DNA, 16 bp, R. norvegicus
atgcagaccaggctga

SEQ ID NO: 481685 - DNA, 16 bp, R. norvegicus
atgcagaccattcagg

SEQ ID NO: 481686 - DNA, 16 bp, R. norvegicus
atgcagagaactgttg

SEQ ID NO: 481687 - DNA, 16 bp, R. norvegicus
atgcagagaccacaga

SEQ ID NO: 481688 - DNA, 16 bp, R. norvegicus
atgcagagacccacaa

SEQ ID NO: 481689 - DNA, 16 bp, R. norvegicus
atgcagagaccctcag

SEQ ID NO: 481690 - DNA, 16 bp, R. norvegicus
atgcagaggccttgga

SEQ ID NO: 481691 - DNA, 16 bp, R. norvegicus
atgcagagtttggagt

SEQ ID NO: 481692 - DNA, 16 bp, R. norvegicus
atgcagatggagccat

SEQ ID NO: 481693 - DNA, 16 bp, R. norvegicus
atgcagatgtagatgc

SEQ ID NO: 481694 - DNA, 16 bp, R. norvegicus
atgcagatttttgaag

SEQ ID NO: 481695 - DNA, 16 bp, R. norvegicus
atgcagccatcttgtc

SEQ ID NO: 481696 - DNA, 16 bp, R. norvegicus
atgcagccctggctgg

SEQ ID NO: 481697 - DNA, 16 bp, R. norvegicus
atgcagctgtctttga

SEQ ID NO: 481698 - DNA, 16 bp, R. norvegicus
atgcaggaatggttca

SEQ ID NO: 481699 - DNA, 16 bp, R. norvegicus
atgcaggagagagaga

SEQ ID NO: 481700 - DNA, 16 bp, R. norvegicus
atgcaggaggccctgg

SEQ ID NO: 481701 - DNA, 16 bp, R. norvegicus
atgcaggcagaacact

SEQ ID NO: 481702 - DNA, 16 bp, R. norvegicus
atgcaggcagaatgct

SEQ ID NO: 481703 - DNA, 16 bp, R. norvegicus
atgcaggcagacacag

SEQ ID NO: 481704 - DNA, 16 bp, R. norvegicus
atgcagggacaaagac

SEQ ID NO: 481705 - DNA, 16 bp, R. norvegicus
atgcagggatggtttg

SEQ ID NO: 481706 - DNA, 16 bp, R. norvegicus
atgcaggggcagagga

SEQ ID NO: 481707 - DNA, 16 bp, R. norvegicus
atgcaggtgaaggcaa

SEQ ID NO: 481708 - DNA, 16 bp, R. norvegicus
atgcagtcctcatcaa

SEQ ID NO: 481709 - DNA, 16 bp, R. norvegicus
atgcagtcctggctgt

SEQ ID NO: 481710 - DNA, 16 bp, R. norvegicus
atgcagtgcactgtga

SEQ ID NO: 481711 - DNA, 16 bp, R. norvegicus
atgcagtgcctgaaga

SEQ ID NO: 481712 - DNA, 16 bp, R. norvegicus
atgcagttcctcatgc

SEQ ID NO: 481713 - DNA, 16 bp, R. norvegicus
atgcagttgaagccat

SEQ ID NO: 481714 - DNA, 16 bp, R. norvegicus
atgcatataatatata

SEQ ID NO: 481715 - DNA, 16 bp, R. norvegicus
atgcatatatgtgcac

SEQ ID NO: 481716 - DNA, 16 bp, R. norvegicus
atgcatatgtatctgt

SEQ ID NO: 481717 - DNA, 16 bp, R. norvegicus
atgcatatgtgtatgc

SEQ ID NO: 481718 - DNA, 16 bp, R. norvegicus
atgcatattcatatct

SEQ ID NO: 481719 - DNA, 16 bp, R. norvegicus
atgcatatttatatat

SEQ ID NO: 481720 - DNA, 16 bp, R. norvegicus
atgcatctgtctgtct

SEQ ID NO: 481721 - DNA, 16 bp, R. norvegicus
atgcatgaagcaaaga

SEQ ID NO: 481722 - DNA, 16 bp, R. norvegicus
atgcatgagtgcacat

SEQ ID NO: 481723 - DNA, 16 bp, R. norvegicus
atgcatgcagataaaa

SEQ ID NO: 481724 - DNA, 16 bp, R. norvegicus
atgcatgcatgtatgt

SEQ ID NO: 481725 - DNA, 16 bp, R. norvegicus
atgcatggacacacac

SEQ ID NO: 481726 - DNA, 16 bp, R. norvegicus
atgcatgtaataacaa

SEQ ID NO: 481727 - DNA, 16 bp, R. norvegicus
atgcatgtgcatatat

SEQ ID NO: 481728 - DNA, 16 bp, R. norvegicus
atgcatgtgtgcacac

SEQ ID NO: 481729 - DNA, 16 bp, R. norvegicus
atgcatgtgtgggtat

SEQ ID NO: 481730 - DNA, 16 bp, R. norvegicus
atgcatgtgtgtgcct

SEQ ID NO: 481731 - DNA, 16 bp, R. norvegicus
atgcatgtttttctgt

SEQ ID NO: 481732 - DNA, 16 bp, R. norvegicus
atgcattatgggaagg

SEQ ID NO: 481733 - DNA, 16 bp, R. norvegicus
atgcatttatgtatat

SEQ ID NO: 481734 - DNA, 16 bp, R. norvegicus
atgcatttatttgttt

SEQ ID NO: 481735 - DNA, 16 bp, R. norvegicus
atgccaaaaagtgcat

SEQ ID NO: 481736 - DNA, 17 bp, R. norvegicus
atgccaaaatctctgtg

SEQ ID NO: 481737 - DNA, 16 bp, R. norvegicus
atgccaaagtctttcc

SEQ ID NO: 481738 - DNA, 16 bp, R. norvegicus
atgccaacacatgcgc

SEQ ID NO: 481739 - DNA, 16 bp, R. norvegicus
atgccaaccaaccagg

SEQ ID NO: 481740 - DNA, 16 bp, R. norvegicus
atgccaacctctgtgt

SEQ ID NO: 481741 - DNA, 16 bp, R. norvegicus
atgccaagaagctctt

SEQ ID NO: 481742 - DNA, 16 bp, R. norvegicus
atgccaagaagggctt

SEQ ID NO: 481743 - DNA, 16 bp, R. norvegicus
atgccaagaattgcat

SEQ ID NO: 481744 - DNA, 16 bp, R. norvegicus
atgccaagcaaccaga

SEQ ID NO: 481745 - DNA, 16 bp, R. norvegicus
atgccaagcagtgctt

SEQ ID NO: 481746 - DNA, 16 bp, R. norvegicus
atgccaaggaaagaaa

SEQ ID NO: 481747 - DNA, 17 bp, R. norvegicus
atgccaagtggctgaca

SEQ ID NO: 481748 - DNA, 16 bp, R. norvegicus
atgccaataaaaatga

SEQ ID NO: 481749 - DNA, 16 bp, R. norvegicus
atgccaccaagcctgg

SEQ ID NO: 481750 - DNA, 16 bp, R. norvegicus
atgccaccatgcctga

SEQ ID NO: 481751 - DNA, 16 bp, R. norvegicus
atgccagaagaaggca

SEQ ID NO: 481752 - DNA, 16 bp, R. norvegicus
atgccagataatgcca

SEQ ID NO: 481753 - DNA, 16 bp, R. norvegicus
atgccagcaccatggg

SEQ ID NO: 481754 - DNA, 16 bp, R. norvegicus
atgccagccaaccaga

SEQ ID NO: 481755 - DNA, 16 bp, R. norvegicus
atgccagccaggagga

SEQ ID NO: 481756 - DNA, 22 bp, R. norvegicus
atgccagcccaagttactgtat

SEQ ID NO: 481757 - DNA, 16 bp, R. norvegicus
atgccaggaaagtaag

SEQ ID NO: 481758 - DNA, 16 bp, R. norvegicus
atgccaggagttctct

SEQ ID NO: 481759 - DNA, 16 bp, R. norvegicus
atgccagtggggctgg

SEQ ID NO: 481760 - DNA, 16 bp, R. norvegicus
atgccatccctacccc

SEQ ID NO: 481761 - DNA, 16 bp, R. norvegicus
atgccatcctctgcca

SEQ ID NO: 481762 - DNA, 16 bp, R. norvegicus
atgccatctgctgcca

SEQ ID NO: 481763 - DNA, 16 bp, R. norvegicus
atgccatgaccaaggc

SEQ ID NO: 481764 - DNA, 16 bp, R. norvegicus
atgcccaaaacaaaga

SEQ ID NO: 481765 - DNA, 16 bp, R. norvegicus
atgcccaagagaggaa

SEQ ID NO: 481766 - DNA, 16 bp, R. norvegicus
atgcccaaggaggcca

SEQ ID NO: 481767 - DNA, 16 bp, R. norvegicus
atgcccacacctcctg

SEQ ID NO: 481768 - DNA, 35 bp, R. norvegicus
atgcccagaagctgctgctgtagtaggaggcagtt

SEQ ID NO: 481769 - DNA, 16 bp, R. norvegicus
atgcccagggccagat

SEQ ID NO: 481770 - DNA, 16 bp, R. norvegicus
atgcccataaaataaa

SEQ ID NO: 481771 - DNA, 16 bp, R. norvegicus
atgcccattacagatg

SEQ ID NO: 481772 - DNA, 16 bp, R. norvegicus
atgccccaaatgaaag

SEQ ID NO: 481773 - DNA, 16 bp, R. norvegicus
atgccccacctgtaac

SEQ ID NO: 481774 - DNA, 16 bp, R. norvegicus
atgccccagtccctgg

SEQ ID NO: 481775 - DNA, 16 bp, R. norvegicus
atgcccctgacccaga

SEQ ID NO: 481776 - DNA, 16 bp, R. norvegicus
atgcccctgtggcatg

SEQ ID NO: 481777 - DNA, 17 bp, R. norvegicus
atgccctcttctgctgt

SEQ ID NO: 481778 - DNA, 16 bp, R. norvegicus
atgccctcttctggag

SEQ ID NO: 481779 - DNA, 16 bp, R. norvegicus
atgccctcttctgggt

SEQ ID NO: 481780 - DNA, 16 bp, R. norvegicus
atgccctggagctgga

SEQ ID NO: 481781 - DNA, 16 bp, R. norvegicus
atgcccttaaaaccct

SEQ ID NO: 481782 - DNA, 16 bp, R. norvegicus
atgcccttaatctcag

SEQ ID NO: 481783 - DNA, 16 bp, R. norvegicus
atgcctaagatcaaaa

SEQ ID NO: 481784 - DNA, 16 bp, R. norvegicus
atgcctagaacaaaag

SEQ ID NO: 481785 - DNA, 16 bp, R. norvegicus
atgcctagtgcccaca

SEQ ID NO: 481786 - DNA, 16 bp, R. norvegicus
atgcctataatcccag

SEQ ID NO: 481787 - DNA, 16 bp, R. norvegicus
atgcctcatctgcatg

SEQ ID NO: 481788 - DNA, 16 bp, R. norvegicus
atgcctcctcctcctc

SEQ ID NO: 481789 - DNA, 16 bp, R. norvegicus
atgcctctggctgtgc

SEQ ID NO: 481790 - DNA, 16 bp, R. norvegicus
atgcctgaaagaattg

SEQ ID NO: 481791 - DNA, 16 bp, R. norvegicus
atgcctgaaagctcta

SEQ ID NO: 481792 - DNA, 16 bp, R. norvegicus
atgcctgaaatcccag

SEQ ID NO: 481793 - DNA, 16 bp, R. norvegicus
atgcctgaggttctct

SEQ ID NO: 481794 - DNA, 16 bp, R. norvegicus
atgcctgcctggaagc

SEQ ID NO: 481795 - DNA, 16 bp, R. norvegicus
atgcctgcctggaggc

SEQ ID NO: 481796 - DNA, 16 bp, R. norvegicus
atgcctgcctggatac

SEQ ID NO: 481797 - DNA, 16 bp, R. norvegicus
atgcctgcctgtgtgc

SEQ ID NO: 481798 - DNA, 16 bp, R. norvegicus
atgcctgggagattcc

SEQ ID NO: 481799 - DNA, 16 bp, R. norvegicus
atgcctggtgcccatg

SEQ ID NO: 481800 - DNA, 16 bp, R. norvegicus
atgcctgtaatccaag

SEQ ID NO: 481801 - DNA, 16 bp, R. norvegicus
atgcctgtctcctggg

SEQ ID NO: 481802 - DNA, 16 bp, R. norvegicus
atgcctgtggaggtca

SEQ ID NO: 481803 - DNA, 16 bp, R. norvegicus
atgccttcaaagccag

SEQ ID NO: 481804 - DNA, 16 bp, R. norvegicus
atgccttccctgccat

SEQ ID NO: 481805 - DNA, 16 bp, R. norvegicus
atgcctttaatcctag

SEQ ID NO: 481806 - DNA, 16 bp, R. norvegicus
atgcctttaattccag

SEQ ID NO: 481807 - DNA, 16 bp, R. norvegicus
atgcctttgctctgcc

SEQ ID NO: 481808 - DNA, 16 bp, R. norvegicus
atgcgcgcacgcacac

SEQ ID NO: 481809 - DNA, 16 bp, R. norvegicus
atgctaaagctagctt

SEQ ID NO: 481810 - DNA, 24 bp, R. norvegicus
atgctaagcaaggagatccatgag

SEQ ID NO: 481811 - DNA, 16 bp, R. norvegicus
atgctaataaaaataa

SEQ ID NO: 481812 - DNA, 16 bp, R. norvegicus
atgctacaggaagaat

SEQ ID NO: 481813 - DNA, 16 bp, R. norvegicus
atgctagcaggaaacc

SEQ ID NO: 481814 - DNA, 16 bp, R. norvegicus
atgctaggcaagggct

SEQ ID NO: 481815 - DNA, 16 bp, R. norvegicus
atgctaggtaagtact

SEQ ID NO: 481816 - DNA, 16 bp, R. norvegicus
atgctcaaagccctgg

SEQ ID NO: 481817 - DNA, 16 bp, R. norvegicus
atgctcaataaatgtt

SEQ ID NO: 481818 - DNA, 16 bp, R. norvegicus
atgctcacagctaacc

SEQ ID NO: 481819 - DNA, 16 bp, R. norvegicus
atgctccccaacccac

SEQ ID NO: 481820 - DNA, 16 bp, R. norvegicus
atgctccccccattac

SEQ ID NO: 481821 - DNA, 16 bp, R. norvegicus
atgctcctgccttgat

SEQ ID NO: 481822 - DNA, 18 bp, R. norvegicus
atgctctcttctggtgtg

SEQ ID NO: 481823 - DNA, 16 bp, R. norvegicus
atgctctggcagagca

SEQ ID NO: 481824 - DNA, 16 bp, R. norvegicus
atgctcttccagaaga

SEQ ID NO: 481825 - DNA, 16 bp, R. norvegicus
atgctcttccctgttt

SEQ ID NO: 481826 - DNA, 16 bp, R. norvegicus
atgctcttgaccactg

SEQ ID NO: 481827 - DNA, 16 bp, R. norvegicus
atgctgaaccatctct

SEQ ID NO: 481828 - DNA, 16 bp, R. norvegicus
atgctgaaccctgtgg

SEQ ID NO: 481829 - DNA, 16 bp, R. norvegicus
atgctgacaagagcct

SEQ ID NO: 481830 - DNA, 16 bp, R. norvegicus
atgctgaccggagcct

SEQ ID NO: 481831 - DNA, 16 bp, R. norvegicus
atgctgacctccaggt

SEQ ID NO: 481832 - DNA, 16 bp, R. norvegicus
atgctgactgccactt

SEQ ID NO: 481833 - DNA, 16 bp, R. norvegicus
atgctgagaaacacct

SEQ ID NO: 481834 - DNA, 16 bp, R. norvegicus
atgctgagaaagcgtt

SEQ ID NO: 481835 - DNA, 16 bp, R. norvegicus
atgctgagctggacag

SEQ ID NO: 481836 - DNA, 16 bp, R. norvegicus
atgctgataatggact

SEQ ID NO: 481837 - DNA, 16 bp, R. norvegicus
atgctgataggaacca

SEQ ID NO: 481838 - DNA, 16 bp, R. norvegicus
atgctgatgaagatgt

SEQ ID NO: 481839 - DNA, 16 bp, R. norvegicus
atgctgccatgttttc

SEQ ID NO: 481840 - DNA, 16 bp, R. norvegicus
atgctgccttttttcc

SEQ ID NO: 481841 - DNA, 16 bp, R. norvegicus
atgctgctatgctcct

SEQ ID NO: 481842 - DNA, 16 bp, R. norvegicus
atgctgctgctgctga

SEQ ID NO: 481843 - DNA, 16 bp, R. norvegicus
atgctgctttctggct

SEQ ID NO: 481844 - DNA, 16 bp, R. norvegicus
atgctggagaaggagc

SEQ ID NO: 481845 - DNA, 16 bp, R. norvegicus
atgctggaggacatca

SEQ ID NO: 481846 - DNA, 16 bp, R. norvegicus
atgctggaggactcca

SEQ ID NO: 481847 - DNA, 16 bp, R. norvegicus
atgctggaggagccaa

SEQ ID NO: 481848 - DNA, 16 bp, R. norvegicus
atgctggagtgggctt

SEQ ID NO: 481849 - DNA, 16 bp, R. norvegicus
atgctggcaaggatgg

SEQ ID NO: 481850 - DNA, 16 bp, R. norvegicus
atgctggcaagtatgt

SEQ ID NO: 481851 - DNA, 16 bp, R. norvegicus
atgctggcctggaaac

SEQ ID NO: 481852 - DNA, 17 bp, R. norvegicus
atgctggcgaggatgca

SEQ ID NO: 481853 - DNA, 16 bp, R. norvegicus
atgctggctgtgcctg

SEQ ID NO: 481854 - DNA, 16 bp, R. norvegicus
atgctggcttccaggc

SEQ ID NO: 481855 - DNA, 16 bp, R. norvegicus
atgctgggaataaagg

SEQ ID NO: 481856 - DNA, 16 bp, R. norvegicus
atgctgggactacaga

SEQ ID NO: 481857 - DNA, 16 bp, R. norvegicus
atgctgggagtgggag

SEQ ID NO: 481858 - DNA, 16 bp, R. norvegicus
atgctgggatcacagg

SEQ ID NO: 481859 - DNA, 16 bp, R. norvegicus
atgctgggccctcttt

SEQ ID NO: 481860 - DNA, 16 bp, R. norvegicus
atgctggggacaacat

SEQ ID NO: 481861 - DNA, 16 bp, R. norvegicus
atgctgggtcttcttt

SEQ ID NO: 481862 - DNA, 16 bp, R. norvegicus
atgctgggtgtggtgg

SEQ ID NO: 481863 - DNA, 16 bp, R. norvegicus
atgctggtgaagatat

SEQ ID NO: 481864 - DNA, 16 bp, R. norvegicus
atgctggtgaagatgt

SEQ ID NO: 481865 - DNA, 16 bp, R. norvegicus
atgctggtgagcatgt

SEQ ID NO: 481866 - DNA, 16 bp, R. norvegicus
atgctggtgtggatgt

SEQ ID NO: 481867 - DNA, 16 bp, R. norvegicus
atgctgtatcttcatt

SEQ ID NO: 481868 - DNA, 16 bp, R. norvegicus
atgctgtcctccagtt

SEQ ID NO: 481869 - DNA, 16 bp, R. norvegicus
atgctgtgacccttca

SEQ ID NO: 481870 - DNA, 16 bp, R. norvegicus
atgctgtgctgacccc

SEQ ID NO: 481871 - DNA, 16 bp, R. norvegicus
atgctgtggtgacccc

SEQ ID NO: 481872 - DNA, 16 bp, R. norvegicus
atgctgtggtgatccc

SEQ ID NO: 481873 - DNA, 16 bp, R. norvegicus
atgctgtggtttgaat

SEQ ID NO: 481874 - DNA, 16 bp, R. norvegicus
atgcttcaagatctcc

SEQ ID NO: 481875 - DNA, 16 bp, R. norvegicus
atgcttcagtcctcct

SEQ ID NO: 481876 - DNA, 16 bp, R. norvegicus
atgcttcagtttttct

SEQ ID NO: 481877 - DNA, 16 bp, R. norvegicus
atgcttcctgccatgc

SEQ ID NO: 481878 - DNA, 16 bp, R. norvegicus
atgcttctttaaaagc

SEQ ID NO: 481879 - DNA, 16 bp, R. norvegicus
atgcttgctgacagga

SEQ ID NO: 481880 - DNA, 16 bp, R. norvegicus
atgcttggtcctcagt

SEQ ID NO: 481881 - DNA, 16 bp, R. norvegicus
atgcttgtggaggtca

SEQ ID NO: 481882 - DNA, 16 bp, R. norvegicus
atgcttgtgtggcaaa

SEQ ID NO: 481883 - DNA, 16 bp, R. norvegicus
atgctttaaaaataaa

SEQ ID NO: 481884 - DNA, 16 bp, R. norvegicus
atgctttctttccttt

SEQ ID NO: 481885 - DNA, 16 bp, R. norvegicus
atgctttcttttatcc

SEQ ID NO: 481886 - DNA, 16 bp, R. norvegicus
atgctttcttttgtcc

SEQ ID NO: 481887 - DNA, 16 bp, R. norvegicus
atgctttggaggaaga

SEQ ID NO: 481888 - DNA, 16 bp, R. norvegicus
atgcttttaaataaat

SEQ ID NO: 481889 - DNA, 16 bp, R. norvegicus
atgcttttcaccctgt

SEQ ID NO: 481890 - DNA, 16 bp, R. norvegicus
atgctttttcctgttt

SEQ ID NO: 481891 - DNA, 16 bp, R. norvegicus
atgctttttgtttggt

SEQ ID NO: 481892 - DNA, 16 bp, R. norvegicus
atgcttttttttaaaa

SEQ ID NO: 481893 - DNA, 16 bp, R. norvegicus
atggaaaaaagcattt

SEQ ID NO: 481894 - DNA, 16 bp, R. norvegicus
atggaaaaagatgcag

SEQ ID NO: 481895 - DNA, 16 bp, R. norvegicus
atggaaaacattgaca

SEQ ID NO: 481896 - DNA, 16 bp, R. norvegicus
atggaaaacatttctt

SEQ ID NO: 481897 - DNA, 16 bp, R. norvegicus
atggaaaaccatcaac

SEQ ID NO: 481898 - DNA, 16 bp, R. norvegicus
atggaaaagaattgaa

SEQ ID NO: 481899 - DNA, 24 bp, R. norvegicus
atggaaaatatcatcctgagtgag

SEQ ID NO: 481900 - DNA, 16 bp, R. norvegicus
atggaaaatgaaatta

SEQ ID NO: 481901 - DNA, 16 bp, R. norvegicus
atggaaacacaaacta

SEQ ID NO: 481902 - DNA, 16 bp, R. norvegicus
atggaaacacacctct

SEQ ID NO: 481903 - DNA, 16 bp, R. norvegicus
atggaaacagaaaaga

SEQ ID NO: 481904 - DNA, 16 bp, R. norvegicus
atggaaacagaaatga

SEQ ID NO: 481905 - DNA, 16 bp, R. norvegicus
atggaaacaggcaact

SEQ ID NO: 481906 - DNA, 16 bp, R. norvegicus
atggaaacaggtaacc

SEQ ID NO: 481907 - DNA, 16 bp, R. norvegicus
atggaaacctgccttg

SEQ ID NO: 481908 - DNA, 16 bp, R. norvegicus
atggaaactgaaatta

SEQ ID NO: 481909 - DNA, 16 bp, R. norvegicus
atggaaacttccagaa

SEQ ID NO: 481910 - DNA, 16 bp, R. norvegicus
atggaaagagaagccc

SEQ ID NO: 481911 - DNA, 16 bp, R. norvegicus
atggaaaggcccggat

SEQ ID NO: 481912 - DNA, 16 bp, R. norvegicus
atggaaatacaaatta

SEQ ID NO: 481913 - DNA, 16 bp, R. norvegicus
atggaaatagaaatta

SEQ ID NO: 481914 - DNA, 16 bp, R. norvegicus
atggaaatccattaac

SEQ ID NO: 481915 - DNA, 16 bp, R. norvegicus
atggaaatgaaaatga

SEQ ID NO: 481916 - DNA, 16 bp, R. norvegicus
atggaaatgcagagtt

SEQ ID NO: 481917 - DNA, 16 bp, R. norvegicus
atggaaatggagaagg

SEQ ID NO: 481918 - DNA, 16 bp, R. norvegicus
atggaaatggggagga

SEQ ID NO: 481919 - DNA, 16 bp, R. norvegicus
atggaaatgtaaatca

SEQ ID NO: 481920 - DNA, 16 bp, R. norvegicus
atggaacaaagactga

SEQ ID NO: 481921 - DNA, 16 bp, R. norvegicus
atggaacagaaattga

SEQ ID NO: 481922 - DNA, 16 bp, R. norvegicus
atggaaccagaaaaga

SEQ ID NO: 481923 - DNA, 16 bp, R. norvegicus
atggaacccagagctt

SEQ ID NO: 481924 - DNA, 48 bp, R. norvegicus
atggaactggaaaatatcatcctgagtgagctaacccaatcacagaaa

SEQ ID NO: 481925 - DNA, 16 bp, R. norvegicus
atggaacttaaaaata

SEQ ID NO: 481926 - DNA, 16 bp, R. norvegicus
atggaagaagcaaaga

SEQ ID NO: 481927 - DNA, 16 bp, R. norvegicus
atggaagacagaagag

SEQ ID NO: 481928 - DNA, 16 bp, R. norvegicus
atggaagacagaatct

SEQ ID NO: 481929 - DNA, 16 bp, R. norvegicus
atggaagagaaagtgg

SEQ ID NO: 481930 - DNA, 16 bp, R. norvegicus
atggaagcaaagttca

SEQ ID NO: 481931 - DNA, 16 bp, R. norvegicus
atggaagccaaaagag

SEQ ID NO: 481932 - DNA, 16 bp, R. norvegicus
atggaagctttgcagt

SEQ ID NO: 481933 - DNA, 16 bp, R. norvegicus
atggaaggaaagaatc

SEQ ID NO: 481934 - DNA, 16 bp, R. norvegicus
atggaagtggagaaga

SEQ ID NO: 481935 - DNA, 16 bp, R. norvegicus
atggaagtgtgtgtgt

SEQ ID NO: 481936 - DNA, 16 bp, R. norvegicus
atggaatattctgctc

SEQ ID NO: 481937 - DNA, 16 bp, R. norvegicus
atggaatcagaaacta

SEQ ID NO: 481938 - DNA, 16 bp, R. norvegicus
atggaatcttctccaa

SEQ ID NO: 481939 - DNA, 16 bp, R. norvegicus
atggaatggaattgaa

SEQ ID NO: 481940 - DNA, 16 bp, R. norvegicus
atggaatggatacaga

SEQ ID NO: 481941 - DNA, 16 bp, R. norvegicus
atggaattggaatgtg

SEQ ID NO: 481942 - DNA, 16 bp, R. norvegicus
atggaattttctgctc

SEQ ID NO: 481943 - DNA, 16 bp, R. norvegicus
atggaatttttaaaaa

SEQ ID NO: 481944 - DNA, 16 bp, R. norvegicus
atggacaatgtcctag

SEQ ID NO: 481945 - DNA, 16 bp, R. norvegicus
atggacaatttcctac

SEQ ID NO: 481946 - DNA, 16 bp, R. norvegicus
atggacacagaaaata

SEQ ID NO: 481947 - DNA, 16 bp, R. norvegicus
atggacacatggacac

SEQ ID NO: 481948 - DNA, 16 bp, R. norvegicus
atggacagaaaaccag

SEQ ID NO: 481949 - DNA, 16 bp, R. norvegicus
atggacagacagatgg

SEQ ID NO: 481950 - DNA, 16 bp, R. norvegicus
atggacagacaggcag

SEQ ID NO: 481951 - DNA, 16 bp, R. norvegicus
atggacaggaaaacag

SEQ ID NO: 481952 - DNA, 16 bp, R. norvegicus
atggacaggaatccag

SEQ ID NO: 481953 - DNA, 16 bp, R. norvegicus
atggacaggagaaaag

SEQ ID NO: 481954 - DNA, 16 bp, R. norvegicus
atggacagtcccatgg

SEQ ID NO: 481955 - DNA, 16 bp, R. norvegicus
atggacagtgacagag

SEQ ID NO: 481956 - DNA, 16 bp, R. norvegicus
atggacgtgtgtgtgt

SEQ ID NO: 481957 - DNA, 16 bp, R. norvegicus
atggactaaccctggg

SEQ ID NO: 481958 - DNA, 17 bp, R. norvegicus
atggactacccgaagaa

SEQ ID NO: 481959 - DNA, 16 bp, R. norvegicus
atggactcatcctctg

SEQ ID NO: 481960 - DNA, 16 bp, R. norvegicus
atggactctgacatgg

SEQ ID NO: 481961 - DNA, 16 bp, R. norvegicus
atggactctgacctca

SEQ ID NO: 481962 - DNA, 16 bp, R. norvegicus
atggactgaaacctct

SEQ ID NO: 481963 - DNA, 17 bp, R. norvegicus
atggactgaccctgaac

SEQ ID NO: 481964 - DNA, 24 bp, R. norvegicus
atggactgaccctggactctgacc

SEQ ID NO: 481965 - DNA, 17 bp, R. norvegicus
atggactgaccgtggac

SEQ ID NO: 481966 - DNA, 16 bp, R. norvegicus
atggactgacctgggc

SEQ ID NO: 481967 - DNA, 16 bp, R. norvegicus
atggactgactctgga

SEQ ID NO: 481968 - DNA, 16 bp, R. norvegicus
atggactggccctgga

SEQ ID NO: 481969 - DNA, 16 bp, R. norvegicus
atggagaaaaagcaat

SEQ ID NO: 481970 - DNA, 16 bp, R. norvegicus
atggagaaaagatagc

SEQ ID NO: 481971 - DNA, 16 bp, R. norvegicus
atggagaaaccaaggt

SEQ ID NO: 481972 - DNA, 16 bp, R. norvegicus
atggagaaaccctgtc

SEQ ID NO: 481973 - DNA, 16 bp, R. norvegicus
atggagaaagacttaa

SEQ ID NO: 481974 - DNA, 16 bp, R. norvegicus
atggagaagaaactga

SEQ ID NO: 481975 - DNA, 16 bp, R. norvegicus
atggagaagaaagcaa

SEQ ID NO: 481976 - DNA, 16 bp, R. norvegicus
atggagaagaccctga

SEQ ID NO: 481977 - DNA, 16 bp, R. norvegicus
atggagaagagacaga

SEQ ID NO: 481978 - DNA, 16 bp, R. norvegicus
atggagaagagactgg

SEQ ID NO: 481979 - DNA, 16 bp, R. norvegicus
atggagaagagattga

SEQ ID NO: 481980 - DNA, 16 bp, R. norvegicus
atggagaagagcctgg

SEQ ID NO: 481981 - DNA, 16 bp, R. norvegicus
atggagaagatcctga

SEQ ID NO: 481982 - DNA, 16 bp, R. norvegicus
atggagaatgcctttg

SEQ ID NO: 481983 - DNA, 16 bp, R. norvegicus
atggagacaagacagt

SEQ ID NO: 481984 - DNA, 16 bp, R. norvegicus
atggagacagaaaatg

SEQ ID NO: 481985 - DNA, 16 bp, R. norvegicus
atggagacagacagac

SEQ ID NO: 481986 - DNA, 16 bp, R. norvegicus
atggagacatggaagt

SEQ ID NO: 481987 - DNA, 16 bp, R. norvegicus
atggagaccctgcagc

SEQ ID NO: 481988 - DNA, 16 bp, R. norvegicus
atggagactgagaagg

SEQ ID NO: 481989 - DNA, 16 bp, R. norvegicus
atggagagaaacttca

SEQ ID NO: 481990 - DNA, 16 bp, R. norvegicus
atggagagaacatgga

SEQ ID NO: 481991 - DNA, 16 bp, R. norvegicus
atggagagaagctgag

SEQ ID NO: 481992 - DNA, 16 bp, R. norvegicus
atggagagacagacag

SEQ ID NO: 481993 - DNA, 16 bp, R. norvegicus
atggagagagtgaaca

SEQ ID NO: 481994 - DNA, 16 bp, R. norvegicus
atggagagatatttga

SEQ ID NO: 481995 - DNA, 16 bp, R. norvegicus
atggagagatgctgct

SEQ ID NO: 481996 - DNA, 18 bp, R. norvegicus
atggagagcaacttgaag

SEQ ID NO: 481997 - DNA, 16 bp, R. norvegicus
atggagaggaaaccag

SEQ ID NO: 481998 - DNA, 16 bp, R. norvegicus
atggagataaagtttg

SEQ ID NO: 481999 - DNA, 16 bp, R. norvegicus
atggagatcagaggac

SEQ ID NO: 482000 - DNA, 16 bp, R. norvegicus
atggagatcatgaggc

SEQ ID NO: 482001 - DNA, 16 bp, R. norvegicus
atggagatggcagagt

SEQ ID NO: 482002 - DNA, 16 bp, R. norvegicus
atggagcagaatttga

SEQ ID NO: 482003 - DNA, 16 bp, R. norvegicus
atggagcaggaggagc

SEQ ID NO: 482004 - DNA, 16 bp, R. norvegicus
atggagcccaggctga

SEQ ID NO: 482005 - DNA, 16 bp, R. norvegicus
atggagcctgaaccag

SEQ ID NO: 482006 - DNA, 16 bp, R. norvegicus
atggagcctggggact

SEQ ID NO: 482007 - DNA, 16 bp, R. norvegicus
atggagccttcccagg

SEQ ID NO: 482008 - DNA, 16 bp, R. norvegicus
atggagctggagaagg

SEQ ID NO: 482009 - DNA, 16 bp, R. norvegicus
atggagctggaggagc

SEQ ID NO: 482010 - DNA, 16 bp, R. norvegicus
atggagcttggggagt

SEQ ID NO: 482011 - DNA, 16 bp, R. norvegicus
atggaggaaaacataa

SEQ ID NO: 482012 - DNA, 16 bp, R. norvegicus
atggaggagacagtga

SEQ ID NO: 482013 - DNA, 16 bp, R. norvegicus
atggaggaggtagaga

SEQ ID NO: 482014 - DNA, 16 bp, R. norvegicus
atggaggagtttgaga

SEQ ID NO: 482015 - DNA, 16 bp, R. norvegicus
atggaggattccccct

SEQ ID NO: 482016 - DNA, 16 bp, R. norvegicus
atggaggatttagaga

SEQ ID NO: 482017 - DNA, 16 bp, R. norvegicus
atggaggcaaaacact

SEQ ID NO: 482018 - DNA, 16 bp, R. norvegicus
atggaggcaaaattta

SEQ ID NO: 482019 - DNA, 16 bp, R. norvegicus
atggaggctgaggagc

SEQ ID NO: 482020 - DNA, 16 bp, R. norvegicus
atggagggagccatgg

SEQ ID NO: 482021 - DNA, 16 bp, R. norvegicus
atggaggggctggaga

SEQ ID NO: 482022 - DNA, 16 bp, R. norvegicus
atggaggtcagagaag

SEQ ID NO: 482023 - DNA, 16 bp, R. norvegicus
atggaggtggcaaagg

SEQ ID NO: 482024 - DNA, 16 bp, R. norvegicus
atggagtcagcctggc

SEQ ID NO: 482025 - DNA, 16 bp, R. norvegicus
atggataaatgataga

SEQ ID NO: 482026 - DNA, 16 bp, R. norvegicus
atggataataatggaa

SEQ ID NO: 482027 - DNA, 39 bp, R. norvegicus
atggatacagaaaatgtggtacatctacacaatggaatg

SEQ ID NO: 482028 - DNA, 16 bp, R. norvegicus
atggatacagaaatgt

SEQ ID NO: 482029 - DNA, 16 bp, R. norvegicus
atggatagatgaatgg

SEQ ID NO: 482030 - DNA, 16 bp, R. norvegicus
atggatattccaagct

SEQ ID NO: 482031 - DNA, 16 bp, R. norvegicus
atggatatttccccct

SEQ ID NO: 482032 - DNA, 16 bp, R. norvegicus
atggatccccaggtgg

SEQ ID NO: 482033 - DNA, 16 bp, R. norvegicus
atggatctacagttga

SEQ ID NO: 482034 - DNA, 16 bp, R. norvegicus
atggatctgcattctt

SEQ ID NO: 482035 - DNA, 16 bp, R. norvegicus
atggatgaaatggaca

SEQ ID NO: 482036 - DNA, 16 bp, R. norvegicus
atggatgaacacacac

SEQ ID NO: 482037 - DNA, 16 bp, R. norvegicus
atggatgaagcaaagg

SEQ ID NO: 482038 - DNA, 16 bp, R. norvegicus
atggatgaccattttg

SEQ ID NO: 482039 - DNA, 16 bp, R. norvegicus
atggatgcttcagacc

SEQ ID NO: 482040 - DNA, 16 bp, R. norvegicus
atggatgcttcagtcc

SEQ ID NO: 482041 - DNA, 16 bp, R. norvegicus
atggatggaaatggaa

SEQ ID NO: 482042 - DNA, 24 bp, R. norvegicus
atggatggatgatggatggatgga

SEQ ID NO: 482043 - DNA, 16 bp, R. norvegicus
atggatggatgggtgg

SEQ ID NO: 482044 - DNA, 16 bp, R. norvegicus
atggatggctggatgg

SEQ ID NO: 482045 - DNA, 16 bp, R. norvegicus
atggatgggcagacag

SEQ ID NO: 482046 - DNA, 16 bp, R. norvegicus
atggatgtctcctaag

SEQ ID NO: 482047 - DNA, 16 bp, R. norvegicus
atggatgttttgccta

SEQ ID NO: 482048 - DNA, 16 bp, R. norvegicus
atggattcagaaaata

SEQ ID NO: 482049 - DNA, 16 bp, R. norvegicus
atggattcttctgctc

SEQ ID NO: 482050 - DNA, 17 bp, R. norvegicus
atggattggcagaatta

SEQ ID NO: 482051 - DNA, 21 bp, R. norvegicus
atggattggcaggattaataa

SEQ ID NO: 482052 - DNA, 16 bp, R. norvegicus
atggatttcatgaagt

SEQ ID NO: 482053 - DNA, 16 bp, R. norvegicus
atggatttcctggatg

SEQ ID NO: 482054 - DNA, 16 bp, R. norvegicus
atggatttggggactt

SEQ ID NO: 482055 - DNA, 16 bp, R. norvegicus
atggcaaacacagagg

SEQ ID NO: 482056 - DNA, 16 bp, R. norvegicus
atggcaaacattttac

SEQ ID NO: 482057 - DNA, 16 bp, R. norvegicus
atggcaaactgtttta

SEQ ID NO: 482058 - DNA, 16 bp, R. norvegicus
atggcaaagatcaaac

SEQ ID NO: 482059 - DNA, 16 bp, R. norvegicus
atggcaagaagttgtt

SEQ ID NO: 482060 - DNA, 16 bp, R. norvegicus
atggcaagttccaggc

SEQ ID NO: 482061 - DNA, 16 bp, R. norvegicus
atggcagaggctatcc

SEQ ID NO: 482062 - DNA, 16 bp, R. norvegicus
atggcagcaaccagga

SEQ ID NO: 482063 - DNA, 16 bp, R. norvegicus
atggcagccctcctgt

SEQ ID NO: 482064 - DNA, 16 bp, R. norvegicus
atggcaggaaataatc

SEQ ID NO: 482065 - DNA, 16 bp, R. norvegicus
atggcaggaacatggc

SEQ ID NO: 482066 - DNA, 16 bp, R. norvegicus
atggcaggaaccatgg

SEQ ID NO: 482067 - DNA, 16 bp, R. norvegicus
atggcaggaggtactt

SEQ ID NO: 482068 - DNA, 16 bp, R. norvegicus
atggcagtgcccaggc

SEQ ID NO: 482069 - DNA, 16 bp, R. norvegicus
atggcatcaagtggag

SEQ ID NO: 482070 - DNA, 16 bp, R. norvegicus
atggcatcctattgct

SEQ ID NO: 482071 - DNA, 16 bp, R. norvegicus
atggcatcttcagcaa

SEQ ID NO: 482072 - DNA, 16 bp, R. norvegicus
atggcatggatctcaa

SEQ ID NO: 482073 - DNA, 16 bp, R. norvegicus
atggcattgtctggca

SEQ ID NO: 482074 - DNA, 16 bp, R. norvegicus
atggccacagttaaga

SEQ ID NO: 482075 - DNA, 16 bp, R. norvegicus
atggccagaaactgga

SEQ ID NO: 482076 - DNA, 16 bp, R. norvegicus
atggccagcagactgg

SEQ ID NO: 482077 - DNA, 16 bp, R. norvegicus
atggccatcttcccaa

SEQ ID NO: 482078 - DNA, 16 bp, R. norvegicus
atggcccagaagcacc

SEQ ID NO: 482079 - DNA, 16 bp, R. norvegicus
atggcccagcaggtaa

SEQ ID NO: 482080 - DNA, 16 bp, R. norvegicus
atggccccatccctca

SEQ ID NO: 482081 - DNA, 16 bp, R. norvegicus
atggcctctgggaact

SEQ ID NO: 482082 - DNA, 16 bp, R. norvegicus
atggcctctgtatcag

SEQ ID NO: 482083 - DNA, 18 bp, R. norvegicus
atggcctgctattcctgg

SEQ ID NO: 482084 - DNA, 16 bp, R. norvegicus
atggccttgtctgtca

SEQ ID NO: 482085 - DNA, 16 bp, R. norvegicus
atggcctttttgggca

SEQ ID NO: 482086 - DNA, 16 bp, R. norvegicus
atggcctttttgtcca

SEQ ID NO: 482087 - DNA, 17 bp, R. norvegicus
atggcgagaggcaagct

SEQ ID NO: 482088 - DNA, 16 bp, R. norvegicus
atggcgccctcttctg

SEQ ID NO: 482089 - DNA, 16 bp, R. norvegicus
atggcggaaggagaga

SEQ ID NO: 482090 - DNA, 16 bp, R. norvegicus
atggctaaggatgctg

SEQ ID NO: 482091 - DNA, 16 bp, R. norvegicus
atggctaaggtaaaaa

SEQ ID NO: 482092 - DNA, 16 bp, R. norvegicus
atggctacttcagttt

SEQ ID NO: 482093 - DNA, 16 bp, R. norvegicus
atggctagaggcaagc

SEQ ID NO: 482094 - DNA, 16 bp, R. norvegicus
atggctataaatgtac

SEQ ID NO: 482095 - DNA, 16 bp, R. norvegicus
atggctatttctggtt

SEQ ID NO: 482096 - DNA, 16 bp, R. norvegicus
atggctcaatgggtaa

SEQ ID NO: 482097 - DNA, 16 bp, R. norvegicus
atggctcagagcactg

SEQ ID NO: 482098 - DNA, 16 bp, R. norvegicus
atggctcagagggcaa

SEQ ID NO: 482099 - DNA, 16 bp, R. norvegicus
atggctcagcagctga

SEQ ID NO: 482100 - DNA, 16 bp, R. norvegicus
atggctcagcagttag

SEQ ID NO: 482101 - DNA, 16 bp, R. norvegicus
atggctcagcccttaa

SEQ ID NO: 482102 - DNA, 16 bp, R. norvegicus
atggctcaggaattaa

SEQ ID NO: 482103 - DNA, 16 bp, R. norvegicus
atggctcagtcaggaa

SEQ ID NO: 482104 - DNA, 16 bp, R. norvegicus
atggctcagtgtttaa

SEQ ID NO: 482105 - DNA, 16 bp, R. norvegicus
atggctccaacagcat

SEQ ID NO: 482106 - DNA, 16 bp, R. norvegicus
atggctccagttgcat

SEQ ID NO: 482107 - DNA, 16 bp, R. norvegicus
atggctcccactacat

SEQ ID NO: 482108 - DNA, 16 bp, R. norvegicus
atggctctcttctttt

SEQ ID NO: 482109 - DNA, 16 bp, R. norvegicus
atggctctgcagttaa

SEQ ID NO: 482110 - DNA, 16 bp, R. norvegicus
atggctgagaaacaca

SEQ ID NO: 482111 - DNA, 16 bp, R. norvegicus
atggctgagaaatatt

SEQ ID NO: 482112 - DNA, 16 bp, R. norvegicus
atggctgagaagaacc

SEQ ID NO: 482113 - DNA, 16 bp, R. norvegicus
atggctgagcaacacc

SEQ ID NO: 482114 - DNA, 29 bp, R. norvegicus
atggctgcacagcccaggcacagcaagtg

SEQ ID NO: 482115 - DNA, 16 bp, R. norvegicus
atggctgctccagctt

SEQ ID NO: 482116 - DNA, 16 bp, R. norvegicus
atggctgctgagaaag

SEQ ID NO: 482117 - DNA, 16 bp, R. norvegicus
atggctgcttctattt

SEQ ID NO: 482118 - DNA, 16 bp, R. norvegicus
atggctggatggctgg

SEQ ID NO: 482119 - DNA, 16 bp, R. norvegicus
atggctggcctctttg

SEQ ID NO: 482120 - DNA, 16 bp, R. norvegicus
atggctgtggctgtgg

SEQ ID NO: 482121 - DNA, 28 bp, R. norvegicus
atggcttacgctctaagatcaagaattg

SEQ ID NO: 482122 - DNA, 16 bp, R. norvegicus
atggcttcagctgcat

SEQ ID NO: 482123 - DNA, 16 bp, R. norvegicus
atggcttcaggtggca

SEQ ID NO: 482124 - DNA, 16 bp, R. norvegicus
atggcttctctccctc

SEQ ID NO: 482125 - DNA, 16 bp, R. norvegicus
atggcttctgcttcaa

SEQ ID NO: 482126 - DNA, 16 bp, R. norvegicus
atgggaaaatattttc

SEQ ID NO: 482127 - DNA, 16 bp, R. norvegicus
atgggaaacaatgaaa

SEQ ID NO: 482128 - DNA, 21 bp, R. norvegicus
atgggaaactcacactccacc

SEQ ID NO: 482129 - DNA, 16 bp, R. norvegicus
atgggaaactgggaaa

SEQ ID NO: 482130 - DNA, 16 bp, R. norvegicus
atgggaacaaagtgtt

SEQ ID NO: 482131 - DNA, 16 bp, R. norvegicus
atgggaagaacaacag

SEQ ID NO: 482132 - DNA, 16 bp, R. norvegicus
atgggaagagaggcct

SEQ ID NO: 482133 - DNA, 16 bp, R. norvegicus
atgggaagcccttggt

SEQ ID NO: 482134 - DNA, 18 bp, R. norvegicus
atgggaagcttgtcatca

SEQ ID NO: 482135 - DNA, 16 bp, R. norvegicus
atgggaattcaaggcc

SEQ ID NO: 482136 - DNA, 16 bp, R. norvegicus
atgggacacaattaaa

SEQ ID NO: 482137 - DNA, 16 bp, R. norvegicus
atgggacagaatgaaa

SEQ ID NO: 482138 - DNA, 16 bp, R. norvegicus
atgggactgggaggag

SEQ ID NO: 482139 - DNA, 16 bp, R. norvegicus
atgggagagagacccc

SEQ ID NO: 482140 - DNA, 16 bp, R. norvegicus
atgggagatatttcca

SEQ ID NO: 482141 - DNA, 21 bp, R. norvegicus
atgggagccgcccagctgtaa

SEQ ID NO: 482142 - DNA, 16 bp, R. norvegicus
atgggaggagagaact

SEQ ID NO: 482143 - DNA, 16 bp, R. norvegicus
atgggatggagagatg

SEQ ID NO: 482144 - DNA, 16 bp, R. norvegicus
atgggatgggggtttt

SEQ ID NO: 482145 - DNA, 16 bp, R. norvegicus
atgggatgtggaacaa

SEQ ID NO: 482146 - DNA, 16 bp, R. norvegicus
atgggatgtggaactg

SEQ ID NO: 482147 - DNA, 16 bp, R. norvegicus
atgggcacagggggaa

SEQ ID NO: 482148 - DNA, 16 bp, R. norvegicus
atgggcaccggagaaa

SEQ ID NO: 482149 - DNA, 16 bp, R. norvegicus
atgggcatccctttct

SEQ ID NO: 482150 - DNA, 16 bp, R. norvegicus
atgggccaaacattca

SEQ ID NO: 482151 - DNA, 16 bp, R. norvegicus
atgggccaccatgcct

SEQ ID NO: 482152 - DNA, 58 bp, R. norvegicus
atgggccaggaacgccggcggcttatctacgtccgtctgacaaggcgtgaggtgaaag

SEQ ID NO: 482153 - DNA, 16 bp, R. norvegicus
atgggcccacagaggc

SEQ ID NO: 482154 - DNA, 16 bp, R. norvegicus
atgggccctggaaaaa

SEQ ID NO: 482155 - DNA, 16 bp, R. norvegicus
atgggcctggagagat

SEQ ID NO: 482156 - DNA, 16 bp, R. norvegicus
atgggctccctctcat

SEQ ID NO: 482157 - DNA, 16 bp, R. norvegicus
atgggctctgcttcag

SEQ ID NO: 482158 - DNA, 16 bp, R. norvegicus
atgggctgaccctggg

SEQ ID NO: 482159 - DNA, 16 bp, R. norvegicus
atgggctggacccagg

SEQ ID NO: 482160 - DNA, 16 bp, R. norvegicus
atgggctggatcccca

SEQ ID NO: 482161 - DNA, 16 bp, R. norvegicus
atgggctggctgtggg

SEQ ID NO: 482162 - DNA, 16 bp, R. norvegicus
atgggctgggccctct

SEQ ID NO: 482163 - DNA, 16 bp, R. norvegicus
atgggcttagtgcaga

SEQ ID NO: 482164 - DNA, 16 bp, R. norvegicus
atgggctttgaggtct

SEQ ID NO: 482165 - DNA, 16 bp, R. norvegicus
atggggaaactgaggc

SEQ ID NO: 482166 - DNA, 16 bp, R. norvegicus
atggggaacagtcaga

SEQ ID NO: 482167 - DNA, 16 bp, R. norvegicus
atggggaactggaggt

SEQ ID NO: 482168 - DNA, 16 bp, R. norvegicus
atggggaagaacactt

SEQ ID NO: 482169 - DNA, 16 bp, R. norvegicus
atggggaagagagcta

SEQ ID NO: 482170 - DNA, 16 bp, R. norvegicus
atggggaagggcccag

SEQ ID NO: 482171 - DNA, 18 bp, R. norvegicus
atggggacctcacagtct

SEQ ID NO: 482172 - DNA, 16 bp, R. norvegicus
atggggagaaggttct

SEQ ID NO: 482173 - DNA, 16 bp, R. norvegicus
atggggagccacagag

SEQ ID NO: 482174 - DNA, 16 bp, R. norvegicus
atggggaggcagaggc

SEQ ID NO: 482175 - DNA, 16 bp, R. norvegicus
atggggagggaaacag

SEQ ID NO: 482176 - DNA, 16 bp, R. norvegicus
atggggatggagagat

SEQ ID NO: 482177 - DNA, 16 bp, R. norvegicus
atggggattgcagtga

SEQ ID NO: 482178 - DNA, 16 bp, R. norvegicus
atggggcaataacaaa

SEQ ID NO: 482179 - DNA, 16 bp, R. norvegicus
atggggccacctactc

SEQ ID NO: 482180 - DNA, 16 bp, R. norvegicus
atggggctgccctcct

SEQ ID NO: 482181 - DNA, 16 bp, R. norvegicus
atggggctggagagat

SEQ ID NO: 482182 - DNA, 16 bp, R. norvegicus
atgggggaaaaggact

SEQ ID NO: 482183 - DNA, 16 bp, R. norvegicus
atgggggacaagagac

SEQ ID NO: 482184 - DNA, 16 bp, R. norvegicus
atgggggacaagggac

SEQ ID NO: 482185 - DNA, 16 bp, R. norvegicus
atggggtctcaaaccc

SEQ ID NO: 482186 - DNA, 16 bp, R. norvegicus
atggggttgcaaggcc

SEQ ID NO: 482187 - DNA, 16 bp, R. norvegicus
atggggttgccatccc

SEQ ID NO: 482188 - DNA, 16 bp, R. norvegicus
atgggtacagagagct

SEQ ID NO: 482189 - DNA, 16 bp, R. norvegicus
atgggtcatgacccct

SEQ ID NO: 482190 - DNA, 16 bp, R. norvegicus
atgggtccctccatct

SEQ ID NO: 482191 - DNA, 16 bp, R. norvegicus
atgggtccctccatgt

SEQ ID NO: 482192 - DNA, 29 bp, R. norvegicus
atgggtctggagacagactccccagagga

SEQ ID NO: 482193 - DNA, 16 bp, R. norvegicus
atgggttctcataaaa

SEQ ID NO: 482194 - DNA, 16 bp, R. norvegicus
atggtacatacacaca

SEQ ID NO: 482195 - DNA, 16 bp, R. norvegicus
atggtacctcatgaaa

SEQ ID NO: 482196 - DNA, 16 bp, R. norvegicus
atggtactgggctttg

SEQ ID NO: 482197 - DNA, 16 bp, R. norvegicus
atggtagcttctccaa

SEQ ID NO: 482198 - DNA, 21 bp, R. norvegicus
atggtatgcactcactgataa

SEQ ID NO: 482199 - DNA, 16 bp, R. norvegicus
atggtattggtactga

SEQ ID NO: 482200 - DNA, 16 bp, R. norvegicus
atggtattggtataga

SEQ ID NO: 482201 - DNA, 16 bp, R. norvegicus
atggtcaaagaagaaa

SEQ ID NO: 482202 - DNA, 16 bp, R. norvegicus
atggtcatggtgtctc

SEQ ID NO: 482203 - DNA, 16 bp, R. norvegicus
atggtcctttctccaa

SEQ ID NO: 482204 - DNA, 16 bp, R. norvegicus
atggtctacagagcaa

SEQ ID NO: 482205 - DNA, 16 bp, R. norvegicus
atggtctgtacaggtt

SEQ ID NO: 482206 - DNA, 16 bp, R. norvegicus
atggtcttaaccactg

SEQ ID NO: 482207 - DNA, 16 bp, R. norvegicus
atggtctttgcctttt

SEQ ID NO: 482208 - DNA, 16 bp, R. norvegicus
atggtgaaaagagaga

SEQ ID NO: 482209 - DNA, 16 bp, R. norvegicus
atggtgaaagtcagct

SEQ ID NO: 482210 - DNA, 16 bp, R. norvegicus
atggtgacagtgatgg

SEQ ID NO: 482211 - DNA, 16 bp, R. norvegicus
atggtgcaggaggagc

SEQ ID NO: 482212 - DNA, 16 bp, R. norvegicus
atggtgctggaggagg

SEQ ID NO: 482213 - DNA, 16 bp, R. norvegicus
atggtgctggaggatc

SEQ ID NO: 482214 - DNA, 16 bp, R. norvegicus
atggtgctggtgctgg

SEQ ID NO: 482215 - DNA, 16 bp, R. norvegicus
atggtgctggtttccg

SEQ ID NO: 482216 - DNA, 16 bp, R. norvegicus
atggtgcttctcccaa

SEQ ID NO: 482217 - DNA, 16 bp, R. norvegicus
atggtggaggaagaga

SEQ ID NO: 482218 - DNA, 16 bp, R. norvegicus
atggtggcaggagcag

SEQ ID NO: 482219 - DNA, 16 bp, R. norvegicus
atggtggcccatgcct

SEQ ID NO: 482220 - DNA, 16 bp, R. norvegicus
atggtggcctacaaaa

SEQ ID NO: 482221 - DNA, 16 bp, R. norvegicus
atggtggcctggaaac

SEQ ID NO: 482222 - DNA, 16 bp, R. norvegicus
atggtggcttctcctc

SEQ ID NO: 482223 - DNA, 16 bp, R. norvegicus
atggtgggaagaagca

SEQ ID NO: 482224 - DNA, 16 bp, R. norvegicus
atggtgggaagaatgg

SEQ ID NO: 482225 - DNA, 16 bp, R. norvegicus
atggtggtgaagttca

SEQ ID NO: 482226 - DNA, 16 bp, R. norvegicus
atggtggtgaatgatg

SEQ ID NO: 482227 - DNA, 16 bp, R. norvegicus
atggtggtgcatacct

SEQ ID NO: 482228 - DNA, 16 bp, R. norvegicus
atggtggtgcatgcct

SEQ ID NO: 482229 - DNA, 16 bp, R. norvegicus
atggtggtggtgatga

SEQ ID NO: 482230 - DNA, 16 bp, R. norvegicus
atggtggtggtgctgg

SEQ ID NO: 482231 - DNA, 16 bp, R. norvegicus
atggtggtggtggcgg

SEQ ID NO: 482232 - DNA, 16 bp, R. norvegicus
atggtggtggtggtgc

SEQ ID NO: 482233 - DNA, 16 bp, R. norvegicus
atggtgtctcatcaca

SEQ ID NO: 482234 - DNA, 16 bp, R. norvegicus
atggtgtcttctcaca

SEQ ID NO: 482235 - DNA, 16 bp, R. norvegicus
atggtgtggtgacccc

SEQ ID NO: 482236 - DNA, 16 bp, R. norvegicus
atggttaaaaatgcag

SEQ ID NO: 482237 - DNA, 16 bp, R. norvegicus
atggttatcctgtact

SEQ ID NO: 482238 - DNA, 16 bp, R. norvegicus
atggttcaagtattaa

SEQ ID NO: 482239 - DNA, 16 bp, R. norvegicus
atggttcaatatagga

SEQ ID NO: 482240 - DNA, 16 bp, R. norvegicus
atggttcagtcagtaa

SEQ ID NO: 482241 - DNA, 16 bp, R. norvegicus
atggttccagagggag

SEQ ID NO: 482242 - DNA, 16 bp, R. norvegicus
atggttcctgtgccct

SEQ ID NO: 482243 - DNA, 16 bp, R. norvegicus
atggttctggctttag

SEQ ID NO: 482244 - DNA, 16 bp, R. norvegicus
atggttctggtctaac

SEQ ID NO: 482245 - DNA, 16 bp, R. norvegicus
atggttgggagccacc

SEQ ID NO: 482246 - DNA, 16 bp, R. norvegicus
atggttgtgagctccc

SEQ ID NO: 482247 - DNA, 27 bp, R. norvegicus
atggtttaatatacagaaaaccatcaa

SEQ ID NO: 482248 - DNA, 16 bp, R. norvegicus
atggtttatttattcc

SEQ ID NO: 482249 - DNA, 16 bp, R. norvegicus
atggtttgtatatgct

SEQ ID NO: 482250 - DNA, 16 bp, R. norvegicus
atggttttactcatct

SEQ ID NO: 482251 - DNA, 16 bp, R. norvegicus
atgtaaaaattgtttt

SEQ ID NO: 482252 - DNA, 16 bp, R. norvegicus
atgtaaaatactcaat

SEQ ID NO: 482253 - DNA, 16 bp, R. norvegicus
atgtaaaatatgtaca

SEQ ID NO: 482254 - DNA, 16 bp, R. norvegicus
atgtaaaccaaataaa

SEQ ID NO: 482255 - DNA, 17 bp, R. norvegicus
atgtaaaggctttacca

SEQ ID NO: 482256 - DNA, 16 bp, R. norvegicus
atgtaaatatgtacat

SEQ ID NO: 482257 - DNA, 16 bp, R. norvegicus
atgtaaatgtaaatat

SEQ ID NO: 482258 - DNA, 16 bp, R. norvegicus
atgtaacttttatttg

SEQ ID NO: 482259 - DNA, 16 bp, R. norvegicus
atgtaataatatctga

SEQ ID NO: 482260 - DNA, 16 bp, R. norvegicus
atgtaattttacattt

SEQ ID NO: 482261 - DNA, 16 bp, R. norvegicus
atgtacaaaacaaaga

SEQ ID NO: 482262 - DNA, 16 bp, R. norvegicus
atgtacaaagaattca

SEQ ID NO: 482263 - DNA, 16 bp, R. norvegicus
atgtacaagaagctta

SEQ ID NO: 482264 - DNA, 16 bp, R. norvegicus
atgtacaaggccctgg

SEQ ID NO: 482265 - DNA, 16 bp, R. norvegicus
atgtacaattttctga

SEQ ID NO: 482266 - DNA, 16 bp, R. norvegicus
atgtacacagtcctta

SEQ ID NO: 482267 - DNA, 16 bp, R. norvegicus
atgtacacgtgcaggc

SEQ ID NO: 482268 - DNA, 16 bp, R. norvegicus
atgtacatatgtacat

SEQ ID NO: 482269 - DNA, 16 bp, R. norvegicus
atgtacatgtataaat

SEQ ID NO: 482270 - DNA, 16 bp, R. norvegicus
atgtacatttatgtat

SEQ ID NO: 482271 - DNA, 16 bp, R. norvegicus
atgtaccaaagaatgc

SEQ ID NO: 482272 - DNA, 56 bp, R. norvegicus
atgtaccacattttctgtatccattcctctgttgaagggcatctcggttctttcca

SEQ ID NO: 482273 - DNA, 56 bp, R. norvegicus
atgtaccacattttctgtatccattcctctgttgaagggcatctgggttctttcca

SEQ ID NO: 482274 - DNA, 16 bp, R. norvegicus
atgtaccaccaggcct

SEQ ID NO: 482275 - DNA, 16 bp, R. norvegicus
atgtaccaccatgcca

SEQ ID NO: 482276 - DNA, 16 bp, R. norvegicus
atgtactcaccgataa

SEQ ID NO: 482277 - DNA, 16 bp, R. norvegicus
atgtactccagataaa

SEQ ID NO: 482278 - DNA, 16 bp, R. norvegicus
atgtactgaccctgag

SEQ ID NO: 482279 - DNA, 16 bp, R. norvegicus
atgtactgtgtgtgtg

SEQ ID NO: 482280 - DNA, 16 bp, R. norvegicus
atgtactttttattat

SEQ ID NO: 482281 - DNA, 16 bp, R. norvegicus
atgtagaaaaatgtaa

SEQ ID NO: 482282 - DNA, 26 bp, R. norvegicus
atgtagaagaatgcagatcaatccat

SEQ ID NO: 482283 - DNA, 26 bp, R. norvegicus
atgtagaagaatgcagatcgatctat

SEQ ID NO: 482284 - DNA, 58 bp, R. norvegicus
atgtagaagaatgcagattgatccatgcttatcaccctgtacaaagcttaagtccaag

SEQ ID NO: 482285 - DNA, 16 bp, R. norvegicus
atgtagaccaggccgg

SEQ ID NO: 482286 - DNA, 16 bp, R. norvegicus
atgtagagatgcatgg

SEQ ID NO: 482287 - DNA, 16 bp, R. norvegicus
atgtagaggtctttga

SEQ ID NO: 482288 - DNA, 16 bp, R. norvegicus
atgtagatcaggctgg

SEQ ID NO: 482289 - DNA, 16 bp, R. norvegicus
atgtagcagaggattt

SEQ ID NO: 482290 - DNA, 16 bp, R. norvegicus
atgtagcccaagctga

SEQ ID NO: 482291 - DNA, 16 bp, R. norvegicus
atgtagcccaagctgg

SEQ ID NO: 482292 - DNA, 16 bp, R. norvegicus
atgtagcccaggctgg

SEQ ID NO: 482293 - DNA, 16 bp, R. norvegicus
atgtagcccaggctgt

SEQ ID NO: 482294 - DNA, 16 bp, R. norvegicus
atgtagccctggccat

SEQ ID NO: 482295 - DNA, 16 bp, R. norvegicus
atgtagccttggttgg

SEQ ID NO: 482296 - DNA, 16 bp, R. norvegicus
atgtagtaaagccttt

SEQ ID NO: 482297 - DNA, 16 bp, R. norvegicus
atgtagtcaagttgat

SEQ ID NO: 482298 - DNA, 16 bp, R. norvegicus
atgtatacacaaacac

SEQ ID NO: 482299 - DNA, 16 bp, R. norvegicus
atgtatataatttcag

SEQ ID NO: 482300 - DNA, 16 bp, R. norvegicus
atgtatatacatattt

SEQ ID NO: 482301 - DNA, 16 bp, R. norvegicus
atgtatatatagtaca

SEQ ID NO: 482302 - DNA, 16 bp, R. norvegicus
atgtatatatattctt

SEQ ID NO: 482303 - DNA, 16 bp, R. norvegicus
atgtatatatatttac

SEQ ID NO: 482304 - DNA, 16 bp, R. norvegicus
atgtatatatgcatat

SEQ ID NO: 482305 - DNA, 16 bp, R. norvegicus
atgtatatatgtatat

SEQ ID NO: 482306 - DNA, 16 bp, R. norvegicus
atgtatatattataca

SEQ ID NO: 482307 - DNA, 16 bp, R. norvegicus
atgtatatattttctt

SEQ ID NO: 482308 - DNA, 16 bp, R. norvegicus
atgtatatgagtatgt

SEQ ID NO: 482309 - DNA, 16 bp, R. norvegicus
atgtatatgagtgtgt

SEQ ID NO: 482310 - DNA, 16 bp, R. norvegicus
atgtatatgtacgtgt

SEQ ID NO: 482311 - DNA, 16 bp, R. norvegicus
atgtatatgtgtattg

SEQ ID NO: 482312 - DNA, 16 bp, R. norvegicus
atgtatatgtttacat

SEQ ID NO: 482313 - DNA, 16 bp, R. norvegicus
atgtatatttacatat

SEQ ID NO: 482314 - DNA, 16 bp, R. norvegicus
atgtatccctgactgg

SEQ ID NO: 482315 - DNA, 16 bp, R. norvegicus
atgtatctatatctat

SEQ ID NO: 482316 - DNA, 16 bp, R. norvegicus
atgtatctgtgtgtgg

SEQ ID NO: 482317 - DNA, 16 bp, R. norvegicus
atgtatgcatgcatgt

SEQ ID NO: 482318 - DNA, 16 bp, R. norvegicus
atgtatgccatgtgtg

SEQ ID NO: 482319 - DNA, 16 bp, R. norvegicus
atgtatgtaattatat

SEQ ID NO: 482320 - DNA, 16 bp, R. norvegicus
atgtatgtacaggtgt

SEQ ID NO: 482321 - DNA, 16 bp, R. norvegicus
atgtatgtagatgccc

SEQ ID NO: 482322 - DNA, 16 bp, R. norvegicus
atgtatgtctgtacac

SEQ ID NO: 482323 - DNA, 16 bp, R. norvegicus
atgtatgtctgtatgt

SEQ ID NO: 482324 - DNA, 16 bp, R. norvegicus
atgtatgtgagcacac

SEQ ID NO: 482325 - DNA, 16 bp, R. norvegicus
atgtatgtgagtgagt

SEQ ID NO: 482326 - DNA, 16 bp, R. norvegicus
atgtatgtgggtaact

SEQ ID NO: 482327 - DNA, 16 bp, R. norvegicus
atgtatgtgtatatat

SEQ ID NO: 482328 - DNA, 16 bp, R. norvegicus
atgtatgtgtatatgt

SEQ ID NO: 482329 - DNA, 16 bp, R. norvegicus
atgtatgtgtatgagt

SEQ ID NO: 482330 - DNA, 16 bp, R. norvegicus
atgtatgtgtgtatgt

SEQ ID NO: 482331 - DNA, 16 bp, R. norvegicus
atgtatgtgtgtgcat

SEQ ID NO: 482332 - DNA, 16 bp, R. norvegicus
atgtattacagagcaa

SEQ ID NO: 482333 - DNA, 16 bp, R. norvegicus
atgtattcttccacaa

SEQ ID NO: 482334 - DNA, 16 bp, R. norvegicus
atgtattcttttgtga

SEQ ID NO: 482335 - DNA, 16 bp, R. norvegicus
atgtattgcatgagag

SEQ ID NO: 482336 - DNA, 16 bp, R. norvegicus
atgtatttatgtatgt

SEQ ID NO: 482337 - DNA, 16 bp, R. norvegicus
atgtatttatttctct

SEQ ID NO: 482338 - DNA, 16 bp, R. norvegicus
atgtatttgagattct

SEQ ID NO: 482339 - DNA, 16 bp, R. norvegicus
atgtatttgtgcatgt

SEQ ID NO: 482340 - DNA, 16 bp, R. norvegicus
atgtatttgtgtatgt

SEQ ID NO: 482341 - DNA, 16 bp, R. norvegicus
atgtattttcaataaa

SEQ ID NO: 482342 - DNA, 16 bp, R. norvegicus
atgtattttcttatat

SEQ ID NO: 482343 - DNA, 16 bp, R. norvegicus
atgtattttgtgtata

SEQ ID NO: 482344 - DNA, 16 bp, R. norvegicus
atgtatttttctatat

SEQ ID NO: 482345 - DNA, 16 bp, R. norvegicus
atgtattttttccatt

SEQ ID NO: 482346 - DNA, 16 bp, R. norvegicus
atgtcaaattttctga

SEQ ID NO: 482347 - DNA, 16 bp, R. norvegicus
atgtcaacctctggcc

SEQ ID NO: 482348 - DNA, 16 bp, R. norvegicus
atgtcacccagcatgc

SEQ ID NO: 482349 - DNA, 16 bp, R. norvegicus
atgtcactttaaagaa

SEQ ID NO: 482350 - DNA, 16 bp, R. norvegicus
atgtcagaagctatac

SEQ ID NO: 482351 - DNA, 16 bp, R. norvegicus
atgtcagcacacacag

SEQ ID NO: 482352 - DNA, 16 bp, R. norvegicus
atgtcagcagcctgac

SEQ ID NO: 482353 - DNA, 17 bp, R. norvegicus
atgtcaggggacctgga

SEQ ID NO: 482354 - DNA, 16 bp, R. norvegicus
atgtcagggtgggcag

SEQ ID NO: 482355 - DNA, 16 bp, R. norvegicus
atgtcaggtgtcttct

SEQ ID NO: 482356 - DNA, 16 bp, R. norvegicus
atgtcatcctgaatga

SEQ ID NO: 482357 - DNA, 16 bp, R. norvegicus
atgtcatctgcaaatg

SEQ ID NO: 482358 - DNA, 16 bp, R. norvegicus
atgtcatgaaattcat

SEQ ID NO: 482359 - DNA, 16 bp, R. norvegicus
atgtcattttaaaata

SEQ ID NO: 482360 - DNA, 16 bp, R. norvegicus
atgtcatttttgttgt

SEQ ID NO: 482361 - DNA, 16 bp, R. norvegicus
atgtcattttttaaaa

SEQ ID NO: 482362 - DNA, 16 bp, R. norvegicus
atgtccaaatttctga

SEQ ID NO: 482363 - DNA, 16 bp, R. norvegicus
atgtccaggatcttct

SEQ ID NO: 482364 - DNA, 16 bp, R. norvegicus
atgtccatctgtctgt

SEQ ID NO: 482365 - DNA, 16 bp, R. norvegicus
atgtcccacattttct

SEQ ID NO: 482366 - DNA, 16 bp, R. norvegicus
atgtcccaggctggcc

SEQ ID NO: 482367 - DNA, 16 bp, R. norvegicus
atgtccccaacccacc

SEQ ID NO: 482368 - DNA, 16 bp, R. norvegicus
atgtccccacccccac

SEQ ID NO: 482369 - DNA, 16 bp, R. norvegicus
atgtccccacccccca

SEQ ID NO: 482370 - DNA, 16 bp, R. norvegicus
atgtccccatccctcc

SEQ ID NO: 482371 - DNA, 16 bp, R. norvegicus
atgtcccccacagtct

SEQ ID NO: 482372 - DNA, 16 bp, R. norvegicus
atgtccctggaagact

SEQ ID NO: 482373 - DNA, 16 bp, R. norvegicus
atgtcccttctgccag

SEQ ID NO: 482374 - DNA, 16 bp, R. norvegicus
atgtcctcatcttcat

SEQ ID NO: 482375 - DNA, 16 bp, R. norvegicus
atgtcctccacaggct

SEQ ID NO: 482376 - DNA, 16 bp, R. norvegicus
atgtcctccagcatca

SEQ ID NO: 482377 - DNA, 16 bp, R. norvegicus
atgtcctctgacctcc

SEQ ID NO: 482378 - DNA, 16 bp, R. norvegicus
atgtccttcaacacag

SEQ ID NO: 482379 - DNA, 16 bp, R. norvegicus
atgtccttgaacagag

SEQ ID NO: 482380 - DNA, 16 bp, R. norvegicus
atgtctacacaatgga

SEQ ID NO: 482381 - DNA, 16 bp, R. norvegicus
atgtctatgctcagtg

SEQ ID NO: 482382 - DNA, 16 bp, R. norvegicus
atgtctcaacaaaaga

SEQ ID NO: 482383 - DNA, 16 bp, R. norvegicus
atgtctccagcccctg

SEQ ID NO: 482384 - DNA, 16 bp, R. norvegicus
atgtctcctgagagcc

SEQ ID NO: 482385 - DNA, 16 bp, R. norvegicus
atgtctcctgagcaaa

SEQ ID NO: 482386 - DNA, 16 bp, R. norvegicus
atgtctctcaacagaa

SEQ ID NO: 482387 - DNA, 16 bp, R. norvegicus
atgtctctcaacatca

SEQ ID NO: 482388 - DNA, 84 bp, R. norvegicus
atgtctcttttatatgttgaggcatcttttgggtatatgcccaagagaggtatagctggatcctcaggcagttcaatgtccaat

SEQ ID NO: 482389 - DNA, 16 bp, R. norvegicus
atgtctgaaaacagct

SEQ ID NO: 482390 - DNA, 16 bp, R. norvegicus
atgtctgcaatcccag

SEQ ID NO: 482391 - DNA, 16 bp, R. norvegicus
atgtctgcctggatac

SEQ ID NO: 482392 - DNA, 16 bp, R. norvegicus
atgtctgggcatagaa

SEQ ID NO: 482393 - DNA, 16 bp, R. norvegicus
atgtctggtgtgtgtg

SEQ ID NO: 482394 - DNA, 16 bp, R. norvegicus
atgtctgtatgtctgt

SEQ ID NO: 482395 - DNA, 16 bp, R. norvegicus
atgtctgtctgtgtgt

SEQ ID NO: 482396 - DNA, 16 bp, R. norvegicus
atgtctgtgtatctgt

SEQ ID NO: 482397 - DNA, 16 bp, R. norvegicus
atgtctgtgtgccatg

SEQ ID NO: 482398 - DNA, 16 bp, R. norvegicus
atgtctgtgtgtgttt

SEQ ID NO: 482399 - DNA, 16 bp, R. norvegicus
atgtctgttcatgtgt

SEQ ID NO: 482400 - DNA, 16 bp, R. norvegicus
atgtctgtttccatga

SEQ ID NO: 482401 - DNA, 16 bp, R. norvegicus
atgtctgtttttgtgc

SEQ ID NO: 482402 - DNA, 16 bp, R. norvegicus
atgtcttcctcctcct

SEQ ID NO: 482403 - DNA, 16 bp, R. norvegicus
atgtctttaagaacat

SEQ ID NO: 482404 - DNA, 16 bp, R. norvegicus
atgtctttccatcttc

SEQ ID NO: 482405 - DNA, 16 bp, R. norvegicus
atgtctttctcaaagt

SEQ ID NO: 482406 - DNA, 16 bp, R. norvegicus
atgtctttcttcagag

SEQ ID NO: 482407 - DNA, 16 bp, R. norvegicus
atgtctttgtgtgtat

SEQ ID NO: 482408 - DNA, 16 bp, R. norvegicus
atgtctttgttttatg

SEQ ID NO: 482409 - DNA, 16 bp, R. norvegicus
atgtgaaaaacaaagt

SEQ ID NO: 482410 - DNA, 16 bp, R. norvegicus
atgtgaaaataaatgt

SEQ ID NO: 482411 - DNA, 16 bp, R. norvegicus
atgtgaaaattatttt

SEQ ID NO: 482412 - DNA, 16 bp, R. norvegicus
atgtgaagatatttgt

SEQ ID NO: 482413 - DNA, 16 bp, R. norvegicus
atgtgaagtcagagga

SEQ ID NO: 482414 - DNA, 16 bp, R. norvegicus
atgtgaatgcatgtgt

SEQ ID NO: 482415 - DNA, 16 bp, R. norvegicus
atgtgacagaggatgg

SEQ ID NO: 482416 - DNA, 16 bp, R. norvegicus
atgtgaccacaggtca

SEQ ID NO: 482417 - DNA, 16 bp, R. norvegicus
atgtgaccagctacct

SEQ ID NO: 482418 - DNA, 18 bp, R. norvegicus
atgtgacgggaggaattt

SEQ ID NO: 482419 - DNA, 16 bp, R. norvegicus
atgtgactcctgtgaa

SEQ ID NO: 482420 - DNA, 16 bp, R. norvegicus
atgtgactgtgtgtgt

SEQ ID NO: 482421 - DNA, 16 bp, R. norvegicus
atgtgacttcaccaga

SEQ ID NO: 482422 - DNA, 16 bp, R. norvegicus
atgtgagagagagaga

SEQ ID NO: 482423 - DNA, 16 bp, R. norvegicus
atgtgagcagaggcag

SEQ ID NO: 482424 - DNA, 16 bp, R. norvegicus
atgtgagcatgcatgt

SEQ ID NO: 482425 - DNA, 16 bp, R. norvegicus
atgtgagggcagggag

SEQ ID NO: 482426 - DNA, 18 bp, R. norvegicus
atgtgaggtggaatctca

SEQ ID NO: 482427 - DNA, 16 bp, R. norvegicus
atgtgagtgtgcatat

SEQ ID NO: 482428 - DNA, 16 bp, R. norvegicus
atgtgatacacagaca

SEQ ID NO: 482429 - DNA, 16 bp, R. norvegicus
atgtgatacagaccct

SEQ ID NO: 482430 - DNA, 16 bp, R. norvegicus
atgtgatattttcttt

SEQ ID NO: 482431 - DNA, 16 bp, R. norvegicus
atgtgatgcacagaca

SEQ ID NO: 482432 - DNA, 16 bp, R. norvegicus
atgtgatgtgtgtatg

SEQ ID NO: 482433 - DNA, 16 bp, R. norvegicus
atgtgatgtttgtctt

SEQ ID NO: 482434 - DNA, 16 bp, R. norvegicus
atgtgatgttttcctg

SEQ ID NO: 482435 - DNA, 16 bp, R. norvegicus
atgtgattgaggctct

SEQ ID NO: 482436 - DNA, 16 bp, R. norvegicus
atgtgcaaatgtgtgt

SEQ ID NO: 482437 - DNA, 16 bp, R. norvegicus
atgtgcaaggctctgg

SEQ ID NO: 482438 - DNA, 16 bp, R. norvegicus
atgtgcacaccacaca

SEQ ID NO: 482439 - DNA, 16 bp, R. norvegicus
atgtgcacatagacac

SEQ ID NO: 482440 - DNA, 16 bp, R. norvegicus
atgtgcacatgagtac

SEQ ID NO: 482441 - DNA, 16 bp, R. norvegicus
atgtgcacctgcacat

SEQ ID NO: 482442 - DNA, 16 bp, R. norvegicus
atgtgcactggagaaa

SEQ ID NO: 482443 - DNA, 16 bp, R. norvegicus
atgtgcatgtgaactt

SEQ ID NO: 482444 - DNA, 16 bp, R. norvegicus
atgtgccaccaccact

SEQ ID NO: 482445 - DNA, 16 bp, R. norvegicus
atgtgcctgtgcctgt

SEQ ID NO: 482446 - DNA, 16 bp, R. norvegicus
atgtgctcactggctt

SEQ ID NO: 482447 - DNA, 16 bp, R. norvegicus
atgtgctcatgtgtgc

SEQ ID NO: 482448 - DNA, 16 bp, R. norvegicus
atgtgctctctctctc

SEQ ID NO: 482449 - DNA, 16 bp, R. norvegicus
atgtgctgtcacctga

SEQ ID NO: 482450 - DNA, 16 bp, R. norvegicus
atgtgcttgtgtgcac

SEQ ID NO: 482451 - DNA, 16 bp, R. norvegicus
atgtggaaaaagagga

SEQ ID NO: 482452 - DNA, 16 bp, R. norvegicus
atgtggaagaagagaa

SEQ ID NO: 482453 - DNA, 16 bp, R. norvegicus
atgtggaagaagagga

SEQ ID NO: 482454 - DNA, 16 bp, R. norvegicus
atgtggaagctgaaca

SEQ ID NO: 482455 - DNA, 16 bp, R. norvegicus
atgtggaagggtccag

SEQ ID NO: 482456 - DNA, 16 bp, R. norvegicus
atgtggaagtcagaga

SEQ ID NO: 482457 - DNA, 16 bp, R. norvegicus
atgtggaagttcttga

SEQ ID NO: 482458 - DNA, 16 bp, R. norvegicus
atgtggacactgggaa

SEQ ID NO: 482459 - DNA, 16 bp, R. norvegicus
atgtggacagggcttt

SEQ ID NO: 482460 - DNA, 16 bp, R. norvegicus
atgtggacatccagtt

SEQ ID NO: 482461 - DNA, 16 bp, R. norvegicus
atgtggagaaagagca

SEQ ID NO: 482462 - DNA, 16 bp, R. norvegicus
atgtggagaaagggga

SEQ ID NO: 482463 - DNA, 16 bp, R. norvegicus
atgtggagaaattgga

SEQ ID NO: 482464 - DNA, 16 bp, R. norvegicus
atgtggagaaggagga

SEQ ID NO: 482465 - DNA, 16 bp, R. norvegicus
atgtggagatagagga

SEQ ID NO: 482466 - DNA, 16 bp, R. norvegicus
atgtggagggcagagg

SEQ ID NO: 482467 - DNA, 16 bp, R. norvegicus
atgtggaggtcctgga

SEQ ID NO: 482468 - DNA, 16 bp, R. norvegicus
atgtggatgatgggaa

SEQ ID NO: 482469 - DNA, 16 bp, R. norvegicus
atgtggatgctggcaa

SEQ ID NO: 482470 - DNA, 16 bp, R. norvegicus
atgtggatgctttact

SEQ ID NO: 482471 - DNA, 16 bp, R. norvegicus
atgtggatttatgtct

SEQ ID NO: 482472 - DNA, 16 bp, R. norvegicus
atgtggctcaggctgg

SEQ ID NO: 482473 - DNA, 16 bp, R. norvegicus
atgtggctgctggaaa

SEQ ID NO: 482474 - DNA, 16 bp, R. norvegicus
atgtggctgctgggaa

SEQ ID NO: 482475 - DNA, 16 bp, R. norvegicus
atgtgggactggagag

SEQ ID NO: 482476 - DNA, 16 bp, R. norvegicus
atgtgggaggctgagg

SEQ ID NO: 482477 - DNA, 16 bp, R. norvegicus
atgtgggcaaagagta

SEQ ID NO: 482478 - DNA, 16 bp, R. norvegicus
atgtgggcactgggga

SEQ ID NO: 482479 - DNA, 16 bp, R. norvegicus
atgtgggctctgggga

SEQ ID NO: 482480 - DNA, 16 bp, R. norvegicus
atgtggggctggggat

SEQ ID NO: 482481 - DNA, 16 bp, R. norvegicus
atgtgggggctgggaa

SEQ ID NO: 482482 - DNA, 16 bp, R. norvegicus
atgtgggtatgtgtgt

SEQ ID NO: 482483 - DNA, 16 bp, R. norvegicus
atgtgggtcagactct

SEQ ID NO: 482484 - DNA, 16 bp, R. norvegicus
atgtggtctgtgaact

SEQ ID NO: 482485 - DNA, 16 bp, R. norvegicus
atgtggtgcatgtaca

SEQ ID NO: 482486 - DNA, 16 bp, R. norvegicus
atgtggtgtgtatgta

SEQ ID NO: 482487 - DNA, 16 bp, R. norvegicus
atgtggttattctttt

SEQ ID NO: 482488 - DNA, 16 bp, R. norvegicus
atgtggtttctgggga

SEQ ID NO: 482489 - DNA, 16 bp, R. norvegicus
atgtgtaaatgtgtat

SEQ ID NO: 482490 - DNA, 16 bp, R. norvegicus
atgtgtaagtgtgtgt

SEQ ID NO: 482491 - DNA, 16 bp, R. norvegicus
atgtgtacaacaatgc

SEQ ID NO: 482492 - DNA, 16 bp, R. norvegicus
atgtgtacatgtgggt

SEQ ID NO: 482493 - DNA, 16 bp, R. norvegicus
atgtgtacctggtacc

SEQ ID NO: 482494 - DNA, 16 bp, R. norvegicus
atgtgtactggctggt

SEQ ID NO: 482495 - DNA, 16 bp, R. norvegicus
atgtgtatacatgtct

SEQ ID NO: 482496 - DNA, 16 bp, R. norvegicus
atgtgtatatatatat

SEQ ID NO: 482497 - DNA, 16 bp, R. norvegicus
atgtgtatatatgcat

SEQ ID NO: 482498 - DNA, 16 bp, R. norvegicus
atgtgtatatgaatat

SEQ ID NO: 482499 - DNA, 16 bp, R. norvegicus
atgtgtatatgtatat

SEQ ID NO: 482500 - DNA, 16 bp, R. norvegicus
atgtgtatgatatatg

SEQ ID NO: 482501 - DNA, 16 bp, R. norvegicus
atgtgtatgtatttat

SEQ ID NO: 482502 - DNA, 16 bp, R. norvegicus
atgtgtatgtgagttt

SEQ ID NO: 482503 - DNA, 16 bp, R. norvegicus
atgtgtatgtgggctt

SEQ ID NO: 482504 - DNA, 16 bp, R. norvegicus
atgtgtatgtgtatat

SEQ ID NO: 482505 - DNA, 16 bp, R. norvegicus
atgtgtatgtgtgtat

SEQ ID NO: 482506 - DNA, 16 bp, R. norvegicus
atgtgtatgtttgcat

SEQ ID NO: 482507 - DNA, 16 bp, R. norvegicus
atgtgtcctgtgtgtg

SEQ ID NO: 482508 - DNA, 16 bp, R. norvegicus
atgtgtctatgcatgt

SEQ ID NO: 482509 - DNA, 16 bp, R. norvegicus
atgtgtctgaaaacag

SEQ ID NO: 482510 - DNA, 16 bp, R. norvegicus
atgtgtctgggtgttt

SEQ ID NO: 482511 - DNA, 16 bp, R. norvegicus
atgtgtctgtctctgt

SEQ ID NO: 482512 - DNA, 16 bp, R. norvegicus
atgtgtctgtggtgtg

SEQ ID NO: 482513 - DNA, 16 bp, R. norvegicus
atgtgtctgtgtatga

SEQ ID NO: 482514 - DNA, 16 bp, R. norvegicus
atgtgtgaatacacac

SEQ ID NO: 482515 - DNA, 16 bp, R. norvegicus
atgtgtgaggccctga

SEQ ID NO: 482516 - DNA, 16 bp, R. norvegicus
atgtgtgaggtcctgg

SEQ ID NO: 482517 - DNA, 16 bp, R. norvegicus
atgtgtgaggtgtgtg

SEQ ID NO: 482518 - DNA, 16 bp, R. norvegicus
atgtgtgatgtgtgtg

SEQ ID NO: 482519 - DNA, 16 bp, R. norvegicus
atgtgtgcaagtgtgt

SEQ ID NO: 482520 - DNA, 16 bp, R. norvegicus
atgtgtgcacacactc

SEQ ID NO: 482521 - DNA, 16 bp, R. norvegicus
atgtgtgcacaggtat

SEQ ID NO: 482522 - DNA, 16 bp, R. norvegicus
atgtgtgcacatttgt

SEQ ID NO: 482523 - DNA, 16 bp, R. norvegicus
atgtgtgcacttgtgt

SEQ ID NO: 482524 - DNA, 16 bp, R. norvegicus
atgtgtgcagagagca

SEQ ID NO: 482525 - DNA, 16 bp, R. norvegicus
atgtgtgcagtgtatg

SEQ ID NO: 482526 - DNA, 16 bp, R. norvegicus
atgtgtgcatacacat

SEQ ID NO: 482527 - DNA, 16 bp, R. norvegicus
atgtgtgcatgagtgt

SEQ ID NO: 482528 - DNA, 16 bp, R. norvegicus
atgtgtgcatgcacac

SEQ ID NO: 482529 - DNA, 16 bp, R. norvegicus
atgtgtgcatggtgtg

SEQ ID NO: 482530 - DNA, 16 bp, R. norvegicus
atgtgtgcatgtgtgt

SEQ ID NO: 482531 - DNA, 16 bp, R. norvegicus
atgtgtgcctggtgcc

SEQ ID NO: 482532 - DNA, 16 bp, R. norvegicus
atgtgtggacagaggg

SEQ ID NO: 482533 - DNA, 16 bp, R. norvegicus
atgtgtggctcagtgc

SEQ ID NO: 482534 - DNA, 16 bp, R. norvegicus
atgtgtgtatatatat

SEQ ID NO: 482535 - DNA, 16 bp, R. norvegicus
atgtgtgtatatgtat

SEQ ID NO: 482536 - DNA, 16 bp, R. norvegicus
atgtgtgtatatgtgt

SEQ ID NO: 482537 - DNA, 16 bp, R. norvegicus
atgtgtgtatgaatgt

SEQ ID NO: 482538 - DNA, 16 bp, R. norvegicus
atgtgtgtatgtgtgt

SEQ ID NO: 482539 - DNA, 16 bp, R. norvegicus
atgtgtgtcctgtgtg

SEQ ID NO: 482540 - DNA, 16 bp, R. norvegicus
atgtgtgtctgtctgt

SEQ ID NO: 482541 - DNA, 16 bp, R. norvegicus
atgtgtgtgaacacac

SEQ ID NO: 482542 - DNA, 16 bp, R. norvegicus
atgtgtgtgactgtgt

SEQ ID NO: 482543 - DNA, 16 bp, R. norvegicus
atgtgtgtgagagcat

SEQ ID NO: 482544 - DNA, 16 bp, R. norvegicus
atgtgtgtgcactgtg

SEQ ID NO: 482545 - DNA, 16 bp, R. norvegicus
atgtgtgtgcagtgtg

SEQ ID NO: 482546 - DNA, 16 bp, R. norvegicus
atgtgtgtgtacatgt

SEQ ID NO: 482547 - DNA, 16 bp, R. norvegicus
atgtgtgtgtccatgt

SEQ ID NO: 482548 - DNA, 16 bp, R. norvegicus
atgtgtgtgtgtatgt

SEQ ID NO: 482549 - DNA, 16 bp, R. norvegicus
atgtgtgtgtgtctgt

SEQ ID NO: 482550 - DNA, 16 bp, R. norvegicus
atgtgtgtgtgtgtgc

SEQ ID NO: 482551 - DNA, 16 bp, R. norvegicus
atgtgtgttcagagag

SEQ ID NO: 482552 - DNA, 16 bp, R. norvegicus
atgtgtgtttctggca

SEQ ID NO: 482553 - DNA, 16 bp, R. norvegicus
atgtgttcaagattct

SEQ ID NO: 482554 - DNA, 16 bp, R. norvegicus
atgtgttcagtgcaga

SEQ ID NO: 482555 - DNA, 16 bp, R. norvegicus
atgtgttccaggttct

SEQ ID NO: 482556 - DNA, 16 bp, R. norvegicus
atgtgttcctgtgtgt

SEQ ID NO: 482557 - DNA, 16 bp, R. norvegicus
atgtgttctgtggatt

SEQ ID NO: 482558 - DNA, 16 bp, R. norvegicus
atgtgttctttattga

SEQ ID NO: 482559 - DNA, 16 bp, R. norvegicus
atgtgttttaaaataa

SEQ ID NO: 482560 - DNA, 18 bp, R. norvegicus
atgttaaaaaatcaagct

SEQ ID NO: 482561 - DNA, 16 bp, R. norvegicus
atgttaaaaggcttgg

SEQ ID NO: 482562 - DNA, 16 bp, R. norvegicus
atgttacaatgttaca

SEQ ID NO: 482563 - DNA, 16 bp, R. norvegicus
atgttacctactggct

SEQ ID NO: 482564 - DNA, 16 bp, R. norvegicus
atgttatcccttttcc

SEQ ID NO: 482565 - DNA, 16 bp, R. norvegicus
atgttatggtgacccc

SEQ ID NO: 482566 - DNA, 16 bp, R. norvegicus
atgttcaaagtcctca

SEQ ID NO: 482567 - DNA, 16 bp, R. norvegicus
atgttcaacaaaactg

SEQ ID NO: 482568 - DNA, 16 bp, R. norvegicus
atgttcaactaaaagt

SEQ ID NO: 482569 - DNA, 16 bp, R. norvegicus
atgttcaatgaattgt

SEQ ID NO: 482570 - DNA, 16 bp, R. norvegicus
atgttcacacatctgt

SEQ ID NO: 482571 - DNA, 16 bp, R. norvegicus
atgttcatatgttcat

SEQ ID NO: 482572 - DNA, 16 bp, R. norvegicus
atgttcatcaaagaaa

SEQ ID NO: 482573 - DNA, 16 bp, R. norvegicus
atgttcatggacatct

SEQ ID NO: 482574 - DNA, 16 bp, R. norvegicus
atgttcatttttacta

SEQ ID NO: 482575 - DNA, 16 bp, R. norvegicus
atgttccccacaggct

SEQ ID NO: 482576 - DNA, 16 bp, R. norvegicus
atgttccccaccatcc

SEQ ID NO: 482577 - DNA, 16 bp, R. norvegicus
atgttctccaggatcc

SEQ ID NO: 482578 - DNA, 16 bp, R. norvegicus
atgttctctcagctcc

SEQ ID NO: 482579 - DNA, 16 bp, R. norvegicus
atgttcttgtatctgt

SEQ ID NO: 482580 - DNA, 16 bp, R. norvegicus
atgttcttgttcttaa

SEQ ID NO: 482581 - DNA, 16 bp, R. norvegicus
atgttctttttaaaaa

SEQ ID NO: 482582 - DNA, 16 bp, R. norvegicus
atgttgaagtctctca

SEQ ID NO: 482583 - DNA, 19 bp, R. norvegicus
atgttgacctcaagttgaa

SEQ ID NO: 482584 - DNA, 16 bp, R. norvegicus
atgttgatgctgggaa

SEQ ID NO: 482585 - DNA, 16 bp, R. norvegicus
atgttgatggatttct

SEQ ID NO: 482586 - DNA, 16 bp, R. norvegicus
atgttgccctggaaac

SEQ ID NO: 482587 - DNA, 16 bp, R. norvegicus
atgttgcctggttggt

SEQ ID NO: 482588 - DNA, 16 bp, R. norvegicus
atgttggcaagaatgt

SEQ ID NO: 482589 - DNA, 16 bp, R. norvegicus
atgttggcattcttcc

SEQ ID NO: 482590 - DNA, 16 bp, R. norvegicus
atgttggccctgaaac

SEQ ID NO: 482591 - DNA, 16 bp, R. norvegicus
atgttggggctggaga

SEQ ID NO: 482592 - DNA, 16 bp, R. norvegicus
atgttggtaaggatgt

SEQ ID NO: 482593 - DNA, 16 bp, R. norvegicus
atgttggtcatccttc

SEQ ID NO: 482594 - DNA, 16 bp, R. norvegicus
atgttggtgctgggaa

SEQ ID NO: 482595 - DNA, 16 bp, R. norvegicus
atgttgtcctggaaac

SEQ ID NO: 482596 - DNA, 16 bp, R. norvegicus
atgttgtctgtctgtc

SEQ ID NO: 482597 - DNA, 16 bp, R. norvegicus
atgttgtggtgatccc

SEQ ID NO: 482598 - DNA, 16 bp, R. norvegicus
atgttgtggtgatgcc

SEQ ID NO: 482599 - DNA, 16 bp, R. norvegicus
atgttgttaaaggcaa

SEQ ID NO: 482600 - DNA, 16 bp, R. norvegicus
atgttgttatctcttt

SEQ ID NO: 482601 - DNA, 16 bp, R. norvegicus
atgtttacatgcatgt

SEQ ID NO: 482602 - DNA, 16 bp, R. norvegicus
atgtttactgggagaa

SEQ ID NO: 482603 - DNA, 16 bp, R. norvegicus
atgtttataaaggaaa

SEQ ID NO: 482604 - DNA, 16 bp, R. norvegicus
atgtttatgtttatga

SEQ ID NO: 482605 - DNA, 16 bp, R. norvegicus
atgtttcagtttgttt

SEQ ID NO: 482606 - DNA, 16 bp, R. norvegicus
atgtttcccgccatga

SEQ ID NO: 482607 - DNA, 16 bp, R. norvegicus
atgtttcttctgccca

SEQ ID NO: 482608 - DNA, 16 bp, R. norvegicus
atgtttgaaaatgaca

SEQ ID NO: 482609 - DNA, 16 bp, R. norvegicus
atgtttgagatgccag

SEQ ID NO: 482610 - DNA, 16 bp, R. norvegicus
atgtttgcacagcaag

SEQ ID NO: 482611 - DNA, 16 bp, R. norvegicus
atgtttggaattctgg

SEQ ID NO: 482612 - DNA, 16 bp, R. norvegicus
atgtttgtctttctgt

SEQ ID NO: 482613 - DNA, 16 bp, R. norvegicus
atgtttgtgggcatct

SEQ ID NO: 482614 - DNA, 16 bp, R. norvegicus
atgtttgtgtatacat

SEQ ID NO: 482615 - DNA, 16 bp, R. norvegicus
atgtttgtgtctgtgt

SEQ ID NO: 482616 - DNA, 16 bp, R. norvegicus
atgtttgtgtgacttt

SEQ ID NO: 482617 - DNA, 16 bp, R. norvegicus
atgtttgtgtgtgtgc

SEQ ID NO: 482618 - DNA, 16 bp, R. norvegicus
atgtttgtgtgtttct

SEQ ID NO: 482619 - DNA, 16 bp, R. norvegicus
atgttttatttattca

SEQ ID NO: 482620 - DNA, 16 bp, R. norvegicus
atgttttcaaatattt

SEQ ID NO: 482621 - DNA, 16 bp, R. norvegicus
atgttttcaatatttt

SEQ ID NO: 482622 - DNA, 16 bp, R. norvegicus
atgttttccatctcca

SEQ ID NO: 482623 - DNA, 16 bp, R. norvegicus
atgttttcctggaagc

SEQ ID NO: 482624 - DNA, 16 bp, R. norvegicus
atgttttcctttatga

SEQ ID NO: 482625 - DNA, 16 bp, R. norvegicus
atgttttctaaaatgt

SEQ ID NO: 482626 - DNA, 16 bp, R. norvegicus
atgttttctgagcctt

SEQ ID NO: 482627 - DNA, 16 bp, R. norvegicus
atgttttcttctaaaa

SEQ ID NO: 482628 - DNA, 16 bp, R. norvegicus
atgttttgcccggaac

SEQ ID NO: 482629 - DNA, 16 bp, R. norvegicus
atgttttgcctgtgtg

SEQ ID NO: 482630 - DNA, 16 bp, R. norvegicus
atgttttgtgaaggaa

SEQ ID NO: 482631 - DNA, 16 bp, R. norvegicus
atgtttttcttaataa

SEQ ID NO: 482632 - DNA, 16 bp, R. norvegicus
attaaaaaatggggtc

SEQ ID NO: 482633 - DNA, 16 bp, R. norvegicus
attaaaaaatgggttt

SEQ ID NO: 482634 - DNA, 16 bp, R. norvegicus
attaaaaaccaagaca

SEQ ID NO: 482635 - DNA, 16 bp, R. norvegicus
attaaaaacccagaaa

SEQ ID NO: 482636 - DNA, 16 bp, R. norvegicus
attaaaaactgaaaat

SEQ ID NO: 482637 - DNA, 16 bp, R. norvegicus
attaaaaagaatgact

SEQ ID NO: 482638 - DNA, 16 bp, R. norvegicus
attaaaaagatcatca

SEQ ID NO: 482639 - DNA, 16 bp, R. norvegicus
attaaaaataaaactg

SEQ ID NO: 482640 - DNA, 16 bp, R. norvegicus
attaaaaatgacaact

SEQ ID NO: 482641 - DNA, 16 bp, R. norvegicus
attaaaaatgtggtac

SEQ ID NO: 482642 - DNA, 16 bp, R. norvegicus
attaaaacagaaaatg

SEQ ID NO: 482643 - DNA, 16 bp, R. norvegicus
attaaaactattttga

SEQ ID NO: 482644 - DNA, 16 bp, R. norvegicus
attaaaactttagaaa

SEQ ID NO: 482645 - DNA, 16 bp, R. norvegicus
attaaaagtcacccaa

SEQ ID NO: 482646 - DNA, 16 bp, R. norvegicus
attaaaagtccaaatg

SEQ ID NO: 482647 - DNA, 16 bp, R. norvegicus
attaaaagtgtgtgct

SEQ ID NO: 482648 - DNA, 16 bp, R. norvegicus
attaaaataaaacatg

SEQ ID NO: 482649 - DNA, 16 bp, R. norvegicus
attaaaatggaaacat

SEQ ID NO: 482650 - DNA, 16 bp, R. norvegicus
attaaaattgaggttt

SEQ ID NO: 482651 - DNA, 16 bp, R. norvegicus
attaaacaaaaccatc

SEQ ID NO: 482652 - DNA, 16 bp, R. norvegicus
attaaacaacaaaagg

SEQ ID NO: 482653 - DNA, 16 bp, R. norvegicus
attaaacagagacatg

SEQ ID NO: 482654 - DNA, 16 bp, R. norvegicus
attaaacaggtaaagg

SEQ ID NO: 482655 - DNA, 16 bp, R. norvegicus
attaaacccatctgga

SEQ ID NO: 482656 - DNA, 16 bp, R. norvegicus
attaaagaagctgaag

SEQ ID NO: 482657 - DNA, 16 bp, R. norvegicus
attaaagaattacagg

SEQ ID NO: 482658 - DNA, 16 bp, R. norvegicus
attaaagacattttag

SEQ ID NO: 482659 - DNA, 16 bp, R. norvegicus
attaaagaggaaacaa

SEQ ID NO: 482660 - DNA, 16 bp, R. norvegicus
attaaaggcatgcact

SEQ ID NO: 482661 - DNA, 16 bp, R. norvegicus
attaaaggtgtgccca

SEQ ID NO: 482662 - DNA, 16 bp, R. norvegicus
attaaagtcatgtgtc

SEQ ID NO: 482663 - DNA, 16 bp, R. norvegicus
attaaatgttgtcctt

SEQ ID NO: 482664 - DNA, 16 bp, R. norvegicus
attaaattctcacaaa

SEQ ID NO: 482665 - DNA, 16 bp, R. norvegicus
attaaattgtaagaag

SEQ ID NO: 482666 - DNA, 16 bp, R. norvegicus
attaacaaactggaca

SEQ ID NO: 482667 - DNA, 16 bp, R. norvegicus
attaacaatgtgacca

SEQ ID NO: 482668 - DNA, 16 bp, R. norvegicus
attaacacacctggga

SEQ ID NO: 482669 - DNA, 16 bp, R. norvegicus
attaacatataaatct

SEQ ID NO: 482670 - DNA, 16 bp, R. norvegicus
attaagaaaaatgttt

SEQ ID NO: 482671 - DNA, 16 bp, R. norvegicus
attaagaaaatgctct

SEQ ID NO: 482672 - DNA, 16 bp, R. norvegicus
attaagaaaatgtcct

SEQ ID NO: 482673 - DNA, 16 bp, R. norvegicus
attaagaagattgaga

SEQ ID NO: 482674 - DNA, 16 bp, R. norvegicus
attaagaatgaagaca

SEQ ID NO: 482675 - DNA, 46 bp, R. norvegicus
attaaggaaacaacaaggttctgtggggaagccagtatgaaaatcc

SEQ ID NO: 482676 - DNA, 16 bp, R. norvegicus
attaatatatgctaat

SEQ ID NO: 482677 - DNA, 16 bp, R. norvegicus
attaatatgaaaatgt

SEQ ID NO: 482678 - DNA, 16 bp, R. norvegicus
attaatatgctatatt

SEQ ID NO: 482679 - DNA, 16 bp, R. norvegicus
attaatattttcctgt

SEQ ID NO: 482680 - DNA, 16 bp, R. norvegicus
attaatgaattaatga

SEQ ID NO: 482681 - DNA, 16 bp, R. norvegicus
attaatgcacagatgc

SEQ ID NO: 482682 - DNA, 16 bp, R. norvegicus
attaatgcatctctca

SEQ ID NO: 482683 - DNA, 16 bp, R. norvegicus
attaatggagagaaac

SEQ ID NO: 482684 - DNA, 16 bp, R. norvegicus
attaatgggaaaaata

SEQ ID NO: 482685 - DNA, 16 bp, R. norvegicus
attaattaaggaaatg

SEQ ID NO: 482686 - DNA, 16 bp, R. norvegicus
attacaaatgtttcag

SEQ ID NO: 482687 - DNA, 16 bp, R. norvegicus
attacacctgtgagtt

SEQ ID NO: 482688 - DNA, 16 bp, R. norvegicus
attacagacggttgtg

SEQ ID NO: 482689 - DNA, 16 bp, R. norvegicus
attacagaggtgaatg

SEQ ID NO: 482690 - DNA, 16 bp, R. norvegicus
attacaggtgattgtg

SEQ ID NO: 482691 - DNA, 16 bp, R. norvegicus
attacatatgagtaca

SEQ ID NO: 482692 - DNA, 16 bp, R. norvegicus
attacatttataccta

SEQ ID NO: 482693 - DNA, 16 bp, R. norvegicus
attacatttatttgta

SEQ ID NO: 482694 - DNA, 16 bp, R. norvegicus
attaccctagatgccc

SEQ ID NO: 482695 - DNA, 16 bp, R. norvegicus
attacctgaaaggaaa

SEQ ID NO: 482696 - DNA, 16 bp, R. norvegicus
attacctttccaggtt

SEQ ID NO: 482697 - DNA, 16 bp, R. norvegicus
attactaccactacta

SEQ ID NO: 482698 - DNA, 17 bp, R. norvegicus
attactcacctatcaaa

SEQ ID NO: 482699 - DNA, 16 bp, R. norvegicus
attactgatgtcaaga

SEQ ID NO: 482700 - DNA, 16 bp, R. norvegicus
attactgtgagtttga

SEQ ID NO: 482701 - DNA, 16 bp, R. norvegicus
attactgtgtgtggtg

SEQ ID NO: 482702 - DNA, 16 bp, R. norvegicus
attacttcatgaaatt

SEQ ID NO: 482703 - DNA, 16 bp, R. norvegicus
attactttcatgcttt

SEQ ID NO: 482704 - DNA, 16 bp, R. norvegicus
attactttcattgcta

SEQ ID NO: 482705 - DNA, 16 bp, R. norvegicus
attacttttatttatg

SEQ ID NO: 482706 - DNA, 16 bp, R. norvegicus
attacttttctcactg

SEQ ID NO: 482707 - DNA, 16 bp, R. norvegicus
attagaaaagcagttg

SEQ ID NO: 482708 - DNA, 16 bp, R. norvegicus
attagaaatatgtaat

SEQ ID NO: 482709 - DNA, 16 bp, R. norvegicus
attagaatggatactc

SEQ ID NO: 482710 - DNA, 16 bp, R. norvegicus
attagagaaaagattg

SEQ ID NO: 482711 - DNA, 16 bp, R. norvegicus
attagagaaatacaaa

SEQ ID NO: 482712 - DNA, 16 bp, R. norvegicus
attagatattaaatgt

SEQ ID NO: 482713 - DNA, 16 bp, R. norvegicus
attagatgctgaaaag

SEQ ID NO: 482714 - DNA, 16 bp, R. norvegicus
attagatgctgggaaa

SEQ ID NO: 482715 - DNA, 16 bp, R. norvegicus
attagccaaaaacaaa

SEQ ID NO: 482716 - DNA, 16 bp, R. norvegicus
attagccaaaaagtat

SEQ ID NO: 482717 - DNA, 16 bp, R. norvegicus
attagcccagaagctc

SEQ ID NO: 482718 - DNA, 16 bp, R. norvegicus
attaggaaaagttctt

SEQ ID NO: 482719 - DNA, 16 bp, R. norvegicus
attaggaagatggaga

SEQ ID NO: 482720 - DNA, 16 bp, R. norvegicus
attaggagctgtggcc

SEQ ID NO: 482721 - DNA, 16 bp, R. norvegicus
attaggctcatcctct

SEQ ID NO: 482722 - DNA, 16 bp, R. norvegicus
attaggtgcatcctct

SEQ ID NO: 482723 - DNA, 16 bp, R. norvegicus
attagttataaagtag

SEQ ID NO: 482724 - DNA, 16 bp, R. norvegicus
attataaatgaggctg

SEQ ID NO: 482725 - DNA, 16 bp, R. norvegicus
attataatgtaagtat

SEQ ID NO: 482726 - DNA, 16 bp, R. norvegicus
attatacaagaaaact

SEQ ID NO: 482727 - DNA, 16 bp, R. norvegicus
attatacataataatg

SEQ ID NO: 482728 - DNA, 16 bp, R. norvegicus
attatagatttaaaag

SEQ ID NO: 482729 - DNA, 16 bp, R. norvegicus
attatatacacatgta

SEQ ID NO: 482730 - DNA, 16 bp, R. norvegicus
attatatacccagcca

SEQ ID NO: 482731 - DNA, 16 bp, R. norvegicus
attatcatcaaagcag

SEQ ID NO: 482732 - DNA, 16 bp, R. norvegicus
attatcatgtgttttt

SEQ ID NO: 482733 - DNA, 16 bp, R. norvegicus
attatcattaggtttg

SEQ ID NO: 482734 - DNA, 16 bp, R. norvegicus
attatgaaaacagaaa

SEQ ID NO: 482735 - DNA, 16 bp, R. norvegicus
attatgaagaaagctg

SEQ ID NO: 482736 - DNA, 16 bp, R. norvegicus
attatgaagagagatg

SEQ ID NO: 482737 - DNA, 16 bp, R. norvegicus
attatgctaaaggcca

SEQ ID NO: 482738 - DNA, 16 bp, R. norvegicus
attatgcttatgccta

SEQ ID NO: 482739 - DNA, 16 bp, R. norvegicus
attatgtgatgggaca

SEQ ID NO: 482740 - DNA, 16 bp, R. norvegicus
attatgtgtgtgcaca

SEQ ID NO: 482741 - DNA, 16 bp, R. norvegicus
attatgtgtgtgtgtg

SEQ ID NO: 482742 - DNA, 16 bp, R. norvegicus
attatgttcacagcag

SEQ ID NO: 482743 - DNA, 16 bp, R. norvegicus
attatgttgatgtatt

SEQ ID NO: 482744 - DNA, 16 bp, R. norvegicus
attatgttttcaaaaa

SEQ ID NO: 482745 - DNA, 16 bp, R. norvegicus
attattacaagattta

SEQ ID NO: 482746 - DNA, 16 bp, R. norvegicus
attattagtattagta

SEQ ID NO: 482747 - DNA, 16 bp, R. norvegicus
attattattcccattt

SEQ ID NO: 482748 - DNA, 16 bp, R. norvegicus
attattattgtcattg

SEQ ID NO: 482749 - DNA, 16 bp, R. norvegicus
attattcaagaaaatg

SEQ ID NO: 482750 - DNA, 16 bp, R. norvegicus
attattccttttcctg

SEQ ID NO: 482751 - DNA, 16 bp, R. norvegicus
attattctttggtttc

SEQ ID NO: 482752 - DNA, 32 bp, R. norvegicus
attattgctggcattattgctacgacagcagt

SEQ ID NO: 482753 - DNA, 16 bp, R. norvegicus
attattggattcaaca

SEQ ID NO: 482754 - DNA, 16 bp, R. norvegicus
attattgttcttcctg

SEQ ID NO: 482755 - DNA, 16 bp, R. norvegicus
attatttataaagtct

SEQ ID NO: 482756 - DNA, 16 bp, R. norvegicus
attatttcattttatg

SEQ ID NO: 482757 - DNA, 16 bp, R. norvegicus
attatttctatcatct

SEQ ID NO: 482758 - DNA, 16 bp, R. norvegicus
attatttgtgactatg

SEQ ID NO: 482759 - DNA, 16 bp, R. norvegicus
attcaaaaggaagaag

SEQ ID NO: 482760 - DNA, 16 bp, R. norvegicus
attcaaaatcattttt

SEQ ID NO: 482761 - DNA, 16 bp, R. norvegicus
attcaaacacaggagt

SEQ ID NO: 482762 - DNA, 16 bp, R. norvegicus
attcaaacatttgagc

SEQ ID NO: 482763 - DNA, 16 bp, R. norvegicus
attcaaaccaccacct

SEQ ID NO: 482764 - DNA, 16 bp, R. norvegicus
attcaaaccacctcag

SEQ ID NO: 482765 - DNA, 16 bp, R. norvegicus
attcaaaccataacag

SEQ ID NO: 482766 - DNA, 16 bp, R. norvegicus
attcaaaccatgacat

SEQ ID NO: 482767 - DNA, 16 bp, R. norvegicus
attcaaagaaaatgca

SEQ ID NO: 482768 - DNA, 16 bp, R. norvegicus
attcaaaggcagaaca

SEQ ID NO: 482769 - DNA, 16 bp, R. norvegicus
attcaaatcccagcaa

SEQ ID NO: 482770 - DNA, 16 bp, R. norvegicus
attcaaatgctaaata

SEQ ID NO: 482771 - DNA, 16 bp, R. norvegicus
attcaaattctcaaac

SEQ ID NO: 482772 - DNA, 16 bp, R. norvegicus
attcaacaatactgga

SEQ ID NO: 482773 - DNA, 16 bp, R. norvegicus
attcaacagaggaatg

SEQ ID NO: 482774 - DNA, 16 bp, R. norvegicus
attcaagaacaaattg

SEQ ID NO: 482775 - DNA, 16 bp, R. norvegicus
attcaagacctgaaaa

SEQ ID NO: 482776 - DNA, 16 bp, R. norvegicus
attcaatccccagcac

SEQ ID NO: 482777 - DNA, 16 bp, R. norvegicus
attcaatgataacctg

SEQ ID NO: 482778 - DNA, 16 bp, R. norvegicus
attcacacactggcgg

SEQ ID NO: 482779 - DNA, 16 bp, R. norvegicus
attcacacatactcac

SEQ ID NO: 482780 - DNA, 16 bp, R. norvegicus
attcacactggtgtga

SEQ ID NO: 482781 - DNA, 16 bp, R. norvegicus
attcacaggaaattca

SEQ ID NO: 482782 - DNA, 16 bp, R. norvegicus
attcacaggtgaggaa

SEQ ID NO: 482783 - DNA, 16 bp, R. norvegicus
attcacatatgcacac

SEQ ID NO: 482784 - DNA, 16 bp, R. norvegicus
attcacatttgatcat

SEQ ID NO: 482785 - DNA, 16 bp, R. norvegicus
attcaccactttgtct

SEQ ID NO: 482786 - DNA, 17 bp, R. norvegicus
attcacctctgtatttg

SEQ ID NO: 482787 - DNA, 16 bp, R. norvegicus
attcactggggcttca

SEQ ID NO: 482788 - DNA, 16 bp, R. norvegicus
attcagaaaacaaaat

SEQ ID NO: 482789 - DNA, 16 bp, R. norvegicus
attcagaaaatgaaaa

SEQ ID NO: 482790 - DNA, 16 bp, R. norvegicus
attcagaaagacaaat

SEQ ID NO: 482791 - DNA, 16 bp, R. norvegicus
attcagaacctgaccc

SEQ ID NO: 482792 - DNA, 16 bp, R. norvegicus
attcagagactgcctc

SEQ ID NO: 482793 - DNA, 16 bp, R. norvegicus
attcagagatctgtct

SEQ ID NO: 482794 - DNA, 16 bp, R. norvegicus
attcagagccctggat

SEQ ID NO: 482795 - DNA, 16 bp, R. norvegicus
attcagagcctgcctc

SEQ ID NO: 482796 - DNA, 16 bp, R. norvegicus
attcagatgaaattca

SEQ ID NO: 482797 - DNA, 16 bp, R. norvegicus
attcagcagctgcaga

SEQ ID NO: 482798 - DNA, 16 bp, R. norvegicus
attcagcaggaagtct

SEQ ID NO: 482799 - DNA, 16 bp, R. norvegicus
attcagccatcatcag

SEQ ID NO: 482800 - DNA, 16 bp, R. norvegicus
attcagccttcacagg

SEQ ID NO: 482801 - DNA, 16 bp, R. norvegicus
attcagctattaaaaa

SEQ ID NO: 482802 - DNA, 16 bp, R. norvegicus
attcagctgttaaaaa

SEQ ID NO: 482803 - DNA, 21 bp, R. norvegicus
attcaggagaatcaaacaaaa

SEQ ID NO: 482804 - DNA, 16 bp, R. norvegicus
attcaggaggcagggg

SEQ ID NO: 482805 - DNA, 16 bp, R. norvegicus
attcaggctggagaga

SEQ ID NO: 482806 - DNA, 16 bp, R. norvegicus
attcaggttgtcaggt

SEQ ID NO: 482807 - DNA, 16 bp, R. norvegicus
attcagtcaagttgac

SEQ ID NO: 482808 - DNA, 16 bp, R. norvegicus
attcagtccccagctc

SEQ ID NO: 482809 - DNA, 16 bp, R. norvegicus
attcagtgcagaattc

SEQ ID NO: 482810 - DNA, 16 bp, R. norvegicus
attcagttcccaggac

SEQ ID NO: 482811 - DNA, 16 bp, R. norvegicus
attcataaaagaaact

SEQ ID NO: 482812 - DNA, 16 bp, R. norvegicus
attcatacacataaat

SEQ ID NO: 482813 - DNA, 16 bp, R. norvegicus
attcatatacatacaa

SEQ ID NO: 482814 - DNA, 16 bp, R. norvegicus
attcatatatatacat

SEQ ID NO: 482815 - DNA, 16 bp, R. norvegicus
attcatcactttttct

SEQ ID NO: 482816 - DNA, 16 bp, R. norvegicus
attcatctggaattac

SEQ ID NO: 482817 - DNA, 16 bp, R. norvegicus
attcatctgtccatcc

SEQ ID NO: 482818 - DNA, 16 bp, R. norvegicus
attcatgatctctttt

SEQ ID NO: 482819 - DNA, 16 bp, R. norvegicus
attcatgcccaacaag

SEQ ID NO: 482820 - DNA, 16 bp, R. norvegicus
attcatggaagttgaa

SEQ ID NO: 482821 - DNA, 16 bp, R. norvegicus
attcatgggaggagat

SEQ ID NO: 482822 - DNA, 16 bp, R. norvegicus
attcattaaaagaaaa

SEQ ID NO: 482823 - DNA, 16 bp, R. norvegicus
attcattaagagaagt

SEQ ID NO: 482824 - DNA, 16 bp, R. norvegicus
attcattcattcatgt

SEQ ID NO: 482825 - DNA, 16 bp, R. norvegicus
attcattcctgtcttt

SEQ ID NO: 482826 - DNA, 16 bp, R. norvegicus
attcattgctctctgc

SEQ ID NO: 482827 - DNA, 17 bp, R. norvegicus
attcattgctgcctatg

SEQ ID NO: 482828 - DNA, 16 bp, R. norvegicus
attccaaacaaatttg

SEQ ID NO: 482829 - DNA, 16 bp, R. norvegicus
attccaagaacactgt

SEQ ID NO: 482830 - DNA, 16 bp, R. norvegicus
attccacaaaaataga

SEQ ID NO: 482831 - DNA, 16 bp, R. norvegicus
attccacctgacacca

SEQ ID NO: 482832 - DNA, 16 bp, R. norvegicus
attccacttcacatca

SEQ ID NO: 482833 - DNA, 16 bp, R. norvegicus
attccagaactcaaga

SEQ ID NO: 482834 - DNA, 16 bp, R. norvegicus
attccagcacccagga

SEQ ID NO: 482835 - DNA, 16 bp, R. norvegicus
attccagcactcagaa

SEQ ID NO: 482836 - DNA, 16 bp, R. norvegicus
attccagcatctggga

SEQ ID NO: 482837 - DNA, 16 bp, R. norvegicus
attccagccagaagga

SEQ ID NO: 482838 - DNA, 16 bp, R. norvegicus
attccaggacagccaa

SEQ ID NO: 482839 - DNA, 17 bp, R. norvegicus
attccaggacagccagg

SEQ ID NO: 482840 - DNA, 16 bp, R. norvegicus
attccaggccagcctg

SEQ ID NO: 482841 - DNA, 16 bp, R. norvegicus
attccagggatgcaag

SEQ ID NO: 482842 - DNA, 16 bp, R. norvegicus
attccaggtgaatttg

SEQ ID NO: 482843 - DNA, 17 bp, R. norvegicus
attccatctggcacagg

SEQ ID NO: 482844 - DNA, 16 bp, R. norvegicus
attccatgataaaaac

SEQ ID NO: 482845 - DNA, 16 bp, R. norvegicus
attccatggtggccca

SEQ ID NO: 482846 - DNA, 16 bp, R. norvegicus
attccattgatcatcc

SEQ ID NO: 482847 - DNA, 16 bp, R. norvegicus
attccattggagaaaa

SEQ ID NO: 482848 - DNA, 16 bp, R. norvegicus
attccattgtacaaat

SEQ ID NO: 482849 - DNA, 16 bp, R. norvegicus
attccatttatctacc

SEQ ID NO: 482850 - DNA, 16 bp, R. norvegicus
attcccagcatcccca

SEQ ID NO: 482851 - DNA, 16 bp, R. norvegicus
attcccagtacccaca

SEQ ID NO: 482852 - DNA, 16 bp, R. norvegicus
attccccacttcttct

SEQ ID NO: 482853 - DNA, 16 bp, R. norvegicus
attccccccaaagggg

SEQ ID NO: 482854 - DNA, 16 bp, R. norvegicus
attcccctattctggg

SEQ ID NO: 482855 - DNA, 16 bp, R. norvegicus
attcccctgcctcagc

SEQ ID NO: 482856 - DNA, 16 bp, R. norvegicus
attcccctgcctcagt

SEQ ID NO: 482857 - DNA, 32 bp, R. norvegicus
attccctcctttgtgccaatcccagtagaggc

SEQ ID NO: 482858 - DNA, 16 bp, R. norvegicus
attccctggaactggt

SEQ ID NO: 482859 - DNA, 16 bp, R. norvegicus
attccctggcactgga

SEQ ID NO: 482860 - DNA, 16 bp, R. norvegicus
attccctttcccagct

SEQ ID NO: 482861 - DNA, 16 bp, R. norvegicus
attccctttcccattt

SEQ ID NO: 482862 - DNA, 16 bp, R. norvegicus
attccctttcctgttt

SEQ ID NO: 482863 - DNA, 16 bp, R. norvegicus
attccgctgccccaag

SEQ ID NO: 482864 - DNA, 16 bp, R. norvegicus
attcctatgcatttta

SEQ ID NO: 482865 - DNA, 16 bp, R. norvegicus
attcctattcaaacca

SEQ ID NO: 482866 - DNA, 16 bp, R. norvegicus
attcctcagaaaatta

SEQ ID NO: 482867 - DNA, 16 bp, R. norvegicus
attcctcagaaaattg

SEQ ID NO: 482868 - DNA, 16 bp, R. norvegicus
attcctcagcagagaa

SEQ ID NO: 482869 - DNA, 16 bp, R. norvegicus
attcctcagctgggaa

SEQ ID NO: 482870 - DNA, 16 bp, R. norvegicus
attcctcagtggagaa

SEQ ID NO: 482871 - DNA, 16 bp, R. norvegicus
attcctccaaacaaaa

SEQ ID NO: 482872 - DNA, 16 bp, R. norvegicus
attcctccattgaaga

SEQ ID NO: 482873 - DNA, 16 bp, R. norvegicus
attcctcctattggga

SEQ ID NO: 482874 - DNA, 16 bp, R. norvegicus
attcctctactctggg

SEQ ID NO: 482875 - DNA, 16 bp, R. norvegicus
attcctcttgggttga

SEQ ID NO: 482876 - DNA, 16 bp, R. norvegicus
attcctctttcttcac

SEQ ID NO: 482877 - DNA, 16 bp, R. norvegicus
attcctgccctgtgtg

SEQ ID NO: 482878 - DNA, 16 bp, R. norvegicus
attcctggaatgaagc

SEQ ID NO: 482879 - DNA, 16 bp, R. norvegicus
attcctggcctggaac

SEQ ID NO: 482880 - DNA, 16 bp, R. norvegicus
attcctggttgctgct

SEQ ID NO: 482881 - DNA, 16 bp, R. norvegicus
attcctgtgttctctt

SEQ ID NO: 482882 - DNA, 16 bp, R. norvegicus
attcctgtttccatga

SEQ ID NO: 482883 - DNA, 16 bp, R. norvegicus
attccttcattgctgg

SEQ ID NO: 482884 - DNA, 16 bp, R. norvegicus
attccttggaactgga

SEQ ID NO: 482885 - DNA, 16 bp, R. norvegicus
attccttgtttgcttt

SEQ ID NO: 482886 - DNA, 16 bp, R. norvegicus
attcctttcctggttt

SEQ ID NO: 482887 - DNA, 16 bp, R. norvegicus
attcctttgatgtgct

SEQ ID NO: 482888 - DNA, 16 bp, R. norvegicus
attcctttgttgtgaa

SEQ ID NO: 482889 - DNA, 16 bp, R. norvegicus
attcggggtcaccttc

SEQ ID NO: 482890 - DNA, 16 bp, R. norvegicus
attctaaaaagacttt

SEQ ID NO: 482891 - DNA, 16 bp, R. norvegicus
attctaaaagtcagaa

SEQ ID NO: 482892 - DNA, 16 bp, R. norvegicus
attctaaaattgaata

SEQ ID NO: 482893 - DNA, 16 bp, R. norvegicus
attctaaggaatctct

SEQ ID NO: 482894 - DNA, 16 bp, R. norvegicus
attctaataaaatgga

SEQ ID NO: 482895 - DNA, 16 bp, R. norvegicus
attctacctcatgcca

SEQ ID NO: 482896 - DNA, 16 bp, R. norvegicus
attctacttccacatc

SEQ ID NO: 482897 - DNA, 16 bp, R. norvegicus
attctagagaatcaaa

SEQ ID NO: 482898 - DNA, 16 bp, R. norvegicus
attctagcaaactgaa

SEQ ID NO: 482899 - DNA, 16 bp, R. norvegicus
attctattaccagctt

SEQ ID NO: 482900 - DNA, 16 bp, R. norvegicus
attctattgtataaat

SEQ ID NO: 482901 - DNA, 16 bp, R. norvegicus
attctattttatggaa

SEQ ID NO: 482902 - DNA, 16 bp, R. norvegicus
attctcaaagaactag

SEQ ID NO: 482903 - DNA, 16 bp, R. norvegicus
attctcaaagaataaa

SEQ ID NO: 482904 - DNA, 16 bp, R. norvegicus
attctcaacaataaaa

SEQ ID NO: 482905 - DNA, 16 bp, R. norvegicus
attctcaacctcccta

SEQ ID NO: 482906 - DNA, 16 bp, R. norvegicus
attctcaacctgtgtg

SEQ ID NO: 482907 - DNA, 16 bp, R. norvegicus
attctcacagaagcag

SEQ ID NO: 482908 - DNA, 16 bp, R. norvegicus
attctcacagccaacc

SEQ ID NO: 482909 - DNA, 16 bp, R. norvegicus
attctcacttccatct

SEQ ID NO: 482910 - DNA, 16 bp, R. norvegicus
attctcagctgaagaa

SEQ ID NO: 482911 - DNA, 16 bp, R. norvegicus
attctcatcaataaaa

SEQ ID NO: 482912 - DNA, 16 bp, R. norvegicus
attctccacaataaaa

SEQ ID NO: 482913 - DNA, 16 bp, R. norvegicus
attctccccagcatct

SEQ ID NO: 482914 - DNA, 16 bp, R. norvegicus
attctcccttccatct

SEQ ID NO: 482915 - DNA, 16 bp, R. norvegicus
attctcctagcagcct

SEQ ID NO: 482916 - DNA, 16 bp, R. norvegicus
attctcctgcctcggc

SEQ ID NO: 482917 - DNA, 16 bp, R. norvegicus
attctcctgcctctac

SEQ ID NO: 482918 - DNA, 16 bp, R. norvegicus
attctcctgtctcagt

SEQ ID NO: 482919 - DNA, 16 bp, R. norvegicus
attctcgcaaaccaaa

SEQ ID NO: 482920 - DNA, 16 bp, R. norvegicus
attctctccagcatct

SEQ ID NO: 482921 - DNA, 16 bp, R. norvegicus
attctctcttcaatct

SEQ ID NO: 482922 - DNA, 16 bp, R. norvegicus
attctctgctacatat

SEQ ID NO: 482923 - DNA, 16 bp, R. norvegicus
attctctggagctgga

SEQ ID NO: 482924 - DNA, 16 bp, R. norvegicus
attctctgggttttct

SEQ ID NO: 482925 - DNA, 16 bp, R. norvegicus
attctctttcctgttt

SEQ ID NO: 482926 - DNA, 16 bp, R. norvegicus
attctctttggttggt

SEQ ID NO: 482927 - DNA, 16 bp, R. norvegicus
attctgaagaggctgg

SEQ ID NO: 482928 - DNA, 16 bp, R. norvegicus
attctgaggcaaatgg

SEQ ID NO: 482929 - DNA, 16 bp, R. norvegicus
attctgatcaagtctc

SEQ ID NO: 482930 - DNA, 16 bp, R. norvegicus
attctgattcataaca

SEQ ID NO: 482931 - DNA, 16 bp, R. norvegicus
attctgattggtgtga

SEQ ID NO: 482932 - DNA, 16 bp, R. norvegicus
attctgatttaatttt

SEQ ID NO: 482933 - DNA, 16 bp, R. norvegicus
attctgcactgaacac

SEQ ID NO: 482934 - DNA, 16 bp, R. norvegicus
attctgcataatgtgt

SEQ ID NO: 482935 - DNA, 16 bp, R. norvegicus
attctgcctcaaaaat

SEQ ID NO: 482936 - DNA, 16 bp, R. norvegicus
attctgctggccctca

SEQ ID NO: 482937 - DNA, 16 bp, R. norvegicus
attctgctgtctacag

SEQ ID NO: 482938 - DNA, 16 bp, R. norvegicus
attctggagatagaaa

SEQ ID NO: 482939 - DNA, 16 bp, R. norvegicus
attctggaggaaatgg

SEQ ID NO: 482940 - DNA, 16 bp, R. norvegicus
attctggaggcagagg

SEQ ID NO: 482941 - DNA, 16 bp, R. norvegicus
attctggctgtcctgg

SEQ ID NO: 482942 - DNA, 16 bp, R. norvegicus
attctggggtgtgtgt

SEQ ID NO: 482943 - DNA, 16 bp, R. norvegicus
attctgggtcagtgtt

SEQ ID NO: 482944 - DNA, 16 bp, R. norvegicus
attctggtttaaaaat

SEQ ID NO: 482945 - DNA, 16 bp, R. norvegicus
attctgtagcccagac

SEQ ID NO: 482946 - DNA, 16 bp, R. norvegicus
attctgtcggtgatgc

SEQ ID NO: 482947 - DNA, 16 bp, R. norvegicus
attctgtttctctaga

SEQ ID NO: 482948 - DNA, 16 bp, R. norvegicus
attcttaaagaattaa

SEQ ID NO: 482949 - DNA, 16 bp, R. norvegicus
attcttaacagtaaaa

SEQ ID NO: 482950 - DNA, 16 bp, R. norvegicus
attcttatacatgctg

SEQ ID NO: 482951 - DNA, 16 bp, R. norvegicus
attcttatttatgtgt

SEQ ID NO: 482952 - DNA, 16 bp, R. norvegicus
attcttcagttgtggg

SEQ ID NO: 482953 - DNA, 16 bp, R. norvegicus
attcttccaaacagaa

SEQ ID NO: 482954 - DNA, 16 bp, R. norvegicus
attcttcccttactgt

SEQ ID NO: 482955 - DNA, 16 bp, R. norvegicus
attcttctcaccctgt

SEQ ID NO: 482956 - DNA, 16 bp, R. norvegicus
attcttctccagcctc

SEQ ID NO: 482957 - DNA, 16 bp, R. norvegicus
attcttctgttgaagg

SEQ ID NO: 482958 - DNA, 16 bp, R. norvegicus
attcttctttaaaaaa

SEQ ID NO: 482959 - DNA, 16 bp, R. norvegicus
attcttgaaaattttt

SEQ ID NO: 482960 - DNA, 16 bp, R. norvegicus
attcttgatcttagaa

SEQ ID NO: 482961 - DNA, 17 bp, R. norvegicus
attcttgatcttagagc

SEQ ID NO: 482962 - DNA, 16 bp, R. norvegicus
attctttctcagcttg

SEQ ID NO: 482963 - DNA, 16 bp, R. norvegicus
attctttctgctgacc

SEQ ID NO: 482964 - DNA, 16 bp, R. norvegicus
attctttcttttgtgc

SEQ ID NO: 482965 - DNA, 16 bp, R. norvegicus
attctttgaaaacctt

SEQ ID NO: 482966 - DNA, 16 bp, R. norvegicus
attctttgatcctgtt

SEQ ID NO: 482967 - DNA, 16 bp, R. norvegicus
attctttgtctctgta

SEQ ID NO: 482968 - DNA, 16 bp, R. norvegicus
attcttttataaaaga

SEQ ID NO: 482969 - DNA, 16 bp, R. norvegicus
attcttttcaacatat

SEQ ID NO: 482970 - DNA, 16 bp, R. norvegicus
attctttttaaagaat

SEQ ID NO: 482971 - DNA, 16 bp, R. norvegicus
attgaaaaagctgaag

SEQ ID NO: 482972 - DNA, 16 bp, R. norvegicus
attgaaaacatttttt

SEQ ID NO: 482973 - DNA, 16 bp, R. norvegicus
attgaaaatggagata

SEQ ID NO: 482974 - DNA, 16 bp, R. norvegicus
attgaaaatggattct

SEQ ID NO: 482975 - DNA, 16 bp, R. norvegicus
attgaaaattcatctt

SEQ ID NO: 482976 - DNA, 16 bp, R. norvegicus
attgaaacacatgaat

SEQ ID NO: 482977 - DNA, 16 bp, R. norvegicus
attgaaacagatgaag

SEQ ID NO: 482978 - DNA, 16 bp, R. norvegicus
attgaaagagatgaag

SEQ ID NO: 482979 - DNA, 16 bp, R. norvegicus
attgaaagagttaaag

SEQ ID NO: 482980 - DNA, 16 bp, R. norvegicus
attgaaagatttgaag

SEQ ID NO: 482981 - DNA, 16 bp, R. norvegicus
attgaaagttttgtgg

SEQ ID NO: 482982 - DNA, 16 bp, R. norvegicus
attgaacatttcttta

SEQ ID NO: 482983 - DNA, 16 bp, R. norvegicus
attgaaccatcccttc

SEQ ID NO: 482984 - DNA, 16 bp, R. norvegicus
attgaactcagataat

SEQ ID NO: 482985 - DNA, 16 bp, R. norvegicus
attgaactcagcacct

SEQ ID NO: 482986 - DNA, 16 bp, R. norvegicus
attgaactgagaaatg

SEQ ID NO: 482987 - DNA, 16 bp, R. norvegicus
attgaactgagcatgg

SEQ ID NO: 482988 - DNA, 16 bp, R. norvegicus
attgaagaaaatgtca

SEQ ID NO: 482989 - DNA, 16 bp, R. norvegicus
attgaagaactagaaa

SEQ ID NO: 482990 - DNA, 16 bp, R. norvegicus
attgaagaagacctga

SEQ ID NO: 482991 - DNA, 16 bp, R. norvegicus
attgaagaagacgtca

SEQ ID NO: 482992 - DNA, 16 bp, R. norvegicus
attgaagaagctaaaa

SEQ ID NO: 482993 - DNA, 16 bp, R. norvegicus
attgaagaagctgaaa

SEQ ID NO: 482994 - DNA, 16 bp, R. norvegicus
attgaagacaagcctt

SEQ ID NO: 482995 - DNA, 16 bp, R. norvegicus
attgaagacacaggaa

SEQ ID NO: 482996 - DNA, 16 bp, R. norvegicus
attgaagaccagattt

SEQ ID NO: 482997 - DNA, 16 bp, R. norvegicus
attgaagacccagaag

SEQ ID NO: 482998 - DNA, 16 bp, R. norvegicus
attgaagacctggaaa

SEQ ID NO: 482999 - DNA, 16 bp, R. norvegicus
attgaagatgctgtct

SEQ ID NO: 483000 - DNA, 16 bp, R. norvegicus
attgaagatgcttctt

SEQ ID NO: 483001 - DNA, 16 bp, R. norvegicus
attgaagcagctgaag

SEQ ID NO: 483002 - DNA, 16 bp, R. norvegicus
attgaaggaatcacag

SEQ ID NO: 483003 - DNA, 16 bp, R. norvegicus
attgaaggagaaggaa

SEQ ID NO: 483004 - DNA, 16 bp, R. norvegicus
attgaaggagttaaag

SEQ ID NO: 483005 - DNA, 16 bp, R. norvegicus
attgaatatattttct

SEQ ID NO: 483006 - DNA, 16 bp, R. norvegicus
attgacaaaggaaatc

SEQ ID NO: 483007 - DNA, 16 bp, R. norvegicus
attgacaaattccaag

SEQ ID NO: 483008 - DNA, 16 bp, R. norvegicus
attgactttgggacag

SEQ ID NO: 483009 - DNA, 16 bp, R. norvegicus
attgagaaaagatctt

SEQ ID NO: 483010 - DNA, 16 bp, R. norvegicus
attgagaagaaacatt

SEQ ID NO: 483011 - DNA, 16 bp, R. norvegicus
attgagaagatcaaac

SEQ ID NO: 483012 - DNA, 16 bp, R. norvegicus
attgagacaatgcctt

SEQ ID NO: 483013 - DNA, 16 bp, R. norvegicus
attgagagtttctctt

SEQ ID NO: 483014 - DNA, 16 bp, R. norvegicus
attgagcacatcaagc

SEQ ID NO: 483015 - DNA, 16 bp, R. norvegicus
attgagcccattgatg

SEQ ID NO: 483016 - DNA, 16 bp, R. norvegicus
attgaggaagacatcc

SEQ ID NO: 483017 - DNA, 16 bp, R. norvegicus
attgaggacccagaaa

SEQ ID NO: 483018 - DNA, 16 bp, R. norvegicus
attgaggagcagaaaa

SEQ ID NO: 483019 - DNA, 16 bp, R. norvegicus
attgagggaagccaag

SEQ ID NO: 483020 - DNA, 16 bp, R. norvegicus
attgagggagctgaag

SEQ ID NO: 483021 - DNA, 16 bp, R. norvegicus
attgagggagctggag

SEQ ID NO: 483022 - DNA, 16 bp, R. norvegicus
attgatacagaaaata

SEQ ID NO: 483023 - DNA, 16 bp, R. norvegicus
attgatcaagaaaatg

SEQ ID NO: 483024 - DNA, 16 bp, R. norvegicus
attgatcaatggaata

SEQ ID NO: 483025 - DNA, 16 bp, R. norvegicus
attgatcagtggaata

SEQ ID NO: 483026 - DNA, 16 bp, R. norvegicus
attgatccatacttat

SEQ ID NO: 483027 - DNA, 16 bp, R. norvegicus
attgatctggaaaaga

SEQ ID NO: 483028 - DNA, 16 bp, R. norvegicus
attgatgaagcaaaaa

SEQ ID NO: 483029 - DNA, 16 bp, R. norvegicus
attgatgttaaagaaa

SEQ ID NO: 483030 - DNA, 16 bp, R. norvegicus
attgatgttaatatta

SEQ ID NO: 483031 - DNA, 16 bp, R. norvegicus
attgattcaagttttt

SEQ ID NO: 483032 - DNA, 16 bp, R. norvegicus
attgattgatttatct

SEQ ID NO: 483033 - DNA, 16 bp, R. norvegicus
attgatttcagctctg

SEQ ID NO: 483034 - DNA, 16 bp, R. norvegicus
attgcaaaacaaacaa

SEQ ID NO: 483035 - DNA, 16 bp, R. norvegicus
attgcaaactggtacc

SEQ ID NO: 483036 - DNA, 16 bp, R. norvegicus
attgcaagagccagag

SEQ ID NO: 483037 - DNA, 16 bp, R. norvegicus
attgcagagcttctgt

SEQ ID NO: 483038 - DNA, 16 bp, R. norvegicus
attgcagatgccaaga

SEQ ID NO: 483039 - DNA, 16 bp, R. norvegicus
attgcagggcaagatc

SEQ ID NO: 483040 - DNA, 16 bp, R. norvegicus
attgcattgagtttgt

SEQ ID NO: 483041 - DNA, 16 bp, R. norvegicus
attgccagaagccatc

SEQ ID NO: 483042 - DNA, 16 bp, R. norvegicus
attgccatcttaccaa

SEQ ID NO: 483043 - DNA, 16 bp, R. norvegicus
attgccatggcaacag

SEQ ID NO: 483044 - DNA, 46 bp, R. norvegicus
attgcctcatggaacaaacttggaaaagaccttgacagaaaattgg

SEQ ID NO: 483045 - DNA, 16 bp, R. norvegicus
attgccttgagacagg

SEQ ID NO: 483046 - DNA, 16 bp, R. norvegicus
attgctacttcttaac

SEQ ID NO: 483047 - DNA, 16 bp, R. norvegicus
attgctatgaagagac

SEQ ID NO: 483048 - DNA, 18 bp, R. norvegicus
attgctatgactaatcaa

SEQ ID NO: 483049 - DNA, 16 bp, R. norvegicus
attgctatgatgaaac

SEQ ID NO: 483050 - DNA, 16 bp, R. norvegicus
attgctattattatta

SEQ ID NO: 483051 - DNA, 16 bp, R. norvegicus
attgctccagaaaaga

SEQ ID NO: 483052 - DNA, 16 bp, R. norvegicus
attgctctggttagaa

SEQ ID NO: 483053 - DNA, 16 bp, R. norvegicus
attgctcttcctaact

SEQ ID NO: 483054 - DNA, 16 bp, R. norvegicus
attgctgaagacaaca

SEQ ID NO: 483055 - DNA, 16 bp, R. norvegicus
attgctgaagagaaca

SEQ ID NO: 483056 - DNA, 16 bp, R. norvegicus
attgctgactttgtga

SEQ ID NO: 483057 - DNA, 16 bp, R. norvegicus
attgctgagaagtacc

SEQ ID NO: 483058 - DNA, 16 bp, R. norvegicus
attgctgatgccaagg

SEQ ID NO: 483059 - DNA, 16 bp, R. norvegicus
attgctgatgccagga

SEQ ID NO: 483060 - DNA, 16 bp, R. norvegicus
attgctgatgtgaaga

SEQ ID NO: 483061 - DNA, 16 bp, R. norvegicus
attgctgctgcagcca

SEQ ID NO: 483062 - DNA, 16 bp, R. norvegicus
attgctgctggcattc

SEQ ID NO: 483063 - DNA, 16 bp, R. norvegicus
attgctggctatgtgt

SEQ ID NO: 483064 - DNA, 16 bp, R. norvegicus
attgctgtccttaaca

SEQ ID NO: 483065 - DNA, 16 bp, R. norvegicus
attgctgtgacaaaat

SEQ ID NO: 483066 - DNA, 16 bp, R. norvegicus
attgctgtggtcatgg

SEQ ID NO: 483067 - DNA, 16 bp, R. norvegicus
attgctgttgttgctg

SEQ ID NO: 483068 - DNA, 16 bp, R. norvegicus
attgcttcaaatatct

SEQ ID NO: 483069 - DNA, 16 bp, R. norvegicus
attgcttgaagtttct

SEQ ID NO: 483070 - DNA, 16 bp, R. norvegicus
attgcttttatttcta

SEQ ID NO: 483071 - DNA, 16 bp, R. norvegicus
attggaaaaatatttt

SEQ ID NO: 483072 - DNA, 16 bp, R. norvegicus
attggaaaacacagat

SEQ ID NO: 483073 - DNA, 16 bp, R. norvegicus
attggaaaatacagat

SEQ ID NO: 483074 - DNA, 16 bp, R. norvegicus
attggaaacaggttaa

SEQ ID NO: 483075 - DNA, 16 bp, R. norvegicus
attggaaaccataata

SEQ ID NO: 483076 - DNA, 16 bp, R. norvegicus
attggaaactggtaca

SEQ ID NO: 483077 - DNA, 16 bp, R. norvegicus
attggaaatgtaaata

SEQ ID NO: 483078 - DNA, 16 bp, R. norvegicus
attggaagaacaacat

SEQ ID NO: 483079 - DNA, 16 bp, R. norvegicus
attggaatcctgaaga

SEQ ID NO: 483080 - DNA, 16 bp, R. norvegicus
attggacagatcatgg

SEQ ID NO: 483081 - DNA, 16 bp, R. norvegicus
attggactgaagtcag

SEQ ID NO: 483082 - DNA, 16 bp, R. norvegicus
attggactttttattt

SEQ ID NO: 483083 - DNA, 16 bp, R. norvegicus
attggagaaggtactt

SEQ ID NO: 483084 - DNA, 16 bp, R. norvegicus
attggagcaggggctg

SEQ ID NO: 483085 - DNA, 16 bp, R. norvegicus
attggaggccccaggg

SEQ ID NO: 483086 - DNA, 16 bp, R. norvegicus
attggatgagaaggga

SEQ ID NO: 483087 - DNA, 17 bp, R. norvegicus
attggatttgggcctgg

SEQ ID NO: 483088 - DNA, 16 bp, R. norvegicus
attggctatgtccttt

SEQ ID NO: 483089 - DNA, 16 bp, R. norvegicus
attggctgagaaagaa

SEQ ID NO: 483090 - DNA, 16 bp, R. norvegicus
attgggaaaaaaatca

SEQ ID NO: 483091 - DNA, 16 bp, R. norvegicus
attgggaaggaagaag

SEQ ID NO: 483092 - DNA, 16 bp, R. norvegicus
attgggaagggatctt

SEQ ID NO: 483093 - DNA, 16 bp, R. norvegicus
attgggaatctttgct

SEQ ID NO: 483094 - DNA, 16 bp, R. norvegicus
attgggactgacttac

SEQ ID NO: 483095 - DNA, 16 bp, R. norvegicus
attgggattgcttcaa

SEQ ID NO: 483096 - DNA, 16 bp, R. norvegicus
attgggccaggacagg

SEQ ID NO: 483097 - DNA, 16 bp, R. norvegicus
attgggggtaggaaca

SEQ ID NO: 483098 - DNA, 16 bp, R. norvegicus
attgggtattttttaa

SEQ ID NO: 483099 - DNA, 16 bp, R. norvegicus
attggtcaaagaaaat

SEQ ID NO: 483100 - DNA, 16 bp, R. norvegicus
attggtcattaatatc

SEQ ID NO: 483101 - DNA, 16 bp, R. norvegicus
attggtcccaagaaac

SEQ ID NO: 483102 - DNA, 16 bp, R. norvegicus
attggtctgaagttca

SEQ ID NO: 483103 - DNA, 16 bp, R. norvegicus
attggtctgaagttgt

SEQ ID NO: 483104 - DNA, 16 bp, R. norvegicus
attggtctgaagtttc

SEQ ID NO: 483105 - DNA, 16 bp, R. norvegicus
attggtgaagccaaga

SEQ ID NO: 483106 - DNA, 16 bp, R. norvegicus
attggttcctgctgtg

SEQ ID NO: 483107 - DNA, 17 bp, R. norvegicus
attggtttatatacaag

SEQ ID NO: 483108 - DNA, 16 bp, R. norvegicus
attgtaaaaacaaaac

SEQ ID NO: 483109 - DNA, 16 bp, R. norvegicus
attgtaaaggaagaag

SEQ ID NO: 483110 - DNA, 16 bp, R. norvegicus
attgtactgtaaatat

SEQ ID NO: 483111 - DNA, 16 bp, R. norvegicus
attgtagctgttttca

SEQ ID NO: 483112 - DNA, 16 bp, R. norvegicus
attgtagcttcctgtt

SEQ ID NO: 483113 - DNA, 16 bp, R. norvegicus
attgtatattttggat

SEQ ID NO: 483114 - DNA, 16 bp, R. norvegicus
attgtatcctggattt

SEQ ID NO: 483115 - DNA, 16 bp, R. norvegicus
attgtatgttttctct

SEQ ID NO: 483116 - DNA, 16 bp, R. norvegicus
attgtattataatttc

SEQ ID NO: 483117 - DNA, 16 bp, R. norvegicus
attgtcaacttgacag

SEQ ID NO: 483118 - DNA, 16 bp, R. norvegicus
attgtcagtttttaca

SEQ ID NO: 483119 - DNA, 31 bp, R. norvegicus
attgtcatcgccttctatgaggagtggctga

SEQ ID NO: 483120 - DNA, 36 bp, R. norvegicus
attgtcatcttggattgctgctgctatgaatcatct

SEQ ID NO: 483121 - DNA, 16 bp, R. norvegicus
attgtgagcctagcct

SEQ ID NO: 483122 - DNA, 16 bp, R. norvegicus
attgtgcctcctgggg

SEQ ID NO: 483123 - DNA, 16 bp, R. norvegicus
attgtggatgtcaaga

SEQ ID NO: 483124 - DNA, 18 bp, R. norvegicus
attgtggcagcggctgtg

SEQ ID NO: 483125 - DNA, 16 bp, R. norvegicus
attgtggctgtcttca

SEQ ID NO: 483126 - DNA, 16 bp, R. norvegicus
attgtgggcggggcca

SEQ ID NO: 483127 - DNA, 16 bp, R. norvegicus
attgtgtccagttgtg

SEQ ID NO: 483128 - DNA, 17 bp, R. norvegicus
attgttacctatgaggt

SEQ ID NO: 483129 - DNA, 16 bp, R. norvegicus
attgttcaacttcctt

SEQ ID NO: 483130 - DNA, 16 bp, R. norvegicus
attgttcagtggttaa

SEQ ID NO: 483131 - DNA, 16 bp, R. norvegicus
attgttcttgtctgaa

SEQ ID NO: 483132 - DNA, 17 bp, R. norvegicus
attgttgccatcaacga

SEQ ID NO: 483133 - DNA, 16 bp, R. norvegicus
attgtttaccaagcta

SEQ ID NO: 483134 - DNA, 19 bp, R. norvegicus
attgtttaccaggctatgg

SEQ ID NO: 483135 - DNA, 16 bp, R. norvegicus
attgtttccaagatga

SEQ ID NO: 483136 - DNA, 16 bp, R. norvegicus
attgtttctatttcaa

SEQ ID NO: 483137 - DNA, 16 bp, R. norvegicus
attgtttcttttccat

SEQ ID NO: 483138 - DNA, 16 bp, R. norvegicus
attgttttcttctctc

SEQ ID NO: 483139 - DNA, 16 bp, R. norvegicus
attgtttttaaaagat

SEQ ID NO: 483140 - DNA, 16 bp, R. norvegicus
attgtttttaaggata

SEQ ID NO: 483141 - DNA, 16 bp, R. norvegicus
atttaaaaaaatactg

SEQ ID NO: 483142 - DNA, 16 bp, R. norvegicus
atttaaaaaatgttca

SEQ ID NO: 483143 - DNA, 16 bp, R. norvegicus
atttaaaaactgaaaa

SEQ ID NO: 483144 - DNA, 16 bp, R. norvegicus
atttaaaaaggattga

SEQ ID NO: 483145 - DNA, 16 bp, R. norvegicus
atttaaaaatcacaca

SEQ ID NO: 483146 - DNA, 16 bp, R. norvegicus
atttaaaacagaattt

SEQ ID NO: 483147 - DNA, 16 bp, R. norvegicus
atttaaaactctatct

SEQ ID NO: 483148 - DNA, 16 bp, R. norvegicus
atttaaaagaaaacca

SEQ ID NO: 483149 - DNA, 16 bp, R. norvegicus
atttaaaagggaattt

SEQ ID NO: 483150 - DNA, 16 bp, R. norvegicus
atttaaaagtttcttt

SEQ ID NO: 483151 - DNA, 16 bp, R. norvegicus
atttaaaatcacattt

SEQ ID NO: 483152 - DNA, 16 bp, R. norvegicus
atttaaaatcatatct

SEQ ID NO: 483153 - DNA, 16 bp, R. norvegicus
atttaaaatgcaaata

SEQ ID NO: 483154 - DNA, 16 bp, R. norvegicus
atttaaaatgttatcc

SEQ ID NO: 483155 - DNA, 16 bp, R. norvegicus
atttaaacaaactgaa

SEQ ID NO: 483156 - DNA, 16 bp, R. norvegicus
atttaaacatgaaaat

SEQ ID NO: 483157 - DNA, 16 bp, R. norvegicus
atttaaagagaaaaca

SEQ ID NO: 483158 - DNA, 16 bp, R. norvegicus
atttaaagaggaaaca

SEQ ID NO: 483159 - DNA, 16 bp, R. norvegicus
atttaaaggaagaaac

SEQ ID NO: 483160 - DNA, 16 bp, R. norvegicus
atttaaaggaagaaat

SEQ ID NO: 483161 - DNA, 16 bp, R. norvegicus
atttaaagtgtaaatt

SEQ ID NO: 483162 - DNA, 16 bp, R. norvegicus
atttaaccaagcaagt

SEQ ID NO: 483163 - DNA, 18 bp, R. norvegicus
atttaacccagtttagtg

SEQ ID NO: 483164 - DNA, 16 bp, R. norvegicus
atttaacccattcaaa

SEQ ID NO: 483165 - DNA, 16 bp, R. norvegicus
atttaaccttaatacc

SEQ ID NO: 483166 - DNA, 16 bp, R. norvegicus
atttaagaaaatgttt

SEQ ID NO: 483167 - DNA, 16 bp, R. norvegicus
atttaagcttttcttc

SEQ ID NO: 483168 - DNA, 16 bp, R. norvegicus
atttaaggaagaaaat

SEQ ID NO: 483169 - DNA, 16 bp, R. norvegicus
atttaaggtcagagct

SEQ ID NO: 483170 - DNA, 16 bp, R. norvegicus
atttaagtacttaaat

SEQ ID NO: 483171 - DNA, 16 bp, R. norvegicus
atttaatgaaaatgca

SEQ ID NO: 483172 - DNA, 16 bp, R. norvegicus
atttaatgaaaatgga

SEQ ID NO: 483173 - DNA, 16 bp, R. norvegicus
atttaatgaacatgaa

SEQ ID NO: 483174 - DNA, 16 bp, R. norvegicus
atttaatgaagtcatt

SEQ ID NO: 483175 - DNA, 16 bp, R. norvegicus
atttaatgttatttca

SEQ ID NO: 483176 - DNA, 16 bp, R. norvegicus
atttaattttacatgt

SEQ ID NO: 483177 - DNA, 16 bp, R. norvegicus
atttacaaaacagaaa

SEQ ID NO: 483178 - DNA, 16 bp, R. norvegicus
atttacacaatggaat

SEQ ID NO: 483179 - DNA, 16 bp, R. norvegicus
atttacagaacatttt

SEQ ID NO: 483180 - DNA, 16 bp, R. norvegicus
atttacagccaccaaa

SEQ ID NO: 483181 - DNA, 16 bp, R. norvegicus
atttacatatgtgcat

SEQ ID NO: 483182 - DNA, 16 bp, R. norvegicus
atttacatgtatatat

SEQ ID NO: 483183 - DNA, 16 bp, R. norvegicus
atttacatttccatga

SEQ ID NO: 483184 - DNA, 16 bp, R. norvegicus
atttacccaagataca

SEQ ID NO: 483185 - DNA, 16 bp, R. norvegicus
atttacctgaaatttt

SEQ ID NO: 483186 - DNA, 16 bp, R. norvegicus
atttactttacatcca

SEQ ID NO: 483187 - DNA, 16 bp, R. norvegicus
atttagagctgcagaa

SEQ ID NO: 483188 - DNA, 16 bp, R. norvegicus
atttagcccagtggta

SEQ ID NO: 483189 - DNA, 16 bp, R. norvegicus
atttataaaagaaaac

SEQ ID NO: 483190 - DNA, 16 bp, R. norvegicus
atttatacatttagaa

SEQ ID NO: 483191 - DNA, 16 bp, R. norvegicus
atttatactccctcca

SEQ ID NO: 483192 - DNA, 16 bp, R. norvegicus
atttatatcaatgaaa

SEQ ID NO: 483193 - DNA, 16 bp, R. norvegicus
atttatatgtatgtgt

SEQ ID NO: 483194 - DNA, 16 bp, R. norvegicus
atttatcatttgttga

SEQ ID NO: 483195 - DNA, 16 bp, R. norvegicus
atttatctttggttga

SEQ ID NO: 483196 - DNA, 16 bp, R. norvegicus
atttatgaagaaaact

SEQ ID NO: 483197 - DNA, 16 bp, R. norvegicus
atttatgccaatgaaa

SEQ ID NO: 483198 - DNA, 16 bp, R. norvegicus
atttatgctgcccata

SEQ ID NO: 483199 - DNA, 16 bp, R. norvegicus
atttatggcctctttt

SEQ ID NO: 483200 - DNA, 16 bp, R. norvegicus
atttatgggactgttt

SEQ ID NO: 483201 - DNA, 16 bp, R. norvegicus
atttatgtgtgtatat

SEQ ID NO: 483202 - DNA, 16 bp, R. norvegicus
atttattatatgtaag

SEQ ID NO: 483203 - DNA, 16 bp, R. norvegicus
atttattatgtgtgtg

SEQ ID NO: 483204 - DNA, 16 bp, R. norvegicus
atttattctctttaca

SEQ ID NO: 483205 - DNA, 16 bp, R. norvegicus
atttattctttgagaa

SEQ ID NO: 483206 - DNA, 16 bp, R. norvegicus
atttattgagcaccta

SEQ ID NO: 483207 - DNA, 16 bp, R. norvegicus
atttatttaatgtgag

SEQ ID NO: 483208 - DNA, 16 bp, R. norvegicus
atttatttacagattt

SEQ ID NO: 483209 - DNA, 16 bp, R. norvegicus
atttatttatctaatg

SEQ ID NO: 483210 - DNA, 16 bp, R. norvegicus
atttatttatgtctgt

SEQ ID NO: 483211 - DNA, 16 bp, R. norvegicus
atttatttattcatgt

SEQ ID NO: 483212 - DNA, 16 bp, R. norvegicus
atttatttcatatatg

SEQ ID NO: 483213 - DNA, 16 bp, R. norvegicus
atttatttggaataaa

SEQ ID NO: 483214 - DNA, 16 bp, R. norvegicus
atttatttggtgttct

SEQ ID NO: 483215 - DNA, 16 bp, R. norvegicus
atttattttaaaagct

SEQ ID NO: 483216 - DNA, 16 bp, R. norvegicus
atttattttgcatatt

SEQ ID NO: 483217 - DNA, 16 bp, R. norvegicus
atttattttgcattta

SEQ ID NO: 483218 - DNA, 16 bp, R. norvegicus
atttatttttagcaat

SEQ ID NO: 483219 - DNA, 16 bp, R. norvegicus
atttcaaaaagaaaag

SEQ ID NO: 483220 - DNA, 16 bp, R. norvegicus
atttcaaaacattttt

SEQ ID NO: 483221 - DNA, 16 bp, R. norvegicus
atttcaaaagagaaaa

SEQ ID NO: 483222 - DNA, 16 bp, R. norvegicus
atttcaaaatttaaag

SEQ ID NO: 483223 - DNA, 16 bp, R. norvegicus
atttcaaactgaaatt

SEQ ID NO: 483224 - DNA, 16 bp, R. norvegicus
atttcaaagaaaacaa

SEQ ID NO: 483225 - DNA, 16 bp, R. norvegicus
atttcaacttttaaaa

SEQ ID NO: 483226 - DNA, 16 bp, R. norvegicus
atttcaagaaagaaaa

SEQ ID NO: 483227 - DNA, 16 bp, R. norvegicus
atttcaagtgagcaca

SEQ ID NO: 483228 - DNA, 16 bp, R. norvegicus
atttcaagttttattt

SEQ ID NO: 483229 - DNA, 16 bp, R. norvegicus
atttcaataaaaatga

SEQ ID NO: 483230 - DNA, 16 bp, R. norvegicus
atttcaccttagtgat

SEQ ID NO: 483231 - DNA, 16 bp, R. norvegicus
atttcagaaaatattt

SEQ ID NO: 483232 - DNA, 16 bp, R. norvegicus
atttcagaaaatggag

SEQ ID NO: 483233 - DNA, 16 bp, R. norvegicus
atttcagaagagactt

SEQ ID NO: 483234 - DNA, 16 bp, R. norvegicus
atttcaggctggagag

SEQ ID NO: 483235 - DNA, 16 bp, R. norvegicus
atttcagttaattttt

SEQ ID NO: 483236 - DNA, 16 bp, R. norvegicus
atttcataattttgtt

SEQ ID NO: 483237 - DNA, 17 bp, R. norvegicus
atttcatgacaaaacca

SEQ ID NO: 483238 - DNA, 16 bp, R. norvegicus
atttcatgatgatgat

SEQ ID NO: 483239 - DNA, 16 bp, R. norvegicus
atttcatgatgtcact

SEQ ID NO: 483240 - DNA, 16 bp, R. norvegicus
atttcatggatgtttt

SEQ ID NO: 483241 - DNA, 16 bp, R. norvegicus
atttcattcttcaaat

SEQ ID NO: 483242 - DNA, 16 bp, R. norvegicus
atttcattttcaaact

SEQ ID NO: 483243 - DNA, 16 bp, R. norvegicus
atttccaaatgaaaac

SEQ ID NO: 483244 - DNA, 16 bp, R. norvegicus
atttccaaattcattt

SEQ ID NO: 483245 - DNA, 16 bp, R. norvegicus
atttccacttatatgt

SEQ ID NO: 483246 - DNA, 16 bp, R. norvegicus
atttccagaatggatg

SEQ ID NO: 483247 - DNA, 16 bp, R. norvegicus
atttccagaatgtttt

SEQ ID NO: 483248 - DNA, 16 bp, R. norvegicus
atttccagcaccacat

SEQ ID NO: 483249 - DNA, 16 bp, R. norvegicus
atttccagcacccaca

SEQ ID NO: 483250 - DNA, 16 bp, R. norvegicus
atttccaggacagcca

SEQ ID NO: 483251 - DNA, 16 bp, R. norvegicus
atttccagtttcatga

SEQ ID NO: 483252 - DNA, 17 bp, R. norvegicus
atttccattacaaatga

SEQ ID NO: 483253 - DNA, 16 bp, R. norvegicus
atttccattcagaaaa

SEQ ID NO: 483254 - DNA, 16 bp, R. norvegicus
atttcccaataaaaaa

SEQ ID NO: 483255 - DNA, 16 bp, R. norvegicus
atttcccagaattcca

SEQ ID NO: 483256 - DNA, 16 bp, R. norvegicus
atttcccagaggcatt

SEQ ID NO: 483257 - DNA, 16 bp, R. norvegicus
atttcccagtgcccat

SEQ ID NO: 483258 - DNA, 16 bp, R. norvegicus
atttccccagaagtcc

SEQ ID NO: 483259 - DNA, 16 bp, R. norvegicus
atttccccagattctg

SEQ ID NO: 483260 - DNA, 16 bp, R. norvegicus
atttccctatgaatat

SEQ ID NO: 483261 - DNA, 16 bp, R. norvegicus
atttccctgatgactt

SEQ ID NO: 483262 - DNA, 16 bp, R. norvegicus
atttcccttcaggaaa

SEQ ID NO: 483263 - DNA, 16 bp, R. norvegicus
atttccctttctcagt

SEQ ID NO: 483264 - DNA, 16 bp, R. norvegicus
atttcccttttcaggt

SEQ ID NO: 483265 - DNA, 16 bp, R. norvegicus
atttcctattttaaaa

SEQ ID NO: 483266 - DNA, 16 bp, R. norvegicus
atttcctcagatgaag

SEQ ID NO: 483267 - DNA, 16 bp, R. norvegicus
atttcctcagctgagg

SEQ ID NO: 483268 - DNA, 16 bp, R. norvegicus
atttcctcaggggagg

SEQ ID NO: 483269 - DNA, 16 bp, R. norvegicus
atttcctccagaattt

SEQ ID NO: 483270 - DNA, 16 bp, R. norvegicus
atttcctcctatgagt

SEQ ID NO: 483271 - DNA, 16 bp, R. norvegicus
atttcctcttctggcc

SEQ ID NO: 483272 - DNA, 16 bp, R. norvegicus
atttcctgaaattctt

SEQ ID NO: 483273 - DNA, 16 bp, R. norvegicus
atttcctgtcttttac

SEQ ID NO: 483274 - DNA, 16 bp, R. norvegicus
atttcctgttctcttt

SEQ ID NO: 483275 - DNA, 16 bp, R. norvegicus
atttccttaatatata

SEQ ID NO: 483276 - DNA, 16 bp, R. norvegicus
atttccttctcctgtt

SEQ ID NO: 483277 - DNA, 16 bp, R. norvegicus
atttccttctgtgaat

SEQ ID NO: 483278 - DNA, 16 bp, R. norvegicus
atttcctttctcctga

SEQ ID NO: 483279 - DNA, 16 bp, R. norvegicus
atttcctttgactgtt

SEQ ID NO: 483280 - DNA, 16 bp, R. norvegicus
atttcctttgattctg

SEQ ID NO: 483281 - DNA, 16 bp, R. norvegicus
atttctaaaaatgaaa

SEQ ID NO: 483282 - DNA, 16 bp, R. norvegicus
atttctaccccaacac

SEQ ID NO: 483283 - DNA, 16 bp, R. norvegicus
atttctagaaaccaaa

SEQ ID NO: 483284 - DNA, 16 bp, R. norvegicus
atttctagtttttaaa

SEQ ID NO: 483285 - DNA, 16 bp, R. norvegicus
atttctattctttcca

SEQ ID NO: 483286 - DNA, 16 bp, R. norvegicus
atttctattgctttga

SEQ ID NO: 483287 - DNA, 16 bp, R. norvegicus
atttctcaaaatgaat

SEQ ID NO: 483288 - DNA, 16 bp, R. norvegicus
atttctcaaagaaata

SEQ ID NO: 483289 - DNA, 16 bp, R. norvegicus
atttctcatgtgcttt

SEQ ID NO: 483290 - DNA, 16 bp, R. norvegicus
atttctcatttaaaaa

SEQ ID NO: 483291 - DNA, 16 bp, R. norvegicus
atttctccagccccat

SEQ ID NO: 483292 - DNA, 16 bp, R. norvegicus
atttctccagctcctg

SEQ ID NO: 483293 - DNA, 16 bp, R. norvegicus
atttctccatgttcta

SEQ ID NO: 483294 - DNA, 16 bp, R. norvegicus
atttctccctgttaaa

SEQ ID NO: 483295 - DNA, 16 bp, R. norvegicus
atttctctaagggatt

SEQ ID NO: 483296 - DNA, 16 bp, R. norvegicus
atttctctatgtagcc

SEQ ID NO: 483297 - DNA, 16 bp, R. norvegicus
atttctctctgctttc

SEQ ID NO: 483298 - DNA, 16 bp, R. norvegicus
atttctcttcagaaaa

SEQ ID NO: 483299 - DNA, 16 bp, R. norvegicus
atttctgagtttgaag

SEQ ID NO: 483300 - DNA, 16 bp, R. norvegicus
atttctgagtttgagg

SEQ ID NO: 483301 - DNA, 16 bp, R. norvegicus
atttctgatcctcctg

SEQ ID NO: 483302 - DNA, 16 bp, R. norvegicus
atttctgatttctttg

SEQ ID NO: 483303 - DNA, 16 bp, R. norvegicus
atttctgcttctttct

SEQ ID NO: 483304 - DNA, 16 bp, R. norvegicus
atttctgcttttgtta

SEQ ID NO: 483305 - DNA, 16 bp, R. norvegicus
atttctggaaatttct

SEQ ID NO: 483306 - DNA, 16 bp, R. norvegicus
atttctgggaaacaga

SEQ ID NO: 483307 - DNA, 17 bp, R. norvegicus
atttctgggtctttaat

SEQ ID NO: 483308 - DNA, 16 bp, R. norvegicus
atttctggttttaaaa

SEQ ID NO: 483309 - DNA, 16 bp, R. norvegicus
atttctgtgccacctt

SEQ ID NO: 483310 - DNA, 16 bp, R. norvegicus
atttctgttcattttc

SEQ ID NO: 483311 - DNA, 16 bp, R. norvegicus
atttctgttttataaa

SEQ ID NO: 483312 - DNA, 16 bp, R. norvegicus
atttcttcaagttttt

SEQ ID NO: 483313 - DNA, 16 bp, R. norvegicus
atttcttcctcagtct

SEQ ID NO: 483314 - DNA, 16 bp, R. norvegicus
atttcttcctggtttt

SEQ ID NO: 483315 - DNA, 16 bp, R. norvegicus
atttcttccttcagaa

SEQ ID NO: 483316 - DNA, 16 bp, R. norvegicus
atttcttcttcagaga

SEQ ID NO: 483317 - DNA, 16 bp, R. norvegicus
atttcttctttgccaa

SEQ ID NO: 483318 - DNA, 16 bp, R. norvegicus
atttcttgggtgaaaa

SEQ ID NO: 483319 - DNA, 16 bp, R. norvegicus
atttcttgtatgcagc

SEQ ID NO: 483320 - DNA, 16 bp, R. norvegicus
atttctttaaaaacat

SEQ ID NO: 483321 - DNA, 16 bp, R. norvegicus
atttctttaaaatgtt

SEQ ID NO: 483322 - DNA, 16 bp, R. norvegicus
atttctttaaagattt

SEQ ID NO: 483323 - DNA, 16 bp, R. norvegicus
atttctttaagtattt

SEQ ID NO: 483324 - DNA, 16 bp, R. norvegicus
atttctttaggaatta

SEQ ID NO: 483325 - DNA, 16 bp, R. norvegicus
atttctttctacaaag

SEQ ID NO: 483326 - DNA, 16 bp, R. norvegicus
atttctttctcaatct

SEQ ID NO: 483327 - DNA, 16 bp, R. norvegicus
atttctttctcagtcc

SEQ ID NO: 483328 - DNA, 16 bp, R. norvegicus
atttctttctctgctc

SEQ ID NO: 483329 - DNA, 16 bp, R. norvegicus
atttctttggaaatga

SEQ ID NO: 483330 - DNA, 16 bp, R. norvegicus
atttcttttagacttt

SEQ ID NO: 483331 - DNA, 16 bp, R. norvegicus
atttcttttattggat

SEQ ID NO: 483332 - DNA, 16 bp, R. norvegicus
atttcttttcagaaaa

SEQ ID NO: 483333 - DNA, 16 bp, R. norvegicus
atttcttttcttcaga

SEQ ID NO: 483334 - DNA, 16 bp, R. norvegicus
atttcttttggaaaaa

SEQ ID NO: 483335 - DNA, 16 bp, R. norvegicus
atttctttttggaggc

SEQ ID NO: 483336 - DNA, 16 bp, R. norvegicus
atttgaaaagaagaag

SEQ ID NO: 483337 - DNA, 16 bp, R. norvegicus
atttgaaaaggaagaa

SEQ ID NO: 483338 - DNA, 16 bp, R. norvegicus
atttgaaaagtgtctt

SEQ ID NO: 483339 - DNA, 16 bp, R. norvegicus
atttgaaaatctacag

SEQ ID NO: 483340 - DNA, 16 bp, R. norvegicus
atttgaaaattcatct

SEQ ID NO: 483341 - DNA, 16 bp, R. norvegicus
atttgaaagagaaaat

SEQ ID NO: 483342 - DNA, 16 bp, R. norvegicus
atttgaaagcacagga

SEQ ID NO: 483343 - DNA, 16 bp, R. norvegicus
atttgaaataacaaaa

SEQ ID NO: 483344 - DNA, 16 bp, R. norvegicus
atttgaaatatagata

SEQ ID NO: 483345 - DNA, 16 bp, R. norvegicus
atttgaaatcacattt

SEQ ID NO: 483346 - DNA, 16 bp, R. norvegicus
atttgaaatgttaata

SEQ ID NO: 483347 - DNA, 16 bp, R. norvegicus
atttgaaatttttctt

SEQ ID NO: 483348 - DNA, 16 bp, R. norvegicus
atttgaacacttagtc

SEQ ID NO: 483349 - DNA, 16 bp, R. norvegicus
atttgaagttcagaaa

SEQ ID NO: 483350 - DNA, 16 bp, R. norvegicus
atttgaagttcttttc

SEQ ID NO: 483351 - DNA, 16 bp, R. norvegicus
atttgaattgtaaata

SEQ ID NO: 483352 - DNA, 16 bp, R. norvegicus
atttgaatttttaaag

SEQ ID NO: 483353 - DNA, 16 bp, R. norvegicus
atttgacaaatatttt

SEQ ID NO: 483354 - DNA, 16 bp, R. norvegicus
atttgacagaatgagt

SEQ ID NO: 483355 - DNA, 16 bp, R. norvegicus
atttgacatgtaaata

SEQ ID NO: 483356 - DNA, 16 bp, R. norvegicus
atttgaccccaaaggg

SEQ ID NO: 483357 - DNA, 16 bp, R. norvegicus
atttgacttttaaatt

SEQ ID NO: 483358 - DNA, 16 bp, R. norvegicus
atttgagaggtggagg

SEQ ID NO: 483359 - DNA, 16 bp, R. norvegicus
atttgaggaaattcaa

SEQ ID NO: 483360 - DNA, 16 bp, R. norvegicus
atttgagtccagcctg

SEQ ID NO: 483361 - DNA, 21 bp, R. norvegicus
atttgatagcttgttggtaag

SEQ ID NO: 483362 - DNA, 16 bp, R. norvegicus
atttgatcccctggaa

SEQ ID NO: 483363 - DNA, 16 bp, R. norvegicus
atttgatgatgatgat

SEQ ID NO: 483364 - DNA, 16 bp, R. norvegicus
atttgatgatgttttg

SEQ ID NO: 483365 - DNA, 16 bp, R. norvegicus
atttgattatgatgat

SEQ ID NO: 483366 - DNA, 16 bp, R. norvegicus
atttgcaaattgccct

SEQ ID NO: 483367 - DNA, 16 bp, R. norvegicus
atttgcagccaccaaa

SEQ ID NO: 483368 - DNA, 16 bp, R. norvegicus
atttgcatcaaactct

SEQ ID NO: 483369 - DNA, 16 bp, R. norvegicus
atttgcattccttaat

SEQ ID NO: 483370 - DNA, 16 bp, R. norvegicus
atttgcatttctgtga

SEQ ID NO: 483371 - DNA, 16 bp, R. norvegicus
atttgcattttcctgg

SEQ ID NO: 483372 - DNA, 16 bp, R. norvegicus
atttgcattttcttta

SEQ ID NO: 483373 - DNA, 16 bp, R. norvegicus
atttgcctctctggag

SEQ ID NO: 483374 - DNA, 16 bp, R. norvegicus
atttgcctctgtgttt

SEQ ID NO: 483375 - DNA, 16 bp, R. norvegicus
atttgcctgtgaattt

SEQ ID NO: 483376 - DNA, 16 bp, R. norvegicus
atttgctataaagaga

SEQ ID NO: 483377 - DNA, 16 bp, R. norvegicus
atttgctcatttgttt

SEQ ID NO: 483378 - DNA, 16 bp, R. norvegicus
atttgctccaaagaaa

SEQ ID NO: 483379 - DNA, 16 bp, R. norvegicus
atttgctgctgttttt

SEQ ID NO: 483380 - DNA, 16 bp, R. norvegicus
atttgctggccagcca

SEQ ID NO: 483381 - DNA, 16 bp, R. norvegicus
atttgctgtcaccaga

SEQ ID NO: 483382 - DNA, 16 bp, R. norvegicus
atttgcttgtttgctt

SEQ ID NO: 483383 - DNA, 16 bp, R. norvegicus
atttgctttatttata

SEQ ID NO: 483384 - DNA, 16 bp, R. norvegicus
atttgcttttgtcatg

SEQ ID NO: 483385 - DNA, 16 bp, R. norvegicus
atttggaaaacagtgg

SEQ ID NO: 483386 - DNA, 16 bp, R. norvegicus
atttggaaagcagagg

SEQ ID NO: 483387 - DNA, 16 bp, R. norvegicus
atttggaaattgttct

SEQ ID NO: 483388 - DNA, 16 bp, R. norvegicus
atttggaagaaagaaa

SEQ ID NO: 483389 - DNA, 16 bp, R. norvegicus
atttggaatataaata

SEQ ID NO: 483390 - DNA, 16 bp, R. norvegicus
atttggaattacaaaa

SEQ ID NO: 483391 - DNA, 16 bp, R. norvegicus
atttggagagaggaaa

SEQ ID NO: 483392 - DNA, 16 bp, R. norvegicus
atttggcactattatg

SEQ ID NO: 483393 - DNA, 16 bp, R. norvegicus
atttggcatcatcaga

SEQ ID NO: 483394 - DNA, 91 bp, R. norvegicus
atttggcatctggccttctattagccaatcaaaggatagatttagttcaagaacaaattgaagcactgtatcatatgacacagctgtcttg

SEQ ID NO: 483395 - DNA, 16 bp, R. norvegicus
atttggcccaaagtca

SEQ ID NO: 483396 - DNA, 16 bp, R. norvegicus
atttgggaagaagaaa

SEQ ID NO: 483397 - DNA, 16 bp, R. norvegicus
atttgggaagaaggaa

SEQ ID NO: 483398 - DNA, 16 bp, R. norvegicus
atttgggccagtcact

SEQ ID NO: 483399 - DNA, 16 bp, R. norvegicus
atttgggtgcatggag

SEQ ID NO: 483400 - DNA, 16 bp, R. norvegicus
atttgggttctgggga

SEQ ID NO: 483401 - DNA, 16 bp, R. norvegicus
atttgggttctttcca

SEQ ID NO: 483402 - DNA, 16 bp, R. norvegicus
atttgggttttcttta

SEQ ID NO: 483403 - DNA, 16 bp, R. norvegicus
atttggttctcagcac

SEQ ID NO: 483404 - DNA, 16 bp, R. norvegicus
atttgtacatatttat

SEQ ID NO: 483405 - DNA, 16 bp, R. norvegicus
atttgtagaccaggct

SEQ ID NO: 483406 - DNA, 16 bp, R. norvegicus
atttgtatgagtgttt

SEQ ID NO: 483407 - DNA, 16 bp, R. norvegicus
atttgtatttcttcct

SEQ ID NO: 483408 - DNA, 16 bp, R. norvegicus
atttgtgaatatttgt

SEQ ID NO: 483409 - DNA, 16 bp, R. norvegicus
atttgtgagcagccag

SEQ ID NO: 483410 - DNA, 16 bp, R. norvegicus
atttgtggaaagatgt

SEQ ID NO: 483411 - DNA, 16 bp, R. norvegicus
atttgtggaaatatat

SEQ ID NO: 483412 - DNA, 16 bp, R. norvegicus
atttgtggcaagttga

SEQ ID NO: 483413 - DNA, 16 bp, R. norvegicus
atttgtggggctgggg

SEQ ID NO: 483414 - DNA, 16 bp, R. norvegicus
atttgtgttcaaggaa

SEQ ID NO: 483415 - DNA, 16 bp, R. norvegicus
atttgttacacacaca

SEQ ID NO: 483416 - DNA, 16 bp, R. norvegicus
atttgttcccttttga

SEQ ID NO: 483417 - DNA, 16 bp, R. norvegicus
atttgttgaaaatact

SEQ ID NO: 483418 - DNA, 16 bp, R. norvegicus
atttgttgaaaatgtt

SEQ ID NO: 483419 - DNA, 16 bp, R. norvegicus
atttgttttaaaggaa

SEQ ID NO: 483420 - DNA, 16 bp, R. norvegicus
atttgttttaggatga

SEQ ID NO: 483421 - DNA, 16 bp, R. norvegicus
atttgttttcttgatg

SEQ ID NO: 483422 - DNA, 16 bp, R. norvegicus
attttaaaaaagtgtt

SEQ ID NO: 483423 - DNA, 16 bp, R. norvegicus
attttaaaaacaagta

SEQ ID NO: 483424 - DNA, 16 bp, R. norvegicus
attttaaaaagagaag

SEQ ID NO: 483425 - DNA, 16 bp, R. norvegicus
attttaaaagcaaaaa

SEQ ID NO: 483426 - DNA, 16 bp, R. norvegicus
attttaaaatgtaaca

SEQ ID NO: 483427 - DNA, 16 bp, R. norvegicus
attttaaaatgtatgt

SEQ ID NO: 483428 - DNA, 16 bp, R. norvegicus
attttaaaatgtgctt

SEQ ID NO: 483429 - DNA, 16 bp, R. norvegicus
attttaaaattcagaa

SEQ ID NO: 483430 - DNA, 16 bp, R. norvegicus
attttaaaattccatt

SEQ ID NO: 483431 - DNA, 16 bp, R. norvegicus
attttaaacaaaagaa

SEQ ID NO: 483432 - DNA, 16 bp, R. norvegicus
attttaaacaaatgtt

SEQ ID NO: 483433 - DNA, 16 bp, R. norvegicus
attttaaagaaattga

SEQ ID NO: 483434 - DNA, 16 bp, R. norvegicus
attttaaagacttatt

SEQ ID NO: 483435 - DNA, 16 bp, R. norvegicus
attttaaatcttgatc

SEQ ID NO: 483436 - DNA, 16 bp, R. norvegicus
attttaaatgaaatga

SEQ ID NO: 483437 - DNA, 16 bp, R. norvegicus
attttaacaaaagtga

SEQ ID NO: 483438 - DNA, 16 bp, R. norvegicus
attttaagaagagaaa

SEQ ID NO: 483439 - DNA, 16 bp, R. norvegicus
attttaagcatttaaa

SEQ ID NO: 483440 - DNA, 16 bp, R. norvegicus
attttaatgaaatgtt

SEQ ID NO: 483441 - DNA, 16 bp, R. norvegicus
attttaatgacatttt

SEQ ID NO: 483442 - DNA, 16 bp, R. norvegicus
attttaattttccaaa

SEQ ID NO: 483443 - DNA, 16 bp, R. norvegicus
attttacagaagagaa

SEQ ID NO: 483444 - DNA, 16 bp, R. norvegicus
attttacattcctcct

SEQ ID NO: 483445 - DNA, 16 bp, R. norvegicus
attttacttaaaatgt

SEQ ID NO: 483446 - DNA, 16 bp, R. norvegicus
attttacttcaaaata

SEQ ID NO: 483447 - DNA, 16 bp, R. norvegicus
attttagccattctga

SEQ ID NO: 483448 - DNA, 16 bp, R. norvegicus
attttagctcctttat

SEQ ID NO: 483449 - DNA, 16 bp, R. norvegicus
attttagtaaggtttc

SEQ ID NO: 483450 - DNA, 16 bp, R. norvegicus
attttagtacattttc

SEQ ID NO: 483451 - DNA, 16 bp, R. norvegicus
attttagtatctttat

SEQ ID NO: 483452 - DNA, 16 bp, R. norvegicus
attttatacaatttgt

SEQ ID NO: 483453 - DNA, 16 bp, R. norvegicus
attttatactgtttgt

SEQ ID NO: 483454 - DNA, 19 bp, R. norvegicus
attttatcaaggcccaggt

SEQ ID NO: 483455 - DNA, 16 bp, R. norvegicus
attttatcacagcaaa

SEQ ID NO: 483456 - DNA, 16 bp, R. norvegicus
attttatcatcatcat

SEQ ID NO: 483457 - DNA, 16 bp, R. norvegicus
attttatgaaggcatt

SEQ ID NO: 483458 - DNA, 16 bp, R. norvegicus
attttatgctgaattt

SEQ ID NO: 483459 - DNA, 16 bp, R. norvegicus
attttatggaaaatat

SEQ ID NO: 483460 - DNA, 16 bp, R. norvegicus
attttatggaacagtt

SEQ ID NO: 483461 - DNA, 16 bp, R. norvegicus
attttattgtacattt

SEQ ID NO: 483462 - DNA, 16 bp, R. norvegicus
attttatttggaaaat

SEQ ID NO: 483463 - DNA, 16 bp, R. norvegicus
attttatttgtttaca

SEQ ID NO: 483464 - DNA, 16 bp, R. norvegicus
attttattttactgaa

SEQ ID NO: 483465 - DNA, 16 bp, R. norvegicus
attttatttttcaaga

SEQ ID NO: 483466 - DNA, 16 bp, R. norvegicus
attttcaaaagctgtt

SEQ ID NO: 483467 - DNA, 16 bp, R. norvegicus
attttcaaactcattt

SEQ ID NO: 483468 - DNA, 16 bp, R. norvegicus
attttcaaatttgttt

SEQ ID NO: 483469 - DNA, 16 bp, R. norvegicus
attttcaacaaatgtt

SEQ ID NO: 483470 - DNA, 16 bp, R. norvegicus
attttcaacaaattgg

SEQ ID NO: 483471 - DNA, 16 bp, R. norvegicus
attttcaactaaaagc

SEQ ID NO: 483472 - DNA, 16 bp, R. norvegicus
attttcaagaaaagaa

SEQ ID NO: 483473 - DNA, 16 bp, R. norvegicus
attttcaagtaaaatt

SEQ ID NO: 483474 - DNA, 16 bp, R. norvegicus
attttcaagttcattt

SEQ ID NO: 483475 - DNA, 16 bp, R. norvegicus
attttcagaaaacaaa

SEQ ID NO: 483476 - DNA, 16 bp, R. norvegicus
attttcagaatatttt

SEQ ID NO: 483477 - DNA, 16 bp, R. norvegicus
attttcagatgaggaa

SEQ ID NO: 483478 - DNA, 16 bp, R. norvegicus
attttcagcaatggtg

SEQ ID NO: 483479 - DNA, 16 bp, R. norvegicus
attttcagctgaggaa

SEQ ID NO: 483480 - DNA, 16 bp, R. norvegicus
attttcaggtcctttg

SEQ ID NO: 483481 - DNA, 16 bp, R. norvegicus
attttcatacaatata

SEQ ID NO: 483482 - DNA, 16 bp, R. norvegicus
attttcatatgttgaa

SEQ ID NO: 483483 - DNA, 16 bp, R. norvegicus
attttcatatttagaa

SEQ ID NO: 483484 - DNA, 16 bp, R. norvegicus
attttcatcatattct

SEQ ID NO: 483485 - DNA, 16 bp, R. norvegicus
attttcatcatggcag

SEQ ID NO: 483486 - DNA, 16 bp, R. norvegicus
attttcattctcctac

SEQ ID NO: 483487 - DNA, 16 bp, R. norvegicus
attttcattggattct

SEQ ID NO: 483488 - DNA, 16 bp, R. norvegicus
attttcatttatgatt

SEQ ID NO: 483489 - DNA, 16 bp, R. norvegicus
attttcatttattgaa

SEQ ID NO: 483490 - DNA, 16 bp, R. norvegicus
attttccaaataaaat

SEQ ID NO: 483491 - DNA, 16 bp, R. norvegicus
attttccagttccagc

SEQ ID NO: 483492 - DNA, 16 bp, R. norvegicus
attttccagttccctc

SEQ ID NO: 483493 - DNA, 16 bp, R. norvegicus
attttccagttccgtc

SEQ ID NO: 483494 - DNA, 16 bp, R. norvegicus
attttccgtatattaa

SEQ ID NO: 483495 - DNA, 16 bp, R. norvegicus
attttcctcatgaata

SEQ ID NO: 483496 - DNA, 16 bp, R. norvegicus
attttcctgaaaatat

SEQ ID NO: 483497 - DNA, 16 bp, R. norvegicus
attttcctgtgtttct

SEQ ID NO: 483498 - DNA, 16 bp, R. norvegicus
attttccttatgaata

SEQ ID NO: 483499 - DNA, 16 bp, R. norvegicus
attttccttttaaaaa

SEQ ID NO: 483500 - DNA, 16 bp, R. norvegicus
attttccttttgaaaa

SEQ ID NO: 483501 - DNA, 16 bp, R. norvegicus
attttctacaaatggt

SEQ ID NO: 483502 - DNA, 16 bp, R. norvegicus
attttctagctctatc

SEQ ID NO: 483503 - DNA, 16 bp, R. norvegicus
attttctataattttg

SEQ ID NO: 483504 - DNA, 16 bp, R. norvegicus
attttctcaaagaccc

SEQ ID NO: 483505 - DNA, 16 bp, R. norvegicus
attttctcaactgaag

SEQ ID NO: 483506 - DNA, 16 bp, R. norvegicus
attttctccatctatg

SEQ ID NO: 483507 - DNA, 16 bp, R. norvegicus
attttctctgtgtctc

SEQ ID NO: 483508 - DNA, 16 bp, R. norvegicus
attttctctttaaaag

SEQ ID NO: 483509 - DNA, 16 bp, R. norvegicus
attttctgaataaaat

SEQ ID NO: 483510 - DNA, 16 bp, R. norvegicus
attttctgaatatttt

SEQ ID NO: 483511 - DNA, 16 bp, R. norvegicus
attttctgaattcatt

SEQ ID NO: 483512 - DNA, 16 bp, R. norvegicus
attttctgaattttat

SEQ ID NO: 483513 - DNA, 16 bp, R. norvegicus
attttctgaggaacag

SEQ ID NO: 483514 - DNA, 16 bp, R. norvegicus
attttctgatttaaaa

SEQ ID NO: 483515 - DNA, 16 bp, R. norvegicus
attttctgcatttctt

SEQ ID NO: 483516 - DNA, 16 bp, R. norvegicus
attttctgctcctgag

SEQ ID NO: 483517 - DNA, 16 bp, R. norvegicus
attttctggaaaaaaa

SEQ ID NO: 483518 - DNA, 16 bp, R. norvegicus
attttctgtatccact

SEQ ID NO: 483519 - DNA, 41 bp, R. norvegicus
attttctgtatccattcctctgttgaagggcatctgggttt

SEQ ID NO: 483520 - DNA, 16 bp, R. norvegicus
attttctgtattcatt

SEQ ID NO: 483521 - DNA, 16 bp, R. norvegicus
attttctgtgtccatt

SEQ ID NO: 483522 - DNA, 16 bp, R. norvegicus
attttctgttctgtat

SEQ ID NO: 483523 - DNA, 16 bp, R. norvegicus
attttcttaaatccta

SEQ ID NO: 483524 - DNA, 16 bp, R. norvegicus
attttcttcaaaaata

SEQ ID NO: 483525 - DNA, 16 bp, R. norvegicus
attttcttcaaattct

SEQ ID NO: 483526 - DNA, 16 bp, R. norvegicus
attttcttctatacct

SEQ ID NO: 483527 - DNA, 16 bp, R. norvegicus
attttcttctatgaat

SEQ ID NO: 483528 - DNA, 16 bp, R. norvegicus
attttcttggaaaaat

SEQ ID NO: 483529 - DNA, 16 bp, R. norvegicus
attttctttatgtaca

SEQ ID NO: 483530 - DNA, 16 bp, R. norvegicus
attttctttctgaaaa

SEQ ID NO: 483531 - DNA, 16 bp, R. norvegicus
attttcttttggaaaa

SEQ ID NO: 483532 - DNA, 16 bp, R. norvegicus
attttgaaaaaacaaa

SEQ ID NO: 483533 - DNA, 16 bp, R. norvegicus
attttgaaaaacaaaa

SEQ ID NO: 483534 - DNA, 16 bp, R. norvegicus
attttgaaaataatgt

SEQ ID NO: 483535 - DNA, 16 bp, R. norvegicus
attttgaaagaaaaga

SEQ ID NO: 483536 - DNA, 16 bp, R. norvegicus
attttgaaaggaaaat

SEQ ID NO: 483537 - DNA, 16 bp, R. norvegicus
attttgaagaaaagaa

SEQ ID NO: 483538 - DNA, 16 bp, R. norvegicus
attttgaaggagaaaa

SEQ ID NO: 483539 - DNA, 16 bp, R. norvegicus
attttgaattttgaaa

SEQ ID NO: 483540 - DNA, 16 bp, R. norvegicus
attttgatggtgatta

SEQ ID NO: 483541 - DNA, 16 bp, R. norvegicus
attttgcaaggctgta

SEQ ID NO: 483542 - DNA, 16 bp, R. norvegicus
attttgcagaagtcca

SEQ ID NO: 483543 - DNA, 16 bp, R. norvegicus
attttgcaggcaaaat

SEQ ID NO: 483544 - DNA, 16 bp, R. norvegicus
attttgcaggcaagtg

SEQ ID NO: 483545 - DNA, 16 bp, R. norvegicus
attttgccagctgcag

SEQ ID NO: 483546 - DNA, 16 bp, R. norvegicus
attttgcccacatgta

SEQ ID NO: 483547 - DNA, 16 bp, R. norvegicus
attttgctcatttcct

SEQ ID NO: 483548 - DNA, 16 bp, R. norvegicus
attttgctcattttga

SEQ ID NO: 483549 - DNA, 16 bp, R. norvegicus
attttgctgaaagtgt

SEQ ID NO: 483550 - DNA, 16 bp, R. norvegicus
attttgctgctgctgc

SEQ ID NO: 483551 - DNA, 21 bp, R. norvegicus
attttgcttgggagcaaggaa

SEQ ID NO: 483552 - DNA, 16 bp, R. norvegicus
attttgcttttaaaat

SEQ ID NO: 483553 - DNA, 16 bp, R. norvegicus
attttgcttttactat

SEQ ID NO: 483554 - DNA, 16 bp, R. norvegicus
attttgctttttaaaa

SEQ ID NO: 483555 - DNA, 16 bp, R. norvegicus
attttggactaaagtc

SEQ ID NO: 483556 - DNA, 16 bp, R. norvegicus
attttggagaaagtaa

SEQ ID NO: 483557 - DNA, 16 bp, R. norvegicus
attttggagaaggtat

SEQ ID NO: 483558 - DNA, 16 bp, R. norvegicus
attttggctcacagtt

SEQ ID NO: 483559 - DNA, 16 bp, R. norvegicus
attttggctcctggtt

SEQ ID NO: 483560 - DNA, 16 bp, R. norvegicus
attttggctgtgtctc

SEQ ID NO: 483561 - DNA, 16 bp, R. norvegicus
attttggtcatgcttc

SEQ ID NO: 483562 - DNA, 16 bp, R. norvegicus
attttggtcattcttc

SEQ ID NO: 483563 - DNA, 16 bp, R. norvegicus
attttggttgctactt

SEQ ID NO: 483564 - DNA, 16 bp, R. norvegicus
attttggtttacagtt

SEQ ID NO: 483565 - DNA, 16 bp, R. norvegicus
attttgtatgtatgta

SEQ ID NO: 483566 - DNA, 16 bp, R. norvegicus
attttgtctttgtgct

SEQ ID NO: 483567 - DNA, 16 bp, R. norvegicus
attttgtgaaatgctt

SEQ ID NO: 483568 - DNA, 16 bp, R. norvegicus
attttgtgcatttgct

SEQ ID NO: 483569 - DNA, 16 bp, R. norvegicus
attttgtggagtattt

SEQ ID NO: 483570 - DNA, 16 bp, R. norvegicus
attttgttctctggtt

SEQ ID NO: 483571 - DNA, 16 bp, R. norvegicus
attttgtttaaaagaa

SEQ ID NO: 483572 - DNA, 16 bp, R. norvegicus
attttgttttaggatg

SEQ ID NO: 483573 - DNA, 16 bp, R. norvegicus
attttgtttttcagat

SEQ ID NO: 483574 - DNA, 16 bp, R. norvegicus
atttttaaaaagtctt

SEQ ID NO: 483575 - DNA, 16 bp, R. norvegicus
atttttaaaaagttga

SEQ ID NO: 483576 - DNA, 16 bp, R. norvegicus
atttttaaaaattcca

SEQ ID NO: 483577 - DNA, 16 bp, R. norvegicus
atttttaaaacatcat

SEQ ID NO: 483578 - DNA, 16 bp, R. norvegicus
atttttaaaagcaaaa

SEQ ID NO: 483579 - DNA, 16 bp, R. norvegicus
atttttaaaagtctgt

SEQ ID NO: 483580 - DNA, 16 bp, R. norvegicus
atttttaaaagtgatt

SEQ ID NO: 483581 - DNA, 16 bp, R. norvegicus
atttttaaaatcagat

SEQ ID NO: 483582 - DNA, 16 bp, R. norvegicus
atttttaaagaagcat

SEQ ID NO: 483583 - DNA, 16 bp, R. norvegicus
atttttaaagcatagt

SEQ ID NO: 483584 - DNA, 16 bp, R. norvegicus
atttttaaagcatttt

SEQ ID NO: 483585 - DNA, 16 bp, R. norvegicus
atttttaaaggaaaat

SEQ ID NO: 483586 - DNA, 16 bp, R. norvegicus
atttttaaaggtaaaa

SEQ ID NO: 483587 - DNA, 16 bp, R. norvegicus
atttttaaatggtaaa

SEQ ID NO: 483588 - DNA, 16 bp, R. norvegicus
atttttaacaatgaaa

SEQ ID NO: 483589 - DNA, 16 bp, R. norvegicus
atttttaccatgaagg

SEQ ID NO: 483590 - DNA, 16 bp, R. norvegicus
atttttactgtgttaa

SEQ ID NO: 483591 - DNA, 16 bp, R. norvegicus
atttttatgtgaaaat

SEQ ID NO: 483592 - DNA, 16 bp, R. norvegicus
atttttattcaaacta

SEQ ID NO: 483593 - DNA, 16 bp, R. norvegicus
atttttattcaaatca

SEQ ID NO: 483594 - DNA, 16 bp, R. norvegicus
atttttattgctactt

SEQ ID NO: 483595 - DNA, 16 bp, R. norvegicus
atttttatttattcag

SEQ ID NO: 483596 - DNA, 16 bp, R. norvegicus
atttttatttctgaaa

SEQ ID NO: 483597 - DNA, 16 bp, R. norvegicus
atttttattttacatg

SEQ ID NO: 483598 - DNA, 16 bp, R. norvegicus
atttttcaaacaaatg

SEQ ID NO: 483599 - DNA, 16 bp, R. norvegicus
atttttcaagaaaaaa

SEQ ID NO: 483600 - DNA, 16 bp, R. norvegicus
atttttcaataaagaa

SEQ ID NO: 483601 - DNA, 16 bp, R. norvegicus
atttttctgatggcta

SEQ ID NO: 483602 - DNA, 16 bp, R. norvegicus
atttttctgtgtcctt

SEQ ID NO: 483603 - DNA, 16 bp, R. norvegicus
atttttctgttgaagg

SEQ ID NO: 483604 - DNA, 16 bp, R. norvegicus
atttttcttaaagaac

SEQ ID NO: 483605 - DNA, 16 bp, R. norvegicus
atttttctttaaatgt

SEQ ID NO: 483606 - DNA, 16 bp, R. norvegicus
atttttctttgtaaaa

SEQ ID NO: 483607 - DNA, 16 bp, R. norvegicus
atttttgaaaaataca

SEQ ID NO: 483608 - DNA, 16 bp, R. norvegicus
atttttgaagaaaaat

SEQ ID NO: 483609 - DNA, 16 bp, R. norvegicus
atttttgacttcttct

SEQ ID NO: 483610 - DNA, 16 bp, R. norvegicus
atttttgataaagaag

SEQ ID NO: 483611 - DNA, 16 bp, R. norvegicus
atttttgatgaagaag

SEQ ID NO: 483612 - DNA, 16 bp, R. norvegicus
atttttgcatatgtat

SEQ ID NO: 483613 - DNA, 16 bp, R. norvegicus
atttttggagacagaa

SEQ ID NO: 483614 - DNA, 16 bp, R. norvegicus
atttttgtaattcctc

SEQ ID NO: 483615 - DNA, 16 bp, R. norvegicus
atttttgtctcagaaa

SEQ ID NO: 483616 - DNA, 16 bp, R. norvegicus
atttttgttttcaaat

SEQ ID NO: 483617 - DNA, 16 bp, R. norvegicus
atttttgttttcatga

SEQ ID NO: 483618 - DNA, 16 bp, R. norvegicus
attttttaaaagagaa

SEQ ID NO: 483619 - DNA, 16 bp, R. norvegicus
attttttaagacaagg

SEQ ID NO: 483620 - DNA, 16 bp, R. norvegicus
attttttccaaagaaa

SEQ ID NO: 483621 - DNA, 16 bp, R. norvegicus
attttttctgctggcc

SEQ ID NO: 483622 - DNA, 16 bp, R. norvegicus
attttttgagacaagt

SEQ ID NO: 483623 - DNA, 16 bp, R. norvegicus
atttttttaaaaagca

SEQ ID NO: 483624 - DNA, 16 bp, R. norvegicus
atttttttaaatcagt

SEQ ID NO: 483625 - DNA, 16 bp, R. norvegicus
atttttttaaatgtct

SEQ ID NO: 483626 - DNA, 16 bp, R. norvegicus
atttttttacagtcca

SEQ ID NO: 483627 - DNA, 16 bp, R. norvegicus
atttttttctcagaaa

SEQ ID NO: 483628 - DNA, 16 bp, R. norvegicus
atttttttctctcaaa

SEQ ID NO: 483629 - DNA, 16 bp, R. norvegicus
atttttttcttcacag

SEQ ID NO: 483630 - DNA, 16 bp, R. norvegicus
atttttttggaaaaaa

SEQ ID NO: 483631 - DNA, 19 bp, R. norvegicus
caaaaaaagagatacccat

SEQ ID NO: 483632 - DNA, 16 bp, R. norvegicus
caaaaaaggaaaaggt

SEQ ID NO: 483633 - DNA, 16 bp, R. norvegicus
caaaaacaacgaattt

SEQ ID NO: 483634 - DNA, 16 bp, R. norvegicus
caaaaacaatttacag

SEQ ID NO: 483635 - DNA, 16 bp, R. norvegicus
caaaaacagatacaga

SEQ ID NO: 483636 - DNA, 16 bp, R. norvegicus
caaaaacatatttgat

SEQ ID NO: 483637 - DNA, 16 bp, R. norvegicus
caaaaacatcattcac

SEQ ID NO: 483638 - DNA, 16 bp, R. norvegicus
caaaaacctccacata

SEQ ID NO: 483639 - DNA, 16 bp, R. norvegicus
caaaaaccttctggtg

SEQ ID NO: 483640 - DNA, 16 bp, R. norvegicus
caaaaactacacatgg

SEQ ID NO: 483641 - DNA, 16 bp, R. norvegicus
caaaaactcagctgac

SEQ ID NO: 483642 - DNA, 16 bp, R. norvegicus
caaaaactctcaatta

SEQ ID NO: 483643 - DNA, 16 bp, R. norvegicus
caaaaactgaagcaga

SEQ ID NO: 483644 - DNA, 16 bp, R. norvegicus
caaaaactggagcaga

SEQ ID NO: 483645 - DNA, 16 bp, R. norvegicus
caaaaagaaatgcagg

SEQ ID NO: 483646 - DNA, 16 bp, R. norvegicus
caaaaagagatcaaga

SEQ ID NO: 483647 - DNA, 16 bp, R. norvegicus
caaaaagagcccgggt

SEQ ID NO: 483648 - DNA, 16 bp, R. norvegicus
caaaaagattggaatt

SEQ ID NO: 483649 - DNA, 16 bp, R. norvegicus
caaaaagcatacagaa

SEQ ID NO: 483650 - DNA, 16 bp, R. norvegicus
caaaaaggactataga

SEQ ID NO: 483651 - DNA, 16 bp, R. norvegicus
caaaaatacagaatac

SEQ ID NO: 483652 - DNA, 16 bp, R. norvegicus
caaaaatagacaaatg

SEQ ID NO: 483653 - DNA, 16 bp, R. norvegicus
caaaaatatcatccac

SEQ ID NO: 483654 - DNA, 16 bp, R. norvegicus
caaaaatattcacatt

SEQ ID NO: 483655 - DNA, 16 bp, R. norvegicus
caaaaatcaagtgtct

SEQ ID NO: 483656 - DNA, 16 bp, R. norvegicus
caaaaatccctcaaag

SEQ ID NO: 483657 - DNA, 16 bp, R. norvegicus
caaaaatgacaggaag

SEQ ID NO: 483658 - DNA, 17 bp, R. norvegicus
caaaaatgattttggaa

SEQ ID NO: 483659 - DNA, 16 bp, R. norvegicus
caaaaatggagaagac

SEQ ID NO: 483660 - DNA, 16 bp, R. norvegicus
caaaaatggagaagag

SEQ ID NO: 483661 - DNA, 16 bp, R. norvegicus
caaaaatttcaccaga

SEQ ID NO: 483662 - DNA, 16 bp, R. norvegicus
caaaaattttaccaga

SEQ ID NO: 483663 - DNA, 16 bp, R. norvegicus
caaaacaaacctttcc

SEQ ID NO: 483664 - DNA, 16 bp, R. norvegicus
caaaacacactggaaa

SEQ ID NO: 483665 - DNA, 16 bp, R. norvegicus
caaaacacccatgcac

SEQ ID NO: 483666 - DNA, 16 bp, R. norvegicus
caaaacagacttcaac

SEQ ID NO: 483667 - DNA, 16 bp, R. norvegicus
caaaacagagttctcc

SEQ ID NO: 483668 - DNA, 16 bp, R. norvegicus
caaaacagcagcctat

SEQ ID NO: 483669 - DNA, 16 bp, R. norvegicus
caaaacagtgtcttct

SEQ ID NO: 483670 - DNA, 16 bp, R. norvegicus
caaaacatcatcagat

SEQ ID NO: 483671 - DNA, 16 bp, R. norvegicus
caaaaccaccctgaga

SEQ ID NO: 483672 - DNA, 16 bp, R. norvegicus
caaaaccagtgccacc

SEQ ID NO: 483673 - DNA, 16 bp, R. norvegicus
caaaacccagaggaag

SEQ ID NO: 483674 - DNA, 24 bp, R. norvegicus
caaaacctattcaggtatattatc

SEQ ID NO: 483675 - DNA, 24 bp, R. norvegicus
caaaacctctttggcgaatggtcc

SEQ ID NO: 483676 - DNA, 16 bp, R. norvegicus
caaaacctgcctggag

SEQ ID NO: 483677 - DNA, 16 bp, R. norvegicus
caaaactaccagccca

SEQ ID NO: 483678 - DNA, 16 bp, R. norvegicus
caaaactagacagtat

SEQ ID NO: 483679 - DNA, 16 bp, R. norvegicus
caaaactcaaattacc

SEQ ID NO: 483680 - DNA, 17 bp, R. norvegicus
caaaactctcacttaac

SEQ ID NO: 483681 - DNA, 17 bp, R. norvegicus
caaaactgccaacagcc

SEQ ID NO: 483682 - DNA, 16 bp, R. norvegicus
caaaactggaaaattt

SEQ ID NO: 483683 - DNA, 16 bp, R. norvegicus
caaaactgtaaataaa

SEQ ID NO: 483684 - DNA, 16 bp, R. norvegicus
caaaacttctgaccca

SEQ ID NO: 483685 - DNA, 16 bp, R. norvegicus
caaaagaaaatgcagg

SEQ ID NO: 483686 - DNA, 16 bp, R. norvegicus
caaaagaaactcaaga

SEQ ID NO: 483687 - DNA, 16 bp, R. norvegicus
caaaagaaagagaact

SEQ ID NO: 483688 - DNA, 16 bp, R. norvegicus
caaaagaacacagatg

SEQ ID NO: 483689 - DNA, 16 bp, R. norvegicus
caaaagaagatagcca

SEQ ID NO: 483690 - DNA, 16 bp, R. norvegicus
caaaagaaggtcaagg

SEQ ID NO: 483691 - DNA, 16 bp, R. norvegicus
caaaagaatattcctt

SEQ ID NO: 483692 - DNA, 16 bp, R. norvegicus
caaaagaattcagaga

SEQ ID NO: 483693 - DNA, 16 bp, R. norvegicus
caaaagagagacacac

SEQ ID NO: 483694 - DNA, 16 bp, R. norvegicus
caaaagatattccaac

SEQ ID NO: 483695 - DNA, 16 bp, R. norvegicus
caaaagatgctggtga

SEQ ID NO: 483696 - DNA, 17 bp, R. norvegicus
caaaagatgtcccaaca

SEQ ID NO: 483697 - DNA, 16 bp, R. norvegicus
caaaagcaacttatag

SEQ ID NO: 483698 - DNA, 16 bp, R. norvegicus
caaaagcaatcttcag

SEQ ID NO: 483699 - DNA, 16 bp, R. norvegicus
caaaagcagcagcagc

SEQ ID NO: 483700 - DNA, 16 bp, R. norvegicus
caaaagcagccccaca

SEQ ID NO: 483701 - DNA, 16 bp, R. norvegicus
caaaagcaggagctgg

SEQ ID NO: 483702 - DNA, 16 bp, R. norvegicus
caaaagctgtggaaaa

SEQ ID NO: 483703 - DNA, 16 bp, R. norvegicus
caaaagctgttctctg

SEQ ID NO: 483704 - DNA, 16 bp, R. norvegicus
caaaagctttcttctt

SEQ ID NO: 483705 - DNA, 94 bp, R. norvegicus
caaaaggacttcagggggaatcactatccctgaactcaagcagtattacagagcaatagtgataaaaactgcatggtattggtacagagacaga

SEQ ID NO: 483706 - DNA, 16 bp, R. norvegicus
caaaaggctggaaaac

SEQ ID NO: 483707 - DNA, 16 bp, R. norvegicus
caaaaggtgaatgctt

SEQ ID NO: 483708 - DNA, 16 bp, R. norvegicus
caaaaggtgactgaga

SEQ ID NO: 483709 - DNA, 16 bp, R. norvegicus
caaaagtaggtagaaa

SEQ ID NO: 483710 - DNA, 16 bp, R. norvegicus
caaaagtgacctacag

SEQ ID NO: 483711 - DNA, 16 bp, R. norvegicus
caaaagtgatctatag

SEQ ID NO: 483712 - DNA, 16 bp, R. norvegicus
caaaagttatctaaaa

SEQ ID NO: 483713 - DNA, 16 bp, R. norvegicus
caaaagttatgaaaaa

SEQ ID NO: 483714 - DNA, 16 bp, R. norvegicus
caaaagttattaaaaa

SEQ ID NO: 483715 - DNA, 16 bp, R. norvegicus
caaaataaaagcaatt

SEQ ID NO: 483716 - DNA, 16 bp, R. norvegicus
caaaataaatatttct

SEQ ID NO: 483717 - DNA, 16 bp, R. norvegicus
caaaataaatggaaag

SEQ ID NO: 483718 - DNA, 16 bp, R. norvegicus
caaaataattttatga

SEQ ID NO: 483719 - DNA, 16 bp, R. norvegicus
caaaatacaagagatg

SEQ ID NO: 483720 - DNA, 16 bp, R. norvegicus
caaaatacagaaggaa

SEQ ID NO: 483721 - DNA, 16 bp, R. norvegicus
caaaatacattgtatt

SEQ ID NO: 483722 - DNA, 16 bp, R. norvegicus
caaaatacccaggaaa

SEQ ID NO: 483723 - DNA, 16 bp, R. norvegicus
caaaatactcatacat

SEQ ID NO: 483724 - DNA, 16 bp, R. norvegicus
caaaatagaaacagag

SEQ ID NO: 483725 - DNA, 16 bp, R. norvegicus
caaaatatacaaagga

SEQ ID NO: 483726 - DNA, 16 bp, R. norvegicus
caaaatatacagagaa

SEQ ID NO: 483727 - DNA, 16 bp, R. norvegicus
caaaatataccaagaa

SEQ ID NO: 483728 - DNA, 16 bp, R. norvegicus
caaaatatcactatat

SEQ ID NO: 483729 - DNA, 16 bp, R. norvegicus
caaaatatctgctaga

SEQ ID NO: 483730 - DNA, 16 bp, R. norvegicus
caaaatatttgttttt

SEQ ID NO: 483731 - DNA, 16 bp, R. norvegicus
caaaatcaggaatgaa

SEQ ID NO: 483732 - DNA, 49 bp, R. norvegicus
caaaatcatttttgatcatgatgctggaggacttcaagaaagacatgaa

SEQ ID NO: 483733 - DNA, 16 bp, R. norvegicus
caaaatctggaaagaa

SEQ ID NO: 483734 - DNA, 16 bp, R. norvegicus
caaaatgaaacaggag

SEQ ID NO: 483735 - DNA, 16 bp, R. norvegicus
caaaatgacaaccaag

SEQ ID NO: 483736 - DNA, 16 bp, R. norvegicus
caaaatgagagagaga

SEQ ID NO: 483737 - DNA, 16 bp, R. norvegicus
caaaatgagtcagaga

SEQ ID NO: 483738 - DNA, 16 bp, R. norvegicus
caaaatgatatttgat

SEQ ID NO: 483739 - DNA, 16 bp, R. norvegicus
caaaatgattttgaaa

SEQ ID NO: 483740 - DNA, 16 bp, R. norvegicus
caaaatgccttacagc

SEQ ID NO: 483741 - DNA, 16 bp, R. norvegicus
caaaatgctgagttct

SEQ ID NO: 483742 - DNA, 16 bp, R. norvegicus
caaaatggcagccaac

SEQ ID NO: 483743 - DNA, 16 bp, R. norvegicus
caaaatggctgcagct

SEQ ID NO: 483744 - DNA, 16 bp, R. norvegicus
caaaatgggaaaatct

SEQ ID NO: 483745 - DNA, 16 bp, R. norvegicus
caaaatgtacagaata

SEQ ID NO: 483746 - DNA, 16 bp, R. norvegicus
caaaatgtataaagaa

SEQ ID NO: 483747 - DNA, 16 bp, R. norvegicus
caaaatgtccacacaa

SEQ ID NO: 483748 - DNA, 16 bp, R. norvegicus
caaaatgtgaatgcat

SEQ ID NO: 483749 - DNA, 16 bp, R. norvegicus
caaaattaaatcaaga

SEQ ID NO: 483750 - DNA, 16 bp, R. norvegicus
caaaattaataaagat

SEQ ID NO: 483751 - DNA, 16 bp, R. norvegicus
caaaattccaagtcaa

SEQ ID NO: 483752 - DNA, 16 bp, R. norvegicus
caaaatttgaaattaa

SEQ ID NO: 483753 - DNA, 16 bp, R. norvegicus
caaacaaaaaacagct

SEQ ID NO: 483754 - DNA, 16 bp, R. norvegicus
caaacaaaagcatagt

SEQ ID NO: 483755 - DNA, 16 bp, R. norvegicus
caaacaacactgagat

SEQ ID NO: 483756 - DNA, 16 bp, R. norvegicus
caaacaaggaagacag

SEQ ID NO: 483757 - DNA, 16 bp, R. norvegicus
caaacaaggtggaaga

SEQ ID NO: 483758 - DNA, 16 bp, R. norvegicus
caaacaagtgaaagac

SEQ ID NO: 483759 - DNA, 16 bp, R. norvegicus
caaacaagtgaaatat

SEQ ID NO: 483760 - DNA, 16 bp, R. norvegicus
caaacaatagtttaaa

SEQ ID NO: 483761 - DNA, 16 bp, R. norvegicus
caaacacaaggagaga

SEQ ID NO: 483762 - DNA, 16 bp, R. norvegicus
caaacacagaggtgaa

SEQ ID NO: 483763 - DNA, 16 bp, R. norvegicus
caaacacagatacaca

SEQ ID NO: 483764 - DNA, 16 bp, R. norvegicus
caaacacataaaggaa

SEQ ID NO: 483765 - DNA, 16 bp, R. norvegicus
caaacacatgaaagaa

SEQ ID NO: 483766 - DNA, 16 bp, R. norvegicus
caaacacatgcacact

SEQ ID NO: 483767 - DNA, 16 bp, R. norvegicus
caaacacatgcacgca

SEQ ID NO: 483768 - DNA, 16 bp, R. norvegicus
caaacaccaggtggaa

SEQ ID NO: 483769 - DNA, 16 bp, R. norvegicus
caaacaccgtgggaga

SEQ ID NO: 483770 - DNA, 16 bp, R. norvegicus
caaacaccttcagttc

SEQ ID NO: 483771 - DNA, 16 bp, R. norvegicus
caaacaccttggccat

SEQ ID NO: 483772 - DNA, 16 bp, R. norvegicus
caaacactctaccact

SEQ ID NO: 483773 - DNA, 16 bp, R. norvegicus
caaacagaaaggtcag

SEQ ID NO: 483774 - DNA, 16 bp, R. norvegicus
caaacagataaaggaa

SEQ ID NO: 483775 - DNA, 16 bp, R. norvegicus
caaacagattccatga

SEQ ID NO: 483776 - DNA, 16 bp, R. norvegicus
caaacagcaaaggcca

SEQ ID NO: 483777 - DNA, 16 bp, R. norvegicus
caaacagctcccctgg

SEQ ID NO: 483778 - DNA, 16 bp, R. norvegicus
caaacagctgaaggaa

SEQ ID NO: 483779 - DNA, 16 bp, R. norvegicus
caaacaggaggacctg

SEQ ID NO: 483780 - DNA, 16 bp, R. norvegicus
caaacaggcaaaggaa

SEQ ID NO: 483781 - DNA, 16 bp, R. norvegicus
caaacaggcaggcaga

SEQ ID NO: 483782 - DNA, 16 bp, R. norvegicus
caaacaggtgaacaaa

SEQ ID NO: 483783 - DNA, 16 bp, R. norvegicus
caaacagtaacaacaa

SEQ ID NO: 483784 - DNA, 16 bp, R. norvegicus
caaacagtggatggag

SEQ ID NO: 483785 - DNA, 16 bp, R. norvegicus
caaacagttccaacaa

SEQ ID NO: 483786 - DNA, 16 bp, R. norvegicus
caaacatatctctcag

SEQ ID NO: 483787 - DNA, 16 bp, R. norvegicus
caaacatatttcttct

SEQ ID NO: 483788 - DNA, 16 bp, R. norvegicus
caaacatcaacaacag

SEQ ID NO: 483789 - DNA, 16 bp, R. norvegicus
caaacatcatctggaa

SEQ ID NO: 483790 - DNA, 16 bp, R. norvegicus
caaacatccccttccc

SEQ ID NO: 483791 - DNA, 16 bp, R. norvegicus
caaacatgaaattctt

SEQ ID NO: 483792 - DNA, 16 bp, R. norvegicus
caaacatgaagacctg

SEQ ID NO: 483793 - DNA, 16 bp, R. norvegicus
caaacatgagcctcgg

SEQ ID NO: 483794 - DNA, 16 bp, R. norvegicus
caaacattagatggag

SEQ ID NO: 483795 - DNA, 16 bp, R. norvegicus
caaaccaccacagctg

SEQ ID NO: 483796 - DNA, 16 bp, R. norvegicus
caaaccaccacagctt

SEQ ID NO: 483797 - DNA, 16 bp, R. norvegicus
caaaccaccacatctg

SEQ ID NO: 483798 - DNA, 16 bp, R. norvegicus
caaacccaagtcttct

SEQ ID NO: 483799 - DNA, 16 bp, R. norvegicus
caaacccactaaaatc

SEQ ID NO: 483800 - DNA, 16 bp, R. norvegicus
caaacccagatcctct

SEQ ID NO: 483801 - DNA, 16 bp, R. norvegicus
caaacccagggcttct

SEQ ID NO: 483802 - DNA, 16 bp, R. norvegicus
caaacccatctggtcc

SEQ ID NO: 483803 - DNA, 16 bp, R. norvegicus
caaacctaaggacaat

SEQ ID NO: 483804 - DNA, 16 bp, R. norvegicus
caaacctaggtcttct

SEQ ID NO: 483805 - DNA, 16 bp, R. norvegicus
caaacctctgggcatg

SEQ ID NO: 483806 - DNA, 16 bp, R. norvegicus
caaacctgacaacctg

SEQ ID NO: 483807 - DNA, 16 bp, R. norvegicus
caaacctgcaccccca

SEQ ID NO: 483808 - DNA, 16 bp, R. norvegicus
caaaccttccagctcc

SEQ ID NO: 483809 - DNA, 16 bp, R. norvegicus
caaactaattgaagaa

SEQ ID NO: 483810 - DNA, 16 bp, R. norvegicus
caaactagacaagatg

SEQ ID NO: 483811 - DNA, 16 bp, R. norvegicus
caaactattacacaaa

SEQ ID NO: 483812 - DNA, 16 bp, R. norvegicus
caaactattagaagaa

SEQ ID NO: 483813 - DNA, 16 bp, R. norvegicus
caaactcaaaggggga

SEQ ID NO: 483814 - DNA, 16 bp, R. norvegicus
caaactcacagagctc

SEQ ID NO: 483815 - DNA, 16 bp, R. norvegicus
caaactcagagagatc

SEQ ID NO: 483816 - DNA, 16 bp, R. norvegicus
caaactcagagatcaa

SEQ ID NO: 483817 - DNA, 16 bp, R. norvegicus
caaactcagatatctg

SEQ ID NO: 483818 - DNA, 16 bp, R. norvegicus
caaactcagatcttca

SEQ ID NO: 483819 - DNA, 16 bp, R. norvegicus
caaactcaggtccttg

SEQ ID NO: 483820 - DNA, 16 bp, R. norvegicus
caaactcaggtctcca

SEQ ID NO: 483821 - DNA, 16 bp, R. norvegicus
caaactcagttcttca

SEQ ID NO: 483822 - DNA, 16 bp, R. norvegicus
caaactccaaactctg

SEQ ID NO: 483823 - DNA, 16 bp, R. norvegicus
caaactccagactctg

SEQ ID NO: 483824 - DNA, 16 bp, R. norvegicus
caaactcctctccaaa

SEQ ID NO: 483825 - DNA, 16 bp, R. norvegicus
caaactctgtgtgtgt

SEQ ID NO: 483826 - DNA, 16 bp, R. norvegicus
caaactgaaacactgt

SEQ ID NO: 483827 - DNA, 16 bp, R. norvegicus
caaactgaacaagcca

SEQ ID NO: 483828 - DNA, 16 bp, R. norvegicus
caaactgaagaggaaa

SEQ ID NO: 483829 - DNA, 16 bp, R. norvegicus
caaactgagaaagaaa

SEQ ID NO: 483830 - DNA, 16 bp, R. norvegicus
caaactgagcaagcca

SEQ ID NO: 483831 - DNA, 16 bp, R. norvegicus
caaactgagggaaatc

SEQ ID NO: 483832 - DNA, 16 bp, R. norvegicus
caaactgcttcagctc

SEQ ID NO: 483833 - DNA, 16 bp, R. norvegicus
caaactggaaaatctg

SEQ ID NO: 483834 - DNA, 16 bp, R. norvegicus
caaactggaagaaaaa

SEQ ID NO: 483835 - DNA, 16 bp, R. norvegicus
caaactggaagataaa

SEQ ID NO: 483836 - DNA, 16 bp, R. norvegicus
caaactgtgaagaact

SEQ ID NO: 483837 - DNA, 16 bp, R. norvegicus
caaacttaaaaagcta

SEQ ID NO: 483838 - DNA, 16 bp, R. norvegicus
caaacttacaaagatc

SEQ ID NO: 483839 - DNA, 48 bp, R. norvegicus
caaacttatgggacacaatgaaagctgtgctaagaggaaaactcatag

SEQ ID NO: 483840 - DNA, 16 bp, R. norvegicus
caaacttccctaacct

SEQ ID NO: 483841 - DNA, 16 bp, R. norvegicus
caaacttctacagcaa

SEQ ID NO: 483842 - DNA, 16 bp, R. norvegicus
caaacttctttcttct

SEQ ID NO: 483843 - DNA, 16 bp, R. norvegicus
caaacttgcccccaag

SEQ ID NO: 483844 - DNA, 16 bp, R. norvegicus
caaactttattaaaat

SEQ ID NO: 483845 - DNA, 16 bp, R. norvegicus
caaagaaaaaatctac

SEQ ID NO: 483846 - DNA, 16 bp, R. norvegicus
caaagaaaacctaata

SEQ ID NO: 483847 - DNA, 16 bp, R. norvegicus
caaagaaaactttaaa

SEQ ID NO: 483848 - DNA, 16 bp, R. norvegicus
caaagaaaagtttcct

SEQ ID NO: 483849 - DNA, 16 bp, R. norvegicus
caaagaaaatgaaatt

SEQ ID NO: 483850 - DNA, 16 bp, R. norvegicus
caaagaaaatgttaaa

SEQ ID NO: 483851 - DNA, 16 bp, R. norvegicus
caaagaaagaaacttc

SEQ ID NO: 483852 - DNA, 16 bp, R. norvegicus
caaagaaagacaactt

SEQ ID NO: 483853 - DNA, 16 bp, R. norvegicus
caaagaaagagaatat

SEQ ID NO: 483854 - DNA, 16 bp, R. norvegicus
caaagaaagatattaa

SEQ ID NO: 483855 - DNA, 16 bp, R. norvegicus
caaagaaaggagcctc

SEQ ID NO: 483856 - DNA, 16 bp, R. norvegicus
caaagaaagtcagaaa

SEQ ID NO: 483857 - DNA, 16 bp, R. norvegicus
caaagaaagtcaggac

SEQ ID NO: 483858 - DNA, 16 bp, R. norvegicus
caaagaaataaaactt

SEQ ID NO: 483859 - DNA, 16 bp, R. norvegicus
caaagaacacattcct

SEQ ID NO: 483860 - DNA, 16 bp, R. norvegicus
caaagaacagaagctg

SEQ ID NO: 483861 - DNA, 16 bp, R. norvegicus
caaagaaccagcattt

SEQ ID NO: 483862 - DNA, 16 bp, R. norvegicus
caaagaaccagctcct

SEQ ID NO: 483863 - DNA, 16 bp, R. norvegicus
caaagaacctgaaaat

SEQ ID NO: 483864 - DNA, 16 bp, R. norvegicus
caaagaactcaagaaa

SEQ ID NO: 483865 - DNA, 16 bp, R. norvegicus
caaagaactcaagcag

SEQ ID NO: 483866 - DNA, 16 bp, R. norvegicus
caaagaactgtaggca

SEQ ID NO: 483867 - DNA, 16 bp, R. norvegicus
caaagaagaagtcaag

SEQ ID NO: 483868 - DNA, 16 bp, R. norvegicus
caaagaagacctaaca

SEQ ID NO: 483869 - DNA, 16 bp, R. norvegicus
caaagaagatgatgag

SEQ ID NO: 483870 - DNA, 16 bp, R. norvegicus
caaagaagctgaggct

SEQ ID NO: 483871 - DNA, 16 bp, R. norvegicus
caaagaaggagcagag

SEQ ID NO: 483872 - DNA, 16 bp, R. norvegicus
caaagaagtacaggca

SEQ ID NO: 483873 - DNA, 16 bp, R. norvegicus
caaagaagtcaaataa

SEQ ID NO: 483874 - DNA, 16 bp, R. norvegicus
caaagaagtcaagaag

SEQ ID NO: 483875 - DNA, 30 bp, R. norvegicus
caaagaagtgcagaccgacaggagccggat

SEQ ID NO: 483876 - DNA, 16 bp, R. norvegicus
caaagaatagagcaga

SEQ ID NO: 483877 - DNA, 16 bp, R. norvegicus
caaagaatccacagct

SEQ ID NO: 483878 - DNA, 16 bp, R. norvegicus
caaagaattaatgaaa

SEQ ID NO: 483879 - DNA, 16 bp, R. norvegicus
caaagacaagcagatc

SEQ ID NO: 483880 - DNA, 16 bp, R. norvegicus
caaagacacagacaat

SEQ ID NO: 483881 - DNA, 16 bp, R. norvegicus
caaagacaccagaaga

SEQ ID NO: 483882 - DNA, 16 bp, R. norvegicus
caaagacagacaccac

SEQ ID NO: 483883 - DNA, 16 bp, R. norvegicus
caaagacagagacaga

SEQ ID NO: 483884 - DNA, 16 bp, R. norvegicus
caaagacagatgaagg

SEQ ID NO: 483885 - DNA, 16 bp, R. norvegicus
caaagacatcatgaaa

SEQ ID NO: 483886 - DNA, 16 bp, R. norvegicus
caaagacccaaagaag

SEQ ID NO: 483887 - DNA, 16 bp, R. norvegicus
caaagacccagctcct

SEQ ID NO: 483888 - DNA, 16 bp, R. norvegicus
caaagactgaagaaat

SEQ ID NO: 483889 - DNA, 16 bp, R. norvegicus
caaagagaacacaaat

SEQ ID NO: 483890 - DNA, 16 bp, R. norvegicus
caaagagaataaaagc

SEQ ID NO: 483891 - DNA, 16 bp, R. norvegicus
caaagagaatgtaaaa

SEQ ID NO: 483892 - DNA, 16 bp, R. norvegicus
caaagagactagaaca

SEQ ID NO: 483893 - DNA, 16 bp, R. norvegicus
caaagagagagaactt

SEQ ID NO: 483894 - DNA, 16 bp, R. norvegicus
caaagagatcctgtct

SEQ ID NO: 483895 - DNA, 16 bp, R. norvegicus
caaagagatggctcag

SEQ ID NO: 483896 - DNA, 16 bp, R. norvegicus
caaagagctaataaaa

SEQ ID NO: 483897 - DNA, 16 bp, R. norvegicus
caaagagctgctgcag

SEQ ID NO: 483898 - DNA, 16 bp, R. norvegicus
caaagaggacaggaac

SEQ ID NO: 483899 - DNA, 16 bp, R. norvegicus
caaagaggccagagga

SEQ ID NO: 483900 - DNA, 16 bp, R. norvegicus
caaagagtgagcacag

SEQ ID NO: 483901 - DNA, 16 bp, R. norvegicus
caaagataaaaactac

SEQ ID NO: 483902 - DNA, 16 bp, R. norvegicus
caaagataaggtaaaa

SEQ ID NO: 483903 - DNA, 16 bp, R. norvegicus
caaagattaaatcaga

SEQ ID NO: 483904 - DNA, 16 bp, R. norvegicus
caaagcaaatacagga

SEQ ID NO: 483905 - DNA, 16 bp, R. norvegicus
caaagcaacagagcca

SEQ ID NO: 483906 - DNA, 16 bp, R. norvegicus
caaagcaacttgagga

SEQ ID NO: 483907 - DNA, 16 bp, R. norvegicus
caaagcaagtcccagg

SEQ ID NO: 483908 - DNA, 16 bp, R. norvegicus
caaagcaatagtgatt

SEQ ID NO: 483909 - DNA, 16 bp, R. norvegicus
caaagcacaagaaaat

SEQ ID NO: 483910 - DNA, 16 bp, R. norvegicus
caaagcacacattaaa

SEQ ID NO: 483911 - DNA, 16 bp, R. norvegicus
caaagcacatattaaa

SEQ ID NO: 483912 - DNA, 16 bp, R. norvegicus
caaagcagacctggcc

SEQ ID NO: 483913 - DNA, 16 bp, R. norvegicus
caaagcagcagcagca

SEQ ID NO: 483914 - DNA, 16 bp, R. norvegicus
caaagcagcccagcta

SEQ ID NO: 483915 - DNA, 16 bp, R. norvegicus
caaagcagccctcagg

SEQ ID NO: 483916 - DNA, 16 bp, R. norvegicus
caaagcagcttgggga

SEQ ID NO: 483917 - DNA, 16 bp, R. norvegicus
caaagcattcaggaaa

SEQ ID NO: 483918 - DNA, 16 bp, R. norvegicus
caaagccaaccattga

SEQ ID NO: 483919 - DNA, 16 bp, R. norvegicus
caaagccacacagaga

SEQ ID NO: 483920 - DNA, 16 bp, R. norvegicus
caaagccagaagagga

SEQ ID NO: 483921 - DNA, 16 bp, R. norvegicus
caaagccagccagtac

SEQ ID NO: 483922 - DNA, 16 bp, R. norvegicus
caaagccagcctgagc

SEQ ID NO: 483923 - DNA, 16 bp, R. norvegicus
caaagccagcctggaa

SEQ ID NO: 483924 - DNA, 16 bp, R. norvegicus
caaagccagcctggta

SEQ ID NO: 483925 - DNA, 16 bp, R. norvegicus
caaagccatccaggat

SEQ ID NO: 483926 - DNA, 16 bp, R. norvegicus
caaagcccaccttcag

SEQ ID NO: 483927 - DNA, 16 bp, R. norvegicus
caaagcccgcctccac

SEQ ID NO: 483928 - DNA, 23 bp, R. norvegicus
caaagcccgcgaccggtctggtg

SEQ ID NO: 483929 - DNA, 16 bp, R. norvegicus
caaagccctcttctgg

SEQ ID NO: 483930 - DNA, 16 bp, R. norvegicus
caaagccctggatctg

SEQ ID NO: 483931 - DNA, 16 bp, R. norvegicus
caaagccctggctgtc

SEQ ID NO: 483932 - DNA, 16 bp, R. norvegicus
caaagccctgtccaca

SEQ ID NO: 483933 - DNA, 16 bp, R. norvegicus
caaagcctgtccccag

SEQ ID NO: 483934 - DNA, 16 bp, R. norvegicus
caaagctacatagaga

SEQ ID NO: 483935 - DNA, 16 bp, R. norvegicus
caaagctcagattacc

SEQ ID NO: 483936 - DNA, 16 bp, R. norvegicus
caaagctcccaaggac

SEQ ID NO: 483937 - DNA, 16 bp, R. norvegicus
caaagctgaaagccag

SEQ ID NO: 483938 - DNA, 16 bp, R. norvegicus
caaagctgagagttct

SEQ ID NO: 483939 - DNA, 16 bp, R. norvegicus
caaagctgctcacctc

SEQ ID NO: 483940 - DNA, 16 bp, R. norvegicus
caaagctgtcctctga

SEQ ID NO: 483941 - DNA, 16 bp, R. norvegicus
caaagctttcattgtg

SEQ ID NO: 483942 - DNA, 16 bp, R. norvegicus
caaaggaaaggccatc

SEQ ID NO: 483943 - DNA, 16 bp, R. norvegicus
caaaggaagagttaga

SEQ ID NO: 483944 - DNA, 16 bp, R. norvegicus
caaaggaagcagagtg

SEQ ID NO: 483945 - DNA, 16 bp, R. norvegicus
caaaggaagtcaggaa

SEQ ID NO: 483946 - DNA, 16 bp, R. norvegicus
caaaggaagtcaggac

SEQ ID NO: 483947 - DNA, 16 bp, R. norvegicus
caaaggaagtgaggac

SEQ ID NO: 483948 - DNA, 16 bp, R. norvegicus
caaaggacactgtggg

SEQ ID NO: 483949 - DNA, 16 bp, R. norvegicus
caaaggacctgaaaat

SEQ ID NO: 483950 - DNA, 16 bp, R. norvegicus
caaaggacctgagttc

SEQ ID NO: 483951 - DNA, 16 bp, R. norvegicus
caaaggagccaaaaac

SEQ ID NO: 483952 - DNA, 16 bp, R. norvegicus
caaaggagccagaacc

SEQ ID NO: 483953 - DNA, 16 bp, R. norvegicus
caaaggaggaacatga

SEQ ID NO: 483954 - DNA, 16 bp, R. norvegicus
caaaggaggatgtgga

SEQ ID NO: 483955 - DNA, 16 bp, R. norvegicus
caaaggagtcacaacc

SEQ ID NO: 483956 - DNA, 16 bp, R. norvegicus
caaaggagttgaggct

SEQ ID NO: 483957 - DNA, 16 bp, R. norvegicus
caaaggatcaaatgga

SEQ ID NO: 483958 - DNA, 16 bp, R. norvegicus
caaaggatcaacagaa

SEQ ID NO: 483959 - DNA, 16 bp, R. norvegicus
caaaggatctggtcag

SEQ ID NO: 483960 - DNA, 16 bp, R. norvegicus
caaaggcagaaagcag

SEQ ID NO: 483961 - DNA, 16 bp, R. norvegicus
caaaggcagaagccct

SEQ ID NO: 483962 - DNA, 16 bp, R. norvegicus
caaaggcagaaggaac

SEQ ID NO: 483963 - DNA, 16 bp, R. norvegicus
caaaggcagcagcagc

SEQ ID NO: 483964 - DNA, 16 bp, R. norvegicus
caaaggcaggaaggag

SEQ ID NO: 483965 - DNA, 17 bp, R. norvegicus
caaaggctgcccttaag

SEQ ID NO: 483966 - DNA, 16 bp, R. norvegicus
caaagggacccagatt

SEQ ID NO: 483967 - DNA, 16 bp, R. norvegicus
caaagggagattggaa

SEQ ID NO: 483968 - DNA, 16 bp, R. norvegicus
caaagggctggagaga

SEQ ID NO: 483969 - DNA, 16 bp, R. norvegicus
caaaggggctggagag

SEQ ID NO: 483970 - DNA, 16 bp, R. norvegicus
caaaggttggaccccc

SEQ ID NO: 483971 - DNA, 16 bp, R. norvegicus
caaagtaaaaggctgg

SEQ ID NO: 483972 - DNA, 16 bp, R. norvegicus
caaagtaatagaagaa

SEQ ID NO: 483973 - DNA, 16 bp, R. norvegicus
caaagtcaaccaacca

SEQ ID NO: 483974 - DNA, 16 bp, R. norvegicus
caaagtcctagccaga

SEQ ID NO: 483975 - DNA, 16 bp, R. norvegicus
caaagtcctatccaga

SEQ ID NO: 483976 - DNA, 16 bp, R. norvegicus
caaagtgcagagcaga

SEQ ID NO: 483977 - DNA, 16 bp, R. norvegicus
caaagtgctgggtcct

SEQ ID NO: 483978 - DNA, 16 bp, R. norvegicus
caaagtggccattttt

SEQ ID NO: 483979 - DNA, 16 bp, R. norvegicus
caaagttaaatcagga

SEQ ID NO: 483980 - DNA, 16 bp, R. norvegicus
caaagtttggagtttg

SEQ ID NO: 483981 - DNA, 16 bp, R. norvegicus
caaataaaaattcttt

SEQ ID NO: 483982 - DNA, 16 bp, R. norvegicus
caaataacccaggctg

SEQ ID NO: 483983 - DNA, 16 bp, R. norvegicus
caaataattggtcaca

SEQ ID NO: 483984 - DNA, 16 bp, R. norvegicus
caaatacacaaaagag

SEQ ID NO: 483985 - DNA, 16 bp, R. norvegicus
caaatacaccagaaaa

SEQ ID NO: 483986 - DNA, 16 bp, R. norvegicus
caaatacactcaaact

SEQ ID NO: 483987 - DNA, 16 bp, R. norvegicus
caaatacagaaaccca

SEQ ID NO: 483988 - DNA, 16 bp, R. norvegicus
caaatacagacacaca

SEQ ID NO: 483989 - DNA, 16 bp, R. norvegicus
caaatacagagaagaa

SEQ ID NO: 483990 - DNA, 18 bp, R. norvegicus
caaatacagaggcgaatg

SEQ ID NO: 483991 - DNA, 16 bp, R. norvegicus
caaatacatccaggag

SEQ ID NO: 483992 - DNA, 16 bp, R. norvegicus
caaatacatctggaat

SEQ ID NO: 483993 - DNA, 16 bp, R. norvegicus
caaatagagaggcaga

SEQ ID NO: 483994 - DNA, 16 bp, R. norvegicus
caaataggaaaattaa

SEQ ID NO: 483995 - DNA, 16 bp, R. norvegicus
caaataggacacccat

SEQ ID NO: 483996 - DNA, 16 bp, R. norvegicus
caaatagtgctggttc

SEQ ID NO: 483997 - DNA, 16 bp, R. norvegicus
caaatatcatgtgtcc

SEQ ID NO: 483998 - DNA, 16 bp, R. norvegicus
caaatatccaggaaat

SEQ ID NO: 483999 - DNA, 16 bp, R. norvegicus
caaatatgcataaaca

SEQ ID NO: 484000 - DNA, 16 bp, R. norvegicus
caaatatgtgaaggaa

SEQ ID NO: 484001 - DNA, 16 bp, R. norvegicus
caaatcaaagcaaaat

SEQ ID NO: 484002 - DNA, 16 bp, R. norvegicus
caaatcagaacaactc

SEQ ID NO: 484003 - DNA, 16 bp, R. norvegicus
caaatcaggaattcta

SEQ ID NO: 484004 - DNA, 16 bp, R. norvegicus
caaatccagccccaca

SEQ ID NO: 484005 - DNA, 16 bp, R. norvegicus
caaatccagcctggtc

SEQ ID NO: 484006 - DNA, 16 bp, R. norvegicus
caaatccatttggaat

SEQ ID NO: 484007 - DNA, 16 bp, R. norvegicus
caaatcccttcagctc

SEQ ID NO: 484008 - DNA, 16 bp, R. norvegicus
caaatcctctggaact

SEQ ID NO: 484009 - DNA, 16 bp, R. norvegicus
caaatcctctggaaga

SEQ ID NO: 484010 - DNA, 16 bp, R. norvegicus
caaatcctgttgggga

SEQ ID NO: 484011 - DNA, 16 bp, R. norvegicus
caaatctaagaataat

SEQ ID NO: 484012 - DNA, 16 bp, R. norvegicus
caaatctgacaacctg

SEQ ID NO: 484013 - DNA, 16 bp, R. norvegicus
caaatcttgtttttct

SEQ ID NO: 484014 - DNA, 16 bp, R. norvegicus
caaatgaacacacaca

SEQ ID NO: 484015 - DNA, 16 bp, R. norvegicus
caaatgaatttgcaaa

SEQ ID NO: 484016 - DNA, 16 bp, R. norvegicus
caaatgacaaatggac

SEQ ID NO: 484017 - DNA, 16 bp, R. norvegicus
caaatgaccctttcac

SEQ ID NO: 484018 - DNA, 16 bp, R. norvegicus
caaatgatgctggttc

SEQ ID NO: 484019 - DNA, 16 bp, R. norvegicus
caaatgattccaagaa

SEQ ID NO: 484020 - DNA, 16 bp, R. norvegicus
caaatgatttctcagt

SEQ ID NO: 484021 - DNA, 16 bp, R. norvegicus
caaatgcaagcccagg

SEQ ID NO: 484022 - DNA, 16 bp, R. norvegicus
caaatgcaatctacag

SEQ ID NO: 484023 - DNA, 16 bp, R. norvegicus
caaatgccaacccaga

SEQ ID NO: 484024 - DNA, 16 bp, R. norvegicus
caaatgctcaaattat

SEQ ID NO: 484025 - DNA, 16 bp, R. norvegicus
caaatgctgcttctgc

SEQ ID NO: 484026 - DNA, 16 bp, R. norvegicus
caaatgctggaaagaa

SEQ ID NO: 484027 - DNA, 19 bp, R. norvegicus
caaatgctggcgaggatgt

SEQ ID NO: 484028 - DNA, 16 bp, R. norvegicus
caaatggaaaaagata

SEQ ID NO: 484029 - DNA, 16 bp, R. norvegicus
caaatggagctggttc

SEQ ID NO: 484030 - DNA, 16 bp, R. norvegicus
caaatggaggtcccac

SEQ ID NO: 484031 - DNA, 16 bp, R. norvegicus
caaatggatcaagaac

SEQ ID NO: 484032 - DNA, 16 bp, R. norvegicus
caaatggatttaaaag

SEQ ID NO: 484033 - DNA, 16 bp, R. norvegicus
caaatggccaataaac

SEQ ID NO: 484034 - DNA, 16 bp, R. norvegicus
caaatgggaaaagaag

SEQ ID NO: 484035 - DNA, 16 bp, R. norvegicus
caaatggtattcccag

SEQ ID NO: 484036 - DNA, 16 bp, R. norvegicus
caaatggttatgagcc

SEQ ID NO: 484037 - DNA, 16 bp, R. norvegicus
caaatgtaaatattct

SEQ ID NO: 484038 - DNA, 16 bp, R. norvegicus
caaatgtgattttata

SEQ ID NO: 484039 - DNA, 23 bp, R. norvegicus
caaatgtggtacatctacacaat

SEQ ID NO: 484040 - DNA, 16 bp, R. norvegicus
caaatgttacttcctt

SEQ ID NO: 484041 - DNA, 16 bp, R. norvegicus
caaatgttattcctgt

SEQ ID NO: 484042 - DNA, 16 bp, R. norvegicus
caaatgttattctatt

SEQ ID NO: 484043 - DNA, 16 bp, R. norvegicus
caaatgttgtcctctt

SEQ ID NO: 484044 - DNA, 36 bp, R. norvegicus
caaatgtttggaactggaaaatatcatcctgagtga

SEQ ID NO: 484045 - DNA, 16 bp, R. norvegicus
caaattaaggaacttg

SEQ ID NO: 484046 - DNA, 16 bp, R. norvegicus
caaattattccagaaa

SEQ ID NO: 484047 - DNA, 16 bp, R. norvegicus
caaattcacagagctc

SEQ ID NO: 484048 - DNA, 16 bp, R. norvegicus
caaattcatatggaat

SEQ ID NO: 484049 - DNA, 16 bp, R. norvegicus
caaattcatctgaaat

SEQ ID NO: 484050 - DNA, 16 bp, R. norvegicus
caaattcctgatcctc

SEQ ID NO: 484051 - DNA, 16 bp, R. norvegicus
caaattccttcaatga

SEQ ID NO: 484052 - DNA, 16 bp, R. norvegicus
caaattctcagcacaa

SEQ ID NO: 484053 - DNA, 16 bp, R. norvegicus
caaattgatttacaaa

SEQ ID NO: 484054 - DNA, 16 bp, R. norvegicus
caaattgcagatgctt

SEQ ID NO: 484055 - DNA, 16 bp, R. norvegicus
caaattggaaagaaag

SEQ ID NO: 484056 - DNA, 16 bp, R. norvegicus
caaattggcaaagaat

SEQ ID NO: 484057 - DNA, 16 bp, R. norvegicus
caaattgtctgaagaa

SEQ ID NO: 484058 - DNA, 16 bp, R. norvegicus
caaattgtgagccaaa

SEQ ID NO: 484059 - DNA, 16 bp, R. norvegicus
caaattgttctctcta

SEQ ID NO: 484060 - DNA, 16 bp, R. norvegicus
caaatttcatttaaaa

SEQ ID NO: 484061 - DNA, 16 bp, R. norvegicus
caaatttccaagaaaa

SEQ ID NO: 484062 - DNA, 16 bp, R. norvegicus
caaatttctgaagaac

SEQ ID NO: 484063 - DNA, 16 bp, R. norvegicus
caaatttgaggccagc

SEQ ID NO: 484064 - DNA, 16 bp, R. norvegicus
caaatttttctccatt

SEQ ID NO: 484065 - DNA, 16 bp, R. norvegicus
caacaaaagatcaaag

SEQ ID NO: 484066 - DNA, 16 bp, R. norvegicus
caacaaaagatgctgg

SEQ ID NO: 484067 - DNA, 16 bp, R. norvegicus
caacaaaagtaacagg

SEQ ID NO: 484068 - DNA, 16 bp, R. norvegicus
caacaaaatcatagag

SEQ ID NO: 484069 - DNA, 52 bp, R. norvegicus
caacaaacaatacttatggactgcccgaagaacagtggaccttggcgtgggc

SEQ ID NO: 484070 - DNA, 16 bp, R. norvegicus
caacaaagaaaaattc

SEQ ID NO: 484071 - DNA, 16 bp, R. norvegicus
caacaaagaaaacttc

SEQ ID NO: 484072 - DNA, 16 bp, R. norvegicus
caacaaagaattggga

SEQ ID NO: 484073 - DNA, 16 bp, R. norvegicus
caacaaagagaatttc

SEQ ID NO: 484074 - DNA, 16 bp, R. norvegicus
caacaaagatggcagt

SEQ ID NO: 484075 - DNA, 16 bp, R. norvegicus
caacaaagggaagata

SEQ ID NO: 484076 - DNA, 16 bp, R. norvegicus
caacaacaaaaacagt

SEQ ID NO: 484077 - DNA, 16 bp, R. norvegicus
caacaacaacagtaac

SEQ ID NO: 484078 - DNA, 16 bp, R. norvegicus
caacaacagcagcaat

SEQ ID NO: 484079 - DNA, 16 bp, R. norvegicus
caacaacatcagcaac

SEQ ID NO: 484080 - DNA, 16 bp, R. norvegicus
caacaaccacagcagc

SEQ ID NO: 484081 - DNA, 16 bp, R. norvegicus
caacaacccagtgaag

SEQ ID NO: 484082 - DNA, 16 bp, R. norvegicus
caacaacttttttttt

SEQ ID NO: 484083 - DNA, 16 bp, R. norvegicus
caacaagaaagtatgt

SEQ ID NO: 484084 - DNA, 16 bp, R. norvegicus
caacaagaaggaagac

SEQ ID NO: 484085 - DNA, 16 bp, R. norvegicus
caacaagaataatttt

SEQ ID NO: 484086 - DNA, 16 bp, R. norvegicus
caacaagacaactctg

SEQ ID NO: 484087 - DNA, 16 bp, R. norvegicus
caacaagacagtgcca

SEQ ID NO: 484088 - DNA, 16 bp, R. norvegicus
caacaagaccatcctt

SEQ ID NO: 484089 - DNA, 16 bp, R. norvegicus
caacaagaccatcttc

SEQ ID NO: 484090 - DNA, 16 bp, R. norvegicus
caacaagaggcagttt

SEQ ID NO: 484091 - DNA, 16 bp, R. norvegicus
caacaagcagctgaaa

SEQ ID NO: 484092 - DNA, 16 bp, R. norvegicus
caacaagcagctgact

SEQ ID NO: 484093 - DNA, 16 bp, R. norvegicus
caacaagccaaggaaa

SEQ ID NO: 484094 - DNA, 16 bp, R. norvegicus
caacaagccccaggga

SEQ ID NO: 484095 - DNA, 16 bp, R. norvegicus
caacaaggatgacatt

SEQ ID NO: 484096 - DNA, 16 bp, R. norvegicus
caacaaggccacaccc

SEQ ID NO: 484097 - DNA, 16 bp, R. norvegicus
caacaaggcccatcct

SEQ ID NO: 484098 - DNA, 16 bp, R. norvegicus
caacaagttagataaa

SEQ ID NO: 484099 - DNA, 16 bp, R. norvegicus
caacaatacatttttt

SEQ ID NO: 484100 - DNA, 16 bp, R. norvegicus
caacaatatcagtcaa

SEQ ID NO: 484101 - DNA, 16 bp, R. norvegicus
caacaatgacaacaaa

SEQ ID NO: 484102 - DNA, 16 bp, R. norvegicus
caacaatgacaatgac

SEQ ID NO: 484103 - DNA, 16 bp, R. norvegicus
caacaatgacgacaac

SEQ ID NO: 484104 - DNA, 16 bp, R. norvegicus
caacaatgcaggagtg

SEQ ID NO: 484105 - DNA, 16 bp, R. norvegicus
caacaatgccaacaac

SEQ ID NO: 484106 - DNA, 16 bp, R. norvegicus
caacacaaagaatcaa

SEQ ID NO: 484107 - DNA, 16 bp, R. norvegicus
caacacaatggaaaag

SEQ ID NO: 484108 - DNA, 16 bp, R. norvegicus
caacacacaatgcaca

SEQ ID NO: 484109 - DNA, 16 bp, R. norvegicus
caacacagtggagctg

SEQ ID NO: 484110 - DNA, 16 bp, R. norvegicus
caacaccatggcattc

SEQ ID NO: 484111 - DNA, 16 bp, R. norvegicus
caacacccaactctca

SEQ ID NO: 484112 - DNA, 16 bp, R. norvegicus
caacactattactgat

SEQ ID NO: 484113 - DNA, 16 bp, R. norvegicus
caacactcctcaaatt

SEQ ID NO: 484114 - DNA, 16 bp, R. norvegicus
caacactgccaccata

SEQ ID NO: 484115 - DNA, 16 bp, R. norvegicus
caacactggtgacatc

SEQ ID NO: 484116 - DNA, 16 bp, R. norvegicus
caacagaaaaatgaat

SEQ ID NO: 484117 - DNA, 16 bp, R. norvegicus
caacagaaaaggaact

SEQ ID NO: 484118 - DNA, 16 bp, R. norvegicus
caacagaaaccaggac

SEQ ID NO: 484119 - DNA, 16 bp, R. norvegicus
caacagaaaccctaac

SEQ ID NO: 484120 - DNA, 16 bp, R. norvegicus
caacagaaactgggga

SEQ ID NO: 484121 - DNA, 16 bp, R. norvegicus
caacagaaagcaaact

SEQ ID NO: 484122 - DNA, 16 bp, R. norvegicus
caacagaaagcctaca

SEQ ID NO: 484123 - DNA, 16 bp, R. norvegicus
caacagaagaacagat

SEQ ID NO: 484124 - DNA, 16 bp, R. norvegicus
caacagaagcaaaagc

SEQ ID NO: 484125 - DNA, 16 bp, R. norvegicus
caacagaattccagag

SEQ ID NO: 484126 - DNA, 16 bp, R. norvegicus
caacagacactgagaa

SEQ ID NO: 484127 - DNA, 16 bp, R. norvegicus
caacagagaaatcttg

SEQ ID NO: 484128 - DNA, 16 bp, R. norvegicus
caacagagacagagac

SEQ ID NO: 484129 - DNA, 16 bp, R. norvegicus
caacagataaaagaag

SEQ ID NO: 484130 - DNA, 16 bp, R. norvegicus
caacagatagaagaga

SEQ ID NO: 484131 - DNA, 16 bp, R. norvegicus
caacagatgaatggat

SEQ ID NO: 484132 - DNA, 16 bp, R. norvegicus
caacagatgcaagaag

SEQ ID NO: 484133 - DNA, 16 bp, R. norvegicus
caacagatgcaagcat

SEQ ID NO: 484134 - DNA, 16 bp, R. norvegicus
caacagatgctgatga

SEQ ID NO: 484135 - DNA, 16 bp, R. norvegicus
caacagatgctggcag

SEQ ID NO: 484136 - DNA, 16 bp, R. norvegicus
caacagatgcttgtga

SEQ ID NO: 484137 - DNA, 16 bp, R. norvegicus
caacagcaacaataac

SEQ ID NO: 484138 - DNA, 16 bp, R. norvegicus
caacagcaccctcagc

SEQ ID NO: 484139 - DNA, 21 bp, R. norvegicus
caacagcagcaacagcaacag

SEQ ID NO: 484140 - DNA, 16 bp, R. norvegicus
caacagcagcagcaaa

SEQ ID NO: 484141 - DNA, 16 bp, R. norvegicus
caacagcagcagcacc

SEQ ID NO: 484142 - DNA, 16 bp, R. norvegicus
caacagcagtgacatg

SEQ ID NO: 484143 - DNA, 16 bp, R. norvegicus
caacagccaatatcaa

SEQ ID NO: 484144 - DNA, 16 bp, R. norvegicus
caacagccacatggtg

SEQ ID NO: 484145 - DNA, 16 bp, R. norvegicus
caacagctctctgcac

SEQ ID NO: 484146 - DNA, 16 bp, R. norvegicus
caacagcttgggaaaa

SEQ ID NO: 484147 - DNA, 16 bp, R. norvegicus
caacaggacagctgca

SEQ ID NO: 484148 - DNA, 16 bp, R. norvegicus
caacaggactgatgca

SEQ ID NO: 484149 - DNA, 16 bp, R. norvegicus
caacaggagctggatg

SEQ ID NO: 484150 - DNA, 16 bp, R. norvegicus
caacaggcacagaaag

SEQ ID NO: 484151 - DNA, 16 bp, R. norvegicus
caacaggcctcaacag

SEQ ID NO: 484152 - DNA, 16 bp, R. norvegicus
caacagtaccagtcag

SEQ ID NO: 484153 - DNA, 16 bp, R. norvegicus
caacagtggggagagg

SEQ ID NO: 484154 - DNA, 16 bp, R. norvegicus
caacagtggtgacatg

SEQ ID NO: 484155 - DNA, 16 bp, R. norvegicus
caacagtgtcctttcc

SEQ ID NO: 484156 - DNA, 16 bp, R. norvegicus
caacatacaatccaca

SEQ ID NO: 484157 - DNA, 16 bp, R. norvegicus
caacatataaaagaga

SEQ ID NO: 484158 - DNA, 16 bp, R. norvegicus
caacatataacagaga

SEQ ID NO: 484159 - DNA, 16 bp, R. norvegicus
caacatattacaagga

SEQ ID NO: 484160 - DNA, 16 bp, R. norvegicus
caacatcaccatcatc

SEQ ID NO: 484161 - DNA, 16 bp, R. norvegicus
caacatccacatggtg

SEQ ID NO: 484162 - DNA, 16 bp, R. norvegicus
caacatccctgacctc

SEQ ID NO: 484163 - DNA, 16 bp, R. norvegicus
caacatcctcttctgg

SEQ ID NO: 484164 - DNA, 16 bp, R. norvegicus
caacatgaagttcaag

SEQ ID NO: 484165 - DNA, 16 bp, R. norvegicus
caacatggaggcagac

SEQ ID NO: 484166 - DNA, 16 bp, R. norvegicus
caacatggcctctggt

SEQ ID NO: 484167 - DNA, 30 bp, R. norvegicus
caacatgtagaagaatgcagatcgatccat

SEQ ID NO: 484168 - DNA, 16 bp, R. norvegicus
caacatgtctgtctct

SEQ ID NO: 484169 - DNA, 16 bp, R. norvegicus
caacatttgctgaaaa

SEQ ID NO: 484170 - DNA, 16 bp, R. norvegicus
caaccaaagaatgcac

SEQ ID NO: 484171 - DNA, 16 bp, R. norvegicus
caaccaaagaatggat

SEQ ID NO: 484172 - DNA, 16 bp, R. norvegicus
caaccaaagagtacat

SEQ ID NO: 484173 - DNA, 16 bp, R. norvegicus
caaccaacagattgca

SEQ ID NO: 484174 - DNA, 50 bp, R. norvegicus
caaccaacagattgggaaaagatctttaccaatcctacaacagatagaga

SEQ ID NO: 484175 - DNA, 21 bp, R. norvegicus
caaccaaccagagcttccagg

SEQ ID NO: 484176 - DNA, 16 bp, R. norvegicus
caaccaaccatccatc

SEQ ID NO: 484177 - DNA, 16 bp, R. norvegicus
caaccaaggaatggat

SEQ ID NO: 484178 - DNA, 16 bp, R. norvegicus
caaccaatcagacccc

SEQ ID NO: 484179 - DNA, 16 bp, R. norvegicus
caaccaatggaaagaa

SEQ ID NO: 484180 - DNA, 16 bp, R. norvegicus
caaccacagaggtccc

SEQ ID NO: 484181 - DNA, 16 bp, R. norvegicus
caaccacagctcccag

SEQ ID NO: 484182 - DNA, 16 bp, R. norvegicus
caaccacaggggtcac

SEQ ID NO: 484183 - DNA, 16 bp, R. norvegicus
caaccacatggtgatt

SEQ ID NO: 484184 - DNA, 16 bp, R. norvegicus
caaccacattcataaa

SEQ ID NO: 484185 - DNA, 16 bp, R. norvegicus
caaccactcaggaaat

SEQ ID NO: 484186 - DNA, 16 bp, R. norvegicus
caaccagacctccccc

SEQ ID NO: 484187 - DNA, 16 bp, R. norvegicus
caaccagagctctcag

SEQ ID NO: 484188 - DNA, 32 bp, R. norvegicus
caaccagagcttccagggactaagccactacc

SEQ ID NO: 484189 - DNA, 17 bp, R. norvegicus
caaccagagcttccagt

SEQ ID NO: 484190 - DNA, 16 bp, R. norvegicus
caaccagggctacaca

SEQ ID NO: 484191 - DNA, 16 bp, R. norvegicus
caaccagggctgtgcc

SEQ ID NO: 484192 - DNA, 16 bp, R. norvegicus
caaccatcaacactca

SEQ ID NO: 484193 - DNA, 16 bp, R. norvegicus
caaccatcatcagaga

SEQ ID NO: 484194 - DNA, 16 bp, R. norvegicus
caaccatctgtaagtc

SEQ ID NO: 484195 - DNA, 16 bp, R. norvegicus
caaccattcaaacaca

SEQ ID NO: 484196 - DNA, 16 bp, R. norvegicus
caaccatttgcagatg

SEQ ID NO: 484197 - DNA, 16 bp, R. norvegicus
caacccacaggaagaa

SEQ ID NO: 484198 - DNA, 16 bp, R. norvegicus
caacccactcctgcct

SEQ ID NO: 484199 - DNA, 16 bp, R. norvegicus
caacccagaaccacct

SEQ ID NO: 484200 - DNA, 16 bp, R. norvegicus
caacccagatgtccaa

SEQ ID NO: 484201 - DNA, 16 bp, R. norvegicus
caacccagatgtccct

SEQ ID NO: 484202 - DNA, 16 bp, R. norvegicus
caaccccacagaaaga

SEQ ID NO: 484203 - DNA, 16 bp, R. norvegicus
caaccccactcatctc

SEQ ID NO: 484204 - DNA, 16 bp, R. norvegicus
caaccccatcagaaca

SEQ ID NO: 484205 - DNA, 16 bp, R. norvegicus
caacccctctggaaat

SEQ ID NO: 484206 - DNA, 16 bp, R. norvegicus
caaccccttcctgcct

SEQ ID NO: 484207 - DNA, 16 bp, R. norvegicus
caaccctaaatatctc

SEQ ID NO: 484208 - DNA, 16 bp, R. norvegicus
caaccctcaaggacag

SEQ ID NO: 484209 - DNA, 16 bp, R. norvegicus
caaccctccacccatt

SEQ ID NO: 484210 - DNA, 16 bp, R. norvegicus
caaccctgaaattcta

SEQ ID NO: 484211 - DNA, 16 bp, R. norvegicus
caaccctgacacagca

SEQ ID NO: 484212 - DNA, 16 bp, R. norvegicus
caaccctgacattccc

SEQ ID NO: 484213 - DNA, 16 bp, R. norvegicus
caaccctgacatttca

SEQ ID NO: 484214 - DNA, 16 bp, R. norvegicus
caaccctgagatacca

SEQ ID NO: 484215 - DNA, 19 bp, R. norvegicus
caaccctgctcccggaccc

SEQ ID NO: 484216 - DNA, 16 bp, R. norvegicus
caaccctggagaaaga

SEQ ID NO: 484217 - DNA, 16 bp, R. norvegicus
caaccgcaaagccctg

SEQ ID NO: 484218 - DNA, 16 bp, R. norvegicus
caacctacacttcacc

SEQ ID NO: 484219 - DNA, 16 bp, R. norvegicus
caacctacagattggg

SEQ ID NO: 484220 - DNA, 16 bp, R. norvegicus
caacctcaatgccctg

SEQ ID NO: 484221 - DNA, 16 bp, R. norvegicus
caacctccagcctcca

SEQ ID NO: 484222 - DNA, 16 bp, R. norvegicus
caacctctgacttcca

SEQ ID NO: 484223 - DNA, 16 bp, R. norvegicus
caacctgagttcaacc

SEQ ID NO: 484224 - DNA, 16 bp, R. norvegicus
caacctgtgggccaca

SEQ ID NO: 484225 - DNA, 16 bp, R. norvegicus
caacctgtgggtcgtg

SEQ ID NO: 484226 - DNA, 16 bp, R. norvegicus
caaccttaccaggctt

SEQ ID NO: 484227 - DNA, 16 bp, R. norvegicus
caaccttcctgcctca

SEQ ID NO: 484228 - DNA, 16 bp, R. norvegicus
caaccttctgaatgct

SEQ ID NO: 484229 - DNA, 16 bp, R. norvegicus
caaccttgagaagcag

SEQ ID NO: 484230 - DNA, 16 bp, R. norvegicus
caaccttggcaagacc

SEQ ID NO: 484231 - DNA, 45 bp, R. norvegicus
caacgaacaatacttatggactgcccgaagaacagtggaccttgg

SEQ ID NO: 484232 - DNA, 16 bp, R. norvegicus
caactcaattctttac

SEQ ID NO: 484233 - DNA, 16 bp, R. norvegicus
caactcagctgctctg

SEQ ID NO: 484234 - DNA, 16 bp, R. norvegicus
caactccatccctcca

SEQ ID NO: 484235 - DNA, 16 bp, R. norvegicus
caactctggagatgga

SEQ ID NO: 484236 - DNA, 16 bp, R. norvegicus
caactcttataaagga

SEQ ID NO: 484237 - DNA, 16 bp, R. norvegicus
caactcttctgctcca

SEQ ID NO: 484238 - DNA, 16 bp, R. norvegicus
caactgaagaatatca

SEQ ID NO: 484239 - DNA, 16 bp, R. norvegicus
caactgaagaatctca

SEQ ID NO: 484240 - DNA, 16 bp, R. norvegicus
caactgcagcaaagtg

SEQ ID NO: 484241 - DNA, 16 bp, R. norvegicus
caactggagatagctt

SEQ ID NO: 484242 - DNA, 16 bp, R. norvegicus
caactgggggccttgc

SEQ ID NO: 484243 - DNA, 16 bp, R. norvegicus
caactgtctggggcag

SEQ ID NO: 484244 - DNA, 16 bp, R. norvegicus
caactgtgccccctgg

SEQ ID NO: 484245 - DNA, 16 bp, R. norvegicus
caacttaaggaaggaa

SEQ ID NO: 484246 - DNA, 16 bp, R. norvegicus
caacttagaaaagaaa

SEQ ID NO: 484247 - DNA, 16 bp, R. norvegicus
caacttatttttaaaa

SEQ ID NO: 484248 - DNA, 16 bp, R. norvegicus
caacttcagcaaagtt

SEQ ID NO: 484249 - DNA, 16 bp, R. norvegicus
caacttcagccaagtg

SEQ ID NO: 484250 - DNA, 16 bp, R. norvegicus
caacttcctacaagct

SEQ ID NO: 484251 - DNA, 16 bp, R. norvegicus
caacttcctgagcaga

SEQ ID NO: 484252 - DNA, 16 bp, R. norvegicus
caacttctctgctgca

SEQ ID NO: 484253 - DNA, 16 bp, R. norvegicus
caacttcttcttcttc

SEQ ID NO: 484254 - DNA, 16 bp, R. norvegicus
caacttgactggatct

SEQ ID NO: 484255 - DNA, 16 bp, R. norvegicus
caacttggagaagaaa

SEQ ID NO: 484256 - DNA, 16 bp, R. norvegicus
caactttatttttcca

SEQ ID NO: 484257 - DNA, 16 bp, R. norvegicus
caactttgtggaattg

SEQ ID NO: 484258 - DNA, 16 bp, R. norvegicus
caacttttctcctgca

SEQ ID NO: 484259 - DNA, 16 bp, R. norvegicus
caactttttaaaagaa

SEQ ID NO: 484260 - DNA, 16 bp, R. norvegicus
caagaaaaactatgct

SEQ ID NO: 484261 - DNA, 16 bp, R. norvegicus
caagaaaagaaattct

SEQ ID NO: 484262 - DNA, 16 bp, R. norvegicus
caagaaaatgccccaa

SEQ ID NO: 484263 - DNA, 16 bp, R. norvegicus
caagaaacaagccaga

SEQ ID NO: 484264 - DNA, 18 bp, R. norvegicus
caagaaacctgcctggtg

SEQ ID NO: 484265 - DNA, 16 bp, R. norvegicus
caagaaactcaagaag

SEQ ID NO: 484266 - DNA, 16 bp, R. norvegicus
caagaaactgcagcac

SEQ ID NO: 484267 - DNA, 16 bp, R. norvegicus
caagaaactggctgta

SEQ ID NO: 484268 - DNA, 16 bp, R. norvegicus
caagaaacttacagaa

SEQ ID NO: 484269 - DNA, 16 bp, R. norvegicus
caagaaagcaagctga

SEQ ID NO: 484270 - DNA, 16 bp, R. norvegicus
caagaaagcttcctgg

SEQ ID NO: 484271 - DNA, 16 bp, R. norvegicus
caagaaatccaggaca

SEQ ID NO: 484272 - DNA, 16 bp, R. norvegicus
caagaaatggaagaga

SEQ ID NO: 484273 - DNA, 16 bp, R. norvegicus
caagaaatggacaatt

SEQ ID NO: 484274 - DNA, 16 bp, R. norvegicus
caagaacaacaatgcc

SEQ ID NO: 484275 - DNA, 16 bp, R. norvegicus
caagaacaagggcttc

SEQ ID NO: 484276 - DNA, 16 bp, R. norvegicus
caagaacaatggcagc

SEQ ID NO: 484277 - DNA, 16 bp, R. norvegicus
caagaacacatcaaag

SEQ ID NO: 484278 - DNA, 16 bp, R. norvegicus
caagaacctctacata

SEQ ID NO: 484279 - DNA, 16 bp, R. norvegicus
caagaacctggaggca

SEQ ID NO: 484280 - DNA, 16 bp, R. norvegicus
caagaactcaaggcag

SEQ ID NO: 484281 - DNA, 23 bp, R. norvegicus
caagaactggactgtccaagcaa

SEQ ID NO: 484282 - DNA, 16 bp, R. norvegicus
caagaagaactataca

SEQ ID NO: 484283 - DNA, 16 bp, R. norvegicus
caagaagaactggaag

SEQ ID NO: 484284 - DNA, 16 bp, R. norvegicus
caagaagaagaatgac

SEQ ID NO: 484285 - DNA, 16 bp, R. norvegicus
caagaagaaggacgac

SEQ ID NO: 484286 - DNA, 16 bp, R. norvegicus
caagaagaagggtgac

SEQ ID NO: 484287 - DNA, 16 bp, R. norvegicus
caagaagaagtatgac

SEQ ID NO: 484288 - DNA, 16 bp, R. norvegicus
caagaagagcatgctg

SEQ ID NO: 484289 - DNA, 16 bp, R. norvegicus
caagaagagggaagac

SEQ ID NO: 484290 - DNA, 16 bp, R. norvegicus
caagaagataacaatc

SEQ ID NO: 484291 - DNA, 16 bp, R. norvegicus
caagaagatcctggac

SEQ ID NO: 484292 - DNA, 16 bp, R. norvegicus
caagaagatggatgac

SEQ ID NO: 484293 - DNA, 16 bp, R. norvegicus
caagaagattgaaaaa

SEQ ID NO: 484294 - DNA, 16 bp, R. norvegicus
caagaagcaatcctga

SEQ ID NO: 484295 - DNA, 16 bp, R. norvegicus
caagaagcagctggaa

SEQ ID NO: 484296 - DNA, 16 bp, R. norvegicus
caagaagcataaagaa

SEQ ID NO: 484297 - DNA, 16 bp, R. norvegicus
caagaagctcttgctg

SEQ ID NO: 484298 - DNA, 16 bp, R. norvegicus
caagaagctgaaagag

SEQ ID NO: 484299 - DNA, 16 bp, R. norvegicus
caagaagctggaaaca

SEQ ID NO: 484300 - DNA, 17 bp, R. norvegicus
caagaagctgttgtcat

SEQ ID NO: 484301 - DNA, 16 bp, R. norvegicus
caagaaggaagtccaa

SEQ ID NO: 484302 - DNA, 16 bp, R. norvegicus
caagaaggaggatgac

SEQ ID NO: 484303 - DNA, 16 bp, R. norvegicus
caagaagtaggaagac

SEQ ID NO: 484304 - DNA, 16 bp, R. norvegicus
caagaagtccctgaaa

SEQ ID NO: 484305 - DNA, 16 bp, R. norvegicus
caagaagtgaatgctg

SEQ ID NO: 484306 - DNA, 16 bp, R. norvegicus
caagaagtgcttaatg

SEQ ID NO: 484307 - DNA, 16 bp, R. norvegicus
caagaagtggatgctg

SEQ ID NO: 484308 - DNA, 16 bp, R. norvegicus
caagaagttcctgaaa

SEQ ID NO: 484309 - DNA, 16 bp, R. norvegicus
caagaagtttacagaa

SEQ ID NO: 484310 - DNA, 16 bp, R. norvegicus
caagaatattttaaaa

SEQ ID NO: 484311 - DNA, 16 bp, R. norvegicus
caagaatcagttctct

SEQ ID NO: 484312 - DNA, 16 bp, R. norvegicus
caagaatctacaaatg

SEQ ID NO: 484313 - DNA, 16 bp, R. norvegicus
caagaattgacaaaag

SEQ ID NO: 484314 - DNA, 16 bp, R. norvegicus
caagaattgacaattg

SEQ ID NO: 484315 - DNA, 16 bp, R. norvegicus
caagaattttattcag

SEQ ID NO: 484316 - DNA, 16 bp, R. norvegicus
caagacaaggcagccc

SEQ ID NO: 484317 - DNA, 16 bp, R. norvegicus
caagacaaggctgtct

SEQ ID NO: 484318 - DNA, 16 bp, R. norvegicus
caagacacttccccac

SEQ ID NO: 484319 - DNA, 16 bp, R. norvegicus
caagacaggaactgaa

SEQ ID NO: 484320 - DNA, 16 bp, R. norvegicus
caagacaggagcatgg

SEQ ID NO: 484321 - DNA, 16 bp, R. norvegicus
caagaccaacctgggc

SEQ ID NO: 484322 - DNA, 16 bp, R. norvegicus
caagaccacacccact

SEQ ID NO: 484323 - DNA, 16 bp, R. norvegicus
caagaccacaccttct

SEQ ID NO: 484324 - DNA, 16 bp, R. norvegicus
caagaccacatctcct

SEQ ID NO: 484325 - DNA, 16 bp, R. norvegicus
caagaccagcctgagc

SEQ ID NO: 484326 - DNA, 16 bp, R. norvegicus
caagaccagcctggcc

SEQ ID NO: 484327 - DNA, 16 bp, R. norvegicus
caagaccagcctggtc

SEQ ID NO: 484328 - DNA, 16 bp, R. norvegicus
caagaccctgcctcag

SEQ ID NO: 484329 - DNA, 16 bp, R. norvegicus
caagaccctgtctcaa

SEQ ID NO: 484330 - DNA, 16 bp, R. norvegicus
caagactcaacagata

SEQ ID NO: 484331 - DNA, 16 bp, R. norvegicus
caagactcagattaaa

SEQ ID NO: 484332 - DNA, 16 bp, R. norvegicus
caagactccatctcaa

SEQ ID NO: 484333 - DNA, 16 bp, R. norvegicus
caagacttcacaggac

SEQ ID NO: 484334 - DNA, 16 bp, R. norvegicus
caagagaacacaggaa

SEQ ID NO: 484335 - DNA, 16 bp, R. norvegicus
caagagaatgaaggaa

SEQ ID NO: 484336 - DNA, 16 bp, R. norvegicus
caagagaatgaatgaa

SEQ ID NO: 484337 - DNA, 16 bp, R. norvegicus
caagagacaacttcct

SEQ ID NO: 484338 - DNA, 16 bp, R. norvegicus
caagagacagaagaca

SEQ ID NO: 484339 - DNA, 16 bp, R. norvegicus
caagagacagaagcag

SEQ ID NO: 484340 - DNA, 16 bp, R. norvegicus
caagagaccaggagaa

SEQ ID NO: 484341 - DNA, 16 bp, R. norvegicus
caagagaccctgtttc

SEQ ID NO: 484342 - DNA, 16 bp, R. norvegicus
caagagactggatgcc

SEQ ID NO: 484343 - DNA, 16 bp, R. norvegicus
caagagagcgagagag

SEQ ID NO: 484344 - DNA, 16 bp, R. norvegicus
caagagatagaagaca

SEQ ID NO: 484345 - DNA, 16 bp, R. norvegicus
caagagatctgatgcc

SEQ ID NO: 484346 - DNA, 16 bp, R. norvegicus
caagagatttcagagg

SEQ ID NO: 484347 - DNA, 16 bp, R. norvegicus
caagagcaagagagga

SEQ ID NO: 484348 - DNA, 16 bp, R. norvegicus
caagagcaagcaggca

SEQ ID NO: 484349 - DNA, 16 bp, R. norvegicus
caagagcacccacatt

SEQ ID NO: 484350 - DNA, 16 bp, R. norvegicus
caagagcagagagaga

SEQ ID NO: 484351 - DNA, 16 bp, R. norvegicus
caagagcagcaaagaa

SEQ ID NO: 484352 - DNA, 16 bp, R. norvegicus
caagagcagcaagggc

SEQ ID NO: 484353 - DNA, 16 bp, R. norvegicus
caagagcagcagcagc

SEQ ID NO: 484354 - DNA, 16 bp, R. norvegicus
caagagcagccagagc

SEQ ID NO: 484355 - DNA, 16 bp, R. norvegicus
caagagcctggtatag

SEQ ID NO: 484356 - DNA, 16 bp, R. norvegicus
caagagctaaataaag

SEQ ID NO: 484357 - DNA, 16 bp, R. norvegicus
caagagctagaagaga

SEQ ID NO: 484358 - DNA, 16 bp, R. norvegicus
caagagctgtgcccag

SEQ ID NO: 484359 - DNA, 16 bp, R. norvegicus
caagaggaaaacacct

SEQ ID NO: 484360 - DNA, 16 bp, R. norvegicus
caagaggaaactgcct

SEQ ID NO: 484361 - DNA, 16 bp, R. norvegicus
caagaggaaatcacct

SEQ ID NO: 484362 - DNA, 16 bp, R. norvegicus
caagaggaagcaggag

SEQ ID NO: 484363 - DNA, 16 bp, R. norvegicus
caagaggagcagaagg

SEQ ID NO: 484364 - DNA, 16 bp, R. norvegicus
caagaggaggtcaagg

SEQ ID NO: 484365 - DNA, 16 bp, R. norvegicus
caagaggcaaaagcag

SEQ ID NO: 484366 - DNA, 16 bp, R. norvegicus
caagaggcaaatgcag

SEQ ID NO: 484367 - DNA, 16 bp, R. norvegicus
caagaggcaactgtat

SEQ ID NO: 484368 - DNA, 16 bp, R. norvegicus
caagaggcagaggctg

SEQ ID NO: 484369 - DNA, 16 bp, R. norvegicus
caagaggcaggggcag

SEQ ID NO: 484370 - DNA, 16 bp, R. norvegicus
caagaggtttactttg

SEQ ID NO: 484371 - DNA, 16 bp, R. norvegicus
caagagtctgaggcag

SEQ ID NO: 484372 - DNA, 16 bp, R. norvegicus
caagagtctgatcaag

SEQ ID NO: 484373 - DNA, 16 bp, R. norvegicus
caagagtgcccacctg

SEQ ID NO: 484374 - DNA, 16 bp, R. norvegicus
caagagtggagcagag

SEQ ID NO: 484375 - DNA, 16 bp, R. norvegicus
caagagtggaggagtg

SEQ ID NO: 484376 - DNA, 16 bp, R. norvegicus
caagagttcaagacca

SEQ ID NO: 484377 - DNA, 29 bp, R. norvegicus
caagagttgtcagagtcggaggaggagga

SEQ ID NO: 484378 - DNA, 16 bp, R. norvegicus
caagataaacaaaccc

SEQ ID NO: 484379 - DNA, 16 bp, R. norvegicus
caagatacagcaaaat

SEQ ID NO: 484380 - DNA, 16 bp, R. norvegicus
caagatatcattattt

SEQ ID NO: 484381 - DNA, 16 bp, R. norvegicus
caagatcaagggcctc

SEQ ID NO: 484382 - DNA, 16 bp, R. norvegicus
caagatcatccttgac

SEQ ID NO: 484383 - DNA, 16 bp, R. norvegicus
caagatcttcaagtct

SEQ ID NO: 484384 - DNA, 16 bp, R. norvegicus
caagatctttagtcat

SEQ ID NO: 484385 - DNA, 16 bp, R. norvegicus
caagatgaactttcaa

SEQ ID NO: 484386 - DNA, 16 bp, R. norvegicus
caagatggagaactct

SEQ ID NO: 484387 - DNA, 16 bp, R. norvegicus
caagatggaggcagag

SEQ ID NO: 484388 - DNA, 16 bp, R. norvegicus
caagatggatgaagcg

SEQ ID NO: 484389 - DNA, 16 bp, R. norvegicus
caagatggcccagcag

SEQ ID NO: 484390 - DNA, 16 bp, R. norvegicus
caagatggttcagcag

SEQ ID NO: 484391 - DNA, 16 bp, R. norvegicus
caagatgtctatgatg

SEQ ID NO: 484392 - DNA, 16 bp, R. norvegicus
caagattcaattcaca

SEQ ID NO: 484393 - DNA, 16 bp, R. norvegicus
caagattctctgtaaa

SEQ ID NO: 484394 - DNA, 16 bp, R. norvegicus
caagattctgaagaaa

SEQ ID NO: 484395 - DNA, 16 bp, R. norvegicus
caagattgctcagtgg

SEQ ID NO: 484396 - DNA, 16 bp, R. norvegicus
caagattggctatgag

SEQ ID NO: 484397 - DNA, 16 bp, R. norvegicus
caagatttatttaaaa

SEQ ID NO: 484398 - DNA, 16 bp, R. norvegicus
caagcaaacaaacata

SEQ ID NO: 484399 - DNA, 16 bp, R. norvegicus
caagcaaatagtccca

SEQ ID NO: 484400 - DNA, 16 bp, R. norvegicus
caagcaaatggatgaa

SEQ ID NO: 484401 - DNA, 16 bp, R. norvegicus
caagcaaatggtcata

SEQ ID NO: 484402 - DNA, 16 bp, R. norvegicus
caagcaaccagagctc

SEQ ID NO: 484403 - DNA, 16 bp, R. norvegicus
caagcaagcagagctt

SEQ ID NO: 484404 - DNA, 16 bp, R. norvegicus
caagcaagtcaaagat

SEQ ID NO: 484405 - DNA, 16 bp, R. norvegicus
caagcaagtgaaaaaa

SEQ ID NO: 484406 - DNA, 16 bp, R. norvegicus
caagcaagtgaaagac

SEQ ID NO: 484407 - DNA, 16 bp, R. norvegicus
caagcaagtggtcaga

SEQ ID NO: 484408 - DNA, 16 bp, R. norvegicus
caagcaatgaaacaaa

SEQ ID NO: 484409 - DNA, 16 bp, R. norvegicus
caagcacagggcctgc

SEQ ID NO: 484410 - DNA, 16 bp, R. norvegicus
caagcacatgaaagaa

SEQ ID NO: 484411 - DNA, 16 bp, R. norvegicus
caagcacatgccacca

SEQ ID NO: 484412 - DNA, 16 bp, R. norvegicus
caagcaccttcacctg

SEQ ID NO: 484413 - DNA, 16 bp, R. norvegicus
caagcacctttactca

SEQ ID NO: 484414 - DNA, 16 bp, R. norvegicus
caagcacttcctggca

SEQ ID NO: 484415 - DNA, 16 bp, R. norvegicus
caagcagaaggacctg

SEQ ID NO: 484416 - DNA, 16 bp, R. norvegicus
caagcagacaaaagct

SEQ ID NO: 484417 - DNA, 16 bp, R. norvegicus
caagcagagcttccag

SEQ ID NO: 484418 - DNA, 16 bp, R. norvegicus
caagcagatcaggaag

SEQ ID NO: 484419 - DNA, 16 bp, R. norvegicus
caagcagcaggcacag

SEQ ID NO: 484420 - DNA, 16 bp, R. norvegicus
caagcagctgaaggag

SEQ ID NO: 484421 - DNA, 16 bp, R. norvegicus
caagcagcttaaagag

SEQ ID NO: 484422 - DNA, 16 bp, R. norvegicus
caagcaggaaaagctt

SEQ ID NO: 484423 - DNA, 16 bp, R. norvegicus
caagcaggaactgaag

SEQ ID NO: 484424 - DNA, 16 bp, R. norvegicus
caagcaggagctgatg

SEQ ID NO: 484425 - DNA, 16 bp, R. norvegicus
caagcaggaggacctg

SEQ ID NO: 484426 - DNA, 16 bp, R. norvegicus
caagcaggaggcagag

SEQ ID NO: 484427 - DNA, 16 bp, R. norvegicus
caagcaggagggcctg

SEQ ID NO: 484428 - DNA, 16 bp, R. norvegicus
caagcaggcaggcaag

SEQ ID NO: 484429 - DNA, 16 bp, R. norvegicus
caagcaggtgaagaag

SEQ ID NO: 484430 - DNA, 16 bp, R. norvegicus
caagcagtgtccttgt

SEQ ID NO: 484431 - DNA, 16 bp, R. norvegicus
caagcatcaccaaaag

SEQ ID NO: 484432 - DNA, 16 bp, R. norvegicus
caagcatcaccaactg

SEQ ID NO: 484433 - DNA, 16 bp, R. norvegicus
caagcatcacccacag

SEQ ID NO: 484434 - DNA, 16 bp, R. norvegicus
caagcatcccaagtgg

SEQ ID NO: 484435 - DNA, 16 bp, R. norvegicus
caagcatgtgtcacca

SEQ ID NO: 484436 - DNA, 16 bp, R. norvegicus
caagccaacttttctc

SEQ ID NO: 484437 - DNA, 16 bp, R. norvegicus
caagccagcaagcaac

SEQ ID NO: 484438 - DNA, 16 bp, R. norvegicus
caagccagcctgggct

SEQ ID NO: 484439 - DNA, 16 bp, R. norvegicus
caagccagggagcagc

SEQ ID NO: 484440 - DNA, 16 bp, R. norvegicus
caagccagggggagca

SEQ ID NO: 484441 - DNA, 16 bp, R. norvegicus
caagccagtgtcagag

SEQ ID NO: 484442 - DNA, 16 bp, R. norvegicus
caagccagtgtcctgt

SEQ ID NO: 484443 - DNA, 16 bp, R. norvegicus
caagccatcacaggac

SEQ ID NO: 484444 - DNA, 16 bp, R. norvegicus
caagccatcttgctgg

SEQ ID NO: 484445 - DNA, 16 bp, R. norvegicus
caagccatgatgagca

SEQ ID NO: 484446 - DNA, 16 bp, R. norvegicus
caagccatggggagca

SEQ ID NO: 484447 - DNA, 20 bp, R. norvegicus
caagccattttggagagcaa

SEQ ID NO: 484448 - DNA, 16 bp, R. norvegicus
caagcccaaggacctg

SEQ ID NO: 484449 - DNA, 16 bp, R. norvegicus
caagccccctcccatc

SEQ ID NO: 484450 - DNA, 16 bp, R. norvegicus
caagccccttcagccc

SEQ ID NO: 484451 - DNA, 16 bp, R. norvegicus
caagccctggataccc

SEQ ID NO: 484452 - DNA, 16 bp, R. norvegicus
caagccctgggttcca

SEQ ID NO: 484453 - DNA, 16 bp, R. norvegicus
caagccgtggggagca

SEQ ID NO: 484454 - DNA, 16 bp, R. norvegicus
caagcctctgaagaca

SEQ ID NO: 484455 - DNA, 16 bp, R. norvegicus
caagcctgaaaacctg

SEQ ID NO: 484456 - DNA, 16 bp, R. norvegicus
caagcctgacaaactg

SEQ ID NO: 484457 - DNA, 16 bp, R. norvegicus
caagcctgagattcca

SEQ ID NO: 484458 - DNA, 16 bp, R. norvegicus
caagcctgcctctgcc

SEQ ID NO: 484459 - DNA, 16 bp, R. norvegicus
caagcctggaaaacca

SEQ ID NO: 484460 - DNA, 16 bp, R. norvegicus
caagcctggtggcctg

SEQ ID NO: 484461 - DNA, 17 bp, R. norvegicus
caagcctttgagaggaa

SEQ ID NO: 484462 - DNA, 16 bp, R. norvegicus
caagcgcaggccctgg

SEQ ID NO: 484463 - DNA, 16 bp, R. norvegicus
caagcggatctctgtg

SEQ ID NO: 484464 - DNA, 16 bp, R. norvegicus
caagctacaggagccc

SEQ ID NO: 484465 - DNA, 16 bp, R. norvegicus
caagctcaagaccctg

SEQ ID NO: 484466 - DNA, 16 bp, R. norvegicus
caagctcacagagatc

SEQ ID NO: 484467 - DNA, 16 bp, R. norvegicus
caagctccaggctcag

SEQ ID NO: 484468 - DNA, 16 bp, R. norvegicus
caagctctttcagtcc

SEQ ID NO: 484469 - DNA, 16 bp, R. norvegicus
caagctgaaaaagaaa

SEQ ID NO: 484470 - DNA, 16 bp, R. norvegicus
caagctgaacaagcca

SEQ ID NO: 484471 - DNA, 16 bp, R. norvegicus
caagctgacaggagcc

SEQ ID NO: 484472 - DNA, 16 bp, R. norvegicus
caagctgaggctgagg

SEQ ID NO: 484473 - DNA, 16 bp, R. norvegicus
caagctgcaggagccc

SEQ ID NO: 484474 - DNA, 16 bp, R. norvegicus
caagctgctccacttc

SEQ ID NO: 484475 - DNA, 16 bp, R. norvegicus
caagctgctgctgctg

SEQ ID NO: 484476 - DNA, 16 bp, R. norvegicus
caagctggaatgttca

SEQ ID NO: 484477 - DNA, 16 bp, R. norvegicus
caagctggagcagcca

SEQ ID NO: 484478 - DNA, 16 bp, R. norvegicus
caagctggagttgcca

SEQ ID NO: 484479 - DNA, 16 bp, R. norvegicus
caagctggccttggac

SEQ ID NO: 484480 - DNA, 16 bp, R. norvegicus
caagctgtatatctgc

SEQ ID NO: 484481 - DNA, 16 bp, R. norvegicus
caagctgttctctgac

SEQ ID NO: 484482 - DNA, 16 bp, R. norvegicus
caagcttgcacagcaa

SEQ ID NO: 484483 - DNA, 16 bp, R. norvegicus
caaggaaagctgctaa

SEQ ID NO: 484484 - DNA, 16 bp, R. norvegicus
caaggaaatacaaatt

SEQ ID NO: 484485 - DNA, 16 bp, R. norvegicus
caaggaaatccaggac

SEQ ID NO: 484486 - DNA, 16 bp, R. norvegicus
caaggaactcaatgcc

SEQ ID NO: 484487 - DNA, 16 bp, R. norvegicus
caaggaagtgaaagat

SEQ ID NO: 484488 - DNA, 16 bp, R. norvegicus
caaggaattctgggaa

SEQ ID NO: 484489 - DNA, 16 bp, R. norvegicus
caaggacaaagacaga

SEQ ID NO: 484490 - DNA, 16 bp, R. norvegicus
caaggacaaggacaag

SEQ ID NO: 484491 - DNA, 16 bp, R. norvegicus
caaggacacctacatt

SEQ ID NO: 484492 - DNA, 16 bp, R. norvegicus
caaggacagacactac

SEQ ID NO: 484493 - DNA, 16 bp, R. norvegicus
caaggacagcagccta

SEQ ID NO: 484494 - DNA, 16 bp, R. norvegicus
caaggacagtcttgtg

SEQ ID NO: 484495 - DNA, 16 bp, R. norvegicus
caaggacatgtgctcc

SEQ ID NO: 484496 - DNA, 16 bp, R. norvegicus
caaggacctcctcatc

SEQ ID NO: 484497 - DNA, 16 bp, R. norvegicus
caaggacctctcttcc

SEQ ID NO: 484498 - DNA, 16 bp, R. norvegicus
caaggacctttaccca

SEQ ID NO: 484499 - DNA, 19 bp, R. norvegicus
caaggactcaatatgactg

SEQ ID NO: 484500 - DNA, 16 bp, R. norvegicus
caaggactctaccaac

SEQ ID NO: 484501 - DNA, 16 bp, R. norvegicus
caaggacttcccctcc

SEQ ID NO: 484502 - DNA, 16 bp, R. norvegicus
caaggacttcttggca

SEQ ID NO: 484503 - DNA, 16 bp, R. norvegicus
caaggagaccccaatg

SEQ ID NO: 484504 - DNA, 16 bp, R. norvegicus
caaggagccttagata

SEQ ID NO: 484505 - DNA, 16 bp, R. norvegicus
caaggagctgggcccc

SEQ ID NO: 484506 - DNA, 16 bp, R. norvegicus
caaggagctggttctt

SEQ ID NO: 484507 - DNA, 16 bp, R. norvegicus
caaggagctgtttgac

SEQ ID NO: 484508 - DNA, 16 bp, R. norvegicus
caaggaggagcttcct

SEQ ID NO: 484509 - DNA, 16 bp, R. norvegicus
caaggaggccagagga

SEQ ID NO: 484510 - DNA, 16 bp, R. norvegicus
caaggaggctggagag

SEQ ID NO: 484511 - DNA, 16 bp, R. norvegicus
caaggaggtcagaaga

SEQ ID NO: 484512 - DNA, 16 bp, R. norvegicus
caaggataatgtaaag

SEQ ID NO: 484513 - DNA, 16 bp, R. norvegicus
caaggatatgaagaaa

SEQ ID NO: 484514 - DNA, 16 bp, R. norvegicus
caaggatatggagaaa

SEQ ID NO: 484515 - DNA, 16 bp, R. norvegicus
caaggatctggagaaa

SEQ ID NO: 484516 - DNA, 16 bp, R. norvegicus
caaggatgcagggatg

SEQ ID NO: 484517 - DNA, 16 bp, R. norvegicus
caaggatgtggtgaaa

SEQ ID NO: 484518 - DNA, 16 bp, R. norvegicus
caaggcactgatatat

SEQ ID NO: 484519 - DNA, 16 bp, R. norvegicus
caaggcagacatggtg

SEQ ID NO: 484520 - DNA, 16 bp, R. norvegicus
caaggcagcctagcta

SEQ ID NO: 484521 - DNA, 16 bp, R. norvegicus
caaggccacacccctt

SEQ ID NO: 484522 - DNA, 16 bp, R. norvegicus
caaggccacagccact

SEQ ID NO: 484523 - DNA, 16 bp, R. norvegicus
caaggccacagctcct

SEQ ID NO: 484524 - DNA, 16 bp, R. norvegicus
caaggccacatcccct

SEQ ID NO: 484525 - DNA, 16 bp, R. norvegicus
caaggccagccaagac

SEQ ID NO: 484526 - DNA, 16 bp, R. norvegicus
caaggccagccaaggc

SEQ ID NO: 484527 - DNA, 16 bp, R. norvegicus
caaggccagccaggga

SEQ ID NO: 484528 - DNA, 16 bp, R. norvegicus
caaggccagcctcagc

SEQ ID NO: 484529 - DNA, 16 bp, R. norvegicus
caaggccagcctgctc

SEQ ID NO: 484530 - DNA, 16 bp, R. norvegicus
caaggccaggctggga

SEQ ID NO: 484531 - DNA, 16 bp, R. norvegicus
caaggccctgggtccc

SEQ ID NO: 484532 - DNA, 27 bp, R. norvegicus
caaggccctgggttcagtccccagctc

SEQ ID NO: 484533 - DNA, 18 bp, R. norvegicus
caaggccctgggttcggc

SEQ ID NO: 484534 - DNA, 27 bp, R. norvegicus
caaggccctgggttcggtccccaactc

SEQ ID NO: 484535 - DNA, 27 bp, R. norvegicus
caaggccctgggttcggtccccagctc

SEQ ID NO: 484536 - DNA, 27 bp, R. norvegicus
caaggccctgggttcggtccctagctc

SEQ ID NO: 484537 - DNA, 20 bp, R. norvegicus
caaggccctgggttcggtct

SEQ ID NO: 484538 - DNA, 20 bp, R. norvegicus
caaggccctgggttcggttc

SEQ ID NO: 484539 - DNA, 27 bp, R. norvegicus
caaggccctgggtttggtccccagctc

SEQ ID NO: 484540 - DNA, 16 bp, R. norvegicus
caaggcctccactgtg

SEQ ID NO: 484541 - DNA, 16 bp, R. norvegicus
caaggcctctggcttc

SEQ ID NO: 484542 - DNA, 16 bp, R. norvegicus
caaggccttctccttc

SEQ ID NO: 484543 - DNA, 16 bp, R. norvegicus
caaggctacacaggga

SEQ ID NO: 484544 - DNA, 16 bp, R. norvegicus
caaggctacacagtga

SEQ ID NO: 484545 - DNA, 16 bp, R. norvegicus
caaggctacactgaga

SEQ ID NO: 484546 - DNA, 16 bp, R. norvegicus
caaggctagcccaggc

SEQ ID NO: 484547 - DNA, 16 bp, R. norvegicus
caaggctcagagatca

SEQ ID NO: 484548 - DNA, 16 bp, R. norvegicus
caaggctcaggaaaca

SEQ ID NO: 484549 - DNA, 16 bp, R. norvegicus
caaggctgaaatcaac

SEQ ID NO: 484550 - DNA, 16 bp, R. norvegicus
caaggctgaatgaggc

SEQ ID NO: 484551 - DNA, 16 bp, R. norvegicus
caaggctgacaacctg

SEQ ID NO: 484552 - DNA, 16 bp, R. norvegicus
caaggctgcagcccct

SEQ ID NO: 484553 - DNA, 16 bp, R. norvegicus
caaggctgcctattct

SEQ ID NO: 484554 - DNA, 16 bp, R. norvegicus
caaggctggcctagaa

SEQ ID NO: 484555 - DNA, 16 bp, R. norvegicus
caaggcttcccactct

SEQ ID NO: 484556 - DNA, 16 bp, R. norvegicus
caaggcttctgtaagg

SEQ ID NO: 484557 - DNA, 20 bp, R. norvegicus
caagggaaaggccaggctgg

SEQ ID NO: 484558 - DNA, 16 bp, R. norvegicus
caagggacactgtcat

SEQ ID NO: 484559 - DNA, 16 bp, R. norvegicus
caagggacccagaagg

SEQ ID NO: 484560 - DNA, 16 bp, R. norvegicus
caagggactcccctcc

SEQ ID NO: 484561 - DNA, 16 bp, R. norvegicus
caagggaggttaaagt

SEQ ID NO: 484562 - DNA, 16 bp, R. norvegicus
caagggcaagggcaag

SEQ ID NO: 484563 - DNA, 16 bp, R. norvegicus
caagggcactggaaaa

SEQ ID NO: 484564 - DNA, 16 bp, R. norvegicus
caagggcagaaggcag

SEQ ID NO: 484565 - DNA, 24 bp, R. norvegicus
caagggcagcacaaggacatctgc

SEQ ID NO: 484566 - DNA, 16 bp, R. norvegicus
caagggcaggctcaga

SEQ ID NO: 484567 - DNA, 16 bp, R. norvegicus
caagggcatctcctcc

SEQ ID NO: 484568 - DNA, 16 bp, R. norvegicus
caagggcctggagaga

SEQ ID NO: 484569 - DNA, 16 bp, R. norvegicus
caagggctcccccttc

SEQ ID NO: 484570 - DNA, 16 bp, R. norvegicus
caagggctgggattgc

SEQ ID NO: 484571 - DNA, 16 bp, R. norvegicus
caagggcttccacttc

SEQ ID NO: 484572 - DNA, 16 bp, R. norvegicus
caagggcttctccttt

SEQ ID NO: 484573 - DNA, 16 bp, R. norvegicus
caaggggaaaaggtca

SEQ ID NO: 484574 - DNA, 16 bp, R. norvegicus
caaggggaccccaatg

SEQ ID NO: 484575 - DNA, 16 bp, R. norvegicus
caaggggagtaaaggg

SEQ ID NO: 484576 - DNA, 16 bp, R. norvegicus
caaggggattcaaatt

SEQ ID NO: 484577 - DNA, 17 bp, R. norvegicus
caaggggctactggcaa

SEQ ID NO: 484578 - DNA, 16 bp, R. norvegicus
caaggggctggggaga

SEQ ID NO: 484579 - DNA, 16 bp, R. norvegicus
caaggtcaatttaatt

SEQ ID NO: 484580 - DNA, 16 bp, R. norvegicus
caaggtcatcctcaat

SEQ ID NO: 484581 - DNA, 25 bp, R. norvegicus
caaggtcctgggttcggtccccagc

SEQ ID NO: 484582 - DNA, 16 bp, R. norvegicus
caaggtccttcctcag

SEQ ID NO: 484583 - DNA, 16 bp, R. norvegicus
caaggtctataaaaat

SEQ ID NO: 484584 - DNA, 16 bp, R. norvegicus
caaggtctgcaactcc

SEQ ID NO: 484585 - DNA, 16 bp, R. norvegicus
caaggtgaccttgaac

SEQ ID NO: 484586 - DNA, 16 bp, R. norvegicus
caaggtgatctccaag

SEQ ID NO: 484587 - DNA, 33 bp, R. norvegicus
caaggtgcatttgctgttgcttctccagcttct

SEQ ID NO: 484588 - DNA, 16 bp, R. norvegicus
caaggtgctggagaag

SEQ ID NO: 484589 - DNA, 16 bp, R. norvegicus
caaggtggccattttt

SEQ ID NO: 484590 - DNA, 16 bp, R. norvegicus
caaggtgggagggagg

SEQ ID NO: 484591 - DNA, 16 bp, R. norvegicus
caaggttgggggcagg

SEQ ID NO: 484592 - DNA, 16 bp, R. norvegicus
caagtaacatacaaag

SEQ ID NO: 484593 - DNA, 16 bp, R. norvegicus
caagtacacccaggag

SEQ ID NO: 484594 - DNA, 16 bp, R. norvegicus
caagtaccaggacagc

SEQ ID NO: 484595 - DNA, 16 bp, R. norvegicus
caagtacctgggattc

SEQ ID NO: 484596 - DNA, 16 bp, R. norvegicus
caagtacctttacctg

SEQ ID NO: 484597 - DNA, 18 bp, R. norvegicus
caagtactcttggtttct

SEQ ID NO: 484598 - DNA, 16 bp, R. norvegicus
caagtacttcttggca

SEQ ID NO: 484599 - DNA, 16 bp, R. norvegicus
caagtagaaacaaaca

SEQ ID NO: 484600 - DNA, 16 bp, R. norvegicus
caagtagaaatgaaaa

SEQ ID NO: 484601 - DNA, 16 bp, R. norvegicus
caagtagaagcaaaaa

SEQ ID NO: 484602 - DNA, 16 bp, R. norvegicus
caagtaggcttcatct

SEQ ID NO: 484603 - DNA, 16 bp, R. norvegicus
caagtaggggctggaa

SEQ ID NO: 484604 - DNA, 16 bp, R. norvegicus
caagtatgaggacctg

SEQ ID NO: 484605 - DNA, 16 bp, R. norvegicus
caagtatgtggagaaa

SEQ ID NO: 484606 - DNA, 16 bp, R. norvegicus
caagtccagtctggtc

SEQ ID NO: 484607 - DNA, 16 bp, R. norvegicus
caagtccatcctgagt

SEQ ID NO: 484608 - DNA, 16 bp, R. norvegicus
caagtccatcttcagg

SEQ ID NO: 484609 - DNA, 16 bp, R. norvegicus
caagtcccagcaccca

SEQ ID NO: 484610 - DNA, 16 bp, R. norvegicus
caagtcccaggacagc

SEQ ID NO: 484611 - DNA, 16 bp, R. norvegicus
caagtcccaggccagc

SEQ ID NO: 484612 - DNA, 32 bp, R. norvegicus
caagtcctccgaagagactgtgtgcccgcagg

SEQ ID NO: 484613 - DNA, 16 bp, R. norvegicus
caagtcttgcttttcc

SEQ ID NO: 484614 - DNA, 16 bp, R. norvegicus
caagtctttaaggaaa

SEQ ID NO: 484615 - DNA, 16 bp, R. norvegicus
caagtctttgaagaaa

SEQ ID NO: 484616 - DNA, 16 bp, R. norvegicus
caagtgaaaaatctgt

SEQ ID NO: 484617 - DNA, 16 bp, R. norvegicus
caagtgaagatgtgtg

SEQ ID NO: 484618 - DNA, 16 bp, R. norvegicus
caagtgacagctcgtg

SEQ ID NO: 484619 - DNA, 16 bp, R. norvegicus
caagtgaccttggttt

SEQ ID NO: 484620 - DNA, 16 bp, R. norvegicus
caagtgatggagaggt

SEQ ID NO: 484621 - DNA, 16 bp, R. norvegicus
caagtgcaagggcacc

SEQ ID NO: 484622 - DNA, 16 bp, R. norvegicus
caagtgcaggggaatg

SEQ ID NO: 484623 - DNA, 16 bp, R. norvegicus
caagtgcccattggtg

SEQ ID NO: 484624 - DNA, 16 bp, R. norvegicus
caagtgctcagtgtcc

SEQ ID NO: 484625 - DNA, 16 bp, R. norvegicus
caagtgctgcagctgg

SEQ ID NO: 484626 - DNA, 16 bp, R. norvegicus
caagtgctgggattac

SEQ ID NO: 484627 - DNA, 16 bp, R. norvegicus
caagtgcttttaacca

SEQ ID NO: 484628 - DNA, 16 bp, R. norvegicus
caagtggaagccctta

SEQ ID NO: 484629 - DNA, 16 bp, R. norvegicus
caagtggatcaaaaac

SEQ ID NO: 484630 - DNA, 16 bp, R. norvegicus
caagtggatgaaagac

SEQ ID NO: 484631 - DNA, 16 bp, R. norvegicus
caagtggattaagaac

SEQ ID NO: 484632 - DNA, 16 bp, R. norvegicus
caagtggattgaggac

SEQ ID NO: 484633 - DNA, 16 bp, R. norvegicus
caagtggctgctggga

SEQ ID NO: 484634 - DNA, 16 bp, R. norvegicus
caagtggttgtgagct

SEQ ID NO: 484635 - DNA, 16 bp, R. norvegicus
caagtgtctgagagat

SEQ ID NO: 484636 - DNA, 16 bp, R. norvegicus
caagtgtctgtgtgtg

SEQ ID NO: 484637 - DNA, 16 bp, R. norvegicus
caagtgtgaagacctg

SEQ ID NO: 484638 - DNA, 16 bp, R. norvegicus
caagtgtgatgaggaa

SEQ ID NO: 484639 - DNA, 16 bp, R. norvegicus
caagtgttatttcctt

SEQ ID NO: 484640 - DNA, 16 bp, R. norvegicus
caagttaataaagaag

SEQ ID NO: 484641 - DNA, 16 bp, R. norvegicus
caagttcaaaaccagc

SEQ ID NO: 484642 - DNA, 16 bp, R. norvegicus
caagttcaaggacagc

SEQ ID NO: 484643 - DNA, 16 bp, R. norvegicus
caagttcaaggccctg

SEQ ID NO: 484644 - DNA, 16 bp, R. norvegicus
caagttcaaggtcacc

SEQ ID NO: 484645 - DNA, 16 bp, R. norvegicus
caagttcagcaaagtg

SEQ ID NO: 484646 - DNA, 16 bp, R. norvegicus
caagttcagctcccag

SEQ ID NO: 484647 - DNA, 16 bp, R. norvegicus
caagttcagctgcagc

SEQ ID NO: 484648 - DNA, 16 bp, R. norvegicus
caagttcataaaagaa

SEQ ID NO: 484649 - DNA, 16 bp, R. norvegicus
caagttcatctggaat

SEQ ID NO: 484650 - DNA, 16 bp, R. norvegicus
caagttccagcaacca

SEQ ID NO: 484651 - DNA, 16 bp, R. norvegicus
caagttccaggaaagc

SEQ ID NO: 484652 - DNA, 16 bp, R. norvegicus
caagttccaggccaag

SEQ ID NO: 484653 - DNA, 16 bp, R. norvegicus
caagttccaggccatc

SEQ ID NO: 484654 - DNA, 16 bp, R. norvegicus
caagttccctcttccc

SEQ ID NO: 484655 - DNA, 16 bp, R. norvegicus
caagttcctgtcctgt

SEQ ID NO: 484656 - DNA, 16 bp, R. norvegicus
caagttctaggacaga

SEQ ID NO: 484657 - DNA, 16 bp, R. norvegicus
caagttctttgaaaag

SEQ ID NO: 484658 - DNA, 16 bp, R. norvegicus
caagttgagaaagaaa

SEQ ID NO: 484659 - DNA, 16 bp, R. norvegicus
caagttgctgaagaaa

SEQ ID NO: 484660 - DNA, 16 bp, R. norvegicus
caagttgcttttgatc

SEQ ID NO: 484661 - DNA, 16 bp, R. norvegicus
caagttggggaggaga

SEQ ID NO: 484662 - DNA, 16 bp, R. norvegicus
caagttgtcctctgac

SEQ ID NO: 484663 - DNA, 16 bp, R. norvegicus
caagtttctgaagctg

SEQ ID NO: 484664 - DNA, 16 bp, R. norvegicus
caagtttctgaggaac

SEQ ID NO: 484665 - DNA, 16 bp, R. norvegicus
caagtttgaggccagc

SEQ ID NO: 484666 - DNA, 16 bp, R. norvegicus
caagtttggtttccag

SEQ ID NO: 484667 - DNA, 16 bp, R. norvegicus
caataaaagaactact

SEQ ID NO: 484668 - DNA, 16 bp, R. norvegicus
caataaaagcccagga

SEQ ID NO: 484669 - DNA, 16 bp, R. norvegicus
caataaaagtaatttt

SEQ ID NO: 484670 - DNA, 16 bp, R. norvegicus
caataaaatagacttt

SEQ ID NO: 484671 - DNA, 16 bp, R. norvegicus
caataaaatcctaact

SEQ ID NO: 484672 - DNA, 16 bp, R. norvegicus
caataaagaaggttct

SEQ ID NO: 484673 - DNA, 16 bp, R. norvegicus
caataaagatgctagt

SEQ ID NO: 484674 - DNA, 16 bp, R. norvegicus
caataaaggcttgttc

SEQ ID NO: 484675 - DNA, 16 bp, R. norvegicus
caataagaaaggggag

SEQ ID NO: 484676 - DNA, 16 bp, R. norvegicus
caataagaaatttact

SEQ ID NO: 484677 - DNA, 16 bp, R. norvegicus
caataagaacaacaat

SEQ ID NO: 484678 - DNA, 16 bp, R. norvegicus
caataagcagctgaaa

SEQ ID NO: 484679 - DNA, 16 bp, R. norvegicus
caataagccagagacc

SEQ ID NO: 484680 - DNA, 16 bp, R. norvegicus
caataaggaaaacaca

SEQ ID NO: 484681 - DNA, 30 bp, R. norvegicus
caataatcactattccttaatatctctcaa

SEQ ID NO: 484682 - DNA, 16 bp, R. norvegicus
caataccaagtggtca

SEQ ID NO: 484683 - DNA, 16 bp, R. norvegicus
caatactagcagcaaa

SEQ ID NO: 484684 - DNA, 16 bp, R. norvegicus
caatactgactgggtt

SEQ ID NO: 484685 - DNA, 16 bp, R. norvegicus
caatactgcccaaact

SEQ ID NO: 484686 - DNA, 16 bp, R. norvegicus
caatactgggtcctca

SEQ ID NO: 484687 - DNA, 16 bp, R. norvegicus
caatactttctctaac

SEQ ID NO: 484688 - DNA, 16 bp, R. norvegicus
caatagaaccaaaagt

SEQ ID NO: 484689 - DNA, 16 bp, R. norvegicus
caatagaagagaaagt

SEQ ID NO: 484690 - DNA, 16 bp, R. norvegicus
caatagcaataataat

SEQ ID NO: 484691 - DNA, 16 bp, R. norvegicus
caatatatgcaaagaa

SEQ ID NO: 484692 - DNA, 16 bp, R. norvegicus
caatatattcaaagaa

SEQ ID NO: 484693 - DNA, 16 bp, R. norvegicus
caatatcagatcatgt

SEQ ID NO: 484694 - DNA, 16 bp, R. norvegicus
caatatcatagaagaa

SEQ ID NO: 484695 - DNA, 16 bp, R. norvegicus
caatatcctgggtttt

SEQ ID NO: 484696 - DNA, 16 bp, R. norvegicus
caatattcataagcaa

SEQ ID NO: 484697 - DNA, 16 bp, R. norvegicus
caatattcctcaaaat

SEQ ID NO: 484698 - DNA, 16 bp, R. norvegicus
caatattcttcagctg

SEQ ID NO: 484699 - DNA, 16 bp, R. norvegicus
caatatttatctttct

SEQ ID NO: 484700 - DNA, 16 bp, R. norvegicus
caatcaaaaaatgagg

SEQ ID NO: 484701 - DNA, 16 bp, R. norvegicus
caatcaaaccaaatgg

SEQ ID NO: 484702 - DNA, 16 bp, R. norvegicus
caatcaacaaaaccag

SEQ ID NO: 484703 - DNA, 16 bp, R. norvegicus
caatcaacagaaacca

SEQ ID NO: 484704 - DNA, 16 bp, R. norvegicus
caatcaaccagacccc

SEQ ID NO: 484705 - DNA, 16 bp, R. norvegicus
caatcaatatcctagt

SEQ ID NO: 484706 - DNA, 16 bp, R. norvegicus
caatcaatgagtacac

SEQ ID NO: 484707 - DNA, 16 bp, R. norvegicus
caatcagacaccaaaa

SEQ ID NO: 484708 - DNA, 16 bp, R. norvegicus
caatcagattggcctg

SEQ ID NO: 484709 - DNA, 16 bp, R. norvegicus
caatcagcaaagcctc

SEQ ID NO: 484710 - DNA, 16 bp, R. norvegicus
caatcatccatcctga

SEQ ID NO: 484711 - DNA, 16 bp, R. norvegicus
caatcatgttcactgg

SEQ ID NO: 484712 - DNA, 16 bp, R. norvegicus
caatcattggtctcta

SEQ ID NO: 484713 - DNA, 16 bp, R. norvegicus
caatccactgaccaca

SEQ ID NO: 484714 - DNA, 16 bp, R. norvegicus
caatccatagactaca

SEQ ID NO: 484715 - DNA, 16 bp, R. norvegicus
caatcccaccaacact

SEQ ID NO: 484716 - DNA, 16 bp, R. norvegicus
caatccctgcatgcct

SEQ ID NO: 484717 - DNA, 16 bp, R. norvegicus
caatccctggagccca

SEQ ID NO: 484718 - DNA, 16 bp, R. norvegicus
caatccctggcaccca

SEQ ID NO: 484719 - DNA, 16 bp, R. norvegicus
caatccgaccaacaat

SEQ ID NO: 484720 - DNA, 16 bp, R. norvegicus
caatccttcccctatc

SEQ ID NO: 484721 - DNA, 16 bp, R. norvegicus
caatctccaccaaaat

SEQ ID NO: 484722 - DNA, 16 bp, R. norvegicus
caatctggtggaggca

SEQ ID NO: 484723 - DNA, 16 bp, R. norvegicus
caatctgttggtttcc

SEQ ID NO: 484724 - DNA, 16 bp, R. norvegicus
caatcttttaaatcaa

SEQ ID NO: 484725 - DNA, 16 bp, R. norvegicus
caatgaaaataacttt

SEQ ID NO: 484726 - DNA, 16 bp, R. norvegicus
caatgaaaatgaaggc

SEQ ID NO: 484727 - DNA, 16 bp, R. norvegicus
caatgaacaccaggag

SEQ ID NO: 484728 - DNA, 16 bp, R. norvegicus
caatgaacctgtggag

SEQ ID NO: 484729 - DNA, 16 bp, R. norvegicus
caatgaagaaagagaa

SEQ ID NO: 484730 - DNA, 16 bp, R. norvegicus
caatgaagaaggaaat

SEQ ID NO: 484731 - DNA, 16 bp, R. norvegicus
caatgaaggctgtgct

SEQ ID NO: 484732 - DNA, 16 bp, R. norvegicus
caatgaatggtgctgg

SEQ ID NO: 484733 - DNA, 16 bp, R. norvegicus
caatgacaacagcaac

SEQ ID NO: 484734 - DNA, 16 bp, R. norvegicus
caatgacaacatgaaa

SEQ ID NO: 484735 - DNA, 16 bp, R. norvegicus
caatgacccagtgtag

SEQ ID NO: 484736 - DNA, 16 bp, R. norvegicus
caatgacttcatcaaa

SEQ ID NO: 484737 - DNA, 16 bp, R. norvegicus
caatgacttcctgaaa

SEQ ID NO: 484738 - DNA, 16 bp, R. norvegicus
caatgactttaagaaa

SEQ ID NO: 484739 - DNA, 16 bp, R. norvegicus
caatgagaaaagtaaa

SEQ ID NO: 484740 - DNA, 22 bp, R. norvegicus
caatgagaagatcaaacctaac

SEQ ID NO: 484741 - DNA, 35 bp, R. norvegicus
caatgagaagatcaaacctaaggataataggtaga

SEQ ID NO: 484742 - DNA, 16 bp, R. norvegicus
caatgagaagatcaag

SEQ ID NO: 484743 - DNA, 16 bp, R. norvegicus
caatgagaagatgaaa

SEQ ID NO: 484744 - DNA, 16 bp, R. norvegicus
caatgagaaggccaaa

SEQ ID NO: 484745 - DNA, 16 bp, R. norvegicus
caatgagagacactgt

SEQ ID NO: 484746 - DNA, 16 bp, R. norvegicus
caatgagatcctgtct

SEQ ID NO: 484747 - DNA, 16 bp, R. norvegicus
caatgagatggttcag

SEQ ID NO: 484748 - DNA, 16 bp, R. norvegicus
caatgagctccaggct

SEQ ID NO: 484749 - DNA, 16 bp, R. norvegicus
caatgagctgggccct

SEQ ID NO: 484750 - DNA, 16 bp, R. norvegicus
caatgaggaacctgca

SEQ ID NO: 484751 - DNA, 16 bp, R. norvegicus
caatgaggagatcaaa

SEQ ID NO: 484752 - DNA, 16 bp, R. norvegicus
caatgaggagctgaga

SEQ ID NO: 484753 - DNA, 17 bp, R. norvegicus
caatgataacgtggtca

SEQ ID NO: 484754 - DNA, 16 bp, R. norvegicus
caatgattggctgtga

SEQ ID NO: 484755 - DNA, 16 bp, R. norvegicus
caatgcaattgccatc

SEQ ID NO: 484756 - DNA, 16 bp, R. norvegicus
caatgcacagatcatg

SEQ ID NO: 484757 - DNA, 16 bp, R. norvegicus
caatgcactcttctgg

SEQ ID NO: 484758 - DNA, 16 bp, R. norvegicus
caatgccagccccagc

SEQ ID NO: 484759 - DNA, 16 bp, R. norvegicus
caatgccagcctgggc

SEQ ID NO: 484760 - DNA, 16 bp, R. norvegicus
caatgccataactcct

SEQ ID NO: 484761 - DNA, 16 bp, R. norvegicus
caatgccctcttttgg

SEQ ID NO: 484762 - DNA, 16 bp, R. norvegicus
caatgcctgaaagaga

SEQ ID NO: 484763 - DNA, 16 bp, R. norvegicus
caatgcctgcctggat

SEQ ID NO: 484764 - DNA, 16 bp, R. norvegicus
caatgccttcctctgg

SEQ ID NO: 484765 - DNA, 16 bp, R. norvegicus
caatgctctcggagag

SEQ ID NO: 484766 - DNA, 16 bp, R. norvegicus
caatgctctgtgctcc

SEQ ID NO: 484767 - DNA, 16 bp, R. norvegicus
caatgctgctgctgct

SEQ ID NO: 484768 - DNA, 16 bp, R. norvegicus
caatgctgtccaaact

SEQ ID NO: 484769 - DNA, 16 bp, R. norvegicus
caatggaaaaaagagc

SEQ ID NO: 484770 - DNA, 16 bp, R. norvegicus
caatggaagagtgttc

SEQ ID NO: 484771 - DNA, 16 bp, R. norvegicus
caatggacagaacatg

SEQ ID NO: 484772 - DNA, 16 bp, R. norvegicus
caatggactcatttcc

SEQ ID NO: 484773 - DNA, 16 bp, R. norvegicus
caatggagaaaagata

SEQ ID NO: 484774 - DNA, 16 bp, R. norvegicus
caatggagaagttaga

SEQ ID NO: 484775 - DNA, 16 bp, R. norvegicus
caatggagacctccaa

SEQ ID NO: 484776 - DNA, 16 bp, R. norvegicus
caatggaggagtgctt

SEQ ID NO: 484777 - DNA, 16 bp, R. norvegicus
caatggaggagttttc

SEQ ID NO: 484778 - DNA, 16 bp, R. norvegicus
caatggagtactgttc

SEQ ID NO: 484779 - DNA, 16 bp, R. norvegicus
caatggagtgctactc

SEQ ID NO: 484780 - DNA, 16 bp, R. norvegicus
caatggcctttttgtt

SEQ ID NO: 484781 - DNA, 16 bp, R. norvegicus
caatgggaaaaagaaa

SEQ ID NO: 484782 - DNA, 16 bp, R. norvegicus
caatggtagttccaga

SEQ ID NO: 484783 - DNA, 16 bp, R. norvegicus
caatgtcaaccagcca

SEQ ID NO: 484784 - DNA, 16 bp, R. norvegicus
caatgtgatgacctgt

SEQ ID NO: 484785 - DNA, 16 bp, R. norvegicus
caatgtgcagagaatg

SEQ ID NO: 484786 - DNA, 16 bp, R. norvegicus
caatgtggataacaaa

SEQ ID NO: 484787 - DNA, 16 bp, R. norvegicus
caatgtgtgctttcag

SEQ ID NO: 484788 - DNA, 16 bp, R. norvegicus
caatgtgtggtttgag

SEQ ID NO: 484789 - DNA, 16 bp, R. norvegicus
caatgttctcttctgg

SEQ ID NO: 484790 - DNA, 16 bp, R. norvegicus
caattaaagctgtgct

SEQ ID NO: 484791 - DNA, 16 bp, R. norvegicus
caattaaatgtccttt

SEQ ID NO: 484792 - DNA, 16 bp, R. norvegicus
caattacatctggtga

SEQ ID NO: 484793 - DNA, 16 bp, R. norvegicus
caattatgttccactg

SEQ ID NO: 484794 - DNA, 16 bp, R. norvegicus
caattcaggagaagct

SEQ ID NO: 484795 - DNA, 16 bp, R. norvegicus
caattcattctgtgaa

SEQ ID NO: 484796 - DNA, 16 bp, R. norvegicus
caattccaataccaat

SEQ ID NO: 484797 - DNA, 16 bp, R. norvegicus
caattctattccactc

SEQ ID NO: 484798 - DNA, 16 bp, R. norvegicus
caattctattgatcaa

SEQ ID NO: 484799 - DNA, 16 bp, R. norvegicus
caattctgagtcagag

SEQ ID NO: 484800 - DNA, 16 bp, R. norvegicus
caattcttcagagact

SEQ ID NO: 484801 - DNA, 16 bp, R. norvegicus
caattcttcagttgag

SEQ ID NO: 484802 - DNA, 16 bp, R. norvegicus
caattctttttaaaaa

SEQ ID NO: 484803 - DNA, 16 bp, R. norvegicus
caattgcctgaccaca

SEQ ID NO: 484804 - DNA, 16 bp, R. norvegicus
caattgggtctaagat

SEQ ID NO: 484805 - DNA, 16 bp, R. norvegicus
caattgtggagaaagt

SEQ ID NO: 484806 - DNA, 16 bp, R. norvegicus
caatttaaaaatgaga

SEQ ID NO: 484807 - DNA, 16 bp, R. norvegicus
caatttcccaagcaaa

SEQ ID NO: 484808 - DNA, 16 bp, R. norvegicus
caatttctctctctct

SEQ ID NO: 484809 - DNA, 16 bp, R. norvegicus
caatttctgcccagtg

SEQ ID NO: 484810 - DNA, 16 bp, R. norvegicus
caatttgagacccatc

SEQ ID NO: 484811 - DNA, 16 bp, R. norvegicus
caatttggagattcct

SEQ ID NO: 484812 - DNA, 16 bp, R. norvegicus
caatttgtaaattcat

SEQ ID NO: 484813 - DNA, 16 bp, R. norvegicus
caattttctagaaaaa

SEQ ID NO: 484814 - DNA, 16 bp, R. norvegicus
caattttctgaagaac

SEQ ID NO: 484815 - DNA, 16 bp, R. norvegicus
caattttggagatggt

SEQ ID NO: 484816 - DNA, 16 bp, R. norvegicus
cacaaaaacagccagt

SEQ ID NO: 484817 - DNA, 16 bp, R. norvegicus
cacaaaaatcactgaa

SEQ ID NO: 484818 - DNA, 16 bp, R. norvegicus
cacaaaacgggcctca

SEQ ID NO: 484819 - DNA, 16 bp, R. norvegicus
cacaaaagaacacata

SEQ ID NO: 484820 - DNA, 16 bp, R. norvegicus
cacaaaagaactcaca

SEQ ID NO: 484821 - DNA, 16 bp, R. norvegicus
cacaaaagaatacata

SEQ ID NO: 484822 - DNA, 16 bp, R. norvegicus
cacaaaagcatctcct

SEQ ID NO: 484823 - DNA, 16 bp, R. norvegicus
cacaaaaggaatccca

SEQ ID NO: 484824 - DNA, 16 bp, R. norvegicus
cacaaaaggacataca

SEQ ID NO: 484825 - DNA, 16 bp, R. norvegicus
cacaaaatatccagga

SEQ ID NO: 484826 - DNA, 16 bp, R. norvegicus
cacaaaatcatagaag

SEQ ID NO: 484827 - DNA, 16 bp, R. norvegicus
cacaaaatggaaacag

SEQ ID NO: 484828 - DNA, 16 bp, R. norvegicus
cacaaacacatgtata

SEQ ID NO: 484829 - DNA, 16 bp, R. norvegicus
cacaaacacctgtaat

SEQ ID NO: 484830 - DNA, 16 bp, R. norvegicus
cacaaacatgaacaca

SEQ ID NO: 484831 - DNA, 16 bp, R. norvegicus
cacaaactcacacaga

SEQ ID NO: 484832 - DNA, 16 bp, R. norvegicus
cacaaactgaatcaaa

SEQ ID NO: 484833 - DNA, 16 bp, R. norvegicus
cacaaagaaacaaatg

SEQ ID NO: 484834 - DNA, 16 bp, R. norvegicus
cacaaagacacttgtt

SEQ ID NO: 484835 - DNA, 16 bp, R. norvegicus
cacaaagagagagagg

SEQ ID NO: 484836 - DNA, 16 bp, R. norvegicus
cacaaagcatccagga

SEQ ID NO: 484837 - DNA, 16 bp, R. norvegicus
cacaaagggaaacaac

SEQ ID NO: 484838 - DNA, 16 bp, R. norvegicus
cacaaagggagaaaac

SEQ ID NO: 484839 - DNA, 16 bp, R. norvegicus
cacaaagggagacaac

SEQ ID NO: 484840 - DNA, 16 bp, R. norvegicus
cacaaagggagacaat

SEQ ID NO: 484841 - DNA, 16 bp, R. norvegicus
cacaaagtaagtctca

SEQ ID NO: 484842 - DNA, 16 bp, R. norvegicus
cacaaatacatgcatg

SEQ ID NO: 484843 - DNA, 16 bp, R. norvegicus
cacaaatacatgtgca

SEQ ID NO: 484844 - DNA, 16 bp, R. norvegicus
cacaaatatgcatgca

SEQ ID NO: 484845 - DNA, 16 bp, R. norvegicus
cacaaatgaaatctat

SEQ ID NO: 484846 - DNA, 16 bp, R. norvegicus
cacaaatgccatccca

SEQ ID NO: 484847 - DNA, 16 bp, R. norvegicus
cacaacaacagcagca

SEQ ID NO: 484848 - DNA, 16 bp, R. norvegicus
cacaacacaattcttc

SEQ ID NO: 484849 - DNA, 16 bp, R. norvegicus
cacaacacagtaatct

SEQ ID NO: 484850 - DNA, 16 bp, R. norvegicus
cacaacagaggaatct

SEQ ID NO: 484851 - DNA, 16 bp, R. norvegicus
cacaacagaggaatgg

SEQ ID NO: 484852 - DNA, 16 bp, R. norvegicus
cacaacagcctgtaac

SEQ ID NO: 484853 - DNA, 16 bp, R. norvegicus
cacaacaggctgggcc

SEQ ID NO: 484854 - DNA, 16 bp, R. norvegicus
cacaacatgtggaact

SEQ ID NO: 484855 - DNA, 16 bp, R. norvegicus
cacaaccacaactttg

SEQ ID NO: 484856 - DNA, 16 bp, R. norvegicus
cacaaccatctggaat

SEQ ID NO: 484857 - DNA, 16 bp, R. norvegicus
cacaacgtgaggaact

SEQ ID NO: 484858 - DNA, 16 bp, R. norvegicus
cacaactatggtcact

SEQ ID NO: 484859 - DNA, 16 bp, R. norvegicus
cacaactgaaagctct

SEQ ID NO: 484860 - DNA, 16 bp, R. norvegicus
cacaactgtttgtaat

SEQ ID NO: 484861 - DNA, 16 bp, R. norvegicus
cacaagaaaacaagta

SEQ ID NO: 484862 - DNA, 16 bp, R. norvegicus
cacaagaaaactcaca

SEQ ID NO: 484863 - DNA, 16 bp, R. norvegicus
cacaagaagaggacat

SEQ ID NO: 484864 - DNA, 16 bp, R. norvegicus
cacaagaagcttcctg

SEQ ID NO: 484865 - DNA, 16 bp, R. norvegicus
cacaagaagggaaact

SEQ ID NO: 484866 - DNA, 16 bp, R. norvegicus
cacaagaccaaggacc

SEQ ID NO: 484867 - DNA, 16 bp, R. norvegicus
cacaagcacagacaat

SEQ ID NO: 484868 - DNA, 16 bp, R. norvegicus
cacaagcagagagaga

SEQ ID NO: 484869 - DNA, 16 bp, R. norvegicus
cacaagcagctgaaag

SEQ ID NO: 484870 - DNA, 16 bp, R. norvegicus
cacaagccccaggaga

SEQ ID NO: 484871 - DNA, 16 bp, R. norvegicus
cacaagcccctgggtt

SEQ ID NO: 484872 - DNA, 16 bp, R. norvegicus
cacaagctcacacaca

SEQ ID NO: 484873 - DNA, 16 bp, R. norvegicus
cacaaggaggaaagct

SEQ ID NO: 484874 - DNA, 16 bp, R. norvegicus
cacaagttcaagatca

SEQ ID NO: 484875 - DNA, 16 bp, R. norvegicus
cacaatagtcacaaat

SEQ ID NO: 484876 - DNA, 16 bp, R. norvegicus
cacaatcaaaacagca

SEQ ID NO: 484877 - DNA, 16 bp, R. norvegicus
cacaatcaaacatttg

SEQ ID NO: 484878 - DNA, 16 bp, R. norvegicus
cacaatgcacagacat

SEQ ID NO: 484879 - DNA, 16 bp, R. norvegicus
cacaatgtaaggcaga

SEQ ID NO: 484880 - DNA, 16 bp, R. norvegicus
cacaatgtattttgat

SEQ ID NO: 484881 - DNA, 16 bp, R. norvegicus
cacaattacctggcaa

SEQ ID NO: 484882 - DNA, 16 bp, R. norvegicus
cacaattattttttaa

SEQ ID NO: 484883 - DNA, 16 bp, R. norvegicus
cacacaaaatgaaaat

SEQ ID NO: 484884 - DNA, 16 bp, R. norvegicus
cacacaaaggcagaag

SEQ ID NO: 484885 - DNA, 16 bp, R. norvegicus
cacacaaatatataca

SEQ ID NO: 484886 - DNA, 16 bp, R. norvegicus
cacacaagacttctcg

SEQ ID NO: 484887 - DNA, 16 bp, R. norvegicus
cacacaagcacacata

SEQ ID NO: 484888 - DNA, 16 bp, R. norvegicus
cacacaagcatgcata

SEQ ID NO: 484889 - DNA, 16 bp, R. norvegicus
cacacaagtatataca

SEQ ID NO: 484890 - DNA, 16 bp, R. norvegicus
cacacaatggcctctc

SEQ ID NO: 484891 - DNA, 16 bp, R. norvegicus
cacacaattctcctgc

SEQ ID NO: 484892 - DNA, 16 bp, R. norvegicus
cacacacaaaaaaagt

SEQ ID NO: 484893 - DNA, 16 bp, R. norvegicus
cacacacaaaaaagat

SEQ ID NO: 484894 - DNA, 16 bp, R. norvegicus
cacacacaaagacata

SEQ ID NO: 484895 - DNA, 16 bp, R. norvegicus
cacacacaaatcttaa

SEQ ID NO: 484896 - DNA, 16 bp, R. norvegicus
cacacacaaatgcaca

SEQ ID NO: 484897 - DNA, 16 bp, R. norvegicus
cacacacaactgcaca

SEQ ID NO: 484898 - DNA, 16 bp, R. norvegicus
cacacacaaggacaca

SEQ ID NO: 484899 - DNA, 16 bp, R. norvegicus
cacacacaatttttca

SEQ ID NO: 484900 - DNA, 16 bp, R. norvegicus
cacacacacaaagaat

SEQ ID NO: 484901 - DNA, 16 bp, R. norvegicus
cacacacacaacagta

SEQ ID NO: 484902 - DNA, 16 bp, R. norvegicus
cacacacacaaggaag

SEQ ID NO: 484903 - DNA, 16 bp, R. norvegicus
cacacacacacacgga

SEQ ID NO: 484904 - DNA, 16 bp, R. norvegicus
cacacacacacacggg

SEQ ID NO: 484905 - DNA, 16 bp, R. norvegicus
cacacacacacactct

SEQ ID NO: 484906 - DNA, 16 bp, R. norvegicus
cacacacacacagagg

SEQ ID NO: 484907 - DNA, 16 bp, R. norvegicus
cacacacacacagctt

SEQ ID NO: 484908 - DNA, 16 bp, R. norvegicus
cacacacacacaggtt

SEQ ID NO: 484909 - DNA, 16 bp, R. norvegicus
cacacacacacatcat

SEQ ID NO: 484910 - DNA, 16 bp, R. norvegicus
cacacacacacatgta

SEQ ID NO: 484911 - DNA, 16 bp, R. norvegicus
cacacacacacatgtg

SEQ ID NO: 484912 - DNA, 16 bp, R. norvegicus
cacacacacacattca

SEQ ID NO: 484913 - DNA, 16 bp, R. norvegicus
cacacacacacattgt

SEQ ID NO: 484914 - DNA, 16 bp, R. norvegicus
cacacacacacatttg

SEQ ID NO: 484915 - DNA, 16 bp, R. norvegicus
cacacacacaccatgc

SEQ ID NO: 484916 - DNA, 16 bp, R. norvegicus
cacacacacaccattc

SEQ ID NO: 484917 - DNA, 16 bp, R. norvegicus
cacacacacacccatg

SEQ ID NO: 484918 - DNA, 16 bp, R. norvegicus
cacacacacaccctgt

SEQ ID NO: 484919 - DNA, 16 bp, R. norvegicus
cacacacacaccttga

SEQ ID NO: 484920 - DNA, 16 bp, R. norvegicus
cacacacacaccttgg

SEQ ID NO: 484921 - DNA, 16 bp, R. norvegicus
cacacacacacgagta

SEQ ID NO: 484922 - DNA, 16 bp, R. norvegicus
cacacacacactacta

SEQ ID NO: 484923 - DNA, 16 bp, R. norvegicus
cacacacacactccat

SEQ ID NO: 484924 - DNA, 16 bp, R. norvegicus
cacacacacactgtag

SEQ ID NO: 484925 - DNA, 16 bp, R. norvegicus
cacacacacagagctg

SEQ ID NO: 484926 - DNA, 16 bp, R. norvegicus
cacacacacagaggct

SEQ ID NO: 484927 - DNA, 16 bp, R. norvegicus
cacacacacagagtct

SEQ ID NO: 484928 - DNA, 16 bp, R. norvegicus
cacacacacagcccat

SEQ ID NO: 484929 - DNA, 16 bp, R. norvegicus
cacacacacagcctca

SEQ ID NO: 484930 - DNA, 16 bp, R. norvegicus
cacacacacagcctgt

SEQ ID NO: 484931 - DNA, 16 bp, R. norvegicus
cacacacacagctttt

SEQ ID NO: 484932 - DNA, 16 bp, R. norvegicus
cacacacacaggacag

SEQ ID NO: 484933 - DNA, 16 bp, R. norvegicus
cacacacacaggagag

SEQ ID NO: 484934 - DNA, 16 bp, R. norvegicus
cacacacacaggggaa

SEQ ID NO: 484935 - DNA, 16 bp, R. norvegicus
cacacacacaggggag

SEQ ID NO: 484936 - DNA, 16 bp, R. norvegicus
cacacacacagggtca

SEQ ID NO: 484937 - DNA, 16 bp, R. norvegicus
cacacacacagtacac

SEQ ID NO: 484938 - DNA, 16 bp, R. norvegicus
cacacacacagtctct

SEQ ID NO: 484939 - DNA, 16 bp, R. norvegicus
cacacacacagtctga

SEQ ID NO: 484940 - DNA, 16 bp, R. norvegicus
cacacacacagtgaag

SEQ ID NO: 484941 - DNA, 16 bp, R. norvegicus
cacacacacagtgccc

SEQ ID NO: 484942 - DNA, 16 bp, R. norvegicus
cacacacacagttgga

SEQ ID NO: 484943 - DNA, 16 bp, R. norvegicus
cacacacacatcatca

SEQ ID NO: 484944 - DNA, 16 bp, R. norvegicus
cacacacacatcctgt

SEQ ID NO: 484945 - DNA, 16 bp, R. norvegicus
cacacacacattgcag

SEQ ID NO: 484946 - DNA, 16 bp, R. norvegicus
cacacacacattttta

SEQ ID NO: 484947 - DNA, 16 bp, R. norvegicus
cacacacacatttttt

SEQ ID NO: 484948 - DNA, 16 bp, R. norvegicus
cacacacaccactgag

SEQ ID NO: 484949 - DNA, 16 bp, R. norvegicus
cacacacaccatgctc

SEQ ID NO: 484950 - DNA, 16 bp, R. norvegicus
cacacacaccatggaa

SEQ ID NO: 484951 - DNA, 16 bp, R. norvegicus
cacacacacccctttc

SEQ ID NO: 484952 - DNA, 16 bp, R. norvegicus
cacacacaccctgaca

SEQ ID NO: 484953 - DNA, 16 bp, R. norvegicus
cacacacaccctgctc

SEQ ID NO: 484954 - DNA, 16 bp, R. norvegicus
cacacacacctcagag

SEQ ID NO: 484955 - DNA, 16 bp, R. norvegicus
cacacacacctcttcc

SEQ ID NO: 484956 - DNA, 16 bp, R. norvegicus
cacacacacctcttct

SEQ ID NO: 484957 - DNA, 16 bp, R. norvegicus
cacacacacctcttta

SEQ ID NO: 484958 - DNA, 16 bp, R. norvegicus
cacacacacctgcttc

SEQ ID NO: 484959 - DNA, 16 bp, R. norvegicus
cacacacacgagaggg

SEQ ID NO: 484960 - DNA, 16 bp, R. norvegicus
cacacacacgagtgca

SEQ ID NO: 484961 - DNA, 16 bp, R. norvegicus
cacacacacggggggg

SEQ ID NO: 484962 - DNA, 16 bp, R. norvegicus
cacacacactcacact

SEQ ID NO: 484963 - DNA, 16 bp, R. norvegicus
cacacacactctcact

SEQ ID NO: 484964 - DNA, 16 bp, R. norvegicus
cacacacactggggaa

SEQ ID NO: 484965 - DNA, 16 bp, R. norvegicus
cacacacacttcatac

SEQ ID NO: 484966 - DNA, 16 bp, R. norvegicus
cacacacacttcccct

SEQ ID NO: 484967 - DNA, 16 bp, R. norvegicus
cacacacacttctatg

SEQ ID NO: 484968 - DNA, 16 bp, R. norvegicus
cacacacacttctcac

SEQ ID NO: 484969 - DNA, 16 bp, R. norvegicus
cacacacactttgttt

SEQ ID NO: 484970 - DNA, 16 bp, R. norvegicus
cacacacagaaaggca

SEQ ID NO: 484971 - DNA, 16 bp, R. norvegicus
cacacacagaagcagg

SEQ ID NO: 484972 - DNA, 16 bp, R. norvegicus
cacacacagacacacg

SEQ ID NO: 484973 - DNA, 16 bp, R. norvegicus
cacacacagagaagaa

SEQ ID NO: 484974 - DNA, 16 bp, R. norvegicus
cacacacagagaagag

SEQ ID NO: 484975 - DNA, 16 bp, R. norvegicus
cacacacagagacaca

SEQ ID NO: 484976 - DNA, 16 bp, R. norvegicus
cacacacagagagaag

SEQ ID NO: 484977 - DNA, 16 bp, R. norvegicus
cacacacagagatgag

SEQ ID NO: 484978 - DNA, 16 bp, R. norvegicus
cacacacagagcacag

SEQ ID NO: 484979 - DNA, 16 bp, R. norvegicus
cacacacagatacaaa

SEQ ID NO: 484980 - DNA, 16 bp, R. norvegicus
cacacacagcacagca

SEQ ID NO: 484981 - DNA, 16 bp, R. norvegicus
cacacacagcagcagc

SEQ ID NO: 484982 - DNA, 16 bp, R. norvegicus
cacacacagccacagc

SEQ ID NO: 484983 - DNA, 16 bp, R. norvegicus
cacacacaggagagag

SEQ ID NO: 484984 - DNA, 16 bp, R. norvegicus
cacacacaggtgaaca

SEQ ID NO: 484985 - DNA, 16 bp, R. norvegicus
cacacacagtcacaca

SEQ ID NO: 484986 - DNA, 16 bp, R. norvegicus
cacacacagtggacag

SEQ ID NO: 484987 - DNA, 16 bp, R. norvegicus
cacacacatacacact

SEQ ID NO: 484988 - DNA, 16 bp, R. norvegicus
cacacacatacacagc

SEQ ID NO: 484989 - DNA, 16 bp, R. norvegicus
cacacacatacactca

SEQ ID NO: 484990 - DNA, 16 bp, R. norvegicus
cacacacatacactct

SEQ ID NO: 484991 - DNA, 16 bp, R. norvegicus
cacacacataccataa

SEQ ID NO: 484992 - DNA, 16 bp, R. norvegicus
cacacacatactcaga

SEQ ID NO: 484993 - DNA, 16 bp, R. norvegicus
cacacacatagactca

SEQ ID NO: 484994 - DNA, 16 bp, R. norvegicus
cacacacatatataca

SEQ ID NO: 484995 - DNA, 16 bp, R. norvegicus
cacacacatatgcaca

SEQ ID NO: 484996 - DNA, 16 bp, R. norvegicus
cacacacatcacatca

SEQ ID NO: 484997 - DNA, 16 bp, R. norvegicus
cacacacatgaccaca

SEQ ID NO: 484998 - DNA, 16 bp, R. norvegicus
cacacacatgagcatg

SEQ ID NO: 484999 - DNA, 16 bp, R. norvegicus
cacacacatgcaaaca

SEQ ID NO: 485000 - DNA, 16 bp, R. norvegicus
cacacacatgcaaata

SEQ ID NO: 485001 - DNA, 16 bp, R. norvegicus
cacacacatgcacaca

SEQ ID NO: 485002 - DNA, 16 bp, R. norvegicus
cacacacatgcagaaa

SEQ ID NO: 485003 - DNA, 16 bp, R. norvegicus
cacacacatgcagtct

SEQ ID NO: 485004 - DNA, 16 bp, R. norvegicus
cacacacatgcatgca

SEQ ID NO: 485005 - DNA, 16 bp, R. norvegicus
cacacacatgcccaca

SEQ ID NO: 485006 - DNA, 16 bp, R. norvegicus
cacacacatgtacaca

SEQ ID NO: 485007 - DNA, 16 bp, R. norvegicus
cacacacatgtgcaca

SEQ ID NO: 485008 - DNA, 16 bp, R. norvegicus
cacacacatgtgggca

SEQ ID NO: 485009 - DNA, 16 bp, R. norvegicus
cacacacattcattca

SEQ ID NO: 485010 - DNA, 16 bp, R. norvegicus
cacacacattcctaca

SEQ ID NO: 485011 - DNA, 16 bp, R. norvegicus
cacacaccactgcaca

SEQ ID NO: 485012 - DNA, 16 bp, R. norvegicus
cacacaccatcccctt

SEQ ID NO: 485013 - DNA, 16 bp, R. norvegicus
cacacacccactcctg

SEQ ID NO: 485014 - DNA, 16 bp, R. norvegicus
cacacacccatgtaca

SEQ ID NO: 485015 - DNA, 16 bp, R. norvegicus
cacacacctatgagca

SEQ ID NO: 485016 - DNA, 16 bp, R. norvegicus
cacacacctcattctg

SEQ ID NO: 485017 - DNA, 16 bp, R. norvegicus
cacacacctgcaaaca

SEQ ID NO: 485018 - DNA, 16 bp, R. norvegicus
cacacacctgtgcaca

SEQ ID NO: 485019 - DNA, 16 bp, R. norvegicus
cacacacctgtgtgca

SEQ ID NO: 485020 - DNA, 16 bp, R. norvegicus
cacacacgcacacgcg

SEQ ID NO: 485021 - DNA, 16 bp, R. norvegicus
cacacacgcacgcaca

SEQ ID NO: 485022 - DNA, 16 bp, R. norvegicus
cacacacgcgcacaca

SEQ ID NO: 485023 - DNA, 16 bp, R. norvegicus
cacacacggacacata

SEQ ID NO: 485024 - DNA, 16 bp, R. norvegicus
cacacacgtgtgcatg

SEQ ID NO: 485025 - DNA, 16 bp, R. norvegicus
cacacactcacaggaa

SEQ ID NO: 485026 - DNA, 16 bp, R. norvegicus
cacacactcacataca

SEQ ID NO: 485027 - DNA, 16 bp, R. norvegicus
cacacactcatattca

SEQ ID NO: 485028 - DNA, 16 bp, R. norvegicus
cacacactcatgtaca

SEQ ID NO: 485029 - DNA, 16 bp, R. norvegicus
cacacacttacacatg

SEQ ID NO: 485030 - DNA, 16 bp, R. norvegicus
cacacacttccacaca

SEQ ID NO: 485031 - DNA, 16 bp, R. norvegicus
cacacagaaccagcca

SEQ ID NO: 485032 - DNA, 16 bp, R. norvegicus
cacacagaagagggca

SEQ ID NO: 485033 - DNA, 16 bp, R. norvegicus
cacacagacaaatgca

SEQ ID NO: 485034 - DNA, 16 bp, R. norvegicus
cacacagacacacatt

SEQ ID NO: 485035 - DNA, 16 bp, R. norvegicus
cacacagacacagatg

SEQ ID NO: 485036 - DNA, 16 bp, R. norvegicus
cacacagacacattca

SEQ ID NO: 485037 - DNA, 16 bp, R. norvegicus
cacacagacactgaca

SEQ ID NO: 485038 - DNA, 16 bp, R. norvegicus
cacacagacagcacac

SEQ ID NO: 485039 - DNA, 16 bp, R. norvegicus
cacacagacatacaca

SEQ ID NO: 485040 - DNA, 16 bp, R. norvegicus
cacacagacccagaca

SEQ ID NO: 485041 - DNA, 16 bp, R. norvegicus
cacacagactcacaca

SEQ ID NO: 485042 - DNA, 16 bp, R. norvegicus
cacacagactcctggg

SEQ ID NO: 485043 - DNA, 16 bp, R. norvegicus
cacacagagacaggaa

SEQ ID NO: 485044 - DNA, 16 bp, R. norvegicus
cacacagagacccaca

SEQ ID NO: 485045 - DNA, 16 bp, R. norvegicus
cacacagagagagaat

SEQ ID NO: 485046 - DNA, 16 bp, R. norvegicus
cacacagagagagata

SEQ ID NO: 485047 - DNA, 16 bp, R. norvegicus
cacacagaggaaggag

SEQ ID NO: 485048 - DNA, 16 bp, R. norvegicus
cacacagaggcagaga

SEQ ID NO: 485049 - DNA, 16 bp, R. norvegicus
cacacagaggcagagg

SEQ ID NO: 485050 - DNA, 16 bp, R. norvegicus
cacacagatctgcctg

SEQ ID NO: 485051 - DNA, 16 bp, R. norvegicus
cacacagatgtgcaca

SEQ ID NO: 485052 - DNA, 16 bp, R. norvegicus
cacacagcacacagcc

SEQ ID NO: 485053 - DNA, 16 bp, R. norvegicus
cacacagcacacatgc

SEQ ID NO: 485054 - DNA, 16 bp, R. norvegicus
cacacagcagcagcag

SEQ ID NO: 485055 - DNA, 16 bp, R. norvegicus
cacacagcatcagcac

SEQ ID NO: 485056 - DNA, 16 bp, R. norvegicus
cacacagccagagagc

SEQ ID NO: 485057 - DNA, 16 bp, R. norvegicus
cacacagctgcacaca

SEQ ID NO: 485058 - DNA, 16 bp, R. norvegicus
cacacagctgctatcc

SEQ ID NO: 485059 - DNA, 16 bp, R. norvegicus
cacacaggacacacag

SEQ ID NO: 485060 - DNA, 16 bp, R. norvegicus
cacacaggacagagga

SEQ ID NO: 485061 - DNA, 16 bp, R. norvegicus
cacacaggatgccctg

SEQ ID NO: 485062 - DNA, 16 bp, R. norvegicus
cacacaggcacacaca

SEQ ID NO: 485063 - DNA, 16 bp, R. norvegicus
cacacaggcacaccca

SEQ ID NO: 485064 - DNA, 16 bp, R. norvegicus
cacacaggcagacatg

SEQ ID NO: 485065 - DNA, 16 bp, R. norvegicus
cacacaggcatacaaa

SEQ ID NO: 485066 - DNA, 16 bp, R. norvegicus
cacacaggctcacaga

SEQ ID NO: 485067 - DNA, 16 bp, R. norvegicus
cacacagtcacacagt

SEQ ID NO: 485068 - DNA, 16 bp, R. norvegicus
cacacagtcagtcagt

SEQ ID NO: 485069 - DNA, 16 bp, R. norvegicus
cacacagtggaagaag

SEQ ID NO: 485070 - DNA, 16 bp, R. norvegicus
cacacagtggctcaca

SEQ ID NO: 485071 - DNA, 16 bp, R. norvegicus
cacacagttgcagaaa

SEQ ID NO: 485072 - DNA, 16 bp, R. norvegicus
cacacatacacaacat

SEQ ID NO: 485073 - DNA, 16 bp, R. norvegicus
cacacatacatgcaca

SEQ ID NO: 485074 - DNA, 16 bp, R. norvegicus
cacacataccacatca

SEQ ID NO: 485075 - DNA, 16 bp, R. norvegicus
cacacatactcacgca

SEQ ID NO: 485076 - DNA, 16 bp, R. norvegicus
cacacatactcagggg

SEQ ID NO: 485077 - DNA, 16 bp, R. norvegicus
cacacatatacacaca

SEQ ID NO: 485078 - DNA, 16 bp, R. norvegicus
cacacatatacctgca

SEQ ID NO: 485079 - DNA, 16 bp, R. norvegicus
cacacatatacgcaca

SEQ ID NO: 485080 - DNA, 16 bp, R. norvegicus
cacacatatactcatg

SEQ ID NO: 485081 - DNA, 16 bp, R. norvegicus
cacacatatatacaca

SEQ ID NO: 485082 - DNA, 16 bp, R. norvegicus
cacacatatatctaca

SEQ ID NO: 485083 - DNA, 16 bp, R. norvegicus
cacacatatgcaaatg

SEQ ID NO: 485084 - DNA, 16 bp, R. norvegicus
cacacatcacagacac

SEQ ID NO: 485085 - DNA, 16 bp, R. norvegicus
cacacatctcggaccc

SEQ ID NO: 485086 - DNA, 16 bp, R. norvegicus
cacacatgacacacag

SEQ ID NO: 485087 - DNA, 16 bp, R. norvegicus
cacacatgagagagag

SEQ ID NO: 485088 - DNA, 16 bp, R. norvegicus
cacacatgatacacat

SEQ ID NO: 485089 - DNA, 16 bp, R. norvegicus
cacacatgcacacaca

SEQ ID NO: 485090 - DNA, 16 bp, R. norvegicus
cacacatgcacacaga

SEQ ID NO: 485091 - DNA, 16 bp, R. norvegicus
cacacatgcacaccaa

SEQ ID NO: 485092 - DNA, 16 bp, R. norvegicus
cacacatgcacaggtg

SEQ ID NO: 485093 - DNA, 16 bp, R. norvegicus
cacacatgcacataaa

SEQ ID NO: 485094 - DNA, 16 bp, R. norvegicus
cacacatgcacttgtg

SEQ ID NO: 485095 - DNA, 16 bp, R. norvegicus
cacacatgccacacat

SEQ ID NO: 485096 - DNA, 16 bp, R. norvegicus
cacacatgccatgcac

SEQ ID NO: 485097 - DNA, 16 bp, R. norvegicus
cacacatgtacacaca

SEQ ID NO: 485098 - DNA, 16 bp, R. norvegicus
cacacatgtatgtgta

SEQ ID NO: 485099 - DNA, 16 bp, R. norvegicus
cacacatgtgagcaca

SEQ ID NO: 485100 - DNA, 16 bp, R. norvegicus
cacacatgtgcacata

SEQ ID NO: 485101 - DNA, 16 bp, R. norvegicus
cacacatgtggtgtgc

SEQ ID NO: 485102 - DNA, 16 bp, R. norvegicus
cacacatttataaaca

SEQ ID NO: 485103 - DNA, 16 bp, R. norvegicus
cacacattttaaaaat

SEQ ID NO: 485104 - DNA, 16 bp, R. norvegicus
cacacattttctctct

SEQ ID NO: 485105 - DNA, 16 bp, R. norvegicus
cacaccaatgtatttt

SEQ ID NO: 485106 - DNA, 16 bp, R. norvegicus
cacaccacacagacat

SEQ ID NO: 485107 - DNA, 16 bp, R. norvegicus
cacaccacagctttcc

SEQ ID NO: 485108 - DNA, 16 bp, R. norvegicus
cacaccagcagagggc

SEQ ID NO: 485109 - DNA, 31 bp, R. norvegicus
cacaccatcctttgggccctctgctggaaaa

SEQ ID NO: 485110 - DNA, 16 bp, R. norvegicus
cacacccacaaggcca

SEQ ID NO: 485111 - DNA, 16 bp, R. norvegicus
cacacccacacaggca

SEQ ID NO: 485112 - DNA, 16 bp, R. norvegicus
cacacccacagagaga

SEQ ID NO: 485113 - DNA, 16 bp, R. norvegicus
cacacccacccatgca

SEQ ID NO: 485114 - DNA, 16 bp, R. norvegicus
cacacccagaatatgg

SEQ ID NO: 485115 - DNA, 16 bp, R. norvegicus
cacacccatgcacatg

SEQ ID NO: 485116 - DNA, 16 bp, R. norvegicus
cacacccctgcacaca

SEQ ID NO: 485117 - DNA, 16 bp, R. norvegicus
cacacctaagagctct

SEQ ID NO: 485118 - DNA, 16 bp, R. norvegicus
cacacctaagatcaca

SEQ ID NO: 485119 - DNA, 16 bp, R. norvegicus
cacacctacaatccca

SEQ ID NO: 485120 - DNA, 16 bp, R. norvegicus
cacacctactccagca

SEQ ID NO: 485121 - DNA, 16 bp, R. norvegicus
cacacctattccaaca

SEQ ID NO: 485122 - DNA, 16 bp, R. norvegicus
cacacctcacacacat

SEQ ID NO: 485123 - DNA, 16 bp, R. norvegicus
cacacctcagacacaa

SEQ ID NO: 485124 - DNA, 16 bp, R. norvegicus
cacacctcctaatagt

SEQ ID NO: 485125 - DNA, 16 bp, R. norvegicus
cacacctgaaaacaga

SEQ ID NO: 485126 - DNA, 16 bp, R. norvegicus
cacacctgaaagcaga

SEQ ID NO: 485127 - DNA, 16 bp, R. norvegicus
cacacctgctccaaca

SEQ ID NO: 485128 - DNA, 16 bp, R. norvegicus
cacacctggacctaaa

SEQ ID NO: 485129 - DNA, 16 bp, R. norvegicus
cacacctgggcagtgg

SEQ ID NO: 485130 - DNA, 16 bp, R. norvegicus
cacacctgtcacccca

SEQ ID NO: 485131 - DNA, 16 bp, R. norvegicus
cacaccttcaatccca

SEQ ID NO: 485132 - DNA, 16 bp, R. norvegicus
cacaccttcccaagca

SEQ ID NO: 485133 - DNA, 16 bp, R. norvegicus
cacacctttggtccca

SEQ ID NO: 485134 - DNA, 16 bp, R. norvegicus
cacacgcacacacgca

SEQ ID NO: 485135 - DNA, 16 bp, R. norvegicus
cacacgcacacgcaca

SEQ ID NO: 485136 - DNA, 16 bp, R. norvegicus
cacacgcatacacaca

SEQ ID NO: 485137 - DNA, 16 bp, R. norvegicus
cacacgcatgcatgca

SEQ ID NO: 485138 - DNA, 16 bp, R. norvegicus
cacacggacatgcaca

SEQ ID NO: 485139 - DNA, 16 bp, R. norvegicus
cacacgtaaacacaca

SEQ ID NO: 485140 - DNA, 16 bp, R. norvegicus
cacacgtgtgcacaca

SEQ ID NO: 485141 - DNA, 16 bp, R. norvegicus
cacactaataataata

SEQ ID NO: 485142 - DNA, 16 bp, R. norvegicus
cacactcaagtgcaca

SEQ ID NO: 485143 - DNA, 16 bp, R. norvegicus
cacactcacactcaaa

SEQ ID NO: 485144 - DNA, 16 bp, R. norvegicus
cacactcacactcaca

SEQ ID NO: 485145 - DNA, 16 bp, R. norvegicus
cacactcaccagcagg

SEQ ID NO: 485146 - DNA, 16 bp, R. norvegicus
cacactcctgtcagca

SEQ ID NO: 485147 - DNA, 16 bp, R. norvegicus
cacactctcacacact

SEQ ID NO: 485148 - DNA, 16 bp, R. norvegicus
cacactctgcttcctg

SEQ ID NO: 485149 - DNA, 16 bp, R. norvegicus
cacactctggaggcag

SEQ ID NO: 485150 - DNA, 16 bp, R. norvegicus
cacactctggctgagc

SEQ ID NO: 485151 - DNA, 16 bp, R. norvegicus
cacactgaaatatttt

SEQ ID NO: 485152 - DNA, 16 bp, R. norvegicus
cacactgacacaccta

SEQ ID NO: 485153 - DNA, 16 bp, R. norvegicus
cacactgacagacaca

SEQ ID NO: 485154 - DNA, 16 bp, R. norvegicus
cacactgactgattca

SEQ ID NO: 485155 - DNA, 16 bp, R. norvegicus
cacactgcacactcac

SEQ ID NO: 485156 - DNA, 16 bp, R. norvegicus
cacactgcatcacagc

SEQ ID NO: 485157 - DNA, 16 bp, R. norvegicus
cacactgctgatggct

SEQ ID NO: 485158 - DNA, 16 bp, R. norvegicus
cacactgctgctgctg

SEQ ID NO: 485159 - DNA, 16 bp, R. norvegicus
cacactggagagaaac

SEQ ID NO: 485160 - DNA, 16 bp, R. norvegicus
cacactggctaccatg

SEQ ID NO: 485161 - DNA, 16 bp, R. norvegicus
cacactgggcagctca

SEQ ID NO: 485162 - DNA, 16 bp, R. norvegicus
cacactggttctcact

SEQ ID NO: 485163 - DNA, 16 bp, R. norvegicus
cacactggttctctcc

SEQ ID NO: 485164 - DNA, 16 bp, R. norvegicus
cacactgtaactgtct

SEQ ID NO: 485165 - DNA, 16 bp, R. norvegicus
cacactgtcactgtct

SEQ ID NO: 485166 - DNA, 16 bp, R. norvegicus
cacactgtctctgtct

SEQ ID NO: 485167 - DNA, 16 bp, R. norvegicus
cacacttgaaaagcaa

SEQ ID NO: 485168 - DNA, 16 bp, R. norvegicus
cacactttctcacaca

SEQ ID NO: 485169 - DNA, 16 bp, R. norvegicus
cacactttgtccctgt

SEQ ID NO: 485170 - DNA, 16 bp, R. norvegicus
cacagaaaacacacat

SEQ ID NO: 485171 - DNA, 16 bp, R. norvegicus
cacagaaacacaggca

SEQ ID NO: 485172 - DNA, 16 bp, R. norvegicus
cacagaaagagacaga

SEQ ID NO: 485173 - DNA, 16 bp, R. norvegicus
cacagaaagcatttct

SEQ ID NO: 485174 - DNA, 16 bp, R. norvegicus
cacagaaatcagcctg

SEQ ID NO: 485175 - DNA, 16 bp, R. norvegicus
cacagaacaccagaga

SEQ ID NO: 485176 - DNA, 16 bp, R. norvegicus
cacagaacagacccgg

SEQ ID NO: 485177 - DNA, 16 bp, R. norvegicus
cacagaacagaggaga

SEQ ID NO: 485178 - DNA, 16 bp, R. norvegicus
cacagaaccaactttt

SEQ ID NO: 485179 - DNA, 16 bp, R. norvegicus
cacagaacccaggacc

SEQ ID NO: 485180 - DNA, 16 bp, R. norvegicus
cacagaactcaagaaa

SEQ ID NO: 485181 - DNA, 16 bp, R. norvegicus
cacagaactcctacag

SEQ ID NO: 485182 - DNA, 16 bp, R. norvegicus
cacagaagaaaatgaa

SEQ ID NO: 485183 - DNA, 16 bp, R. norvegicus
cacagaagaacacata

SEQ ID NO: 485184 - DNA, 16 bp, R. norvegicus
cacagaagacacagaa

SEQ ID NO: 485185 - DNA, 16 bp, R. norvegicus
cacagaagagaccttt

SEQ ID NO: 485186 - DNA, 16 bp, R. norvegicus
cacagaagagcagaga

SEQ ID NO: 485187 - DNA, 16 bp, R. norvegicus
cacagaagcagaggca

SEQ ID NO: 485188 - DNA, 16 bp, R. norvegicus
cacagaagcagaggga

SEQ ID NO: 485189 - DNA, 16 bp, R. norvegicus
cacagaagcaggggag

SEQ ID NO: 485190 - DNA, 16 bp, R. norvegicus
cacagaagcagggtga

SEQ ID NO: 485191 - DNA, 16 bp, R. norvegicus
cacagaagcagtggga

SEQ ID NO: 485192 - DNA, 16 bp, R. norvegicus
cacagaagccaggaaa

SEQ ID NO: 485193 - DNA, 16 bp, R. norvegicus
cacagaagctgtggtc

SEQ ID NO: 485194 - DNA, 16 bp, R. norvegicus
cacagaagtgtgtgtg

SEQ ID NO: 485195 - DNA, 16 bp, R. norvegicus
cacagaatagtcaaaa

SEQ ID NO: 485196 - DNA, 16 bp, R. norvegicus
cacagaatatttaaaa

SEQ ID NO: 485197 - DNA, 16 bp, R. norvegicus
cacagaatcttcacaa

SEQ ID NO: 485198 - DNA, 16 bp, R. norvegicus
cacagacaagcaacag

SEQ ID NO: 485199 - DNA, 16 bp, R. norvegicus
cacagacaagcacaca

SEQ ID NO: 485200 - DNA, 16 bp, R. norvegicus
cacagacacacacact

SEQ ID NO: 485201 - DNA, 16 bp, R. norvegicus
cacagacacacagatg

SEQ ID NO: 485202 - DNA, 16 bp, R. norvegicus
cacagacacacagctc

SEQ ID NO: 485203 - DNA, 16 bp, R. norvegicus
cacagacacacatgca

SEQ ID NO: 485204 - DNA, 16 bp, R. norvegicus
cacagacacacctgca

SEQ ID NO: 485205 - DNA, 16 bp, R. norvegicus
cacagacacagagagg

SEQ ID NO: 485206 - DNA, 16 bp, R. norvegicus
cacagacacagtgtcc

SEQ ID NO: 485207 - DNA, 16 bp, R. norvegicus
cacagacaccaacatg

SEQ ID NO: 485208 - DNA, 16 bp, R. norvegicus
cacagacaccatgacc

SEQ ID NO: 485209 - DNA, 16 bp, R. norvegicus
cacagacacctacaca

SEQ ID NO: 485210 - DNA, 16 bp, R. norvegicus
cacagacagacagaca

SEQ ID NO: 485211 - DNA, 16 bp, R. norvegicus
cacagacagacggaca

SEQ ID NO: 485212 - DNA, 16 bp, R. norvegicus
cacagacagcaccacc

SEQ ID NO: 485213 - DNA, 16 bp, R. norvegicus
cacagacaggcagaac

SEQ ID NO: 485214 - DNA, 16 bp, R. norvegicus
cacagacaggtgggca

SEQ ID NO: 485215 - DNA, 16 bp, R. norvegicus
cacagacataaaataa

SEQ ID NO: 485216 - DNA, 16 bp, R. norvegicus
cacagacatacatgta

SEQ ID NO: 485217 - DNA, 16 bp, R. norvegicus
cacagacatagagaaa

SEQ ID NO: 485218 - DNA, 16 bp, R. norvegicus
cacagacatatatgca

SEQ ID NO: 485219 - DNA, 16 bp, R. norvegicus
cacagacatcaacaca

SEQ ID NO: 485220 - DNA, 16 bp, R. norvegicus
cacagacatcatgacc

SEQ ID NO: 485221 - DNA, 16 bp, R. norvegicus
cacagacatcctcctg

SEQ ID NO: 485222 - DNA, 16 bp, R. norvegicus
cacagacatctgcctg

SEQ ID NO: 485223 - DNA, 16 bp, R. norvegicus
cacagacatgcataca

SEQ ID NO: 485224 - DNA, 16 bp, R. norvegicus
cacagaccacacaaag

SEQ ID NO: 485225 - DNA, 16 bp, R. norvegicus
cacagaccacagacac

SEQ ID NO: 485226 - DNA, 16 bp, R. norvegicus
cacagacccaaagaag

SEQ ID NO: 485227 - DNA, 16 bp, R. norvegicus
cacagacccaaaggag

SEQ ID NO: 485228 - DNA, 16 bp, R. norvegicus
cacagacccaaggaag

SEQ ID NO: 485229 - DNA, 16 bp, R. norvegicus
cacagacccagaaaga

SEQ ID NO: 485230 - DNA, 16 bp, R. norvegicus
cacagaccgtgcctcc

SEQ ID NO: 485231 - DNA, 16 bp, R. norvegicus
cacagacgtgcacaca

SEQ ID NO: 485232 - DNA, 16 bp, R. norvegicus
cacagactacacacac

SEQ ID NO: 485233 - DNA, 16 bp, R. norvegicus
cacagactcacaggcc

SEQ ID NO: 485234 - DNA, 16 bp, R. norvegicus
cacagactcagacaca

SEQ ID NO: 485235 - DNA, 16 bp, R. norvegicus
cacagactgccccacc

SEQ ID NO: 485236 - DNA, 22 bp, R. norvegicus
cacagactgtgaggatcccatg

SEQ ID NO: 485237 - DNA, 18 bp, R. norvegicus
cacagacttaggacccag

SEQ ID NO: 485238 - DNA, 16 bp, R. norvegicus
cacagagaaaaatgaa

SEQ ID NO: 485239 - DNA, 16 bp, R. norvegicus
cacagagaaaacttgt

SEQ ID NO: 485240 - DNA, 16 bp, R. norvegicus
cacagagaaaccatct

SEQ ID NO: 485241 - DNA, 16 bp, R. norvegicus
cacagagaaacccttt

SEQ ID NO: 485242 - DNA, 16 bp, R. norvegicus
cacagagaaactgtgt

SEQ ID NO: 485243 - DNA, 16 bp, R. norvegicus
cacagagaaagaagcc

SEQ ID NO: 485244 - DNA, 16 bp, R. norvegicus
cacagagaaagcttat

SEQ ID NO: 485245 - DNA, 16 bp, R. norvegicus
cacagagaaaggggcc

SEQ ID NO: 485246 - DNA, 16 bp, R. norvegicus
cacagagaaatctgtc

SEQ ID NO: 485247 - DNA, 16 bp, R. norvegicus
cacagagaagccctat

SEQ ID NO: 485248 - DNA, 16 bp, R. norvegicus
cacagagaaggcagag

SEQ ID NO: 485249 - DNA, 16 bp, R. norvegicus
cacagagaaggggaag

SEQ ID NO: 485250 - DNA, 16 bp, R. norvegicus
cacagagacaaagaca

SEQ ID NO: 485251 - DNA, 16 bp, R. norvegicus
cacagagacacaccca

SEQ ID NO: 485252 - DNA, 16 bp, R. norvegicus
cacagagacagaagca

SEQ ID NO: 485253 - DNA, 16 bp, R. norvegicus
cacagagacagaccca

SEQ ID NO: 485254 - DNA, 16 bp, R. norvegicus
cacagagacagagctg

SEQ ID NO: 485255 - DNA, 16 bp, R. norvegicus
cacagagacatacaca

SEQ ID NO: 485256 - DNA, 16 bp, R. norvegicus
cacagagacccaccta

SEQ ID NO: 485257 - DNA, 16 bp, R. norvegicus
cacagagaccttgtga

SEQ ID NO: 485258 - DNA, 16 bp, R. norvegicus
cacagagactagaaga

SEQ ID NO: 485259 - DNA, 16 bp, R. norvegicus
cacagagactgaagtg

SEQ ID NO: 485260 - DNA, 16 bp, R. norvegicus
cacagagactgagaga

SEQ ID NO: 485261 - DNA, 16 bp, R. norvegicus
cacagagactgtggta

SEQ ID NO: 485262 - DNA, 16 bp, R. norvegicus
cacagagagagaaaca

SEQ ID NO: 485263 - DNA, 16 bp, R. norvegicus
cacagagagctcatag

SEQ ID NO: 485264 - DNA, 16 bp, R. norvegicus
cacagagagggagaag

SEQ ID NO: 485265 - DNA, 16 bp, R. norvegicus
cacagagagggagaga

SEQ ID NO: 485266 - DNA, 16 bp, R. norvegicus
cacagagatcacctgc

SEQ ID NO: 485267 - DNA, 16 bp, R. norvegicus
cacagagatcagaaaa

SEQ ID NO: 485268 - DNA, 16 bp, R. norvegicus
cacagagatctggctg

SEQ ID NO: 485269 - DNA, 16 bp, R. norvegicus
cacagagatcttcctg

SEQ ID NO: 485270 - DNA, 16 bp, R. norvegicus
cacagagatgagggaa

SEQ ID NO: 485271 - DNA, 16 bp, R. norvegicus
cacagagattgaacca

SEQ ID NO: 485272 - DNA, 16 bp, R. norvegicus
cacagagcacagaaca

SEQ ID NO: 485273 - DNA, 16 bp, R. norvegicus
cacagagcccagaaga

SEQ ID NO: 485274 - DNA, 16 bp, R. norvegicus
cacagagccccacctg

SEQ ID NO: 485275 - DNA, 16 bp, R. norvegicus
cacagagccctccctg

SEQ ID NO: 485276 - DNA, 16 bp, R. norvegicus
cacagaggaacactgc

SEQ ID NO: 485277 - DNA, 16 bp, R. norvegicus
cacagaggaagaagag

SEQ ID NO: 485278 - DNA, 16 bp, R. norvegicus
cacagaggaagcagag

SEQ ID NO: 485279 - DNA, 16 bp, R. norvegicus
cacagaggaaggagag

SEQ ID NO: 485280 - DNA, 16 bp, R. norvegicus
cacagaggaaggcaga

SEQ ID NO: 485281 - DNA, 16 bp, R. norvegicus
cacagaggaggcagag

SEQ ID NO: 485282 - DNA, 16 bp, R. norvegicus
cacagaggcacagagg

SEQ ID NO: 485283 - DNA, 17 bp, R. norvegicus
cacagaggcagaattcc

SEQ ID NO: 485284 - DNA, 16 bp, R. norvegicus
cacagaggcagaggca

SEQ ID NO: 485285 - DNA, 16 bp, R. norvegicus
cacagaggcatacata

SEQ ID NO: 485286 - DNA, 16 bp, R. norvegicus
cacagaggccagaagg

SEQ ID NO: 485287 - DNA, 16 bp, R. norvegicus
cacagaggctggaaga

SEQ ID NO: 485288 - DNA, 16 bp, R. norvegicus
cacagaggtccatctg

SEQ ID NO: 485289 - DNA, 16 bp, R. norvegicus
cacagatcacatgaaa

SEQ ID NO: 485290 - DNA, 16 bp, R. norvegicus
cacagatccaaagaag

SEQ ID NO: 485291 - DNA, 16 bp, R. norvegicus
cacagatctgcctgcc

SEQ ID NO: 485292 - DNA, 16 bp, R. norvegicus
cacagatgcacactca

SEQ ID NO: 485293 - DNA, 16 bp, R. norvegicus
cacagatgccagtcca

SEQ ID NO: 485294 - DNA, 19 bp, R. norvegicus
cacagatgcctggtacctt

SEQ ID NO: 485295 - DNA, 16 bp, R. norvegicus
cacagatgggaacagt

SEQ ID NO: 485296 - DNA, 16 bp, R. norvegicus
cacagatggttgtgag

SEQ ID NO: 485297 - DNA, 16 bp, R. norvegicus
cacagatgtcagaaga

SEQ ID NO: 485298 - DNA, 16 bp, R. norvegicus
cacagatgtctttgcc

SEQ ID NO: 485299 - DNA, 16 bp, R. norvegicus
cacagatgtgtgtgtg

SEQ ID NO: 485300 - DNA, 16 bp, R. norvegicus
cacagatgtttgtaga

SEQ ID NO: 485301 - DNA, 16 bp, R. norvegicus
cacagattggaaagga

SEQ ID NO: 485302 - DNA, 16 bp, R. norvegicus
cacagatttttttttt

SEQ ID NO: 485303 - DNA, 16 bp, R. norvegicus
cacagcaaaacattag

SEQ ID NO: 485304 - DNA, 16 bp, R. norvegicus
cacagcaacagaacag

SEQ ID NO: 485305 - DNA, 16 bp, R. norvegicus
cacagcaacagagaag

SEQ ID NO: 485306 - DNA, 16 bp, R. norvegicus
cacagcaacagcaaca

SEQ ID NO: 485307 - DNA, 16 bp, R. norvegicus
cacagcaagagaaacc

SEQ ID NO: 485308 - DNA, 16 bp, R. norvegicus
cacagcaagctcatct

SEQ ID NO: 485309 - DNA, 16 bp, R. norvegicus
cacagcaagctccagg

SEQ ID NO: 485310 - DNA, 16 bp, R. norvegicus
cacagcaatgggaaag

SEQ ID NO: 485311 - DNA, 16 bp, R. norvegicus
cacagcacacacagca

SEQ ID NO: 485312 - DNA, 16 bp, R. norvegicus
cacagcacagcacagg

SEQ ID NO: 485313 - DNA, 16 bp, R. norvegicus
cacagcacagcagcag

SEQ ID NO: 485314 - DNA, 16 bp, R. norvegicus
cacagcacccactgtg

SEQ ID NO: 485315 - DNA, 16 bp, R. norvegicus
cacagcactcaggaga

SEQ ID NO: 485316 - DNA, 16 bp, R. norvegicus
cacagcactctgtacc

SEQ ID NO: 485317 - DNA, 16 bp, R. norvegicus
cacagcagaaaaaccc

SEQ ID NO: 485318 - DNA, 16 bp, R. norvegicus
cacagcagcagaacac

SEQ ID NO: 485319 - DNA, 16 bp, R. norvegicus
cacagcagcagcaaca

SEQ ID NO: 485320 - DNA, 16 bp, R. norvegicus
cacagcagcctctcct

SEQ ID NO: 485321 - DNA, 16 bp, R. norvegicus
cacagcagctcacaac

SEQ ID NO: 485322 - DNA, 16 bp, R. norvegicus
cacagcagctgctggg

SEQ ID NO: 485323 - DNA, 16 bp, R. norvegicus
cacagcaggcaaacca

SEQ ID NO: 485324 - DNA, 16 bp, R. norvegicus
cacagcaggcagctca

SEQ ID NO: 485325 - DNA, 16 bp, R. norvegicus
cacagcaggcatccag

SEQ ID NO: 485326 - DNA, 16 bp, R. norvegicus
cacagcagtagaaaag

SEQ ID NO: 485327 - DNA, 16 bp, R. norvegicus
cacagcagtaggaagg

SEQ ID NO: 485328 - DNA, 16 bp, R. norvegicus
cacagcagtagtaacc

SEQ ID NO: 485329 - DNA, 16 bp, R. norvegicus
cacagcagtgggagca

SEQ ID NO: 485330 - DNA, 16 bp, R. norvegicus
cacagcatgaggacct

SEQ ID NO: 485331 - DNA, 16 bp, R. norvegicus
cacagcatgcacctgg

SEQ ID NO: 485332 - DNA, 16 bp, R. norvegicus
cacagccaaacagcag

SEQ ID NO: 485333 - DNA, 16 bp, R. norvegicus
cacagccacacagaca

SEQ ID NO: 485334 - DNA, 16 bp, R. norvegicus
cacagccacagccaca

SEQ ID NO: 485335 - DNA, 16 bp, R. norvegicus
cacagccacagcctca

SEQ ID NO: 485336 - DNA, 16 bp, R. norvegicus
cacagccacaggcaca

SEQ ID NO: 485337 - DNA, 16 bp, R. norvegicus
cacagccacctcagca

SEQ ID NO: 485338 - DNA, 16 bp, R. norvegicus
cacagccagacacagc

SEQ ID NO: 485339 - DNA, 16 bp, R. norvegicus
cacagccagagagcac

SEQ ID NO: 485340 - DNA, 16 bp, R. norvegicus
cacagccagaggcaga

SEQ ID NO: 485341 - DNA, 16 bp, R. norvegicus
cacagccagcagcagc

SEQ ID NO: 485342 - DNA, 16 bp, R. norvegicus
cacagccagcatacag

SEQ ID NO: 485343 - DNA, 16 bp, R. norvegicus
cacagccatcctcctg

SEQ ID NO: 485344 - DNA, 16 bp, R. norvegicus
cacagccatctgcaac

SEQ ID NO: 485345 - DNA, 16 bp, R. norvegicus
cacagcccacaggttg

SEQ ID NO: 485346 - DNA, 16 bp, R. norvegicus
cacagccctccataga

SEQ ID NO: 485347 - DNA, 16 bp, R. norvegicus
cacagccctggctgtc

SEQ ID NO: 485348 - DNA, 16 bp, R. norvegicus
cacagcctccctcctc

SEQ ID NO: 485349 - DNA, 16 bp, R. norvegicus
cacagcctcctcctca

SEQ ID NO: 485350 - DNA, 16 bp, R. norvegicus
cacagcctgcagcttg

SEQ ID NO: 485351 - DNA, 16 bp, R. norvegicus
cacagccttcattgtg

SEQ ID NO: 485352 - DNA, 16 bp, R. norvegicus
cacagctcctcctccc

SEQ ID NO: 485353 - DNA, 16 bp, R. norvegicus
cacagctctccacacc

SEQ ID NO: 485354 - DNA, 16 bp, R. norvegicus
cacagctctgcctgcc

SEQ ID NO: 485355 - DNA, 16 bp, R. norvegicus
cacagctgagagcaga

SEQ ID NO: 485356 - DNA, 16 bp, R. norvegicus
cacagctgccttggga

SEQ ID NO: 485357 - DNA, 16 bp, R. norvegicus
cacagctgctgcagat

SEQ ID NO: 485358 - DNA, 16 bp, R. norvegicus
cacagctgctgctgct

SEQ ID NO: 485359 - DNA, 16 bp, R. norvegicus
cacagctgtggaatgc

SEQ ID NO: 485360 - DNA, 16 bp, R. norvegicus
cacagctgttgtccac

SEQ ID NO: 485361 - DNA, 16 bp, R. norvegicus
cacagcttttcttctc

SEQ ID NO: 485362 - DNA, 16 bp, R. norvegicus
cacaggaaaacaaata

SEQ ID NO: 485363 - DNA, 16 bp, R. norvegicus
cacaggaaacaggaaa

SEQ ID NO: 485364 - DNA, 16 bp, R. norvegicus
cacaggaaactgtgct

SEQ ID NO: 485365 - DNA, 16 bp, R. norvegicus
cacaggaaagagaggc

SEQ ID NO: 485366 - DNA, 16 bp, R. norvegicus
cacaggaacaccaagc

SEQ ID NO: 485367 - DNA, 16 bp, R. norvegicus
cacaggaactgaggag

SEQ ID NO: 485368 - DNA, 16 bp, R. norvegicus
cacaggaagaagacaa

SEQ ID NO: 485369 - DNA, 16 bp, R. norvegicus
cacaggaagatcaaca

SEQ ID NO: 485370 - DNA, 16 bp, R. norvegicus
cacaggaagcaggaag

SEQ ID NO: 485371 - DNA, 16 bp, R. norvegicus
cacaggacacaggaac

SEQ ID NO: 485372 - DNA, 16 bp, R. norvegicus
cacaggacactgtcat

SEQ ID NO: 485373 - DNA, 16 bp, R. norvegicus
cacaggacagcacaca

SEQ ID NO: 485374 - DNA, 16 bp, R. norvegicus
cacaggaccaaggtcc

SEQ ID NO: 485375 - DNA, 16 bp, R. norvegicus
cacaggaccaggggcc

SEQ ID NO: 485376 - DNA, 16 bp, R. norvegicus
cacaggagaaagaatg

SEQ ID NO: 485377 - DNA, 16 bp, R. norvegicus
cacaggagagagagag

SEQ ID NO: 485378 - DNA, 16 bp, R. norvegicus
cacaggaggaaataag

SEQ ID NO: 485379 - DNA, 16 bp, R. norvegicus
cacaggaggaaatgca

SEQ ID NO: 485380 - DNA, 16 bp, R. norvegicus
cacaggagggagagag

SEQ ID NO: 485381 - DNA, 16 bp, R. norvegicus
cacaggcacaaacaca

SEQ ID NO: 485382 - DNA, 16 bp, R. norvegicus
cacaggcacacatgca

SEQ ID NO: 485383 - DNA, 16 bp, R. norvegicus
cacaggcacagagaca

SEQ ID NO: 485384 - DNA, 16 bp, R. norvegicus
cacaggcacaggcaca

SEQ ID NO: 485385 - DNA, 16 bp, R. norvegicus
cacaggcacaggcacc

SEQ ID NO: 485386 - DNA, 16 bp, R. norvegicus
cacaggcagacaggca

SEQ ID NO: 485387 - DNA, 16 bp, R. norvegicus
cacaggcagagactgg

SEQ ID NO: 485388 - DNA, 16 bp, R. norvegicus
cacaggcagctgtgag

SEQ ID NO: 485389 - DNA, 16 bp, R. norvegicus
cacaggccaacctgat

SEQ ID NO: 485390 - DNA, 16 bp, R. norvegicus
cacaggcccagaggaa

SEQ ID NO: 485391 - DNA, 16 bp, R. norvegicus
cacaggctcacagacc

SEQ ID NO: 485392 - DNA, 17 bp, R. norvegicus
cacaggcttatgggaca

SEQ ID NO: 485393 - DNA, 16 bp, R. norvegicus
cacagggacagaccca

SEQ ID NO: 485394 - DNA, 16 bp, R. norvegicus
cacagggacagctgaa

SEQ ID NO: 485395 - DNA, 16 bp, R. norvegicus
cacagggaccccaaag

SEQ ID NO: 485396 - DNA, 16 bp, R. norvegicus
cacagggaccccagtg

SEQ ID NO: 485397 - DNA, 16 bp, R. norvegicus
cacagggacctaggaa

SEQ ID NO: 485398 - DNA, 16 bp, R. norvegicus
cacagggagcaagcca

SEQ ID NO: 485399 - DNA, 16 bp, R. norvegicus
cacagggagtggggag

SEQ ID NO: 485400 - DNA, 16 bp, R. norvegicus
cacagggatctgcctg

SEQ ID NO: 485401 - DNA, 16 bp, R. norvegicus
cacagggcaacaacag

SEQ ID NO: 485402 - DNA, 16 bp, R. norvegicus
cacagggcacaggaac

SEQ ID NO: 485403 - DNA, 16 bp, R. norvegicus
cacagggcacagggca

SEQ ID NO: 485404 - DNA, 16 bp, R. norvegicus
cacagggccagctctc

SEQ ID NO: 485405 - DNA, 16 bp, R. norvegicus
cacagggccctgggtt

SEQ ID NO: 485406 - DNA, 16 bp, R. norvegicus
cacagggcctgcacag

SEQ ID NO: 485407 - DNA, 16 bp, R. norvegicus
cacaggggatgcagag

SEQ ID NO: 485408 - DNA, 16 bp, R. norvegicus
cacaggggtccctggc

SEQ ID NO: 485409 - DNA, 16 bp, R. norvegicus
cacagggtggctcaca

SEQ ID NO: 485410 - DNA, 16 bp, R. norvegicus
cacagggtttctctgt

SEQ ID NO: 485411 - DNA, 16 bp, R. norvegicus
cacaggtcacataggc

SEQ ID NO: 485412 - DNA, 16 bp, R. norvegicus
cacaggtcttcagctg

SEQ ID NO: 485413 - DNA, 16 bp, R. norvegicus
cacaggtcttcctgtt

SEQ ID NO: 485414 - DNA, 16 bp, R. norvegicus
cacaggtgacaacaga

SEQ ID NO: 485415 - DNA, 16 bp, R. norvegicus
cacaggtgaggaggcc

SEQ ID NO: 485416 - DNA, 16 bp, R. norvegicus
cacaggtggaaaccag

SEQ ID NO: 485417 - DNA, 16 bp, R. norvegicus
cacaggtgtttgtgag

SEQ ID NO: 485418 - DNA, 16 bp, R. norvegicus
cacaggttcagaacca

SEQ ID NO: 485419 - DNA, 16 bp, R. norvegicus
cacagtcaaggctgag

SEQ ID NO: 485420 - DNA, 16 bp, R. norvegicus
cacagtcacacagaca

SEQ ID NO: 485421 - DNA, 16 bp, R. norvegicus
cacagtcacagcagcc

SEQ ID NO: 485422 - DNA, 16 bp, R. norvegicus
cacagtcacagccaca

SEQ ID NO: 485423 - DNA, 16 bp, R. norvegicus
cacagtcaggctctca

SEQ ID NO: 485424 - DNA, 16 bp, R. norvegicus
cacagtccaggtttga

SEQ ID NO: 485425 - DNA, 16 bp, R. norvegicus
cacagtccccttctgc

SEQ ID NO: 485426 - DNA, 16 bp, R. norvegicus
cacagtccttggaggc

SEQ ID NO: 485427 - DNA, 16 bp, R. norvegicus
cacagtctcctgctgc

SEQ ID NO: 485428 - DNA, 16 bp, R. norvegicus
cacagtctgctgcaga

SEQ ID NO: 485429 - DNA, 16 bp, R. norvegicus
cacagtgaaagcagtg

SEQ ID NO: 485430 - DNA, 16 bp, R. norvegicus
cacagtgacccacttc

SEQ ID NO: 485431 - DNA, 16 bp, R. norvegicus
cacagtgacttccagg

SEQ ID NO: 485432 - DNA, 16 bp, R. norvegicus
cacagtggactgggcc

SEQ ID NO: 485433 - DNA, 16 bp, R. norvegicus
cacagtggagcacgtg

SEQ ID NO: 485434 - DNA, 16 bp, R. norvegicus
cacagtggagctggct

SEQ ID NO: 485435 - DNA, 16 bp, R. norvegicus
cacagtggcctgggcc

SEQ ID NO: 485436 - DNA, 16 bp, R. norvegicus
cacagtgggatgggcc

SEQ ID NO: 485437 - DNA, 16 bp, R. norvegicus
cacagtgggtgctgtg

SEQ ID NO: 485438 - DNA, 16 bp, R. norvegicus
cacagtgtgcagggct

SEQ ID NO: 485439 - DNA, 16 bp, R. norvegicus
cacagtgtgggtgctg

SEQ ID NO: 485440 - DNA, 16 bp, R. norvegicus
cacagtgtgtcccaca

SEQ ID NO: 485441 - DNA, 16 bp, R. norvegicus
cacagttcagaactta

SEQ ID NO: 485442 - DNA, 16 bp, R. norvegicus
cacagttcagtggttt

SEQ ID NO: 485443 - DNA, 16 bp, R. norvegicus
cacagtttctgtgagt

SEQ ID NO: 485444 - DNA, 16 bp, R. norvegicus
cacataaaagaacata

SEQ ID NO: 485445 - DNA, 16 bp, R. norvegicus
cacataaaagaataca

SEQ ID NO: 485446 - DNA, 16 bp, R. norvegicus
cacataaaagcacaca

SEQ ID NO: 485447 - DNA, 16 bp, R. norvegicus
cacataaaaggacaca

SEQ ID NO: 485448 - DNA, 16 bp, R. norvegicus
cacataaaagtcaaaa

SEQ ID NO: 485449 - DNA, 16 bp, R. norvegicus
cacataagtacacata

SEQ ID NO: 485450 - DNA, 23 bp, R. norvegicus
cacataatagtcaaaacaccaaa

SEQ ID NO: 485451 - DNA, 16 bp, R. norvegicus
cacataattggtcaaa

SEQ ID NO: 485452 - DNA, 16 bp, R. norvegicus
cacatacaaacatgtg

SEQ ID NO: 485453 - DNA, 16 bp, R. norvegicus
cacatacaaataatta

SEQ ID NO: 485454 - DNA, 16 bp, R. norvegicus
cacatacaatacatat

SEQ ID NO: 485455 - DNA, 16 bp, R. norvegicus
cacatacacagaaaat

SEQ ID NO: 485456 - DNA, 16 bp, R. norvegicus
cacatacacagacaca

SEQ ID NO: 485457 - DNA, 16 bp, R. norvegicus
cacatacacagcaaag

SEQ ID NO: 485458 - DNA, 16 bp, R. norvegicus
cacatacaccctcaca

SEQ ID NO: 485459 - DNA, 16 bp, R. norvegicus
cacatacactcacaca

SEQ ID NO: 485460 - DNA, 16 bp, R. norvegicus
cacatacataaatgca

SEQ ID NO: 485461 - DNA, 16 bp, R. norvegicus
cacatacatactcaca

SEQ ID NO: 485462 - DNA, 16 bp, R. norvegicus
cacatacatatacaaa

SEQ ID NO: 485463 - DNA, 16 bp, R. norvegicus
cacatacatgaaaaat

SEQ ID NO: 485464 - DNA, 16 bp, R. norvegicus
cacatacatgtacaca

SEQ ID NO: 485465 - DNA, 16 bp, R. norvegicus
cacatacatgtgcaca

SEQ ID NO: 485466 - DNA, 16 bp, R. norvegicus
cacatacccactcaca

SEQ ID NO: 485467 - DNA, 16 bp, R. norvegicus
cacatacctgtggtca

SEQ ID NO: 485468 - DNA, 16 bp, R. norvegicus
cacatactcaaacaca

SEQ ID NO: 485469 - DNA, 16 bp, R. norvegicus
cacatactcacacaaa

SEQ ID NO: 485470 - DNA, 16 bp, R. norvegicus
cacatactcaggtcat

SEQ ID NO: 485471 - DNA, 16 bp, R. norvegicus
cacatagacacacatg

SEQ ID NO: 485472 - DNA, 16 bp, R. norvegicus
cacatagacatacatg

SEQ ID NO: 485473 - DNA, 16 bp, R. norvegicus
cacatagataaaataa

SEQ ID NO: 485474 - DNA, 16 bp, R. norvegicus
cacatagtgcacagac

SEQ ID NO: 485475 - DNA, 16 bp, R. norvegicus
cacatatacacacacc

SEQ ID NO: 485476 - DNA, 16 bp, R. norvegicus
cacatatacacatgta

SEQ ID NO: 485477 - DNA, 36 bp, R. norvegicus
cacatatacttggaaattgaacaatgctctactcaa

SEQ ID NO: 485478 - DNA, 16 bp, R. norvegicus
cacatatatccacaca

SEQ ID NO: 485479 - DNA, 16 bp, R. norvegicus
cacatatcttcctggt

SEQ ID NO: 485480 - DNA, 16 bp, R. norvegicus
cacatatgtggtacac

SEQ ID NO: 485481 - DNA, 16 bp, R. norvegicus
cacatatgtgtatatt

SEQ ID NO: 485482 - DNA, 16 bp, R. norvegicus
cacatcaaaagaatca

SEQ ID NO: 485483 - DNA, 16 bp, R. norvegicus
cacatcaaaagcatca

SEQ ID NO: 485484 - DNA, 16 bp, R. norvegicus
cacatcaaaatcatca

SEQ ID NO: 485485 - DNA, 16 bp, R. norvegicus
cacatcagcacttcag

SEQ ID NO: 485486 - DNA, 16 bp, R. norvegicus
cacatccaaagacttt

SEQ ID NO: 485487 - DNA, 16 bp, R. norvegicus
cacatccacagtgaca

SEQ ID NO: 485488 - DNA, 16 bp, R. norvegicus
cacatccacatataca

SEQ ID NO: 485489 - DNA, 20 bp, R. norvegicus
cacatccagacaccagagga

SEQ ID NO: 485490 - DNA, 16 bp, R. norvegicus
cacatccagcagaaag

SEQ ID NO: 485491 - DNA, 16 bp, R. norvegicus
cacatcccagccacac

SEQ ID NO: 485492 - DNA, 16 bp, R. norvegicus
cacatccccaccagca

SEQ ID NO: 485493 - DNA, 16 bp, R. norvegicus
cacatcctcaccagct

SEQ ID NO: 485494 - DNA, 16 bp, R. norvegicus
cacatcctcaccatca

SEQ ID NO: 485495 - DNA, 35 bp, R. norvegicus
cacatcctcgccagcatctgttgtcccctgagttt

SEQ ID NO: 485496 - DNA, 16 bp, R. norvegicus
cacatccttgtcaaca

SEQ ID NO: 485497 - DNA, 17 bp, R. norvegicus
cacatctacacaatgga

SEQ ID NO: 485498 - DNA, 16 bp, R. norvegicus
cacatctgagagcaca

SEQ ID NO: 485499 - DNA, 16 bp, R. norvegicus
cacatctgcagtccca

SEQ ID NO: 485500 - DNA, 16 bp, R. norvegicus
cacatctgcatccagc

SEQ ID NO: 485501 - DNA, 16 bp, R. norvegicus
cacatctgctcaggtg

SEQ ID NO: 485502 - DNA, 16 bp, R. norvegicus
cacatctttgtcagca

SEQ ID NO: 485503 - DNA, 16 bp, R. norvegicus
cacatgaaactcaaga

SEQ ID NO: 485504 - DNA, 16 bp, R. norvegicus
cacatgaaagaataca

SEQ ID NO: 485505 - DNA, 16 bp, R. norvegicus
cacatgaagaccatgc

SEQ ID NO: 485506 - DNA, 16 bp, R. norvegicus
cacatgaaggctcaca

SEQ ID NO: 485507 - DNA, 16 bp, R. norvegicus
cacatgaaggtcaagc

SEQ ID NO: 485508 - DNA, 16 bp, R. norvegicus
cacatgaagttgggag

SEQ ID NO: 485509 - DNA, 16 bp, R. norvegicus
cacatgaatacacaca

SEQ ID NO: 485510 - DNA, 16 bp, R. norvegicus
cacatgcaaaataaat

SEQ ID NO: 485511 - DNA, 16 bp, R. norvegicus
cacatgcaaacacaca

SEQ ID NO: 485512 - DNA, 16 bp, R. norvegicus
cacatgcacacataca

SEQ ID NO: 485513 - DNA, 16 bp, R. norvegicus
cacatgcacacccaca

SEQ ID NO: 485514 - DNA, 16 bp, R. norvegicus
cacatgcacactcaca

SEQ ID NO: 485515 - DNA, 16 bp, R. norvegicus
cacatgcacagactca

SEQ ID NO: 485516 - DNA, 16 bp, R. norvegicus
cacatgcacaggcaca

SEQ ID NO: 485517 - DNA, 16 bp, R. norvegicus
cacatgcacatacata

SEQ ID NO: 485518 - DNA, 16 bp, R. norvegicus
cacatgcacatgcaat

SEQ ID NO: 485519 - DNA, 16 bp, R. norvegicus
cacatgcacgcatgca

SEQ ID NO: 485520 - DNA, 16 bp, R. norvegicus
cacatgcacgtgcaca

SEQ ID NO: 485521 - DNA, 16 bp, R. norvegicus
cacatgcactcacaca

SEQ ID NO: 485522 - DNA, 16 bp, R. norvegicus
cacatgcactcatgtg

SEQ ID NO: 485523 - DNA, 16 bp, R. norvegicus
cacatgcagaaacaca

SEQ ID NO: 485524 - DNA, 16 bp, R. norvegicus
cacatgcagacacaca

SEQ ID NO: 485525 - DNA, 16 bp, R. norvegicus
cacatgcagctgaagc

SEQ ID NO: 485526 - DNA, 16 bp, R. norvegicus
cacatgcaggtgcaca

SEQ ID NO: 485527 - DNA, 16 bp, R. norvegicus
cacatgcataggcaca

SEQ ID NO: 485528 - DNA, 16 bp, R. norvegicus
cacatgcatctgcaca

SEQ ID NO: 485529 - DNA, 16 bp, R. norvegicus
cacatgcatgcacaca

SEQ ID NO: 485530 - DNA, 16 bp, R. norvegicus
cacatgcatgcagtgc

SEQ ID NO: 485531 - DNA, 16 bp, R. norvegicus
cacatgcatgcatatg

SEQ ID NO: 485532 - DNA, 16 bp, R. norvegicus
cacatgcatgtgcaca

SEQ ID NO: 485533 - DNA, 16 bp, R. norvegicus
cacatgcatttgcaca

SEQ ID NO: 485534 - DNA, 16 bp, R. norvegicus
cacatgccagcccagg

SEQ ID NO: 485535 - DNA, 16 bp, R. norvegicus
cacatgccaggcaagc

SEQ ID NO: 485536 - DNA, 16 bp, R. norvegicus
cacatgcccatggccg

SEQ ID NO: 485537 - DNA, 16 bp, R. norvegicus
cacatgcctggtgccc

SEQ ID NO: 485538 - DNA, 16 bp, R. norvegicus
cacatgcctttaattc

SEQ ID NO: 485539 - DNA, 16 bp, R. norvegicus
cacatgcgtgtgcatg

SEQ ID NO: 485540 - DNA, 16 bp, R. norvegicus
cacatgctcacacaca

SEQ ID NO: 485541 - DNA, 16 bp, R. norvegicus
cacatgctccacgatg

SEQ ID NO: 485542 - DNA, 16 bp, R. norvegicus
cacatgctgacacaca

SEQ ID NO: 485543 - DNA, 16 bp, R. norvegicus
cacatgcttacacaca

SEQ ID NO: 485544 - DNA, 16 bp, R. norvegicus
cacatggacagagcca

SEQ ID NO: 485545 - DNA, 16 bp, R. norvegicus
cacatggagcactacc

SEQ ID NO: 485546 - DNA, 16 bp, R. norvegicus
cacatggaggaactca

SEQ ID NO: 485547 - DNA, 16 bp, R. norvegicus
cacatggagtgactca

SEQ ID NO: 485548 - DNA, 16 bp, R. norvegicus
cacatggcagctaaca

SEQ ID NO: 485549 - DNA, 16 bp, R. norvegicus
cacatggcagctcaca

SEQ ID NO: 485550 - DNA, 16 bp, R. norvegicus
cacatggctgctcaca

SEQ ID NO: 485551 - DNA, 16 bp, R. norvegicus
cacatggctgtgagcc

SEQ ID NO: 485552 - DNA, 16 bp, R. norvegicus
cacatgggcacagagg

SEQ ID NO: 485553 - DNA, 16 bp, R. norvegicus
cacatgggctctgggg

SEQ ID NO: 485554 - DNA, 16 bp, R. norvegicus
cacatggtcacacaca

SEQ ID NO: 485555 - DNA, 16 bp, R. norvegicus
cacatggtgactcaca

SEQ ID NO: 485556 - DNA, 16 bp, R. norvegicus
cacatggtggaaggca

SEQ ID NO: 485557 - DNA, 16 bp, R. norvegicus
cacatggtgtctcaca

SEQ ID NO: 485558 - DNA, 16 bp, R. norvegicus
cacatgtacaacaatg

SEQ ID NO: 485559 - DNA, 16 bp, R. norvegicus
cacatgtacacataaa

SEQ ID NO: 485560 - DNA, 16 bp, R. norvegicus
cacatgtactcacaca

SEQ ID NO: 485561 - DNA, 16 bp, R. norvegicus
cacatgtatacacaca

SEQ ID NO: 485562 - DNA, 16 bp, R. norvegicus
cacatgtatgaaaatg

SEQ ID NO: 485563 - DNA, 16 bp, R. norvegicus
cacatgtatgcacata

SEQ ID NO: 485564 - DNA, 16 bp, R. norvegicus
cacatgtatgtacaca

SEQ ID NO: 485565 - DNA, 16 bp, R. norvegicus
cacatgtcacatgtca

SEQ ID NO: 485566 - DNA, 16 bp, R. norvegicus
cacatgtccttgtggt

SEQ ID NO: 485567 - DNA, 16 bp, R. norvegicus
cacatgtgcacacatg

SEQ ID NO: 485568 - DNA, 16 bp, R. norvegicus
cacatgtgcacatgtg

SEQ ID NO: 485569 - DNA, 16 bp, R. norvegicus
cacatgtgcacgtgca

SEQ ID NO: 485570 - DNA, 16 bp, R. norvegicus
cacatgtgcactgtgg

SEQ ID NO: 485571 - DNA, 16 bp, R. norvegicus
cacatgtgcacttgca

SEQ ID NO: 485572 - DNA, 16 bp, R. norvegicus
cacatgtggaggacag

SEQ ID NO: 485573 - DNA, 16 bp, R. norvegicus
cacatgtgggggcagg

SEQ ID NO: 485574 - DNA, 16 bp, R. norvegicus
cacatgtgtgggggtg

SEQ ID NO: 485575 - DNA, 16 bp, R. norvegicus
cacatgtgtgtatatt

SEQ ID NO: 485576 - DNA, 16 bp, R. norvegicus
cacatgtgtgtgtgca

SEQ ID NO: 485577 - DNA, 16 bp, R. norvegicus
cacatgtgtgtgtttg

SEQ ID NO: 485578 - DNA, 16 bp, R. norvegicus
cacatgtgttcatgtg

SEQ ID NO: 485579 - DNA, 16 bp, R. norvegicus
cacatgttaaaaagtt

SEQ ID NO: 485580 - DNA, 16 bp, R. norvegicus
cacatgttcatagcag

SEQ ID NO: 485581 - DNA, 16 bp, R. norvegicus
cacatgtttggttgtg

SEQ ID NO: 485582 - DNA, 16 bp, R. norvegicus
cacatgttttctctca

SEQ ID NO: 485583 - DNA, 16 bp, R. norvegicus
cacattaaaaagccag

SEQ ID NO: 485584 - DNA, 16 bp, R. norvegicus
cacattaccaagtctg

SEQ ID NO: 485585 - DNA, 16 bp, R. norvegicus
cacattcacaaacata

SEQ ID NO: 485586 - DNA, 16 bp, R. norvegicus
cacattcacacagaca

SEQ ID NO: 485587 - DNA, 16 bp, R. norvegicus
cacattcacaggcaca

SEQ ID NO: 485588 - DNA, 16 bp, R. norvegicus
cacattcactcacaca

SEQ ID NO: 485589 - DNA, 16 bp, R. norvegicus
cacattcccacccact

SEQ ID NO: 485590 - DNA, 16 bp, R. norvegicus
cacattctgcaaaata

SEQ ID NO: 485591 - DNA, 16 bp, R. norvegicus
cacattgagaagatca

SEQ ID NO: 485592 - DNA, 16 bp, R. norvegicus
cacatttaaatttaaa

SEQ ID NO: 485593 - DNA, 16 bp, R. norvegicus
cacatttacacacact

SEQ ID NO: 485594 - DNA, 16 bp, R. norvegicus
cacatttgcacaggag

SEQ ID NO: 485595 - DNA, 17 bp, R. norvegicus
cacatttggggcaggct

SEQ ID NO: 485596 - DNA, 16 bp, R. norvegicus
cacattttctgtatct

SEQ ID NO: 485597 - DNA, 16 bp, R. norvegicus
cacatttttttatcca

SEQ ID NO: 485598 - DNA, 16 bp, R. norvegicus
caccaaaaaacttctg

SEQ ID NO: 485599 - DNA, 16 bp, R. norvegicus
caccaaaaattccacc

SEQ ID NO: 485600 - DNA, 16 bp, R. norvegicus
caccaaagaagcttct

SEQ ID NO: 485601 - DNA, 16 bp, R. norvegicus
caccaaagcctgacac

SEQ ID NO: 485602 - DNA, 16 bp, R. norvegicus
caccaaatgcagaaaa

SEQ ID NO: 485603 - DNA, 16 bp, R. norvegicus
caccaaatgtcccttg

SEQ ID NO: 485604 - DNA, 16 bp, R. norvegicus
caccaacaaggcagca

SEQ ID NO: 485605 - DNA, 16 bp, R. norvegicus
caccaacagctcaggc

SEQ ID NO: 485606 - DNA, 16 bp, R. norvegicus
caccaacagtggagaa

SEQ ID NO: 485607 - DNA, 16 bp, R. norvegicus
caccaacatggctgcc

SEQ ID NO: 485608 - DNA, 16 bp, R. norvegicus
caccaaccaaagagca

SEQ ID NO: 485609 - DNA, 16 bp, R. norvegicus
caccaaccagagcttc

SEQ ID NO: 485610 - DNA, 16 bp, R. norvegicus
caccaaccaggcagca

SEQ ID NO: 485611 - DNA, 17 bp, R. norvegicus
caccaaccattacctgt

SEQ ID NO: 485612 - DNA, 16 bp, R. norvegicus
caccaaccgaagaaca

SEQ ID NO: 485613 - DNA, 16 bp, R. norvegicus
caccaacctggcagca

SEQ ID NO: 485614 - DNA, 16 bp, R. norvegicus
caccaactgtggacca

SEQ ID NO: 485615 - DNA, 16 bp, R. norvegicus
caccaagaggacatct

SEQ ID NO: 485616 - DNA, 16 bp, R. norvegicus
caccaagatactttat

SEQ ID NO: 485617 - DNA, 16 bp, R. norvegicus
caccaagatcaactct

SEQ ID NO: 485618 - DNA, 16 bp, R. norvegicus
caccaagatgacatct

SEQ ID NO: 485619 - DNA, 16 bp, R. norvegicus
caccaagatggctcag

SEQ ID NO: 485620 - DNA, 16 bp, R. norvegicus
caccaagcctgaccac

SEQ ID NO: 485621 - DNA, 16 bp, R. norvegicus
caccaagctgtccatg

SEQ ID NO: 485622 - DNA, 16 bp, R. norvegicus
caccaaggaggcagag

SEQ ID NO: 485623 - DNA, 16 bp, R. norvegicus
caccaagggcttcccc

SEQ ID NO: 485624 - DNA, 16 bp, R. norvegicus
caccaagtccattcct

SEQ ID NO: 485625 - DNA, 16 bp, R. norvegicus
caccaagtctgcctgc

SEQ ID NO: 485626 - DNA, 16 bp, R. norvegicus
caccaatcaggaggaa

SEQ ID NO: 485627 - DNA, 16 bp, R. norvegicus
caccaatgagaatggc

SEQ ID NO: 485628 - DNA, 16 bp, R. norvegicus
caccaatgagtacaca

SEQ ID NO: 485629 - DNA, 16 bp, R. norvegicus
caccaatgcaaataaa

SEQ ID NO: 485630 - DNA, 16 bp, R. norvegicus
caccacaagaagacct

SEQ ID NO: 485631 - DNA, 16 bp, R. norvegicus
caccacacacatgcag

SEQ ID NO: 485632 - DNA, 16 bp, R. norvegicus
caccacacctccacag

SEQ ID NO: 485633 - DNA, 16 bp, R. norvegicus
caccacacctggattt

SEQ ID NO: 485634 - DNA, 16 bp, R. norvegicus
caccacacctgtgtca

SEQ ID NO: 485635 - DNA, 16 bp, R. norvegicus
caccacacttggcttc

SEQ ID NO: 485636 - DNA, 16 bp, R. norvegicus
caccacagacacacat

SEQ ID NO: 485637 - DNA, 16 bp, R. norvegicus
caccacagcaaaccct

SEQ ID NO: 485638 - DNA, 16 bp, R. norvegicus
caccacagcatgaaga

SEQ ID NO: 485639 - DNA, 16 bp, R. norvegicus
caccacatgcacacac

SEQ ID NO: 485640 - DNA, 16 bp, R. norvegicus
caccaccaaaggaagt

SEQ ID NO: 485641 - DNA, 16 bp, R. norvegicus
caccaccaacactgcc

SEQ ID NO: 485642 - DNA, 16 bp, R. norvegicus
caccaccacaccctgc

SEQ ID NO: 485643 - DNA, 16 bp, R. norvegicus
caccaccacacctggc

SEQ ID NO: 485644 - DNA, 16 bp, R. norvegicus
caccaccacagtgaca

SEQ ID NO: 485645 - DNA, 16 bp, R. norvegicus
caccaccacatccagc

SEQ ID NO: 485646 - DNA, 16 bp, R. norvegicus
caccaccaccaccgct

SEQ ID NO: 485647 - DNA, 16 bp, R. norvegicus
caccaccaccactgtc

SEQ ID NO: 485648 - DNA, 16 bp, R. norvegicus
caccaccacctgctgg

SEQ ID NO: 485649 - DNA, 16 bp, R. norvegicus
caccaccacctggctg

SEQ ID NO: 485650 - DNA, 16 bp, R. norvegicus
caccaccactacctgg

SEQ ID NO: 485651 - DNA, 16 bp, R. norvegicus
caccaccactgccact

SEQ ID NO: 485652 - DNA, 16 bp, R. norvegicus
caccaccactgcccag

SEQ ID NO: 485653 - DNA, 16 bp, R. norvegicus
caccaccagaatctga

SEQ ID NO: 485654 - DNA, 16 bp, R. norvegicus
caccaccagcaccatc

SEQ ID NO: 485655 - DNA, 16 bp, R. norvegicus
caccaccaggcctccc

SEQ ID NO: 485656 - DNA, 16 bp, R. norvegicus
caccaccatagagaac

SEQ ID NO: 485657 - DNA, 16 bp, R. norvegicus
caccaccatcaccgcc

SEQ ID NO: 485658 - DNA, 16 bp, R. norvegicus
caccaccatcagcacc

SEQ ID NO: 485659 - DNA, 16 bp, R. norvegicus
caccaccatcatcatt

SEQ ID NO: 485660 - DNA, 16 bp, R. norvegicus
caccaccatccacgtg

SEQ ID NO: 485661 - DNA, 16 bp, R. norvegicus
caccaccatcgccacc

SEQ ID NO: 485662 - DNA, 16 bp, R. norvegicus
caccaccatcgtcatc

SEQ ID NO: 485663 - DNA, 16 bp, R. norvegicus
caccaccatgaccacc

SEQ ID NO: 485664 - DNA, 16 bp, R. norvegicus
caccaccatgtccagc

SEQ ID NO: 485665 - DNA, 16 bp, R. norvegicus
caccaccctgtgagga

SEQ ID NO: 485666 - DNA, 16 bp, R. norvegicus
caccaccgtgcctggc

SEQ ID NO: 485667 - DNA, 16 bp, R. norvegicus
caccactctggcattc

SEQ ID NO: 485668 - DNA, 16 bp, R. norvegicus
caccactgccaccacc

SEQ ID NO: 485669 - DNA, 16 bp, R. norvegicus
caccactgccaccact

SEQ ID NO: 485670 - DNA, 16 bp, R. norvegicus
caccactgcccagctg

SEQ ID NO: 485671 - DNA, 16 bp, R. norvegicus
caccactgtccagctg

SEQ ID NO: 485672 - DNA, 16 bp, R. norvegicus
caccagaaactgagga

SEQ ID NO: 485673 - DNA, 16 bp, R. norvegicus
caccagaacatgagga

SEQ ID NO: 485674 - DNA, 18 bp, R. norvegicus
caccagaaccttctcccc

SEQ ID NO: 485675 - DNA, 16 bp, R. norvegicus
caccagaagaaggcac

SEQ ID NO: 485676 - DNA, 16 bp, R. norvegicus
caccagaagagggcat

SEQ ID NO: 485677 - DNA, 16 bp, R. norvegicus
caccagagaaaaccag

SEQ ID NO: 485678 - DNA, 16 bp, R. norvegicus
caccagagaactcata

SEQ ID NO: 485679 - DNA, 16 bp, R. norvegicus
caccagagatgaccac

SEQ ID NO: 485680 - DNA, 16 bp, R. norvegicus
caccagagctcctagg

SEQ ID NO: 485681 - DNA, 16 bp, R. norvegicus
caccagcaacagagga

SEQ ID NO: 485682 - DNA, 16 bp, R. norvegicus
caccagcaagtcccag

SEQ ID NO: 485683 - DNA, 16 bp, R. norvegicus
caccagcaatgaaaga

SEQ ID NO: 485684 - DNA, 16 bp, R. norvegicus
caccagcagcagcacc

SEQ ID NO: 485685 - DNA, 16 bp, R. norvegicus
caccagcagcagcagg

SEQ ID NO: 485686 - DNA, 16 bp, R. norvegicus
caccagcagctgactg

SEQ ID NO: 485687 - DNA, 16 bp, R. norvegicus
caccagcatctgctct

SEQ ID NO: 485688 - DNA, 16 bp, R. norvegicus
caccagcccaggcatg

SEQ ID NO: 485689 - DNA, 16 bp, R. norvegicus
caccagcctctgcctc

SEQ ID NO: 485690 - DNA, 16 bp, R. norvegicus
caccagccttctcacc

SEQ ID NO: 485691 - DNA, 16 bp, R. norvegicus
caccagctactctctg

SEQ ID NO: 485692 - DNA, 16 bp, R. norvegicus
caccagctcagaggag

SEQ ID NO: 485693 - DNA, 16 bp, R. norvegicus
caccagctcctgcttc

SEQ ID NO: 485694 - DNA, 16 bp, R. norvegicus
caccagctggggacca

SEQ ID NO: 485695 - DNA, 16 bp, R. norvegicus
caccaggaaggcagag

SEQ ID NO: 485696 - DNA, 16 bp, R. norvegicus
caccaggagaacaaag

SEQ ID NO: 485697 - DNA, 16 bp, R. norvegicus
caccaggcacaaacca

SEQ ID NO: 485698 - DNA, 16 bp, R. norvegicus
caccaggcaccaggca

SEQ ID NO: 485699 - DNA, 16 bp, R. norvegicus
caccaggcagctttcg

SEQ ID NO: 485700 - DNA, 16 bp, R. norvegicus
caccaggcagtggtgg

SEQ ID NO: 485701 - DNA, 16 bp, R. norvegicus
caccaggcctgcctag

SEQ ID NO: 485702 - DNA, 16 bp, R. norvegicus
caccaggctggtcact

SEQ ID NO: 485703 - DNA, 16 bp, R. norvegicus
caccagggagatggag

SEQ ID NO: 485704 - DNA, 16 bp, R. norvegicus
caccagggccagctct

SEQ ID NO: 485705 - DNA, 17 bp, R. norvegicus
caccaggggaaggggaa

SEQ ID NO: 485706 - DNA, 16 bp, R. norvegicus
caccagtggaaagaga

SEQ ID NO: 485707 - DNA, 18 bp, R. norvegicus
caccagtggaaggcgaag

SEQ ID NO: 485708 - DNA, 16 bp, R. norvegicus
caccagtgggaagaga

SEQ ID NO: 485709 - DNA, 16 bp, R. norvegicus
caccagtgggaggaga

SEQ ID NO: 485710 - DNA, 16 bp, R. norvegicus
caccagtgtgcagaca

SEQ ID NO: 485711 - DNA, 16 bp, R. norvegicus
caccagttagaccagc

SEQ ID NO: 485712 - DNA, 16 bp, R. norvegicus
caccatacacacagac

SEQ ID NO: 485713 - DNA, 16 bp, R. norvegicus
caccatagtgccccaa

SEQ ID NO: 485714 - DNA, 16 bp, R. norvegicus
caccatcacacatgtg

SEQ ID NO: 485715 - DNA, 16 bp, R. norvegicus
caccatcacaccatca

SEQ ID NO: 485716 - DNA, 16 bp, R. norvegicus
caccatcaccatcaca

SEQ ID NO: 485717 - DNA, 16 bp, R. norvegicus
caccatcatcaccaac

SEQ ID NO: 485718 - DNA, 16 bp, R. norvegicus
caccatcatcaccatt

SEQ ID NO: 485719 - DNA, 16 bp, R. norvegicus
caccatcatcatcctc

SEQ ID NO: 485720 - DNA, 16 bp, R. norvegicus
caccatcatcctcatc

SEQ ID NO: 485721 - DNA, 16 bp, R. norvegicus
caccatcatcttcatc

SEQ ID NO: 485722 - DNA, 16 bp, R. norvegicus
caccatccaggctcca

SEQ ID NO: 485723 - DNA, 16 bp, R. norvegicus
caccatccctgacatc

SEQ ID NO: 485724 - DNA, 16 bp, R. norvegicus
caccatcggagcacaa

SEQ ID NO: 485725 - DNA, 16 bp, R. norvegicus
caccatcgtcatcatc

SEQ ID NO: 485726 - DNA, 16 bp, R. norvegicus
caccatctccactgtg

SEQ ID NO: 485727 - DNA, 16 bp, R. norvegicus
caccatctccagagat

SEQ ID NO: 485728 - DNA, 16 bp, R. norvegicus
caccatgaagggagcc

SEQ ID NO: 485729 - DNA, 16 bp, R. norvegicus
caccatgaccaaagag

SEQ ID NO: 485730 - DNA, 16 bp, R. norvegicus
caccatgaccaaggtg

SEQ ID NO: 485731 - DNA, 16 bp, R. norvegicus
caccatgccagcctgg

SEQ ID NO: 485732 - DNA, 16 bp, R. norvegicus
caccatgcccaacttt

SEQ ID NO: 485733 - DNA, 16 bp, R. norvegicus
caccatgcccagcatt

SEQ ID NO: 485734 - DNA, 16 bp, R. norvegicus
caccatgcccagctct

SEQ ID NO: 485735 - DNA, 16 bp, R. norvegicus
caccatgcctggcttc

SEQ ID NO: 485736 - DNA, 16 bp, R. norvegicus
caccatgcctgtctgt

SEQ ID NO: 485737 - DNA, 16 bp, R. norvegicus
caccatgctgttgctg

SEQ ID NO: 485738 - DNA, 16 bp, R. norvegicus
caccatgcttctcacc

SEQ ID NO: 485739 - DNA, 16 bp, R. norvegicus
caccatggacagctcc

SEQ ID NO: 485740 - DNA, 16 bp, R. norvegicus
caccatggcagcaccc

SEQ ID NO: 485741 - DNA, 16 bp, R. norvegicus
caccatggccaaagca

SEQ ID NO: 485742 - DNA, 16 bp, R. norvegicus
caccatggccccaggt

SEQ ID NO: 485743 - DNA, 16 bp, R. norvegicus
caccatgtctgtctgc

SEQ ID NO: 485744 - DNA, 16 bp, R. norvegicus
caccatgtgagtctgc

SEQ ID NO: 485745 - DNA, 16 bp, R. norvegicus
caccatgtgcatgcag

SEQ ID NO: 485746 - DNA, 16 bp, R. norvegicus
caccatgtgggtccta

SEQ ID NO: 485747 - DNA, 16 bp, R. norvegicus
caccatgtgggtgctg

SEQ ID NO: 485748 - DNA, 29 bp, R. norvegicus
caccatgtggttgctgggatttgaactca

SEQ ID NO: 485749 - DNA, 16 bp, R. norvegicus
caccattagttgaaaa

SEQ ID NO: 485750 - DNA, 16 bp, R. norvegicus
caccattgccctcact

SEQ ID NO: 485751 - DNA, 16 bp, R. norvegicus
caccattgctgtcttc

SEQ ID NO: 485752 - DNA, 16 bp, R. norvegicus
caccattggagcctgg

SEQ ID NO: 485753 - DNA, 16 bp, R. norvegicus
caccattgtcagggca

SEQ ID NO: 485754 - DNA, 16 bp, R. norvegicus
caccatttgtggaaaa

SEQ ID NO: 485755 - DNA, 16 bp, R. norvegicus
caccatttttttttaa

SEQ ID NO: 485756 - DNA, 16 bp, R. norvegicus
cacccaacacatatac

SEQ ID NO: 485757 - DNA, 16 bp, R. norvegicus
cacccaacagcacttc

SEQ ID NO: 485758 - DNA, 16 bp, R. norvegicus
cacccaagtgctggga

SEQ ID NO: 485759 - DNA, 16 bp, R. norvegicus
cacccaatgccaccat

SEQ ID NO: 485760 - DNA, 16 bp, R. norvegicus
cacccacacacacatg

SEQ ID NO: 485761 - DNA, 16 bp, R. norvegicus
cacccacacacatgca

SEQ ID NO: 485762 - DNA, 16 bp, R. norvegicus
cacccacactctcctg

SEQ ID NO: 485763 - DNA, 16 bp, R. norvegicus
cacccacactgcagct

SEQ ID NO: 485764 - DNA, 16 bp, R. norvegicus
cacccacagaggccag

SEQ ID NO: 485765 - DNA, 16 bp, R. norvegicus
cacccacagtgataca

SEQ ID NO: 485766 - DNA, 16 bp, R. norvegicus
cacccacagtggcctg

SEQ ID NO: 485767 - DNA, 16 bp, R. norvegicus
cacccacagtgggcca

SEQ ID NO: 485768 - DNA, 16 bp, R. norvegicus
cacccacagtgggctt

SEQ ID NO: 485769 - DNA, 16 bp, R. norvegicus
cacccacatggccact

SEQ ID NO: 485770 - DNA, 16 bp, R. norvegicus
cacccacatggctgct

SEQ ID NO: 485771 - DNA, 16 bp, R. norvegicus
cacccaccacctcagg

SEQ ID NO: 485772 - DNA, 16 bp, R. norvegicus
cacccacccacttctg

SEQ ID NO: 485773 - DNA, 16 bp, R. norvegicus
cacccacggtgggctg

SEQ ID NO: 485774 - DNA, 16 bp, R. norvegicus
cacccactcagagaag

SEQ ID NO: 485775 - DNA, 16 bp, R. norvegicus
cacccactcctgcctc

SEQ ID NO: 485776 - DNA, 16 bp, R. norvegicus
cacccacttggtggct

SEQ ID NO: 485777 - DNA, 16 bp, R. norvegicus
cacccagagaccttca

SEQ ID NO: 485778 - DNA, 16 bp, R. norvegicus
cacccagagctatgag

SEQ ID NO: 485779 - DNA, 16 bp, R. norvegicus
cacccagagctgacct

SEQ ID NO: 485780 - DNA, 16 bp, R. norvegicus
cacccagagcttccag

SEQ ID NO: 485781 - DNA, 16 bp, R. norvegicus
cacccagcagctgact

SEQ ID NO: 485782 - DNA, 16 bp, R. norvegicus
cacccagccagccagc

SEQ ID NO: 485783 - DNA, 16 bp, R. norvegicus
cacccaggaggaggag

SEQ ID NO: 485784 - DNA, 16 bp, R. norvegicus
cacccaggaggctgag

SEQ ID NO: 485785 - DNA, 16 bp, R. norvegicus
cacccaggcccctgga

SEQ ID NO: 485786 - DNA, 16 bp, R. norvegicus
cacccaggtggtgctg

SEQ ID NO: 485787 - DNA, 16 bp, R. norvegicus
cacccagtgctcccag

SEQ ID NO: 485788 - DNA, 16 bp, R. norvegicus
cacccagttctcccag

SEQ ID NO: 485789 - DNA, 16 bp, R. norvegicus
cacccatcagtcatct

SEQ ID NO: 485790 - DNA, 16 bp, R. norvegicus
cacccatctgtctgtc

SEQ ID NO: 485791 - DNA, 16 bp, R. norvegicus
cacccatgactcctcc

SEQ ID NO: 485792 - DNA, 16 bp, R. norvegicus
cacccatgtaaaaagc

SEQ ID NO: 485793 - DNA, 16 bp, R. norvegicus
caccccaacatcatct

SEQ ID NO: 485794 - DNA, 16 bp, R. norvegicus
caccccacactccatt

SEQ ID NO: 485795 - DNA, 16 bp, R. norvegicus
caccccacgagcaaac

SEQ ID NO: 485796 - DNA, 16 bp, R. norvegicus
caccccagagctctca

SEQ ID NO: 485797 - DNA, 16 bp, R. norvegicus
caccccaggccttcct

SEQ ID NO: 485798 - DNA, 16 bp, R. norvegicus
caccccagtcctgctc

SEQ ID NO: 485799 - DNA, 16 bp, R. norvegicus
caccccagtctcatca

SEQ ID NO: 485800 - DNA, 16 bp, R. norvegicus
cacccccatggtggct

SEQ ID NO: 485801 - DNA, 16 bp, R. norvegicus
caccccctttcctcag

SEQ ID NO: 485802 - DNA, 16 bp, R. norvegicus
cacccctctcttctga

SEQ ID NO: 485803 - DNA, 16 bp, R. norvegicus
cacccctgtgcccagc

SEQ ID NO: 485804 - DNA, 16 bp, R. norvegicus
caccctcctctgcctc

SEQ ID NO: 485805 - DNA, 16 bp, R. norvegicus
caccctctggaactgt

SEQ ID NO: 485806 - DNA, 16 bp, R. norvegicus
caccctcttctgccct

SEQ ID NO: 485807 - DNA, 16 bp, R. norvegicus
caccctcttctgctct

SEQ ID NO: 485808 - DNA, 16 bp, R. norvegicus
caccctcttctggcct

SEQ ID NO: 485809 - DNA, 16 bp, R. norvegicus
caccctcttctgtcct

SEQ ID NO: 485810 - DNA, 16 bp, R. norvegicus
caccctgcctgcctgg

SEQ ID NO: 485811 - DNA, 16 bp, R. norvegicus
caccctggagctggag

SEQ ID NO: 485812 - DNA, 16 bp, R. norvegicus
caccctggcattcctc

SEQ ID NO: 485813 - DNA, 16 bp, R. norvegicus
caccctggccttcccc

SEQ ID NO: 485814 - DNA, 16 bp, R. norvegicus
caccctgggcaggtgg

SEQ ID NO: 485815 - DNA, 16 bp, R. norvegicus
caccctgtctgcctgc

SEQ ID NO: 485816 - DNA, 16 bp, R. norvegicus
caccctgtgggtgctg

SEQ ID NO: 485817 - DNA, 16 bp, R. norvegicus
caccctttcacctgtg

SEQ ID NO: 485818 - DNA, 16 bp, R. norvegicus
caccgacacagctctg

SEQ ID NO: 485819 - DNA, 16 bp, R. norvegicus
caccgactgctcttcc

SEQ ID NO: 485820 - DNA, 16 bp, R. norvegicus
caccgccaccaccatc

SEQ ID NO: 485821 - DNA, 16 bp, R. norvegicus
caccgcggtgcggacc

SEQ ID NO: 485822 - DNA, 16 bp, R. norvegicus
caccggcctctgcctc

SEQ ID NO: 485823 - DNA, 16 bp, R. norvegicus
cacctaaagagatgtt

SEQ ID NO: 485824 - DNA, 16 bp, R. norvegicus
cacctaagaccatctg

SEQ ID NO: 485825 - DNA, 16 bp, R. norvegicus
cacctacaaggcagct

SEQ ID NO: 485826 - DNA, 16 bp, R. norvegicus
cacctacacacactca

SEQ ID NO: 485827 - DNA, 16 bp, R. norvegicus
cacctacacagtgaca

SEQ ID NO: 485828 - DNA, 16 bp, R. norvegicus
cacctacaccagtttt

SEQ ID NO: 485829 - DNA, 16 bp, R. norvegicus
cacctacactcacaca

SEQ ID NO: 485830 - DNA, 16 bp, R. norvegicus
cacctacatgcagccc

SEQ ID NO: 485831 - DNA, 16 bp, R. norvegicus
cacctaccatgggccc

SEQ ID NO: 485832 - DNA, 16 bp, R. norvegicus
cacctactccaatgag

SEQ ID NO: 485833 - DNA, 16 bp, R. norvegicus
cacctagagccctctg

SEQ ID NO: 485834 - DNA, 16 bp, R. norvegicus
cacctatagagaaggg

SEQ ID NO: 485835 - DNA, 16 bp, R. norvegicus
cacctatgtaaataaa

SEQ ID NO: 485836 - DNA, 16 bp, R. norvegicus
cacctatgtatttgtt

SEQ ID NO: 485837 - DNA, 16 bp, R. norvegicus
cacctcaacaccctgc

SEQ ID NO: 485838 - DNA, 16 bp, R. norvegicus
cacctcaataccctgg

SEQ ID NO: 485839 - DNA, 16 bp, R. norvegicus
cacctcacaccaggga

SEQ ID NO: 485840 - DNA, 16 bp, R. norvegicus
cacctcacacctgtca

SEQ ID NO: 485841 - DNA, 16 bp, R. norvegicus
cacctcacagcagtca

SEQ ID NO: 485842 - DNA, 16 bp, R. norvegicus
cacctcacccctgcag

SEQ ID NO: 485843 - DNA, 16 bp, R. norvegicus
cacctcacctcacaga

SEQ ID NO: 485844 - DNA, 16 bp, R. norvegicus
cacctcactgtgggag

SEQ ID NO: 485845 - DNA, 16 bp, R. norvegicus
cacctcagagaaaaga

SEQ ID NO: 485846 - DNA, 16 bp, R. norvegicus
cacctcagagacaaga

SEQ ID NO: 485847 - DNA, 16 bp, R. norvegicus
cacctcagcccacatc

SEQ ID NO: 485848 - DNA, 16 bp, R. norvegicus
cacctcagcctcagaa

SEQ ID NO: 485849 - DNA, 16 bp, R. norvegicus
cacctcagtctcagtc

SEQ ID NO: 485850 - DNA, 17 bp, R. norvegicus
cacctcatttggttctc

SEQ ID NO: 485851 - DNA, 16 bp, R. norvegicus
cacctccaaatatgaa

SEQ ID NO: 485852 - DNA, 16 bp, R. norvegicus
cacctccaacaaggcc

SEQ ID NO: 485853 - DNA, 16 bp, R. norvegicus
cacctccacagtgaca

SEQ ID NO: 485854 - DNA, 16 bp, R. norvegicus
cacctccacataaaac

SEQ ID NO: 485855 - DNA, 16 bp, R. norvegicus
cacctccacctgggaa

SEQ ID NO: 485856 - DNA, 16 bp, R. norvegicus
cacctccagcagaaag

SEQ ID NO: 485857 - DNA, 16 bp, R. norvegicus
cacctccagttccagg

SEQ ID NO: 485858 - DNA, 16 bp, R. norvegicus
cacctccatggcctct

SEQ ID NO: 485859 - DNA, 16 bp, R. norvegicus
cacctcccaagagctg

SEQ ID NO: 485860 - DNA, 16 bp, R. norvegicus
cacctcccaggactct

SEQ ID NO: 485861 - DNA, 16 bp, R. norvegicus
cacctcccaggtctcc

SEQ ID NO: 485862 - DNA, 33 bp, R. norvegicus
cacctcccgtcacataattgtcaaaacaccaaa

SEQ ID NO: 485863 - DNA, 16 bp, R. norvegicus
cacctcctaaagtttc

SEQ ID NO: 485864 - DNA, 16 bp, R. norvegicus
cacctcctacctcctg

SEQ ID NO: 485865 - DNA, 16 bp, R. norvegicus
cacctcctccaggaag

SEQ ID NO: 485866 - DNA, 16 bp, R. norvegicus
cacctcctctcaaagc

SEQ ID NO: 485867 - DNA, 16 bp, R. norvegicus
cacctcctcttccctg

SEQ ID NO: 485868 - DNA, 16 bp, R. norvegicus
cacctcctcttctgca

SEQ ID NO: 485869 - DNA, 16 bp, R. norvegicus
cacctcctgcagcagc

SEQ ID NO: 485870 - DNA, 16 bp, R. norvegicus
cacctcctgggtgctg

SEQ ID NO: 485871 - DNA, 16 bp, R. norvegicus
cacctcggcccacatc

SEQ ID NO: 485872 - DNA, 16 bp, R. norvegicus
cacctcgtccagcaag

SEQ ID NO: 485873 - DNA, 16 bp, R. norvegicus
cacctctccagcacca

SEQ ID NO: 485874 - DNA, 16 bp, R. norvegicus
cacctctccagcctgg

SEQ ID NO: 485875 - DNA, 16 bp, R. norvegicus
cacctctccagccttg

SEQ ID NO: 485876 - DNA, 16 bp, R. norvegicus
cacctctccagctctc

SEQ ID NO: 485877 - DNA, 16 bp, R. norvegicus
cacctctccagtgctg

SEQ ID NO: 485878 - DNA, 16 bp, R. norvegicus
cacctctcctgctccc

SEQ ID NO: 485879 - DNA, 16 bp, R. norvegicus
cacctcttctgctcac

SEQ ID NO: 485880 - DNA, 16 bp, R. norvegicus
cacctctttctttagg

SEQ ID NO: 485881 - DNA, 16 bp, R. norvegicus
cacctgactctgcctc

SEQ ID NO: 485882 - DNA, 16 bp, R. norvegicus
cacctgagattcctga

SEQ ID NO: 485883 - DNA, 16 bp, R. norvegicus
cacctgaggctgacct

SEQ ID NO: 485884 - DNA, 16 bp, R. norvegicus
cacctgatgtaggtgc

SEQ ID NO: 485885 - DNA, 16 bp, R. norvegicus
cacctgatgtcaacct

SEQ ID NO: 485886 - DNA, 16 bp, R. norvegicus
cacctgcacacaccca

SEQ ID NO: 485887 - DNA, 16 bp, R. norvegicus
cacctgcacacataca

SEQ ID NO: 485888 - DNA, 16 bp, R. norvegicus
cacctgcacacccaca

SEQ ID NO: 485889 - DNA, 16 bp, R. norvegicus
cacctgcacatagaca

SEQ ID NO: 485890 - DNA, 16 bp, R. norvegicus
cacctgcacctgcacc

SEQ ID NO: 485891 - DNA, 16 bp, R. norvegicus
cacctgcccagaggtg

SEQ ID NO: 485892 - DNA, 16 bp, R. norvegicus
cacctgcctctgccac

SEQ ID NO: 485893 - DNA, 16 bp, R. norvegicus
cacctgcctctgcccc

SEQ ID NO: 485894 - DNA, 16 bp, R. norvegicus
cacctgcctctgccgc

SEQ ID NO: 485895 - DNA, 16 bp, R. norvegicus
cacctgcctgtaactc

SEQ ID NO: 485896 - DNA, 16 bp, R. norvegicus
cacctgccttggcctc

SEQ ID NO: 485897 - DNA, 16 bp, R. norvegicus
cacctgctcccactgt

SEQ ID NO: 485898 - DNA, 16 bp, R. norvegicus
cacctgctcctgcctc

SEQ ID NO: 485899 - DNA, 16 bp, R. norvegicus
cacctgcttctccctc

SEQ ID NO: 485900 - DNA, 16 bp, R. norvegicus
cacctggaactgaagt

SEQ ID NO: 485901 - DNA, 16 bp, R. norvegicus
cacctggactctgagg

SEQ ID NO: 485902 - DNA, 16 bp, R. norvegicus
cacctgggaagaagga

SEQ ID NO: 485903 - DNA, 16 bp, R. norvegicus
cacctgggagacagag

SEQ ID NO: 485904 - DNA, 16 bp, R. norvegicus
cacctgggaggctgag

SEQ ID NO: 485905 - DNA, 16 bp, R. norvegicus
cacctggggctggaga

SEQ ID NO: 485906 - DNA, 16 bp, R. norvegicus
cacctgggtgctggga

SEQ ID NO: 485907 - DNA, 16 bp, R. norvegicus
cacctggtggaagggg

SEQ ID NO: 485908 - DNA, 16 bp, R. norvegicus
cacctgtcaccccagc

SEQ ID NO: 485909 - DNA, 16 bp, R. norvegicus
cacctgtccatccatc

SEQ ID NO: 485910 - DNA, 16 bp, R. norvegicus
cacctgtctcttcctc

SEQ ID NO: 485911 - DNA, 16 bp, R. norvegicus
cacctgtcttggcggt

SEQ ID NO: 485912 - DNA, 16 bp, R. norvegicus
cacctgtgcccagagc

SEQ ID NO: 485913 - DNA, 16 bp, R. norvegicus
cacctgtgtctcatca

SEQ ID NO: 485914 - DNA, 16 bp, R. norvegicus
cacctgtgtctgcttc

SEQ ID NO: 485915 - DNA, 16 bp, R. norvegicus
cacctgtttgactgtg

SEQ ID NO: 485916 - DNA, 16 bp, R. norvegicus
caccttcagatgaaga

SEQ ID NO: 485917 - DNA, 16 bp, R. norvegicus
caccttcatcatcatc

SEQ ID NO: 485918 - DNA, 16 bp, R. norvegicus
caccttccactggtgc

SEQ ID NO: 485919 - DNA, 16 bp, R. norvegicus
caccttctaacagtgc

SEQ ID NO: 485920 - DNA, 16 bp, R. norvegicus
caccttctcagcacct

SEQ ID NO: 485921 - DNA, 16 bp, R. norvegicus
caccttctgtagccag

SEQ ID NO: 485922 - DNA, 16 bp, R. norvegicus
caccttgcctgggcag

SEQ ID NO: 485923 - DNA, 16 bp, R. norvegicus
caccttggcaggacca

SEQ ID NO: 485924 - DNA, 16 bp, R. norvegicus
caccttgtggatgctg

SEQ ID NO: 485925 - DNA, 16 bp, R. norvegicus
cacctttagctccttc

SEQ ID NO: 485926 - DNA, 16 bp, R. norvegicus
cacctttagtctcagc

SEQ ID NO: 485927 - DNA, 16 bp, R. norvegicus
cacctttctctgtctc

SEQ ID NO: 485928 - DNA, 16 bp, R. norvegicus
cacctttgcctcctga

SEQ ID NO: 485929 - DNA, 16 bp, R. norvegicus
cacctttgcctgctga

SEQ ID NO: 485930 - DNA, 16 bp, R. norvegicus
caccttttctttatcc

SEQ ID NO: 485931 - DNA, 16 bp, R. norvegicus
cacgcacacacacaat

SEQ ID NO: 485932 - DNA, 16 bp, R. norvegicus
cacgcacacacacacg

SEQ ID NO: 485933 - DNA, 16 bp, R. norvegicus
cacgcacacacaccct

SEQ ID NO: 485934 - DNA, 16 bp, R. norvegicus
cacgcacacgcacaca

SEQ ID NO: 485935 - DNA, 16 bp, R. norvegicus
cacgcacatacacaca

SEQ ID NO: 485936 - DNA, 18 bp, R. norvegicus
cacgcacgcacgcacgca

SEQ ID NO: 485937 - DNA, 18 bp, R. norvegicus
cacgcacgcacgcacgcc

SEQ ID NO: 485938 - DNA, 16 bp, R. norvegicus
cacgcatgcgcacaca

SEQ ID NO: 485939 - DNA, 16 bp, R. norvegicus
cacgcatgctcacaca

SEQ ID NO: 485940 - DNA, 16 bp, R. norvegicus
cacgcatgtgcacaca

SEQ ID NO: 485941 - DNA, 16 bp, R. norvegicus
cacgcgcacgcgcacg

SEQ ID NO: 485942 - DNA, 16 bp, R. norvegicus
cacgcgcacgcgcgcg

SEQ ID NO: 485943 - DNA, 16 bp, R. norvegicus
cacgctcatacacaca

SEQ ID NO: 485944 - DNA, 16 bp, R. norvegicus
cacggaccacaaaggc

SEQ ID NO: 485945 - DNA, 25 bp, R. norvegicus
cacggagacaatgcctcccgtcagc

SEQ ID NO: 485946 - DNA, 16 bp, R. norvegicus
cacggtgctggagcag

SEQ ID NO: 485947 - DNA, 16 bp, R. norvegicus
cacgtacacatgcatg

SEQ ID NO: 485948 - DNA, 16 bp, R. norvegicus
cacgtgcacgcacaca

SEQ ID NO: 485949 - DNA, 16 bp, R. norvegicus
cacgtgcacgtgtgtg

SEQ ID NO: 485950 - DNA, 16 bp, R. norvegicus
cacgtgccaccatgcc

SEQ ID NO: 485951 - DNA, 16 bp, R. norvegicus
cacgtgggtcctggga

SEQ ID NO: 485952 - DNA, 16 bp, R. norvegicus
cacgtgtccaatcctg

SEQ ID NO: 485953 - DNA, 16 bp, R. norvegicus
cacgtgtgcacacaca

SEQ ID NO: 485954 - DNA, 16 bp, R. norvegicus
cacgtgtgcctggtgc

SEQ ID NO: 485955 - DNA, 16 bp, R. norvegicus
cacgtgtgtgcatgca

SEQ ID NO: 485956 - DNA, 16 bp, R. norvegicus
cactaaactgggttaa

SEQ ID NO: 485957 - DNA, 18 bp, R. norvegicus
cactaaactgggttaaat

SEQ ID NO: 485958 - DNA, 16 bp, R. norvegicus
cactaaataagaaaat

SEQ ID NO: 485959 - DNA, 16 bp, R. norvegicus
cactaagaaatctctc

SEQ ID NO: 485960 - DNA, 16 bp, R. norvegicus
cactaagaagagctgt

SEQ ID NO: 485961 - DNA, 16 bp, R. norvegicus
cactaaggtattttat

SEQ ID NO: 485962 - DNA, 16 bp, R. norvegicus
cactacacctggcttt

SEQ ID NO: 485963 - DNA, 16 bp, R. norvegicus
cactacagcttccatg

SEQ ID NO: 485964 - DNA, 16 bp, R. norvegicus
cactacttggaggtgt

SEQ ID NO: 485965 - DNA, 16 bp, R. norvegicus
cactagaaagtcccaa

SEQ ID NO: 485966 - DNA, 16 bp, R. norvegicus
cactagttccagctcc

SEQ ID NO: 485967 - DNA, 20 bp, R. norvegicus
cactatagagagatttctta

SEQ ID NO: 485968 - DNA, 16 bp, R. norvegicus
cactatcaccatcacc

SEQ ID NO: 485969 - DNA, 16 bp, R. norvegicus
cactatctgcagatga

SEQ ID NO: 485970 - DNA, 16 bp, R. norvegicus
cactattcctcaagat

SEQ ID NO: 485971 - DNA, 16 bp, R. norvegicus
cactcaagaggctgag

SEQ ID NO: 485972 - DNA, 16 bp, R. norvegicus
cactcacacaaacata

SEQ ID NO: 485973 - DNA, 16 bp, R. norvegicus
cactcacacaaactca

SEQ ID NO: 485974 - DNA, 16 bp, R. norvegicus
cactcacactcactct

SEQ ID NO: 485975 - DNA, 16 bp, R. norvegicus
cactcacagaaggaaa

SEQ ID NO: 485976 - DNA, 16 bp, R. norvegicus
cactcacagacacatg

SEQ ID NO: 485977 - DNA, 16 bp, R. norvegicus
cactcacccactcact

SEQ ID NO: 485978 - DNA, 16 bp, R. norvegicus
cactcactcacactca

SEQ ID NO: 485979 - DNA, 16 bp, R. norvegicus
cactcactcactcact

SEQ ID NO: 485980 - DNA, 29 bp, R. norvegicus
cactcactcagcagataaaattacaccta

SEQ ID NO: 485981 - DNA, 16 bp, R. norvegicus
cactcactctctctct

SEQ ID NO: 485982 - DNA, 16 bp, R. norvegicus
cactcactgtgtgtgt

SEQ ID NO: 485983 - DNA, 16 bp, R. norvegicus
cactcactgttcttcc

SEQ ID NO: 485984 - DNA, 16 bp, R. norvegicus
cactcagaagactgtg

SEQ ID NO: 485985 - DNA, 16 bp, R. norvegicus
cactcagaaggcagag

SEQ ID NO: 485986 - DNA, 16 bp, R. norvegicus
cactcagacacagaca

SEQ ID NO: 485987 - DNA, 16 bp, R. norvegicus
cactcagacactcaca

SEQ ID NO: 485988 - DNA, 16 bp, R. norvegicus
cactcagagcctgccc

SEQ ID NO: 485989 - DNA, 16 bp, R. norvegicus
cactcagaggcagaag

SEQ ID NO: 485990 - DNA, 16 bp, R. norvegicus
cactcagaggcaggag

SEQ ID NO: 485991 - DNA, 16 bp, R. norvegicus
cactcaggagagcagg

SEQ ID NO: 485992 - DNA, 16 bp, R. norvegicus
cactcaggaggaggag

SEQ ID NO: 485993 - DNA, 16 bp, R. norvegicus
cactcaggaggctgtg

SEQ ID NO: 485994 - DNA, 16 bp, R. norvegicus
cactcaggcatgcaca

SEQ ID NO: 485995 - DNA, 16 bp, R. norvegicus
cactcagtgagaacca

SEQ ID NO: 485996 - DNA, 16 bp, R. norvegicus
cactcatatacataaa

SEQ ID NO: 485997 - DNA, 16 bp, R. norvegicus
cactcatccacactca

SEQ ID NO: 485998 - DNA, 16 bp, R. norvegicus
cactcatctcccagtc

SEQ ID NO: 485999 - DNA, 16 bp, R. norvegicus
cactcatgcacacatg

SEQ ID NO: 486000 - DNA, 16 bp, R. norvegicus
cactcatttattcatt

SEQ ID NO: 486001 - DNA, 16 bp, R. norvegicus
cactccaacaaggaca

SEQ ID NO: 486002 - DNA, 16 bp, R. norvegicus
cactccagcctcctcc

SEQ ID NO: 486003 - DNA, 16 bp, R. norvegicus
cactccagcttgcttc

SEQ ID NO: 486004 - DNA, 16 bp, R. norvegicus
cactccaggagatgga

SEQ ID NO: 486005 - DNA, 16 bp, R. norvegicus
cactccagggcaggcc

SEQ ID NO: 486006 - DNA, 16 bp, R. norvegicus
cactccatctttaaaa

SEQ ID NO: 486007 - DNA, 16 bp, R. norvegicus
cactccatgagatgaa

SEQ ID NO: 486008 - DNA, 16 bp, R. norvegicus
cactccattaacacac

SEQ ID NO: 486009 - DNA, 16 bp, R. norvegicus
cactcccacagctctc

SEQ ID NO: 486010 - DNA, 31 bp, R. norvegicus
cactccccctacctgaaagccttaaaagctg

SEQ ID NO: 486011 - DNA, 16 bp, R. norvegicus
cactcccctctccagg

SEQ ID NO: 486012 - DNA, 19 bp, R. norvegicus
cactcccgaattccttcta

SEQ ID NO: 486013 - DNA, 16 bp, R. norvegicus
cactccctgaaccaag

SEQ ID NO: 486014 - DNA, 16 bp, R. norvegicus
cactccctggcctcca

SEQ ID NO: 486015 - DNA, 16 bp, R. norvegicus
cactccctggggactc

SEQ ID NO: 486016 - DNA, 16 bp, R. norvegicus
cactccgggggtcttt

SEQ ID NO: 486017 - DNA, 16 bp, R. norvegicus
cactcctcaattgctg

SEQ ID NO: 486018 - DNA, 16 bp, R. norvegicus
cactcctcagctgtcc

SEQ ID NO: 486019 - DNA, 16 bp, R. norvegicus
cactcctccattgtct

SEQ ID NO: 486020 - DNA, 36 bp, R. norvegicus
cactcctctaatttgtctaaacagttgtcaagttat

SEQ ID NO: 486021 - DNA, 16 bp, R. norvegicus
cactcctgcctcaccc

SEQ ID NO: 486022 - DNA, 16 bp, R. norvegicus
cactcctgcctcagca

SEQ ID NO: 486023 - DNA, 16 bp, R. norvegicus
cactcctgcctcagtg

SEQ ID NO: 486024 - DNA, 16 bp, R. norvegicus
cactcctgggtgttca

SEQ ID NO: 486025 - DNA, 16 bp, R. norvegicus
cactcgctcacacaca

SEQ ID NO: 486026 - DNA, 16 bp, R. norvegicus
cactctaacaataaac

SEQ ID NO: 486027 - DNA, 16 bp, R. norvegicus
cactctcagtgacaca

SEQ ID NO: 486028 - DNA, 16 bp, R. norvegicus
cactctcatccatgga

SEQ ID NO: 486029 - DNA, 16 bp, R. norvegicus
cactctcccactgagc

SEQ ID NO: 486030 - DNA, 16 bp, R. norvegicus
cactctctgtgtcctc

SEQ ID NO: 486031 - DNA, 17 bp, R. norvegicus
cactctgcagcctcagg

SEQ ID NO: 486032 - DNA, 16 bp, R. norvegicus
cactctgccagacaaa

SEQ ID NO: 486033 - DNA, 16 bp, R. norvegicus
cactctggagacagag

SEQ ID NO: 486034 - DNA, 16 bp, R. norvegicus
cactctgggggcagag

SEQ ID NO: 486035 - DNA, 16 bp, R. norvegicus
cactctgtagccctgg

SEQ ID NO: 486036 - DNA, 16 bp, R. norvegicus
cactctgttctcagct

SEQ ID NO: 486037 - DNA, 16 bp, R. norvegicus
cactcttcacatgctc

SEQ ID NO: 486038 - DNA, 16 bp, R. norvegicus
cactcttccactcttc

SEQ ID NO: 486039 - DNA, 16 bp, R. norvegicus
cactctttgttcctgt

SEQ ID NO: 486040 - DNA, 16 bp, R. norvegicus
cactgaaaaaagaaat

SEQ ID NO: 486041 - DNA, 16 bp, R. norvegicus
cactgaaagcctctca

SEQ ID NO: 486042 - DNA, 16 bp, R. norvegicus
cactgaactgcctgag

SEQ ID NO: 486043 - DNA, 16 bp, R. norvegicus
cactgaagaaaatgac

SEQ ID NO: 486044 - DNA, 16 bp, R. norvegicus
cactgaagcagaggcc

SEQ ID NO: 486045 - DNA, 16 bp, R. norvegicus
cactgaagccagaaga

SEQ ID NO: 486046 - DNA, 16 bp, R. norvegicus
cactgacaaaggaagt

SEQ ID NO: 486047 - DNA, 16 bp, R. norvegicus
cactgacacacacact

SEQ ID NO: 486048 - DNA, 16 bp, R. norvegicus
cactgacacacacata

SEQ ID NO: 486049 - DNA, 16 bp, R. norvegicus
cactgacacagacaca

SEQ ID NO: 486050 - DNA, 16 bp, R. norvegicus
cactgactgctcctct

SEQ ID NO: 486051 - DNA, 16 bp, R. norvegicus
cactgactgctcttct

SEQ ID NO: 486052 - DNA, 16 bp, R. norvegicus
cactgacttctcttcc

SEQ ID NO: 486053 - DNA, 16 bp, R. norvegicus
cactgagaagcaaaca

SEQ ID NO: 486054 - DNA, 16 bp, R. norvegicus
cactgagaaggaacag

SEQ ID NO: 486055 - DNA, 16 bp, R. norvegicus
cactgagaaggagaaa

SEQ ID NO: 486056 - DNA, 16 bp, R. norvegicus
cactgagaagtcaggt

SEQ ID NO: 486057 - DNA, 16 bp, R. norvegicus
cactgagacatctttc

SEQ ID NO: 486058 - DNA, 16 bp, R. norvegicus
cactgagagaccctgt

SEQ ID NO: 486059 - DNA, 18 bp, R. norvegicus
cactgagcaaaaggcctt

SEQ ID NO: 486060 - DNA, 16 bp, R. norvegicus
cactgagcatctccct

SEQ ID NO: 486061 - DNA, 16 bp, R. norvegicus
cactgagccacacacc

SEQ ID NO: 486062 - DNA, 16 bp, R. norvegicus
cactgagccacagccc

SEQ ID NO: 486063 - DNA, 16 bp, R. norvegicus
cactgagcctgaagct

SEQ ID NO: 486064 - DNA, 16 bp, R. norvegicus
cactgagccttggttt

SEQ ID NO: 486065 - DNA, 16 bp, R. norvegicus
cactgagctccatcct

SEQ ID NO: 486066 - DNA, 16 bp, R. norvegicus
cactgaggaagatgtg

SEQ ID NO: 486067 - DNA, 16 bp, R. norvegicus
cactgagggacatctg

SEQ ID NO: 486068 - DNA, 33 bp, R. norvegicus
cactgagggacttatgccctggagtggcagcta

SEQ ID NO: 486069 - DNA, 16 bp, R. norvegicus
cactgaggtgtgtttt

SEQ ID NO: 486070 - DNA, 16 bp, R. norvegicus
cactgcaaacctgagg

SEQ ID NO: 486071 - DNA, 16 bp, R. norvegicus
cactgcacgagaagat

SEQ ID NO: 486072 - DNA, 16 bp, R. norvegicus
cactgcagtctctcag

SEQ ID NO: 486073 - DNA, 16 bp, R. norvegicus
cactgcagtgtgtgtg

SEQ ID NO: 486074 - DNA, 16 bp, R. norvegicus
cactgccaccaccacc

SEQ ID NO: 486075 - DNA, 16 bp, R. norvegicus
cactgccaccactgcc

SEQ ID NO: 486076 - DNA, 16 bp, R. norvegicus
cactgccactgtcttc

SEQ ID NO: 486077 - DNA, 16 bp, R. norvegicus
cactgccatcccagct

SEQ ID NO: 486078 - DNA, 16 bp, R. norvegicus
cactgcccacagtgga

SEQ ID NO: 486079 - DNA, 16 bp, R. norvegicus
cactgcccaccctgcc

SEQ ID NO: 486080 - DNA, 16 bp, R. norvegicus
cactgccccactgccc

SEQ ID NO: 486081 - DNA, 49 bp, R. norvegicus
cactgcccgaaggacgaggccaatcacagacagccactcaagcatacga

SEQ ID NO: 486082 - DNA, 16 bp, R. norvegicus
cactgccctggcattt

SEQ ID NO: 486083 - DNA, 16 bp, R. norvegicus
cactgcccttccagag

SEQ ID NO: 486084 - DNA, 16 bp, R. norvegicus
cactgccgctgctgtt

SEQ ID NO: 486085 - DNA, 16 bp, R. norvegicus
cactgcctccatggct

SEQ ID NO: 486086 - DNA, 16 bp, R. norvegicus
cactgcctctggctct

SEQ ID NO: 486087 - DNA, 16 bp, R. norvegicus
cactgcctctgtctgc

SEQ ID NO: 486088 - DNA, 16 bp, R. norvegicus
cactgctgagaatgaa

SEQ ID NO: 486089 - DNA, 16 bp, R. norvegicus
cactgctgccaccacc

SEQ ID NO: 486090 - DNA, 17 bp, R. norvegicus
cactgctgctgctgctc

SEQ ID NO: 486091 - DNA, 16 bp, R. norvegicus
cactgctgcttcctgg

SEQ ID NO: 486092 - DNA, 16 bp, R. norvegicus
cactgctgtgctcaca

SEQ ID NO: 486093 - DNA, 16 bp, R. norvegicus
cactgctttggccctt

SEQ ID NO: 486094 - DNA, 16 bp, R. norvegicus
cactggaaaatgactg

SEQ ID NO: 486095 - DNA, 16 bp, R. norvegicus
cactggaaggagaagc

SEQ ID NO: 486096 - DNA, 16 bp, R. norvegicus
cactggacagccagcc

SEQ ID NO: 486097 - DNA, 16 bp, R. norvegicus
cactggagaagcagag

SEQ ID NO: 486098 - DNA, 16 bp, R. norvegicus
cactggagagactgag

SEQ ID NO: 486099 - DNA, 17 bp, R. norvegicus
cactggagagcttcttg

SEQ ID NO: 486100 - DNA, 16 bp, R. norvegicus
cactggagcatgggaa

SEQ ID NO: 486101 - DNA, 16 bp, R. norvegicus
cactggagctgcaggt

SEQ ID NO: 486102 - DNA, 16 bp, R. norvegicus
cactggaggagaagga

SEQ ID NO: 486103 - DNA, 16 bp, R. norvegicus
cactggccagcaagcc

SEQ ID NO: 486104 - DNA, 16 bp, R. norvegicus
cactggctgcagcact

SEQ ID NO: 486105 - DNA, 16 bp, R. norvegicus
cactggctgctgctct

SEQ ID NO: 486106 - DNA, 16 bp, R. norvegicus
cactggctgcttctcc

SEQ ID NO: 486107 - DNA, 16 bp, R. norvegicus
cactggctggcctgga

SEQ ID NO: 486108 - DNA, 16 bp, R. norvegicus
cactggctgtcttgga

SEQ ID NO: 486109 - DNA, 16 bp, R. norvegicus
cactgggaaagcagag

SEQ ID NO: 486110 - DNA, 16 bp, R. norvegicus
cactgggagaaagctg

SEQ ID NO: 486111 - DNA, 16 bp, R. norvegicus
cactgggatcaaaggt

SEQ ID NO: 486112 - DNA, 16 bp, R. norvegicus
cactgggcacagcttg

SEQ ID NO: 486113 - DNA, 16 bp, R. norvegicus
cactgggcagggtcac

SEQ ID NO: 486114 - DNA, 16 bp, R. norvegicus
cactggggaccctgtg

SEQ ID NO: 486115 - DNA, 16 bp, R. norvegicus
cactggggagaatttc

SEQ ID NO: 486116 - DNA, 16 bp, R. norvegicus
cactggggaggcagag

SEQ ID NO: 486117 - DNA, 16 bp, R. norvegicus
cactggggaggccgag

SEQ ID NO: 486118 - DNA, 16 bp, R. norvegicus
cactggggatccaaac

SEQ ID NO: 486119 - DNA, 16 bp, R. norvegicus
cactggggctcttact

SEQ ID NO: 486120 - DNA, 16 bp, R. norvegicus
cactggggctggagag

SEQ ID NO: 486121 - DNA, 16 bp, R. norvegicus
cactggggcttgctgg

SEQ ID NO: 486122 - DNA, 16 bp, R. norvegicus
cactggggtggggtgg

SEQ ID NO: 486123 - DNA, 16 bp, R. norvegicus
cactgggtcctgggaa

SEQ ID NO: 486124 - DNA, 16 bp, R. norvegicus
cactgggtgttgactg

SEQ ID NO: 486125 - DNA, 16 bp, R. norvegicus
cactggtacaggagac

SEQ ID NO: 486126 - DNA, 16 bp, R. norvegicus
cactggtcatggtgtc

SEQ ID NO: 486127 - DNA, 16 bp, R. norvegicus
cactggtgttttgttc

SEQ ID NO: 486128 - DNA, 16 bp, R. norvegicus
cactgtaccaactgag

SEQ ID NO: 486129 - DNA, 16 bp, R. norvegicus
cactgtaccacaagga

SEQ ID NO: 486130 - DNA, 16 bp, R. norvegicus
cactgtacctcacaca

SEQ ID NO: 486131 - DNA, 16 bp, R. norvegicus
cactgtagaccaggct

SEQ ID NO: 486132 - DNA, 16 bp, R. norvegicus
cactgtagaccaggtt

SEQ ID NO: 486133 - DNA, 19 bp, R. norvegicus
cactgtagctgccttcaga

SEQ ID NO: 486134 - DNA, 16 bp, R. norvegicus
cactgtcacacacagc

SEQ ID NO: 486135 - DNA, 16 bp, R. norvegicus
cactgtcacagacagc

SEQ ID NO: 486136 - DNA, 16 bp, R. norvegicus
cactgtcaccatcacc

SEQ ID NO: 486137 - DNA, 16 bp, R. norvegicus
cactgtcactggcttc

SEQ ID NO: 486138 - DNA, 16 bp, R. norvegicus
cactgtcactttcttc

SEQ ID NO: 486139 - DNA, 16 bp, R. norvegicus
cactgtcatcaccacc

SEQ ID NO: 486140 - DNA, 16 bp, R. norvegicus
cactgtcattctcttc

SEQ ID NO: 486141 - DNA, 16 bp, R. norvegicus
cactgtccccttggtg

SEQ ID NO: 486142 - DNA, 16 bp, R. norvegicus
cactgtcctcatcaca

SEQ ID NO: 486143 - DNA, 16 bp, R. norvegicus
cactgtcctgctgatg

SEQ ID NO: 486144 - DNA, 17 bp, R. norvegicus
cactgtctcttttggga

SEQ ID NO: 486145 - DNA, 17 bp, R. norvegicus
cactgtctgttcactgt

SEQ ID NO: 486146 - DNA, 16 bp, R. norvegicus
cactgtgaaaagcaag

SEQ ID NO: 486147 - DNA, 16 bp, R. norvegicus
cactgtgaaaatcagt

SEQ ID NO: 486148 - DNA, 16 bp, R. norvegicus
cactgtgaaccctgag

SEQ ID NO: 486149 - DNA, 16 bp, R. norvegicus
cactgtgaagatttcc

SEQ ID NO: 486150 - DNA, 16 bp, R. norvegicus
cactgtgaagattttc

SEQ ID NO: 486151 - DNA, 16 bp, R. norvegicus
cactgtgaagtgatgc

SEQ ID NO: 486152 - DNA, 16 bp, R. norvegicus
cactgtgagacccact

SEQ ID NO: 486153 - DNA, 16 bp, R. norvegicus
cactgtgagagaccag

SEQ ID NO: 486154 - DNA, 16 bp, R. norvegicus
cactgtgagcagtgcc

SEQ ID NO: 486155 - DNA, 16 bp, R. norvegicus
cactgtgagtggtgcc

SEQ ID NO: 486156 - DNA, 16 bp, R. norvegicus
cactgtgcagaccagg

SEQ ID NO: 486157 - DNA, 16 bp, R. norvegicus
cactgtgcagtttctc

SEQ ID NO: 486158 - DNA, 16 bp, R. norvegicus
cactgtgctctcctgg

SEQ ID NO: 486159 - DNA, 16 bp, R. norvegicus
cactgtgctgcccagt

SEQ ID NO: 486160 - DNA, 16 bp, R. norvegicus
cactgtgcttcctgga

SEQ ID NO: 486161 - DNA, 16 bp, R. norvegicus
cactgtgcttggcttt

SEQ ID NO: 486162 - DNA, 16 bp, R. norvegicus
cactgtggaagtcagt

SEQ ID NO: 486163 - DNA, 16 bp, R. norvegicus
cactgtggatctacag

SEQ ID NO: 486164 - DNA, 16 bp, R. norvegicus
cactgtgggcggtgct

SEQ ID NO: 486165 - DNA, 16 bp, R. norvegicus
cactgtgggggcgggc

SEQ ID NO: 486166 - DNA, 16 bp, R. norvegicus
cactgtggtacccagg

SEQ ID NO: 486167 - DNA, 17 bp, R. norvegicus
cactgtggtgccccaag

SEQ ID NO: 486168 - DNA, 16 bp, R. norvegicus
cactgtggtgctggac

SEQ ID NO: 486169 - DNA, 16 bp, R. norvegicus
cactgtgtagctgagg

SEQ ID NO: 486170 - DNA, 16 bp, R. norvegicus
cactgtgtctgagaca

SEQ ID NO: 486171 - DNA, 16 bp, R. norvegicus
cactgtgtctgtcttc

SEQ ID NO: 486172 - DNA, 16 bp, R. norvegicus
cactgtgtctgtgttt

SEQ ID NO: 486173 - DNA, 16 bp, R. norvegicus
cactgtgtgcatgtgg

SEQ ID NO: 486174 - DNA, 16 bp, R. norvegicus
cactgtgtgtgcactg

SEQ ID NO: 486175 - DNA, 16 bp, R. norvegicus
cactgttgttcttcct

SEQ ID NO: 486176 - DNA, 16 bp, R. norvegicus
cactgtttctttgtga

SEQ ID NO: 486177 - DNA, 16 bp, R. norvegicus
cacttaaagaaaagtt

SEQ ID NO: 486178 - DNA, 17 bp, R. norvegicus
cacttaaagctgtaaca

SEQ ID NO: 486179 - DNA, 16 bp, R. norvegicus
cacttaagtatagtat

SEQ ID NO: 486180 - DNA, 16 bp, R. norvegicus
cacttacaggagaaaa

SEQ ID NO: 486181 - DNA, 16 bp, R. norvegicus
cacttacatggtggct

SEQ ID NO: 486182 - DNA, 16 bp, R. norvegicus
cacttacctagcaagc

SEQ ID NO: 486183 - DNA, 16 bp, R. norvegicus
cacttatacactcaca

SEQ ID NO: 486184 - DNA, 16 bp, R. norvegicus
cacttcaacaaggcca

SEQ ID NO: 486185 - DNA, 16 bp, R. norvegicus
cacttcagcttcttca

SEQ ID NO: 486186 - DNA, 16 bp, R. norvegicus
cacttcatactcaaca

SEQ ID NO: 486187 - DNA, 32 bp, R. norvegicus
cacttcattctcagcagtgtcctgtagattac

SEQ ID NO: 486188 - DNA, 16 bp, R. norvegicus
cacttccacatcacag

SEQ ID NO: 486189 - DNA, 16 bp, R. norvegicus
cacttccaggggatcc

SEQ ID NO: 486190 - DNA, 16 bp, R. norvegicus
cacttccatgctgaca

SEQ ID NO: 486191 - DNA, 16 bp, R. norvegicus
cacttccctctctgtc

SEQ ID NO: 486192 - DNA, 16 bp, R. norvegicus
cacttccggtatttag

SEQ ID NO: 486193 - DNA, 16 bp, R. norvegicus
cacttcctaggcaagc

SEQ ID NO: 486194 - DNA, 16 bp, R. norvegicus
cacttcctccaaaaaa

SEQ ID NO: 486195 - DNA, 16 bp, R. norvegicus
cacttcctcccacaag

SEQ ID NO: 486196 - DNA, 16 bp, R. norvegicus
cacttcctgcacctgc

SEQ ID NO: 486197 - DNA, 16 bp, R. norvegicus
cacttcctgcctccag

SEQ ID NO: 486198 - DNA, 16 bp, R. norvegicus
cacttcctgccttcct

SEQ ID NO: 486199 - DNA, 16 bp, R. norvegicus
cacttcctggtgctcc

SEQ ID NO: 486200 - DNA, 16 bp, R. norvegicus
cacttcctgttcactc

SEQ ID NO: 486201 - DNA, 16 bp, R. norvegicus
cacttcctgtttgctc

SEQ ID NO: 486202 - DNA, 16 bp, R. norvegicus
cacttcctttctcagt

SEQ ID NO: 486203 - DNA, 16 bp, R. norvegicus
cacttctaagagtcca

SEQ ID NO: 486204 - DNA, 16 bp, R. norvegicus
cacttctctctcccag

SEQ ID NO: 486205 - DNA, 16 bp, R. norvegicus
cacttctgcctcccaa

SEQ ID NO: 486206 - DNA, 16 bp, R. norvegicus
cacttctgtggattta

SEQ ID NO: 486207 - DNA, 16 bp, R. norvegicus
cacttgactttttttt

SEQ ID NO: 486208 - DNA, 16 bp, R. norvegicus
cacttgagaattcttt

SEQ ID NO: 486209 - DNA, 16 bp, R. norvegicus
cacttgaggccctgtc

SEQ ID NO: 486210 - DNA, 29 bp, R. norvegicus
cacttgatcttagccaaaaggccgagaag

SEQ ID NO: 486211 - DNA, 16 bp, R. norvegicus
cacttgcaaggcaagc

SEQ ID NO: 486212 - DNA, 16 bp, R. norvegicus
cacttgcagcagaaaa

SEQ ID NO: 486213 - DNA, 16 bp, R. norvegicus
cacttgccaccaagcc

SEQ ID NO: 486214 - DNA, 16 bp, R. norvegicus
cacttgcctagcaacc

SEQ ID NO: 486215 - DNA, 16 bp, R. norvegicus
cacttgcctctacctc

SEQ ID NO: 486216 - DNA, 16 bp, R. norvegicus
cacttgctaggcaagc

SEQ ID NO: 486217 - DNA, 16 bp, R. norvegicus
cacttgctgttctttc

SEQ ID NO: 486218 - DNA, 16 bp, R. norvegicus
cacttgctttttgaca

SEQ ID NO: 486219 - DNA, 16 bp, R. norvegicus
cacttggacacacaca

SEQ ID NO: 486220 - DNA, 16 bp, R. norvegicus
cacttggagggcagag

SEQ ID NO: 486221 - DNA, 16 bp, R. norvegicus
cacttggctagcaagc

SEQ ID NO: 486222 - DNA, 16 bp, R. norvegicus
cacttgggaagagaga

SEQ ID NO: 486223 - DNA, 16 bp, R. norvegicus
cacttgggagcctgag

SEQ ID NO: 486224 - DNA, 16 bp, R. norvegicus
cacttgggagtcagag

SEQ ID NO: 486225 - DNA, 17 bp, R. norvegicus
cacttgggccagggatg

SEQ ID NO: 486226 - DNA, 16 bp, R. norvegicus
cacttgtctctgcctc

SEQ ID NO: 486227 - DNA, 16 bp, R. norvegicus
cactttagctccttca

SEQ ID NO: 486228 - DNA, 16 bp, R. norvegicus
cactttatattttaaa

SEQ ID NO: 486229 - DNA, 16 bp, R. norvegicus
cactttcagcaatgga

SEQ ID NO: 486230 - DNA, 16 bp, R. norvegicus
cactttccccactgag

SEQ ID NO: 486231 - DNA, 16 bp, R. norvegicus
cactttcccttctatt

SEQ ID NO: 486232 - DNA, 19 bp, R. norvegicus
cactttcctacactcaaac

SEQ ID NO: 486233 - DNA, 16 bp, R. norvegicus
cactttcctcatccag

SEQ ID NO: 486234 - DNA, 16 bp, R. norvegicus
cactttgcagaagttg

SEQ ID NO: 486235 - DNA, 16 bp, R. norvegicus
cactttgctgacattg

SEQ ID NO: 486236 - DNA, 16 bp, R. norvegicus
cactttggaggcagaa

SEQ ID NO: 486237 - DNA, 16 bp, R. norvegicus
cactttggcctttctt

SEQ ID NO: 486238 - DNA, 16 bp, R. norvegicus
cactttgtagccaagg

SEQ ID NO: 486239 - DNA, 16 bp, R. norvegicus
cactttgtctgccact

SEQ ID NO: 486240 - DNA, 17 bp, R. norvegicus
cactttgtgaggactaa

SEQ ID NO: 486241 - DNA, 16 bp, R. norvegicus
cactttgttgaaggtg

SEQ ID NO: 486242 - DNA, 16 bp, R. norvegicus
cacttttctgctacca

SEQ ID NO: 486243 - DNA, 16 bp, R. norvegicus
cagaaaaaatggaaat

SEQ ID NO: 486244 - DNA, 16 bp, R. norvegicus
cagaaaaaccttgtct

SEQ ID NO: 486245 - DNA, 16 bp, R. norvegicus
cagaaaaatataattt

SEQ ID NO: 486246 - DNA, 16 bp, R. norvegicus
cagaaaaattctcaaa

SEQ ID NO: 486247 - DNA, 16 bp, R. norvegicus
cagaaaaatttgcaaa

SEQ ID NO: 486248 - DNA, 16 bp, R. norvegicus
cagaaaacacagatac

SEQ ID NO: 486249 - DNA, 16 bp, R. norvegicus
cagaaaacagcagcag

SEQ ID NO: 486250 - DNA, 16 bp, R. norvegicus
cagaaaacattttaaa

SEQ ID NO: 486251 - DNA, 16 bp, R. norvegicus
cagaaaaccacagcta

SEQ ID NO: 486252 - DNA, 16 bp, R. norvegicus
cagaaaaccagccagt

SEQ ID NO: 486253 - DNA, 16 bp, R. norvegicus
cagaaaaccatcaatg

SEQ ID NO: 486254 - DNA, 16 bp, R. norvegicus
cagaaaacccaggaca

SEQ ID NO: 486255 - DNA, 16 bp, R. norvegicus
cagaaaagaaaaccct

SEQ ID NO: 486256 - DNA, 16 bp, R. norvegicus
cagaaaagaaaatccc

SEQ ID NO: 486257 - DNA, 16 bp, R. norvegicus
cagaaaagaaaattct

SEQ ID NO: 486258 - DNA, 16 bp, R. norvegicus
cagaaaagaaagatct

SEQ ID NO: 486259 - DNA, 16 bp, R. norvegicus
cagaaaagaaatccct

SEQ ID NO: 486260 - DNA, 16 bp, R. norvegicus
cagaaaagaaattact

SEQ ID NO: 486261 - DNA, 16 bp, R. norvegicus
cagaaaagaaattcct

SEQ ID NO: 486262 - DNA, 16 bp, R. norvegicus
cagaaaagacctttga

SEQ ID NO: 486263 - DNA, 16 bp, R. norvegicus
cagaaaagactgaaag

SEQ ID NO: 486264 - DNA, 16 bp, R. norvegicus
cagaaaagagcatcag

SEQ ID NO: 486265 - DNA, 16 bp, R. norvegicus
cagaaaagcaacattt

SEQ ID NO: 486266 - DNA, 16 bp, R. norvegicus
cagaaaagcccagcag

SEQ ID NO: 486267 - DNA, 16 bp, R. norvegicus
cagaaaaggaaactga

SEQ ID NO: 486268 - DNA, 16 bp, R. norvegicus
cagaaaaggctactgg

SEQ ID NO: 486269 - DNA, 16 bp, R. norvegicus
cagaaaaggggaagcc

SEQ ID NO: 486270 - DNA, 16 bp, R. norvegicus
cagaaaagtgagcaga

SEQ ID NO: 486271 - DNA, 16 bp, R. norvegicus
cagaaaataaaaatgt

SEQ ID NO: 486272 - DNA, 16 bp, R. norvegicus
cagaaaatgaagataa

SEQ ID NO: 486273 - DNA, 16 bp, R. norvegicus
cagaaaatgaaggaaa

SEQ ID NO: 486274 - DNA, 16 bp, R. norvegicus
cagaaaatggagagaa

SEQ ID NO: 486275 - DNA, 16 bp, R. norvegicus
cagaaaatggagagac

SEQ ID NO: 486276 - DNA, 16 bp, R. norvegicus
cagaaaatggagagat

SEQ ID NO: 486277 - DNA, 16 bp, R. norvegicus
cagaaaattagaaata

SEQ ID NO: 486278 - DNA, 16 bp, R. norvegicus
cagaaaattcaggaca

SEQ ID NO: 486279 - DNA, 16 bp, R. norvegicus
cagaaaattctcaaca

SEQ ID NO: 486280 - DNA, 16 bp, R. norvegicus
cagaaaattggaaatc

SEQ ID NO: 486281 - DNA, 16 bp, R. norvegicus
cagaaaattttctttt

SEQ ID NO: 486282 - DNA, 16 bp, R. norvegicus
cagaaacaaagactac

SEQ ID NO: 486283 - DNA, 16 bp, R. norvegicus
cagaaacaaagtgtgg

SEQ ID NO: 486284 - DNA, 16 bp, R. norvegicus
cagaaacaagagagac

SEQ ID NO: 486285 - DNA, 16 bp, R. norvegicus
cagaaacaagatcctg

SEQ ID NO: 486286 - DNA, 16 bp, R. norvegicus
cagaaacacaaagggt

SEQ ID NO: 486287 - DNA, 16 bp, R. norvegicus
cagaaacacacagaga

SEQ ID NO: 486288 - DNA, 16 bp, R. norvegicus
cagaaacacagagaga

SEQ ID NO: 486289 - DNA, 16 bp, R. norvegicus
cagaaacacagagata

SEQ ID NO: 486290 - DNA, 16 bp, R. norvegicus
cagaaacacttcccag

SEQ ID NO: 486291 - DNA, 16 bp, R. norvegicus
cagaaacagagacaca

SEQ ID NO: 486292 - DNA, 16 bp, R. norvegicus
cagaaacagctgaaga

SEQ ID NO: 486293 - DNA, 16 bp, R. norvegicus
cagaaacaggaagcag

SEQ ID NO: 486294 - DNA, 16 bp, R. norvegicus
cagaaacaggagaatc

SEQ ID NO: 486295 - DNA, 16 bp, R. norvegicus
cagaaaccaagagtac

SEQ ID NO: 486296 - DNA, 16 bp, R. norvegicus
cagaaaccaaggaaga

SEQ ID NO: 486297 - DNA, 16 bp, R. norvegicus
cagaaaccatggagga

SEQ ID NO: 486298 - DNA, 16 bp, R. norvegicus
cagaaaccctgcctca

SEQ ID NO: 486299 - DNA, 16 bp, R. norvegicus
cagaaactaaagagaa

SEQ ID NO: 486300 - DNA, 37 bp, R. norvegicus
cagaaactatgaaggccagaagatcctggactgacgt

SEQ ID NO: 486301 - DNA, 16 bp, R. norvegicus
cagaaactcaagcagg

SEQ ID NO: 486302 - DNA, 16 bp, R. norvegicus
cagaaactgaaaataa

SEQ ID NO: 486303 - DNA, 16 bp, R. norvegicus
cagaaactgaaacaga

SEQ ID NO: 486304 - DNA, 16 bp, R. norvegicus
cagaaactgaagaaaa

SEQ ID NO: 486305 - DNA, 16 bp, R. norvegicus
cagaaactgaagaaat

SEQ ID NO: 486306 - DNA, 16 bp, R. norvegicus
cagaaactgaagcaga

SEQ ID NO: 486307 - DNA, 16 bp, R. norvegicus
cagaaactgaaggaac

SEQ ID NO: 486308 - DNA, 16 bp, R. norvegicus
cagaaactgaaggaga

SEQ ID NO: 486309 - DNA, 16 bp, R. norvegicus
cagaaactgaagtaaa

SEQ ID NO: 486310 - DNA, 16 bp, R. norvegicus
cagaaactggaagtgt

SEQ ID NO: 486311 - DNA, 16 bp, R. norvegicus
cagaaactgtaaagaa

SEQ ID NO: 486312 - DNA, 16 bp, R. norvegicus
cagaaactgtggagga

SEQ ID NO: 486313 - DNA, 16 bp, R. norvegicus
cagaaacttccacctc

SEQ ID NO: 486314 - DNA, 16 bp, R. norvegicus
cagaaagaaaagctga

SEQ ID NO: 486315 - DNA, 16 bp, R. norvegicus
cagaaagaaaatattt

SEQ ID NO: 486316 - DNA, 16 bp, R. norvegicus
cagaaagaaccaggag

SEQ ID NO: 486317 - DNA, 16 bp, R. norvegicus
cagaaagaactagaaa

SEQ ID NO: 486318 - DNA, 16 bp, R. norvegicus
cagaaagaactggaag

SEQ ID NO: 486319 - DNA, 16 bp, R. norvegicus
cagaaagaagaaaatg

SEQ ID NO: 486320 - DNA, 16 bp, R. norvegicus
cagaaagaagaaatga

SEQ ID NO: 486321 - DNA, 16 bp, R. norvegicus
cagaaagacacagaca

SEQ ID NO: 486322 - DNA, 16 bp, R. norvegicus
cagaaagacacaggaa

SEQ ID NO: 486323 - DNA, 16 bp, R. norvegicus
cagaaagacagataca

SEQ ID NO: 486324 - DNA, 16 bp, R. norvegicus
cagaaagaccagctaa

SEQ ID NO: 486325 - DNA, 16 bp, R. norvegicus
cagaaagactatacat

SEQ ID NO: 486326 - DNA, 16 bp, R. norvegicus
cagaaagactgtgcac

SEQ ID NO: 486327 - DNA, 16 bp, R. norvegicus
cagaaagagacacaga

SEQ ID NO: 486328 - DNA, 16 bp, R. norvegicus
cagaaagagatagaaa

SEQ ID NO: 486329 - DNA, 16 bp, R. norvegicus
cagaaagatacaaagg

SEQ ID NO: 486330 - DNA, 16 bp, R. norvegicus
cagaaagatagaaaca

SEQ ID NO: 486331 - DNA, 16 bp, R. norvegicus
cagaaagatctagaaa

SEQ ID NO: 486332 - DNA, 16 bp, R. norvegicus
cagaaagatggatcct

SEQ ID NO: 486333 - DNA, 16 bp, R. norvegicus
cagaaagcaaaggcag

SEQ ID NO: 486334 - DNA, 16 bp, R. norvegicus
cagaaagcacacacac

SEQ ID NO: 486335 - DNA, 16 bp, R. norvegicus
cagaaagcacagaaag

SEQ ID NO: 486336 - DNA, 16 bp, R. norvegicus
cagaaagctgaggcag

SEQ ID NO: 486337 - DNA, 16 bp, R. norvegicus
cagaaaggagagacag

SEQ ID NO: 486338 - DNA, 16 bp, R. norvegicus
cagaaaggtcacaagt

SEQ ID NO: 486339 - DNA, 16 bp, R. norvegicus
cagaaaggttgatcaa

SEQ ID NO: 486340 - DNA, 16 bp, R. norvegicus
cagaaagtcttttcct

SEQ ID NO: 486341 - DNA, 16 bp, R. norvegicus
cagaaagtggttggtt

SEQ ID NO: 486342 - DNA, 16 bp, R. norvegicus
cagaaagtgttcttaa

SEQ ID NO: 486343 - DNA, 16 bp, R. norvegicus
cagaaagttctagaaa

SEQ ID NO: 486344 - DNA, 16 bp, R. norvegicus
cagaaagttgtcctct

SEQ ID NO: 486345 - DNA, 16 bp, R. norvegicus
cagaaatagcagaaga

SEQ ID NO: 486346 - DNA, 16 bp, R. norvegicus
cagaaatatttaaaag

SEQ ID NO: 486347 - DNA, 16 bp, R. norvegicus
cagaaatcaaccaagt

SEQ ID NO: 486348 - DNA, 16 bp, R. norvegicus
cagaaatccacctgcc

SEQ ID NO: 486349 - DNA, 16 bp, R. norvegicus
cagaaatctgcctgac

SEQ ID NO: 486350 - DNA, 16 bp, R. norvegicus
cagaaatgaaaacgga

SEQ ID NO: 486351 - DNA, 16 bp, R. norvegicus
cagaaatgaagaacaa

SEQ ID NO: 486352 - DNA, 16 bp, R. norvegicus
cagaaatggaaaagga

SEQ ID NO: 486353 - DNA, 16 bp, R. norvegicus
cagaaatggaaaggga

SEQ ID NO: 486354 - DNA, 16 bp, R. norvegicus
cagaaatgtgggtaga

SEQ ID NO: 486355 - DNA, 16 bp, R. norvegicus
cagaaattatgaacca

SEQ ID NO: 486356 - DNA, 16 bp, R. norvegicus
cagaaattgaaaacaa

SEQ ID NO: 486357 - DNA, 16 bp, R. norvegicus
cagaaattgaagcaga

SEQ ID NO: 486358 - DNA, 16 bp, R. norvegicus
cagaaattggaaggaa

SEQ ID NO: 486359 - DNA, 16 bp, R. norvegicus
cagaacaaaccagaga

SEQ ID NO: 486360 - DNA, 16 bp, R. norvegicus
cagaacaacaaagatg

SEQ ID NO: 486361 - DNA, 16 bp, R. norvegicus
cagaacaccaatagtt

SEQ ID NO: 486362 - DNA, 16 bp, R. norvegicus
cagaacaccaatggca

SEQ ID NO: 486363 - DNA, 16 bp, R. norvegicus
cagaacaccagtgact

SEQ ID NO: 486364 - DNA, 16 bp, R. norvegicus
cagaacagccagagct

SEQ ID NO: 486365 - DNA, 16 bp, R. norvegicus
cagaacatgaagagcc

SEQ ID NO: 486366 - DNA, 16 bp, R. norvegicus
cagaacatggaaagaa

SEQ ID NO: 486367 - DNA, 16 bp, R. norvegicus
cagaaccaacagttgg

SEQ ID NO: 486368 - DNA, 16 bp, R. norvegicus
cagaaccagccagcac

SEQ ID NO: 486369 - DNA, 16 bp, R. norvegicus
cagaaccaggagctgg

SEQ ID NO: 486370 - DNA, 16 bp, R. norvegicus
cagaacctctggaagg

SEQ ID NO: 486371 - DNA, 16 bp, R. norvegicus
cagaacctgaaggaac

SEQ ID NO: 486372 - DNA, 16 bp, R. norvegicus
cagaacctttgcagtt

SEQ ID NO: 486373 - DNA, 16 bp, R. norvegicus
cagaacggttttacca

SEQ ID NO: 486374 - DNA, 16 bp, R. norvegicus
cagaactaagcagaga

SEQ ID NO: 486375 - DNA, 16 bp, R. norvegicus
cagaactcacatggtg

SEQ ID NO: 486376 - DNA, 16 bp, R. norvegicus
cagaactcctaaggaa

SEQ ID NO: 486377 - DNA, 16 bp, R. norvegicus
cagaactcctagggac

SEQ ID NO: 486378 - DNA, 16 bp, R. norvegicus
cagaactcctgggaga

SEQ ID NO: 486379 - DNA, 16 bp, R. norvegicus
cagaactgaaagccag

SEQ ID NO: 486380 - DNA, 16 bp, R. norvegicus
cagaactgctcctgtc

SEQ ID NO: 486381 - DNA, 16 bp, R. norvegicus
cagaactggaaagaac

SEQ ID NO: 486382 - DNA, 16 bp, R. norvegicus
cagaactggagacttg

SEQ ID NO: 486383 - DNA, 16 bp, R. norvegicus
cagaagaaactgcaag

SEQ ID NO: 486384 - DNA, 16 bp, R. norvegicus
cagaagaaagaatgga

SEQ ID NO: 486385 - DNA, 16 bp, R. norvegicus
cagaagaaagcatctt

SEQ ID NO: 486386 - DNA, 16 bp, R. norvegicus
cagaagaaagctaaag

SEQ ID NO: 486387 - DNA, 16 bp, R. norvegicus
cagaagaaataaaatt

SEQ ID NO: 486388 - DNA, 16 bp, R. norvegicus
cagaagaacatggccc

SEQ ID NO: 486389 - DNA, 16 bp, R. norvegicus
cagaagaacctgggca

SEQ ID NO: 486390 - DNA, 16 bp, R. norvegicus
cagaagaactggagaa

SEQ ID NO: 486391 - DNA, 16 bp, R. norvegicus
cagaagaagaggcaga

SEQ ID NO: 486392 - DNA, 34 bp, R. norvegicus
cagaagaagagttacaagagttgatagatcaaat

SEQ ID NO: 486393 - DNA, 16 bp, R. norvegicus
cagaagaaggaagctg

SEQ ID NO: 486394 - DNA, 16 bp, R. norvegicus
cagaagaaggcatcag

SEQ ID NO: 486395 - DNA, 17 bp, R. norvegicus
cagaagaatcctgttgc

SEQ ID NO: 486396 - DNA, 16 bp, R. norvegicus
cagaagaatttcctac

SEQ ID NO: 486397 - DNA, 16 bp, R. norvegicus
cagaagacacacacag

SEQ ID NO: 486398 - DNA, 16 bp, R. norvegicus
cagaagacagagacag

SEQ ID NO: 486399 - DNA, 16 bp, R. norvegicus
cagaagacagggagga

SEQ ID NO: 486400 - DNA, 16 bp, R. norvegicus
cagaagacagttatat

SEQ ID NO: 486401 - DNA, 16 bp, R. norvegicus
cagaagacccagattc

SEQ ID NO: 486402 - DNA, 16 bp, R. norvegicus
cagaagagaaagtagg

SEQ ID NO: 486403 - DNA, 16 bp, R. norvegicus
cagaagagaatatcag

SEQ ID NO: 486404 - DNA, 16 bp, R. norvegicus
cagaagagagcagcag

SEQ ID NO: 486405 - DNA, 16 bp, R. norvegicus
cagaagagaggggtgg

SEQ ID NO: 486406 - DNA, 16 bp, R. norvegicus
cagaagagattttgga

SEQ ID NO: 486407 - DNA, 16 bp, R. norvegicus
cagaagagcagaagag

SEQ ID NO: 486408 - DNA, 16 bp, R. norvegicus
cagaagagcatcagat

SEQ ID NO: 486409 - DNA, 16 bp, R. norvegicus
cagaagaggaagtaga

SEQ ID NO: 486410 - DNA, 16 bp, R. norvegicus
cagaagaggacacaga

SEQ ID NO: 486411 - DNA, 16 bp, R. norvegicus
cagaagaggacctcag

SEQ ID NO: 486412 - DNA, 16 bp, R. norvegicus
cagaagaggatgctgg

SEQ ID NO: 486413 - DNA, 16 bp, R. norvegicus
cagaagaggccatcag

SEQ ID NO: 486414 - DNA, 16 bp, R. norvegicus
cagaagagggaaccag

SEQ ID NO: 486415 - DNA, 16 bp, R. norvegicus
cagaagagggagcaga

SEQ ID NO: 486416 - DNA, 16 bp, R. norvegicus
cagaagagggagctgg

SEQ ID NO: 486417 - DNA, 16 bp, R. norvegicus
cagaagagggcacaga

SEQ ID NO: 486418 - DNA, 17 bp, R. norvegicus
cagaagagggcaccaga

SEQ ID NO: 486419 - DNA, 16 bp, R. norvegicus
cagaagagggcagcag

SEQ ID NO: 486420 - DNA, 16 bp, R. norvegicus
cagaagagggcctcag

SEQ ID NO: 486421 - DNA, 16 bp, R. norvegicus
cagaagagggccttgg

SEQ ID NO: 486422 - DNA, 16 bp, R. norvegicus
cagaagagggcttggg

SEQ ID NO: 486423 - DNA, 27 bp, R. norvegicus
cagaagagtctctacaaagatgtgatg

SEQ ID NO: 486424 - DNA, 24 bp, R. norvegicus
cagaagagtttcatggagatcagt

SEQ ID NO: 486425 - DNA, 16 bp, R. norvegicus
cagaagatactgggca

SEQ ID NO: 486426 - DNA, 16 bp, R. norvegicus
cagaagatagcataga

SEQ ID NO: 486427 - DNA, 16 bp, R. norvegicus
cagaagatcatgggca

SEQ ID NO: 486428 - DNA, 16 bp, R. norvegicus
cagaagatccaggaca

SEQ ID NO: 486429 - DNA, 16 bp, R. norvegicus
cagaagatcctgaact

SEQ ID NO: 486430 - DNA, 16 bp, R. norvegicus
cagaagatcctgagca

SEQ ID NO: 486431 - DNA, 16 bp, R. norvegicus
cagaagatcctggaga

SEQ ID NO: 486432 - DNA, 16 bp, R. norvegicus
cagaagatctgacacc

SEQ ID NO: 486433 - DNA, 16 bp, R. norvegicus
cagaagatggaaacat

SEQ ID NO: 486434 - DNA, 16 bp, R. norvegicus
cagaagatggcatcag

SEQ ID NO: 486435 - DNA, 16 bp, R. norvegicus
cagaagatgtggccca

SEQ ID NO: 486436 - DNA, 16 bp, R. norvegicus
cagaagattcaataga

SEQ ID NO: 486437 - DNA, 16 bp, R. norvegicus
cagaagattctagaag

SEQ ID NO: 486438 - DNA, 16 bp, R. norvegicus
cagaagcaaaagctgg

SEQ ID NO: 486439 - DNA, 16 bp, R. norvegicus
cagaagcaaagcagaa

SEQ ID NO: 486440 - DNA, 16 bp, R. norvegicus
cagaagcaaaggagag

SEQ ID NO: 486441 - DNA, 16 bp, R. norvegicus
cagaagcaacagaaag

SEQ ID NO: 486442 - DNA, 16 bp, R. norvegicus
cagaagcacacacaca

SEQ ID NO: 486443 - DNA, 16 bp, R. norvegicus
cagaagcagaaggaac

SEQ ID NO: 486444 - DNA, 16 bp, R. norvegicus
cagaagcagaaggaga

SEQ ID NO: 486445 - DNA, 16 bp, R. norvegicus
cagaagcagaaggatc

SEQ ID NO: 486446 - DNA, 16 bp, R. norvegicus
cagaagcagagagaga

SEQ ID NO: 486447 - DNA, 16 bp, R. norvegicus
cagaagcagagagcag

SEQ ID NO: 486448 - DNA, 16 bp, R. norvegicus
cagaagcagaggaaat

SEQ ID NO: 486449 - DNA, 16 bp, R. norvegicus
cagaagcagaggaaga

SEQ ID NO: 486450 - DNA, 16 bp, R. norvegicus
cagaagcagaggccat

SEQ ID NO: 486451 - DNA, 16 bp, R. norvegicus
cagaagcagatactta

SEQ ID NO: 486452 - DNA, 16 bp, R. norvegicus
cagaagcagatgcaga

SEQ ID NO: 486453 - DNA, 16 bp, R. norvegicus
cagaagcagatgcttg

SEQ ID NO: 486454 - DNA, 16 bp, R. norvegicus
cagaagcagatgtatg

SEQ ID NO: 486455 - DNA, 16 bp, R. norvegicus
cagaagcagcaagaag

SEQ ID NO: 486456 - DNA, 16 bp, R. norvegicus
cagaagcagcagcagt

SEQ ID NO: 486457 - DNA, 16 bp, R. norvegicus
cagaagcagcaggagc

SEQ ID NO: 486458 - DNA, 16 bp, R. norvegicus
cagaagcaggaagaga

SEQ ID NO: 486459 - DNA, 16 bp, R. norvegicus
cagaagcaggaggaag

SEQ ID NO: 486460 - DNA, 16 bp, R. norvegicus
cagaagcaggcagagc

SEQ ID NO: 486461 - DNA, 16 bp, R. norvegicus
cagaagcaggggcagg

SEQ ID NO: 486462 - DNA, 16 bp, R. norvegicus
cagaagcagggggaga

SEQ ID NO: 486463 - DNA, 16 bp, R. norvegicus
cagaagcaggtggacc

SEQ ID NO: 486464 - DNA, 16 bp, R. norvegicus
cagaagccaaaaagca

SEQ ID NO: 486465 - DNA, 16 bp, R. norvegicus
cagaagccaaaaggca

SEQ ID NO: 486466 - DNA, 16 bp, R. norvegicus
cagaagccacagagga

SEQ ID NO: 486467 - DNA, 16 bp, R. norvegicus
cagaagccagaaagaa

SEQ ID NO: 486468 - DNA, 16 bp, R. norvegicus
cagaagccagaagaca

SEQ ID NO: 486469 - DNA, 16 bp, R. norvegicus
cagaagccagaggaag

SEQ ID NO: 486470 - DNA, 16 bp, R. norvegicus
cagaagccagaggctt

SEQ ID NO: 486471 - DNA, 16 bp, R. norvegicus
cagaagccagagtcct

SEQ ID NO: 486472 - DNA, 16 bp, R. norvegicus
cagaagccaggaaagt

SEQ ID NO: 486473 - DNA, 16 bp, R. norvegicus
cagaagccatggagag

SEQ ID NO: 486474 - DNA, 16 bp, R. norvegicus
cagaagccatggagga

SEQ ID NO: 486475 - DNA, 16 bp, R. norvegicus
cagaagcccatgggtg

SEQ ID NO: 486476 - DNA, 16 bp, R. norvegicus
cagaagccctcctgca

SEQ ID NO: 486477 - DNA, 16 bp, R. norvegicus
cagaagcctgatatgg

SEQ ID NO: 486478 - DNA, 16 bp, R. norvegicus
cagaagcggcaggacc

SEQ ID NO: 486479 - DNA, 16 bp, R. norvegicus
cagaagctacacccat

SEQ ID NO: 486480 - DNA, 16 bp, R. norvegicus
cagaagctcaagctag

SEQ ID NO: 486481 - DNA, 16 bp, R. norvegicus
cagaagctcaaggtca

SEQ ID NO: 486482 - DNA, 16 bp, R. norvegicus
cagaagctcacagcca

SEQ ID NO: 486483 - DNA, 16 bp, R. norvegicus
cagaagctctcagacg

SEQ ID NO: 486484 - DNA, 16 bp, R. norvegicus
cagaagctctcagagg

SEQ ID NO: 486485 - DNA, 16 bp, R. norvegicus
cagaagctgaaaaaaa

SEQ ID NO: 486486 - DNA, 16 bp, R. norvegicus
cagaagctgaaccaca

SEQ ID NO: 486487 - DNA, 16 bp, R. norvegicus
cagaagctgaagcaga

SEQ ID NO: 486488 - DNA, 16 bp, R. norvegicus
cagaagctgaaggaaa

SEQ ID NO: 486489 - DNA, 16 bp, R. norvegicus
cagaagctgagagaag

SEQ ID NO: 486490 - DNA, 16 bp, R. norvegicus
cagaagctgatgtaga

SEQ ID NO: 486491 - DNA, 16 bp, R. norvegicus
cagaagctgctgagcc

SEQ ID NO: 486492 - DNA, 16 bp, R. norvegicus
cagaagctggaaagta

SEQ ID NO: 486493 - DNA, 16 bp, R. norvegicus
cagaagctggaagaga

SEQ ID NO: 486494 - DNA, 16 bp, R. norvegicus
cagaagctggtgaccc

SEQ ID NO: 486495 - DNA, 16 bp, R. norvegicus
cagaagctgttcagct

SEQ ID NO: 486496 - DNA, 16 bp, R. norvegicus
cagaagctttgcagat

SEQ ID NO: 486497 - DNA, 16 bp, R. norvegicus
cagaaggaaaagagcc

SEQ ID NO: 486498 - DNA, 16 bp, R. norvegicus
cagaaggaagaggcag

SEQ ID NO: 486499 - DNA, 16 bp, R. norvegicus
cagaaggaagcagcca

SEQ ID NO: 486500 - DNA, 16 bp, R. norvegicus
cagaaggacagaagga

SEQ ID NO: 486501 - DNA, 16 bp, R. norvegicus
cagaaggacagacagc

SEQ ID NO: 486502 - DNA, 16 bp, R. norvegicus
cagaaggacatgcatg

SEQ ID NO: 486503 - DNA, 16 bp, R. norvegicus
cagaaggagaaactga

SEQ ID NO: 486504 - DNA, 16 bp, R. norvegicus
cagaaggagactgtct

SEQ ID NO: 486505 - DNA, 16 bp, R. norvegicus
cagaaggagagaacag

SEQ ID NO: 486506 - DNA, 16 bp, R. norvegicus
cagaaggagatcaagg

SEQ ID NO: 486507 - DNA, 16 bp, R. norvegicus
cagaaggagcaggcag

SEQ ID NO: 486508 - DNA, 16 bp, R. norvegicus
cagaaggagctgaaag

SEQ ID NO: 486509 - DNA, 16 bp, R. norvegicus
cagaaggagctgaagg

SEQ ID NO: 486510 - DNA, 18 bp, R. norvegicus
cagaaggatcctggtgtc

SEQ ID NO: 486511 - DNA, 16 bp, R. norvegicus
cagaaggatctcaagt

SEQ ID NO: 486512 - DNA, 16 bp, R. norvegicus
cagaaggcagagatgg

SEQ ID NO: 486513 - DNA, 16 bp, R. norvegicus
cagaaggcagagctgg

SEQ ID NO: 486514 - DNA, 16 bp, R. norvegicus
cagaaggcagaggaag

SEQ ID NO: 486515 - DNA, 16 bp, R. norvegicus
cagaaggcagaggcag

SEQ ID NO: 486516 - DNA, 16 bp, R. norvegicus
cagaaggcagcatttc

SEQ ID NO: 486517 - DNA, 16 bp, R. norvegicus
cagaaggcagccagga

SEQ ID NO: 486518 - DNA, 16 bp, R. norvegicus
cagaaggccaaggcag

SEQ ID NO: 486519 - DNA, 16 bp, R. norvegicus
cagaaggctgaggaag

SEQ ID NO: 486520 - DNA, 16 bp, R. norvegicus
cagaaggctgaggcag

SEQ ID NO: 486521 - DNA, 16 bp, R. norvegicus
cagaagggaaagagcc

SEQ ID NO: 486522 - DNA, 16 bp, R. norvegicus
cagaagggcagacatg

SEQ ID NO: 486523 - DNA, 16 bp, R. norvegicus
cagaagggcctgccca

SEQ ID NO: 486524 - DNA, 16 bp, R. norvegicus
cagaagggtcctgtcc

SEQ ID NO: 486525 - DNA, 16 bp, R. norvegicus
cagaaggtcaggaaat

SEQ ID NO: 486526 - DNA, 16 bp, R. norvegicus
cagaagtatttctcta

SEQ ID NO: 486527 - DNA, 16 bp, R. norvegicus
cagaagtcatggagga

SEQ ID NO: 486528 - DNA, 16 bp, R. norvegicus
cagaagtccacaaaat

SEQ ID NO: 486529 - DNA, 16 bp, R. norvegicus
cagaagtgctgacaca

SEQ ID NO: 486530 - DNA, 16 bp, R. norvegicus
cagaagttcaaggcca

SEQ ID NO: 486531 - DNA, 16 bp, R. norvegicus
cagaagttcaaggtca

SEQ ID NO: 486532 - DNA, 16 bp, R. norvegicus
cagaagttcagagtca

SEQ ID NO: 486533 - DNA, 16 bp, R. norvegicus
cagaagttcagtccag

SEQ ID NO: 486534 - DNA, 16 bp, R. norvegicus
cagaagttcctgggca

SEQ ID NO: 486535 - DNA, 16 bp, R. norvegicus
cagaataatcaaaaca

SEQ ID NO: 486536 - DNA, 16 bp, R. norvegicus
cagaatacaacagata

SEQ ID NO: 486537 - DNA, 16 bp, R. norvegicus
cagaatacagaataca

SEQ ID NO: 486538 - DNA, 16 bp, R. norvegicus
cagaatacaggaaata

SEQ ID NO: 486539 - DNA, 16 bp, R. norvegicus
cagaatacagtaacct

SEQ ID NO: 486540 - DNA, 16 bp, R. norvegicus
cagaataccaacagtt

SEQ ID NO: 486541 - DNA, 16 bp, R. norvegicus
cagaataccagtggct

SEQ ID NO: 486542 - DNA, 16 bp, R. norvegicus
cagaatactcacagga

SEQ ID NO: 486543 - DNA, 17 bp, R. norvegicus
cagaatcacaacagact

SEQ ID NO: 486544 - DNA, 16 bp, R. norvegicus
cagaatcattttgatt

SEQ ID NO: 486545 - DNA, 16 bp, R. norvegicus
cagaatccaagaacac

SEQ ID NO: 486546 - DNA, 16 bp, R. norvegicus
cagaatccatgctaca

SEQ ID NO: 486547 - DNA, 16 bp, R. norvegicus
cagaatctatgaaggc

SEQ ID NO: 486548 - DNA, 16 bp, R. norvegicus
cagaatctccatgaca

SEQ ID NO: 486549 - DNA, 16 bp, R. norvegicus
cagaatctgctgtcac

SEQ ID NO: 486550 - DNA, 16 bp, R. norvegicus
cagaatctgtggaaat

SEQ ID NO: 486551 - DNA, 16 bp, R. norvegicus
cagaatgagcaagaga

SEQ ID NO: 486552 - DNA, 16 bp, R. norvegicus
cagaatgcttgcctag

SEQ ID NO: 486553 - DNA, 16 bp, R. norvegicus
cagaatggaaaatggg

SEQ ID NO: 486554 - DNA, 16 bp, R. norvegicus
cagaatgtcactagga

SEQ ID NO: 486555 - DNA, 16 bp, R. norvegicus
cagaattatgccagac

SEQ ID NO: 486556 - DNA, 16 bp, R. norvegicus
cagaattatttttatt

SEQ ID NO: 486557 - DNA, 16 bp, R. norvegicus
cagaattcaagaacac

SEQ ID NO: 486558 - DNA, 16 bp, R. norvegicus
cagaattcaggaagaa

SEQ ID NO: 486559 - DNA, 16 bp, R. norvegicus
cagaattccaaacatc

SEQ ID NO: 486560 - DNA, 16 bp, R. norvegicus
cagaattccaaatata

SEQ ID NO: 486561 - DNA, 16 bp, R. norvegicus
cagaattccataaaaa

SEQ ID NO: 486562 - DNA, 16 bp, R. norvegicus
cagaattctatcagat

SEQ ID NO: 486563 - DNA, 16 bp, R. norvegicus
cagaatttaaaaataa

SEQ ID NO: 486564 - DNA, 16 bp, R. norvegicus
cagaatttcttttaaa

SEQ ID NO: 486565 - DNA, 16 bp, R. norvegicus
cagaattttatttatt

SEQ ID NO: 486566 - DNA, 16 bp, R. norvegicus
cagacaaaccagaggg

SEQ ID NO: 486567 - DNA, 16 bp, R. norvegicus
cagacaaaccagttaa

SEQ ID NO: 486568 - DNA, 16 bp, R. norvegicus
cagacaacacagacgg

SEQ ID NO: 486569 - DNA, 16 bp, R. norvegicus
cagacaaccacagctg

SEQ ID NO: 486570 - DNA, 16 bp, R. norvegicus
cagacaagcagacaga

SEQ ID NO: 486571 - DNA, 16 bp, R. norvegicus
cagacaaggcagctct

SEQ ID NO: 486572 - DNA, 16 bp, R. norvegicus
cagacaaggccatctt

SEQ ID NO: 486573 - DNA, 16 bp, R. norvegicus
cagacaaggtggccca

SEQ ID NO: 486574 - DNA, 16 bp, R. norvegicus
cagacaatgccatctt

SEQ ID NO: 486575 - DNA, 16 bp, R. norvegicus
cagacaattgctgatg

SEQ ID NO: 486576 - DNA, 16 bp, R. norvegicus
cagacacaaagaaact

SEQ ID NO: 486577 - DNA, 16 bp, R. norvegicus
cagacacacacatacc

SEQ ID NO: 486578 - DNA, 16 bp, R. norvegicus
cagacacacacatgaa

SEQ ID NO: 486579 - DNA, 16 bp, R. norvegicus
cagacacacactcatg

SEQ ID NO: 486580 - DNA, 16 bp, R. norvegicus
cagacacacatagaaa

SEQ ID NO: 486581 - DNA, 16 bp, R. norvegicus
cagacacaccagacaa

SEQ ID NO: 486582 - DNA, 16 bp, R. norvegicus
cagacacaccagagga

SEQ ID NO: 486583 - DNA, 16 bp, R. norvegicus
cagacacaccagtaga

SEQ ID NO: 486584 - DNA, 16 bp, R. norvegicus
cagacacacctgaaga

SEQ ID NO: 486585 - DNA, 16 bp, R. norvegicus
cagacacactcaaagt

SEQ ID NO: 486586 - DNA, 16 bp, R. norvegicus
cagacacagaagaaca

SEQ ID NO: 486587 - DNA, 16 bp, R. norvegicus
cagacacagacacagg

SEQ ID NO: 486588 - DNA, 16 bp, R. norvegicus
cagacacagacgcaga

SEQ ID NO: 486589 - DNA, 16 bp, R. norvegicus
cagacacagagggaac

SEQ ID NO: 486590 - DNA, 16 bp, R. norvegicus
cagacacatacatata

SEQ ID NO: 486591 - DNA, 16 bp, R. norvegicus
cagacaccaaacccag

SEQ ID NO: 486592 - DNA, 16 bp, R. norvegicus
cagacaccaaatcctg

SEQ ID NO: 486593 - DNA, 16 bp, R. norvegicus
cagacaccacacatga

SEQ ID NO: 486594 - DNA, 16 bp, R. norvegicus
cagacacccacacaga

SEQ ID NO: 486595 - DNA, 16 bp, R. norvegicus
cagacaccctcacaca

SEQ ID NO: 486596 - DNA, 16 bp, R. norvegicus
cagacactcctgtgaa

SEQ ID NO: 486597 - DNA, 16 bp, R. norvegicus
cagacactgaaacaag

SEQ ID NO: 486598 - DNA, 16 bp, R. norvegicus
cagacactgcccggac

SEQ ID NO: 486599 - DNA, 16 bp, R. norvegicus
cagacactggattacc

SEQ ID NO: 486600 - DNA, 16 bp, R. norvegicus
cagacagacaaacaag

SEQ ID NO: 486601 - DNA, 16 bp, R. norvegicus
cagacagacaaactga

SEQ ID NO: 486602 - DNA, 16 bp, R. norvegicus
cagacagacaagagac

SEQ ID NO: 486603 - DNA, 16 bp, R. norvegicus
cagacagacaagcagg

SEQ ID NO: 486604 - DNA, 16 bp, R. norvegicus
cagacagacagaagag

SEQ ID NO: 486605 - DNA, 16 bp, R. norvegicus
cagacagacagaagat

SEQ ID NO: 486606 - DNA, 16 bp, R. norvegicus
cagacagacagacaaa

SEQ ID NO: 486607 - DNA, 16 bp, R. norvegicus
cagacagacagacaga

SEQ ID NO: 486608 - DNA, 16 bp, R. norvegicus
cagacagacagacatc

SEQ ID NO: 486609 - DNA, 16 bp, R. norvegicus
cagacagacagagaat

SEQ ID NO: 486610 - DNA, 16 bp, R. norvegicus
cagacagacagagagc

SEQ ID NO: 486611 - DNA, 16 bp, R. norvegicus
cagacagacaggagga

SEQ ID NO: 486612 - DNA, 16 bp, R. norvegicus
cagacagacatgcaga

SEQ ID NO: 486613 - DNA, 16 bp, R. norvegicus
cagacagacccacaga

SEQ ID NO: 486614 - DNA, 16 bp, R. norvegicus
cagacagagagacaaa

SEQ ID NO: 486615 - DNA, 16 bp, R. norvegicus
cagacagagagagaca

SEQ ID NO: 486616 - DNA, 16 bp, R. norvegicus
cagacagagagagaga

SEQ ID NO: 486617 - DNA, 16 bp, R. norvegicus
cagacagagctctgtg

SEQ ID NO: 486618 - DNA, 16 bp, R. norvegicus
cagacagaggaagaga

SEQ ID NO: 486619 - DNA, 16 bp, R. norvegicus
cagacagataaataga

SEQ ID NO: 486620 - DNA, 16 bp, R. norvegicus
cagacagatagacaag

SEQ ID NO: 486621 - DNA, 16 bp, R. norvegicus
cagacagatctctggg

SEQ ID NO: 486622 - DNA, 16 bp, R. norvegicus
cagacagatgcagaca

SEQ ID NO: 486623 - DNA, 16 bp, R. norvegicus
cagacagatgtgagcc

SEQ ID NO: 486624 - DNA, 16 bp, R. norvegicus
cagacagcaggaagag

SEQ ID NO: 486625 - DNA, 16 bp, R. norvegicus
cagacagccagacaga

SEQ ID NO: 486626 - DNA, 16 bp, R. norvegicus
cagacaggcagaaagg

SEQ ID NO: 486627 - DNA, 16 bp, R. norvegicus
cagacaggccttgaac

SEQ ID NO: 486628 - DNA, 16 bp, R. norvegicus
cagacaggtaacagct

SEQ ID NO: 486629 - DNA, 16 bp, R. norvegicus
cagacaggtgaaagga

SEQ ID NO: 486630 - DNA, 16 bp, R. norvegicus
cagacagtggatgatg

SEQ ID NO: 486631 - DNA, 16 bp, R. norvegicus
cagacagtgggagagg

SEQ ID NO: 486632 - DNA, 16 bp, R. norvegicus
cagacagttgtgagtt

SEQ ID NO: 486633 - DNA, 16 bp, R. norvegicus
cagacagttgtgccaa

SEQ ID NO: 486634 - DNA, 16 bp, R. norvegicus
cagacataccagaaga

SEQ ID NO: 486635 - DNA, 16 bp, R. norvegicus
cagacatgcagaattt

SEQ ID NO: 486636 - DNA, 16 bp, R. norvegicus
cagacatgcccagagg

SEQ ID NO: 486637 - DNA, 16 bp, R. norvegicus
cagacatggggacatc

SEQ ID NO: 486638 - DNA, 16 bp, R. norvegicus
cagacatggtgctgag

SEQ ID NO: 486639 - DNA, 16 bp, R. norvegicus
cagacatggtggctca

SEQ ID NO: 486640 - DNA, 16 bp, R. norvegicus
cagacattgacacaga

SEQ ID NO: 486641 - DNA, 16 bp, R. norvegicus
cagacattgctggagg

SEQ ID NO: 486642 - DNA, 16 bp, R. norvegicus
cagacatttcaccaga

SEQ ID NO: 486643 - DNA, 16 bp, R. norvegicus
cagaccaaagaaatga

SEQ ID NO: 486644 - DNA, 16 bp, R. norvegicus
cagaccaatcagaatt

SEQ ID NO: 486645 - DNA, 16 bp, R. norvegicus
cagaccaatctgatgg

SEQ ID NO: 486646 - DNA, 16 bp, R. norvegicus
cagaccacagacatca

SEQ ID NO: 486647 - DNA, 16 bp, R. norvegicus
cagaccacagactcag

SEQ ID NO: 486648 - DNA, 16 bp, R. norvegicus
cagaccaccaatggct

SEQ ID NO: 486649 - DNA, 16 bp, R. norvegicus
cagaccagccaggact

SEQ ID NO: 486650 - DNA, 16 bp, R. norvegicus
cagaccagcctgggct

SEQ ID NO: 486651 - DNA, 16 bp, R. norvegicus
cagaccaggaagcagg

SEQ ID NO: 486652 - DNA, 16 bp, R. norvegicus
cagaccaggctgacct

SEQ ID NO: 486653 - DNA, 16 bp, R. norvegicus
cagaccaggctggcct

SEQ ID NO: 486654 - DNA, 16 bp, R. norvegicus
cagaccagggacatct

SEQ ID NO: 486655 - DNA, 16 bp, R. norvegicus
cagaccatcctgagac

SEQ ID NO: 486656 - DNA, 16 bp, R. norvegicus
cagacccaaaacctgc

SEQ ID NO: 486657 - DNA, 16 bp, R. norvegicus
cagacccacacataca

SEQ ID NO: 486658 - DNA, 16 bp, R. norvegicus
cagacccagaaagaca

SEQ ID NO: 486659 - DNA, 16 bp, R. norvegicus
cagacccagacatggc

SEQ ID NO: 486660 - DNA, 16 bp, R. norvegicus
cagacccagagaagct

SEQ ID NO: 486661 - DNA, 16 bp, R. norvegicus
cagacccagatccagg

SEQ ID NO: 486662 - DNA, 16 bp, R. norvegicus
cagacccaggaagaca

SEQ ID NO: 486663 - DNA, 16 bp, R. norvegicus
cagaccccaaacccag

SEQ ID NO: 486664 - DNA, 16 bp, R. norvegicus
cagaccccacagtcct

SEQ ID NO: 486665 - DNA, 16 bp, R. norvegicus
cagaccctccagagct

SEQ ID NO: 486666 - DNA, 16 bp, R. norvegicus
cagaccctcccctcag

SEQ ID NO: 486667 - DNA, 16 bp, R. norvegicus
cagaccctggacagca

SEQ ID NO: 486668 - DNA, 16 bp, R. norvegicus
cagaccctgtgggaga

SEQ ID NO: 486669 - DNA, 16 bp, R. norvegicus
cagacctcacccaaat

SEQ ID NO: 486670 - DNA, 16 bp, R. norvegicus
cagacctctgtgagct

SEQ ID NO: 486671 - DNA, 16 bp, R. norvegicus
cagacctgacctccag

SEQ ID NO: 486672 - DNA, 16 bp, R. norvegicus
cagacctggtgctgga

SEQ ID NO: 486673 - DNA, 16 bp, R. norvegicus
cagacctgtcagaatt

SEQ ID NO: 486674 - DNA, 16 bp, R. norvegicus
cagaccttcatggaag

SEQ ID NO: 486675 - DNA, 16 bp, R. norvegicus
cagaccttccagagct

SEQ ID NO: 486676 - DNA, 16 bp, R. norvegicus
cagacggcaagcttaa

SEQ ID NO: 486677 - DNA, 16 bp, R. norvegicus
cagacgggaatctccc

SEQ ID NO: 486678 - DNA, 16 bp, R. norvegicus
cagactaatttccaga

SEQ ID NO: 486679 - DNA, 16 bp, R. norvegicus
cagactatggggactt

SEQ ID NO: 486680 - DNA, 16 bp, R. norvegicus
cagactcagaaagaaa

SEQ ID NO: 486681 - DNA, 16 bp, R. norvegicus
cagactcagactcaga

SEQ ID NO: 486682 - DNA, 16 bp, R. norvegicus
cagactcaggaagaca

SEQ ID NO: 486683 - DNA, 16 bp, R. norvegicus
cagactcatgaagaaa

SEQ ID NO: 486684 - DNA, 16 bp, R. norvegicus
cagactccaaaggaca

SEQ ID NO: 486685 - DNA, 16 bp, R. norvegicus
cagactccccagagga

SEQ ID NO: 486686 - DNA, 16 bp, R. norvegicus
cagactctccacagat

SEQ ID NO: 486687 - DNA, 16 bp, R. norvegicus
cagactctttggacaa

SEQ ID NO: 486688 - DNA, 16 bp, R. norvegicus
cagactgacttccaga

SEQ ID NO: 486689 - DNA, 16 bp, R. norvegicus
cagactgagcacagga

SEQ ID NO: 486690 - DNA, 16 bp, R. norvegicus
cagactgatttccaaa

SEQ ID NO: 486691 - DNA, 19 bp, R. norvegicus
cagactgatttccagaata

SEQ ID NO: 486692 - DNA, 16 bp, R. norvegicus
cagactgattttcaga

SEQ ID NO: 486693 - DNA, 16 bp, R. norvegicus
cagactgctttccaga

SEQ ID NO: 486694 - DNA, 16 bp, R. norvegicus
cagactggaaaaaaaa

SEQ ID NO: 486695 - DNA, 16 bp, R. norvegicus
cagactggcttggaac

SEQ ID NO: 486696 - DNA, 16 bp, R. norvegicus
cagactgtgctcttaa

SEQ ID NO: 486697 - DNA, 16 bp, R. norvegicus
cagacttcctccaaca

SEQ ID NO: 486698 - DNA, 16 bp, R. norvegicus
cagacttctctccaga

SEQ ID NO: 486699 - DNA, 16 bp, R. norvegicus
cagacttctgtcagca

SEQ ID NO: 486700 - DNA, 16 bp, R. norvegicus
cagacttttccccaga

SEQ ID NO: 486701 - DNA, 16 bp, R. norvegicus
cagagaaaaccctgtc

SEQ ID NO: 486702 - DNA, 16 bp, R. norvegicus
cagagaaaagcaaatc

SEQ ID NO: 486703 - DNA, 16 bp, R. norvegicus
cagagaaacacaggaa

SEQ ID NO: 486704 - DNA, 16 bp, R. norvegicus
cagagaaacactgttt

SEQ ID NO: 486705 - DNA, 16 bp, R. norvegicus
cagagaaaccagaaga

SEQ ID NO: 486706 - DNA, 16 bp, R. norvegicus
cagagaaaccctgtct

SEQ ID NO: 486707 - DNA, 16 bp, R. norvegicus
cagagaaactatgtct

SEQ ID NO: 486708 - DNA, 17 bp, R. norvegicus
cagagaaagaactggaa

SEQ ID NO: 486709 - DNA, 16 bp, R. norvegicus
cagagaaagagacaca

SEQ ID NO: 486710 - DNA, 16 bp, R. norvegicus
cagagaaagatctgga

SEQ ID NO: 486711 - DNA, 16 bp, R. norvegicus
cagagaaagcagaaca

SEQ ID NO: 486712 - DNA, 16 bp, R. norvegicus
cagagaaagcagtttc

SEQ ID NO: 486713 - DNA, 16 bp, R. norvegicus
cagagaaagcttatga

SEQ ID NO: 486714 - DNA, 16 bp, R. norvegicus
cagagaaaggacagga

SEQ ID NO: 486715 - DNA, 16 bp, R. norvegicus
cagagaaaggagcctc

SEQ ID NO: 486716 - DNA, 16 bp, R. norvegicus
cagagaaaggagtgaa

SEQ ID NO: 486717 - DNA, 16 bp, R. norvegicus
cagagaaagggaagcc

SEQ ID NO: 486718 - DNA, 16 bp, R. norvegicus
cagagaaagggctgga

SEQ ID NO: 486719 - DNA, 16 bp, R. norvegicus
cagagaaagtactgaa

SEQ ID NO: 486720 - DNA, 16 bp, R. norvegicus
cagagaaagtgtctgt

SEQ ID NO: 486721 - DNA, 16 bp, R. norvegicus
cagagaaatacaaatc

SEQ ID NO: 486722 - DNA, 16 bp, R. norvegicus
cagagaaatactgtct

SEQ ID NO: 486723 - DNA, 16 bp, R. norvegicus
cagagaaatcctgtct

SEQ ID NO: 486724 - DNA, 16 bp, R. norvegicus
cagagaaatgaaaatc

SEQ ID NO: 486725 - DNA, 16 bp, R. norvegicus
cagagaaatgcaaaac

SEQ ID NO: 486726 - DNA, 16 bp, R. norvegicus
cagagaaatgcaggaa

SEQ ID NO: 486727 - DNA, 16 bp, R. norvegicus
cagagaaatgctggag

SEQ ID NO: 486728 - DNA, 16 bp, R. norvegicus
cagagaacaaaatcta

SEQ ID NO: 486729 - DNA, 16 bp, R. norvegicus
cagagaacaaccttgg

SEQ ID NO: 486730 - DNA, 16 bp, R. norvegicus
cagagaacacacacag

SEQ ID NO: 486731 - DNA, 16 bp, R. norvegicus
cagagaacagaacaga

SEQ ID NO: 486732 - DNA, 16 bp, R. norvegicus
cagagaactgtttatt

SEQ ID NO: 486733 - DNA, 16 bp, R. norvegicus
cagagaagaactggaa

SEQ ID NO: 486734 - DNA, 16 bp, R. norvegicus
cagagaagacgcacct

SEQ ID NO: 486735 - DNA, 16 bp, R. norvegicus
cagagaagaggaaacc

SEQ ID NO: 486736 - DNA, 16 bp, R. norvegicus
cagagaagcagaggcc

SEQ ID NO: 486737 - DNA, 16 bp, R. norvegicus
cagagaagcagcagca

SEQ ID NO: 486738 - DNA, 16 bp, R. norvegicus
cagagaagctgcttct

SEQ ID NO: 486739 - DNA, 16 bp, R. norvegicus
cagagaagcttctctg

SEQ ID NO: 486740 - DNA, 16 bp, R. norvegicus
cagagaaggaactgga

SEQ ID NO: 486741 - DNA, 16 bp, R. norvegicus
cagagaaggacaaccc

SEQ ID NO: 486742 - DNA, 16 bp, R. norvegicus
cagagaaggaggggca

SEQ ID NO: 486743 - DNA, 16 bp, R. norvegicus
cagagaaggctcagtg

SEQ ID NO: 486744 - DNA, 16 bp, R. norvegicus
cagagaaggggaagct

SEQ ID NO: 486745 - DNA, 16 bp, R. norvegicus
cagagaagtacctaaa

SEQ ID NO: 486746 - DNA, 16 bp, R. norvegicus
cagagaagtcctgtct

SEQ ID NO: 486747 - DNA, 16 bp, R. norvegicus
cagagaagtgcaggcc

SEQ ID NO: 486748 - DNA, 16 bp, R. norvegicus
cagagaagtttctttg

SEQ ID NO: 486749 - DNA, 16 bp, R. norvegicus
cagagaatccaggttc

SEQ ID NO: 486750 - DNA, 16 bp, R. norvegicus
cagagaatgagagact

SEQ ID NO: 486751 - DNA, 16 bp, R. norvegicus
cagagaatgagagaga

SEQ ID NO: 486752 - DNA, 16 bp, R. norvegicus
cagagacaaagacaca

SEQ ID NO: 486753 - DNA, 16 bp, R. norvegicus
cagagacaaagagtag

SEQ ID NO: 486754 - DNA, 16 bp, R. norvegicus
cagagacaaagtgaaa

SEQ ID NO: 486755 - DNA, 16 bp, R. norvegicus
cagagacaacctgaag

SEQ ID NO: 486756 - DNA, 16 bp, R. norvegicus
cagagacaactgaaga

SEQ ID NO: 486757 - DNA, 16 bp, R. norvegicus
cagagacaagaagatc

SEQ ID NO: 486758 - DNA, 16 bp, R. norvegicus
cagagacacaaataca

SEQ ID NO: 486759 - DNA, 16 bp, R. norvegicus
cagagacacacaagca

SEQ ID NO: 486760 - DNA, 16 bp, R. norvegicus
cagagacacacaggga

SEQ ID NO: 486761 - DNA, 16 bp, R. norvegicus
cagagacacacaggta

SEQ ID NO: 486762 - DNA, 16 bp, R. norvegicus
cagagacacacctgct

SEQ ID NO: 486763 - DNA, 16 bp, R. norvegicus
cagagacacagaaaga

SEQ ID NO: 486764 - DNA, 16 bp, R. norvegicus
cagagacacagaagca

SEQ ID NO: 486765 - DNA, 16 bp, R. norvegicus
cagagacacagacaga

SEQ ID NO: 486766 - DNA, 16 bp, R. norvegicus
cagagacactgtgaaa

SEQ ID NO: 486767 - DNA, 16 bp, R. norvegicus
cagagacagaaacaga

SEQ ID NO: 486768 - DNA, 16 bp, R. norvegicus
cagagacagaaactga

SEQ ID NO: 486769 - DNA, 16 bp, R. norvegicus
cagagacagaaataga

SEQ ID NO: 486770 - DNA, 16 bp, R. norvegicus
cagagacagaagagag

SEQ ID NO: 486771 - DNA, 16 bp, R. norvegicus
cagagacagaagcaac

SEQ ID NO: 486772 - DNA, 16 bp, R. norvegicus
cagagacagaagcaga

SEQ ID NO: 486773 - DNA, 16 bp, R. norvegicus
cagagacagaaggatc

SEQ ID NO: 486774 - DNA, 16 bp, R. norvegicus
cagagacagaatgaaa

SEQ ID NO: 486775 - DNA, 16 bp, R. norvegicus
cagagacagacacaga

SEQ ID NO: 486776 - DNA, 16 bp, R. norvegicus
cagagacagagacgga

SEQ ID NO: 486777 - DNA, 16 bp, R. norvegicus
cagagacagagatagg

SEQ ID NO: 486778 - DNA, 16 bp, R. norvegicus
cagagacagatggaga

SEQ ID NO: 486779 - DNA, 16 bp, R. norvegicus
cagagacagcaacaca

SEQ ID NO: 486780 - DNA, 16 bp, R. norvegicus
cagagacagcaagacc

SEQ ID NO: 486781 - DNA, 16 bp, R. norvegicus
cagagacagcaagggc

SEQ ID NO: 486782 - DNA, 16 bp, R. norvegicus
cagagacagcctgatg

SEQ ID NO: 486783 - DNA, 16 bp, R. norvegicus
cagagacaggcagaca

SEQ ID NO: 486784 - DNA, 16 bp, R. norvegicus
cagagacaggcggatc

SEQ ID NO: 486785 - DNA, 16 bp, R. norvegicus
cagagacaggggatcc

SEQ ID NO: 486786 - DNA, 16 bp, R. norvegicus
cagagacagggtttct

SEQ ID NO: 486787 - DNA, 16 bp, R. norvegicus
cagagacaggtggagc

SEQ ID NO: 486788 - DNA, 16 bp, R. norvegicus
cagagacaggtggatg

SEQ ID NO: 486789 - DNA, 16 bp, R. norvegicus
cagagacagtgtactc

SEQ ID NO: 486790 - DNA, 16 bp, R. norvegicus
cagagacatggtgaaa

SEQ ID NO: 486791 - DNA, 16 bp, R. norvegicus
cagagaccacaaagga

SEQ ID NO: 486792 - DNA, 16 bp, R. norvegicus
cagagaccacagagga

SEQ ID NO: 486793 - DNA, 16 bp, R. norvegicus
cagagaccacagccag

SEQ ID NO: 486794 - DNA, 16 bp, R. norvegicus
cagagaccacaggaca

SEQ ID NO: 486795 - DNA, 16 bp, R. norvegicus
cagagaccagcagagg

SEQ ID NO: 486796 - DNA, 16 bp, R. norvegicus
cagagaccatgctgag

SEQ ID NO: 486797 - DNA, 16 bp, R. norvegicus
cagagaccatggagga

SEQ ID NO: 486798 - DNA, 16 bp, R. norvegicus
cagagacccacagcaa

SEQ ID NO: 486799 - DNA, 16 bp, R. norvegicus
cagagacccacagcca

SEQ ID NO: 486800 - DNA, 16 bp, R. norvegicus
cagagacccctgagac

SEQ ID NO: 486801 - DNA, 16 bp, R. norvegicus
cagagaccctgagttc

SEQ ID NO: 486802 - DNA, 16 bp, R. norvegicus
cagagacctacctgcc

SEQ ID NO: 486803 - DNA, 16 bp, R. norvegicus
cagagacctgcagcca

SEQ ID NO: 486804 - DNA, 16 bp, R. norvegicus
cagagactatgaaacc

SEQ ID NO: 486805 - DNA, 16 bp, R. norvegicus
cagagactatgaaatc

SEQ ID NO: 486806 - DNA, 16 bp, R. norvegicus
cagagactgaaccagc

SEQ ID NO: 486807 - DNA, 16 bp, R. norvegicus
cagagactgaagaagc

SEQ ID NO: 486808 - DNA, 16 bp, R. norvegicus
cagagactgaagcagg

SEQ ID NO: 486809 - DNA, 16 bp, R. norvegicus
cagagactgagaagga

SEQ ID NO: 486810 - DNA, 16 bp, R. norvegicus
cagagactgatggaaa

SEQ ID NO: 486811 - DNA, 16 bp, R. norvegicus
cagagagaaaactgga

SEQ ID NO: 486812 - DNA, 16 bp, R. norvegicus
cagagagaaaccctat

SEQ ID NO: 486813 - DNA, 16 bp, R. norvegicus
cagagagaaagaagtg

SEQ ID NO: 486814 - DNA, 16 bp, R. norvegicus
cagagagaaaggaatc

SEQ ID NO: 486815 - DNA, 16 bp, R. norvegicus
cagagagaacatggag

SEQ ID NO: 486816 - DNA, 16 bp, R. norvegicus
cagagagaagaaaatg

SEQ ID NO: 486817 - DNA, 16 bp, R. norvegicus
cagagagaagatctat

SEQ ID NO: 486818 - DNA, 16 bp, R. norvegicus
cagagagaagcaggga

SEQ ID NO: 486819 - DNA, 16 bp, R. norvegicus
cagagagaagccagtg

SEQ ID NO: 486820 - DNA, 16 bp, R. norvegicus
cagagagaagcctctg

SEQ ID NO: 486821 - DNA, 16 bp, R. norvegicus
cagagagacaaagagg

SEQ ID NO: 486822 - DNA, 16 bp, R. norvegicus
cagagagacagagaag

SEQ ID NO: 486823 - DNA, 16 bp, R. norvegicus
cagagagaccagaaga

SEQ ID NO: 486824 - DNA, 16 bp, R. norvegicus
cagagagaccctgact

SEQ ID NO: 486825 - DNA, 16 bp, R. norvegicus
cagagagaccctgtct

SEQ ID NO: 486826 - DNA, 16 bp, R. norvegicus
cagagagactgaaaaa

SEQ ID NO: 486827 - DNA, 16 bp, R. norvegicus
cagagagagacaagga

SEQ ID NO: 486828 - DNA, 16 bp, R. norvegicus
cagagagagacacaga

SEQ ID NO: 486829 - DNA, 16 bp, R. norvegicus
cagagagagacaggga

SEQ ID NO: 486830 - DNA, 16 bp, R. norvegicus
cagagagaggaagaca

SEQ ID NO: 486831 - DNA, 16 bp, R. norvegicus
cagagagaggacagag

SEQ ID NO: 486832 - DNA, 16 bp, R. norvegicus
cagagagatggctcag

SEQ ID NO: 486833 - DNA, 16 bp, R. norvegicus
cagagagcaatgaatg

SEQ ID NO: 486834 - DNA, 16 bp, R. norvegicus
cagagagcacagacac

SEQ ID NO: 486835 - DNA, 16 bp, R. norvegicus
cagagagcactccagg

SEQ ID NO: 486836 - DNA, 16 bp, R. norvegicus
cagagagcagaggaag

SEQ ID NO: 486837 - DNA, 16 bp, R. norvegicus
cagagagcagcttccc

SEQ ID NO: 486838 - DNA, 16 bp, R. norvegicus
cagagagccacagcca

SEQ ID NO: 486839 - DNA, 16 bp, R. norvegicus
cagagagccacctgcc

SEQ ID NO: 486840 - DNA, 16 bp, R. norvegicus
cagagagccccaggga

SEQ ID NO: 486841 - DNA, 23 bp, R. norvegicus
cagagagcccttgggcagcaccc

SEQ ID NO: 486842 - DNA, 16 bp, R. norvegicus
cagagagctgctgcag

SEQ ID NO: 486843 - DNA, 16 bp, R. norvegicus
cagagagctgctgcca

SEQ ID NO: 486844 - DNA, 16 bp, R. norvegicus
cagagagctgctgcgg

SEQ ID NO: 486845 - DNA, 16 bp, R. norvegicus
cagagagctgtgggcc

SEQ ID NO: 486846 - DNA, 16 bp, R. norvegicus
cagagaggaagcacag

SEQ ID NO: 486847 - DNA, 16 bp, R. norvegicus
cagagaggaaggagct

SEQ ID NO: 486848 - DNA, 16 bp, R. norvegicus
cagagaggaatagcaa

SEQ ID NO: 486849 - DNA, 16 bp, R. norvegicus
cagagaggagggagcc

SEQ ID NO: 486850 - DNA, 16 bp, R. norvegicus
cagagaggatgctggg

SEQ ID NO: 486851 - DNA, 16 bp, R. norvegicus
cagagaggcagaagca

SEQ ID NO: 486852 - DNA, 16 bp, R. norvegicus
cagagaggcagagagt

SEQ ID NO: 486853 - DNA, 16 bp, R. norvegicus
cagagaggcaggcacg

SEQ ID NO: 486854 - DNA, 16 bp, R. norvegicus
cagagaggctggggag

SEQ ID NO: 486855 - DNA, 16 bp, R. norvegicus
cagagagggcactgga

SEQ ID NO: 486856 - DNA, 16 bp, R. norvegicus
cagagaggtcagagga

SEQ ID NO: 486857 - DNA, 16 bp, R. norvegicus
cagagaggtcatggag

SEQ ID NO: 486858 - DNA, 16 bp, R. norvegicus
cagagagtctgcagag

SEQ ID NO: 486859 - DNA, 16 bp, R. norvegicus
cagagagtgaacagga

SEQ ID NO: 486860 - DNA, 16 bp, R. norvegicus
cagagagtgagacaga

SEQ ID NO: 486861 - DNA, 16 bp, R. norvegicus
cagagagtgagagaga

SEQ ID NO: 486862 - DNA, 16 bp, R. norvegicus
cagagagtgaggagag

SEQ ID NO: 486863 - DNA, 16 bp, R. norvegicus
cagagagtggaccagg

SEQ ID NO: 486864 - DNA, 16 bp, R. norvegicus
cagagagtgtatcaaa

SEQ ID NO: 486865 - DNA, 16 bp, R. norvegicus
cagagataaagaattc

SEQ ID NO: 486866 - DNA, 16 bp, R. norvegicus
cagagatactgcccag

SEQ ID NO: 486867 - DNA, 16 bp, R. norvegicus
cagagatcactgtgga

SEQ ID NO: 486868 - DNA, 16 bp, R. norvegicus
cagagatcagaagagg

SEQ ID NO: 486869 - DNA, 16 bp, R. norvegicus
cagagatcctgcagct

SEQ ID NO: 486870 - DNA, 16 bp, R. norvegicus
cagagatctacctgac

SEQ ID NO: 486871 - DNA, 16 bp, R. norvegicus
cagagatctgcctggc

SEQ ID NO: 486872 - DNA, 16 bp, R. norvegicus
cagagatcttcctgtc

SEQ ID NO: 486873 - DNA, 16 bp, R. norvegicus
cagagatggaaatgga

SEQ ID NO: 486874 - DNA, 16 bp, R. norvegicus
cagagatggagcagag

SEQ ID NO: 486875 - DNA, 16 bp, R. norvegicus
cagagattccacctca

SEQ ID NO: 486876 - DNA, 16 bp, R. norvegicus
cagagattgaaggaaa

SEQ ID NO: 486877 - DNA, 16 bp, R. norvegicus
cagagattttggcatt

SEQ ID NO: 486878 - DNA, 16 bp, R. norvegicus
cagagatttttatttt

SEQ ID NO: 486879 - DNA, 16 bp, R. norvegicus
cagagatttttttctt

SEQ ID NO: 486880 - DNA, 16 bp, R. norvegicus
cagagcaaactgggaa

SEQ ID NO: 486881 - DNA, 16 bp, R. norvegicus
cagagcaagacagaga

SEQ ID NO: 486882 - DNA, 16 bp, R. norvegicus
cagagcaagctggcca

SEQ ID NO: 486883 - DNA, 16 bp, R. norvegicus
cagagcaagtttgagg

SEQ ID NO: 486884 - DNA, 16 bp, R. norvegicus
cagagcaatagtagta

SEQ ID NO: 486885 - DNA, 16 bp, R. norvegicus
cagagcacagccacaa

SEQ ID NO: 486886 - DNA, 17 bp, R. norvegicus
cagagcactgaaaggac

SEQ ID NO: 486887 - DNA, 16 bp, R. norvegicus
cagagcagaacacaca

SEQ ID NO: 486888 - DNA, 16 bp, R. norvegicus
cagagcagagagcaga

SEQ ID NO: 486889 - DNA, 16 bp, R. norvegicus
cagagcagagaggcag

SEQ ID NO: 486890 - DNA, 16 bp, R. norvegicus
cagagcagagcagagt

SEQ ID NO: 486891 - DNA, 16 bp, R. norvegicus
cagagcagcacagaca

SEQ ID NO: 486892 - DNA, 16 bp, R. norvegicus
cagagcagcagaggca

SEQ ID NO: 486893 - DNA, 16 bp, R. norvegicus
cagagcagcagcagag

SEQ ID NO: 486894 - DNA, 16 bp, R. norvegicus
cagagcaggctcagtg

SEQ ID NO: 486895 - DNA, 16 bp, R. norvegicus
cagagcagtcagacag

SEQ ID NO: 486896 - DNA, 16 bp, R. norvegicus
cagagcagtgcacaca

SEQ ID NO: 486897 - DNA, 16 bp, R. norvegicus
cagagcatctcagaag

SEQ ID NO: 486898 - DNA, 16 bp, R. norvegicus
cagagcatgctgggaa

SEQ ID NO: 486899 - DNA, 16 bp, R. norvegicus
cagagccacacagaga

SEQ ID NO: 486900 - DNA, 16 bp, R. norvegicus
cagagccacagagcca

SEQ ID NO: 486901 - DNA, 16 bp, R. norvegicus
cagagccagaggcaga

SEQ ID NO: 486902 - DNA, 16 bp, R. norvegicus
cagagccagcagggtg

SEQ ID NO: 486903 - DNA, 16 bp, R. norvegicus
cagagccagcctggtc

SEQ ID NO: 486904 - DNA, 16 bp, R. norvegicus
cagagccagctctcca

SEQ ID NO: 486905 - DNA, 16 bp, R. norvegicus
cagagccaggacccga

SEQ ID NO: 486906 - DNA, 16 bp, R. norvegicus
cagagccaggctgact

SEQ ID NO: 486907 - DNA, 16 bp, R. norvegicus
cagagccatctcccca

SEQ ID NO: 486908 - DNA, 16 bp, R. norvegicus
cagagccatctctcca

SEQ ID NO: 486909 - DNA, 16 bp, R. norvegicus
cagagccatctcttca

SEQ ID NO: 486910 - DNA, 16 bp, R. norvegicus
cagagccatgggtctg

SEQ ID NO: 486911 - DNA, 16 bp, R. norvegicus
cagagcccaactctcc

SEQ ID NO: 486912 - DNA, 16 bp, R. norvegicus
cagagcccaggaccac

SEQ ID NO: 486913 - DNA, 16 bp, R. norvegicus
cagagcccatggagga

SEQ ID NO: 486914 - DNA, 16 bp, R. norvegicus
cagagcccccagggac

SEQ ID NO: 486915 - DNA, 16 bp, R. norvegicus
cagagccctccacaca

SEQ ID NO: 486916 - DNA, 16 bp, R. norvegicus
cagagcctagagtgct

SEQ ID NO: 486917 - DNA, 16 bp, R. norvegicus
cagagcctcccaggag

SEQ ID NO: 486918 - DNA, 16 bp, R. norvegicus
cagagcctgaaggaat

SEQ ID NO: 486919 - DNA, 16 bp, R. norvegicus
cagagcctgaccaata

SEQ ID NO: 486920 - DNA, 16 bp, R. norvegicus
cagagcctgcctctct

SEQ ID NO: 486921 - DNA, 16 bp, R. norvegicus
cagagcctgtcccaca

SEQ ID NO: 486922 - DNA, 16 bp, R. norvegicus
cagagctaaacagata

SEQ ID NO: 486923 - DNA, 16 bp, R. norvegicus
cagagctaaagaaaga

SEQ ID NO: 486924 - DNA, 16 bp, R. norvegicus
cagagctacacagtga

SEQ ID NO: 486925 - DNA, 16 bp, R. norvegicus
cagagctacatagtga

SEQ ID NO: 486926 - DNA, 16 bp, R. norvegicus
cagagctactcagaga

SEQ ID NO: 486927 - DNA, 16 bp, R. norvegicus
cagagctatacagtga

SEQ ID NO: 486928 - DNA, 16 bp, R. norvegicus
cagagctatgaatttt

SEQ ID NO: 486929 - DNA, 16 bp, R. norvegicus
cagagctcagacagaa

SEQ ID NO: 486930 - DNA, 16 bp, R. norvegicus
cagagctcagagctct

SEQ ID NO: 486931 - DNA, 16 bp, R. norvegicus
cagagctcagggaacc

SEQ ID NO: 486932 - DNA, 16 bp, R. norvegicus
cagagctcctggaact

SEQ ID NO: 486933 - DNA, 16 bp, R. norvegicus
cagagctgagaattct

SEQ ID NO: 486934 - DNA, 16 bp, R. norvegicus
cagagctgagagttct

SEQ ID NO: 486935 - DNA, 16 bp, R. norvegicus
cagagctgaggactga

SEQ ID NO: 486936 - DNA, 16 bp, R. norvegicus
cagagctgcagaggaa

SEQ ID NO: 486937 - DNA, 16 bp, R. norvegicus
cagagctgccaggagg

SEQ ID NO: 486938 - DNA, 16 bp, R. norvegicus
cagagctggagagaag

SEQ ID NO: 486939 - DNA, 16 bp, R. norvegicus
cagagctggagatgtg

SEQ ID NO: 486940 - DNA, 16 bp, R. norvegicus
cagagctggcagcagc

SEQ ID NO: 486941 - DNA, 16 bp, R. norvegicus
cagagctggggagaca

SEQ ID NO: 486942 - DNA, 16 bp, R. norvegicus
cagagcttcagggact

SEQ ID NO: 486943 - DNA, 16 bp, R. norvegicus
cagagcttctcagaag

SEQ ID NO: 486944 - DNA, 16 bp, R. norvegicus
cagagcttctcaggag

SEQ ID NO: 486945 - DNA, 16 bp, R. norvegicus
cagagcttctgtaagg

SEQ ID NO: 486946 - DNA, 16 bp, R. norvegicus
cagagcttgggaggca

SEQ ID NO: 486947 - DNA, 16 bp, R. norvegicus
cagagctttcagggac

SEQ ID NO: 486948 - DNA, 16 bp, R. norvegicus
cagaggaaaatttcct

SEQ ID NO: 486949 - DNA, 16 bp, R. norvegicus
cagaggaaagtggatc

SEQ ID NO: 486950 - DNA, 16 bp, R. norvegicus
cagaggaagaaactga

SEQ ID NO: 486951 - DNA, 16 bp, R. norvegicus
cagaggaagacacctg

SEQ ID NO: 486952 - DNA, 16 bp, R. norvegicus
cagaggaagacatcag

SEQ ID NO: 486953 - DNA, 16 bp, R. norvegicus
cagaggaagaccagca

SEQ ID NO: 486954 - DNA, 16 bp, R. norvegicus
cagaggaagatgctgg

SEQ ID NO: 486955 - DNA, 16 bp, R. norvegicus
cagaggaagccctgag

SEQ ID NO: 486956 - DNA, 16 bp, R. norvegicus
cagaggaagcctctct

SEQ ID NO: 486957 - DNA, 16 bp, R. norvegicus
cagaggaaggcattgg

SEQ ID NO: 486958 - DNA, 16 bp, R. norvegicus
cagaggaaggggtggg

SEQ ID NO: 486959 - DNA, 16 bp, R. norvegicus
cagaggaatggacaca

SEQ ID NO: 486960 - DNA, 16 bp, R. norvegicus
cagaggacaacatgct

SEQ ID NO: 486961 - DNA, 16 bp, R. norvegicus
cagaggacaaccttgg

SEQ ID NO: 486962 - DNA, 16 bp, R. norvegicus
cagaggacaactcttg

SEQ ID NO: 486963 - DNA, 16 bp, R. norvegicus
cagaggacaacttcaa

SEQ ID NO: 486964 - DNA, 16 bp, R. norvegicus
cagaggacaatcttgg

SEQ ID NO: 486965 - DNA, 16 bp, R. norvegicus
cagaggacacagagac

SEQ ID NO: 486966 - DNA, 16 bp, R. norvegicus
cagaggacagaggaca

SEQ ID NO: 486967 - DNA, 16 bp, R. norvegicus
cagaggacagagggca

SEQ ID NO: 486968 - DNA, 16 bp, R. norvegicus
cagaggacagcattgt

SEQ ID NO: 486969 - DNA, 16 bp, R. norvegicus
cagaggacagttatgg

SEQ ID NO: 486970 - DNA, 16 bp, R. norvegicus
cagaggacatggaggg

SEQ ID NO: 486971 - DNA, 16 bp, R. norvegicus
cagaggaccagggttc

SEQ ID NO: 486972 - DNA, 16 bp, R. norvegicus
cagaggaccaggttca

SEQ ID NO: 486973 - DNA, 16 bp, R. norvegicus
cagaggacccagattc

SEQ ID NO: 486974 - DNA, 16 bp, R. norvegicus
cagaggacccagattt

SEQ ID NO: 486975 - DNA, 16 bp, R. norvegicus
cagaggacccaggctc

SEQ ID NO: 486976 - DNA, 16 bp, R. norvegicus
cagaggacccaggctt

SEQ ID NO: 486977 - DNA, 16 bp, R. norvegicus
cagaggacccagtttt

SEQ ID NO: 486978 - DNA, 16 bp, R. norvegicus
cagaggacctgggctc

SEQ ID NO: 486979 - DNA, 16 bp, R. norvegicus
cagaggactcaggctc

SEQ ID NO: 486980 - DNA, 16 bp, R. norvegicus
cagaggagacagagag

SEQ ID NO: 486981 - DNA, 16 bp, R. norvegicus
cagaggagagaggcca

SEQ ID NO: 486982 - DNA, 16 bp, R. norvegicus
cagaggagcagagagg

SEQ ID NO: 486983 - DNA, 16 bp, R. norvegicus
cagaggaggagacaga

SEQ ID NO: 486984 - DNA, 16 bp, R. norvegicus
cagaggaggagcatcc

SEQ ID NO: 486985 - DNA, 16 bp, R. norvegicus
cagaggagggcactgg

SEQ ID NO: 486986 - DNA, 16 bp, R. norvegicus
cagaggagggcatcag

SEQ ID NO: 486987 - DNA, 16 bp, R. norvegicus
cagaggaggtcctgca

SEQ ID NO: 486988 - DNA, 16 bp, R. norvegicus
cagaggataacttgtg

SEQ ID NO: 486989 - DNA, 16 bp, R. norvegicus
cagaggataactttgt

SEQ ID NO: 486990 - DNA, 16 bp, R. norvegicus
cagaggataataaatg

SEQ ID NO: 486991 - DNA, 16 bp, R. norvegicus
cagaggatcactccaa

SEQ ID NO: 486992 - DNA, 16 bp, R. norvegicus
cagaggatcagaagtt

SEQ ID NO: 486993 - DNA, 16 bp, R. norvegicus
cagaggatccaaagcc

SEQ ID NO: 486994 - DNA, 16 bp, R. norvegicus
cagaggatctgggttt

SEQ ID NO: 486995 - DNA, 16 bp, R. norvegicus
cagaggatgactttgt

SEQ ID NO: 486996 - DNA, 16 bp, R. norvegicus
cagaggatgagaagga

SEQ ID NO: 486997 - DNA, 16 bp, R. norvegicus
cagaggatgccaagaa

SEQ ID NO: 486998 - DNA, 16 bp, R. norvegicus
cagaggatgctgggaa

SEQ ID NO: 486999 - DNA, 16 bp, R. norvegicus
cagaggatggaaagac

SEQ ID NO: 487000 - DNA, 16 bp, R. norvegicus
cagaggatggatacag

SEQ ID NO: 487001 - DNA, 16 bp, R. norvegicus
cagaggatggcctctg

SEQ ID NO: 487002 - DNA, 16 bp, R. norvegicus
cagaggatggcctttt

SEQ ID NO: 487003 - DNA, 16 bp, R. norvegicus
cagaggatgtggagaa

SEQ ID NO: 487004 - DNA, 16 bp, R. norvegicus
cagaggattctgggaa

SEQ ID NO: 487005 - DNA, 16 bp, R. norvegicus
cagaggcaaagggaag

SEQ ID NO: 487006 - DNA, 16 bp, R. norvegicus
cagaggcaagaggatg

SEQ ID NO: 487007 - DNA, 16 bp, R. norvegicus
cagaggcaagcagacc

SEQ ID NO: 487008 - DNA, 16 bp, R. norvegicus
cagaggcaagtgggtc

SEQ ID NO: 487009 - DNA, 16 bp, R. norvegicus
cagaggcaatggagga

SEQ ID NO: 487010 - DNA, 16 bp, R. norvegicus
cagaggcagaaacaga

SEQ ID NO: 487011 - DNA, 16 bp, R. norvegicus
cagaggcagaagcaga

SEQ ID NO: 487012 - DNA, 16 bp, R. norvegicus
cagaggcagaagcagc

SEQ ID NO: 487013 - DNA, 16 bp, R. norvegicus
cagaggcagaagctca

SEQ ID NO: 487014 - DNA, 16 bp, R. norvegicus
cagaggcagaaggaac

SEQ ID NO: 487015 - DNA, 16 bp, R. norvegicus
cagaggcagacagaca

SEQ ID NO: 487016 - DNA, 16 bp, R. norvegicus
cagaggcagacaggca

SEQ ID NO: 487017 - DNA, 16 bp, R. norvegicus
cagaggcagagagagc

SEQ ID NO: 487018 - DNA, 16 bp, R. norvegicus
cagaggcagaggcaaa

SEQ ID NO: 487019 - DNA, 16 bp, R. norvegicus
cagaggcagaggcaga

SEQ ID NO: 487020 - DNA, 16 bp, R. norvegicus
cagaggcagaggccag

SEQ ID NO: 487021 - DNA, 16 bp, R. norvegicus
cagaggcagagggaaa

SEQ ID NO: 487022 - DNA, 16 bp, R. norvegicus
cagaggcagatgctgg

SEQ ID NO: 487023 - DNA, 16 bp, R. norvegicus
cagaggcagatggagc

SEQ ID NO: 487024 - DNA, 16 bp, R. norvegicus
cagaggcagatgtttg

SEQ ID NO: 487025 - DNA, 16 bp, R. norvegicus
cagaggcagcagcagc

SEQ ID NO: 487026 - DNA, 16 bp, R. norvegicus
cagaggcagcagcagg

SEQ ID NO: 487027 - DNA, 16 bp, R. norvegicus
cagaggcagcaggatc

SEQ ID NO: 487028 - DNA, 16 bp, R. norvegicus
cagaggcaggaagaag

SEQ ID NO: 487029 - DNA, 16 bp, R. norvegicus
cagaggcaggaagact

SEQ ID NO: 487030 - DNA, 16 bp, R. norvegicus
cagaggcaggaagatc

SEQ ID NO: 487031 - DNA, 16 bp, R. norvegicus
cagaggcaggagcatg

SEQ ID NO: 487032 - DNA, 16 bp, R. norvegicus
cagaggcaggaggatc

SEQ ID NO: 487033 - DNA, 16 bp, R. norvegicus
cagaggcaggcaggag

SEQ ID NO: 487034 - DNA, 16 bp, R. norvegicus
cagaggcagggggagc

SEQ ID NO: 487035 - DNA, 16 bp, R. norvegicus
cagaggcagggggatc

SEQ ID NO: 487036 - DNA, 16 bp, R. norvegicus
cagaggcaggtggtct

SEQ ID NO: 487037 - DNA, 16 bp, R. norvegicus
cagaggcagtggaaag

SEQ ID NO: 487038 - DNA, 16 bp, R. norvegicus
cagaggccaagagaga

SEQ ID NO: 487039 - DNA, 16 bp, R. norvegicus
cagaggccacagagac

SEQ ID NO: 487040 - DNA, 16 bp, R. norvegicus
cagaggccacagagag

SEQ ID NO: 487041 - DNA, 16 bp, R. norvegicus
cagaggccacagagga

SEQ ID NO: 487042 - DNA, 16 bp, R. norvegicus
cagaggccagaagagg

SEQ ID NO: 487043 - DNA, 16 bp, R. norvegicus
cagaggccagacaaga

SEQ ID NO: 487044 - DNA, 16 bp, R. norvegicus
cagaggccagagaaga

SEQ ID NO: 487045 - DNA, 16 bp, R. norvegicus
cagaggccagagaggg

SEQ ID NO: 487046 - DNA, 16 bp, R. norvegicus
cagaggccagcagagg

SEQ ID NO: 487047 - DNA, 16 bp, R. norvegicus
cagaggccagcctggt

SEQ ID NO: 487048 - DNA, 16 bp, R. norvegicus
cagaggccaggagagg

SEQ ID NO: 487049 - DNA, 16 bp, R. norvegicus
cagaggccatggagga

SEQ ID NO: 487050 - DNA, 16 bp, R. norvegicus
cagaggccatggagtg

SEQ ID NO: 487051 - DNA, 16 bp, R. norvegicus
cagaggccatggggag

SEQ ID NO: 487052 - DNA, 16 bp, R. norvegicus
cagaggccatggtaaa

SEQ ID NO: 487053 - DNA, 16 bp, R. norvegicus
cagaggcccctgagct

SEQ ID NO: 487054 - DNA, 16 bp, R. norvegicus
cagaggccctggaggg

SEQ ID NO: 487055 - DNA, 16 bp, R. norvegicus
cagaggccgtggagga

SEQ ID NO: 487056 - DNA, 16 bp, R. norvegicus
cagaggcctgcctgcc

SEQ ID NO: 487057 - DNA, 16 bp, R. norvegicus
cagaggcctgtctcct

SEQ ID NO: 487058 - DNA, 16 bp, R. norvegicus
cagaggctagaagagg

SEQ ID NO: 487059 - DNA, 16 bp, R. norvegicus
cagaggctcagtccag

SEQ ID NO: 487060 - DNA, 16 bp, R. norvegicus
cagaggctctgccaga

SEQ ID NO: 487061 - DNA, 16 bp, R. norvegicus
cagaggctgagaacat

SEQ ID NO: 487062 - DNA, 16 bp, R. norvegicus
cagaggctggaaagaa

SEQ ID NO: 487063 - DNA, 16 bp, R. norvegicus
cagaggctgggctgcc

SEQ ID NO: 487064 - DNA, 16 bp, R. norvegicus
cagaggctgtctctga

SEQ ID NO: 487065 - DNA, 16 bp, R. norvegicus
cagaggcttgatgttc

SEQ ID NO: 487066 - DNA, 16 bp, R. norvegicus
cagaggcttgtaattt

SEQ ID NO: 487067 - DNA, 16 bp, R. norvegicus
cagagggaagcaaaga

SEQ ID NO: 487068 - DNA, 16 bp, R. norvegicus
cagagggaaggcagga

SEQ ID NO: 487069 - DNA, 16 bp, R. norvegicus
cagagggacacagaga

SEQ ID NO: 487070 - DNA, 16 bp, R. norvegicus
cagagggacagaggga

SEQ ID NO: 487071 - DNA, 16 bp, R. norvegicus
cagagggacaggagaa

SEQ ID NO: 487072 - DNA, 16 bp, R. norvegicus
cagagggacccatggc

SEQ ID NO: 487073 - DNA, 16 bp, R. norvegicus
cagagggagacaaccc

SEQ ID NO: 487074 - DNA, 16 bp, R. norvegicus
cagagggaggagaagc

SEQ ID NO: 487075 - DNA, 16 bp, R. norvegicus
cagagggattaaagct

SEQ ID NO: 487076 - DNA, 16 bp, R. norvegicus
cagagggcacagagag

SEQ ID NO: 487077 - DNA, 16 bp, R. norvegicus
cagagggcacagatga

SEQ ID NO: 487078 - DNA, 16 bp, R. norvegicus
cagagggcagaactgg

SEQ ID NO: 487079 - DNA, 16 bp, R. norvegicus
cagagggcagctttca

SEQ ID NO: 487080 - DNA, 16 bp, R. norvegicus
cagagggccaggagaa

SEQ ID NO: 487081 - DNA, 16 bp, R. norvegicus
cagagggctgcctggt

SEQ ID NO: 487082 - DNA, 16 bp, R. norvegicus
cagaggggaaactgga

SEQ ID NO: 487083 - DNA, 16 bp, R. norvegicus
cagaggggatggagaa

SEQ ID NO: 487084 - DNA, 16 bp, R. norvegicus
cagaggggcctggtgc

SEQ ID NO: 487085 - DNA, 16 bp, R. norvegicus
cagagggtacagagac

SEQ ID NO: 487086 - DNA, 16 bp, R. norvegicus
cagagggtacagagag

SEQ ID NO: 487087 - DNA, 16 bp, R. norvegicus
cagagggtcaggagaa

SEQ ID NO: 487088 - DNA, 16 bp, R. norvegicus
cagagggtggacctgg

SEQ ID NO: 487089 - DNA, 16 bp, R. norvegicus
cagaggtaaccagatg

SEQ ID NO: 487090 - DNA, 16 bp, R. norvegicus
cagaggtcaaccttga

SEQ ID NO: 487091 - DNA, 16 bp, R. norvegicus
cagaggtcacagagac

SEQ ID NO: 487092 - DNA, 16 bp, R. norvegicus
cagaggtcagaggtca

SEQ ID NO: 487093 - DNA, 16 bp, R. norvegicus
cagaggtcaggggaca

SEQ ID NO: 487094 - DNA, 16 bp, R. norvegicus
cagaggtccacctgct

SEQ ID NO: 487095 - DNA, 17 bp, R. norvegicus
cagaggtcccgagttca

SEQ ID NO: 487096 - DNA, 16 bp, R. norvegicus
cagaggtgaaggagag

SEQ ID NO: 487097 - DNA, 16 bp, R. norvegicus
cagaggtgacctgtga

SEQ ID NO: 487098 - DNA, 16 bp, R. norvegicus
cagaggtggagagagg

SEQ ID NO: 487099 - DNA, 16 bp, R. norvegicus
cagaggtggatgttca

SEQ ID NO: 487100 - DNA, 16 bp, R. norvegicus
cagaggtggtggtggt

SEQ ID NO: 487101 - DNA, 16 bp, R. norvegicus
cagaggtgtgcagagg

SEQ ID NO: 487102 - DNA, 16 bp, R. norvegicus
cagaggttcaggaaat

SEQ ID NO: 487103 - DNA, 16 bp, R. norvegicus
cagagtaaaggctgga

SEQ ID NO: 487104 - DNA, 16 bp, R. norvegicus
cagagtaaagggctgg

SEQ ID NO: 487105 - DNA, 16 bp, R. norvegicus
cagagtatcagaacaa

SEQ ID NO: 487106 - DNA, 16 bp, R. norvegicus
cagagtatcatcaata

SEQ ID NO: 487107 - DNA, 16 bp, R. norvegicus
cagagtcaaaggctgg

SEQ ID NO: 487108 - DNA, 16 bp, R. norvegicus
cagagtcacatggcca

SEQ ID NO: 487109 - DNA, 16 bp, R. norvegicus
cagagtcaggaggatc

SEQ ID NO: 487110 - DNA, 27 bp, R. norvegicus
cagagtcagtcaaaacctatggagtca

SEQ ID NO: 487111 - DNA, 16 bp, R. norvegicus
cagagtccagggtccg

SEQ ID NO: 487112 - DNA, 16 bp, R. norvegicus
cagagtcctctggaag

SEQ ID NO: 487113 - DNA, 16 bp, R. norvegicus
cagagtctctcattgg

SEQ ID NO: 487114 - DNA, 16 bp, R. norvegicus
cagagtctgagtcaga

SEQ ID NO: 487115 - DNA, 16 bp, R. norvegicus
cagagtctgataaacc

SEQ ID NO: 487116 - DNA, 16 bp, R. norvegicus
cagagtctgtgacagg

SEQ ID NO: 487117 - DNA, 16 bp, R. norvegicus
cagagtgaaaagctgg

SEQ ID NO: 487118 - DNA, 16 bp, R. norvegicus
cagagtgaatcccagg

SEQ ID NO: 487119 - DNA, 16 bp, R. norvegicus
cagagtgagagacaga

SEQ ID NO: 487120 - DNA, 16 bp, R. norvegicus
cagagtgagtccagga

SEQ ID NO: 487121 - DNA, 16 bp, R. norvegicus
cagagtgagttccagt

SEQ ID NO: 487122 - DNA, 16 bp, R. norvegicus
cagagtgagttcccag

SEQ ID NO: 487123 - DNA, 16 bp, R. norvegicus
cagagtgccacagaga

SEQ ID NO: 487124 - DNA, 17 bp, R. norvegicus
cagagtgcccagctcgg

SEQ ID NO: 487125 - DNA, 16 bp, R. norvegicus
cagagtgcttgctgct

SEQ ID NO: 487126 - DNA, 17 bp, R. norvegicus
cagagtggaagagacca

SEQ ID NO: 487127 - DNA, 16 bp, R. norvegicus
cagagtggatgtacca

SEQ ID NO: 487128 - DNA, 16 bp, R. norvegicus
cagagtggggaggcag

SEQ ID NO: 487129 - DNA, 16 bp, R. norvegicus
cagagtgggtgctggg

SEQ ID NO: 487130 - DNA, 16 bp, R. norvegicus
cagagtgttctgctct

SEQ ID NO: 487131 - DNA, 16 bp, R. norvegicus
cagagttagtttgaga

SEQ ID NO: 487132 - DNA, 16 bp, R. norvegicus
cagagttatatggatc

SEQ ID NO: 487133 - DNA, 16 bp, R. norvegicus
cagagttcaaatccca

SEQ ID NO: 487134 - DNA, 16 bp, R. norvegicus
cagagttccaggacag

SEQ ID NO: 487135 - DNA, 16 bp, R. norvegicus
cagagttgtcctctga

SEQ ID NO: 487136 - DNA, 16 bp, R. norvegicus
cagagtttctcagtgt

SEQ ID NO: 487137 - DNA, 16 bp, R. norvegicus
cagagtttggagtttg

SEQ ID NO: 487138 - DNA, 16 bp, R. norvegicus
cagagttttgaagaga

SEQ ID NO: 487139 - DNA, 16 bp, R. norvegicus
cagagttttggagagg

SEQ ID NO: 487140 - DNA, 16 bp, R. norvegicus
cagataaacagataaa

SEQ ID NO: 487141 - DNA, 16 bp, R. norvegicus
cagataagtcatctaa

SEQ ID NO: 487142 - DNA, 16 bp, R. norvegicus
cagatacaagaaaaat

SEQ ID NO: 487143 - DNA, 16 bp, R. norvegicus
cagatacacagagaca

SEQ ID NO: 487144 - DNA, 16 bp, R. norvegicus
cagatacagaaagaaa

SEQ ID NO: 487145 - DNA, 16 bp, R. norvegicus
cagatacagagagaca

SEQ ID NO: 487146 - DNA, 16 bp, R. norvegicus
cagatacagatctctc

SEQ ID NO: 487147 - DNA, 16 bp, R. norvegicus
cagatacatcagaaga

SEQ ID NO: 487148 - DNA, 16 bp, R. norvegicus
cagatacccacagcta

SEQ ID NO: 487149 - DNA, 16 bp, R. norvegicus
cagatacctgtgtttc

SEQ ID NO: 487150 - DNA, 16 bp, R. norvegicus
cagatagatcagtgga

SEQ ID NO: 487151 - DNA, 16 bp, R. norvegicus
cagatagctaaaacta

SEQ ID NO: 487152 - DNA, 16 bp, R. norvegicus
cagatatgcctgggaa

SEQ ID NO: 487153 - DNA, 16 bp, R. norvegicus
cagatcacacacacac

SEQ ID NO: 487154 - DNA, 16 bp, R. norvegicus
cagatcagaaaaaaag

SEQ ID NO: 487155 - DNA, 16 bp, R. norvegicus
cagatcagcagcttct

SEQ ID NO: 487156 - DNA, 16 bp, R. norvegicus
cagatcagctccctct

SEQ ID NO: 487157 - DNA, 16 bp, R. norvegicus
cagatcaggaagctga

SEQ ID NO: 487158 - DNA, 16 bp, R. norvegicus
cagatcatggaacaga

SEQ ID NO: 487159 - DNA, 16 bp, R. norvegicus
cagatccaagaacaca

SEQ ID NO: 487160 - DNA, 16 bp, R. norvegicus
cagatccactctccct

SEQ ID NO: 487161 - DNA, 16 bp, R. norvegicus
cagatccagggctttg

SEQ ID NO: 487162 - DNA, 16 bp, R. norvegicus
cagatccagggttttg

SEQ ID NO: 487163 - DNA, 16 bp, R. norvegicus
cagatccagtctcagg

SEQ ID NO: 487164 - DNA, 25 bp, R. norvegicus
cagatcccattacagatggttgtga

SEQ ID NO: 487165 - DNA, 16 bp, R. norvegicus
cagatcccctagaact

SEQ ID NO: 487166 - DNA, 16 bp, R. norvegicus
cagatccctccctccc

SEQ ID NO: 487167 - DNA, 16 bp, R. norvegicus
cagatccctgagtttg

SEQ ID NO: 487168 - DNA, 16 bp, R. norvegicus
cagatcctccctacct

SEQ ID NO: 487169 - DNA, 16 bp, R. norvegicus
cagatcctctggaaaa

SEQ ID NO: 487170 - DNA, 16 bp, R. norvegicus
cagatcctgtgaagag

SEQ ID NO: 487171 - DNA, 17 bp, R. norvegicus
cagatctcagacatggt

SEQ ID NO: 487172 - DNA, 16 bp, R. norvegicus
cagatctccagctcct

SEQ ID NO: 487173 - DNA, 16 bp, R. norvegicus
cagatctctgagttca

SEQ ID NO: 487174 - DNA, 16 bp, R. norvegicus
cagatctctgagttcc

SEQ ID NO: 487175 - DNA, 16 bp, R. norvegicus
cagatctcttgagttt

SEQ ID NO: 487176 - DNA, 16 bp, R. norvegicus
cagatcttcccacctc

SEQ ID NO: 487177 - DNA, 16 bp, R. norvegicus
cagatcttcctcttcc

SEQ ID NO: 487178 - DNA, 16 bp, R. norvegicus
cagatcttcctgtttg

SEQ ID NO: 487179 - DNA, 16 bp, R. norvegicus
cagatctttgtgaatt

SEQ ID NO: 487180 - DNA, 16 bp, R. norvegicus
cagatgaagaaattga

SEQ ID NO: 487181 - DNA, 16 bp, R. norvegicus
cagatgaagaagtaga

SEQ ID NO: 487182 - DNA, 16 bp, R. norvegicus
cagatgaagacataga

SEQ ID NO: 487183 - DNA, 16 bp, R. norvegicus
cagatgaagatgaaga

SEQ ID NO: 487184 - DNA, 16 bp, R. norvegicus
cagatgaagatgcaga

SEQ ID NO: 487185 - DNA, 16 bp, R. norvegicus
cagatgaagatggaga

SEQ ID NO: 487186 - DNA, 16 bp, R. norvegicus
cagatgaatttggaaa

SEQ ID NO: 487187 - DNA, 16 bp, R. norvegicus
cagatgaccaaaatgt

SEQ ID NO: 487188 - DNA, 16 bp, R. norvegicus
cagatgacctgagttt

SEQ ID NO: 487189 - DNA, 16 bp, R. norvegicus
cagatgagaccaccac

SEQ ID NO: 487190 - DNA, 16 bp, R. norvegicus
cagatgaggaaacaga

SEQ ID NO: 487191 - DNA, 16 bp, R. norvegicus
cagatgaggaaactaa

SEQ ID NO: 487192 - DNA, 16 bp, R. norvegicus
cagatgataaacaact

SEQ ID NO: 487193 - DNA, 16 bp, R. norvegicus
cagatgatatgatggt

SEQ ID NO: 487194 - DNA, 16 bp, R. norvegicus
cagatgatgtttggtg

SEQ ID NO: 487195 - DNA, 16 bp, R. norvegicus
cagatgattgtgaact

SEQ ID NO: 487196 - DNA, 16 bp, R. norvegicus
cagatgcacatacaca

SEQ ID NO: 487197 - DNA, 16 bp, R. norvegicus
cagatgcagaagcaga

SEQ ID NO: 487198 - DNA, 16 bp, R. norvegicus
cagatgcagagattca

SEQ ID NO: 487199 - DNA, 16 bp, R. norvegicus
cagatgcagatgcaga

SEQ ID NO: 487200 - DNA, 16 bp, R. norvegicus
cagatgcagatgtttg

SEQ ID NO: 487201 - DNA, 17 bp, R. norvegicus
cagatgccagaggaaaa

SEQ ID NO: 487202 - DNA, 16 bp, R. norvegicus
cagatgccatggaggg

SEQ ID NO: 487203 - DNA, 16 bp, R. norvegicus
cagatgcccacagagg

SEQ ID NO: 487204 - DNA, 16 bp, R. norvegicus
cagatgccccagaact

SEQ ID NO: 487205 - DNA, 16 bp, R. norvegicus
cagatgccccagagct

SEQ ID NO: 487206 - DNA, 16 bp, R. norvegicus
cagatgccctgaaact

SEQ ID NO: 487207 - DNA, 16 bp, R. norvegicus
cagatgccctgagttc

SEQ ID NO: 487208 - DNA, 16 bp, R. norvegicus
cagatgccctggagtt

SEQ ID NO: 487209 - DNA, 16 bp, R. norvegicus
cagatgctgaagagga

SEQ ID NO: 487210 - DNA, 16 bp, R. norvegicus
cagatgctgaggagga

SEQ ID NO: 487211 - DNA, 16 bp, R. norvegicus
cagatgctgatgagaa

SEQ ID NO: 487212 - DNA, 16 bp, R. norvegicus
cagatgctgatgagga

SEQ ID NO: 487213 - DNA, 16 bp, R. norvegicus
cagatgctggaaacaa

SEQ ID NO: 487214 - DNA, 16 bp, R. norvegicus
cagatgctggagaaga

SEQ ID NO: 487215 - DNA, 16 bp, R. norvegicus
cagatgctggccagga

SEQ ID NO: 487216 - DNA, 16 bp, R. norvegicus
cagatgctggggagga

SEQ ID NO: 487217 - DNA, 17 bp, R. norvegicus
cagatgctggtgaagat

SEQ ID NO: 487218 - DNA, 16 bp, R. norvegicus
cagatgctgtccagga

SEQ ID NO: 487219 - DNA, 16 bp, R. norvegicus
cagatgcttctattgg

SEQ ID NO: 487220 - DNA, 16 bp, R. norvegicus
cagatgcttgtagcca

SEQ ID NO: 487221 - DNA, 26 bp, R. norvegicus
cagatggaaagatctcccatgctcat

SEQ ID NO: 487222 - DNA, 16 bp, R. norvegicus
cagatggagaaaacaa

SEQ ID NO: 487223 - DNA, 16 bp, R. norvegicus
cagatggagaaacaga

SEQ ID NO: 487224 - DNA, 16 bp, R. norvegicus
cagatggagaaactga

SEQ ID NO: 487225 - DNA, 16 bp, R. norvegicus
cagatggcaggaaata

SEQ ID NO: 487226 - DNA, 16 bp, R. norvegicus
cagatggccagtgtcc

SEQ ID NO: 487227 - DNA, 16 bp, R. norvegicus
cagatggcctatgagt

SEQ ID NO: 487228 - DNA, 16 bp, R. norvegicus
cagatggctcagtggg

SEQ ID NO: 487229 - DNA, 16 bp, R. norvegicus
cagatggctgtgagtt

SEQ ID NO: 487230 - DNA, 16 bp, R. norvegicus
cagatggggctggaga

SEQ ID NO: 487231 - DNA, 16 bp, R. norvegicus
cagatggtgaaaggca

SEQ ID NO: 487232 - DNA, 16 bp, R. norvegicus
cagatggtgagaggca

SEQ ID NO: 487233 - DNA, 16 bp, R. norvegicus
cagatggttttagcac

SEQ ID NO: 487234 - DNA, 16 bp, R. norvegicus
cagatgtagaagtctc

SEQ ID NO: 487235 - DNA, 16 bp, R. norvegicus
cagatgtcagcaggcc

SEQ ID NO: 487236 - DNA, 16 bp, R. norvegicus
cagatgtcagcccaga

SEQ ID NO: 487237 - DNA, 16 bp, R. norvegicus
cagatgtcatggggca

SEQ ID NO: 487238 - DNA, 16 bp, R. norvegicus
cagatgtcattacaga

SEQ ID NO: 487239 - DNA, 16 bp, R. norvegicus
cagatgtccttcaaga

SEQ ID NO: 487240 - DNA, 16 bp, R. norvegicus
cagatgtgcagcctgg

SEQ ID NO: 487241 - DNA, 16 bp, R. norvegicus
cagatgtgcagcttga

SEQ ID NO: 487242 - DNA, 16 bp, R. norvegicus
cagatgtgcttcaaca

SEQ ID NO: 487243 - DNA, 16 bp, R. norvegicus
cagatgtggaaagaag

SEQ ID NO: 487244 - DNA, 16 bp, R. norvegicus
cagatgtggagttggt

SEQ ID NO: 487245 - DNA, 16 bp, R. norvegicus
cagatgtggtagcaca

SEQ ID NO: 487246 - DNA, 16 bp, R. norvegicus
cagatgtggtgctgga

SEQ ID NO: 487247 - DNA, 16 bp, R. norvegicus
cagatgtggttgctgg

SEQ ID NO: 487248 - DNA, 16 bp, R. norvegicus
cagatgtgtgtccctt

SEQ ID NO: 487249 - DNA, 16 bp, R. norvegicus
cagatgttcagtccat

SEQ ID NO: 487250 - DNA, 16 bp, R. norvegicus
cagatgttggtgagga

SEQ ID NO: 487251 - DNA, 16 bp, R. norvegicus
cagatgtttgtggatt

SEQ ID NO: 487252 - DNA, 16 bp, R. norvegicus
cagattattgaattat

SEQ ID NO: 487253 - DNA, 16 bp, R. norvegicus
cagattccctgaagct

SEQ ID NO: 487254 - DNA, 16 bp, R. norvegicus
cagattctcactatgt

SEQ ID NO: 487255 - DNA, 16 bp, R. norvegicus
cagattctcctgcctc

SEQ ID NO: 487256 - DNA, 16 bp, R. norvegicus
cagattctgagagctc

SEQ ID NO: 487257 - DNA, 16 bp, R. norvegicus
cagattctgttcttat

SEQ ID NO: 487258 - DNA, 16 bp, R. norvegicus
cagattgatttccaga

SEQ ID NO: 487259 - DNA, 16 bp, R. norvegicus
cagattgattttattt

SEQ ID NO: 487260 - DNA, 16 bp, R. norvegicus
cagattggcctgtgtg

SEQ ID NO: 487261 - DNA, 16 bp, R. norvegicus
cagattggggaaaggt

SEQ ID NO: 487262 - DNA, 16 bp, R. norvegicus
cagattgttttccaga

SEQ ID NO: 487263 - DNA, 16 bp, R. norvegicus
cagatttatttccaga

SEQ ID NO: 487264 - DNA, 16 bp, R. norvegicus
cagattttcaagattt

SEQ ID NO: 487265 - DNA, 16 bp, R. norvegicus
cagattttccagtatt

SEQ ID NO: 487266 - DNA, 16 bp, R. norvegicus
cagattttgttaattt

SEQ ID NO: 487267 - DNA, 16 bp, R. norvegicus
cagcaaaagcagcagc

SEQ ID NO: 487268 - DNA, 16 bp, R. norvegicus
cagcaaaagtgtcaag

SEQ ID NO: 487269 - DNA, 16 bp, R. norvegicus
cagcaaacacagaggc

SEQ ID NO: 487270 - DNA, 16 bp, R. norvegicus
cagcaaaccactgagc

SEQ ID NO: 487271 - DNA, 16 bp, R. norvegicus
cagcaaaccagctgct

SEQ ID NO: 487272 - DNA, 16 bp, R. norvegicus
cagcaaagaaatcaaa

SEQ ID NO: 487273 - DNA, 16 bp, R. norvegicus
cagcaaagaaggcaag

SEQ ID NO: 487274 - DNA, 16 bp, R. norvegicus
cagcaaagccatcctc

SEQ ID NO: 487275 - DNA, 16 bp, R. norvegicus
cagcaaagcccagtga

SEQ ID NO: 487276 - DNA, 16 bp, R. norvegicus
cagcaaaggcagcagc

SEQ ID NO: 487277 - DNA, 16 bp, R. norvegicus
cagcaaaggggctggg

SEQ ID NO: 487278 - DNA, 16 bp, R. norvegicus
cagcaaagggtgctgg

SEQ ID NO: 487279 - DNA, 16 bp, R. norvegicus
cagcaaagtggaagtg

SEQ ID NO: 487280 - DNA, 16 bp, R. norvegicus
cagcaaagtggccaga

SEQ ID NO: 487281 - DNA, 16 bp, R. norvegicus
cagcaaatgctggcaa

SEQ ID NO: 487282 - DNA, 16 bp, R. norvegicus
cagcaaatggagctgg

SEQ ID NO: 487283 - DNA, 16 bp, R. norvegicus
cagcaaatgggacctc

SEQ ID NO: 487284 - DNA, 16 bp, R. norvegicus
cagcaaattccaggcc

SEQ ID NO: 487285 - DNA, 16 bp, R. norvegicus
cagcaacaacaaaatt

SEQ ID NO: 487286 - DNA, 16 bp, R. norvegicus
cagcaacaacagcagt

SEQ ID NO: 487287 - DNA, 16 bp, R. norvegicus
cagcaacagcagcaag

SEQ ID NO: 487288 - DNA, 16 bp, R. norvegicus
cagcaacagcagcagt

SEQ ID NO: 487289 - DNA, 16 bp, R. norvegicus
cagcaacagcagtagc

SEQ ID NO: 487290 - DNA, 16 bp, R. norvegicus
cagcaacaggcccaaa

SEQ ID NO: 487291 - DNA, 16 bp, R. norvegicus
cagcaacagtgactgg

SEQ ID NO: 487292 - DNA, 16 bp, R. norvegicus
cagcaacatggctgtt

SEQ ID NO: 487293 - DNA, 16 bp, R. norvegicus
cagcaacatggcttct

SEQ ID NO: 487294 - DNA, 16 bp, R. norvegicus
cagcaaccacacggca

SEQ ID NO: 487295 - DNA, 16 bp, R. norvegicus
cagcaaccacagggtg

SEQ ID NO: 487296 - DNA, 35 bp, R. norvegicus
cagcaaccacatggtggctcacaaccatctgtaat

SEQ ID NO: 487297 - DNA, 16 bp, R. norvegicus
cagcaaccagaagggc

SEQ ID NO: 487298 - DNA, 16 bp, R. norvegicus
cagcaaccaggaatac

SEQ ID NO: 487299 - DNA, 16 bp, R. norvegicus
cagcaaccccatggtg

SEQ ID NO: 487300 - DNA, 16 bp, R. norvegicus
cagcaacgacatggtg

SEQ ID NO: 487301 - DNA, 16 bp, R. norvegicus
cagcaactcctataaa

SEQ ID NO: 487302 - DNA, 16 bp, R. norvegicus
cagcaacttgatgtgc

SEQ ID NO: 487303 - DNA, 16 bp, R. norvegicus
cagcaagaagcagctg

SEQ ID NO: 487304 - DNA, 16 bp, R. norvegicus
cagcaagacctggata

SEQ ID NO: 487305 - DNA, 16 bp, R. norvegicus
cagcaagagcagcagc

SEQ ID NO: 487306 - DNA, 16 bp, R. norvegicus
cagcaagagcagccag

SEQ ID NO: 487307 - DNA, 16 bp, R. norvegicus
cagcaagagggctcag

SEQ ID NO: 487308 - DNA, 16 bp, R. norvegicus
cagcaagatggagaag

SEQ ID NO: 487309 - DNA, 16 bp, R. norvegicus
cagcaagatggctcag

SEQ ID NO: 487310 - DNA, 16 bp, R. norvegicus
cagcaagcagagagag

SEQ ID NO: 487311 - DNA, 16 bp, R. norvegicus
cagcaagcagcaagca

SEQ ID NO: 487312 - DNA, 16 bp, R. norvegicus
cagcaagcagcagaac

SEQ ID NO: 487313 - DNA, 16 bp, R. norvegicus
cagcaagcagcagtgc

SEQ ID NO: 487314 - DNA, 16 bp, R. norvegicus
cagcaagcagcattcc

SEQ ID NO: 487315 - DNA, 16 bp, R. norvegicus
cagcaagcctcaggga

SEQ ID NO: 487316 - DNA, 16 bp, R. norvegicus
cagcaagctcccagga

SEQ ID NO: 487317 - DNA, 16 bp, R. norvegicus
cagcaaggacagtctc

SEQ ID NO: 487318 - DNA, 16 bp, R. norvegicus
cagcaaggagagactg

SEQ ID NO: 487319 - DNA, 16 bp, R. norvegicus
cagcaaggccatcctt

SEQ ID NO: 487320 - DNA, 16 bp, R. norvegicus
cagcaaggtcagagct

SEQ ID NO: 487321 - DNA, 16 bp, R. norvegicus
cagcaaggtttgaccc

SEQ ID NO: 487322 - DNA, 16 bp, R. norvegicus
cagcaagtcccaggaa

SEQ ID NO: 487323 - DNA, 16 bp, R. norvegicus
cagcaagtgctcttca

SEQ ID NO: 487324 - DNA, 16 bp, R. norvegicus
cagcaagttcaaggcc

SEQ ID NO: 487325 - DNA, 16 bp, R. norvegicus
cagcaagttccaggcc

SEQ ID NO: 487326 - DNA, 16 bp, R. norvegicus
cagcaatatggaagta

SEQ ID NO: 487327 - DNA, 16 bp, R. norvegicus
cagcaatcagatttat

SEQ ID NO: 487328 - DNA, 16 bp, R. norvegicus
cagcaatgaacatggt

SEQ ID NO: 487329 - DNA, 16 bp, R. norvegicus
cagcaatgagaaaaat

SEQ ID NO: 487330 - DNA, 16 bp, R. norvegicus
cagcaatggaaacctt

SEQ ID NO: 487331 - DNA, 16 bp, R. norvegicus
cagcaatgtagaagtg

SEQ ID NO: 487332 - DNA, 16 bp, R. norvegicus
cagcaatgtggaggtg

SEQ ID NO: 487333 - DNA, 16 bp, R. norvegicus
cagcaatgtgggcagg

SEQ ID NO: 487334 - DNA, 16 bp, R. norvegicus
cagcacaaaacaggaa

SEQ ID NO: 487335 - DNA, 16 bp, R. norvegicus
cagcacaagagctggg

SEQ ID NO: 487336 - DNA, 16 bp, R. norvegicus
cagcacaaggcaggaa

SEQ ID NO: 487337 - DNA, 16 bp, R. norvegicus
cagcacaagtccagga

SEQ ID NO: 487338 - DNA, 16 bp, R. norvegicus
cagcacacacatggca

SEQ ID NO: 487339 - DNA, 16 bp, R. norvegicus
cagcacacagaagctg

SEQ ID NO: 487340 - DNA, 16 bp, R. norvegicus
cagcacacagcacaca

SEQ ID NO: 487341 - DNA, 16 bp, R. norvegicus
cagcacacagcagctg

SEQ ID NO: 487342 - DNA, 16 bp, R. norvegicus
cagcacacaggcagac

SEQ ID NO: 487343 - DNA, 16 bp, R. norvegicus
cagcacaccagaaagc

SEQ ID NO: 487344 - DNA, 16 bp, R. norvegicus
cagcacaccagcacac

SEQ ID NO: 487345 - DNA, 16 bp, R. norvegicus
cagcacaccccagtac

SEQ ID NO: 487346 - DNA, 16 bp, R. norvegicus
cagcacagacacacag

SEQ ID NO: 487347 - DNA, 16 bp, R. norvegicus
cagcacagcagaagag

SEQ ID NO: 487348 - DNA, 16 bp, R. norvegicus
cagcacagcagagctg

SEQ ID NO: 487349 - DNA, 16 bp, R. norvegicus
cagcacagccctgcac

SEQ ID NO: 487350 - DNA, 16 bp, R. norvegicus
cagcacaggaaagaaa

SEQ ID NO: 487351 - DNA, 16 bp, R. norvegicus
cagcacaggagctggg

SEQ ID NO: 487352 - DNA, 16 bp, R. norvegicus
cagcacagtgcctggc

SEQ ID NO: 487353 - DNA, 16 bp, R. norvegicus
cagcacagtgtgtgtg

SEQ ID NO: 487354 - DNA, 16 bp, R. norvegicus
cagcacatctgctaca

SEQ ID NO: 487355 - DNA, 16 bp, R. norvegicus
cagcacatggatgtct

SEQ ID NO: 487356 - DNA, 16 bp, R. norvegicus
cagcacatgttggcaa

SEQ ID NO: 487357 - DNA, 16 bp, R. norvegicus
cagcaccacagtgccc

SEQ ID NO: 487358 - DNA, 16 bp, R. norvegicus
cagcaccagcaccaac

SEQ ID NO: 487359 - DNA, 16 bp, R. norvegicus
cagcaccagcagcagc

SEQ ID NO: 487360 - DNA, 16 bp, R. norvegicus
cagcaccagtctccaa

SEQ ID NO: 487361 - DNA, 16 bp, R. norvegicus
cagcaccatgtctggc

SEQ ID NO: 487362 - DNA, 16 bp, R. norvegicus
cagcacccacactgag

SEQ ID NO: 487363 - DNA, 16 bp, R. norvegicus
cagcacccacagaaaa

SEQ ID NO: 487364 - DNA, 16 bp, R. norvegicus
cagcacccacatcagc

SEQ ID NO: 487365 - DNA, 16 bp, R. norvegicus
cagcacccacatgaca

SEQ ID NO: 487366 - DNA, 16 bp, R. norvegicus
cagcacccacattggt

SEQ ID NO: 487367 - DNA, 16 bp, R. norvegicus
cagcacccatgtctgg

SEQ ID NO: 487368 - DNA, 16 bp, R. norvegicus
cagcaccctccatggc

SEQ ID NO: 487369 - DNA, 16 bp, R. norvegicus
cagcaccctgcacatc

SEQ ID NO: 487370 - DNA, 16 bp, R. norvegicus
cagcaccgtgcctgcc

SEQ ID NO: 487371 - DNA, 16 bp, R. norvegicus
cagcacctacatggct

SEQ ID NO: 487372 - DNA, 16 bp, R. norvegicus
cagcacctatatggca

SEQ ID NO: 487373 - DNA, 16 bp, R. norvegicus
cagcacctcctgcacc

SEQ ID NO: 487374 - DNA, 16 bp, R. norvegicus
cagcaccttcggagat

SEQ ID NO: 487375 - DNA, 16 bp, R. norvegicus
cagcacgtgctcttaa

SEQ ID NO: 487376 - DNA, 16 bp, R. norvegicus
cagcactcaggaagga

SEQ ID NO: 487377 - DNA, 16 bp, R. norvegicus
cagcactcaggtggca

SEQ ID NO: 487378 - DNA, 16 bp, R. norvegicus
cagcactcctggaaac

SEQ ID NO: 487379 - DNA, 16 bp, R. norvegicus
cagcactcctggaaga

SEQ ID NO: 487380 - DNA, 16 bp, R. norvegicus
cagcactgagatcaca

SEQ ID NO: 487381 - DNA, 16 bp, R. norvegicus
cagcactgaggaggga

SEQ ID NO: 487382 - DNA, 16 bp, R. norvegicus
cagcactgccctgact

SEQ ID NO: 487383 - DNA, 16 bp, R. norvegicus
cagcactgccctggct

SEQ ID NO: 487384 - DNA, 16 bp, R. norvegicus
cagcactggaaggcag

SEQ ID NO: 487385 - DNA, 16 bp, R. norvegicus
cagcactggagaggta

SEQ ID NO: 487386 - DNA, 16 bp, R. norvegicus
cagcactggctggagt

SEQ ID NO: 487387 - DNA, 16 bp, R. norvegicus
cagcactggctgtcct

SEQ ID NO: 487388 - DNA, 16 bp, R. norvegicus
cagcacttgagagaca

SEQ ID NO: 487389 - DNA, 16 bp, R. norvegicus
cagcacttggaagtca

SEQ ID NO: 487390 - DNA, 16 bp, R. norvegicus
cagcacttggaatgca

SEQ ID NO: 487391 - DNA, 16 bp, R. norvegicus
cagcacttgggagaca

SEQ ID NO: 487392 - DNA, 16 bp, R. norvegicus
cagcacttgggaggtg

SEQ ID NO: 487393 - DNA, 16 bp, R. norvegicus
cagcagaaaaacccta

SEQ ID NO: 487394 - DNA, 16 bp, R. norvegicus
cagcagaaagaacaga

SEQ ID NO: 487395 - DNA, 16 bp, R. norvegicus
cagcagaaagacagtg

SEQ ID NO: 487396 - DNA, 16 bp, R. norvegicus
cagcagaaaggactgg

SEQ ID NO: 487397 - DNA, 16 bp, R. norvegicus
cagcagaagaccccag

SEQ ID NO: 487398 - DNA, 16 bp, R. norvegicus
cagcagaagactgctg

SEQ ID NO: 487399 - DNA, 16 bp, R. norvegicus
cagcagaagcagccag

SEQ ID NO: 487400 - DNA, 16 bp, R. norvegicus
cagcagaagccagagg

SEQ ID NO: 487401 - DNA, 16 bp, R. norvegicus
cagcagaagctacagc

SEQ ID NO: 487402 - DNA, 16 bp, R. norvegicus
cagcagaaggagaaag

SEQ ID NO: 487403 - DNA, 16 bp, R. norvegicus
cagcagacacagcaga

SEQ ID NO: 487404 - DNA, 16 bp, R. norvegicus
cagcagacaccagctg

SEQ ID NO: 487405 - DNA, 16 bp, R. norvegicus
cagcagacactgtgga

SEQ ID NO: 487406 - DNA, 16 bp, R. norvegicus
cagcagacagaagcag

SEQ ID NO: 487407 - DNA, 16 bp, R. norvegicus
cagcagacagagacca

SEQ ID NO: 487408 - DNA, 16 bp, R. norvegicus
cagcagacagcagcag

SEQ ID NO: 487409 - DNA, 16 bp, R. norvegicus
cagcagagaaatggat

SEQ ID NO: 487410 - DNA, 16 bp, R. norvegicus
cagcagagcagtgcac

SEQ ID NO: 487411 - DNA, 16 bp, R. norvegicus
cagcagagctcccagg

SEQ ID NO: 487412 - DNA, 16 bp, R. norvegicus
cagcagaggatggagg

SEQ ID NO: 487413 - DNA, 16 bp, R. norvegicus
cagcagaggcagcaga

SEQ ID NO: 487414 - DNA, 16 bp, R. norvegicus
cagcagatactggcga

SEQ ID NO: 487415 - DNA, 17 bp, R. norvegicus
cagcagatgatggcgag

SEQ ID NO: 487416 - DNA, 16 bp, R. norvegicus
cagcagatgctgccaa

SEQ ID NO: 487417 - DNA, 16 bp, R. norvegicus
cagcagatgctgggaa

SEQ ID NO: 487418 - DNA, 16 bp, R. norvegicus
cagcagattgggaaaa

SEQ ID NO: 487419 - DNA, 16 bp, R. norvegicus
cagcagcaaacctctg

SEQ ID NO: 487420 - DNA, 16 bp, R. norvegicus
cagcagcaacaacaag

SEQ ID NO: 487421 - DNA, 16 bp, R. norvegicus
cagcagcaacaacaat

SEQ ID NO: 487422 - DNA, 16 bp, R. norvegicus
cagcagcaacaaccac

SEQ ID NO: 487423 - DNA, 16 bp, R. norvegicus
cagcagcaacagcaaa

SEQ ID NO: 487424 - DNA, 16 bp, R. norvegicus
cagcagcaacagcaat

SEQ ID NO: 487425 - DNA, 16 bp, R. norvegicus
cagcagcaacagcaga

SEQ ID NO: 487426 - DNA, 16 bp, R. norvegicus
cagcagcaacccactg

SEQ ID NO: 487427 - DNA, 16 bp, R. norvegicus
cagcagcacacacagc

SEQ ID NO: 487428 - DNA, 16 bp, R. norvegicus
cagcagcacacagcag

SEQ ID NO: 487429 - DNA, 16 bp, R. norvegicus
cagcagcacaccactg

SEQ ID NO: 487430 - DNA, 16 bp, R. norvegicus
cagcagcacagcagca

SEQ ID NO: 487431 - DNA, 16 bp, R. norvegicus
cagcagcacctctgca

SEQ ID NO: 487432 - DNA, 16 bp, R. norvegicus
cagcagcagaaaggaa

SEQ ID NO: 487433 - DNA, 16 bp, R. norvegicus
cagcagcagaaaggag

SEQ ID NO: 487434 - DNA, 16 bp, R. norvegicus
cagcagcagactgaga

SEQ ID NO: 487435 - DNA, 16 bp, R. norvegicus
cagcagcagagcagca

SEQ ID NO: 487436 - DNA, 16 bp, R. norvegicus
cagcagcagaggcagc

SEQ ID NO: 487437 - DNA, 16 bp, R. norvegicus
cagcagcagcaaaagc

SEQ ID NO: 487438 - DNA, 16 bp, R. norvegicus
cagcagcagcaacaaa

SEQ ID NO: 487439 - DNA, 17 bp, R. norvegicus
cagcagcagcaacagct

SEQ ID NO: 487440 - DNA, 16 bp, R. norvegicus
cagcagcagcaacagg

SEQ ID NO: 487441 - DNA, 16 bp, R. norvegicus
cagcagcagcaacagt

SEQ ID NO: 487442 - DNA, 16 bp, R. norvegicus
cagcagcagcaaccac

SEQ ID NO: 487443 - DNA, 16 bp, R. norvegicus
cagcagcagcaaccag

SEQ ID NO: 487444 - DNA, 16 bp, R. norvegicus
cagcagcagcaatgga

SEQ ID NO: 487445 - DNA, 16 bp, R. norvegicus
cagcagcagcaccagc

SEQ ID NO: 487446 - DNA, 16 bp, R. norvegicus
cagcagcagcaccatc

SEQ ID NO: 487447 - DNA, 16 bp, R. norvegicus
cagcagcagcagaaaa

SEQ ID NO: 487448 - DNA, 16 bp, R. norvegicus
cagcagcagcagaagt

SEQ ID NO: 487449 - DNA, 16 bp, R. norvegicus
cagcagcagcagagaa

SEQ ID NO: 487450 - DNA, 16 bp, R. norvegicus
cagcagcagcagagag

SEQ ID NO: 487451 - DNA, 16 bp, R. norvegicus
cagcagcagcagaggc

SEQ ID NO: 487452 - DNA, 17 bp, R. norvegicus
cagcagcagcagcaact

SEQ ID NO: 487453 - DNA, 17 bp, R. norvegicus
cagcagcagcagcacaa

SEQ ID NO: 487454 - DNA, 16 bp, R. norvegicus
cagcagcagcagcact

SEQ ID NO: 487455 - DNA, 16 bp, R. norvegicus
cagcagcagcagcata

SEQ ID NO: 487456 - DNA, 16 bp, R. norvegicus
cagcagcagcagcatg

SEQ ID NO: 487457 - DNA, 16 bp, R. norvegicus
cagcagcagcagccct

SEQ ID NO: 487458 - DNA, 16 bp, R. norvegicus
cagcagcagcagccgc

SEQ ID NO: 487459 - DNA, 16 bp, R. norvegicus
cagcagcagcagcctg

SEQ ID NO: 487460 - DNA, 16 bp, R. norvegicus
cagcagcagcagcctt

SEQ ID NO: 487461 - DNA, 16 bp, R. norvegicus
cagcagcagcagcgag

SEQ ID NO: 487462 - DNA, 16 bp, R. norvegicus
cagcagcagcagctca

SEQ ID NO: 487463 - DNA, 16 bp, R. norvegicus
cagcagcagcagctcc

SEQ ID NO: 487464 - DNA, 16 bp, R. norvegicus
cagcagcagcagctct

SEQ ID NO: 487465 - DNA, 16 bp, R. norvegicus
cagcagcagcagctga

SEQ ID NO: 487466 - DNA, 16 bp, R. norvegicus
cagcagcagcagctgt

SEQ ID NO: 487467 - DNA, 16 bp, R. norvegicus
cagcagcagcagcttg

SEQ ID NO: 487468 - DNA, 16 bp, R. norvegicus
cagcagcagcaggaag

SEQ ID NO: 487469 - DNA, 16 bp, R. norvegicus
cagcagcagcaggaga

SEQ ID NO: 487470 - DNA, 16 bp, R. norvegicus
cagcagcagcaggcag

SEQ ID NO: 487471 - DNA, 16 bp, R. norvegicus
cagcagcagcaggcta

SEQ ID NO: 487472 - DNA, 16 bp, R. norvegicus
cagcagcagcagggac

SEQ ID NO: 487473 - DNA, 16 bp, R. norvegicus
cagcagcagcagggag

SEQ ID NO: 487474 - DNA, 16 bp, R. norvegicus
cagcagcagcaggtcc

SEQ ID NO: 487475 - DNA, 16 bp, R. norvegicus
cagcagcagcagtgac

SEQ ID NO: 487476 - DNA, 16 bp, R. norvegicus
cagcagcagccgcagc

SEQ ID NO: 487477 - DNA, 16 bp, R. norvegicus
cagcagcagctctctg

SEQ ID NO: 487478 - DNA, 16 bp, R. norvegicus
cagcagcagctggcct

SEQ ID NO: 487479 - DNA, 16 bp, R. norvegicus
cagcagcagctgtgga

SEQ ID NO: 487480 - DNA, 16 bp, R. norvegicus
cagcagcagcttctgg

SEQ ID NO: 487481 - DNA, 16 bp, R. norvegicus
cagcagcaggaaaagc

SEQ ID NO: 487482 - DNA, 16 bp, R. norvegicus
cagcagcaggaagaga

SEQ ID NO: 487483 - DNA, 16 bp, R. norvegicus
cagcagcaggaagcag

SEQ ID NO: 487484 - DNA, 16 bp, R. norvegicus
cagcagcaggagcagc

SEQ ID NO: 487485 - DNA, 16 bp, R. norvegicus
cagcagcaggagcagg

SEQ ID NO: 487486 - DNA, 16 bp, R. norvegicus
cagcagcaggagtgag

SEQ ID NO: 487487 - DNA, 16 bp, R. norvegicus
cagcagcagtagcagc

SEQ ID NO: 487488 - DNA, 16 bp, R. norvegicus
cagcagcagtggaatg

SEQ ID NO: 487489 - DNA, 16 bp, R. norvegicus
cagcagcatccaggca

SEQ ID NO: 487490 - DNA, 16 bp, R. norvegicus
cagcagccacagcagc

SEQ ID NO: 487491 - DNA, 16 bp, R. norvegicus
cagcagccaccacagg

SEQ ID NO: 487492 - DNA, 16 bp, R. norvegicus
cagcagccaccctctt

SEQ ID NO: 487493 - DNA, 16 bp, R. norvegicus
cagcagccaggaagac

SEQ ID NO: 487494 - DNA, 16 bp, R. norvegicus
cagcagccaggcaggc

SEQ ID NO: 487495 - DNA, 21 bp, R. norvegicus
cagcagccagttcctgcccct

SEQ ID NO: 487496 - DNA, 16 bp, R. norvegicus
cagcagccatatggtg

SEQ ID NO: 487497 - DNA, 16 bp, R. norvegicus
cagcagccatcagttg

SEQ ID NO: 487498 - DNA, 16 bp, R. norvegicus
cagcagcccagcagcc

SEQ ID NO: 487499 - DNA, 16 bp, R. norvegicus
cagcagccccagcagc

SEQ ID NO: 487500 - DNA, 16 bp, R. norvegicus
cagcagcctatgcccc

SEQ ID NO: 487501 - DNA, 16 bp, R. norvegicus
cagcagcctcctctcc

SEQ ID NO: 487502 - DNA, 16 bp, R. norvegicus
cagcagcctgacagca

SEQ ID NO: 487503 - DNA, 16 bp, R. norvegicus
cagcagcgcagatctt

SEQ ID NO: 487504 - DNA, 16 bp, R. norvegicus
cagcagctaagagcat

SEQ ID NO: 487505 - DNA, 16 bp, R. norvegicus
cagcagctatgaatgg

SEQ ID NO: 487506 - DNA, 16 bp, R. norvegicus
cagcagctcacaacca

SEQ ID NO: 487507 - DNA, 16 bp, R. norvegicus
cagcagctccacgctg

SEQ ID NO: 487508 - DNA, 16 bp, R. norvegicus
cagcagctcctgcttc

SEQ ID NO: 487509 - DNA, 16 bp, R. norvegicus
cagcagctctctactc

SEQ ID NO: 487510 - DNA, 19 bp, R. norvegicus
cagcagctctctgctccca

SEQ ID NO: 487511 - DNA, 16 bp, R. norvegicus
cagcagctgaacacca

SEQ ID NO: 487512 - DNA, 16 bp, R. norvegicus
cagcagctgagagcac

SEQ ID NO: 487513 - DNA, 16 bp, R. norvegicus
cagcagctgagagctc

SEQ ID NO: 487514 - DNA, 16 bp, R. norvegicus
cagcagctgatgaaaa

SEQ ID NO: 487515 - DNA, 16 bp, R. norvegicus
cagcagctgatggaga

SEQ ID NO: 487516 - DNA, 16 bp, R. norvegicus
cagcagctgatgggag

SEQ ID NO: 487517 - DNA, 16 bp, R. norvegicus
cagcagctgattgaga

SEQ ID NO: 487518 - DNA, 16 bp, R. norvegicus
cagcagctggctgaga

SEQ ID NO: 487519 - DNA, 16 bp, R. norvegicus
cagcagctggggacca

SEQ ID NO: 487520 - DNA, 16 bp, R. norvegicus
cagcagcttcacacag

SEQ ID NO: 487521 - DNA, 16 bp, R. norvegicus
cagcagcttctctgcc

SEQ ID NO: 487522 - DNA, 16 bp, R. norvegicus
cagcagcttctcttca

SEQ ID NO: 487523 - DNA, 16 bp, R. norvegicus
cagcagcttggcagca

SEQ ID NO: 487524 - DNA, 16 bp, R. norvegicus
cagcagctttacagca

SEQ ID NO: 487525 - DNA, 16 bp, R. norvegicus
cagcagctttcttctc

SEQ ID NO: 487526 - DNA, 16 bp, R. norvegicus
cagcaggaaaccactg

SEQ ID NO: 487527 - DNA, 16 bp, R. norvegicus
cagcaggaacctggag

SEQ ID NO: 487528 - DNA, 16 bp, R. norvegicus
cagcaggaagaaagag

SEQ ID NO: 487529 - DNA, 16 bp, R. norvegicus
cagcaggaagagcaag

SEQ ID NO: 487530 - DNA, 16 bp, R. norvegicus
cagcaggaagagggag

SEQ ID NO: 487531 - DNA, 16 bp, R. norvegicus
cagcaggaaggagaga

SEQ ID NO: 487532 - DNA, 16 bp, R. norvegicus
cagcaggactaagcac

SEQ ID NO: 487533 - DNA, 16 bp, R. norvegicus
cagcaggagactgtgt

SEQ ID NO: 487534 - DNA, 16 bp, R. norvegicus
cagcaggagagagagg

SEQ ID NO: 487535 - DNA, 16 bp, R. norvegicus
cagcaggagccaccac

SEQ ID NO: 487536 - DNA, 16 bp, R. norvegicus
cagcaggaggagcagg

SEQ ID NO: 487537 - DNA, 16 bp, R. norvegicus
cagcaggagggaccag

SEQ ID NO: 487538 - DNA, 16 bp, R. norvegicus
cagcaggagtgtgagg

SEQ ID NO: 487539 - DNA, 16 bp, R. norvegicus
cagcaggcaaaggcag

SEQ ID NO: 487540 - DNA, 16 bp, R. norvegicus
cagcaggcaccaggca

SEQ ID NO: 487541 - DNA, 16 bp, R. norvegicus
cagcaggcagaggcag

SEQ ID NO: 487542 - DNA, 16 bp, R. norvegicus
cagcaggcagcaagaa

SEQ ID NO: 487543 - DNA, 16 bp, R. norvegicus
cagcaggcagtgggca

SEQ ID NO: 487544 - DNA, 16 bp, R. norvegicus
cagcaggcccctctgc

SEQ ID NO: 487545 - DNA, 16 bp, R. norvegicus
cagcaggcctgagagg

SEQ ID NO: 487546 - DNA, 16 bp, R. norvegicus
cagcagggacagcagc

SEQ ID NO: 487547 - DNA, 16 bp, R. norvegicus
cagcagggccagctct

SEQ ID NO: 487548 - DNA, 16 bp, R. norvegicus
cagcaggggcagcagc

SEQ ID NO: 487549 - DNA, 16 bp, R. norvegicus
cagcaggggcagcagg

SEQ ID NO: 487550 - DNA, 16 bp, R. norvegicus
cagcaggggctggaga

SEQ ID NO: 487551 - DNA, 16 bp, R. norvegicus
cagcaggtaaaggtgc

SEQ ID NO: 487552 - DNA, 16 bp, R. norvegicus
cagcagtaacaacaac

SEQ ID NO: 487553 - DNA, 16 bp, R. norvegicus
cagcagtagcagcagc

SEQ ID NO: 487554 - DNA, 16 bp, R. norvegicus
cagcagtagcagcagt

SEQ ID NO: 487555 - DNA, 16 bp, R. norvegicus
cagcagtagtagcagc

SEQ ID NO: 487556 - DNA, 16 bp, R. norvegicus
cagcagtcaccccaac

SEQ ID NO: 487557 - DNA, 16 bp, R. norvegicus
cagcagtcagttcctg

SEQ ID NO: 487558 - DNA, 16 bp, R. norvegicus
cagcagtgaggagcac

SEQ ID NO: 487559 - DNA, 16 bp, R. norvegicus
cagcagtgcccacctg

SEQ ID NO: 487560 - DNA, 16 bp, R. norvegicus
cagcagtggaaaccct

SEQ ID NO: 487561 - DNA, 16 bp, R. norvegicus
cagcagtggatggaaa

SEQ ID NO: 487562 - DNA, 16 bp, R. norvegicus
cagcagtggcagctca

SEQ ID NO: 487563 - DNA, 16 bp, R. norvegicus
cagcagtgggagggga

SEQ ID NO: 487564 - DNA, 16 bp, R. norvegicus
cagcagtgtgacagca

SEQ ID NO: 487565 - DNA, 16 bp, R. norvegicus
cagcagttagaagcac

SEQ ID NO: 487566 - DNA, 16 bp, R. norvegicus
cagcagttgatggaaa

SEQ ID NO: 487567 - DNA, 16 bp, R. norvegicus
cagcatacaccagttg

SEQ ID NO: 487568 - DNA, 16 bp, R. norvegicus
cagcatcaaggcaggc

SEQ ID NO: 487569 - DNA, 16 bp, R. norvegicus
cagcatcaccaccacc

SEQ ID NO: 487570 - DNA, 16 bp, R. norvegicus
cagcatcaccaccatc

SEQ ID NO: 487571 - DNA, 16 bp, R. norvegicus
cagcatcactgaagtg

SEQ ID NO: 487572 - DNA, 16 bp, R. norvegicus
cagcatcagcaccacc

SEQ ID NO: 487573 - DNA, 16 bp, R. norvegicus
cagcatcagcatcagc

SEQ ID NO: 487574 - DNA, 16 bp, R. norvegicus
cagcatccacagcatc

SEQ ID NO: 487575 - DNA, 16 bp, R. norvegicus
cagcatccaccagctg

SEQ ID NO: 487576 - DNA, 16 bp, R. norvegicus
cagcatccaggaagat

SEQ ID NO: 487577 - DNA, 16 bp, R. norvegicus
cagcatccaggaagca

SEQ ID NO: 487578 - DNA, 16 bp, R. norvegicus
cagcatccccaagtgg

SEQ ID NO: 487579 - DNA, 16 bp, R. norvegicus
cagcatcctcagcagc

SEQ ID NO: 487580 - DNA, 16 bp, R. norvegicus
cagcatcctgatcaaa

SEQ ID NO: 487581 - DNA, 16 bp, R. norvegicus
cagcatcctggcaggc

SEQ ID NO: 487582 - DNA, 16 bp, R. norvegicus
cagcatccttccatgg

SEQ ID NO: 487583 - DNA, 23 bp, R. norvegicus
cagcatccttgagcatattcaga

SEQ ID NO: 487584 - DNA, 16 bp, R. norvegicus
cagcatctctctctct

SEQ ID NO: 487585 - DNA, 16 bp, R. norvegicus
cagcatctgccttctc

SEQ ID NO: 487586 - DNA, 18 bp, R. norvegicus
cagcatctgctgtcaccg

SEQ ID NO: 487587 - DNA, 16 bp, R. norvegicus
cagcatctgctgttgt

SEQ ID NO: 487588 - DNA, 16 bp, R. norvegicus
cagcatctggctcctg

SEQ ID NO: 487589 - DNA, 16 bp, R. norvegicus
cagcatgagtccagga

SEQ ID NO: 487590 - DNA, 16 bp, R. norvegicus
cagcatgcacagggcc

SEQ ID NO: 487591 - DNA, 16 bp, R. norvegicus
cagcatggacagtgtg

SEQ ID NO: 487592 - DNA, 16 bp, R. norvegicus
cagcatggccaaggca

SEQ ID NO: 487593 - DNA, 16 bp, R. norvegicus
cagcatgggcccactg

SEQ ID NO: 487594 - DNA, 16 bp, R. norvegicus
cagcatgggcctgctg

SEQ ID NO: 487595 - DNA, 16 bp, R. norvegicus
cagcattactgttttg

SEQ ID NO: 487596 - DNA, 16 bp, R. norvegicus
cagcattcaggaaaca

SEQ ID NO: 487597 - DNA, 17 bp, R. norvegicus
cagcattcctcacagca

SEQ ID NO: 487598 - DNA, 16 bp, R. norvegicus
cagcattcctccacgg

SEQ ID NO: 487599 - DNA, 24 bp, R. norvegicus
cagcatttgctgtcacctgaattt

SEQ ID NO: 487600 - DNA, 26 bp, R. norvegicus
cagcatttgctgtcacctgagttttt

SEQ ID NO: 487601 - DNA, 37 bp, R. norvegicus
cagcattttcagcaaatggtgctggttcaactggagg

SEQ ID NO: 487602 - DNA, 16 bp, R. norvegicus
cagcattttgctgaat

SEQ ID NO: 487603 - DNA, 16 bp, R. norvegicus
cagcattttggagatg

SEQ ID NO: 487604 - DNA, 16 bp, R. norvegicus
cagccaacatccccct

SEQ ID NO: 487605 - DNA, 16 bp, R. norvegicus
cagccaaccataggac

SEQ ID NO: 487606 - DNA, 16 bp, R. norvegicus
cagccaagaagcagag

SEQ ID NO: 487607 - DNA, 16 bp, R. norvegicus
cagccaagagcagaga

SEQ ID NO: 487608 - DNA, 16 bp, R. norvegicus
cagccaagcctgcagc

SEQ ID NO: 487609 - DNA, 16 bp, R. norvegicus
cagccaaggatgacct

SEQ ID NO: 487610 - DNA, 16 bp, R. norvegicus
cagccaaggccttttg

SEQ ID NO: 487611 - DNA, 16 bp, R. norvegicus
cagccaatcagaagct

SEQ ID NO: 487612 - DNA, 16 bp, R. norvegicus
cagccaatgaaacttc

SEQ ID NO: 487613 - DNA, 16 bp, R. norvegicus
cagccacacagccaca

SEQ ID NO: 487614 - DNA, 16 bp, R. norvegicus
cagccacagaaagcaa

SEQ ID NO: 487615 - DNA, 16 bp, R. norvegicus
cagccacagctacagc

SEQ ID NO: 487616 - DNA, 16 bp, R. norvegicus
cagccacaggcccaaa

SEQ ID NO: 487617 - DNA, 16 bp, R. norvegicus
cagccacagtcacagc

SEQ ID NO: 487618 - DNA, 16 bp, R. norvegicus
cagccacatacacaca

SEQ ID NO: 487619 - DNA, 16 bp, R. norvegicus
cagccacattctttgc

SEQ ID NO: 487620 - DNA, 16 bp, R. norvegicus
cagccaccaaaccaag

SEQ ID NO: 487621 - DNA, 16 bp, R. norvegicus
cagccaccaaacccag

SEQ ID NO: 487622 - DNA, 16 bp, R. norvegicus
cagccaccaacagatt

SEQ ID NO: 487623 - DNA, 16 bp, R. norvegicus
cagccaccacacactc

SEQ ID NO: 487624 - DNA, 16 bp, R. norvegicus
cagccaccacactctc

SEQ ID NO: 487625 - DNA, 16 bp, R. norvegicus
cagccaccatcagaga

SEQ ID NO: 487626 - DNA, 16 bp, R. norvegicus
cagccactgcacactt

SEQ ID NO: 487627 - DNA, 16 bp, R. norvegicus
cagccacttctgccca

SEQ ID NO: 487628 - DNA, 33 bp, R. norvegicus
cagccactttgctgaagttgtttatcagcttta

SEQ ID NO: 487629 - DNA, 16 bp, R. norvegicus
cagccagaactgcaca

SEQ ID NO: 487630 - DNA, 16 bp, R. norvegicus
cagccagaatctggaa

SEQ ID NO: 487631 - DNA, 16 bp, R. norvegicus
cagccagagagtgaca

SEQ ID NO: 487632 - DNA, 16 bp, R. norvegicus
cagccagagctacaga

SEQ ID NO: 487633 - DNA, 16 bp, R. norvegicus
cagccagagctcccag

SEQ ID NO: 487634 - DNA, 16 bp, R. norvegicus
cagccagagctgcaga

SEQ ID NO: 487635 - DNA, 16 bp, R. norvegicus
cagccagaggaattaa

SEQ ID NO: 487636 - DNA, 16 bp, R. norvegicus
cagccagagttcaaaa

SEQ ID NO: 487637 - DNA, 16 bp, R. norvegicus
cagccagcaagcccca

SEQ ID NO: 487638 - DNA, 16 bp, R. norvegicus
cagccagcagcagcag

SEQ ID NO: 487639 - DNA, 16 bp, R. norvegicus
cagccagccacagcca

SEQ ID NO: 487640 - DNA, 16 bp, R. norvegicus
cagccagccagaatcc

SEQ ID NO: 487641 - DNA, 16 bp, R. norvegicus
cagccagccagccaca

SEQ ID NO: 487642 - DNA, 16 bp, R. norvegicus
cagccagccagccagg

SEQ ID NO: 487643 - DNA, 16 bp, R. norvegicus
cagccagcctagcaga

SEQ ID NO: 487644 - DNA, 16 bp, R. norvegicus
cagccagcctgccacc

SEQ ID NO: 487645 - DNA, 16 bp, R. norvegicus
cagccagctccttcct

SEQ ID NO: 487646 - DNA, 16 bp, R. norvegicus
cagccagctgcagaaa

SEQ ID NO: 487647 - DNA, 16 bp, R. norvegicus
cagccaggaatagcca

SEQ ID NO: 487648 - DNA, 16 bp, R. norvegicus
cagccaggacaatatg

SEQ ID NO: 487649 - DNA, 16 bp, R. norvegicus
cagccaggaccacaga

SEQ ID NO: 487650 - DNA, 16 bp, R. norvegicus
cagccaggactagcag

SEQ ID NO: 487651 - DNA, 16 bp, R. norvegicus
cagccaggactatgca

SEQ ID NO: 487652 - DNA, 16 bp, R. norvegicus
cagccaggcctcagtc

SEQ ID NO: 487653 - DNA, 16 bp, R. norvegicus
cagccaggcctccacc

SEQ ID NO: 487654 - DNA, 16 bp, R. norvegicus
cagccaggcctggtgg

SEQ ID NO: 487655 - DNA, 16 bp, R. norvegicus
cagccaggctcagcag

SEQ ID NO: 487656 - DNA, 16 bp, R. norvegicus
cagccagggagcagag

SEQ ID NO: 487657 - DNA, 16 bp, R. norvegicus
cagccagggcaacaga

SEQ ID NO: 487658 - DNA, 16 bp, R. norvegicus
cagccagggctgcata

SEQ ID NO: 487659 - DNA, 16 bp, R. norvegicus
cagccagggcttcaca

SEQ ID NO: 487660 - DNA, 16 bp, R. norvegicus
cagccaggggctacac

SEQ ID NO: 487661 - DNA, 16 bp, R. norvegicus
cagccaggtgtggtgg

SEQ ID NO: 487662 - DNA, 16 bp, R. norvegicus
cagccagtcacagagg

SEQ ID NO: 487663 - DNA, 16 bp, R. norvegicus
cagccagtcagccagc

SEQ ID NO: 487664 - DNA, 16 bp, R. norvegicus
cagccagtgctgagcc

SEQ ID NO: 487665 - DNA, 16 bp, R. norvegicus
cagccagttctgggaa

SEQ ID NO: 487666 - DNA, 16 bp, R. norvegicus
cagccataccaagctc

SEQ ID NO: 487667 - DNA, 16 bp, R. norvegicus
cagccatcatcaaaga

SEQ ID NO: 487668 - DNA, 16 bp, R. norvegicus
cagccatcatcagaaa

SEQ ID NO: 487669 - DNA, 16 bp, R. norvegicus
cagccatcttctgtaa

SEQ ID NO: 487670 - DNA, 16 bp, R. norvegicus
cagccatgactacaca

SEQ ID NO: 487671 - DNA, 16 bp, R. norvegicus
cagccatgggcttttg

SEQ ID NO: 487672 - DNA, 16 bp, R. norvegicus
cagccatggtgctgga

SEQ ID NO: 487673 - DNA, 16 bp, R. norvegicus
cagccattcagaacct

SEQ ID NO: 487674 - DNA, 16 bp, R. norvegicus
cagccattctcaacct

SEQ ID NO: 487675 - DNA, 16 bp, R. norvegicus
cagccatttcagccca

SEQ ID NO: 487676 - DNA, 16 bp, R. norvegicus
cagccatttggcattt

SEQ ID NO: 487677 - DNA, 16 bp, R. norvegicus
cagccattttggaaat

SEQ ID NO: 487678 - DNA, 16 bp, R. norvegicus
cagcccaagtccacag

SEQ ID NO: 487679 - DNA, 16 bp, R. norvegicus
cagcccacagtgggca

SEQ ID NO: 487680 - DNA, 16 bp, R. norvegicus
cagcccacgccaaggt

SEQ ID NO: 487681 - DNA, 16 bp, R. norvegicus
cagcccagagacagca

SEQ ID NO: 487682 - DNA, 16 bp, R. norvegicus
cagcccagatgagaaa

SEQ ID NO: 487683 - DNA, 16 bp, R. norvegicus
cagcccagatgggaaa

SEQ ID NO: 487684 - DNA, 16 bp, R. norvegicus
cagcccagatgtccca

SEQ ID NO: 487685 - DNA, 16 bp, R. norvegicus
cagcccagcccagcag

SEQ ID NO: 487686 - DNA, 16 bp, R. norvegicus
cagcccagcccagcca

SEQ ID NO: 487687 - DNA, 16 bp, R. norvegicus
cagcccagcctggtct

SEQ ID NO: 487688 - DNA, 16 bp, R. norvegicus
cagcccagctggaaga

SEQ ID NO: 487689 - DNA, 16 bp, R. norvegicus
cagcccaggaccccag

SEQ ID NO: 487690 - DNA, 16 bp, R. norvegicus
cagcccaggcatgcag

SEQ ID NO: 487691 - DNA, 16 bp, R. norvegicus
cagcccaggctacaga

SEQ ID NO: 487692 - DNA, 16 bp, R. norvegicus
cagcccagggcagtat

SEQ ID NO: 487693 - DNA, 16 bp, R. norvegicus
cagcccagggctctat

SEQ ID NO: 487694 - DNA, 16 bp, R. norvegicus
cagcccaggggctggg

SEQ ID NO: 487695 - DNA, 16 bp, R. norvegicus
cagcccagttgcagca

SEQ ID NO: 487696 - DNA, 16 bp, R. norvegicus
cagcccatgctggact

SEQ ID NO: 487697 - DNA, 16 bp, R. norvegicus
cagcccatggtgggtg

SEQ ID NO: 487698 - DNA, 16 bp, R. norvegicus
cagcccattgtggtgg

SEQ ID NO: 487699 - DNA, 16 bp, R. norvegicus
cagcccattgttggtg

SEQ ID NO: 487700 - DNA, 16 bp, R. norvegicus
cagccccaattacatg

SEQ ID NO: 487701 - DNA, 16 bp, R. norvegicus
cagccccagcatcaaa

SEQ ID NO: 487702 - DNA, 16 bp, R. norvegicus
cagccccagccccagg

SEQ ID NO: 487703 - DNA, 16 bp, R. norvegicus
cagccccagccccagt

SEQ ID NO: 487704 - DNA, 16 bp, R. norvegicus
cagccccagctctggg

SEQ ID NO: 487705 - DNA, 16 bp, R. norvegicus
cagccccctcactggg

SEQ ID NO: 487706 - DNA, 16 bp, R. norvegicus
cagcccctgaacccca

SEQ ID NO: 487707 - DNA, 16 bp, R. norvegicus
cagcccctgcccctgc

SEQ ID NO: 487708 - DNA, 16 bp, R. norvegicus
cagcccctgctcccag

SEQ ID NO: 487709 - DNA, 16 bp, R. norvegicus
cagcccctgctcctgc

SEQ ID NO: 487710 - DNA, 16 bp, R. norvegicus
cagccccttttttttt

SEQ ID NO: 487711 - DNA, 16 bp, R. norvegicus
cagccctccatggcct

SEQ ID NO: 487712 - DNA, 16 bp, R. norvegicus
cagccctctggaccca

SEQ ID NO: 487713 - DNA, 16 bp, R. norvegicus
cagccctgaaaacaca

SEQ ID NO: 487714 - DNA, 16 bp, R. norvegicus
cagccctgactgtcct

SEQ ID NO: 487715 - DNA, 16 bp, R. norvegicus
cagccctgagtttgag

SEQ ID NO: 487716 - DNA, 16 bp, R. norvegicus
cagccctgcacctggc

SEQ ID NO: 487717 - DNA, 16 bp, R. norvegicus
cagccctgccctgccc

SEQ ID NO: 487718 - DNA, 16 bp, R. norvegicus
cagccctggctggctt

SEQ ID NO: 487719 - DNA, 16 bp, R. norvegicus
cagcccttccatggac

SEQ ID NO: 487720 - DNA, 16 bp, R. norvegicus
cagccgcagccgcagc

SEQ ID NO: 487721 - DNA, 16 bp, R. norvegicus
cagcctagaacagagc

SEQ ID NO: 487722 - DNA, 16 bp, R. norvegicus
cagcctagcctatttg

SEQ ID NO: 487723 - DNA, 16 bp, R. norvegicus
cagcctagtccacaga

SEQ ID NO: 487724 - DNA, 89 bp, R. norvegicus
cagcctataccctgtgaaagagctagaagcgctgaacctcgacagttctgaaagctctgaaaataaaaccttagactcagaggaggagg

SEQ ID NO: 487725 - DNA, 16 bp, R. norvegicus
cagcctcaagatctgg

SEQ ID NO: 487726 - DNA, 16 bp, R. norvegicus
cagcctcacaagtgct

SEQ ID NO: 487727 - DNA, 16 bp, R. norvegicus
cagcctcaccacagcc

SEQ ID NO: 487728 - DNA, 16 bp, R. norvegicus
cagcctcagaagtgcc

SEQ ID NO: 487729 - DNA, 16 bp, R. norvegicus
cagcctcagcctcagg

SEQ ID NO: 487730 - DNA, 16 bp, R. norvegicus
cagcctcagcctccag

SEQ ID NO: 487731 - DNA, 16 bp, R. norvegicus
cagcctcagttgtagt

SEQ ID NO: 487732 - DNA, 16 bp, R. norvegicus
cagcctcatgggactg

SEQ ID NO: 487733 - DNA, 16 bp, R. norvegicus
cagcctccagcctcca

SEQ ID NO: 487734 - DNA, 16 bp, R. norvegicus
cagcctccaggcaggc

SEQ ID NO: 487735 - DNA, 16 bp, R. norvegicus
cagcctcccaggtgct

SEQ ID NO: 487736 - DNA, 16 bp, R. norvegicus
cagcctccccagagct

SEQ ID NO: 487737 - DNA, 16 bp, R. norvegicus
cagcctcccttgcagc

SEQ ID NO: 487738 - DNA, 16 bp, R. norvegicus
cagcctcctccctcag

SEQ ID NO: 487739 - DNA, 16 bp, R. norvegicus
cagcctcctcctcctc

SEQ ID NO: 487740 - DNA, 16 bp, R. norvegicus
cagcctcctgcctctg

SEQ ID NO: 487741 - DNA, 16 bp, R. norvegicus
cagcctctactcctct

SEQ ID NO: 487742 - DNA, 16 bp, R. norvegicus
cagcctctcagaggac

SEQ ID NO: 487743 - DNA, 16 bp, R. norvegicus
cagcctctcctcacat

SEQ ID NO: 487744 - DNA, 16 bp, R. norvegicus
cagcctctcctctcct

SEQ ID NO: 487745 - DNA, 16 bp, R. norvegicus
cagcctctcttcctct

SEQ ID NO: 487746 - DNA, 16 bp, R. norvegicus
cagcctctgcctccag

SEQ ID NO: 487747 - DNA, 16 bp, R. norvegicus
cagcctctgctacaca

SEQ ID NO: 487748 - DNA, 16 bp, R. norvegicus
cagcctctgctggctt

SEQ ID NO: 487749 - DNA, 16 bp, R. norvegicus
cagcctctgcttctct

SEQ ID NO: 487750 - DNA, 16 bp, R. norvegicus
cagcctctgggagccc

SEQ ID NO: 487751 - DNA, 18 bp, R. norvegicus
cagcctctggtaatctca

SEQ ID NO: 487752 - DNA, 16 bp, R. norvegicus
cagcctctgtgagttc

SEQ ID NO: 487753 - DNA, 16 bp, R. norvegicus
cagcctctttatcctt

SEQ ID NO: 487754 - DNA, 16 bp, R. norvegicus
cagcctgacctacaca

SEQ ID NO: 487755 - DNA, 16 bp, R. norvegicus
cagcctgacctacaga

SEQ ID NO: 487756 - DNA, 16 bp, R. norvegicus
cagcctgagatacaca

SEQ ID NO: 487757 - DNA, 16 bp, R. norvegicus
cagcctgagctacaaa

SEQ ID NO: 487758 - DNA, 16 bp, R. norvegicus
cagcctgagctacaga

SEQ ID NO: 487759 - DNA, 16 bp, R. norvegicus
cagcctgagtccttgg

SEQ ID NO: 487760 - DNA, 16 bp, R. norvegicus
cagcctgatcttatga

SEQ ID NO: 487761 - DNA, 16 bp, R. norvegicus
cagcctgcactacttt

SEQ ID NO: 487762 - DNA, 16 bp, R. norvegicus
cagcctgcactttgct

SEQ ID NO: 487763 - DNA, 16 bp, R. norvegicus
cagcctgcagcaggag

SEQ ID NO: 487764 - DNA, 16 bp, R. norvegicus
cagcctgcagttcttt

SEQ ID NO: 487765 - DNA, 16 bp, R. norvegicus
cagcctgccaccagcc

SEQ ID NO: 487766 - DNA, 16 bp, R. norvegicus
cagcctgcccctgcct

SEQ ID NO: 487767 - DNA, 16 bp, R. norvegicus
cagcctgccttgggaa

SEQ ID NO: 487768 - DNA, 16 bp, R. norvegicus
cagcctgcctttgcct

SEQ ID NO: 487769 - DNA, 16 bp, R. norvegicus
cagcctgctctgcctg

SEQ ID NO: 487770 - DNA, 16 bp, R. norvegicus
cagcctgcttcttcag

SEQ ID NO: 487771 - DNA, 16 bp, R. norvegicus
cagcctgctttcttct

SEQ ID NO: 487772 - DNA, 16 bp, R. norvegicus
cagcctggagcctgga

SEQ ID NO: 487773 - DNA, 16 bp, R. norvegicus
cagcctggcattcccc

SEQ ID NO: 487774 - DNA, 16 bp, R. norvegicus
cagcctggctcactgg

SEQ ID NO: 487775 - DNA, 16 bp, R. norvegicus
cagcctgggacaggat

SEQ ID NO: 487776 - DNA, 16 bp, R. norvegicus
cagcctgggctacaca

SEQ ID NO: 487777 - DNA, 16 bp, R. norvegicus
cagcctgggctataaa

SEQ ID NO: 487778 - DNA, 16 bp, R. norvegicus
cagcctgggctgcaca

SEQ ID NO: 487779 - DNA, 16 bp, R. norvegicus
cagcctgggctgcata

SEQ ID NO: 487780 - DNA, 16 bp, R. norvegicus
cagcctgggcttcaca

SEQ ID NO: 487781 - DNA, 16 bp, R. norvegicus
cagcctggggataacc

SEQ ID NO: 487782 - DNA, 16 bp, R. norvegicus
cagcctggtctacata

SEQ ID NO: 487783 - DNA, 16 bp, R. norvegicus
cagcctggtctacatg

SEQ ID NO: 487784 - DNA, 16 bp, R. norvegicus
cagcctggtctaccag

SEQ ID NO: 487785 - DNA, 16 bp, R. norvegicus
cagcctggtctccatg

SEQ ID NO: 487786 - DNA, 16 bp, R. norvegicus
cagcctggtggactca

SEQ ID NO: 487787 - DNA, 16 bp, R. norvegicus
cagcctgtatatgttc

SEQ ID NO: 487788 - DNA, 16 bp, R. norvegicus
cagcctgtcagcctct

SEQ ID NO: 487789 - DNA, 16 bp, R. norvegicus
cagcctgtctgcatga

SEQ ID NO: 487790 - DNA, 16 bp, R. norvegicus
cagcctgttctacaga

SEQ ID NO: 487791 - DNA, 24 bp, R. norvegicus
cagccttatttataatagccagaa

SEQ ID NO: 487792 - DNA, 16 bp, R. norvegicus
cagccttatttatata

SEQ ID NO: 487793 - DNA, 16 bp, R. norvegicus
cagccttcagatgcag

SEQ ID NO: 487794 - DNA, 16 bp, R. norvegicus
cagccttcgccgcgcc

SEQ ID NO: 487795 - DNA, 16 bp, R. norvegicus
cagccttctgagttct

SEQ ID NO: 487796 - DNA, 16 bp, R. norvegicus
cagccttggtcagaga

SEQ ID NO: 487797 - DNA, 16 bp, R. norvegicus
cagccttgtctaatcc

SEQ ID NO: 487798 - DNA, 16 bp, R. norvegicus
cagcctttccctaatt

SEQ ID NO: 487799 - DNA, 16 bp, R. norvegicus
cagccttttactgtga

SEQ ID NO: 487800 - DNA, 16 bp, R. norvegicus
cagcgactgaaggaac

SEQ ID NO: 487801 - DNA, 17 bp, R. norvegicus
cagcgagctgctgcggg

SEQ ID NO: 487802 - DNA, 16 bp, R. norvegicus
cagcgccacctactgg

SEQ ID NO: 487803 - DNA, 16 bp, R. norvegicus
cagcgccccctgctgg

SEQ ID NO: 487804 - DNA, 16 bp, R. norvegicus
cagcgccctctgctgg

SEQ ID NO: 487805 - DNA, 16 bp, R. norvegicus
cagcggcagcagcaac

SEQ ID NO: 487806 - DNA, 16 bp, R. norvegicus
cagcggcggcggcagc

SEQ ID NO: 487807 - DNA, 16 bp, R. norvegicus
cagcgggatggaagag

SEQ ID NO: 487808 - DNA, 20 bp, R. norvegicus
cagcggtactgcacatgtgc

SEQ ID NO: 487809 - DNA, 16 bp, R. norvegicus
cagcgtgctggacttc

SEQ ID NO: 487810 - DNA, 21 bp, R. norvegicus
cagctaaccctgttgctgaag

SEQ ID NO: 487811 - DNA, 16 bp, R. norvegicus
cagctacactatgagc

SEQ ID NO: 487812 - DNA, 16 bp, R. norvegicus
cagctacagctacagc

SEQ ID NO: 487813 - DNA, 16 bp, R. norvegicus
cagctaccattaacgc

SEQ ID NO: 487814 - DNA, 16 bp, R. norvegicus
cagctactctctgagc

SEQ ID NO: 487815 - DNA, 23 bp, R. norvegicus
cagctagtacacggctggtgagg

SEQ ID NO: 487816 - DNA, 16 bp, R. norvegicus
cagctagtagaacata

SEQ ID NO: 487817 - DNA, 16 bp, R. norvegicus
cagctagtgaggccct

SEQ ID NO: 487818 - DNA, 25 bp, R. norvegicus
cagctatcaaaaacaatgactttac

SEQ ID NO: 487819 - DNA, 16 bp, R. norvegicus
cagctatcaaaaacag

SEQ ID NO: 487820 - DNA, 16 bp, R. norvegicus
cagctatcaaaaatga

SEQ ID NO: 487821 - DNA, 16 bp, R. norvegicus
cagctatcaaacacaa

SEQ ID NO: 487822 - DNA, 16 bp, R. norvegicus
cagctatcctgggttt

SEQ ID NO: 487823 - DNA, 16 bp, R. norvegicus
cagctattaaaaacag

SEQ ID NO: 487824 - DNA, 16 bp, R. norvegicus
cagctcaaagaccagt

SEQ ID NO: 487825 - DNA, 16 bp, R. norvegicus
cagctcaagggaaggc

SEQ ID NO: 487826 - DNA, 16 bp, R. norvegicus
cagctcaatggggtct

SEQ ID NO: 487827 - DNA, 16 bp, R. norvegicus
cagctcacaaacacct

SEQ ID NO: 487828 - DNA, 16 bp, R. norvegicus
cagctcacacctgtct

SEQ ID NO: 487829 - DNA, 16 bp, R. norvegicus
cagctcacagagatcc

SEQ ID NO: 487830 - DNA, 16 bp, R. norvegicus
cagctcacagccacct

SEQ ID NO: 487831 - DNA, 16 bp, R. norvegicus
cagctcagaaccacct

SEQ ID NO: 487832 - DNA, 16 bp, R. norvegicus
cagctcagagatctgc

SEQ ID NO: 487833 - DNA, 16 bp, R. norvegicus
cagctcagcacagtgc

SEQ ID NO: 487834 - DNA, 16 bp, R. norvegicus
cagctcagccacatcc

SEQ ID NO: 487835 - DNA, 16 bp, R. norvegicus
cagctcagcccagccc

SEQ ID NO: 487836 - DNA, 16 bp, R. norvegicus
cagctcagctcagcac

SEQ ID NO: 487837 - DNA, 16 bp, R. norvegicus
cagctcagctgttctg

SEQ ID NO: 487838 - DNA, 16 bp, R. norvegicus
cagctcaggaggcaga

SEQ ID NO: 487839 - DNA, 16 bp, R. norvegicus
cagctcatatgtagca

SEQ ID NO: 487840 - DNA, 16 bp, R. norvegicus
cagctcatgctggaga

SEQ ID NO: 487841 - DNA, 16 bp, R. norvegicus
cagctcatgctggtga

SEQ ID NO: 487842 - DNA, 16 bp, R. norvegicus
cagctcattgtgggtg

SEQ ID NO: 487843 - DNA, 16 bp, R. norvegicus
cagctccaagggatct

SEQ ID NO: 487844 - DNA, 16 bp, R. norvegicus
cagctccacgctgccc

SEQ ID NO: 487845 - DNA, 16 bp, R. norvegicus
cagctccagaaaaaaa

SEQ ID NO: 487846 - DNA, 16 bp, R. norvegicus
cagctccagaaaaaga

SEQ ID NO: 487847 - DNA, 16 bp, R. norvegicus
cagctccagctaacca

SEQ ID NO: 487848 - DNA, 16 bp, R. norvegicus
cagctccagcttcctg

SEQ ID NO: 487849 - DNA, 16 bp, R. norvegicus
cagctccaggaacaga

SEQ ID NO: 487850 - DNA, 16 bp, R. norvegicus
cagctccaggttcagt

SEQ ID NO: 487851 - DNA, 16 bp, R. norvegicus
cagctccagtctctcc

SEQ ID NO: 487852 - DNA, 16 bp, R. norvegicus
cagctccatgctccca

SEQ ID NO: 487853 - DNA, 16 bp, R. norvegicus
cagctcccaactgcct

SEQ ID NO: 487854 - DNA, 16 bp, R. norvegicus
cagctcccagcaccca

SEQ ID NO: 487855 - DNA, 16 bp, R. norvegicus
cagctcccagctccag

SEQ ID NO: 487856 - DNA, 16 bp, R. norvegicus
cagctccccagtaacc

SEQ ID NO: 487857 - DNA, 16 bp, R. norvegicus
cagctccccctgcacc

SEQ ID NO: 487858 - DNA, 16 bp, R. norvegicus
cagctcccgaagtgtc

SEQ ID NO: 487859 - DNA, 16 bp, R. norvegicus
cagctccctcttctgg

SEQ ID NO: 487860 - DNA, 16 bp, R. norvegicus
cagctccgtctccagc

SEQ ID NO: 487861 - DNA, 16 bp, R. norvegicus
cagctcctcctccagc

SEQ ID NO: 487862 - DNA, 16 bp, R. norvegicus
cagctcctgcatccag

SEQ ID NO: 487863 - DNA, 16 bp, R. norvegicus
cagctcctgccaccag

SEQ ID NO: 487864 - DNA, 16 bp, R. norvegicus
cagctcctgcctcaag

SEQ ID NO: 487865 - DNA, 16 bp, R. norvegicus
cagctcctgcctccag

SEQ ID NO: 487866 - DNA, 16 bp, R. norvegicus
cagctcctgccttgag

SEQ ID NO: 487867 - DNA, 16 bp, R. norvegicus
cagctcctgctcccac

SEQ ID NO: 487868 - DNA, 16 bp, R. norvegicus
cagctcctgctcctgc

SEQ ID NO: 487869 - DNA, 16 bp, R. norvegicus
cagctcctgcttctag

SEQ ID NO: 487870 - DNA, 16 bp, R. norvegicus
cagctccttcactgcc

SEQ ID NO: 487871 - DNA, 16 bp, R. norvegicus
cagctccttcagcacc

SEQ ID NO: 487872 - DNA, 16 bp, R. norvegicus
cagctccttcagtcca

SEQ ID NO: 487873 - DNA, 16 bp, R. norvegicus
cagctccttctccacc

SEQ ID NO: 487874 - DNA, 16 bp, R. norvegicus
cagctccttcttcagc

SEQ ID NO: 487875 - DNA, 16 bp, R. norvegicus
cagctccttgcaccca

SEQ ID NO: 487876 - DNA, 16 bp, R. norvegicus
cagctccttgtcactt

SEQ ID NO: 487877 - DNA, 17 bp, R. norvegicus
cagctcggccatggtga

SEQ ID NO: 487878 - DNA, 16 bp, R. norvegicus
cagctctcacctcaaa

SEQ ID NO: 487879 - DNA, 16 bp, R. norvegicus
cagctctccagctccc

SEQ ID NO: 487880 - DNA, 16 bp, R. norvegicus
cagctctccagctctc

SEQ ID NO: 487881 - DNA, 16 bp, R. norvegicus
cagctctcccacatcc

SEQ ID NO: 487882 - DNA, 16 bp, R. norvegicus
cagctctcctcagcag

SEQ ID NO: 487883 - DNA, 16 bp, R. norvegicus
cagctctcctgcctgc

SEQ ID NO: 487884 - DNA, 16 bp, R. norvegicus
cagctctcctgctctc

SEQ ID NO: 487885 - DNA, 16 bp, R. norvegicus
cagctctctacaccca

SEQ ID NO: 487886 - DNA, 16 bp, R. norvegicus
cagctctctcctccac

SEQ ID NO: 487887 - DNA, 16 bp, R. norvegicus
cagctctctccttcct

SEQ ID NO: 487888 - DNA, 16 bp, R. norvegicus
cagctctctctgggca

SEQ ID NO: 487889 - DNA, 16 bp, R. norvegicus
cagctctctctttgtt

SEQ ID NO: 487890 - DNA, 16 bp, R. norvegicus
cagctctctgagtttg

SEQ ID NO: 487891 - DNA, 16 bp, R. norvegicus
cagctctctgccccca

SEQ ID NO: 487892 - DNA, 16 bp, R. norvegicus
cagctctctgtgaggg

SEQ ID NO: 487893 - DNA, 16 bp, R. norvegicus
cagctctcttccccca

SEQ ID NO: 487894 - DNA, 16 bp, R. norvegicus
cagctctctttcccac

SEQ ID NO: 487895 - DNA, 16 bp, R. norvegicus
cagctctgaaaagaag

SEQ ID NO: 487896 - DNA, 16 bp, R. norvegicus
cagctctgaagggaaa

SEQ ID NO: 487897 - DNA, 19 bp, R. norvegicus
cagctctgcagcctcagga

SEQ ID NO: 487898 - DNA, 16 bp, R. norvegicus
cagctctgcctcctcc

SEQ ID NO: 487899 - DNA, 16 bp, R. norvegicus
cagctctgcctgcact

SEQ ID NO: 487900 - DNA, 16 bp, R. norvegicus
cagctctgcctgcccc

SEQ ID NO: 487901 - DNA, 16 bp, R. norvegicus
cagctctgctgtgctg

SEQ ID NO: 487902 - DNA, 16 bp, R. norvegicus
cagctctggacacagg

SEQ ID NO: 487903 - DNA, 16 bp, R. norvegicus
cagctctggctgtgtc

SEQ ID NO: 487904 - DNA, 16 bp, R. norvegicus
cagctctgggagcaga

SEQ ID NO: 487905 - DNA, 16 bp, R. norvegicus
cagctctgggaggcag

SEQ ID NO: 487906 - DNA, 16 bp, R. norvegicus
cagctcttcctgtacc

SEQ ID NO: 487907 - DNA, 16 bp, R. norvegicus
cagctcttctgctctc

SEQ ID NO: 487908 - DNA, 16 bp, R. norvegicus
cagctcttggcacagg

SEQ ID NO: 487909 - DNA, 16 bp, R. norvegicus
cagctctttgaaaatg

SEQ ID NO: 487910 - DNA, 16 bp, R. norvegicus
cagctgaaatgaggcc

SEQ ID NO: 487911 - DNA, 16 bp, R. norvegicus
cagctgaagccagaga

SEQ ID NO: 487912 - DNA, 16 bp, R. norvegicus
cagctgaaggagtcag

SEQ ID NO: 487913 - DNA, 16 bp, R. norvegicus
cagctgactgaggcag

SEQ ID NO: 487914 - DNA, 16 bp, R. norvegicus
cagctgagaaagaaat

SEQ ID NO: 487915 - DNA, 16 bp, R. norvegicus
cagctgagaaatcttt

SEQ ID NO: 487916 - DNA, 16 bp, R. norvegicus
cagctgagaatgattt

SEQ ID NO: 487917 - DNA, 16 bp, R. norvegicus
cagctgagacaggagg

SEQ ID NO: 487918 - DNA, 16 bp, R. norvegicus
cagctgagagacactg

SEQ ID NO: 487919 - DNA, 16 bp, R. norvegicus
cagctgagagcagagc

SEQ ID NO: 487920 - DNA, 16 bp, R. norvegicus
cagctgagatgagtcc

SEQ ID NO: 487921 - DNA, 16 bp, R. norvegicus
cagctgaggaatggct

SEQ ID NO: 487922 - DNA, 16 bp, R. norvegicus
cagctgaggaccaagt

SEQ ID NO: 487923 - DNA, 18 bp, R. norvegicus
cagctgaggagaaccaga

SEQ ID NO: 487924 - DNA, 16 bp, R. norvegicus
cagctgagggacatct

SEQ ID NO: 487925 - DNA, 16 bp, R. norvegicus
cagctgagtctcatgg

SEQ ID NO: 487926 - DNA, 16 bp, R. norvegicus
cagctgatgctcttaa

SEQ ID NO: 487927 - DNA, 16 bp, R. norvegicus
cagctgatggagacag

SEQ ID NO: 487928 - DNA, 23 bp, R. norvegicus
cagctgcagaagactaatacaaa

SEQ ID NO: 487929 - DNA, 16 bp, R. norvegicus
cagctgcagaaggcta

SEQ ID NO: 487930 - DNA, 16 bp, R. norvegicus
cagctgcagatagttt

SEQ ID NO: 487931 - DNA, 16 bp, R. norvegicus
cagctgcagcacgagg

SEQ ID NO: 487932 - DNA, 16 bp, R. norvegicus
cagctgcagcagcaac

SEQ ID NO: 487933 - DNA, 16 bp, R. norvegicus
cagctgcagcaggacc

SEQ ID NO: 487934 - DNA, 16 bp, R. norvegicus
cagctgcagcaggagg

SEQ ID NO: 487935 - DNA, 16 bp, R. norvegicus
cagctgcagccatggg

SEQ ID NO: 487936 - DNA, 16 bp, R. norvegicus
cagctgccacccaggc

SEQ ID NO: 487937 - DNA, 16 bp, R. norvegicus
cagctgccatccttcc

SEQ ID NO: 487938 - DNA, 16 bp, R. norvegicus
cagctgccctgactct

SEQ ID NO: 487939 - DNA, 16 bp, R. norvegicus
cagctgcctcacactc

SEQ ID NO: 487940 - DNA, 16 bp, R. norvegicus
cagctgcctctctgct

SEQ ID NO: 487941 - DNA, 16 bp, R. norvegicus
cagctgcctgagtggc

SEQ ID NO: 487942 - DNA, 16 bp, R. norvegicus
cagctgcctgctgcca

SEQ ID NO: 487943 - DNA, 16 bp, R. norvegicus
cagctgcctttgagtc

SEQ ID NO: 487944 - DNA, 16 bp, R. norvegicus
cagctgcggtccatgt

SEQ ID NO: 487945 - DNA, 16 bp, R. norvegicus
cagctgctaccaccaa

SEQ ID NO: 487946 - DNA, 16 bp, R. norvegicus
cagctgctcctggact

SEQ ID NO: 487947 - DNA, 16 bp, R. norvegicus
cagctgctcttctgta

SEQ ID NO: 487948 - DNA, 16 bp, R. norvegicus
cagctgctgattcatg

SEQ ID NO: 487949 - DNA, 16 bp, R. norvegicus
cagctgctgcagacag

SEQ ID NO: 487950 - DNA, 16 bp, R. norvegicus
cagctgctgcctccag

SEQ ID NO: 487951 - DNA, 16 bp, R. norvegicus
cagctgctgctgcttc

SEQ ID NO: 487952 - DNA, 16 bp, R. norvegicus
cagctgctgctgggag

SEQ ID NO: 487953 - DNA, 16 bp, R. norvegicus
cagctgctgcttcctg

SEQ ID NO: 487954 - DNA, 16 bp, R. norvegicus
cagctgctggaggaag

SEQ ID NO: 487955 - DNA, 16 bp, R. norvegicus
cagctgctggatgaaa

SEQ ID NO: 487956 - DNA, 16 bp, R. norvegicus
cagctgctggatgaag

SEQ ID NO: 487957 - DNA, 16 bp, R. norvegicus
cagctgctggtggagc

SEQ ID NO: 487958 - DNA, 16 bp, R. norvegicus
cagctgctgtggacaa

SEQ ID NO: 487959 - DNA, 16 bp, R. norvegicus
cagctgctgtggacag

SEQ ID NO: 487960 - DNA, 16 bp, R. norvegicus
cagctggaaagatggc

SEQ ID NO: 487961 - DNA, 16 bp, R. norvegicus
cagctggaaccatggg

SEQ ID NO: 487962 - DNA, 16 bp, R. norvegicus
cagctggacacacagc

SEQ ID NO: 487963 - DNA, 16 bp, R. norvegicus
cagctggagaccaagt

SEQ ID NO: 487964 - DNA, 16 bp, R. norvegicus
cagctggagccttggg

SEQ ID NO: 487965 - DNA, 16 bp, R. norvegicus
cagctggaggagttct

SEQ ID NO: 487966 - DNA, 16 bp, R. norvegicus
cagctggaggctcagc

SEQ ID NO: 487967 - DNA, 16 bp, R. norvegicus
cagctggatctcaagg

SEQ ID NO: 487968 - DNA, 16 bp, R. norvegicus
cagctggatctctgag

SEQ ID NO: 487969 - DNA, 16 bp, R. norvegicus
cagctgggaaaactcc

SEQ ID NO: 487970 - DNA, 16 bp, R. norvegicus
cagctgggaggtggtg

SEQ ID NO: 487971 - DNA, 16 bp, R. norvegicus
cagctgggcctggtgg

SEQ ID NO: 487972 - DNA, 16 bp, R. norvegicus
cagctgggctggcagc

SEQ ID NO: 487973 - DNA, 16 bp, R. norvegicus
cagctggggagatggc

SEQ ID NO: 487974 - DNA, 16 bp, R. norvegicus
cagctggggctgaaga

SEQ ID NO: 487975 - DNA, 16 bp, R. norvegicus
cagctgggtcttcatg

SEQ ID NO: 487976 - DNA, 16 bp, R. norvegicus
cagctggtcacatggt

SEQ ID NO: 487977 - DNA, 16 bp, R. norvegicus
cagctggtgtctgctg

SEQ ID NO: 487978 - DNA, 18 bp, R. norvegicus
cagctgtccaccatgaga

SEQ ID NO: 487979 - DNA, 16 bp, R. norvegicus
cagctgtctataactc

SEQ ID NO: 487980 - DNA, 16 bp, R. norvegicus
cagctgtctcaagctc

SEQ ID NO: 487981 - DNA, 16 bp, R. norvegicus
cagctgtgagctgccc

SEQ ID NO: 487982 - DNA, 16 bp, R. norvegicus
cagctgtgatgagctg

SEQ ID NO: 487983 - DNA, 16 bp, R. norvegicus
cagctgtgctggcttc

SEQ ID NO: 487984 - DNA, 16 bp, R. norvegicus
cagctgtgttcagcct

SEQ ID NO: 487985 - DNA, 16 bp, R. norvegicus
cagctgttagaaatat

SEQ ID NO: 487986 - DNA, 16 bp, R. norvegicus
cagctgttcatgtggg

SEQ ID NO: 487987 - DNA, 16 bp, R. norvegicus
cagcttaaaggaggaa

SEQ ID NO: 487988 - DNA, 16 bp, R. norvegicus
cagcttataaagacaa

SEQ ID NO: 487989 - DNA, 16 bp, R. norvegicus
cagcttcagaaaaaaa

SEQ ID NO: 487990 - DNA, 16 bp, R. norvegicus
cagcttcagccacatg

SEQ ID NO: 487991 - DNA, 16 bp, R. norvegicus
cagcttcagggaatcc

SEQ ID NO: 487992 - DNA, 16 bp, R. norvegicus
cagcttccagcaagca

SEQ ID NO: 487993 - DNA, 16 bp, R. norvegicus
cagcttcccagagatg

SEQ ID NO: 487994 - DNA, 16 bp, R. norvegicus
cagcttcctcctccag

SEQ ID NO: 487995 - DNA, 16 bp, R. norvegicus
cagcttcctgagttct

SEQ ID NO: 487996 - DNA, 16 bp, R. norvegicus
cagcttcctgattttc

SEQ ID NO: 487997 - DNA, 16 bp, R. norvegicus
cagcttcctgttcctg

SEQ ID NO: 487998 - DNA, 16 bp, R. norvegicus
cagcttcctttctcct

SEQ ID NO: 487999 - DNA, 16 bp, R. norvegicus
cagcttctacagaaga

SEQ ID NO: 488000 - DNA, 16 bp, R. norvegicus
cagcttctgcttctgc

SEQ ID NO: 488001 - DNA, 16 bp, R. norvegicus
cagcttctggcctcag

SEQ ID NO: 488002 - DNA, 16 bp, R. norvegicus
cagcttctgtctatta

SEQ ID NO: 488003 - DNA, 16 bp, R. norvegicus
cagcttctgtctccag

SEQ ID NO: 488004 - DNA, 16 bp, R. norvegicus
cagcttcttccagatt

SEQ ID NO: 488005 - DNA, 16 bp, R. norvegicus
cagcttctttgtgctc

SEQ ID NO: 488006 - DNA, 16 bp, R. norvegicus
cagcttgactcccagg

SEQ ID NO: 488007 - DNA, 16 bp, R. norvegicus
cagcttgactgcccct

SEQ ID NO: 488008 - DNA, 16 bp, R. norvegicus
cagcttgatctacaga

SEQ ID NO: 488009 - DNA, 16 bp, R. norvegicus
cagcttgctctgggga

SEQ ID NO: 488010 - DNA, 16 bp, R. norvegicus
cagcttgcttctccag

SEQ ID NO: 488011 - DNA, 16 bp, R. norvegicus
cagcttggtctataaa

SEQ ID NO: 488012 - DNA, 16 bp, R. norvegicus
cagctttattcagagc

SEQ ID NO: 488013 - DNA, 16 bp, R. norvegicus
cagctttccttggcag

SEQ ID NO: 488014 - DNA, 16 bp, R. norvegicus
cagctttctgcctgca

SEQ ID NO: 488015 - DNA, 16 bp, R. norvegicus
cagcttttcttagctg

SEQ ID NO: 488016 - DNA, 16 bp, R. norvegicus
cagcttttctttcttc

SEQ ID NO: 488017 - DNA, 16 bp, R. norvegicus
cagcttttgttgttgt

SEQ ID NO: 488018 - DNA, 16 bp, R. norvegicus
caggaaaaaacatggg

SEQ ID NO: 488019 - DNA, 16 bp, R. norvegicus
caggaaaaactacatg

SEQ ID NO: 488020 - DNA, 16 bp, R. norvegicus
caggaaaacacttctt

SEQ ID NO: 488021 - DNA, 16 bp, R. norvegicus
caggaaaacaggaagg

SEQ ID NO: 488022 - DNA, 16 bp, R. norvegicus
caggaaaacattaaca

SEQ ID NO: 488023 - DNA, 16 bp, R. norvegicus
caggaaaaccctaaga

SEQ ID NO: 488024 - DNA, 16 bp, R. norvegicus
caggaaaagagccaag

SEQ ID NO: 488025 - DNA, 16 bp, R. norvegicus
caggaaaagctgaaga

SEQ ID NO: 488026 - DNA, 16 bp, R. norvegicus
caggaaacacactcag

SEQ ID NO: 488027 - DNA, 16 bp, R. norvegicus
caggaaacagagaagg

SEQ ID NO: 488028 - DNA, 16 bp, R. norvegicus
caggaaacccaggaca

SEQ ID NO: 488029 - DNA, 16 bp, R. norvegicus
caggaaactgagaaag

SEQ ID NO: 488030 - DNA, 16 bp, R. norvegicus
caggaaagaagtcagc

SEQ ID NO: 488031 - DNA, 16 bp, R. norvegicus
caggaaagactacaag

SEQ ID NO: 488032 - DNA, 16 bp, R. norvegicus
caggaaagcaaaaggc

SEQ ID NO: 488033 - DNA, 16 bp, R. norvegicus
caggaaagccagagct

SEQ ID NO: 488034 - DNA, 16 bp, R. norvegicus
caggaaagccaggact

SEQ ID NO: 488035 - DNA, 16 bp, R. norvegicus
caggaaaggaagcaga

SEQ ID NO: 488036 - DNA, 16 bp, R. norvegicus
caggaaaggagatgga

SEQ ID NO: 488037 - DNA, 16 bp, R. norvegicus
caggaaagtaagaggc

SEQ ID NO: 488038 - DNA, 16 bp, R. norvegicus
caggaaatcaagcagg

SEQ ID NO: 488039 - DNA, 16 bp, R. norvegicus
caggaaatcaaggaca

SEQ ID NO: 488040 - DNA, 16 bp, R. norvegicus
caggaaatccaggaga

SEQ ID NO: 488041 - DNA, 16 bp, R. norvegicus
caggaaatccgggaca

SEQ ID NO: 488042 - DNA, 16 bp, R. norvegicus
caggaaatgtacctca

SEQ ID NO: 488043 - DNA, 16 bp, R. norvegicus
caggaaatttggaaca

SEQ ID NO: 488044 - DNA, 16 bp, R. norvegicus
caggaaattttttaca

SEQ ID NO: 488045 - DNA, 16 bp, R. norvegicus
caggaacaactgaaga

SEQ ID NO: 488046 - DNA, 16 bp, R. norvegicus
caggaacaagacaaag

SEQ ID NO: 488047 - DNA, 17 bp, R. norvegicus
caggaacacaagcaaca

SEQ ID NO: 488048 - DNA, 16 bp, R. norvegicus
caggaacacaagcagg

SEQ ID NO: 488049 - DNA, 16 bp, R. norvegicus
caggaacacacaggaa

SEQ ID NO: 488050 - DNA, 16 bp, R. norvegicus
caggaacacagagaaa

SEQ ID NO: 488051 - DNA, 16 bp, R. norvegicus
caggaacacctgaaga

SEQ ID NO: 488052 - DNA, 16 bp, R. norvegicus
caggaacagaccataa

SEQ ID NO: 488053 - DNA, 16 bp, R. norvegicus
caggaacagaggcagg

SEQ ID NO: 488054 - DNA, 16 bp, R. norvegicus
caggaacagatgaaga

SEQ ID NO: 488055 - DNA, 16 bp, R. norvegicus
caggaacagatgcaga

SEQ ID NO: 488056 - DNA, 16 bp, R. norvegicus
caggaacagcagaaga

SEQ ID NO: 488057 - DNA, 16 bp, R. norvegicus
caggaacagcagcagc

SEQ ID NO: 488058 - DNA, 16 bp, R. norvegicus
caggaacagctaaaga

SEQ ID NO: 488059 - DNA, 16 bp, R. norvegicus
caggaacagctgaaca

SEQ ID NO: 488060 - DNA, 16 bp, R. norvegicus
caggaacagctgaaga

SEQ ID NO: 488061 - DNA, 16 bp, R. norvegicus
caggaacagctgaagg

SEQ ID NO: 488062 - DNA, 16 bp, R. norvegicus
caggaacagctggaga

SEQ ID NO: 488063 - DNA, 16 bp, R. norvegicus
caggaacatgaggcag

SEQ ID NO: 488064 - DNA, 16 bp, R. norvegicus
caggaaccagcagcag

SEQ ID NO: 488065 - DNA, 16 bp, R. norvegicus
caggaacctccatatt

SEQ ID NO: 488066 - DNA, 16 bp, R. norvegicus
caggaacctctctgtg

SEQ ID NO: 488067 - DNA, 16 bp, R. norvegicus
caggaacctgacatag

SEQ ID NO: 488068 - DNA, 16 bp, R. norvegicus
caggaacctggagcag

SEQ ID NO: 488069 - DNA, 16 bp, R. norvegicus
caggaacctggaggaa

SEQ ID NO: 488070 - DNA, 16 bp, R. norvegicus
caggaacctgggagca

SEQ ID NO: 488071 - DNA, 16 bp, R. norvegicus
caggaacctggtatgg

SEQ ID NO: 488072 - DNA, 16 bp, R. norvegicus
caggaactcaagattg

SEQ ID NO: 488073 - DNA, 16 bp, R. norvegicus
caggaactcaagcagg

SEQ ID NO: 488074 - DNA, 16 bp, R. norvegicus
caggaactcacacaga

SEQ ID NO: 488075 - DNA, 16 bp, R. norvegicus
caggaactcaggcaga

SEQ ID NO: 488076 - DNA, 16 bp, R. norvegicus
caggaactcaggcagg

SEQ ID NO: 488077 - DNA, 16 bp, R. norvegicus
caggaactccaacagg

SEQ ID NO: 488078 - DNA, 16 bp, R. norvegicus
caggaactccaggcag

SEQ ID NO: 488079 - DNA, 16 bp, R. norvegicus
caggaactcctgactc

SEQ ID NO: 488080 - DNA, 16 bp, R. norvegicus
caggaactctggaact

SEQ ID NO: 488081 - DNA, 16 bp, R. norvegicus
caggaactgaaacaga

SEQ ID NO: 488082 - DNA, 16 bp, R. norvegicus
caggaactgaaagttc

SEQ ID NO: 488083 - DNA, 16 bp, R. norvegicus
caggaactgaacccag

SEQ ID NO: 488084 - DNA, 16 bp, R. norvegicus
caggaactgaactcag

SEQ ID NO: 488085 - DNA, 16 bp, R. norvegicus
caggaactgaagcaaa

SEQ ID NO: 488086 - DNA, 16 bp, R. norvegicus
caggaactgaagcaga

SEQ ID NO: 488087 - DNA, 16 bp, R. norvegicus
caggaactgaagttac

SEQ ID NO: 488088 - DNA, 16 bp, R. norvegicus
caggaactggaggaga

SEQ ID NO: 488089 - DNA, 16 bp, R. norvegicus
caggaactggaggcag

SEQ ID NO: 488090 - DNA, 16 bp, R. norvegicus
caggaactgggaggca

SEQ ID NO: 488091 - DNA, 16 bp, R. norvegicus
caggaagaaacaatca

SEQ ID NO: 488092 - DNA, 16 bp, R. norvegicus
caggaagaaacaggag

SEQ ID NO: 488093 - DNA, 16 bp, R. norvegicus
caggaagaaactgaag

SEQ ID NO: 488094 - DNA, 16 bp, R. norvegicus
caggaagaaactggaa

SEQ ID NO: 488095 - DNA, 16 bp, R. norvegicus
caggaagaacaatatc

SEQ ID NO: 488096 - DNA, 16 bp, R. norvegicus
caggaagaactagaaa

SEQ ID NO: 488097 - DNA, 16 bp, R. norvegicus
caggaagaagctgagg

SEQ ID NO: 488098 - DNA, 16 bp, R. norvegicus
caggaagaagctggag

SEQ ID NO: 488099 - DNA, 16 bp, R. norvegicus
caggaagaatggaaat

SEQ ID NO: 488100 - DNA, 16 bp, R. norvegicus
caggaagaattctgga

SEQ ID NO: 488101 - DNA, 16 bp, R. norvegicus
caggaagaccaacaat

SEQ ID NO: 488102 - DNA, 16 bp, R. norvegicus
caggaagaccaacagc

SEQ ID NO: 488103 - DNA, 16 bp, R. norvegicus
caggaagaccagcaga

SEQ ID NO: 488104 - DNA, 16 bp, R. norvegicus
caggaagacctggtgc

SEQ ID NO: 488105 - DNA, 16 bp, R. norvegicus
caggaagacttgtgct

SEQ ID NO: 488106 - DNA, 16 bp, R. norvegicus
caggaagagagaggca

SEQ ID NO: 488107 - DNA, 16 bp, R. norvegicus
caggaagagatggaga

SEQ ID NO: 488108 - DNA, 16 bp, R. norvegicus
caggaagagcagaaag

SEQ ID NO: 488109 - DNA, 16 bp, R. norvegicus
caggaagagcagtcag

SEQ ID NO: 488110 - DNA, 16 bp, R. norvegicus
caggaagagctgaaga

SEQ ID NO: 488111 - DNA, 16 bp, R. norvegicus
caggaagattgctgtg

SEQ ID NO: 488112 - DNA, 16 bp, R. norvegicus
caggaagcaaaaattt

SEQ ID NO: 488113 - DNA, 16 bp, R. norvegicus
caggaagcagaagcag

SEQ ID NO: 488114 - DNA, 16 bp, R. norvegicus
caggaagcagaaggag

SEQ ID NO: 488115 - DNA, 16 bp, R. norvegicus
caggaagcagagaaag

SEQ ID NO: 488116 - DNA, 16 bp, R. norvegicus
caggaagcagagaagg

SEQ ID NO: 488117 - DNA, 16 bp, R. norvegicus
caggaagcagagagag

SEQ ID NO: 488118 - DNA, 16 bp, R. norvegicus
caggaagcagagaggg

SEQ ID NO: 488119 - DNA, 16 bp, R. norvegicus
caggaagcagaggaag

SEQ ID NO: 488120 - DNA, 16 bp, R. norvegicus
caggaagcagcaccct

SEQ ID NO: 488121 - DNA, 16 bp, R. norvegicus
caggaagcagcttctc

SEQ ID NO: 488122 - DNA, 16 bp, R. norvegicus
caggaagcaggaagaa

SEQ ID NO: 488123 - DNA, 16 bp, R. norvegicus
caggaagcagggagag

SEQ ID NO: 488124 - DNA, 16 bp, R. norvegicus
caggaagcagggcagc

SEQ ID NO: 488125 - DNA, 16 bp, R. norvegicus
caggaagccaaggcag

SEQ ID NO: 488126 - DNA, 16 bp, R. norvegicus
caggaagccactgcct

SEQ ID NO: 488127 - DNA, 16 bp, R. norvegicus
caggaagccaggaaaa

SEQ ID NO: 488128 - DNA, 16 bp, R. norvegicus
caggaagcccagctca

SEQ ID NO: 488129 - DNA, 16 bp, R. norvegicus
caggaagccctcaaac

SEQ ID NO: 488130 - DNA, 16 bp, R. norvegicus
caggaagctgaagaag

SEQ ID NO: 488131 - DNA, 16 bp, R. norvegicus
caggaagctggagcag

SEQ ID NO: 488132 - DNA, 16 bp, R. norvegicus
caggaagctggagctg

SEQ ID NO: 488133 - DNA, 16 bp, R. norvegicus
caggaagctgggaaag

SEQ ID NO: 488134 - DNA, 16 bp, R. norvegicus
caggaaggaaggccca

SEQ ID NO: 488135 - DNA, 16 bp, R. norvegicus
caggaaggaggaaggc

SEQ ID NO: 488136 - DNA, 16 bp, R. norvegicus
caggaaggaggcagag

SEQ ID NO: 488137 - DNA, 16 bp, R. norvegicus
caggaaggccacctgc

SEQ ID NO: 488138 - DNA, 16 bp, R. norvegicus
caggaaggctactgat

SEQ ID NO: 488139 - DNA, 16 bp, R. norvegicus
caggaaggtcaagcca

SEQ ID NO: 488140 - DNA, 16 bp, R. norvegicus
caggaagtaatcaaac

SEQ ID NO: 488141 - DNA, 16 bp, R. norvegicus
caggaagtccctgaaa

SEQ ID NO: 488142 - DNA, 16 bp, R. norvegicus
caggaagtccctgaag

SEQ ID NO: 488143 - DNA, 16 bp, R. norvegicus
caggaagtgaaatgga

SEQ ID NO: 488144 - DNA, 16 bp, R. norvegicus
caggaagtgaggcaga

SEQ ID NO: 488145 - DNA, 16 bp, R. norvegicus
caggaagtggagacag

SEQ ID NO: 488146 - DNA, 16 bp, R. norvegicus
caggaagtggggagag

SEQ ID NO: 488147 - DNA, 16 bp, R. norvegicus
caggaagtttccactg

SEQ ID NO: 488148 - DNA, 16 bp, R. norvegicus
caggaatcacgaggag

SEQ ID NO: 488149 - DNA, 16 bp, R. norvegicus
caggaatccacctgtc

SEQ ID NO: 488150 - DNA, 16 bp, R. norvegicus
caggaatgcagggatg

SEQ ID NO: 488151 - DNA, 16 bp, R. norvegicus
caggaatgtgagcaga

SEQ ID NO: 488152 - DNA, 16 bp, R. norvegicus
caggaattcaaggacc

SEQ ID NO: 488153 - DNA, 16 bp, R. norvegicus
caggaattcaaggccc

SEQ ID NO: 488154 - DNA, 16 bp, R. norvegicus
caggaattcaaggctg

SEQ ID NO: 488155 - DNA, 16 bp, R. norvegicus
caggaattccactgtc

SEQ ID NO: 488156 - DNA, 16 bp, R. norvegicus
caggaattgaggtaaa

SEQ ID NO: 488157 - DNA, 16 bp, R. norvegicus
caggaatttttctcca

SEQ ID NO: 488158 - DNA, 16 bp, R. norvegicus
caggacaaaacagcaa

SEQ ID NO: 488159 - DNA, 16 bp, R. norvegicus
caggacaaccagggtt

SEQ ID NO: 488160 - DNA, 16 bp, R. norvegicus
caggacaacctgggct

SEQ ID NO: 488161 - DNA, 16 bp, R. norvegicus
caggacaatcagaggc

SEQ ID NO: 488162 - DNA, 17 bp, R. norvegicus
caggacaatggaggctg

SEQ ID NO: 488163 - DNA, 16 bp, R. norvegicus
caggacacagaagcag

SEQ ID NO: 488164 - DNA, 16 bp, R. norvegicus
caggacacagcagaac

SEQ ID NO: 488165 - DNA, 16 bp, R. norvegicus
caggacacagtaacct

SEQ ID NO: 488166 - DNA, 16 bp, R. norvegicus
caggacacccagggct

SEQ ID NO: 488167 - DNA, 16 bp, R. norvegicus
caggacagaagaatgg

SEQ ID NO: 488168 - DNA, 16 bp, R. norvegicus
caggacagagaaaccc

SEQ ID NO: 488169 - DNA, 16 bp, R. norvegicus
caggacagcacagacc

SEQ ID NO: 488170 - DNA, 16 bp, R. norvegicus
caggacagcaggacag

SEQ ID NO: 488171 - DNA, 16 bp, R. norvegicus
caggacagcatggcca

SEQ ID NO: 488172 - DNA, 16 bp, R. norvegicus
caggacagctggggct

SEQ ID NO: 488173 - DNA, 16 bp, R. norvegicus
caggacaggaaccagg

SEQ ID NO: 488174 - DNA, 16 bp, R. norvegicus
caggacaggacagaac

SEQ ID NO: 488175 - DNA, 16 bp, R. norvegicus
caggacaggacagcca

SEQ ID NO: 488176 - DNA, 16 bp, R. norvegicus
caggacagggaaaagc

SEQ ID NO: 488177 - DNA, 16 bp, R. norvegicus
caggacagggaggcag

SEQ ID NO: 488178 - DNA, 16 bp, R. norvegicus
caggacagtcagggct

SEQ ID NO: 488179 - DNA, 16 bp, R. norvegicus
caggacatccaggact

SEQ ID NO: 488180 - DNA, 16 bp, R. norvegicus
caggacatccagggct

SEQ ID NO: 488181 - DNA, 16 bp, R. norvegicus
caggaccaaaggcctc

SEQ ID NO: 488182 - DNA, 16 bp, R. norvegicus
caggaccaaggacctt

SEQ ID NO: 488183 - DNA, 16 bp, R. norvegicus
caggaccaagggcttc

SEQ ID NO: 488184 - DNA, 16 bp, R. norvegicus
caggaccacacacaca

SEQ ID NO: 488185 - DNA, 16 bp, R. norvegicus
caggaccaccagccta

SEQ ID NO: 488186 - DNA, 16 bp, R. norvegicus
caggaccacctgcctg

SEQ ID NO: 488187 - DNA, 16 bp, R. norvegicus
caggaccagccccttc

SEQ ID NO: 488188 - DNA, 16 bp, R. norvegicus
caggaccaggggcctc

SEQ ID NO: 488189 - DNA, 16 bp, R. norvegicus
caggaccatcagccta

SEQ ID NO: 488190 - DNA, 16 bp, R. norvegicus
caggaccatgcctgcc

SEQ ID NO: 488191 - DNA, 16 bp, R. norvegicus
caggacccaacatgga

SEQ ID NO: 488192 - DNA, 16 bp, R. norvegicus
caggacccacatcagg

SEQ ID NO: 488193 - DNA, 16 bp, R. norvegicus
caggacccaggcagct

SEQ ID NO: 488194 - DNA, 16 bp, R. norvegicus
caggacccaggccttc

SEQ ID NO: 488195 - DNA, 16 bp, R. norvegicus
caggacctaaaaatgg

SEQ ID NO: 488196 - DNA, 40 bp, R. norvegicus
caggacctacctcttcacaggatctgcactgttgcagcaa

SEQ ID NO: 488197 - DNA, 16 bp, R. norvegicus
caggacctccaggagg

SEQ ID NO: 488198 - DNA, 16 bp, R. norvegicus
caggacctctggagag

SEQ ID NO: 488199 - DNA, 16 bp, R. norvegicus
caggacctgaagcaga

SEQ ID NO: 488200 - DNA, 16 bp, R. norvegicus
caggacctggaggcag

SEQ ID NO: 488201 - DNA, 16 bp, R. norvegicus
caggaccttgtgcatg

SEQ ID NO: 488202 - DNA, 16 bp, R. norvegicus
caggacctttggaaaa

SEQ ID NO: 488203 - DNA, 16 bp, R. norvegicus
caggactacaaagaga

SEQ ID NO: 488204 - DNA, 24 bp, R. norvegicus
caggactacagctctcagagacag

SEQ ID NO: 488205 - DNA, 16 bp, R. norvegicus
caggactacatagcaa

SEQ ID NO: 488206 - DNA, 16 bp, R. norvegicus
caggactcaaactcag

SEQ ID NO: 488207 - DNA, 16 bp, R. norvegicus
caggactcagagggag

SEQ ID NO: 488208 - DNA, 16 bp, R. norvegicus
caggactccagaggca

SEQ ID NO: 488209 - DNA, 16 bp, R. norvegicus
caggactcctggaaga

SEQ ID NO: 488210 - DNA, 16 bp, R. norvegicus
caggactctgaagaaa

SEQ ID NO: 488211 - DNA, 16 bp, R. norvegicus
caggactgaagccctg

SEQ ID NO: 488212 - DNA, 16 bp, R. norvegicus
caggactgcagtagta

SEQ ID NO: 488213 - DNA, 16 bp, R. norvegicus
caggactgccaggact

SEQ ID NO: 488214 - DNA, 16 bp, R. norvegicus
caggactgccagggct

SEQ ID NO: 488215 - DNA, 16 bp, R. norvegicus
caggactgtgtgtgtg

SEQ ID NO: 488216 - DNA, 16 bp, R. norvegicus
caggacttcctggttg

SEQ ID NO: 488217 - DNA, 16 bp, R. norvegicus
caggacttctgggtcc

SEQ ID NO: 488218 - DNA, 16 bp, R. norvegicus
caggacttgaactcag

SEQ ID NO: 488219 - DNA, 16 bp, R. norvegicus
caggacttttatcctg

SEQ ID NO: 488220 - DNA, 16 bp, R. norvegicus
caggagaaaatttaga

SEQ ID NO: 488221 - DNA, 16 bp, R. norvegicus
caggagaaagaagacc

SEQ ID NO: 488222 - DNA, 16 bp, R. norvegicus
caggagaaagaatgtt

SEQ ID NO: 488223 - DNA, 16 bp, R. norvegicus
caggagaaatagtctt

SEQ ID NO: 488224 - DNA, 16 bp, R. norvegicus
caggagaagagtgtgg

SEQ ID NO: 488225 - DNA, 16 bp, R. norvegicus
caggagaagcagagag

SEQ ID NO: 488226 - DNA, 16 bp, R. norvegicus
caggagaagctgagct

SEQ ID NO: 488227 - DNA, 16 bp, R. norvegicus
caggagaaggagcagg

SEQ ID NO: 488228 - DNA, 16 bp, R. norvegicus
caggagaaggcaggag

SEQ ID NO: 488229 - DNA, 16 bp, R. norvegicus
caggagaaggcatcag

SEQ ID NO: 488230 - DNA, 16 bp, R. norvegicus
caggagaatctctgtg

SEQ ID NO: 488231 - DNA, 16 bp, R. norvegicus
caggagacagaagcaa

SEQ ID NO: 488232 - DNA, 16 bp, R. norvegicus
caggagacagactgtg

SEQ ID NO: 488233 - DNA, 16 bp, R. norvegicus
caggagacagaggaga

SEQ ID NO: 488234 - DNA, 16 bp, R. norvegicus
caggagacaggagaca

SEQ ID NO: 488235 - DNA, 16 bp, R. norvegicus
caggagagaaaccctg

SEQ ID NO: 488236 - DNA, 16 bp, R. norvegicus
caggagagaaagcagc

SEQ ID NO: 488237 - DNA, 16 bp, R. norvegicus
caggagagaagccctg

SEQ ID NO: 488238 - DNA, 16 bp, R. norvegicus
caggagagaaggccag

SEQ ID NO: 488239 - DNA, 16 bp, R. norvegicus
caggagagaggatgct

SEQ ID NO: 488240 - DNA, 16 bp, R. norvegicus
caggagagatttacat

SEQ ID NO: 488241 - DNA, 16 bp, R. norvegicus
caggagagccagggct

SEQ ID NO: 488242 - DNA, 16 bp, R. norvegicus
caggagaggacatcag

SEQ ID NO: 488243 - DNA, 16 bp, R. norvegicus
caggagaggcaggaga

SEQ ID NO: 488244 - DNA, 16 bp, R. norvegicus
caggagaggctgcaga

SEQ ID NO: 488245 - DNA, 16 bp, R. norvegicus
caggagagggactcag

SEQ ID NO: 488246 - DNA, 16 bp, R. norvegicus
caggagagtgaggcag

SEQ ID NO: 488247 - DNA, 16 bp, R. norvegicus
caggagatctactgca

SEQ ID NO: 488248 - DNA, 16 bp, R. norvegicus
caggagatggaagaga

SEQ ID NO: 488249 - DNA, 16 bp, R. norvegicus
caggagcaacttcagc

SEQ ID NO: 488250 - DNA, 16 bp, R. norvegicus
caggagcacaaagcag

SEQ ID NO: 488251 - DNA, 16 bp, R. norvegicus
caggagcaccaccaca

SEQ ID NO: 488252 - DNA, 16 bp, R. norvegicus
caggagcactggctct

SEQ ID NO: 488253 - DNA, 16 bp, R. norvegicus
caggagcagaagatta

SEQ ID NO: 488254 - DNA, 16 bp, R. norvegicus
caggagcagaagcaga

SEQ ID NO: 488255 - DNA, 16 bp, R. norvegicus
caggagcagaaggacc

SEQ ID NO: 488256 - DNA, 16 bp, R. norvegicus
caggagcagactggct

SEQ ID NO: 488257 - DNA, 16 bp, R. norvegicus
caggagcagcaggtcc

SEQ ID NO: 488258 - DNA, 16 bp, R. norvegicus
caggagcaggaagctg

SEQ ID NO: 488259 - DNA, 16 bp, R. norvegicus
caggagcaggagcagg

SEQ ID NO: 488260 - DNA, 16 bp, R. norvegicus
caggagcaggaggaga

SEQ ID NO: 488261 - DNA, 19 bp, R. norvegicus
caggagccaaaaactaaaa

SEQ ID NO: 488262 - DNA, 16 bp, R. norvegicus
caggagccaacatcaa

SEQ ID NO: 488263 - DNA, 16 bp, R. norvegicus
caggagccagggcttc

SEQ ID NO: 488264 - DNA, 16 bp, R. norvegicus
caggagccgcaggacc

SEQ ID NO: 488265 - DNA, 16 bp, R. norvegicus
caggagccggatgaag

SEQ ID NO: 488266 - DNA, 16 bp, R. norvegicus
caggagcctatcctgg

SEQ ID NO: 488267 - DNA, 16 bp, R. norvegicus
caggagcctggagaca

SEQ ID NO: 488268 - DNA, 16 bp, R. norvegicus
caggagcctggtgtag

SEQ ID NO: 488269 - DNA, 16 bp, R. norvegicus
caggagccttccatcc

SEQ ID NO: 488270 - DNA, 16 bp, R. norvegicus
caggagcggatgcaga

SEQ ID NO: 488271 - DNA, 16 bp, R. norvegicus
caggagctaaagcaga

SEQ ID NO: 488272 - DNA, 16 bp, R. norvegicus
caggagctcaaagcag

SEQ ID NO: 488273 - DNA, 16 bp, R. norvegicus
caggagctcaagcaga

SEQ ID NO: 488274 - DNA, 16 bp, R. norvegicus
caggagctcaagcagg

SEQ ID NO: 488275 - DNA, 16 bp, R. norvegicus
caggagctctctgcag

SEQ ID NO: 488276 - DNA, 16 bp, R. norvegicus
caggagctctgacaca

SEQ ID NO: 488277 - DNA, 16 bp, R. norvegicus
caggagctgacacaga

SEQ ID NO: 488278 - DNA, 16 bp, R. norvegicus
caggagctgagcagag

SEQ ID NO: 488279 - DNA, 16 bp, R. norvegicus
caggagctgaggcaga

SEQ ID NO: 488280 - DNA, 16 bp, R. norvegicus
caggagctgaggcagg

SEQ ID NO: 488281 - DNA, 16 bp, R. norvegicus
caggagctgattcaga

SEQ ID NO: 488282 - DNA, 16 bp, R. norvegicus
caggagctgctgcaga

SEQ ID NO: 488283 - DNA, 16 bp, R. norvegicus
caggagctggaagcag

SEQ ID NO: 488284 - DNA, 16 bp, R. norvegicus
caggagctggagaaat

SEQ ID NO: 488285 - DNA, 16 bp, R. norvegicus
caggagctgtccacag

SEQ ID NO: 488286 - DNA, 16 bp, R. norvegicus
caggagcttccaggga

SEQ ID NO: 488287 - DNA, 16 bp, R. norvegicus
caggaggaagaggcag

SEQ ID NO: 488288 - DNA, 16 bp, R. norvegicus
caggaggaaggcagag

SEQ ID NO: 488289 - DNA, 16 bp, R. norvegicus
caggaggaattctggg

SEQ ID NO: 488290 - DNA, 16 bp, R. norvegicus
caggaggacaggtgtg

SEQ ID NO: 488291 - DNA, 16 bp, R. norvegicus
caggaggaccaggaat

SEQ ID NO: 488292 - DNA, 16 bp, R. norvegicus
caggaggaccaggagg

SEQ ID NO: 488293 - DNA, 16 bp, R. norvegicus
caggaggaccaggagt

SEQ ID NO: 488294 - DNA, 16 bp, R. norvegicus
caggaggacctgtgcc

SEQ ID NO: 488295 - DNA, 16 bp, R. norvegicus
caggaggagaagattc

SEQ ID NO: 488296 - DNA, 16 bp, R. norvegicus
caggaggagagagcaa

SEQ ID NO: 488297 - DNA, 18 bp, R. norvegicus
caggaggagcagcagcag

SEQ ID NO: 488298 - DNA, 16 bp, R. norvegicus
caggaggagctgaatt

SEQ ID NO: 488299 - DNA, 16 bp, R. norvegicus
caggaggagctgacag

SEQ ID NO: 488300 - DNA, 16 bp, R. norvegicus
caggaggagctgagac

SEQ ID NO: 488301 - DNA, 16 bp, R. norvegicus
caggaggagctgagct

SEQ ID NO: 488302 - DNA, 16 bp, R. norvegicus
caggaggagctgggag

SEQ ID NO: 488303 - DNA, 16 bp, R. norvegicus
caggaggaggaagaca

SEQ ID NO: 488304 - DNA, 16 bp, R. norvegicus
caggaggaggaagatg

SEQ ID NO: 488305 - DNA, 16 bp, R. norvegicus
caggaggaggaagtgg

SEQ ID NO: 488306 - DNA, 17 bp, R. norvegicus
caggaggaggagcagca

SEQ ID NO: 488307 - DNA, 16 bp, R. norvegicus
caggaggaggagccag

SEQ ID NO: 488308 - DNA, 16 bp, R. norvegicus
caggaggaggatgagg

SEQ ID NO: 488309 - DNA, 16 bp, R. norvegicus
caggaggagtataagg

SEQ ID NO: 488310 - DNA, 16 bp, R. norvegicus
caggaggatcaagcca

SEQ ID NO: 488311 - DNA, 16 bp, R. norvegicus
caggaggatcacaagt

SEQ ID NO: 488312 - DNA, 16 bp, R. norvegicus
caggaggatcactgca

SEQ ID NO: 488313 - DNA, 16 bp, R. norvegicus
caggaggatcagaaga

SEQ ID NO: 488314 - DNA, 16 bp, R. norvegicus
caggaggatcagaagg

SEQ ID NO: 488315 - DNA, 16 bp, R. norvegicus
caggaggatcagaagt

SEQ ID NO: 488316 - DNA, 16 bp, R. norvegicus
caggaggatcaggagt

SEQ ID NO: 488317 - DNA, 16 bp, R. norvegicus
caggaggatccctgtg

SEQ ID NO: 488318 - DNA, 16 bp, R. norvegicus
caggaggatctctgca

SEQ ID NO: 488319 - DNA, 16 bp, R. norvegicus
caggaggatctctgtg

SEQ ID NO: 488320 - DNA, 16 bp, R. norvegicus
caggaggatggtaagt

SEQ ID NO: 488321 - DNA, 16 bp, R. norvegicus
caggaggatgtctgtg

SEQ ID NO: 488322 - DNA, 16 bp, R. norvegicus
caggaggattgctgga

SEQ ID NO: 488323 - DNA, 16 bp, R. norvegicus
caggaggattgctgtg

SEQ ID NO: 488324 - DNA, 16 bp, R. norvegicus
caggaggatttctggg

SEQ ID NO: 488325 - DNA, 16 bp, R. norvegicus
caggaggcagaagaaa

SEQ ID NO: 488326 - DNA, 16 bp, R. norvegicus
caggaggcagaagaag

SEQ ID NO: 488327 - DNA, 16 bp, R. norvegicus
caggaggcagaagagg

SEQ ID NO: 488328 - DNA, 16 bp, R. norvegicus
caggaggcagacagac

SEQ ID NO: 488329 - DNA, 16 bp, R. norvegicus
caggaggcagagcaga

SEQ ID NO: 488330 - DNA, 16 bp, R. norvegicus
caggaggcagaggaaa

SEQ ID NO: 488331 - DNA, 16 bp, R. norvegicus
caggaggcagaggcat

SEQ ID NO: 488332 - DNA, 16 bp, R. norvegicus
caggaggcagagggat

SEQ ID NO: 488333 - DNA, 16 bp, R. norvegicus
caggaggcagatgtag

SEQ ID NO: 488334 - DNA, 16 bp, R. norvegicus
caggaggcagcagcag

SEQ ID NO: 488335 - DNA, 16 bp, R. norvegicus
caggaggcagcaggca

SEQ ID NO: 488336 - DNA, 16 bp, R. norvegicus
caggaggcaggaagag

SEQ ID NO: 488337 - DNA, 16 bp, R. norvegicus
caggaggcaggcagag

SEQ ID NO: 488338 - DNA, 16 bp, R. norvegicus
caggaggcaggcagca

SEQ ID NO: 488339 - DNA, 16 bp, R. norvegicus
caggaggcagggacag

SEQ ID NO: 488340 - DNA, 16 bp, R. norvegicus
caggaggcaggggcag

SEQ ID NO: 488341 - DNA, 16 bp, R. norvegicus
caggaggcccagatgg

SEQ ID NO: 488342 - DNA, 16 bp, R. norvegicus
caggaggccctggcag

SEQ ID NO: 488343 - DNA, 16 bp, R. norvegicus
caggaggccttcttgg

SEQ ID NO: 488344 - DNA, 16 bp, R. norvegicus
caggaggctgagacag

SEQ ID NO: 488345 - DNA, 16 bp, R. norvegicus
caggaggctgaggaga

SEQ ID NO: 488346 - DNA, 16 bp, R. norvegicus
caggaggctgaggagg

SEQ ID NO: 488347 - DNA, 16 bp, R. norvegicus
caggaggctgagtcag

SEQ ID NO: 488348 - DNA, 16 bp, R. norvegicus
caggagggagatcctc

SEQ ID NO: 488349 - DNA, 16 bp, R. norvegicus
caggaggggcaggctc

SEQ ID NO: 488350 - DNA, 16 bp, R. norvegicus
caggaggggctggaga

SEQ ID NO: 488351 - DNA, 16 bp, R. norvegicus
caggaggggttagggg

SEQ ID NO: 488352 - DNA, 16 bp, R. norvegicus
caggaggtagaaggtg

SEQ ID NO: 488353 - DNA, 16 bp, R. norvegicus
caggaggtagaggtgg

SEQ ID NO: 488354 - DNA, 16 bp, R. norvegicus
caggaggtgatgcaga

SEQ ID NO: 488355 - DNA, 16 bp, R. norvegicus
caggagtcagcacagc

SEQ ID NO: 488356 - DNA, 16 bp, R. norvegicus
caggagtcagcagtgg

SEQ ID NO: 488357 - DNA, 16 bp, R. norvegicus
caggagtcctcaagct

SEQ ID NO: 488358 - DNA, 16 bp, R. norvegicus
caggagtgcccccctg

SEQ ID NO: 488359 - DNA, 16 bp, R. norvegicus
caggagtgctcacaca

SEQ ID NO: 488360 - DNA, 16 bp, R. norvegicus
caggagtgctggagac

SEQ ID NO: 488361 - DNA, 16 bp, R. norvegicus
caggagtgctgtgaga

SEQ ID NO: 488362 - DNA, 20 bp, R. norvegicus
caggagtggcaggacccctg

SEQ ID NO: 488363 - DNA, 16 bp, R. norvegicus
caggagtgggaggcag

SEQ ID NO: 488364 - DNA, 16 bp, R. norvegicus
caggagtgggtgaatg

SEQ ID NO: 488365 - DNA, 16 bp, R. norvegicus
caggagttacaggtgg

SEQ ID NO: 488366 - DNA, 16 bp, R. norvegicus
caggagttccaggtca

SEQ ID NO: 488367 - DNA, 16 bp, R. norvegicus
caggagttctctgctg

SEQ ID NO: 488368 - DNA, 16 bp, R. norvegicus
caggatacagctatat

SEQ ID NO: 488369 - DNA, 16 bp, R. norvegicus
caggatatgatgtcaa

SEQ ID NO: 488370 - DNA, 16 bp, R. norvegicus
caggatatgtaagcca

SEQ ID NO: 488371 - DNA, 16 bp, R. norvegicus
caggatattggagatg

SEQ ID NO: 488372 - DNA, 16 bp, R. norvegicus
caggatcaagagcttc

SEQ ID NO: 488373 - DNA, 16 bp, R. norvegicus
caggatcaggtttggg

SEQ ID NO: 488374 - DNA, 16 bp, R. norvegicus
caggatcatattttct

SEQ ID NO: 488375 - DNA, 16 bp, R. norvegicus
caggatcatcctccag

SEQ ID NO: 488376 - DNA, 16 bp, R. norvegicus
caggatcctgccctgc

SEQ ID NO: 488377 - DNA, 16 bp, R. norvegicus
caggatcctggtatag

SEQ ID NO: 488378 - DNA, 16 bp, R. norvegicus
caggatctcttactga

SEQ ID NO: 488379 - DNA, 16 bp, R. norvegicus
caggatgaaagaagag

SEQ ID NO: 488380 - DNA, 16 bp, R. norvegicus
caggatgacattttca

SEQ ID NO: 488381 - DNA, 16 bp, R. norvegicus
caggatgagcttttaa

SEQ ID NO: 488382 - DNA, 16 bp, R. norvegicus
caggatgatattatcc

SEQ ID NO: 488383 - DNA, 16 bp, R. norvegicus
caggatgcagaagcag

SEQ ID NO: 488384 - DNA, 16 bp, R. norvegicus
caggatgctgaggcag

SEQ ID NO: 488385 - DNA, 16 bp, R. norvegicus
caggatggctcagtga

SEQ ID NO: 488386 - DNA, 16 bp, R. norvegicus
caggatggtgaggtgg

SEQ ID NO: 488387 - DNA, 16 bp, R. norvegicus
caggatgtaaagaaac

SEQ ID NO: 488388 - DNA, 16 bp, R. norvegicus
caggatgtggaaaaag

SEQ ID NO: 488389 - DNA, 16 bp, R. norvegicus
caggattcaatgagaa

SEQ ID NO: 488390 - DNA, 16 bp, R. norvegicus
caggattccagcttat

SEQ ID NO: 488391 - DNA, 16 bp, R. norvegicus
caggattgagagttca

SEQ ID NO: 488392 - DNA, 16 bp, R. norvegicus
caggattgttttatct

SEQ ID NO: 488393 - DNA, 16 bp, R. norvegicus
caggatttaaagatgg

SEQ ID NO: 488394 - DNA, 18 bp, R. norvegicus
caggatttacttaaggag

SEQ ID NO: 488395 - DNA, 16 bp, R. norvegicus
caggcaaaacactcat

SEQ ID NO: 488396 - DNA, 16 bp, R. norvegicus
caggcaaaacacttat

SEQ ID NO: 488397 - DNA, 16 bp, R. norvegicus
caggcaaaacagccat

SEQ ID NO: 488398 - DNA, 16 bp, R. norvegicus
caggcaaaagactcag

SEQ ID NO: 488399 - DNA, 16 bp, R. norvegicus
caggcaaacagcgact

SEQ ID NO: 488400 - DNA, 16 bp, R. norvegicus
caggcaaagggatgga

SEQ ID NO: 488401 - DNA, 16 bp, R. norvegicus
caggcaaatggatgga

SEQ ID NO: 488402 - DNA, 16 bp, R. norvegicus
caggcaaccacagctg

SEQ ID NO: 488403 - DNA, 16 bp, R. norvegicus
caggcaaccattgaac

SEQ ID NO: 488404 - DNA, 16 bp, R. norvegicus
caggcaactgtgctat

SEQ ID NO: 488405 - DNA, 16 bp, R. norvegicus
caggcaagcaagcaag

SEQ ID NO: 488406 - DNA, 16 bp, R. norvegicus
caggcaagcaggcaag

SEQ ID NO: 488407 - DNA, 16 bp, R. norvegicus
caggcaagtgctctac

SEQ ID NO: 488408 - DNA, 16 bp, R. norvegicus
caggcaatcctctgct

SEQ ID NO: 488409 - DNA, 16 bp, R. norvegicus
caggcacaaaacatcc

SEQ ID NO: 488410 - DNA, 16 bp, R. norvegicus
caggcacacagacaca

SEQ ID NO: 488411 - DNA, 16 bp, R. norvegicus
caggcacacatgcagg

SEQ ID NO: 488412 - DNA, 16 bp, R. norvegicus
caggcacagaaagaca

SEQ ID NO: 488413 - DNA, 16 bp, R. norvegicus
caggcacagacacaga

SEQ ID NO: 488414 - DNA, 16 bp, R. norvegicus
caggcacagacagaaa

SEQ ID NO: 488415 - DNA, 16 bp, R. norvegicus
caggcacagccagaaa

SEQ ID NO: 488416 - DNA, 16 bp, R. norvegicus
caggcacagtggctca

SEQ ID NO: 488417 - DNA, 16 bp, R. norvegicus
caggcacatagtaggt

SEQ ID NO: 488418 - DNA, 16 bp, R. norvegicus
caggcacgtcctgtgt

SEQ ID NO: 488419 - DNA, 16 bp, R. norvegicus
caggcactcagagctg

SEQ ID NO: 488420 - DNA, 16 bp, R. norvegicus
caggcactgaatggcc

SEQ ID NO: 488421 - DNA, 16 bp, R. norvegicus
caggcactgtgctagg

SEQ ID NO: 488422 - DNA, 16 bp, R. norvegicus
caggcagaaacccaaa

SEQ ID NO: 488423 - DNA, 16 bp, R. norvegicus
caggcagaacactcat

SEQ ID NO: 488424 - DNA, 16 bp, R. norvegicus
caggcagaactcccag

SEQ ID NO: 488425 - DNA, 21 bp, R. norvegicus
caggcagaagtgagggccttc

SEQ ID NO: 488426 - DNA, 16 bp, R. norvegicus
caggcagacagacaag

SEQ ID NO: 488427 - DNA, 16 bp, R. norvegicus
caggcagacagacaca

SEQ ID NO: 488428 - DNA, 16 bp, R. norvegicus
caggcagagaagagga

SEQ ID NO: 488429 - DNA, 16 bp, R. norvegicus
caggcagagacaggag

SEQ ID NO: 488430 - DNA, 16 bp, R. norvegicus
caggcagagagagaaa

SEQ ID NO: 488431 - DNA, 16 bp, R. norvegicus
caggcagagcaggctg

SEQ ID NO: 488432 - DNA, 16 bp, R. norvegicus
caggcagagctctctg

SEQ ID NO: 488433 - DNA, 16 bp, R. norvegicus
caggcagaggcagaca

SEQ ID NO: 488434 - DNA, 16 bp, R. norvegicus
caggcagagggaacag

SEQ ID NO: 488435 - DNA, 16 bp, R. norvegicus
caggcagataaatcag

SEQ ID NO: 488436 - DNA, 16 bp, R. norvegicus
caggcagatccttggg

SEQ ID NO: 488437 - DNA, 16 bp, R. norvegicus
caggcagatctctgag

SEQ ID NO: 488438 - DNA, 16 bp, R. norvegicus
caggcagcaagaagag

SEQ ID NO: 488439 - DNA, 16 bp, R. norvegicus
caggcagcacagtgga

SEQ ID NO: 488440 - DNA, 16 bp, R. norvegicus
caggcagcagagagag

SEQ ID NO: 488441 - DNA, 16 bp, R. norvegicus
caggcagcagcaggag

SEQ ID NO: 488442 - DNA, 16 bp, R. norvegicus
caggcagcagcctgag

SEQ ID NO: 488443 - DNA, 16 bp, R. norvegicus
caggcagcaggaagac

SEQ ID NO: 488444 - DNA, 16 bp, R. norvegicus
caggcagcaggaagag

SEQ ID NO: 488445 - DNA, 16 bp, R. norvegicus
caggcagccacagctg

SEQ ID NO: 488446 - DNA, 16 bp, R. norvegicus
caggcagccagaagcc

SEQ ID NO: 488447 - DNA, 16 bp, R. norvegicus
caggcagccagaagga

SEQ ID NO: 488448 - DNA, 16 bp, R. norvegicus
caggcagccaggaaga

SEQ ID NO: 488449 - DNA, 16 bp, R. norvegicus
caggcagctgaaagag

SEQ ID NO: 488450 - DNA, 16 bp, R. norvegicus
caggcagctggagcag

SEQ ID NO: 488451 - DNA, 16 bp, R. norvegicus
caggcagcttggagga

SEQ ID NO: 488452 - DNA, 16 bp, R. norvegicus
caggcaggaaccccag

SEQ ID NO: 488453 - DNA, 16 bp, R. norvegicus
caggcaggacaggttg

SEQ ID NO: 488454 - DNA, 16 bp, R. norvegicus
caggcaggagtcctgc

SEQ ID NO: 488455 - DNA, 16 bp, R. norvegicus
caggcaggattcccag

SEQ ID NO: 488456 - DNA, 16 bp, R. norvegicus
caggcaggcaagcagg

SEQ ID NO: 488457 - DNA, 16 bp, R. norvegicus
caggcaggcagagctc

SEQ ID NO: 488458 - DNA, 16 bp, R. norvegicus
caggcaggtggtcctg

SEQ ID NO: 488459 - DNA, 16 bp, R. norvegicus
caggcaggtgtggtgc

SEQ ID NO: 488460 - DNA, 16 bp, R. norvegicus
caggcagtgaaaggta

SEQ ID NO: 488461 - DNA, 16 bp, R. norvegicus
caggcagtgagaaccc

SEQ ID NO: 488462 - DNA, 16 bp, R. norvegicus
caggcagtggcagctc

SEQ ID NO: 488463 - DNA, 16 bp, R. norvegicus
caggcagtggtgacac

SEQ ID NO: 488464 - DNA, 16 bp, R. norvegicus
caggcatcctcatctg

SEQ ID NO: 488465 - DNA, 16 bp, R. norvegicus
caggcatctttcttgc

SEQ ID NO: 488466 - DNA, 16 bp, R. norvegicus
caggcatgatgctgga

SEQ ID NO: 488467 - DNA, 16 bp, R. norvegicus
caggcatgatggtaca

SEQ ID NO: 488468 - DNA, 16 bp, R. norvegicus
caggcatgcacatggc

SEQ ID NO: 488469 - DNA, 16 bp, R. norvegicus
caggcatgcaccagca

SEQ ID NO: 488470 - DNA, 16 bp, R. norvegicus
caggcatgcaggcatg

SEQ ID NO: 488471 - DNA, 16 bp, R. norvegicus
caggcatggtggcaca

SEQ ID NO: 488472 - DNA, 16 bp, R. norvegicus
caggcatggtggtaca

SEQ ID NO: 488473 - DNA, 16 bp, R. norvegicus
caggcatgtgcacaca

SEQ ID NO: 488474 - DNA, 16 bp, R. norvegicus
caggccaacatcctcc

SEQ ID NO: 488475 - DNA, 16 bp, R. norvegicus
caggccaacctgggct

SEQ ID NO: 488476 - DNA, 16 bp, R. norvegicus
caggccaaggacacag

SEQ ID NO: 488477 - DNA, 16 bp, R. norvegicus
caggccacagacatca

SEQ ID NO: 488478 - DNA, 16 bp, R. norvegicus
caggccacagagtcag

SEQ ID NO: 488479 - DNA, 16 bp, R. norvegicus
caggccacccagggct

SEQ ID NO: 488480 - DNA, 16 bp, R. norvegicus
caggccagaagagggt

SEQ ID NO: 488481 - DNA, 16 bp, R. norvegicus
caggccagcatccccc

SEQ ID NO: 488482 - DNA, 16 bp, R. norvegicus
caggccagccagagat

SEQ ID NO: 488483 - DNA, 16 bp, R. norvegicus
caggccagccaggtct

SEQ ID NO: 488484 - DNA, 16 bp, R. norvegicus
caggccagccttgaac

SEQ ID NO: 488485 - DNA, 16 bp, R. norvegicus
caggccagcttgggct

SEQ ID NO: 488486 - DNA, 16 bp, R. norvegicus
caggccagtctgatct

SEQ ID NO: 488487 - DNA, 16 bp, R. norvegicus
caggccagtgaaagac

SEQ ID NO: 488488 - DNA, 16 bp, R. norvegicus
caggccagtgagatgg

SEQ ID NO: 488489 - DNA, 16 bp, R. norvegicus
caggccatcctgggct

SEQ ID NO: 488490 - DNA, 16 bp, R. norvegicus
caggccatctctccag

SEQ ID NO: 488491 - DNA, 16 bp, R. norvegicus
caggccatgtggttct

SEQ ID NO: 488492 - DNA, 16 bp, R. norvegicus
caggcccaagaggaaa

SEQ ID NO: 488493 - DNA, 16 bp, R. norvegicus
caggcccaagggcctc

SEQ ID NO: 488494 - DNA, 16 bp, R. norvegicus
caggcccacagaaggg

SEQ ID NO: 488495 - DNA, 16 bp, R. norvegicus
caggcccagacccagg

SEQ ID NO: 488496 - DNA, 16 bp, R. norvegicus
caggcccagaggaaca

SEQ ID NO: 488497 - DNA, 16 bp, R. norvegicus
caggcccagattcagg

SEQ ID NO: 488498 - DNA, 16 bp, R. norvegicus
caggcccagggacccc

SEQ ID NO: 488499 - DNA, 16 bp, R. norvegicus
caggcccagtgtcact

SEQ ID NO: 488500 - DNA, 16 bp, R. norvegicus
caggccctgtgcctgc

SEQ ID NO: 488501 - DNA, 16 bp, R. norvegicus
caggcctaccaggaga

SEQ ID NO: 488502 - DNA, 16 bp, R. norvegicus
caggcctcagatccaa

SEQ ID NO: 488503 - DNA, 16 bp, R. norvegicus
caggcctcatctcaaa

SEQ ID NO: 488504 - DNA, 16 bp, R. norvegicus
caggcctccccattcc

SEQ ID NO: 488505 - DNA, 16 bp, R. norvegicus
caggcctctgcctccc

SEQ ID NO: 488506 - DNA, 58 bp, R. norvegicus
caggcctggcaaaagaaggccctgctatcagctttcagcaagaaccaatacccgagct

SEQ ID NO: 488507 - DNA, 16 bp, R. norvegicus
caggcctggccagctt

SEQ ID NO: 488508 - DNA, 16 bp, R. norvegicus
caggcctgggaccaga

SEQ ID NO: 488509 - DNA, 16 bp, R. norvegicus
caggcctggtggtaca

SEQ ID NO: 488510 - DNA, 16 bp, R. norvegicus
caggcctgtggccaaa

SEQ ID NO: 488511 - DNA, 16 bp, R. norvegicus
caggccttgggacctc

SEQ ID NO: 488512 - DNA, 16 bp, R. norvegicus
caggccttgtgcttgc

SEQ ID NO: 488513 - DNA, 16 bp, R. norvegicus
caggcctttagtccca

SEQ ID NO: 488514 - DNA, 16 bp, R. norvegicus
caggcgacaacagatg

SEQ ID NO: 488515 - DNA, 26 bp, R. norvegicus
caggcgtgtccgcctgtctgaaggtt

SEQ ID NO: 488516 - DNA, 18 bp, R. norvegicus
caggcgtgtctgcctctc

SEQ ID NO: 488517 - DNA, 16 bp, R. norvegicus
caggctaagaaaggaa

SEQ ID NO: 488518 - DNA, 16 bp, R. norvegicus
caggctaagcaagcta

SEQ ID NO: 488519 - DNA, 16 bp, R. norvegicus
caggctacacagagaa

SEQ ID NO: 488520 - DNA, 16 bp, R. norvegicus
caggctatccttaaac

SEQ ID NO: 488521 - DNA, 16 bp, R. norvegicus
caggctatggcagagc

SEQ ID NO: 488522 - DNA, 16 bp, R. norvegicus
caggctattgccaagg

SEQ ID NO: 488523 - DNA, 19 bp, R. norvegicus
caggctcaagaaatgtgac

SEQ ID NO: 488524 - DNA, 16 bp, R. norvegicus
caggctcagaaagaaa

SEQ ID NO: 488525 - DNA, 16 bp, R. norvegicus
caggctcagaaagaca

SEQ ID NO: 488526 - DNA, 16 bp, R. norvegicus
caggctcagagagaag

SEQ ID NO: 488527 - DNA, 16 bp, R. norvegicus
caggctcaggagtgcc

SEQ ID NO: 488528 - DNA, 16 bp, R. norvegicus
caggctcaggctcagg

SEQ ID NO: 488529 - DNA, 16 bp, R. norvegicus
caggctcagtccatgt

SEQ ID NO: 488530 - DNA, 16 bp, R. norvegicus
caggctccagtcagca

SEQ ID NO: 488531 - DNA, 16 bp, R. norvegicus
caggctcccctccctc

SEQ ID NO: 488532 - DNA, 16 bp, R. norvegicus
caggctcctcctcctc

SEQ ID NO: 488533 - DNA, 16 bp, R. norvegicus
caggctcctgtcagaa

SEQ ID NO: 488534 - DNA, 16 bp, R. norvegicus
caggctcctgtcagca

SEQ ID NO: 488535 - DNA, 16 bp, R. norvegicus
caggctcctgtcagct

SEQ ID NO: 488536 - DNA, 16 bp, R. norvegicus
caggctctagcctttt

SEQ ID NO: 488537 - DNA, 16 bp, R. norvegicus
caggctctgaatgagc

SEQ ID NO: 488538 - DNA, 16 bp, R. norvegicus
caggctctgaatgtgt

SEQ ID NO: 488539 - DNA, 16 bp, R. norvegicus
caggctgacacacaca

SEQ ID NO: 488540 - DNA, 16 bp, R. norvegicus
caggctgacctggagc

SEQ ID NO: 488541 - DNA, 16 bp, R. norvegicus
caggctgagaaggaaa

SEQ ID NO: 488542 - DNA, 16 bp, R. norvegicus
caggctgagcaagaca

SEQ ID NO: 488543 - DNA, 16 bp, R. norvegicus
caggctgataagcatg

SEQ ID NO: 488544 - DNA, 16 bp, R. norvegicus
caggctgcagagagag

SEQ ID NO: 488545 - DNA, 16 bp, R. norvegicus
caggctgcagtcagag

SEQ ID NO: 488546 - DNA, 16 bp, R. norvegicus
caggctgccatgtttc

SEQ ID NO: 488547 - DNA, 16 bp, R. norvegicus
caggctgccctagaac

SEQ ID NO: 488548 - DNA, 16 bp, R. norvegicus
caggctgccctcagac

SEQ ID NO: 488549 - DNA, 16 bp, R. norvegicus
caggctgccctggaac

SEQ ID NO: 488550 - DNA, 16 bp, R. norvegicus
caggctgccttgccaa

SEQ ID NO: 488551 - DNA, 16 bp, R. norvegicus
caggctgctgctgctg

SEQ ID NO: 488552 - DNA, 16 bp, R. norvegicus
caggctggagagctgg

SEQ ID NO: 488553 - DNA, 16 bp, R. norvegicus
caggctggcaggaacc

SEQ ID NO: 488554 - DNA, 16 bp, R. norvegicus
caggctggccctggac

SEQ ID NO: 488555 - DNA, 16 bp, R. norvegicus
caggctggcctcaaat

SEQ ID NO: 488556 - DNA, 16 bp, R. norvegicus
caggctggcctcaagc

SEQ ID NO: 488557 - DNA, 16 bp, R. norvegicus
caggctggcctcagat

SEQ ID NO: 488558 - DNA, 16 bp, R. norvegicus
caggctggcctctgcc

SEQ ID NO: 488559 - DNA, 16 bp, R. norvegicus
caggctggcctgggac

SEQ ID NO: 488560 - DNA, 16 bp, R. norvegicus
caggctggccttgaat

SEQ ID NO: 488561 - DNA, 16 bp, R. norvegicus
caggctgtcctggagc

SEQ ID NO: 488562 - DNA, 16 bp, R. norvegicus
caggctgtggcagagc

SEQ ID NO: 488563 - DNA, 16 bp, R. norvegicus
caggcttagaggaggg

SEQ ID NO: 488564 - DNA, 16 bp, R. norvegicus
caggcttcccagggat

SEQ ID NO: 488565 - DNA, 16 bp, R. norvegicus
caggcttcttggggca

SEQ ID NO: 488566 - DNA, 16 bp, R. norvegicus
caggcttgcctgcagc

SEQ ID NO: 488567 - DNA, 16 bp, R. norvegicus
caggcttggcagcaga

SEQ ID NO: 488568 - DNA, 16 bp, R. norvegicus
caggcttggcaggaag

SEQ ID NO: 488569 - DNA, 16 bp, R. norvegicus
caggcttggtgcagga

SEQ ID NO: 488570 - DNA, 16 bp, R. norvegicus
caggcttggtggcaag

SEQ ID NO: 488571 - DNA, 16 bp, R. norvegicus
caggcttggtggcagg

SEQ ID NO: 488572 - DNA, 16 bp, R. norvegicus
caggcttgtctgcccc

SEQ ID NO: 488573 - DNA, 16 bp, R. norvegicus
caggctttgaggtctc

SEQ ID NO: 488574 - DNA, 16 bp, R. norvegicus
caggctttgcacctgg

SEQ ID NO: 488575 - DNA, 24 bp, R. norvegicus
caggctttgctaccagggagcagc

SEQ ID NO: 488576 - DNA, 16 bp, R. norvegicus
caggctttggcagagc

SEQ ID NO: 488577 - DNA, 16 bp, R. norvegicus
cagggaaacagccctg

SEQ ID NO: 488578 - DNA, 16 bp, R. norvegicus
cagggaaacagggaga

SEQ ID NO: 488579 - DNA, 16 bp, R. norvegicus
cagggaaaggactgga

SEQ ID NO: 488580 - DNA, 16 bp, R. norvegicus
cagggaaccaccctgc

SEQ ID NO: 488581 - DNA, 16 bp, R. norvegicus
cagggaaccaggaaag

SEQ ID NO: 488582 - DNA, 16 bp, R. norvegicus
cagggaactgtgggac

SEQ ID NO: 488583 - DNA, 16 bp, R. norvegicus
cagggaagaccaccac

SEQ ID NO: 488584 - DNA, 16 bp, R. norvegicus
cagggaagcagagaca

SEQ ID NO: 488585 - DNA, 16 bp, R. norvegicus
cagggaagcaggaagc

SEQ ID NO: 488586 - DNA, 16 bp, R. norvegicus
cagggaaggttttcaa

SEQ ID NO: 488587 - DNA, 16 bp, R. norvegicus
cagggaatctgatgct

SEQ ID NO: 488588 - DNA, 16 bp, R. norvegicus
cagggacaaaaatgga

SEQ ID NO: 488589 - DNA, 16 bp, R. norvegicus
cagggacaaagagcag

SEQ ID NO: 488590 - DNA, 16 bp, R. norvegicus
cagggacaagacaaag

SEQ ID NO: 488591 - DNA, 16 bp, R. norvegicus
cagggacaagggcttc

SEQ ID NO: 488592 - DNA, 16 bp, R. norvegicus
cagggacacacacaca

SEQ ID NO: 488593 - DNA, 16 bp, R. norvegicus
cagggacacacttact

SEQ ID NO: 488594 - DNA, 16 bp, R. norvegicus
cagggacaccaggaga

SEQ ID NO: 488595 - DNA, 16 bp, R. norvegicus
cagggacagagacaga

SEQ ID NO: 488596 - DNA, 16 bp, R. norvegicus
cagggacagctcctgc

SEQ ID NO: 488597 - DNA, 16 bp, R. norvegicus
cagggacagctctcct

SEQ ID NO: 488598 - DNA, 16 bp, R. norvegicus
cagggacaggacaagg

SEQ ID NO: 488599 - DNA, 16 bp, R. norvegicus
cagggacagggacaga

SEQ ID NO: 488600 - DNA, 16 bp, R. norvegicus
cagggacccaagaaaa

SEQ ID NO: 488601 - DNA, 22 bp, R. norvegicus
cagggacccaatgctctgtgct

SEQ ID NO: 488602 - DNA, 16 bp, R. norvegicus
cagggacccaggagca

SEQ ID NO: 488603 - DNA, 16 bp, R. norvegicus
cagggaccccgaagca

SEQ ID NO: 488604 - DNA, 16 bp, R. norvegicus
cagggacccctatgga

SEQ ID NO: 488605 - DNA, 16 bp, R. norvegicus
cagggacctggagaca

SEQ ID NO: 488606 - DNA, 16 bp, R. norvegicus
cagggactgggatatt

SEQ ID NO: 488607 - DNA, 16 bp, R. norvegicus
cagggagaaagagtgg

SEQ ID NO: 488608 - DNA, 16 bp, R. norvegicus
cagggagaagaatctc

SEQ ID NO: 488609 - DNA, 16 bp, R. norvegicus
cagggagacaaagaac

SEQ ID NO: 488610 - DNA, 16 bp, R. norvegicus
cagggagacagacagg

SEQ ID NO: 488611 - DNA, 16 bp, R. norvegicus
cagggagacagagaca

SEQ ID NO: 488612 - DNA, 16 bp, R. norvegicus
cagggagagatcctgt

SEQ ID NO: 488613 - DNA, 16 bp, R. norvegicus
cagggagatcctgtct

SEQ ID NO: 488614 - DNA, 16 bp, R. norvegicus
cagggagcagaggcag

SEQ ID NO: 488615 - DNA, 16 bp, R. norvegicus
cagggagcccagatgg

SEQ ID NO: 488616 - DNA, 16 bp, R. norvegicus
cagggagccccaggga

SEQ ID NO: 488617 - DNA, 16 bp, R. norvegicus
cagggagcccgagggc

SEQ ID NO: 488618 - DNA, 16 bp, R. norvegicus
cagggagctggaacag

SEQ ID NO: 488619 - DNA, 16 bp, R. norvegicus
cagggaggaccaccac

SEQ ID NO: 488620 - DNA, 16 bp, R. norvegicus
cagggaggagctgggg

SEQ ID NO: 488621 - DNA, 16 bp, R. norvegicus
cagggaggcagacaga

SEQ ID NO: 488622 - DNA, 16 bp, R. norvegicus
cagggaggcatggcag

SEQ ID NO: 488623 - DNA, 16 bp, R. norvegicus
cagggagtgaaatgtg

SEQ ID NO: 488624 - DNA, 16 bp, R. norvegicus
cagggagtgaaggaag

SEQ ID NO: 488625 - DNA, 16 bp, R. norvegicus
cagggagtggagaggt

SEQ ID NO: 488626 - DNA, 16 bp, R. norvegicus
cagggagtggcaggat

SEQ ID NO: 488627 - DNA, 16 bp, R. norvegicus
cagggatatttgtgtc

SEQ ID NO: 488628 - DNA, 16 bp, R. norvegicus
cagggatccacgggtt

SEQ ID NO: 488629 - DNA, 16 bp, R. norvegicus
cagggatgaaaatgga

SEQ ID NO: 488630 - DNA, 16 bp, R. norvegicus
cagggatgctgggatg

SEQ ID NO: 488631 - DNA, 16 bp, R. norvegicus
cagggatggagagatg

SEQ ID NO: 488632 - DNA, 16 bp, R. norvegicus
cagggatggagcagag

SEQ ID NO: 488633 - DNA, 16 bp, R. norvegicus
cagggatggttcgagg

SEQ ID NO: 488634 - DNA, 16 bp, R. norvegicus
cagggatgtagggatg

SEQ ID NO: 488635 - DNA, 16 bp, R. norvegicus
cagggattgaactctg

SEQ ID NO: 488636 - DNA, 16 bp, R. norvegicus
cagggattggactcag

SEQ ID NO: 488637 - DNA, 20 bp, R. norvegicus
cagggatttttgtgtctcct

SEQ ID NO: 488638 - DNA, 16 bp, R. norvegicus
cagggcacaggcaaca

SEQ ID NO: 488639 - DNA, 16 bp, R. norvegicus
cagggcagaaactcaa

SEQ ID NO: 488640 - DNA, 16 bp, R. norvegicus
cagggcagaaggaagg

SEQ ID NO: 488641 - DNA, 16 bp, R. norvegicus
cagggcagccagggct

SEQ ID NO: 488642 - DNA, 16 bp, R. norvegicus
cagggcagctagggct

SEQ ID NO: 488643 - DNA, 16 bp, R. norvegicus
cagggcagcttctgag

SEQ ID NO: 488644 - DNA, 16 bp, R. norvegicus
cagggcaggaagcaag

SEQ ID NO: 488645 - DNA, 16 bp, R. norvegicus
cagggcaggaaggtgg

SEQ ID NO: 488646 - DNA, 16 bp, R. norvegicus
cagggcaggacagact

SEQ ID NO: 488647 - DNA, 16 bp, R. norvegicus
cagggcaggacagggc

SEQ ID NO: 488648 - DNA, 16 bp, R. norvegicus
cagggcaggagcctgg

SEQ ID NO: 488649 - DNA, 16 bp, R. norvegicus
cagggcaggagctcaa

SEQ ID NO: 488650 - DNA, 16 bp, R. norvegicus
cagggcagggcaaggc

SEQ ID NO: 488651 - DNA, 16 bp, R. norvegicus
cagggcagggcagagc

SEQ ID NO: 488652 - DNA, 16 bp, R. norvegicus
cagggcagggtggcag

SEQ ID NO: 488653 - DNA, 16 bp, R. norvegicus
cagggcagtgctggag

SEQ ID NO: 488654 - DNA, 16 bp, R. norvegicus
cagggcagtggtggtg

SEQ ID NO: 488655 - DNA, 16 bp, R. norvegicus
cagggcatccaatgcc

SEQ ID NO: 488656 - DNA, 16 bp, R. norvegicus
cagggcatggaggtgg

SEQ ID NO: 488657 - DNA, 16 bp, R. norvegicus
cagggccaacctggtc

SEQ ID NO: 488658 - DNA, 16 bp, R. norvegicus
cagggccaagggcctc

SEQ ID NO: 488659 - DNA, 16 bp, R. norvegicus
cagggccacctgccca

SEQ ID NO: 488660 - DNA, 16 bp, R. norvegicus
cagggccagcctggtt

SEQ ID NO: 488661 - DNA, 16 bp, R. norvegicus
cagggccaggaggcag

SEQ ID NO: 488662 - DNA, 16 bp, R. norvegicus
cagggccaggctgcag

SEQ ID NO: 488663 - DNA, 16 bp, R. norvegicus
cagggccagggccagg

SEQ ID NO: 488664 - DNA, 16 bp, R. norvegicus
cagggcccaggctctg

SEQ ID NO: 488665 - DNA, 16 bp, R. norvegicus
cagggccctagcattt

SEQ ID NO: 488666 - DNA, 16 bp, R. norvegicus
cagggcctgctctccc

SEQ ID NO: 488667 - DNA, 16 bp, R. norvegicus
cagggccttgggcatg

SEQ ID NO: 488668 - DNA, 16 bp, R. norvegicus
cagggccttgggcttg

SEQ ID NO: 488669 - DNA, 16 bp, R. norvegicus
cagggctacacagaca

SEQ ID NO: 488670 - DNA, 16 bp, R. norvegicus
cagggctacagagtga

SEQ ID NO: 488671 - DNA, 16 bp, R. norvegicus
cagggctagcctgggc

SEQ ID NO: 488672 - DNA, 16 bp, R. norvegicus
cagggctcagggaacc

SEQ ID NO: 488673 - DNA, 16 bp, R. norvegicus
cagggctgagcatttg

SEQ ID NO: 488674 - DNA, 16 bp, R. norvegicus
cagggctgcagagatg

SEQ ID NO: 488675 - DNA, 16 bp, R. norvegicus
cagggctgggctgggc

SEQ ID NO: 488676 - DNA, 16 bp, R. norvegicus
cagggctggggctggg

SEQ ID NO: 488677 - DNA, 16 bp, R. norvegicus
cagggctttgaggtgg

SEQ ID NO: 488678 - DNA, 16 bp, R. norvegicus
caggggaaaatttctt

SEQ ID NO: 488679 - DNA, 16 bp, R. norvegicus
caggggaaaattttct

SEQ ID NO: 488680 - DNA, 16 bp, R. norvegicus
caggggaaatttttct

SEQ ID NO: 488681 - DNA, 16 bp, R. norvegicus
caggggaagcaagcca

SEQ ID NO: 488682 - DNA, 16 bp, R. norvegicus
caggggaatatgggag

SEQ ID NO: 488683 - DNA, 16 bp, R. norvegicus
caggggaatatgggga

SEQ ID NO: 488684 - DNA, 16 bp, R. norvegicus
caggggacaggggaca

SEQ ID NO: 488685 - DNA, 16 bp, R. norvegicus
caggggaccagagctg

SEQ ID NO: 488686 - DNA, 16 bp, R. norvegicus
caggggaggcagaaca

SEQ ID NO: 488687 - DNA, 16 bp, R. norvegicus
caggggaggcagaggc

SEQ ID NO: 488688 - DNA, 16 bp, R. norvegicus
caggggagtgtgtgct

SEQ ID NO: 488689 - DNA, 16 bp, R. norvegicus
caggggatctgacact

SEQ ID NO: 488690 - DNA, 16 bp, R. norvegicus
caggggatgcagagca

SEQ ID NO: 488691 - DNA, 16 bp, R. norvegicus
caggggcacatgttcc

SEQ ID NO: 488692 - DNA, 16 bp, R. norvegicus
caggggcagcagcagg

SEQ ID NO: 488693 - DNA, 16 bp, R. norvegicus
caggggctccaacacc

SEQ ID NO: 488694 - DNA, 16 bp, R. norvegicus
caggggctgaggcagg

SEQ ID NO: 488695 - DNA, 16 bp, R. norvegicus
caggggctggaactgg

SEQ ID NO: 488696 - DNA, 16 bp, R. norvegicus
caggggctggagagat

SEQ ID NO: 488697 - DNA, 16 bp, R. norvegicus
cagggggagctgagag

SEQ ID NO: 488698 - DNA, 16 bp, R. norvegicus
cagggggatggggaga

SEQ ID NO: 488699 - DNA, 16 bp, R. norvegicus
caggggtacacagaga

SEQ ID NO: 488700 - DNA, 16 bp, R. norvegicus
caggggtcagaggtca

SEQ ID NO: 488701 - DNA, 17 bp, R. norvegicus
caggggtcctgtcgctc

SEQ ID NO: 488702 - DNA, 16 bp, R. norvegicus
caggggtgagagtggg

SEQ ID NO: 488703 - DNA, 16 bp, R. norvegicus
caggggtgagcattgt

SEQ ID NO: 488704 - DNA, 16 bp, R. norvegicus
caggggtgcccacctg

SEQ ID NO: 488705 - DNA, 16 bp, R. norvegicus
cagggtattttcatct

SEQ ID NO: 488706 - DNA, 16 bp, R. norvegicus
cagggtcacacagaga

SEQ ID NO: 488707 - DNA, 16 bp, R. norvegicus
cagggtcacagcatta

SEQ ID NO: 488708 - DNA, 16 bp, R. norvegicus
cagggtcagggtcagg

SEQ ID NO: 488709 - DNA, 16 bp, R. norvegicus
cagggtcctcctggct

SEQ ID NO: 488710 - DNA, 16 bp, R. norvegicus
cagggtcctgtcagca

SEQ ID NO: 488711 - DNA, 16 bp, R. norvegicus
cagggtctggggtcca

SEQ ID NO: 488712 - DNA, 16 bp, R. norvegicus
cagggtgagaagaatg

SEQ ID NO: 488713 - DNA, 16 bp, R. norvegicus
cagggtgaggaggcag

SEQ ID NO: 488714 - DNA, 16 bp, R. norvegicus
cagggtgataaatatg

SEQ ID NO: 488715 - DNA, 16 bp, R. norvegicus
cagggtgcagatggag

SEQ ID NO: 488716 - DNA, 16 bp, R. norvegicus
cagggtggggagaagg

SEQ ID NO: 488717 - DNA, 16 bp, R. norvegicus
cagggtggggaggcag

SEQ ID NO: 488718 - DNA, 18 bp, R. norvegicus
cagggtggtcagcagcac

SEQ ID NO: 488719 - DNA, 16 bp, R. norvegicus
cagggttacacagaaa

SEQ ID NO: 488720 - DNA, 16 bp, R. norvegicus
cagggttccagatgtc

SEQ ID NO: 488721 - DNA, 16 bp, R. norvegicus
cagggttcctgcagct

SEQ ID NO: 488722 - DNA, 16 bp, R. norvegicus
cagggtttctctgtcc

SEQ ID NO: 488723 - DNA, 16 bp, R. norvegicus
cagggtttctgttcct

SEQ ID NO: 488724 - DNA, 16 bp, R. norvegicus
cagggtttctttgtgt

SEQ ID NO: 488725 - DNA, 16 bp, R. norvegicus
caggtacaagacagaa

SEQ ID NO: 488726 - DNA, 16 bp, R. norvegicus
caggtacaagatagaa

SEQ ID NO: 488727 - DNA, 16 bp, R. norvegicus
caggtacacaggtaca

SEQ ID NO: 488728 - DNA, 16 bp, R. norvegicus
caggtagaacaatttc

SEQ ID NO: 488729 - DNA, 16 bp, R. norvegicus
caggtagccctggctg

SEQ ID NO: 488730 - DNA, 16 bp, R. norvegicus
caggtatggaaggaga

SEQ ID NO: 488731 - DNA, 16 bp, R. norvegicus
caggtatggtggtgca

SEQ ID NO: 488732 - DNA, 16 bp, R. norvegicus
caggtatgtgtgtgtg

SEQ ID NO: 488733 - DNA, 16 bp, R. norvegicus
caggtattttgtcaca

SEQ ID NO: 488734 - DNA, 16 bp, R. norvegicus
caggtcaagaagcagg

SEQ ID NO: 488735 - DNA, 16 bp, R. norvegicus
caggtcacagcagatg

SEQ ID NO: 488736 - DNA, 16 bp, R. norvegicus
caggtcagaagcctgt

SEQ ID NO: 488737 - DNA, 16 bp, R. norvegicus
caggtcagaggagctg

SEQ ID NO: 488738 - DNA, 16 bp, R. norvegicus
caggtcagctacagta

SEQ ID NO: 488739 - DNA, 16 bp, R. norvegicus
caggtcatcagccttg

SEQ ID NO: 488740 - DNA, 16 bp, R. norvegicus
caggtccagatgtgtt

SEQ ID NO: 488741 - DNA, 16 bp, R. norvegicus
caggtccctcctgctg

SEQ ID NO: 488742 - DNA, 16 bp, R. norvegicus
caggtccctgtgcttg

SEQ ID NO: 488743 - DNA, 16 bp, R. norvegicus
caggtcctagaggaat

SEQ ID NO: 488744 - DNA, 16 bp, R. norvegicus
caggtcctcgggcttg

SEQ ID NO: 488745 - DNA, 16 bp, R. norvegicus
caggtctcctagttgg

SEQ ID NO: 488746 - DNA, 16 bp, R. norvegicus
caggtctctggaagag

SEQ ID NO: 488747 - DNA, 16 bp, R. norvegicus
caggtctgtttccctc

SEQ ID NO: 488748 - DNA, 16 bp, R. norvegicus
caggtcttcccacctc

SEQ ID NO: 488749 - DNA, 16 bp, R. norvegicus
caggtcttctgaaaga

SEQ ID NO: 488750 - DNA, 16 bp, R. norvegicus
caggtcttctgtgaga

SEQ ID NO: 488751 - DNA, 16 bp, R. norvegicus
caggtgaagaagagag

SEQ ID NO: 488752 - DNA, 16 bp, R. norvegicus
caggtgaagacagaag

SEQ ID NO: 488753 - DNA, 16 bp, R. norvegicus
caggtgaaggaaatga

SEQ ID NO: 488754 - DNA, 16 bp, R. norvegicus
caggtgagaaatgctg

SEQ ID NO: 488755 - DNA, 16 bp, R. norvegicus
caggtgagaccatcac

SEQ ID NO: 488756 - DNA, 16 bp, R. norvegicus
caggtgagggacatct

SEQ ID NO: 488757 - DNA, 16 bp, R. norvegicus
caggtgcacactcaca

SEQ ID NO: 488758 - DNA, 16 bp, R. norvegicus
caggtgcacatgcaca

SEQ ID NO: 488759 - DNA, 16 bp, R. norvegicus
caggtgcattcccagt

SEQ ID NO: 488760 - DNA, 16 bp, R. norvegicus
caggtgccagcagatg

SEQ ID NO: 488761 - DNA, 16 bp, R. norvegicus
caggtgcccaaggagg

SEQ ID NO: 488762 - DNA, 16 bp, R. norvegicus
caggtgcccatggagg

SEQ ID NO: 488763 - DNA, 16 bp, R. norvegicus
caggtgcccgtggagg

SEQ ID NO: 488764 - DNA, 16 bp, R. norvegicus
caggtgctggcagagt

SEQ ID NO: 488765 - DNA, 16 bp, R. norvegicus
caggtgctgggactaa

SEQ ID NO: 488766 - DNA, 16 bp, R. norvegicus
caggtgctgggattac

SEQ ID NO: 488767 - DNA, 16 bp, R. norvegicus
caggtggatcactgtg

SEQ ID NO: 488768 - DNA, 16 bp, R. norvegicus
caggtggatgctggga

SEQ ID NO: 488769 - DNA, 16 bp, R. norvegicus
caggtggatttctatg

SEQ ID NO: 488770 - DNA, 16 bp, R. norvegicus
caggtggcagaagcag

SEQ ID NO: 488771 - DNA, 16 bp, R. norvegicus
caggtggcaggtggca

SEQ ID NO: 488772 - DNA, 16 bp, R. norvegicus
caggtggccctgggct

SEQ ID NO: 488773 - DNA, 16 bp, R. norvegicus
caggtgggaggcagag

SEQ ID NO: 488774 - DNA, 16 bp, R. norvegicus
caggtggggactcctg

SEQ ID NO: 488775 - DNA, 16 bp, R. norvegicus
caggtggttgtgaacc

SEQ ID NO: 488776 - DNA, 16 bp, R. norvegicus
caggtgtcatacagac

SEQ ID NO: 488777 - DNA, 16 bp, R. norvegicus
caggtgtctgtggagg

SEQ ID NO: 488778 - DNA, 16 bp, R. norvegicus
caggtgtgagtgtgtg

SEQ ID NO: 488779 - DNA, 16 bp, R. norvegicus
caggtgtggctgctgt

SEQ ID NO: 488780 - DNA, 16 bp, R. norvegicus
caggtgtggtagcaca

SEQ ID NO: 488781 - DNA, 16 bp, R. norvegicus
caggtgtggtccaggt

SEQ ID NO: 488782 - DNA, 16 bp, R. norvegicus
caggtgtggtggcaca

SEQ ID NO: 488783 - DNA, 16 bp, R. norvegicus
caggtgtgtgggaagg

SEQ ID NO: 488784 - DNA, 16 bp, R. norvegicus
caggtgttcaaggcca

SEQ ID NO: 488785 - DNA, 16 bp, R. norvegicus
caggtgttttgttaca

SEQ ID NO: 488786 - DNA, 16 bp, R. norvegicus
caggttactgtatcaa

SEQ ID NO: 488787 - DNA, 16 bp, R. norvegicus
caggttcaaaagttca

SEQ ID NO: 488788 - DNA, 16 bp, R. norvegicus
caggttcaacttcctg

SEQ ID NO: 488789 - DNA, 16 bp, R. norvegicus
caggttcaaggtcagc

SEQ ID NO: 488790 - DNA, 16 bp, R. norvegicus
caggttcaattcccag

SEQ ID NO: 488791 - DNA, 16 bp, R. norvegicus
caggttccattctcca

SEQ ID NO: 488792 - DNA, 16 bp, R. norvegicus
caggttcccagctttt

SEQ ID NO: 488793 - DNA, 16 bp, R. norvegicus
caggttcctgacagca

SEQ ID NO: 488794 - DNA, 16 bp, R. norvegicus
caggttcctgcctcca

SEQ ID NO: 488795 - DNA, 16 bp, R. norvegicus
caggttctctgtaaga

SEQ ID NO: 488796 - DNA, 16 bp, R. norvegicus
caggttctgtgagaga

SEQ ID NO: 488797 - DNA, 16 bp, R. norvegicus
caggttgaaaaagaaa

SEQ ID NO: 488798 - DNA, 16 bp, R. norvegicus
caggttgcagagagag

SEQ ID NO: 488799 - DNA, 16 bp, R. norvegicus
caggttggagagatgg

SEQ ID NO: 488800 - DNA, 16 bp, R. norvegicus
caggttgtcctctgac

SEQ ID NO: 488801 - DNA, 16 bp, R. norvegicus
caggtttattgggaaa

SEQ ID NO: 488802 - DNA, 16 bp, R. norvegicus
caggtttctgccctgc

SEQ ID NO: 488803 - DNA, 16 bp, R. norvegicus
caggtttggggacagg

SEQ ID NO: 488804 - DNA, 18 bp, R. norvegicus
caggttttcctgatatct

SEQ ID NO: 488805 - DNA, 16 bp, R. norvegicus
caggttttctttgtgt

SEQ ID NO: 488806 - DNA, 16 bp, R. norvegicus
caggttttcttttctt

SEQ ID NO: 488807 - DNA, 16 bp, R. norvegicus
caggttttgggtctgg

SEQ ID NO: 488808 - DNA, 16 bp, R. norvegicus
cagtaaaggaaaaatg

SEQ ID NO: 488809 - DNA, 16 bp, R. norvegicus
cagtaaatatattcaa

SEQ ID NO: 488810 - DNA, 16 bp, R. norvegicus
cagtaagagaagatgc

SEQ ID NO: 488811 - DNA, 16 bp, R. norvegicus
cagtaagatagataaa

SEQ ID NO: 488812 - DNA, 16 bp, R. norvegicus
cagtaagcagcatcct

SEQ ID NO: 488813 - DNA, 16 bp, R. norvegicus
cagtaagcagcatttc

SEQ ID NO: 488814 - DNA, 16 bp, R. norvegicus
cagtaagcagcgccct

SEQ ID NO: 488815 - DNA, 16 bp, R. norvegicus
cagtaagcctcagaga

SEQ ID NO: 488816 - DNA, 16 bp, R. norvegicus
cagtaagggctacaca

SEQ ID NO: 488817 - DNA, 16 bp, R. norvegicus
cagtaagttccaggcc

SEQ ID NO: 488818 - DNA, 16 bp, R. norvegicus
cagtacacagacatac

SEQ ID NO: 488819 - DNA, 16 bp, R. norvegicus
cagtacacatccatcc

SEQ ID NO: 488820 - DNA, 16 bp, R. norvegicus
cagtacacctgaaagc

SEQ ID NO: 488821 - DNA, 16 bp, R. norvegicus
cagtaccacagcccag

SEQ ID NO: 488822 - DNA, 16 bp, R. norvegicus
cagtaccaggaatggg

SEQ ID NO: 488823 - DNA, 16 bp, R. norvegicus
cagtaccaggcatgaa

SEQ ID NO: 488824 - DNA, 16 bp, R. norvegicus
cagtaccatgtctgct

SEQ ID NO: 488825 - DNA, 16 bp, R. norvegicus
cagtacctcatggaac

SEQ ID NO: 488826 - DNA, 16 bp, R. norvegicus
cagtacctgacagggg

SEQ ID NO: 488827 - DNA, 16 bp, R. norvegicus
cagtacctgatgctgg

SEQ ID NO: 488828 - DNA, 16 bp, R. norvegicus
cagtacctgcagttct

SEQ ID NO: 488829 - DNA, 16 bp, R. norvegicus
cagtactaagaagaaa

SEQ ID NO: 488830 - DNA, 16 bp, R. norvegicus
cagtactactcagcta

SEQ ID NO: 488831 - DNA, 16 bp, R. norvegicus
cagtactcagaactca

SEQ ID NO: 488832 - DNA, 16 bp, R. norvegicus
cagtacttggaaggca

SEQ ID NO: 488833 - DNA, 16 bp, R. norvegicus
cagtagaacttggcag

SEQ ID NO: 488834 - DNA, 16 bp, R. norvegicus
cagtagacttcagctt

SEQ ID NO: 488835 - DNA, 16 bp, R. norvegicus
cagtagcaaaatcaca

SEQ ID NO: 488836 - DNA, 16 bp, R. norvegicus
cagtagcaacagcagc

SEQ ID NO: 488837 - DNA, 16 bp, R. norvegicus
cagtagcagcagcttc

SEQ ID NO: 488838 - DNA, 16 bp, R. norvegicus
cagtagccttcctcaa

SEQ ID NO: 488839 - DNA, 16 bp, R. norvegicus
cagtagtagcagcagc

SEQ ID NO: 488840 - DNA, 16 bp, R. norvegicus
cagtagtggacagtgg

SEQ ID NO: 488841 - DNA, 16 bp, R. norvegicus
cagtatcttggtgaat

SEQ ID NO: 488842 - DNA, 16 bp, R. norvegicus
cagtatgagctcttaa

SEQ ID NO: 488843 - DNA, 16 bp, R. norvegicus
cagtatgcacttcttg

SEQ ID NO: 488844 - DNA, 16 bp, R. norvegicus
cagtattacagaggaa

SEQ ID NO: 488845 - DNA, 16 bp, R. norvegicus
cagtattccattgtgt

SEQ ID NO: 488846 - DNA, 16 bp, R. norvegicus
cagtattcctgagtta

SEQ ID NO: 488847 - DNA, 16 bp, R. norvegicus
cagtcaaaaactctga

SEQ ID NO: 488848 - DNA, 16 bp, R. norvegicus
cagtcaaaacattcat

SEQ ID NO: 488849 - DNA, 16 bp, R. norvegicus
cagtcaaagaagatgc

SEQ ID NO: 488850 - DNA, 16 bp, R. norvegicus
cagtcaacaaacccag

SEQ ID NO: 488851 - DNA, 16 bp, R. norvegicus
cagtcaaccactggac

SEQ ID NO: 488852 - DNA, 16 bp, R. norvegicus
cagtcaatggagagaa

SEQ ID NO: 488853 - DNA, 16 bp, R. norvegicus
cagtcacagaggagca

SEQ ID NO: 488854 - DNA, 16 bp, R. norvegicus
cagtcacaggaaatga

SEQ ID NO: 488855 - DNA, 16 bp, R. norvegicus
cagtcacagtcacagt

SEQ ID NO: 488856 - DNA, 16 bp, R. norvegicus
cagtcacatggtggct

SEQ ID NO: 488857 - DNA, 16 bp, R. norvegicus
cagtcaccaaacccat

SEQ ID NO: 488858 - DNA, 16 bp, R. norvegicus
cagtcaccaggagcac

SEQ ID NO: 488859 - DNA, 16 bp, R. norvegicus
cagtcactctccctct

SEQ ID NO: 488860 - DNA, 16 bp, R. norvegicus
cagtcactctggcact

SEQ ID NO: 488861 - DNA, 16 bp, R. norvegicus
cagtcactggatggcc

SEQ ID NO: 488862 - DNA, 16 bp, R. norvegicus
cagtcagaaatagcag

SEQ ID NO: 488863 - DNA, 16 bp, R. norvegicus
cagtcagaagctgaga

SEQ ID NO: 488864 - DNA, 16 bp, R. norvegicus
cagtcagaatggctaa

SEQ ID NO: 488865 - DNA, 16 bp, R. norvegicus
cagtcagacagacagg

SEQ ID NO: 488866 - DNA, 16 bp, R. norvegicus
cagtcagagctacaga

SEQ ID NO: 488867 - DNA, 16 bp, R. norvegicus
cagtcagatcaagatg

SEQ ID NO: 488868 - DNA, 16 bp, R. norvegicus
cagtcagcctctttcc

SEQ ID NO: 488869 - DNA, 16 bp, R. norvegicus
cagtcagcctggagag

SEQ ID NO: 488870 - DNA, 16 bp, R. norvegicus
cagtcagctgcagaag

SEQ ID NO: 488871 - DNA, 16 bp, R. norvegicus
cagtcagctgctggtg

SEQ ID NO: 488872 - DNA, 16 bp, R. norvegicus
cagtcaggaaacagaa

SEQ ID NO: 488873 - DNA, 16 bp, R. norvegicus
cagtcaggaagctgag

SEQ ID NO: 488874 - DNA, 16 bp, R. norvegicus
cagtcaggagacagag

SEQ ID NO: 488875 - DNA, 16 bp, R. norvegicus
cagtcagtactcttaa

SEQ ID NO: 488876 - DNA, 16 bp, R. norvegicus
cagtcagtgctctgaa

SEQ ID NO: 488877 - DNA, 16 bp, R. norvegicus
cagtcatcatcagaaa

SEQ ID NO: 488878 - DNA, 16 bp, R. norvegicus
cagtcatcatcagaga

SEQ ID NO: 488879 - DNA, 16 bp, R. norvegicus
cagtcattaaattctc

SEQ ID NO: 488880 - DNA, 16 bp, R. norvegicus
cagtcattggctggcc

SEQ ID NO: 488881 - DNA, 16 bp, R. norvegicus
cagtccaagtggatca

SEQ ID NO: 488882 - DNA, 16 bp, R. norvegicus
cagtccagtcctctag

SEQ ID NO: 488883 - DNA, 16 bp, R. norvegicus
cagtccattctcatca

SEQ ID NO: 488884 - DNA, 16 bp, R. norvegicus
cagtccccagcaccca

SEQ ID NO: 488885 - DNA, 16 bp, R. norvegicus
cagtccccagcatcca

SEQ ID NO: 488886 - DNA, 16 bp, R. norvegicus
cagtccccagctccag

SEQ ID NO: 488887 - DNA, 17 bp, R. norvegicus
cagtccccagctctgaa

SEQ ID NO: 488888 - DNA, 16 bp, R. norvegicus
cagtccccagctctgg

SEQ ID NO: 488889 - DNA, 16 bp, R. norvegicus
cagtcccctgctggct

SEQ ID NO: 488890 - DNA, 16 bp, R. norvegicus
cagtccctgacactat

SEQ ID NO: 488891 - DNA, 16 bp, R. norvegicus
cagtccctgcctggca

SEQ ID NO: 488892 - DNA, 16 bp, R. norvegicus
cagtcctcagcaccca

SEQ ID NO: 488893 - DNA, 16 bp, R. norvegicus
cagtcctcagctcaaa

SEQ ID NO: 488894 - DNA, 16 bp, R. norvegicus
cagtcctctaggcagg

SEQ ID NO: 488895 - DNA, 16 bp, R. norvegicus
cagtcctgacacacag

SEQ ID NO: 488896 - DNA, 16 bp, R. norvegicus
cagtcctgcctcagcc

SEQ ID NO: 488897 - DNA, 16 bp, R. norvegicus
cagtcctgctgtgtct

SEQ ID NO: 488898 - DNA, 16 bp, R. norvegicus
cagtccttccatgtct

SEQ ID NO: 488899 - DNA, 16 bp, R. norvegicus
cagtccttctaagaag

SEQ ID NO: 488900 - DNA, 16 bp, R. norvegicus
cagtctcagttcaatg

SEQ ID NO: 488901 - DNA, 16 bp, R. norvegicus
cagtctccaaggtcaa

SEQ ID NO: 488902 - DNA, 16 bp, R. norvegicus
cagtctccatcttcta

SEQ ID NO: 488903 - DNA, 16 bp, R. norvegicus
cagtctccatggtcaa

SEQ ID NO: 488904 - DNA, 16 bp, R. norvegicus
cagtctcccacagaca

SEQ ID NO: 488905 - DNA, 16 bp, R. norvegicus
cagtctcccctgagct

SEQ ID NO: 488906 - DNA, 16 bp, R. norvegicus
cagtctcctgcctcag

SEQ ID NO: 488907 - DNA, 16 bp, R. norvegicus
cagtctctcaggagac

SEQ ID NO: 488908 - DNA, 16 bp, R. norvegicus
cagtctctccctctcc

SEQ ID NO: 488909 - DNA, 16 bp, R. norvegicus
cagtctctctgcctcc

SEQ ID NO: 488910 - DNA, 16 bp, R. norvegicus
cagtctctgctccatc

SEQ ID NO: 488911 - DNA, 16 bp, R. norvegicus
cagtctctgctccttt

SEQ ID NO: 488912 - DNA, 16 bp, R. norvegicus
cagtctctgcttcagt

SEQ ID NO: 488913 - DNA, 16 bp, R. norvegicus
cagtctctggaaccca

SEQ ID NO: 488914 - DNA, 16 bp, R. norvegicus
cagtctctggatagcc

SEQ ID NO: 488915 - DNA, 16 bp, R. norvegicus
cagtctctgtttcatc

SEQ ID NO: 488916 - DNA, 16 bp, R. norvegicus
cagtctcttcagtcat

SEQ ID NO: 488917 - DNA, 16 bp, R. norvegicus
cagtctcttctgattt

SEQ ID NO: 488918 - DNA, 16 bp, R. norvegicus
cagtctcttgatggtt

SEQ ID NO: 488919 - DNA, 28 bp, R. norvegicus
cagtctctttcggagggacaatcatatc

SEQ ID NO: 488920 - DNA, 16 bp, R. norvegicus
cagtctgaaagttcct

SEQ ID NO: 488921 - DNA, 16 bp, R. norvegicus
cagtctgaagacctcc

SEQ ID NO: 488922 - DNA, 16 bp, R. norvegicus
cagtctgatggaggca

SEQ ID NO: 488923 - DNA, 16 bp, R. norvegicus
cagtctgatttccaga

SEQ ID NO: 488924 - DNA, 17 bp, R. norvegicus
cagtctggaggttcttc

SEQ ID NO: 488925 - DNA, 16 bp, R. norvegicus
cagtctggggctggag

SEQ ID NO: 488926 - DNA, 16 bp, R. norvegicus
cagtctggtgtacaga

SEQ ID NO: 488927 - DNA, 16 bp, R. norvegicus
cagtctggtgtttcct

SEQ ID NO: 488928 - DNA, 16 bp, R. norvegicus
cagtctgtcatggtgg

SEQ ID NO: 488929 - DNA, 16 bp, R. norvegicus
cagtctgtctatgtct

SEQ ID NO: 488930 - DNA, 16 bp, R. norvegicus
cagtctgtttactcca

SEQ ID NO: 488931 - DNA, 16 bp, R. norvegicus
cagtcttctccagaaa

SEQ ID NO: 488932 - DNA, 16 bp, R. norvegicus
cagtcttgggaaaaaa

SEQ ID NO: 488933 - DNA, 16 bp, R. norvegicus
cagtcttttcctgttt

SEQ ID NO: 488934 - DNA, 16 bp, R. norvegicus
cagtgaaaaagacaga

SEQ ID NO: 488935 - DNA, 16 bp, R. norvegicus
cagtgaaaaaggaagg

SEQ ID NO: 488936 - DNA, 16 bp, R. norvegicus
cagtgaaaaatcacaa

SEQ ID NO: 488937 - DNA, 16 bp, R. norvegicus
cagtgaaaataatttt

SEQ ID NO: 488938 - DNA, 16 bp, R. norvegicus
cagtgaacagaagctg

SEQ ID NO: 488939 - DNA, 16 bp, R. norvegicus
cagtgaagacatgaga

SEQ ID NO: 488940 - DNA, 16 bp, R. norvegicus
cagtgaagagaggcag

SEQ ID NO: 488941 - DNA, 16 bp, R. norvegicus
cagtgaagatcaaact

SEQ ID NO: 488942 - DNA, 16 bp, R. norvegicus
cagtgaaggagttaga

SEQ ID NO: 488943 - DNA, 16 bp, R. norvegicus
cagtgacaaagacata

SEQ ID NO: 488944 - DNA, 16 bp, R. norvegicus
cagtgacagaaagctg

SEQ ID NO: 488945 - DNA, 16 bp, R. norvegicus
cagtgacagcagcagc

SEQ ID NO: 488946 - DNA, 16 bp, R. norvegicus
cagtgacaggcccaaa

SEQ ID NO: 488947 - DNA, 16 bp, R. norvegicus
cagtgacaggcccaac

SEQ ID NO: 488948 - DNA, 16 bp, R. norvegicus
cagtgacagtgagagc

SEQ ID NO: 488949 - DNA, 16 bp, R. norvegicus
cagtgacctttgcctt

SEQ ID NO: 488950 - DNA, 16 bp, R. norvegicus
cagtgactcctggagg

SEQ ID NO: 488951 - DNA, 16 bp, R. norvegicus
cagtgactgagggaaa

SEQ ID NO: 488952 - DNA, 16 bp, R. norvegicus
cagtgagaacatacca

SEQ ID NO: 488953 - DNA, 19 bp, R. norvegicus
cagtgagaagggctaagat

SEQ ID NO: 488954 - DNA, 16 bp, R. norvegicus
cagtgagagacagaaa

SEQ ID NO: 488955 - DNA, 16 bp, R. norvegicus
cagtgagaggagaggc

SEQ ID NO: 488956 - DNA, 16 bp, R. norvegicus
cagtgagagtgagggc

SEQ ID NO: 488957 - DNA, 16 bp, R. norvegicus
cagtgagctccagggt

SEQ ID NO: 488958 - DNA, 16 bp, R. norvegicus
cagtgagctcctggga

SEQ ID NO: 488959 - DNA, 16 bp, R. norvegicus
cagtgaggagctgggg

SEQ ID NO: 488960 - DNA, 16 bp, R. norvegicus
cagtgaggatgtggag

SEQ ID NO: 488961 - DNA, 16 bp, R. norvegicus
cagtgaggccctgtct

SEQ ID NO: 488962 - DNA, 16 bp, R. norvegicus
cagtgagtgagtgagt

SEQ ID NO: 488963 - DNA, 16 bp, R. norvegicus
cagtgagttcaaagct

SEQ ID NO: 488964 - DNA, 17 bp, R. norvegicus
cagtgagttccaggaca

SEQ ID NO: 488965 - DNA, 16 bp, R. norvegicus
cagtgagttccagggc

SEQ ID NO: 488966 - DNA, 16 bp, R. norvegicus
cagtgatcgtgattgt

SEQ ID NO: 488967 - DNA, 16 bp, R. norvegicus
cagtgatcttcctgcc

SEQ ID NO: 488968 - DNA, 16 bp, R. norvegicus
cagtgatgatgatggt

SEQ ID NO: 488969 - DNA, 16 bp, R. norvegicus
cagtgatggactacaa

SEQ ID NO: 488970 - DNA, 16 bp, R. norvegicus
cagtgatggcagtgtg

SEQ ID NO: 488971 - DNA, 16 bp, R. norvegicus
cagtgatttgctgctg

SEQ ID NO: 488972 - DNA, 16 bp, R. norvegicus
cagtgcacagaagaag

SEQ ID NO: 488973 - DNA, 16 bp, R. norvegicus
cagtgcacagacacac

SEQ ID NO: 488974 - DNA, 16 bp, R. norvegicus
cagtgcacagcagcat

SEQ ID NO: 488975 - DNA, 16 bp, R. norvegicus
cagtgcacctgcccca

SEQ ID NO: 488976 - DNA, 16 bp, R. norvegicus
cagtgcagcagggttc

SEQ ID NO: 488977 - DNA, 16 bp, R. norvegicus
cagtgcagggagagag

SEQ ID NO: 488978 - DNA, 16 bp, R. norvegicus
cagtgcagtcactgct

SEQ ID NO: 488979 - DNA, 16 bp, R. norvegicus
cagtgcagtgtcctgg

SEQ ID NO: 488980 - DNA, 16 bp, R. norvegicus
cagtgcatgggggctc

SEQ ID NO: 488981 - DNA, 16 bp, R. norvegicus
cagtgcattctgggaa

SEQ ID NO: 488982 - DNA, 16 bp, R. norvegicus
cagtgccatgcctgtc

SEQ ID NO: 488983 - DNA, 16 bp, R. norvegicus
cagtgccccaaaatat

SEQ ID NO: 488984 - DNA, 16 bp, R. norvegicus
cagtgccctctgctgg

SEQ ID NO: 488985 - DNA, 16 bp, R. norvegicus
cagtgcctctggcctc

SEQ ID NO: 488986 - DNA, 16 bp, R. norvegicus
cagtgcctgcagaaag

SEQ ID NO: 488987 - DNA, 16 bp, R. norvegicus
cagtgctactccctgg

SEQ ID NO: 488988 - DNA, 16 bp, R. norvegicus
cagtgctcctgagcca

SEQ ID NO: 488989 - DNA, 17 bp, R. norvegicus
cagtgctctggctcaga

SEQ ID NO: 488990 - DNA, 16 bp, R. norvegicus
cagtgctgaggatcaa

SEQ ID NO: 488991 - DNA, 16 bp, R. norvegicus
cagtgctgggattgta

SEQ ID NO: 488992 - DNA, 16 bp, R. norvegicus
cagtgctggggagatg

SEQ ID NO: 488993 - DNA, 16 bp, R. norvegicus
cagtgctgggggtgga

SEQ ID NO: 488994 - DNA, 16 bp, R. norvegicus
cagtgctgtgctgtgc

SEQ ID NO: 488995 - DNA, 16 bp, R. norvegicus
cagtgcttggaaggca

SEQ ID NO: 488996 - DNA, 16 bp, R. norvegicus
cagtggaaaaaaagag

SEQ ID NO: 488997 - DNA, 16 bp, R. norvegicus
cagtggaaaaaatttc

SEQ ID NO: 488998 - DNA, 16 bp, R. norvegicus
cagtggaaggaaaagc

SEQ ID NO: 488999 - DNA, 16 bp, R. norvegicus
cagtggaaggagagag

SEQ ID NO: 489000 - DNA, 16 bp, R. norvegicus
cagtggaaggagagga

SEQ ID NO: 489001 - DNA, 16 bp, R. norvegicus
cagtggaatggaattg

SEQ ID NO: 489002 - DNA, 16 bp, R. norvegicus
cagtggacctgagttc

SEQ ID NO: 489003 - DNA, 16 bp, R. norvegicus
cagtggactgggtcct

SEQ ID NO: 489004 - DNA, 16 bp, R. norvegicus
cagtggagaacaggca

SEQ ID NO: 489005 - DNA, 16 bp, R. norvegicus
cagtggaggaaatgcc

SEQ ID NO: 489006 - DNA, 16 bp, R. norvegicus
cagtggaggatatgga

SEQ ID NO: 489007 - DNA, 16 bp, R. norvegicus
cagtggaggcctggct

SEQ ID NO: 489008 - DNA, 16 bp, R. norvegicus
cagtggagtggagtca

SEQ ID NO: 489009 - DNA, 16 bp, R. norvegicus
cagtggatggaggcag

SEQ ID NO: 489010 - DNA, 16 bp, R. norvegicus
cagtggatggccccat

SEQ ID NO: 489011 - DNA, 16 bp, R. norvegicus
cagtggcagctcaatc

SEQ ID NO: 489012 - DNA, 16 bp, R. norvegicus
cagtggcagtggcagt

SEQ ID NO: 489013 - DNA, 16 bp, R. norvegicus
cagtggctacagcaca

SEQ ID NO: 489014 - DNA, 16 bp, R. norvegicus
cagtggctcacagcca

SEQ ID NO: 489015 - DNA, 16 bp, R. norvegicus
cagtggctctcaactt

SEQ ID NO: 489016 - DNA, 16 bp, R. norvegicus
cagtggctgaggctgg

SEQ ID NO: 489017 - DNA, 16 bp, R. norvegicus
cagtggctttccttag

SEQ ID NO: 489018 - DNA, 16 bp, R. norvegicus
cagtgggaaaaaagat

SEQ ID NO: 489019 - DNA, 16 bp, R. norvegicus
cagtgggaagagaggc

SEQ ID NO: 489020 - DNA, 16 bp, R. norvegicus
cagtgggagagagagc

SEQ ID NO: 489021 - DNA, 16 bp, R. norvegicus
cagtgggagagccagg

SEQ ID NO: 489022 - DNA, 16 bp, R. norvegicus
cagtgggagaggaagc

SEQ ID NO: 489023 - DNA, 16 bp, R. norvegicus
cagtgggagaggatgc

SEQ ID NO: 489024 - DNA, 16 bp, R. norvegicus
cagtgggagagggaac

SEQ ID NO: 489025 - DNA, 16 bp, R. norvegicus
cagtgggagatggaga

SEQ ID NO: 489026 - DNA, 16 bp, R. norvegicus
cagtgggaggagagaa

SEQ ID NO: 489027 - DNA, 16 bp, R. norvegicus
cagtgggccatgttct

SEQ ID NO: 489028 - DNA, 16 bp, R. norvegicus
cagtgggctgggcact

SEQ ID NO: 489029 - DNA, 16 bp, R. norvegicus
cagtgggctgggcctt

SEQ ID NO: 489030 - DNA, 16 bp, R. norvegicus
cagtggggacatggaa

SEQ ID NO: 489031 - DNA, 16 bp, R. norvegicus
cagtggggacccagtt

SEQ ID NO: 489032 - DNA, 16 bp, R. norvegicus
cagtggggtgggagag

SEQ ID NO: 489033 - DNA, 16 bp, R. norvegicus
cagtgggtaccaggcc

SEQ ID NO: 489034 - DNA, 16 bp, R. norvegicus
cagtgggtggcaccat

SEQ ID NO: 489035 - DNA, 16 bp, R. norvegicus
cagtggtctgggccct

SEQ ID NO: 489036 - DNA, 16 bp, R. norvegicus
cagtggtggagcactt

SEQ ID NO: 489037 - DNA, 16 bp, R. norvegicus
cagtggtggcaccacc

SEQ ID NO: 489038 - DNA, 16 bp, R. norvegicus
cagtggtggcatacac

SEQ ID NO: 489039 - DNA, 16 bp, R. norvegicus
cagtggtggtgatggt

SEQ ID NO: 489040 - DNA, 16 bp, R. norvegicus
cagtggtgtctcagac

SEQ ID NO: 489041 - DNA, 16 bp, R. norvegicus
cagtggttctcaacct

SEQ ID NO: 489042 - DNA, 16 bp, R. norvegicus
cagtggttctcaactt

SEQ ID NO: 489043 - DNA, 19 bp, R. norvegicus
cagtgtaaggggaagccct

SEQ ID NO: 489044 - DNA, 18 bp, R. norvegicus
cagtgtacgcatatacat

SEQ ID NO: 489045 - DNA, 16 bp, R. norvegicus
cagtgtacttaaataa

SEQ ID NO: 489046 - DNA, 16 bp, R. norvegicus
cagtgtcagctcagtg

SEQ ID NO: 489047 - DNA, 16 bp, R. norvegicus
cagtgtcctacatgca

SEQ ID NO: 489048 - DNA, 16 bp, R. norvegicus
cagtgtcctatgctgt

SEQ ID NO: 489049 - DNA, 16 bp, R. norvegicus
cagtgtcctcaactgc

SEQ ID NO: 489050 - DNA, 16 bp, R. norvegicus
cagtgtccttagcctt

SEQ ID NO: 489051 - DNA, 16 bp, R. norvegicus
cagtgtctccagctgc

SEQ ID NO: 489052 - DNA, 16 bp, R. norvegicus
cagtgtctctgctgcc

SEQ ID NO: 489053 - DNA, 16 bp, R. norvegicus
cagtgtctgcactgga

SEQ ID NO: 489054 - DNA, 16 bp, R. norvegicus
cagtgtctttttcctt

SEQ ID NO: 489055 - DNA, 16 bp, R. norvegicus
cagtgtgctctctgcc

SEQ ID NO: 489056 - DNA, 16 bp, R. norvegicus
cagtgtggaagagacc

SEQ ID NO: 489057 - DNA, 16 bp, R. norvegicus
cagtgtggaagtgtaa

SEQ ID NO: 489058 - DNA, 16 bp, R. norvegicus
cagtgtggaggtcaga

SEQ ID NO: 489059 - DNA, 16 bp, R. norvegicus
cagtgtggatgtgtac

SEQ ID NO: 489060 - DNA, 16 bp, R. norvegicus
cagtgtggcacagtct

SEQ ID NO: 489061 - DNA, 16 bp, R. norvegicus
cagtgtggcagtgtgg

SEQ ID NO: 489062 - DNA, 16 bp, R. norvegicus
cagtgtggcagttcct

SEQ ID NO: 489063 - DNA, 16 bp, R. norvegicus
cagtgtggccagctgc

SEQ ID NO: 489064 - DNA, 16 bp, R. norvegicus
cagtgtggggctggag

SEQ ID NO: 489065 - DNA, 16 bp, R. norvegicus
cagtgtgtgacagtgt

SEQ ID NO: 489066 - DNA, 16 bp, R. norvegicus
cagtgtgtgctcttaa

SEQ ID NO: 489067 - DNA, 16 bp, R. norvegicus
cagtgtgttccaggct

SEQ ID NO: 489068 - DNA, 16 bp, R. norvegicus
cagtgttcccagctca

SEQ ID NO: 489069 - DNA, 16 bp, R. norvegicus
cagtgttcctctttct

SEQ ID NO: 489070 - DNA, 16 bp, R. norvegicus
cagtgttctgctagca

SEQ ID NO: 489071 - DNA, 16 bp, R. norvegicus
cagtgttctttgcctt

SEQ ID NO: 489072 - DNA, 26 bp, R. norvegicus
cagtgttgtggtgacaccaactgcct

SEQ ID NO: 489073 - DNA, 16 bp, R. norvegicus
cagtgttgtttccatg

SEQ ID NO: 489074 - DNA, 16 bp, R. norvegicus
cagtgtttcttctgtt

SEQ ID NO: 489075 - DNA, 16 bp, R. norvegicus
cagtgtttggctgtgg

SEQ ID NO: 489076 - DNA, 16 bp, R. norvegicus
cagtgttttgcctaca

SEQ ID NO: 489077 - DNA, 16 bp, R. norvegicus
cagtgttttggagatg

SEQ ID NO: 489078 - DNA, 16 bp, R. norvegicus
cagtgtttttgtttgt

SEQ ID NO: 489079 - DNA, 16 bp, R. norvegicus
cagttaagagcacttg

SEQ ID NO: 489080 - DNA, 16 bp, R. norvegicus
cagttacaaagaaagg

SEQ ID NO: 489081 - DNA, 16 bp, R. norvegicus
cagttagaccagcacc

SEQ ID NO: 489082 - DNA, 16 bp, R. norvegicus
cagttataaaagttat

SEQ ID NO: 489083 - DNA, 28 bp, R. norvegicus
cagttatggggacagagtgttctgcttt

SEQ ID NO: 489084 - DNA, 16 bp, R. norvegicus
cagttattatcactat

SEQ ID NO: 489085 - DNA, 16 bp, R. norvegicus
cagttcaaaggttggc

SEQ ID NO: 489086 - DNA, 16 bp, R. norvegicus
cagttcaagaccagcc

SEQ ID NO: 489087 - DNA, 16 bp, R. norvegicus
cagttcaatgatttcc

SEQ ID NO: 489088 - DNA, 16 bp, R. norvegicus
cagttcacagaactca

SEQ ID NO: 489089 - DNA, 16 bp, R. norvegicus
cagttcacagccatct

SEQ ID NO: 489090 - DNA, 16 bp, R. norvegicus
cagttcacttcctgct

SEQ ID NO: 489091 - DNA, 16 bp, R. norvegicus
cagttcagaaactgga

SEQ ID NO: 489092 - DNA, 16 bp, R. norvegicus
cagttcaggatctgaa

SEQ ID NO: 489093 - DNA, 16 bp, R. norvegicus
cagttcagtcagtcaa

SEQ ID NO: 489094 - DNA, 16 bp, R. norvegicus
cagttccagagaatcc

SEQ ID NO: 489095 - DNA, 16 bp, R. norvegicus
cagttccaggaaatcc

SEQ ID NO: 489096 - DNA, 16 bp, R. norvegicus
cagttccaggacaacc

SEQ ID NO: 489097 - DNA, 16 bp, R. norvegicus
cagttccaggagatct

SEQ ID NO: 489098 - DNA, 16 bp, R. norvegicus
cagttccaggcacagc

SEQ ID NO: 489099 - DNA, 16 bp, R. norvegicus
cagttccagtggaaac

SEQ ID NO: 489100 - DNA, 16 bp, R. norvegicus
cagttcccagcacaca

SEQ ID NO: 489101 - DNA, 16 bp, R. norvegicus
cagttcccagcagcca

SEQ ID NO: 489102 - DNA, 16 bp, R. norvegicus
cagttcccctccccca

SEQ ID NO: 489103 - DNA, 16 bp, R. norvegicus
cagttccctccctccc

SEQ ID NO: 489104 - DNA, 16 bp, R. norvegicus
cagttcctcagaaaac

SEQ ID NO: 489105 - DNA, 16 bp, R. norvegicus
cagttcctcaggctgt

SEQ ID NO: 489106 - DNA, 16 bp, R. norvegicus
cagttcctcatcccat

SEQ ID NO: 489107 - DNA, 16 bp, R. norvegicus
cagttcctcctgctgt

SEQ ID NO: 489108 - DNA, 16 bp, R. norvegicus
cagttcctgagaaaat

SEQ ID NO: 489109 - DNA, 16 bp, R. norvegicus
cagttcctgagacatc

SEQ ID NO: 489110 - DNA, 16 bp, R. norvegicus
cagttcctgcctccgg

SEQ ID NO: 489111 - DNA, 16 bp, R. norvegicus
cagttcctgtcagcat

SEQ ID NO: 489112 - DNA, 16 bp, R. norvegicus
cagttcctgtgccctg

SEQ ID NO: 489113 - DNA, 16 bp, R. norvegicus
cagttccttcagttct

SEQ ID NO: 489114 - DNA, 16 bp, R. norvegicus
cagttccttctccagc

SEQ ID NO: 489115 - DNA, 16 bp, R. norvegicus
cagttctacctcaaga

SEQ ID NO: 489116 - DNA, 16 bp, R. norvegicus
cagttctcagcaccca

SEQ ID NO: 489117 - DNA, 16 bp, R. norvegicus
cagttctcccaccaca

SEQ ID NO: 489118 - DNA, 16 bp, R. norvegicus
cagttctcccaggttc

SEQ ID NO: 489119 - DNA, 16 bp, R. norvegicus
cagttctctccttccc

SEQ ID NO: 489120 - DNA, 16 bp, R. norvegicus
cagttctctgagttca

SEQ ID NO: 489121 - DNA, 16 bp, R. norvegicus
cagttctctgttccca

SEQ ID NO: 489122 - DNA, 16 bp, R. norvegicus
cagttctggaagccgt

SEQ ID NO: 489123 - DNA, 16 bp, R. norvegicus
cagttctggggatcca

SEQ ID NO: 489124 - DNA, 16 bp, R. norvegicus
cagttctgggtgcagg

SEQ ID NO: 489125 - DNA, 16 bp, R. norvegicus
cagttctgtgcaccca

SEQ ID NO: 489126 - DNA, 16 bp, R. norvegicus
cagttcttactctgat

SEQ ID NO: 489127 - DNA, 16 bp, R. norvegicus
cagttcttcatcccat

SEQ ID NO: 489128 - DNA, 16 bp, R. norvegicus
cagttcttccccagag

SEQ ID NO: 489129 - DNA, 16 bp, R. norvegicus
cagttgagccagcacc

SEQ ID NO: 489130 - DNA, 16 bp, R. norvegicus
cagttgatgacttctg

SEQ ID NO: 489131 - DNA, 16 bp, R. norvegicus
cagttgccaggagtgc

SEQ ID NO: 489132 - DNA, 16 bp, R. norvegicus
cagttgtgaatctctg

SEQ ID NO: 489133 - DNA, 16 bp, R. norvegicus
cagttgtgaggcacca

SEQ ID NO: 489134 - DNA, 16 bp, R. norvegicus
cagttgtgggaacaga

SEQ ID NO: 489135 - DNA, 16 bp, R. norvegicus
cagttgttcaatttca

SEQ ID NO: 489136 - DNA, 16 bp, R. norvegicus
cagtttaaaaaataaa

SEQ ID NO: 489137 - DNA, 16 bp, R. norvegicus
cagtttattgagtcat

SEQ ID NO: 489138 - DNA, 16 bp, R. norvegicus
cagtttcagccatgtg

SEQ ID NO: 489139 - DNA, 16 bp, R. norvegicus
cagtttcatccatttg

SEQ ID NO: 489140 - DNA, 16 bp, R. norvegicus
cagtttcccagccagc

SEQ ID NO: 489141 - DNA, 16 bp, R. norvegicus
cagtttcctctccctc

SEQ ID NO: 489142 - DNA, 16 bp, R. norvegicus
cagtttcctgcaccca

SEQ ID NO: 489143 - DNA, 16 bp, R. norvegicus
cagtttctcctccaca

SEQ ID NO: 489144 - DNA, 16 bp, R. norvegicus
cagtttctcctctgga

SEQ ID NO: 489145 - DNA, 16 bp, R. norvegicus
cagtttctctgctgac

SEQ ID NO: 489146 - DNA, 16 bp, R. norvegicus
cagtttctcttactgg

SEQ ID NO: 489147 - DNA, 16 bp, R. norvegicus
cagtttctgcctccca

SEQ ID NO: 489148 - DNA, 16 bp, R. norvegicus
cagtttcttcttgggc

SEQ ID NO: 489149 - DNA, 16 bp, R. norvegicus
cagtttgaggagaaaa

SEQ ID NO: 489150 - DNA, 16 bp, R. norvegicus
cagtttgcaatgccac

SEQ ID NO: 489151 - DNA, 16 bp, R. norvegicus
cagtttgcactcccac

SEQ ID NO: 489152 - DNA, 16 bp, R. norvegicus
cagtttggactcaagg

SEQ ID NO: 489153 - DNA, 16 bp, R. norvegicus
cagtttgtacccaaag

SEQ ID NO: 489154 - DNA, 16 bp, R. norvegicus
cagtttgtctgtctgt

SEQ ID NO: 489155 - DNA, 16 bp, R. norvegicus
cagttttaagaggtcc

SEQ ID NO: 489156 - DNA, 16 bp, R. norvegicus
cagttttattcatttc

SEQ ID NO: 489157 - DNA, 16 bp, R. norvegicus
cagttttccctccctc

SEQ ID NO: 489158 - DNA, 16 bp, R. norvegicus
cagttttctccttcca

SEQ ID NO: 489159 - DNA, 16 bp, R. norvegicus
cagttttctgaagaac

SEQ ID NO: 489160 - DNA, 16 bp, R. norvegicus
cagttttctgagaaaa

SEQ ID NO: 489161 - DNA, 16 bp, R. norvegicus
cagttttctgaggagc

SEQ ID NO: 489162 - DNA, 16 bp, R. norvegicus
cagttttcttcaaggg

SEQ ID NO: 489163 - DNA, 16 bp, R. norvegicus
cagttttcttctcttt

SEQ ID NO: 489164 - DNA, 16 bp, R. norvegicus
cagttttctttgcctt

SEQ ID NO: 489165 - DNA, 16 bp, R. norvegicus
cagttttggagaagat

SEQ ID NO: 489166 - DNA, 16 bp, R. norvegicus
cagttttgtgtgtgtg

SEQ ID NO: 489167 - DNA, 16 bp, R. norvegicus
cagtttttctccattt

SEQ ID NO: 489168 - DNA, 16 bp, R. norvegicus
cagttttttgggtttt

SEQ ID NO: 489169 - DNA, 16 bp, R. norvegicus
cataaaaccagccagc

SEQ ID NO: 489170 - DNA, 16 bp, R. norvegicus
cataaaagaaacacta

SEQ ID NO: 489171 - DNA, 16 bp, R. norvegicus
cataaaagaacacata

SEQ ID NO: 489172 - DNA, 16 bp, R. norvegicus
cataaaagaatacaca

SEQ ID NO: 489173 - DNA, 16 bp, R. norvegicus
cataaaagaatatata

SEQ ID NO: 489174 - DNA, 16 bp, R. norvegicus
cataaaataattttgt

SEQ ID NO: 489175 - DNA, 16 bp, R. norvegicus
cataaaattaaatttc

SEQ ID NO: 489176 - DNA, 16 bp, R. norvegicus
cataaaattatttcac

SEQ ID NO: 489177 - DNA, 16 bp, R. norvegicus
cataaaattctaagaa

SEQ ID NO: 489178 - DNA, 16 bp, R. norvegicus
cataaaattgaaaagt

SEQ ID NO: 489179 - DNA, 16 bp, R. norvegicus
cataaaattgtttttg

SEQ ID NO: 489180 - DNA, 16 bp, R. norvegicus
cataaagacacacaca

SEQ ID NO: 489181 - DNA, 16 bp, R. norvegicus
cataaagcagtccaag

SEQ ID NO: 489182 - DNA, 16 bp, R. norvegicus
cataaataatcaagta

SEQ ID NO: 489183 - DNA, 16 bp, R. norvegicus
cataaatcaagacaat

SEQ ID NO: 489184 - DNA, 16 bp, R. norvegicus
cataaatgtataaata

SEQ ID NO: 489185 - DNA, 16 bp, R. norvegicus
cataaccaaggcaatt

SEQ ID NO: 489186 - DNA, 16 bp, R. norvegicus
cataaccttcccaaac

SEQ ID NO: 489187 - DNA, 16 bp, R. norvegicus
cataagtcctctatcc

SEQ ID NO: 489188 - DNA, 16 bp, R. norvegicus
cataatagacaaaaca

SEQ ID NO: 489189 - DNA, 16 bp, R. norvegicus
cataatagtcaaagca

SEQ ID NO: 489190 - DNA, 16 bp, R. norvegicus
cataatcttctgggct

SEQ ID NO: 489191 - DNA, 16 bp, R. norvegicus
cataatgtgaatatct

SEQ ID NO: 489192 - DNA, 16 bp, R. norvegicus
cataattataattttg

SEQ ID NO: 489193 - DNA, 16 bp, R. norvegicus
cataatttaattcata

SEQ ID NO: 489194 - DNA, 30 bp, R. norvegicus
cataatttcagccattgtgctgtctgctgc

SEQ ID NO: 489195 - DNA, 16 bp, R. norvegicus
cataattttaaaaaga

SEQ ID NO: 489196 - DNA, 16 bp, R. norvegicus
catacaacacacatgt

SEQ ID NO: 489197 - DNA, 48 bp, R. norvegicus
catacaagaagcctacagaactccaaatagattggaccagaaaagaaa

SEQ ID NO: 489198 - DNA, 16 bp, R. norvegicus
catacaagcaaaacac

SEQ ID NO: 489199 - DNA, 16 bp, R. norvegicus
catacaagcacataca

SEQ ID NO: 489200 - DNA, 16 bp, R. norvegicus
catacaatggaaaagg

SEQ ID NO: 489201 - DNA, 16 bp, R. norvegicus
catacaattcatattg

SEQ ID NO: 489202 - DNA, 16 bp, R. norvegicus
catacacaaatacatg

SEQ ID NO: 489203 - DNA, 16 bp, R. norvegicus
catacacacacaagca

SEQ ID NO: 489204 - DNA, 16 bp, R. norvegicus
catacacacagaggta

SEQ ID NO: 489205 - DNA, 16 bp, R. norvegicus
catacacacatatttt

SEQ ID NO: 489206 - DNA, 16 bp, R. norvegicus
catacacacatgcagg

SEQ ID NO: 489207 - DNA, 16 bp, R. norvegicus
catacacacatgtatg

SEQ ID NO: 489208 - DNA, 16 bp, R. norvegicus
catacacagagatata

SEQ ID NO: 489209 - DNA, 16 bp, R. norvegicus
catacacagatacaca

SEQ ID NO: 489210 - DNA, 16 bp, R. norvegicus
catacacagtctcaca

SEQ ID NO: 489211 - DNA, 16 bp, R. norvegicus
catacacataagataa

SEQ ID NO: 489212 - DNA, 16 bp, R. norvegicus
catacacatacacaca

SEQ ID NO: 489213 - DNA, 16 bp, R. norvegicus
catacacataggcaaa

SEQ ID NO: 489214 - DNA, 16 bp, R. norvegicus
catacacatgcacaca

SEQ ID NO: 489215 - DNA, 16 bp, R. norvegicus
catacacgtgtacaca

SEQ ID NO: 489216 - DNA, 16 bp, R. norvegicus
catacactcacatgca

SEQ ID NO: 489217 - DNA, 16 bp, R. norvegicus
catacagaactccaaa

SEQ ID NO: 489218 - DNA, 16 bp, R. norvegicus
catacagaaggggaga

SEQ ID NO: 489219 - DNA, 16 bp, R. norvegicus
catacagactgtaaga

SEQ ID NO: 489220 - DNA, 16 bp, R. norvegicus
catacagccaccaaat

SEQ ID NO: 489221 - DNA, 16 bp, R. norvegicus
catacaggcatgcaca

SEQ ID NO: 489222 - DNA, 16 bp, R. norvegicus
catacaggttttatga

SEQ ID NO: 489223 - DNA, 16 bp, R. norvegicus
catacagtcacacaga

SEQ ID NO: 489224 - DNA, 16 bp, R. norvegicus
catacataaaagaaag

SEQ ID NO: 489225 - DNA, 16 bp, R. norvegicus
catacatacacataca

SEQ ID NO: 489226 - DNA, 16 bp, R. norvegicus
catacatacataaatg

SEQ ID NO: 489227 - DNA, 16 bp, R. norvegicus
catacatacatacaca

SEQ ID NO: 489228 - DNA, 16 bp, R. norvegicus
catacatacatacaga

SEQ ID NO: 489229 - DNA, 16 bp, R. norvegicus
catacatacatacatg

SEQ ID NO: 489230 - DNA, 16 bp, R. norvegicus
catacatacataccag

SEQ ID NO: 489231 - DNA, 16 bp, R. norvegicus
catacataccatacat

SEQ ID NO: 489232 - DNA, 16 bp, R. norvegicus
catacatagcagagga

SEQ ID NO: 489233 - DNA, 16 bp, R. norvegicus
catacatatacatgca

SEQ ID NO: 489234 - DNA, 16 bp, R. norvegicus
catacatgaaggcaaa

SEQ ID NO: 489235 - DNA, 16 bp, R. norvegicus
catacatgtatataat

SEQ ID NO: 489236 - DNA, 16 bp, R. norvegicus
catacatgtatgtgta

SEQ ID NO: 489237 - DNA, 16 bp, R. norvegicus
catacatgtgccctct

SEQ ID NO: 489238 - DNA, 16 bp, R. norvegicus
catacattttttaaaa

SEQ ID NO: 489239 - DNA, 16 bp, R. norvegicus
cataccaagtgtgttc

SEQ ID NO: 489240 - DNA, 16 bp, R. norvegicus
cataccacacacatat

SEQ ID NO: 489241 - DNA, 16 bp, R. norvegicus
cataccacatacatat

SEQ ID NO: 489242 - DNA, 16 bp, R. norvegicus
cataccagaagaaggc

SEQ ID NO: 489243 - DNA, 16 bp, R. norvegicus
cataccatgcatgttt

SEQ ID NO: 489244 - DNA, 16 bp, R. norvegicus
catacccaataactta

SEQ ID NO: 489245 - DNA, 16 bp, R. norvegicus
catacctgatcctgcc

SEQ ID NO: 489246 - DNA, 16 bp, R. norvegicus
catacgcatacacaca

SEQ ID NO: 489247 - DNA, 16 bp, R. norvegicus
catactcagaactcag

SEQ ID NO: 489248 - DNA, 16 bp, R. norvegicus
catactcatcaaaaaa

SEQ ID NO: 489249 - DNA, 16 bp, R. norvegicus
catactggagaaaaac

SEQ ID NO: 489250 - DNA, 16 bp, R. norvegicus
catactggagagaaac

SEQ ID NO: 489251 - DNA, 16 bp, R. norvegicus
catactttgttgctct

SEQ ID NO: 489252 - DNA, 16 bp, R. norvegicus
catagaaacacagaaa

SEQ ID NO: 489253 - DNA, 16 bp, R. norvegicus
catagaagaactcata

SEQ ID NO: 489254 - DNA, 16 bp, R. norvegicus
catagaagaaggagaa

SEQ ID NO: 489255 - DNA, 16 bp, R. norvegicus
catagaagaaggggag

SEQ ID NO: 489256 - DNA, 16 bp, R. norvegicus
catagaagacctcatg

SEQ ID NO: 489257 - DNA, 16 bp, R. norvegicus
catagaagatatcata

SEQ ID NO: 489258 - DNA, 16 bp, R. norvegicus
catagaagcaggggat

SEQ ID NO: 489259 - DNA, 16 bp, R. norvegicus
catagaaggaacttgg

SEQ ID NO: 489260 - DNA, 16 bp, R. norvegicus
catagaaggagaaacc

SEQ ID NO: 489261 - DNA, 16 bp, R. norvegicus
catagaaggggaggag

SEQ ID NO: 489262 - DNA, 16 bp, R. norvegicus
catagaatatattttg

SEQ ID NO: 489263 - DNA, 16 bp, R. norvegicus
catagacacacacata

SEQ ID NO: 489264 - DNA, 16 bp, R. norvegicus
catagacacagaaaca

SEQ ID NO: 489265 - DNA, 16 bp, R. norvegicus
catagacccaaaagat

SEQ ID NO: 489266 - DNA, 16 bp, R. norvegicus
catagatgcacacaca

SEQ ID NO: 489267 - DNA, 16 bp, R. norvegicus
catagcaagttccaga

SEQ ID NO: 489268 - DNA, 16 bp, R. norvegicus
catagcagctttattc

SEQ ID NO: 489269 - DNA, 16 bp, R. norvegicus
catagcagtaaaatcc

SEQ ID NO: 489270 - DNA, 26 bp, R. norvegicus
catagccaaataaggacttgtttact

SEQ ID NO: 489271 - DNA, 16 bp, R. norvegicus
catagccatctgtaac

SEQ ID NO: 489272 - DNA, 16 bp, R. norvegicus
catagctctgagtggc

SEQ ID NO: 489273 - DNA, 16 bp, R. norvegicus
catagctctggctgtc

SEQ ID NO: 489274 - DNA, 18 bp, R. norvegicus
cataggtagtaatgaata

SEQ ID NO: 489275 - DNA, 16 bp, R. norvegicus
catagtgaatttgaag

SEQ ID NO: 489276 - DNA, 16 bp, R. norvegicus
catagtgccactccct

SEQ ID NO: 489277 - DNA, 16 bp, R. norvegicus
catagtggaaggaaag

SEQ ID NO: 489278 - DNA, 16 bp, R. norvegicus
catagtggagcccgtg

SEQ ID NO: 489279 - DNA, 16 bp, R. norvegicus
catagtggggcatgtg

SEQ ID NO: 489280 - DNA, 16 bp, R. norvegicus
catagtggtacacacc

SEQ ID NO: 489281 - DNA, 16 bp, R. norvegicus
catagttttcaagata

SEQ ID NO: 489282 - DNA, 16 bp, R. norvegicus
catataattgggcaca

SEQ ID NO: 489283 - DNA, 16 bp, R. norvegicus
catatacacaaatgca

SEQ ID NO: 489284 - DNA, 16 bp, R. norvegicus
catatacacacaccta

SEQ ID NO: 489285 - DNA, 16 bp, R. norvegicus
catatacacatagaca

SEQ ID NO: 489286 - DNA, 16 bp, R. norvegicus
catatacagaaacaca

SEQ ID NO: 489287 - DNA, 16 bp, R. norvegicus
catatacagcaaacaa

SEQ ID NO: 489288 - DNA, 16 bp, R. norvegicus
catatacatacacaca

SEQ ID NO: 489289 - DNA, 16 bp, R. norvegicus
catatacccaaatgat

SEQ ID NO: 489290 - DNA, 16 bp, R. norvegicus
catatagacatacata

SEQ ID NO: 489291 - DNA, 16 bp, R. norvegicus
catatatacatatata

SEQ ID NO: 489292 - DNA, 16 bp, R. norvegicus
catatatacatggaaa

SEQ ID NO: 489293 - DNA, 16 bp, R. norvegicus
catatatagccaccaa

SEQ ID NO: 489294 - DNA, 16 bp, R. norvegicus
catatatatatatgta

SEQ ID NO: 489295 - DNA, 16 bp, R. norvegicus
catatatatgcatatg

SEQ ID NO: 489296 - DNA, 16 bp, R. norvegicus
catatatatgtacaca

SEQ ID NO: 489297 - DNA, 16 bp, R. norvegicus
catatatatgtataca

SEQ ID NO: 489298 - DNA, 16 bp, R. norvegicus
catatatcccaggctg

SEQ ID NO: 489299 - DNA, 16 bp, R. norvegicus
catatatgcagacaaa

SEQ ID NO: 489300 - DNA, 16 bp, R. norvegicus
catatatgtatgaaat

SEQ ID NO: 489301 - DNA, 16 bp, R. norvegicus
catatcatcggcaaat

SEQ ID NO: 489302 - DNA, 16 bp, R. norvegicus
catatcccacacaggg

SEQ ID NO: 489303 - DNA, 16 bp, R. norvegicus
catatcccacacctgg

SEQ ID NO: 489304 - DNA, 16 bp, R. norvegicus
catatcctctcccact

SEQ ID NO: 489305 - DNA, 16 bp, R. norvegicus
catatctaaacagaga

SEQ ID NO: 489306 - DNA, 16 bp, R. norvegicus
catatctcacagacag

SEQ ID NO: 489307 - DNA, 16 bp, R. norvegicus
catatctgactccaga

SEQ ID NO: 489308 - DNA, 16 bp, R. norvegicus
catatgaagccaccaa

SEQ ID NO: 489309 - DNA, 16 bp, R. norvegicus
catatgcaaatacaca

SEQ ID NO: 489310 - DNA, 16 bp, R. norvegicus
catatgcattttggtc

SEQ ID NO: 489311 - DNA, 17 bp, R. norvegicus
catatgctcttccctgt

SEQ ID NO: 489312 - DNA, 16 bp, R. norvegicus
catatgggctggatcc

SEQ ID NO: 489313 - DNA, 16 bp, R. norvegicus
catatgtaacagatgt

SEQ ID NO: 489314 - DNA, 16 bp, R. norvegicus
catatgtagcagagaa

SEQ ID NO: 489315 - DNA, 16 bp, R. norvegicus
catatgtatgcacaca

SEQ ID NO: 489316 - DNA, 16 bp, R. norvegicus
catatgtgcagacaca

SEQ ID NO: 489317 - DNA, 16 bp, R. norvegicus
catatgtgtgtgcact

SEQ ID NO: 489318 - DNA, 16 bp, R. norvegicus
catatgtgtgtgtgca

SEQ ID NO: 489319 - DNA, 16 bp, R. norvegicus
catattcaaagaaaaa

SEQ ID NO: 489320 - DNA, 16 bp, R. norvegicus
catattcacacacact

SEQ ID NO: 489321 - DNA, 16 bp, R. norvegicus
catattggagatgcca

SEQ ID NO: 489322 - DNA, 16 bp, R. norvegicus
catatttatatataca

SEQ ID NO: 489323 - DNA, 16 bp, R. norvegicus
catatttcttcctatg

SEQ ID NO: 489324 - DNA, 16 bp, R. norvegicus
catattttaaaactat

SEQ ID NO: 489325 - DNA, 16 bp, R. norvegicus
catattttccagtttt

SEQ ID NO: 489326 - DNA, 53 bp, R. norvegicus
catcaaaacaatcatccaccatgatcaagtaggcttcatcccaggcatgcaga

SEQ ID NO: 489327 - DNA, 16 bp, R. norvegicus
catcaaaaccatcatc

SEQ ID NO: 489328 - DNA, 16 bp, R. norvegicus
catcaaaacccagttc

SEQ ID NO: 489329 - DNA, 16 bp, R. norvegicus
catcaaaatacaaaga

SEQ ID NO: 489330 - DNA, 16 bp, R. norvegicus
catcaaaatcccaagt

SEQ ID NO: 489331 - DNA, 16 bp, R. norvegicus
catcaaaattccaaga

SEQ ID NO: 489332 - DNA, 16 bp, R. norvegicus
catcaaaattcttact

SEQ ID NO: 489333 - DNA, 16 bp, R. norvegicus
catcaaacatggagaa

SEQ ID NO: 489334 - DNA, 16 bp, R. norvegicus
catcaaaccaggactt

SEQ ID NO: 489335 - DNA, 16 bp, R. norvegicus
catcaaactcacagag

SEQ ID NO: 489336 - DNA, 16 bp, R. norvegicus
catcaaactccattct

SEQ ID NO: 489337 - DNA, 16 bp, R. norvegicus
catcaaactgccttct

SEQ ID NO: 489338 - DNA, 16 bp, R. norvegicus
catcaaagaaaaatct

SEQ ID NO: 489339 - DNA, 16 bp, R. norvegicus
catcaaagaaaaattc

SEQ ID NO: 489340 - DNA, 16 bp, R. norvegicus
catcaaagaaaatact

SEQ ID NO: 489341 - DNA, 16 bp, R. norvegicus
catcaaagaagaccta

SEQ ID NO: 489342 - DNA, 16 bp, R. norvegicus
catcaaagaagcctct

SEQ ID NO: 489343 - DNA, 16 bp, R. norvegicus
catcaaagacatcatc

SEQ ID NO: 489344 - DNA, 16 bp, R. norvegicus
catcaaagagaactct

SEQ ID NO: 489345 - DNA, 16 bp, R. norvegicus
catcaaaggaaaaaac

SEQ ID NO: 489346 - DNA, 16 bp, R. norvegicus
catcaaaggaaaaaca

SEQ ID NO: 489347 - DNA, 16 bp, R. norvegicus
catcaaaggacaaatc

SEQ ID NO: 489348 - DNA, 16 bp, R. norvegicus
catcaaatgaccaaac

SEQ ID NO: 489349 - DNA, 16 bp, R. norvegicus
catcaacaacagaaac

SEQ ID NO: 489350 - DNA, 16 bp, R. norvegicus
catcaacatcaacatc

SEQ ID NO: 489351 - DNA, 16 bp, R. norvegicus
catcaacatcaccatc

SEQ ID NO: 489352 - DNA, 16 bp, R. norvegicus
catcaacatggctgcc

SEQ ID NO: 489353 - DNA, 16 bp, R. norvegicus
catcaacattcataag

SEQ ID NO: 489354 - DNA, 16 bp, R. norvegicus
catcaacccagccaca

SEQ ID NO: 489355 - DNA, 17 bp, R. norvegicus
catcaaccgcacagcac

SEQ ID NO: 489356 - DNA, 16 bp, R. norvegicus
catcaactcctgcctc

SEQ ID NO: 489357 - DNA, 16 bp, R. norvegicus
catcaagaaagacata

SEQ ID NO: 489358 - DNA, 16 bp, R. norvegicus
catcaagcctgacaac

SEQ ID NO: 489359 - DNA, 16 bp, R. norvegicus
catcaagccttcccag

SEQ ID NO: 489360 - DNA, 16 bp, R. norvegicus
catcaaggacctccac

SEQ ID NO: 489361 - DNA, 16 bp, R. norvegicus
catcaagttctggagg

SEQ ID NO: 489362 - DNA, 16 bp, R. norvegicus
catcaatattcacaag

SEQ ID NO: 489363 - DNA, 16 bp, R. norvegicus
catcaatggacccaat

SEQ ID NO: 489364 - DNA, 16 bp, R. norvegicus
catcacacacatcaca

SEQ ID NO: 489365 - DNA, 16 bp, R. norvegicus
catcacagaagaagct

SEQ ID NO: 489366 - DNA, 16 bp, R. norvegicus
catcacagcacagcag

SEQ ID NO: 489367 - DNA, 16 bp, R. norvegicus
catcacagccatagaa

SEQ ID NO: 489368 - DNA, 25 bp, R. norvegicus
catcacagtgctcctccatcacagt

SEQ ID NO: 489369 - DNA, 16 bp, R. norvegicus
catcacatcatcatca

SEQ ID NO: 489370 - DNA, 16 bp, R. norvegicus
catcaccaccaccgcc

SEQ ID NO: 489371 - DNA, 16 bp, R. norvegicus
catcaccaccagcacc

SEQ ID NO: 489372 - DNA, 16 bp, R. norvegicus
catcaccaccagcagc

SEQ ID NO: 489373 - DNA, 16 bp, R. norvegicus
catcaccaccattacc

SEQ ID NO: 489374 - DNA, 16 bp, R. norvegicus
catcaccaccgccacc

SEQ ID NO: 489375 - DNA, 16 bp, R. norvegicus
catcaccagctttctg

SEQ ID NO: 489376 - DNA, 16 bp, R. norvegicus
catcaccatcactgtc

SEQ ID NO: 489377 - DNA, 16 bp, R. norvegicus
catcaccatcatcaac

SEQ ID NO: 489378 - DNA, 16 bp, R. norvegicus
catcaccatcctcatc

SEQ ID NO: 489379 - DNA, 16 bp, R. norvegicus
catcaccatcttcatc

SEQ ID NO: 489380 - DNA, 16 bp, R. norvegicus
catcaccatgcccagc

SEQ ID NO: 489381 - DNA, 16 bp, R. norvegicus
catcaccatggcctca

SEQ ID NO: 489382 - DNA, 16 bp, R. norvegicus
catcaccttcatcatc

SEQ ID NO: 489383 - DNA, 16 bp, R. norvegicus
catcactgagggaaga

SEQ ID NO: 489384 - DNA, 16 bp, R. norvegicus
catcactgagggaagt

SEQ ID NO: 489385 - DNA, 16 bp, R. norvegicus
catcactgcatccctg

SEQ ID NO: 489386 - DNA, 16 bp, R. norvegicus
catcactgtcaccatc

SEQ ID NO: 489387 - DNA, 16 bp, R. norvegicus
catcactgtcctcatc

SEQ ID NO: 489388 - DNA, 16 bp, R. norvegicus
catcacttcccaggag

SEQ ID NO: 489389 - DNA, 16 bp, R. norvegicus
catcagaaaccaagac

SEQ ID NO: 489390 - DNA, 16 bp, R. norvegicus
catcagaaagcacaga

SEQ ID NO: 489391 - DNA, 16 bp, R. norvegicus
catcagaattacacca

SEQ ID NO: 489392 - DNA, 16 bp, R. norvegicus
catcagacagctcaca

SEQ ID NO: 489393 - DNA, 16 bp, R. norvegicus
catcagacatggaggt

SEQ ID NO: 489394 - DNA, 16 bp, R. norvegicus
catcagagaagctttt

SEQ ID NO: 489395 - DNA, 16 bp, R. norvegicus
catcagagaattcata

SEQ ID NO: 489396 - DNA, 16 bp, R. norvegicus
catcagagtccctgga

SEQ ID NO: 489397 - DNA, 16 bp, R. norvegicus
catcagatcccattac

SEQ ID NO: 489398 - DNA, 16 bp, R. norvegicus
catcagatcctctgga

SEQ ID NO: 489399 - DNA, 16 bp, R. norvegicus
catcagatgctgaaaa

SEQ ID NO: 489400 - DNA, 16 bp, R. norvegicus
catcagcaagcacttc

SEQ ID NO: 489401 - DNA, 16 bp, R. norvegicus
catcagcagcctcctc

SEQ ID NO: 489402 - DNA, 16 bp, R. norvegicus
catcagcatcaccacc

SEQ ID NO: 489403 - DNA, 17 bp, R. norvegicus
catcagcgccacagatg

SEQ ID NO: 489404 - DNA, 16 bp, R. norvegicus
catcagctcctgcttg

SEQ ID NO: 489405 - DNA, 16 bp, R. norvegicus
catcagctgatggaca

SEQ ID NO: 489406 - DNA, 16 bp, R. norvegicus
catcagcttctgcttc

SEQ ID NO: 489407 - DNA, 16 bp, R. norvegicus
catcaggaaaatggaa

SEQ ID NO: 489408 - DNA, 16 bp, R. norvegicus
catcaggaaagtgcaa

SEQ ID NO: 489409 - DNA, 16 bp, R. norvegicus
catcaggaggaggagg

SEQ ID NO: 489410 - DNA, 16 bp, R. norvegicus
catcaggattctaatc

SEQ ID NO: 489411 - DNA, 16 bp, R. norvegicus
catcagggaaatccaa

SEQ ID NO: 489412 - DNA, 16 bp, R. norvegicus
catcagggaagcttct

SEQ ID NO: 489413 - DNA, 16 bp, R. norvegicus
catcagggcaggagca

SEQ ID NO: 489414 - DNA, 16 bp, R. norvegicus
catcaggtcccctaga

SEQ ID NO: 489415 - DNA, 16 bp, R. norvegicus
catcagtaatggtgtc

SEQ ID NO: 489416 - DNA, 16 bp, R. norvegicus
catcagtcctgctgtg

SEQ ID NO: 489417 - DNA, 16 bp, R. norvegicus
catcagtcctgttgtg

SEQ ID NO: 489418 - DNA, 16 bp, R. norvegicus
catcagtctgtcctca

SEQ ID NO: 489419 - DNA, 16 bp, R. norvegicus
catcagtggaagggga

SEQ ID NO: 489420 - DNA, 16 bp, R. norvegicus
catcagtgggaagaaa

SEQ ID NO: 489421 - DNA, 16 bp, R. norvegicus
catcagtgggaggaga

SEQ ID NO: 489422 - DNA, 16 bp, R. norvegicus
catcagttactggtgt

SEQ ID NO: 489423 - DNA, 16 bp, R. norvegicus
catcatatacatgtac

SEQ ID NO: 489424 - DNA, 16 bp, R. norvegicus
catcatcacagcccag

SEQ ID NO: 489425 - DNA, 16 bp, R. norvegicus
catcatcaccagcatc

SEQ ID NO: 489426 - DNA, 16 bp, R. norvegicus
catcatcaccatcgtc

SEQ ID NO: 489427 - DNA, 16 bp, R. norvegicus
catcatcaccgtcatc

SEQ ID NO: 489428 - DNA, 16 bp, R. norvegicus
catcatcagaaaagct

SEQ ID NO: 489429 - DNA, 16 bp, R. norvegicus
catcatcagaatgctg

SEQ ID NO: 489430 - DNA, 16 bp, R. norvegicus
catcatcagagaccag

SEQ ID NO: 489431 - DNA, 16 bp, R. norvegicus
catcatcagatcccag

SEQ ID NO: 489432 - DNA, 16 bp, R. norvegicus
catcatcagcatccct

SEQ ID NO: 489433 - DNA, 16 bp, R. norvegicus
catcatcatcaacatc

SEQ ID NO: 489434 - DNA, 16 bp, R. norvegicus
catcatcatcaaggcg

SEQ ID NO: 489435 - DNA, 16 bp, R. norvegicus
catcatcatcaaggtg

SEQ ID NO: 489436 - DNA, 16 bp, R. norvegicus
catcatcatcatcatc

SEQ ID NO: 489437 - DNA, 16 bp, R. norvegicus
catcatcatcatcctt

SEQ ID NO: 489438 - DNA, 16 bp, R. norvegicus
catcatcatcatctct

SEQ ID NO: 489439 - DNA, 16 bp, R. norvegicus
catcatcatcatctgg

SEQ ID NO: 489440 - DNA, 16 bp, R. norvegicus
catcatcatcattgcc

SEQ ID NO: 489441 - DNA, 16 bp, R. norvegicus
catcatcatccaaaat

SEQ ID NO: 489442 - DNA, 16 bp, R. norvegicus
catcatcatcctcatc

SEQ ID NO: 489443 - DNA, 16 bp, R. norvegicus
catcatcatcctcttc

SEQ ID NO: 489444 - DNA, 16 bp, R. norvegicus
catcatcatctgaagg

SEQ ID NO: 489445 - DNA, 16 bp, R. norvegicus
catcatcatctgtatc

SEQ ID NO: 489446 - DNA, 16 bp, R. norvegicus
catcatcatcttcttc

SEQ ID NO: 489447 - DNA, 16 bp, R. norvegicus
catcatcccaaaatgt

SEQ ID NO: 489448 - DNA, 16 bp, R. norvegicus
catcatcctctctctc

SEQ ID NO: 489449 - DNA, 16 bp, R. norvegicus
catcatcctctgctac

SEQ ID NO: 489450 - DNA, 16 bp, R. norvegicus
catcatcgccagcatc

SEQ ID NO: 489451 - DNA, 16 bp, R. norvegicus
catcatctatgtatct

SEQ ID NO: 489452 - DNA, 16 bp, R. norvegicus
catcatctccatcacc

SEQ ID NO: 489453 - DNA, 16 bp, R. norvegicus
catcatctccatcatc

SEQ ID NO: 489454 - DNA, 16 bp, R. norvegicus
catcatcttcttcctc

SEQ ID NO: 489455 - DNA, 16 bp, R. norvegicus
catcatgaacaaatgt

SEQ ID NO: 489456 - DNA, 16 bp, R. norvegicus
catcatgaccaggaag

SEQ ID NO: 489457 - DNA, 16 bp, R. norvegicus
catcatgagctgggtg

SEQ ID NO: 489458 - DNA, 16 bp, R. norvegicus
catcatgagctgtgtg

SEQ ID NO: 489459 - DNA, 16 bp, R. norvegicus
catcatgatcaaggag

SEQ ID NO: 489460 - DNA, 16 bp, R. norvegicus
catcatgatcaagtag

SEQ ID NO: 489461 - DNA, 16 bp, R. norvegicus
catcatgcctgcctgg

SEQ ID NO: 489462 - DNA, 16 bp, R. norvegicus
catcatggcaggaaac

SEQ ID NO: 489463 - DNA, 16 bp, R. norvegicus
catcatgggagagctg

SEQ ID NO: 489464 - DNA, 16 bp, R. norvegicus
catcatgggtcctttc

SEQ ID NO: 489465 - DNA, 16 bp, R. norvegicus
catcatgttttcctta

SEQ ID NO: 489466 - DNA, 16 bp, R. norvegicus
catcattaccatcatc

SEQ ID NO: 489467 - DNA, 16 bp, R. norvegicus
catcattatcaccacc

SEQ ID NO: 489468 - DNA, 16 bp, R. norvegicus
catcattatcatcatc

SEQ ID NO: 489469 - DNA, 16 bp, R. norvegicus
catcattgaagaaagt

SEQ ID NO: 489470 - DNA, 16 bp, R. norvegicus
catcatttcccctttc

SEQ ID NO: 489471 - DNA, 16 bp, R. norvegicus
catcatttccctcttc

SEQ ID NO: 489472 - DNA, 16 bp, R. norvegicus
catcatttgcaataaa

SEQ ID NO: 489473 - DNA, 49 bp, R. norvegicus
catcattttactttcaagcctagaaattgcacacttgtatataaaccaa

SEQ ID NO: 489474 - DNA, 16 bp, R. norvegicus
catccaaattccaact

SEQ ID NO: 489475 - DNA, 16 bp, R. norvegicus
catccacagggcagct

SEQ ID NO: 489476 - DNA, 16 bp, R. norvegicus
catccaccaatccatc

SEQ ID NO: 489477 - DNA, 16 bp, R. norvegicus
catccacccatccttc

SEQ ID NO: 489478 - DNA, 16 bp, R. norvegicus
catccacctcaaaaat

SEQ ID NO: 489479 - DNA, 16 bp, R. norvegicus
catccacgtggcagct

SEQ ID NO: 489480 - DNA, 16 bp, R. norvegicus
catccactccagcaaa

SEQ ID NO: 489481 - DNA, 16 bp, R. norvegicus
catccactcctgcctc

SEQ ID NO: 489482 - DNA, 16 bp, R. norvegicus
catccactcttacaac

SEQ ID NO: 489483 - DNA, 16 bp, R. norvegicus
catccactgctggatg

SEQ ID NO: 489484 - DNA, 16 bp, R. norvegicus
catccagactctgaca

SEQ ID NO: 489485 - DNA, 16 bp, R. norvegicus
catccagagcatgtca

SEQ ID NO: 489486 - DNA, 16 bp, R. norvegicus
catccagagcctgccc

SEQ ID NO: 489487 - DNA, 16 bp, R. norvegicus
catccagagcgtgtcc

SEQ ID NO: 489488 - DNA, 16 bp, R. norvegicus
catccagagctcccag

SEQ ID NO: 489489 - DNA, 16 bp, R. norvegicus
catccagatcagcagg

SEQ ID NO: 489490 - DNA, 16 bp, R. norvegicus
catccagatttttcca

SEQ ID NO: 489491 - DNA, 16 bp, R. norvegicus
catccaggaaatccaa

SEQ ID NO: 489492 - DNA, 17 bp, R. norvegicus
catccaggaagaggggg

SEQ ID NO: 489493 - DNA, 16 bp, R. norvegicus
catccaggaagcagag

SEQ ID NO: 489494 - DNA, 16 bp, R. norvegicus
catccaggaccacctg

SEQ ID NO: 489495 - DNA, 16 bp, R. norvegicus
catccaggccttttct

SEQ ID NO: 489496 - DNA, 16 bp, R. norvegicus
catccagttcctgtct

SEQ ID NO: 489497 - DNA, 16 bp, R. norvegicus
catccatagtcatcag

SEQ ID NO: 489498 - DNA, 16 bp, R. norvegicus
catccatatacagcca

SEQ ID NO: 489499 - DNA, 16 bp, R. norvegicus
catccatccacctgtc

SEQ ID NO: 489500 - DNA, 16 bp, R. norvegicus
catccatccatccata

SEQ ID NO: 489501 - DNA, 16 bp, R. norvegicus
catccatccatccatc

SEQ ID NO: 489502 - DNA, 16 bp, R. norvegicus
catccatccatcctct

SEQ ID NO: 489503 - DNA, 16 bp, R. norvegicus
catccatccatcctgt

SEQ ID NO: 489504 - DNA, 16 bp, R. norvegicus
catccatcctatcaga

SEQ ID NO: 489505 - DNA, 16 bp, R. norvegicus
catccatccttccatc

SEQ ID NO: 489506 - DNA, 16 bp, R. norvegicus
catccatctgtccgtc

SEQ ID NO: 489507 - DNA, 16 bp, R. norvegicus
catccatgcagggaga

SEQ ID NO: 489508 - DNA, 16 bp, R. norvegicus
catccatgcatacata

SEQ ID NO: 489509 - DNA, 16 bp, R. norvegicus
catccatgcatccctg

SEQ ID NO: 489510 - DNA, 16 bp, R. norvegicus
catccattcccacctc

SEQ ID NO: 489511 - DNA, 16 bp, R. norvegicus
catccatttgtccatc

SEQ ID NO: 489512 - DNA, 16 bp, R. norvegicus
catccattttgtttag

SEQ ID NO: 489513 - DNA, 16 bp, R. norvegicus
catcccaaacactgcc

SEQ ID NO: 489514 - DNA, 16 bp, R. norvegicus
catcccagcatcccag

SEQ ID NO: 489515 - DNA, 16 bp, R. norvegicus
catcccaggaaatggg

SEQ ID NO: 489516 - DNA, 16 bp, R. norvegicus
catcccaggagatctg

SEQ ID NO: 489517 - DNA, 16 bp, R. norvegicus
catcccaggatgcagg

SEQ ID NO: 489518 - DNA, 18 bp, R. norvegicus
catcccaggcatggaggg

SEQ ID NO: 489519 - DNA, 16 bp, R. norvegicus
catcccagggaagcag

SEQ ID NO: 489520 - DNA, 16 bp, R. norvegicus
catcccaggtctctgg

SEQ ID NO: 489521 - DNA, 16 bp, R. norvegicus
catcccaggtttctgg

SEQ ID NO: 489522 - DNA, 16 bp, R. norvegicus
catcccatccacagac

SEQ ID NO: 489523 - DNA, 16 bp, R. norvegicus
catcccatctgcagac

SEQ ID NO: 489524 - DNA, 16 bp, R. norvegicus
catccccaagatctca

SEQ ID NO: 489525 - DNA, 16 bp, R. norvegicus
catccccagccctgca

SEQ ID NO: 489526 - DNA, 16 bp, R. norvegicus
catccccatctccatc

SEQ ID NO: 489527 - DNA, 16 bp, R. norvegicus
catcccccagccccag

SEQ ID NO: 489528 - DNA, 16 bp, R. norvegicus
catcccccatgcctgc

SEQ ID NO: 489529 - DNA, 16 bp, R. norvegicus
catccccctgcctcag

SEQ ID NO: 489530 - DNA, 16 bp, R. norvegicus
catcccctctgaggtg

SEQ ID NO: 489531 - DNA, 16 bp, R. norvegicus
catcccctttgcctct

SEQ ID NO: 489532 - DNA, 16 bp, R. norvegicus
catccctctccatgtg

SEQ ID NO: 489533 - DNA, 16 bp, R. norvegicus
catccctctgccctga

SEQ ID NO: 489534 - DNA, 16 bp, R. norvegicus
catccctgaatttctt

SEQ ID NO: 489535 - DNA, 16 bp, R. norvegicus
catccctgagatgaag

SEQ ID NO: 489536 - DNA, 16 bp, R. norvegicus
catccctgcatccccg

SEQ ID NO: 489537 - DNA, 16 bp, R. norvegicus
catccctgcatccctg

SEQ ID NO: 489538 - DNA, 16 bp, R. norvegicus
catccctggcctggtg

SEQ ID NO: 489539 - DNA, 16 bp, R. norvegicus
catccctgggccaaga

SEQ ID NO: 489540 - DNA, 16 bp, R. norvegicus
catccctggggtccct

SEQ ID NO: 489541 - DNA, 16 bp, R. norvegicus
catccctggtccaagg

SEQ ID NO: 489542 - DNA, 16 bp, R. norvegicus
catccctgtatccctg

SEQ ID NO: 489543 - DNA, 16 bp, R. norvegicus
catccctgtcaccatg

SEQ ID NO: 489544 - DNA, 16 bp, R. norvegicus
catcccttacttgatg

SEQ ID NO: 489545 - DNA, 16 bp, R. norvegicus
catcccttatgcagcc

SEQ ID NO: 489546 - DNA, 16 bp, R. norvegicus
catcccttcccctgag

SEQ ID NO: 489547 - DNA, 16 bp, R. norvegicus
catccggcagaacgca

SEQ ID NO: 489548 - DNA, 17 bp, R. norvegicus
catccggctcctgtcga

SEQ ID NO: 489549 - DNA, 16 bp, R. norvegicus
catccgtttcctgtca

SEQ ID NO: 489550 - DNA, 16 bp, R. norvegicus
catcctcaaacaaaag

SEQ ID NO: 489551 - DNA, 16 bp, R. norvegicus
catcctcacacagaca

SEQ ID NO: 489552 - DNA, 16 bp, R. norvegicus
catcctcacctgtgga

SEQ ID NO: 489553 - DNA, 16 bp, R. norvegicus
catcctcagctacata

SEQ ID NO: 489554 - DNA, 16 bp, R. norvegicus
catcctcatcaccatc

SEQ ID NO: 489555 - DNA, 16 bp, R. norvegicus
catcctcatcatcacc

SEQ ID NO: 489556 - DNA, 16 bp, R. norvegicus
catcctcctcatcatc

SEQ ID NO: 489557 - DNA, 16 bp, R. norvegicus
catcctcctgtctctg

SEQ ID NO: 489558 - DNA, 16 bp, R. norvegicus
catcctcgccaacatt

SEQ ID NO: 489559 - DNA, 16 bp, R. norvegicus
catcctcgccaccatc

SEQ ID NO: 489560 - DNA, 17 bp, R. norvegicus
catcctcgccagaattt

SEQ ID NO: 489561 - DNA, 18 bp, R. norvegicus
catcctcgccagcatctc

SEQ ID NO: 489562 - DNA, 33 bp, R. norvegicus
catcctcgccagcatctgctgtcccctgagttt

SEQ ID NO: 489563 - DNA, 16 bp, R. norvegicus
catcctcgccatcatc

SEQ ID NO: 489564 - DNA, 16 bp, R. norvegicus
catcctctccaacatc

SEQ ID NO: 489565 - DNA, 16 bp, R. norvegicus
catcctctccaccatc

SEQ ID NO: 489566 - DNA, 16 bp, R. norvegicus
catcctctccagcatc

SEQ ID NO: 489567 - DNA, 16 bp, R. norvegicus
catcctctctggcctc

SEQ ID NO: 489568 - DNA, 16 bp, R. norvegicus
catcctctgcaacata

SEQ ID NO: 489569 - DNA, 16 bp, R. norvegicus
catcctctgccacaca

SEQ ID NO: 489570 - DNA, 16 bp, R. norvegicus
catcctctgggacatt

SEQ ID NO: 489571 - DNA, 16 bp, R. norvegicus
catcctcttcctcatc

SEQ ID NO: 489572 - DNA, 16 bp, R. norvegicus
catcctgaaactcact

SEQ ID NO: 489573 - DNA, 16 bp, R. norvegicus
catcctgaaattcttt

SEQ ID NO: 489574 - DNA, 16 bp, R. norvegicus
catcctgaagcagctg

SEQ ID NO: 489575 - DNA, 16 bp, R. norvegicus
catcctgaatgaggca

SEQ ID NO: 489576 - DNA, 16 bp, R. norvegicus
catcctgacatcagat

SEQ ID NO: 489577 - DNA, 16 bp, R. norvegicus
catcctgaccctgcct

SEQ ID NO: 489578 - DNA, 16 bp, R. norvegicus
catcctgagagaggta

SEQ ID NO: 489579 - DNA, 21 bp, R. norvegicus
catcctgcaccaccaactgct

SEQ ID NO: 489580 - DNA, 16 bp, R. norvegicus
catcctgcaccactgc

SEQ ID NO: 489581 - DNA, 16 bp, R. norvegicus
catcctgctccttcca

SEQ ID NO: 489582 - DNA, 16 bp, R. norvegicus
catcctggggtctcca

SEQ ID NO: 489583 - DNA, 16 bp, R. norvegicus
catcctggtctacagg

SEQ ID NO: 489584 - DNA, 16 bp, R. norvegicus
catcctggtggggaag

SEQ ID NO: 489585 - DNA, 16 bp, R. norvegicus
catcctggttgcaggc

SEQ ID NO: 489586 - DNA, 16 bp, R. norvegicus
catcctgttgatgtca

SEQ ID NO: 489587 - DNA, 16 bp, R. norvegicus
catcctgttgccaggc

SEQ ID NO: 489588 - DNA, 16 bp, R. norvegicus
catccttatggagaca

SEQ ID NO: 489589 - DNA, 16 bp, R. norvegicus
catccttccagcccca

SEQ ID NO: 489590 - DNA, 16 bp, R. norvegicus
catccttcccaccatg

SEQ ID NO: 489591 - DNA, 16 bp, R. norvegicus
catccttctgtttctc

SEQ ID NO: 489592 - DNA, 16 bp, R. norvegicus
catccttggtcatcag

SEQ ID NO: 489593 - DNA, 16 bp, R. norvegicus
catccttgtggagatg

SEQ ID NO: 489594 - DNA, 16 bp, R. norvegicus
catcctttctcctgtg

SEQ ID NO: 489595 - DNA, 16 bp, R. norvegicus
catcgccatggggaag

SEQ ID NO: 489596 - DNA, 21 bp, R. norvegicus
catcggagcccaattctccca

SEQ ID NO: 489597 - DNA, 16 bp, R. norvegicus
catcggattccctgga

SEQ ID NO: 489598 - DNA, 20 bp, R. norvegicus
catcgtaccttaaaagagct

SEQ ID NO: 489599 - DNA, 16 bp, R. norvegicus
catcgtcatcattgtc

SEQ ID NO: 489600 - DNA, 16 bp, R. norvegicus
catctacccaaaagat

SEQ ID NO: 489601 - DNA, 16 bp, R. norvegicus
catctacccaatggag

SEQ ID NO: 489602 - DNA, 16 bp, R. norvegicus
catctacccatctgtc

SEQ ID NO: 489603 - DNA, 16 bp, R. norvegicus
catctactgcaagagg

SEQ ID NO: 489604 - DNA, 16 bp, R. norvegicus
catctactgctaggca

SEQ ID NO: 489605 - DNA, 16 bp, R. norvegicus
catctactttccacca

SEQ ID NO: 489606 - DNA, 16 bp, R. norvegicus
catctatagtctttgg

SEQ ID NO: 489607 - DNA, 16 bp, R. norvegicus
catctatcaaaaacaa

SEQ ID NO: 489608 - DNA, 16 bp, R. norvegicus
catctatccatcatct

SEQ ID NO: 489609 - DNA, 16 bp, R. norvegicus
catctatggcaattga

SEQ ID NO: 489610 - DNA, 16 bp, R. norvegicus
catctcaccagcccca

SEQ ID NO: 489611 - DNA, 16 bp, R. norvegicus
catctcaccttttctg

SEQ ID NO: 489612 - DNA, 16 bp, R. norvegicus
catctcagaccaagac

SEQ ID NO: 489613 - DNA, 16 bp, R. norvegicus
catctcagctgctgta

SEQ ID NO: 489614 - DNA, 16 bp, R. norvegicus
catctcagggatgcag

SEQ ID NO: 489615 - DNA, 16 bp, R. norvegicus
catctccatcatcttc

SEQ ID NO: 489616 - DNA, 16 bp, R. norvegicus
catctccatctccatc

SEQ ID NO: 489617 - DNA, 16 bp, R. norvegicus
catctcccacagtctg

SEQ ID NO: 489618 - DNA, 16 bp, R. norvegicus
catctccccagaccct

SEQ ID NO: 489619 - DNA, 16 bp, R. norvegicus
catctccccagcccac

SEQ ID NO: 489620 - DNA, 16 bp, R. norvegicus
catctccccagccttg

SEQ ID NO: 489621 - DNA, 16 bp, R. norvegicus
catctccccaggaaaa

SEQ ID NO: 489622 - DNA, 16 bp, R. norvegicus
catctccctaaaccct

SEQ ID NO: 489623 - DNA, 16 bp, R. norvegicus
catctcccttctctgg

SEQ ID NO: 489624 - DNA, 16 bp, R. norvegicus
catctcctcagcctct

SEQ ID NO: 489625 - DNA, 16 bp, R. norvegicus
catctcctcccagatc

SEQ ID NO: 489626 - DNA, 16 bp, R. norvegicus
catctccttcagtcct

SEQ ID NO: 489627 - DNA, 16 bp, R. norvegicus
catctccttcagtctt

SEQ ID NO: 489628 - DNA, 16 bp, R. norvegicus
catctcgagatttgag

SEQ ID NO: 489629 - DNA, 16 bp, R. norvegicus
catctctcaactctca

SEQ ID NO: 489630 - DNA, 16 bp, R. norvegicus
catctctccaacctga

SEQ ID NO: 489631 - DNA, 16 bp, R. norvegicus
catctctccagactcc

SEQ ID NO: 489632 - DNA, 16 bp, R. norvegicus
catctctccagccatc

SEQ ID NO: 489633 - DNA, 16 bp, R. norvegicus
catctctccagctgcc

SEQ ID NO: 489634 - DNA, 16 bp, R. norvegicus
catctctccagttctc

SEQ ID NO: 489635 - DNA, 16 bp, R. norvegicus
catctctccagttctt

SEQ ID NO: 489636 - DNA, 16 bp, R. norvegicus
catctctccatcccca

SEQ ID NO: 489637 - DNA, 16 bp, R. norvegicus
catctctctagcccat

SEQ ID NO: 489638 - DNA, 16 bp, R. norvegicus
catctctctagccctt

SEQ ID NO: 489639 - DNA, 16 bp, R. norvegicus
catctctctgagcctc

SEQ ID NO: 489640 - DNA, 16 bp, R. norvegicus
catctctctgcactgc

SEQ ID NO: 489641 - DNA, 16 bp, R. norvegicus
catctctctggccctg

SEQ ID NO: 489642 - DNA, 16 bp, R. norvegicus
catctctctggcctcc

SEQ ID NO: 489643 - DNA, 16 bp, R. norvegicus
catctctctgtttcct

SEQ ID NO: 489644 - DNA, 16 bp, R. norvegicus
catctctgaagaaaga

SEQ ID NO: 489645 - DNA, 16 bp, R. norvegicus
catctctgactcattc

SEQ ID NO: 489646 - DNA, 16 bp, R. norvegicus
catctctgaggatgaa

SEQ ID NO: 489647 - DNA, 16 bp, R. norvegicus
catctctgattccaga

SEQ ID NO: 489648 - DNA, 16 bp, R. norvegicus
catctctgcagcccta

SEQ ID NO: 489649 - DNA, 16 bp, R. norvegicus
catctctgcagccctg

SEQ ID NO: 489650 - DNA, 16 bp, R. norvegicus
catctctgtctccctg

SEQ ID NO: 489651 - DNA, 16 bp, R. norvegicus
catctctttctgcttc

SEQ ID NO: 489652 - DNA, 48 bp, R. norvegicus
catctgaaaccctggtgcacggaggctcccggaaggagcggcacagat

SEQ ID NO: 489653 - DNA, 16 bp, R. norvegicus
catctgcaaatggtga

SEQ ID NO: 489654 - DNA, 16 bp, R. norvegicus
catctgcactttggcc

SEQ ID NO: 489655 - DNA, 16 bp, R. norvegicus
catctgccctctcccc

SEQ ID NO: 489656 - DNA, 16 bp, R. norvegicus
catctgccctctcctc

SEQ ID NO: 489657 - DNA, 16 bp, R. norvegicus
catctgcctctacctc

SEQ ID NO: 489658 - DNA, 16 bp, R. norvegicus
catctgcctctgcctt

SEQ ID NO: 489659 - DNA, 16 bp, R. norvegicus
catctgctgacaccaa

SEQ ID NO: 489660 - DNA, 16 bp, R. norvegicus
catctggacctgggcc

SEQ ID NO: 489661 - DNA, 16 bp, R. norvegicus
catctggaggaaatgg

SEQ ID NO: 489662 - DNA, 16 bp, R. norvegicus
catctgggaagcagag

SEQ ID NO: 489663 - DNA, 16 bp, R. norvegicus
catctgggacacatgg

SEQ ID NO: 489664 - DNA, 16 bp, R. norvegicus
catctggttgtctctg

SEQ ID NO: 489665 - DNA, 17 bp, R. norvegicus
catctgtaaaccccttc

SEQ ID NO: 489666 - DNA, 16 bp, R. norvegicus
catctgtaacaagatc

SEQ ID NO: 489667 - DNA, 16 bp, R. norvegicus
catctgtaaccccagt

SEQ ID NO: 489668 - DNA, 16 bp, R. norvegicus
catctgtaatagtgtc

SEQ ID NO: 489669 - DNA, 18 bp, R. norvegicus
catctgtaatgggatcca

SEQ ID NO: 489670 - DNA, 20 bp, R. norvegicus
catctgtaatgggatctgac

SEQ ID NO: 489671 - DNA, 23 bp, R. norvegicus
catctgtagctagaagcctaagt

SEQ ID NO: 489672 - DNA, 16 bp, R. norvegicus
catctgtctctctgtg

SEQ ID NO: 489673 - DNA, 16 bp, R. norvegicus
catctgtctttgtctc

SEQ ID NO: 489674 - DNA, 16 bp, R. norvegicus
catctgtgatcccagc

SEQ ID NO: 489675 - DNA, 16 bp, R. norvegicus
catctgtgtctttgtc

SEQ ID NO: 489676 - DNA, 16 bp, R. norvegicus
catctgtgtgtgtgtg

SEQ ID NO: 489677 - DNA, 16 bp, R. norvegicus
catctgtttccattgg

SEQ ID NO: 489678 - DNA, 16 bp, R. norvegicus
catcttaaaacaaaag

SEQ ID NO: 489679 - DNA, 16 bp, R. norvegicus
catcttaatgctaatt

SEQ ID NO: 489680 - DNA, 16 bp, R. norvegicus
catcttcacccactga

SEQ ID NO: 489681 - DNA, 16 bp, R. norvegicus
catcttcagacaccaa

SEQ ID NO: 489682 - DNA, 16 bp, R. norvegicus
catcttcatctgcctc

SEQ ID NO: 489683 - DNA, 16 bp, R. norvegicus
catcttcatggagaca

SEQ ID NO: 489684 - DNA, 16 bp, R. norvegicus
catcttcattgttctg

SEQ ID NO: 489685 - DNA, 16 bp, R. norvegicus
catcttcattttaaaa

SEQ ID NO: 489686 - DNA, 16 bp, R. norvegicus
catcttccacaggatt

SEQ ID NO: 489687 - DNA, 16 bp, R. norvegicus
catcttcccagcctcc

SEQ ID NO: 489688 - DNA, 16 bp, R. norvegicus
catcttcccttgggcc

SEQ ID NO: 489689 - DNA, 16 bp, R. norvegicus
catcttcctgaggaac

SEQ ID NO: 489690 - DNA, 16 bp, R. norvegicus
catcttccttgctggc

SEQ ID NO: 489691 - DNA, 16 bp, R. norvegicus
catcttcgccagcatc

SEQ ID NO: 489692 - DNA, 16 bp, R. norvegicus
catcttctcagacaag

SEQ ID NO: 489693 - DNA, 16 bp, R. norvegicus
catcttctcagcacct

SEQ ID NO: 489694 - DNA, 16 bp, R. norvegicus
catcttctggtctcca

SEQ ID NO: 489695 - DNA, 16 bp, R. norvegicus
catcttctgtcacctg

SEQ ID NO: 489696 - DNA, 16 bp, R. norvegicus
catcttcttggagatg

SEQ ID NO: 489697 - DNA, 16 bp, R. norvegicus
catcttgatctgactg

SEQ ID NO: 489698 - DNA, 16 bp, R. norvegicus
catcttgatctgcagg

SEQ ID NO: 489699 - DNA, 16 bp, R. norvegicus
catcttgcccaaagca

SEQ ID NO: 489700 - DNA, 16 bp, R. norvegicus
catcttggtggatttt

SEQ ID NO: 489701 - DNA, 16 bp, R. norvegicus
catcttgttctgaaag

SEQ ID NO: 489702 - DNA, 16 bp, R. norvegicus
catctttgtggagaca

SEQ ID NO: 489703 - DNA, 16 bp, R. norvegicus
catcttttctagtttg

SEQ ID NO: 489704 - DNA, 16 bp, R. norvegicus
catgaaaaaacacaca

SEQ ID NO: 489705 - DNA, 16 bp, R. norvegicus
catgaaaagagaaaca

SEQ ID NO: 489706 - DNA, 16 bp, R. norvegicus
catgaaaccattgttt

SEQ ID NO: 489707 - DNA, 16 bp, R. norvegicus
catgaaactccagaag

SEQ ID NO: 489708 - DNA, 16 bp, R. norvegicus
catgaaactgaaaggc

SEQ ID NO: 489709 - DNA, 16 bp, R. norvegicus
catgaaactgcaaagc

SEQ ID NO: 489710 - DNA, 16 bp, R. norvegicus
catgaaagaatacaca

SEQ ID NO: 489711 - DNA, 16 bp, R. norvegicus
catgaaataattttat

SEQ ID NO: 489712 - DNA, 16 bp, R. norvegicus
catgaacaccaagctg

SEQ ID NO: 489713 - DNA, 16 bp, R. norvegicus
catgaacatgcaagaa

SEQ ID NO: 489714 - DNA, 16 bp, R. norvegicus
catgaagaacctgatc

SEQ ID NO: 489715 - DNA, 16 bp, R. norvegicus
catgaagaactgcatt

SEQ ID NO: 489716 - DNA, 16 bp, R. norvegicus
catgaagaactgtact

SEQ ID NO: 489717 - DNA, 16 bp, R. norvegicus
catgaagaagtcaagc

SEQ ID NO: 489718 - DNA, 16 bp, R. norvegicus
catgaagatcaagaag

SEQ ID NO: 489719 - DNA, 17 bp, R. norvegicus
catgaagattcagctct

SEQ ID NO: 489720 - DNA, 16 bp, R. norvegicus
catgaagctggagcca

SEQ ID NO: 489721 - DNA, 16 bp, R. norvegicus
catgaaggaacacaca

SEQ ID NO: 489722 - DNA, 16 bp, R. norvegicus
catgaaggccaagctg

SEQ ID NO: 489723 - DNA, 16 bp, R. norvegicus
catgaaggtcaagctg

SEQ ID NO: 489724 - DNA, 16 bp, R. norvegicus
catgaagtcctccagc

SEQ ID NO: 489725 - DNA, 16 bp, R. norvegicus
catgaagttgggagag

SEQ ID NO: 489726 - DNA, 16 bp, R. norvegicus
catgaataaagggcct

SEQ ID NO: 489727 - DNA, 16 bp, R. norvegicus
catgaatgtccttttg

SEQ ID NO: 489728 - DNA, 16 bp, R. norvegicus
catgaatgtgtgcatg

SEQ ID NO: 489729 - DNA, 16 bp, R. norvegicus
catgaatgtgtgtatg

SEQ ID NO: 489730 - DNA, 16 bp, R. norvegicus
catgaattcacagcag

SEQ ID NO: 489731 - DNA, 16 bp, R. norvegicus
catgaatttgaaaaga

SEQ ID NO: 489732 - DNA, 16 bp, R. norvegicus
catgaatttgaaagtg

SEQ ID NO: 489733 - DNA, 16 bp, R. norvegicus
catgaatttgaggcca

SEQ ID NO: 489734 - DNA, 16 bp, R. norvegicus
catgacaacagaatct

SEQ ID NO: 489735 - DNA, 16 bp, R. norvegicus
catgacaattacagag

SEQ ID NO: 489736 - DNA, 16 bp, R. norvegicus
catgacagcctgcatg

SEQ ID NO: 489737 - DNA, 16 bp, R. norvegicus
catgacaggaccaagg

SEQ ID NO: 489738 - DNA, 16 bp, R. norvegicus
catgacatatcaagtt

SEQ ID NO: 489739 - DNA, 16 bp, R. norvegicus
catgacatcatcggag

SEQ ID NO: 489740 - DNA, 16 bp, R. norvegicus
catgaccagagcaact

SEQ ID NO: 489741 - DNA, 16 bp, R. norvegicus
catgaccatgaccatg

SEQ ID NO: 489742 - DNA, 16 bp, R. norvegicus
catgacccctttgggg

SEQ ID NO: 489743 - DNA, 16 bp, R. norvegicus
catgactttaatccca

SEQ ID NO: 489744 - DNA, 16 bp, R. norvegicus
catgagaacctgtctc

SEQ ID NO: 489745 - DNA, 16 bp, R. norvegicus
catgagagaaatgcaa

SEQ ID NO: 489746 - DNA, 16 bp, R. norvegicus
catgagagtaaaccag

SEQ ID NO: 489747 - DNA, 16 bp, R. norvegicus
catgagcaaaagcaag

SEQ ID NO: 489748 - DNA, 16 bp, R. norvegicus
catgagcatgggagga

SEQ ID NO: 489749 - DNA, 16 bp, R. norvegicus
catgagcgcacacaca

SEQ ID NO: 489750 - DNA, 16 bp, R. norvegicus
catgagctccccctgc

SEQ ID NO: 489751 - DNA, 16 bp, R. norvegicus
catgagctgagcaagg

SEQ ID NO: 489752 - DNA, 16 bp, R. norvegicus
catgaggaagaggagg

SEQ ID NO: 489753 - DNA, 16 bp, R. norvegicus
catgaggacacacaca

SEQ ID NO: 489754 - DNA, 16 bp, R. norvegicus
catgaggagcaaggca

SEQ ID NO: 489755 - DNA, 16 bp, R. norvegicus
catgaggaggaggagg

SEQ ID NO: 489756 - DNA, 17 bp, R. norvegicus
catgaggggcaggctct

SEQ ID NO: 489757 - DNA, 16 bp, R. norvegicus
catgaggtcctgggtt

SEQ ID NO: 489758 - DNA, 16 bp, R. norvegicus
catgagtaaacttaaa

SEQ ID NO: 489759 - DNA, 16 bp, R. norvegicus
catgagtctgtggggg

SEQ ID NO: 489760 - DNA, 16 bp, R. norvegicus
catgagttctgaggat

SEQ ID NO: 489761 - DNA, 16 bp, R. norvegicus
catgagtttgaggtta

SEQ ID NO: 489762 - DNA, 16 bp, R. norvegicus
catgatatatatatat

SEQ ID NO: 489763 - DNA, 16 bp, R. norvegicus
catgatcatcccatta

SEQ ID NO: 489764 - DNA, 16 bp, R. norvegicus
catgatcattccatta

SEQ ID NO: 489765 - DNA, 16 bp, R. norvegicus
catgatgagaccctgt

SEQ ID NO: 489766 - DNA, 16 bp, R. norvegicus
catgatgatgaaggac

SEQ ID NO: 489767 - DNA, 16 bp, R. norvegicus
catgatgctggagcag

SEQ ID NO: 489768 - DNA, 16 bp, R. norvegicus
catgatgctggaggat

SEQ ID NO: 489769 - DNA, 16 bp, R. norvegicus
catgatgggaaactca

SEQ ID NO: 489770 - DNA, 16 bp, R. norvegicus
catgatgtgtttcttc

SEQ ID NO: 489771 - DNA, 16 bp, R. norvegicus
catgatttctttctca

SEQ ID NO: 489772 - DNA, 16 bp, R. norvegicus
catgcaaacacacaca

SEQ ID NO: 489773 - DNA, 16 bp, R. norvegicus
catgcacaaggtcctg

SEQ ID NO: 489774 - DNA, 16 bp, R. norvegicus
catgcacacaaacaga

SEQ ID NO: 489775 - DNA, 16 bp, R. norvegicus
catgcacacacaggaa

SEQ ID NO: 489776 - DNA, 16 bp, R. norvegicus
catgcacacacttaca

SEQ ID NO: 489777 - DNA, 16 bp, R. norvegicus
catgcacacctttaat

SEQ ID NO: 489778 - DNA, 16 bp, R. norvegicus
catgcacagaaacaca

SEQ ID NO: 489779 - DNA, 16 bp, R. norvegicus
catgcacagatacatg

SEQ ID NO: 489780 - DNA, 16 bp, R. norvegicus
catgcacataatttaa

SEQ ID NO: 489781 - DNA, 16 bp, R. norvegicus
catgcacatacatacc

SEQ ID NO: 489782 - DNA, 16 bp, R. norvegicus
catgcacatagacaca

SEQ ID NO: 489783 - DNA, 16 bp, R. norvegicus
catgcacatgcacaca

SEQ ID NO: 489784 - DNA, 16 bp, R. norvegicus
catgcacatgcataca

SEQ ID NO: 489785 - DNA, 16 bp, R. norvegicus
catgcagacacacaca

SEQ ID NO: 489786 - DNA, 16 bp, R. norvegicus
catgcagaggccagag

SEQ ID NO: 489787 - DNA, 16 bp, R. norvegicus
catgcagatgtccctg

SEQ ID NO: 489788 - DNA, 16 bp, R. norvegicus
catgcaggagcacaca

SEQ ID NO: 489789 - DNA, 16 bp, R. norvegicus
catgcaggaggctgag

SEQ ID NO: 489790 - DNA, 16 bp, R. norvegicus
catgcaggatctaaaa

SEQ ID NO: 489791 - DNA, 16 bp, R. norvegicus
catgcaggcatgcagg

SEQ ID NO: 489792 - DNA, 16 bp, R. norvegicus
catgcaggctgtcatg

SEQ ID NO: 489793 - DNA, 16 bp, R. norvegicus
catgcagggatggttc

SEQ ID NO: 489794 - DNA, 16 bp, R. norvegicus
catgcagggcaactga

SEQ ID NO: 489795 - DNA, 16 bp, R. norvegicus
catgcaggtatacatg

SEQ ID NO: 489796 - DNA, 16 bp, R. norvegicus
catgcaggtgtgtgtg

SEQ ID NO: 489797 - DNA, 16 bp, R. norvegicus
catgcagtacctgtgg

SEQ ID NO: 489798 - DNA, 16 bp, R. norvegicus
catgcatacacgcaca

SEQ ID NO: 489799 - DNA, 16 bp, R. norvegicus
catgcatacttgcaca

SEQ ID NO: 489800 - DNA, 16 bp, R. norvegicus
catgcatgaagccctg

SEQ ID NO: 489801 - DNA, 16 bp, R. norvegicus
catgcatgcacacgca

SEQ ID NO: 489802 - DNA, 16 bp, R. norvegicus
catgcatgcaggcaaa

SEQ ID NO: 489803 - DNA, 16 bp, R. norvegicus
catgcatgcagtaccc

SEQ ID NO: 489804 - DNA, 16 bp, R. norvegicus
catgcatgctcacaca

SEQ ID NO: 489805 - DNA, 16 bp, R. norvegicus
catgcatgtgcacacg

SEQ ID NO: 489806 - DNA, 16 bp, R. norvegicus
catgcatgtggagatc

SEQ ID NO: 489807 - DNA, 16 bp, R. norvegicus
catgccacagtgcaca

SEQ ID NO: 489808 - DNA, 16 bp, R. norvegicus
catgccaccagacaga

SEQ ID NO: 489809 - DNA, 16 bp, R. norvegicus
catgccaccagggcca

SEQ ID NO: 489810 - DNA, 17 bp, R. norvegicus
catgccagacacaaagc

SEQ ID NO: 489811 - DNA, 16 bp, R. norvegicus
catgccaggcagctca

SEQ ID NO: 489812 - DNA, 17 bp, R. norvegicus
catgccagggatgaagc

SEQ ID NO: 489813 - DNA, 16 bp, R. norvegicus
catgccagtgtgtgtg

SEQ ID NO: 489814 - DNA, 16 bp, R. norvegicus
catgcccacactcaca

SEQ ID NO: 489815 - DNA, 16 bp, R. norvegicus
catgcccatgcacaca

SEQ ID NO: 489816 - DNA, 16 bp, R. norvegicus
catgcccatgcccatg

SEQ ID NO: 489817 - DNA, 16 bp, R. norvegicus
catgcccgaaagcaga

SEQ ID NO: 489818 - DNA, 16 bp, R. norvegicus
catgccctgacattcc

SEQ ID NO: 489819 - DNA, 16 bp, R. norvegicus
catgcctatgtgtgtg

SEQ ID NO: 489820 - DNA, 16 bp, R. norvegicus
catgcctcccaccatg

SEQ ID NO: 489821 - DNA, 16 bp, R. norvegicus
catgcctcctgccatg

SEQ ID NO: 489822 - DNA, 16 bp, R. norvegicus
catgcctctgcctccc

SEQ ID NO: 489823 - DNA, 16 bp, R. norvegicus
catgcctctgccttcc

SEQ ID NO: 489824 - DNA, 16 bp, R. norvegicus
catgcctgggatgagg

SEQ ID NO: 489825 - DNA, 16 bp, R. norvegicus
catgcctgtaatccca

SEQ ID NO: 489826 - DNA, 16 bp, R. norvegicus
catgcctgtgtctgtg

SEQ ID NO: 489827 - DNA, 16 bp, R. norvegicus
catgccttcaatctca

SEQ ID NO: 489828 - DNA, 16 bp, R. norvegicus
catgccttcctcacca

SEQ ID NO: 489829 - DNA, 16 bp, R. norvegicus
catgcctttaatccca

SEQ ID NO: 489830 - DNA, 16 bp, R. norvegicus
catgcgcacgcacaca

SEQ ID NO: 489831 - DNA, 16 bp, R. norvegicus
catgcgcatgcacatg

SEQ ID NO: 489832 - DNA, 16 bp, R. norvegicus
catgcgtgcatgtatg

SEQ ID NO: 489833 - DNA, 16 bp, R. norvegicus
catgcgtgtgagtgtg

SEQ ID NO: 489834 - DNA, 16 bp, R. norvegicus
catgctacaatctaca

SEQ ID NO: 489835 - DNA, 16 bp, R. norvegicus
catgctagacaagtgc

SEQ ID NO: 489836 - DNA, 16 bp, R. norvegicus
catgctcagacacaca

SEQ ID NO: 489837 - DNA, 16 bp, R. norvegicus
catgctcatgctcatg

SEQ ID NO: 489838 - DNA, 16 bp, R. norvegicus
catgctcatgtgcatg

SEQ ID NO: 489839 - DNA, 16 bp, R. norvegicus
catgctccaccatgcc

SEQ ID NO: 489840 - DNA, 16 bp, R. norvegicus
catgctcccagccatg

SEQ ID NO: 489841 - DNA, 16 bp, R. norvegicus
catgctccctaccatg

SEQ ID NO: 489842 - DNA, 16 bp, R. norvegicus
catgctccctgctgtg

SEQ ID NO: 489843 - DNA, 16 bp, R. norvegicus
catgctcctgctgcca

SEQ ID NO: 489844 - DNA, 16 bp, R. norvegicus
catgctcctggattgg

SEQ ID NO: 489845 - DNA, 16 bp, R. norvegicus
catgctgacaggagcc

SEQ ID NO: 489846 - DNA, 16 bp, R. norvegicus
catgctgacctcaaac

SEQ ID NO: 489847 - DNA, 16 bp, R. norvegicus
catgctggaatgttga

SEQ ID NO: 489848 - DNA, 16 bp, R. norvegicus
catgctgggagaagga

SEQ ID NO: 489849 - DNA, 16 bp, R. norvegicus
catgctgggcaagtgc

SEQ ID NO: 489850 - DNA, 16 bp, R. norvegicus
catgctgggtaagcac

SEQ ID NO: 489851 - DNA, 16 bp, R. norvegicus
catgctggtcattgtt

SEQ ID NO: 489852 - DNA, 16 bp, R. norvegicus
catgctgtggatgtgt

SEQ ID NO: 489853 - DNA, 16 bp, R. norvegicus
catgctgttttgtctc

SEQ ID NO: 489854 - DNA, 16 bp, R. norvegicus
catgcttatcatcctg

SEQ ID NO: 489855 - DNA, 16 bp, R. norvegicus
catgcttcccaacatg

SEQ ID NO: 489856 - DNA, 16 bp, R. norvegicus
catgcttcctgccaca

SEQ ID NO: 489857 - DNA, 16 bp, R. norvegicus
catgcttcctgccatg

SEQ ID NO: 489858 - DNA, 16 bp, R. norvegicus
catgcttctcaccatg

SEQ ID NO: 489859 - DNA, 16 bp, R. norvegicus
catgcttgcatgcatg

SEQ ID NO: 489860 - DNA, 16 bp, R. norvegicus
catgcttgtacacaca

SEQ ID NO: 489861 - DNA, 16 bp, R. norvegicus
catgctttccaccatg

SEQ ID NO: 489862 - DNA, 16 bp, R. norvegicus
catggaaaaagaaact

SEQ ID NO: 489863 - DNA, 16 bp, R. norvegicus
catggaaaagaaaaga

SEQ ID NO: 489864 - DNA, 16 bp, R. norvegicus
catggaaacagaaaat

SEQ ID NO: 489865 - DNA, 16 bp, R. norvegicus
catggaaacagaaata

SEQ ID NO: 489866 - DNA, 16 bp, R. norvegicus
catggaaacagaagct

SEQ ID NO: 489867 - DNA, 16 bp, R. norvegicus
catggaaactgaacaa

SEQ ID NO: 489868 - DNA, 16 bp, R. norvegicus
catggaaatccccaaa

SEQ ID NO: 489869 - DNA, 16 bp, R. norvegicus
catggaagacagaaga

SEQ ID NO: 489870 - DNA, 16 bp, R. norvegicus
catggaagctcccaga

SEQ ID NO: 489871 - DNA, 16 bp, R. norvegicus
catggaaggactcatg

SEQ ID NO: 489872 - DNA, 16 bp, R. norvegicus
catggaagtattttga

SEQ ID NO: 489873 - DNA, 32 bp, R. norvegicus
catggaataacacatactggagagaaacctta

SEQ ID NO: 489874 - DNA, 16 bp, R. norvegicus
catggaatatccaaat

SEQ ID NO: 489875 - DNA, 16 bp, R. norvegicus
catggacacatacatg

SEQ ID NO: 489876 - DNA, 16 bp, R. norvegicus
catggacagacacatg

SEQ ID NO: 489877 - DNA, 16 bp, R. norvegicus
catggacagtgtgtca

SEQ ID NO: 489878 - DNA, 16 bp, R. norvegicus
catggacatacataca

SEQ ID NO: 489879 - DNA, 16 bp, R. norvegicus
catggagaaagactta

SEQ ID NO: 489880 - DNA, 16 bp, R. norvegicus
catggagacagaaact

SEQ ID NO: 489881 - DNA, 16 bp, R. norvegicus
catggagaccaagctg

SEQ ID NO: 489882 - DNA, 16 bp, R. norvegicus
catggagagagagggg

SEQ ID NO: 489883 - DNA, 16 bp, R. norvegicus
catggagagatagata

SEQ ID NO: 489884 - DNA, 16 bp, R. norvegicus
catggagagctcataa

SEQ ID NO: 489885 - DNA, 16 bp, R. norvegicus
catggagatccacctg

SEQ ID NO: 489886 - DNA, 16 bp, R. norvegicus
catggagatcttgaga

SEQ ID NO: 489887 - DNA, 16 bp, R. norvegicus
catggagctggaggag

SEQ ID NO: 489888 - DNA, 16 bp, R. norvegicus
catggaggaatgcttc

SEQ ID NO: 489889 - DNA, 16 bp, R. norvegicus
catggaggacacaggg

SEQ ID NO: 489890 - DNA, 16 bp, R. norvegicus
catggaggagaaggaa

SEQ ID NO: 489891 - DNA, 16 bp, R. norvegicus
catggaggcaagaaga

SEQ ID NO: 489892 - DNA, 16 bp, R. norvegicus
catggaggcagaacac

SEQ ID NO: 489893 - DNA, 16 bp, R. norvegicus
catggaggcagagaga

SEQ ID NO: 489894 - DNA, 16 bp, R. norvegicus
catggaggccggaaga

SEQ ID NO: 489895 - DNA, 16 bp, R. norvegicus
catggagggaaccatg

SEQ ID NO: 489896 - DNA, 16 bp, R. norvegicus
catggagtaacccatg

SEQ ID NO: 489897 - DNA, 16 bp, R. norvegicus
catggagtatcttggt

SEQ ID NO: 489898 - DNA, 16 bp, R. norvegicus
catggagtgggaggag

SEQ ID NO: 489899 - DNA, 16 bp, R. norvegicus
catggataaagtggag

SEQ ID NO: 489900 - DNA, 16 bp, R. norvegicus
catggatccttctcca

SEQ ID NO: 489901 - DNA, 16 bp, R. norvegicus
catggatgagtccatg

SEQ ID NO: 489902 - DNA, 16 bp, R. norvegicus
catggatgctgggaac

SEQ ID NO: 489903 - DNA, 16 bp, R. norvegicus
catggatgctggggat

SEQ ID NO: 489904 - DNA, 16 bp, R. norvegicus
catggatgtctgtgca

SEQ ID NO: 489905 - DNA, 16 bp, R. norvegicus
catggcaagttcaagg

SEQ ID NO: 489906 - DNA, 16 bp, R. norvegicus
catggcaatgtccagg

SEQ ID NO: 489907 - DNA, 16 bp, R. norvegicus
catggcacatcaagtc

SEQ ID NO: 489908 - DNA, 16 bp, R. norvegicus
catggcagcagccagg

SEQ ID NO: 489909 - DNA, 16 bp, R. norvegicus
catggcagcatccagg

SEQ ID NO: 489910 - DNA, 16 bp, R. norvegicus
catggcagccaggaag

SEQ ID NO: 489911 - DNA, 16 bp, R. norvegicus
catggcagcctgcagg

SEQ ID NO: 489912 - DNA, 16 bp, R. norvegicus
catggcagggaacatg

SEQ ID NO: 489913 - DNA, 16 bp, R. norvegicus
catggcagtgggcagg

SEQ ID NO: 489914 - DNA, 18 bp, R. norvegicus
catggcatgataatgatg

SEQ ID NO: 489915 - DNA, 16 bp, R. norvegicus
catggccaaagctgcc

SEQ ID NO: 489916 - DNA, 16 bp, R. norvegicus
catggccaaattaatt

SEQ ID NO: 489917 - DNA, 16 bp, R. norvegicus
catggccaagtgtgtg

SEQ ID NO: 489918 - DNA, 16 bp, R. norvegicus
catggccagcctctat

SEQ ID NO: 489919 - DNA, 16 bp, R. norvegicus
catggccatcatggtg

SEQ ID NO: 489920 - DNA, 16 bp, R. norvegicus
catggcccatgttacc

SEQ ID NO: 489921 - DNA, 16 bp, R. norvegicus
catggccctcagcagc

SEQ ID NO: 489922 - DNA, 16 bp, R. norvegicus
catggccgctctgctg

SEQ ID NO: 489923 - DNA, 16 bp, R. norvegicus
catggccggcctttcc

SEQ ID NO: 489924 - DNA, 16 bp, R. norvegicus
catggcctctgcctcc

SEQ ID NO: 489925 - DNA, 16 bp, R. norvegicus
catggcctctggtggc

SEQ ID NO: 489926 - DNA, 16 bp, R. norvegicus
catggcctgaccctgg

SEQ ID NO: 489927 - DNA, 16 bp, R. norvegicus
catggctcagtggtag

SEQ ID NO: 489928 - DNA, 16 bp, R. norvegicus
catggctgcccactct

SEQ ID NO: 489929 - DNA, 16 bp, R. norvegicus
catggctgctttcttc

SEQ ID NO: 489930 - DNA, 16 bp, R. norvegicus
catggctgtgctcatg

SEQ ID NO: 489931 - DNA, 16 bp, R. norvegicus
catggcttctcccctt

SEQ ID NO: 489932 - DNA, 16 bp, R. norvegicus
catggctttaattcca

SEQ ID NO: 489933 - DNA, 16 bp, R. norvegicus
catgggaactggagaa

SEQ ID NO: 489934 - DNA, 16 bp, R. norvegicus
catgggactgagcaac

SEQ ID NO: 489935 - DNA, 16 bp, R. norvegicus
catgggagagagaccc

SEQ ID NO: 489936 - DNA, 16 bp, R. norvegicus
catgggagagagccaa

SEQ ID NO: 489937 - DNA, 16 bp, R. norvegicus
catgggaggaagagct

SEQ ID NO: 489938 - DNA, 16 bp, R. norvegicus
catgggaggcctccct

SEQ ID NO: 489939 - DNA, 16 bp, R. norvegicus
catgggatggttctca

SEQ ID NO: 489940 - DNA, 16 bp, R. norvegicus
catgggcacagccatg

SEQ ID NO: 489941 - DNA, 16 bp, R. norvegicus
catgggcacctgcaca

SEQ ID NO: 489942 - DNA, 16 bp, R. norvegicus
catgggcactgggaaa

SEQ ID NO: 489943 - DNA, 16 bp, R. norvegicus
catgggcatctttttc

SEQ ID NO: 489944 - DNA, 16 bp, R. norvegicus
catgggcatgtgcaca

SEQ ID NO: 489945 - DNA, 16 bp, R. norvegicus
catgggccaccatgcc

SEQ ID NO: 489946 - DNA, 16 bp, R. norvegicus
catgggccatatgtgg

SEQ ID NO: 489947 - DNA, 16 bp, R. norvegicus
catgggcctctcctcc

SEQ ID NO: 489948 - DNA, 16 bp, R. norvegicus
catgggctttaagacc

SEQ ID NO: 489949 - DNA, 16 bp, R. norvegicus
catggggaccccagtg

SEQ ID NO: 489950 - DNA, 16 bp, R. norvegicus
catggggacctcacag

SEQ ID NO: 489951 - DNA, 16 bp, R. norvegicus
catggggagcaaggca

SEQ ID NO: 489952 - DNA, 16 bp, R. norvegicus
catggggatccatctc

SEQ ID NO: 489953 - DNA, 16 bp, R. norvegicus
catggggcccggtggc

SEQ ID NO: 489954 - DNA, 16 bp, R. norvegicus
catggggctggaggag

SEQ ID NO: 489955 - DNA, 16 bp, R. norvegicus
catggggctggcatgg

SEQ ID NO: 489956 - DNA, 16 bp, R. norvegicus
catggggctgtccatg

SEQ ID NO: 489957 - DNA, 16 bp, R. norvegicus
catggggtccccaatg

SEQ ID NO: 489958 - DNA, 16 bp, R. norvegicus
catgggtactctttgg

SEQ ID NO: 489959 - DNA, 16 bp, R. norvegicus
catgggtccatccatg

SEQ ID NO: 489960 - DNA, 16 bp, R. norvegicus
catgggtctgtgctag

SEQ ID NO: 489961 - DNA, 16 bp, R. norvegicus
catgggtgcctccatg

SEQ ID NO: 489962 - DNA, 16 bp, R. norvegicus
catgggtgcttccttc

SEQ ID NO: 489963 - DNA, 16 bp, R. norvegicus
catggtagaaagagag

SEQ ID NO: 489964 - DNA, 16 bp, R. norvegicus
catggtagaagggaag

SEQ ID NO: 489965 - DNA, 40 bp, R. norvegicus
catggtattggtacagagacagacagatagaccaacggaa

SEQ ID NO: 489966 - DNA, 16 bp, R. norvegicus
catggtatttatcaca

SEQ ID NO: 489967 - DNA, 16 bp, R. norvegicus
catggtcaaactctca

SEQ ID NO: 489968 - DNA, 16 bp, R. norvegicus
catggtccaggaggag

SEQ ID NO: 489969 - DNA, 16 bp, R. norvegicus
catggtgaagcctgcc

SEQ ID NO: 489970 - DNA, 16 bp, R. norvegicus
catggtgactcccaac

SEQ ID NO: 489971 - DNA, 16 bp, R. norvegicus
catggtgaggtcctgg

SEQ ID NO: 489972 - DNA, 16 bp, R. norvegicus
catggtgcagacagag

SEQ ID NO: 489973 - DNA, 16 bp, R. norvegicus
catggtgctgcagaag

SEQ ID NO: 489974 - DNA, 16 bp, R. norvegicus
catggtgctggagagg

SEQ ID NO: 489975 - DNA, 16 bp, R. norvegicus
catggtgctggaggag

SEQ ID NO: 489976 - DNA, 16 bp, R. norvegicus
catggtgctggagggg

SEQ ID NO: 489977 - DNA, 16 bp, R. norvegicus
catggtgctggggaag

SEQ ID NO: 489978 - DNA, 16 bp, R. norvegicus
catggtggaagcatgg

SEQ ID NO: 489979 - DNA, 16 bp, R. norvegicus
catggtggaaggagaa

SEQ ID NO: 489980 - DNA, 16 bp, R. norvegicus
catggtggaaggagag

SEQ ID NO: 489981 - DNA, 16 bp, R. norvegicus
catggtggaggaagag

SEQ ID NO: 489982 - DNA, 16 bp, R. norvegicus
catggtggcacctgcc

SEQ ID NO: 489983 - DNA, 16 bp, R. norvegicus
catggtggcatttcct

SEQ ID NO: 489984 - DNA, 16 bp, R. norvegicus
catggtggctcacacc

SEQ ID NO: 489985 - DNA, 16 bp, R. norvegicus
catggtggcttacaac

SEQ ID NO: 489986 - DNA, 16 bp, R. norvegicus
catggtgggaagcacg

SEQ ID NO: 489987 - DNA, 16 bp, R. norvegicus
catggtgggaagcctg

SEQ ID NO: 489988 - DNA, 16 bp, R. norvegicus
catggtggtgcacacc

SEQ ID NO: 489989 - DNA, 16 bp, R. norvegicus
catggtggtgcaggcc

SEQ ID NO: 489990 - DNA, 16 bp, R. norvegicus
catggtggtggtggtg

SEQ ID NO: 489991 - DNA, 16 bp, R. norvegicus
catggtgtacatgtgg

SEQ ID NO: 489992 - DNA, 16 bp, R. norvegicus
catggtgtctgttctc

SEQ ID NO: 489993 - DNA, 16 bp, R. norvegicus
catggtgtcttttcat

SEQ ID NO: 489994 - DNA, 16 bp, R. norvegicus
catggtgttttaccac

SEQ ID NO: 489995 - DNA, 16 bp, R. norvegicus
catggttattggagga

SEQ ID NO: 489996 - DNA, 16 bp, R. norvegicus
catggtttctggtgac

SEQ ID NO: 489997 - DNA, 16 bp, R. norvegicus
catggttttgtttttg

SEQ ID NO: 489998 - DNA, 16 bp, R. norvegicus
catgtacacacaagca

SEQ ID NO: 489999 - DNA, 16 bp, R. norvegicus
catgtacacacacaca

SEQ ID NO: 490000 - DNA, 16 bp, R. norvegicus
catgtacacatacata

SEQ ID NO: 490001 - DNA, 16 bp, R. norvegicus
catgtacacatgtatg

SEQ ID NO: 490002 - DNA, 16 bp, R. norvegicus
catgtacactcacaca

SEQ ID NO: 490003 - DNA, 16 bp, R. norvegicus
catgtacactgtggca

SEQ ID NO: 490004 - DNA, 16 bp, R. norvegicus
catgtacatctgtgca

SEQ ID NO: 490005 - DNA, 16 bp, R. norvegicus
catgtacatgcagtgc

SEQ ID NO: 490006 - DNA, 16 bp, R. norvegicus
catgtacattcacaca

SEQ ID NO: 490007 - DNA, 16 bp, R. norvegicus
catgtacttcttggca

SEQ ID NO: 490008 - DNA, 16 bp, R. norvegicus
catgtatacacacaca

SEQ ID NO: 490009 - DNA, 16 bp, R. norvegicus
catgtatacatgcata

SEQ ID NO: 490010 - DNA, 16 bp, R. norvegicus
catgtatctgtctgtc

SEQ ID NO: 490011 - DNA, 16 bp, R. norvegicus
catgtatgaaaatgtc

SEQ ID NO: 490012 - DNA, 16 bp, R. norvegicus
catgtatgtgatgtgt

SEQ ID NO: 490013 - DNA, 16 bp, R. norvegicus
catgtatgtgtgtgca

SEQ ID NO: 490014 - DNA, 16 bp, R. norvegicus
catgtatgttttttgt

SEQ ID NO: 490015 - DNA, 16 bp, R. norvegicus
catgtattttgtattt

SEQ ID NO: 490016 - DNA, 16 bp, R. norvegicus
catgtcaaaaacagag

SEQ ID NO: 490017 - DNA, 16 bp, R. norvegicus
catgtcaatatgtgaa

SEQ ID NO: 490018 - DNA, 16 bp, R. norvegicus
catgtcactgtgggtg

SEQ ID NO: 490019 - DNA, 16 bp, R. norvegicus
catgtccaataaagag

SEQ ID NO: 490020 - DNA, 16 bp, R. norvegicus
catgtccagcaagcac

SEQ ID NO: 490021 - DNA, 16 bp, R. norvegicus
catgtccccagaagac

SEQ ID NO: 490022 - DNA, 16 bp, R. norvegicus
catgtcctccacaggt

SEQ ID NO: 490023 - DNA, 16 bp, R. norvegicus
catgtcctctgaaaga

SEQ ID NO: 490024 - DNA, 16 bp, R. norvegicus
catgtctatgtgtgtg

SEQ ID NO: 490025 - DNA, 16 bp, R. norvegicus
catgtctccagccaca

SEQ ID NO: 490026 - DNA, 16 bp, R. norvegicus
catgtctccagcccta

SEQ ID NO: 490027 - DNA, 16 bp, R. norvegicus
catgtctccagtccct

SEQ ID NO: 490028 - DNA, 16 bp, R. norvegicus
catgtctgcacactgg

SEQ ID NO: 490029 - DNA, 16 bp, R. norvegicus
catgtctggaacattc

SEQ ID NO: 490030 - DNA, 16 bp, R. norvegicus
catgtctgggtccatg

SEQ ID NO: 490031 - DNA, 16 bp, R. norvegicus
catgtctgtgaagaat

SEQ ID NO: 490032 - DNA, 16 bp, R. norvegicus
catgtctgtgtctctg

SEQ ID NO: 490033 - DNA, 16 bp, R. norvegicus
catgtctttgttatat

SEQ ID NO: 490034 - DNA, 16 bp, R. norvegicus
catgtcttttttatat

SEQ ID NO: 490035 - DNA, 16 bp, R. norvegicus
catgtgaaggaatgtt

SEQ ID NO: 490036 - DNA, 16 bp, R. norvegicus
catgtgattttctttt

SEQ ID NO: 490037 - DNA, 16 bp, R. norvegicus
catgtgattttttttc

SEQ ID NO: 490038 - DNA, 16 bp, R. norvegicus
catgtgcacacacaaa

SEQ ID NO: 490039 - DNA, 16 bp, R. norvegicus
catgtgcacacatgca

SEQ ID NO: 490040 - DNA, 16 bp, R. norvegicus
catgtgcactctttgg

SEQ ID NO: 490041 - DNA, 44 bp, R. norvegicus
catgtgcaggcttgtccccttgctagggctccctctagtggtga

SEQ ID NO: 490042 - DNA, 16 bp, R. norvegicus
catgtgcaggtgtgtg

SEQ ID NO: 490043 - DNA, 16 bp, R. norvegicus
catgtgcatatacaca

SEQ ID NO: 490044 - DNA, 16 bp, R. norvegicus
catgtgcatgtgggtg

SEQ ID NO: 490045 - DNA, 16 bp, R. norvegicus
catgtgccatcatgcc

SEQ ID NO: 490046 - DNA, 16 bp, R. norvegicus
catgtgcctctcctca

SEQ ID NO: 490047 - DNA, 16 bp, R. norvegicus
catgtgctcacacaca

SEQ ID NO: 490048 - DNA, 16 bp, R. norvegicus
catgtgctctgtgcat

SEQ ID NO: 490049 - DNA, 16 bp, R. norvegicus
catgtgcttgtatgtg

SEQ ID NO: 490050 - DNA, 16 bp, R. norvegicus
catgtggaagccagag

SEQ ID NO: 490051 - DNA, 16 bp, R. norvegicus
catgtggaagcctttt

SEQ ID NO: 490052 - DNA, 17 bp, R. norvegicus
catgtggagcaggctct

SEQ ID NO: 490053 - DNA, 16 bp, R. norvegicus
catgtggaggtcagag

SEQ ID NO: 490054 - DNA, 16 bp, R. norvegicus
catgtggatctctgtg

SEQ ID NO: 490055 - DNA, 16 bp, R. norvegicus
catgtggatgctggga

SEQ ID NO: 490056 - DNA, 16 bp, R. norvegicus
catgtggcagcttaca

SEQ ID NO: 490057 - DNA, 16 bp, R. norvegicus
catgtgggacactgag

SEQ ID NO: 490058 - DNA, 16 bp, R. norvegicus
catgtgggccctgggg

SEQ ID NO: 490059 - DNA, 16 bp, R. norvegicus
catgtgggtcccagga

SEQ ID NO: 490060 - DNA, 16 bp, R. norvegicus
catgtgggtgctggga

SEQ ID NO: 490061 - DNA, 16 bp, R. norvegicus
catgtggtcactggga

SEQ ID NO: 490062 - DNA, 16 bp, R. norvegicus
catgtggtctctgaat

SEQ ID NO: 490063 - DNA, 16 bp, R. norvegicus
catgtggtctgtgaat

SEQ ID NO: 490064 - DNA, 16 bp, R. norvegicus
catgtggttgtgggaa

SEQ ID NO: 490065 - DNA, 16 bp, R. norvegicus
catgtgtaccatggca

SEQ ID NO: 490066 - DNA, 16 bp, R. norvegicus
catgtgtacctgcatg

SEQ ID NO: 490067 - DNA, 16 bp, R. norvegicus
catgtgtatgtgcatg

SEQ ID NO: 490068 - DNA, 16 bp, R. norvegicus
catgtgtatgtgtttg

SEQ ID NO: 490069 - DNA, 16 bp, R. norvegicus
catgtgtcctggttat

SEQ ID NO: 490070 - DNA, 16 bp, R. norvegicus
catgtgtctttgctgt

SEQ ID NO: 490071 - DNA, 16 bp, R. norvegicus
catgtgtgaggatgcc

SEQ ID NO: 490072 - DNA, 16 bp, R. norvegicus
catgtgtgcacacaga

SEQ ID NO: 490073 - DNA, 16 bp, R. norvegicus
catgtgtgcacgtgca

SEQ ID NO: 490074 - DNA, 16 bp, R. norvegicus
catgtgtgcatgtgca

SEQ ID NO: 490075 - DNA, 16 bp, R. norvegicus
catgtgtgccatgtgt

SEQ ID NO: 490076 - DNA, 16 bp, R. norvegicus
catgtgtgggcacatg

SEQ ID NO: 490077 - DNA, 16 bp, R. norvegicus
catgtgtgtacgcatg

SEQ ID NO: 490078 - DNA, 16 bp, R. norvegicus
catgtgtgtctatgta

SEQ ID NO: 490079 - DNA, 16 bp, R. norvegicus
catgtgtgtctgtctg

SEQ ID NO: 490080 - DNA, 16 bp, R. norvegicus
catgtgtgtgagggtg

SEQ ID NO: 490081 - DNA, 16 bp, R. norvegicus
catgtgtgtgcagtgt

SEQ ID NO: 490082 - DNA, 16 bp, R. norvegicus
catgtgtgtgccagtg

SEQ ID NO: 490083 - DNA, 16 bp, R. norvegicus
catgtgtgtgtacctg

SEQ ID NO: 490084 - DNA, 16 bp, R. norvegicus
catgtgtgtgtatgtg

SEQ ID NO: 490085 - DNA, 16 bp, R. norvegicus
catgtgtgtgtgagtg

SEQ ID NO: 490086 - DNA, 16 bp, R. norvegicus
catgtgttgttgttgt

SEQ ID NO: 490087 - DNA, 16 bp, R. norvegicus
catgtgttttgttttg

SEQ ID NO: 490088 - DNA, 16 bp, R. norvegicus
catgttaaaaagttca

SEQ ID NO: 490089 - DNA, 16 bp, R. norvegicus
catgttcaaggccagc

SEQ ID NO: 490090 - DNA, 16 bp, R. norvegicus
catgttcacacacatg

SEQ ID NO: 490091 - DNA, 16 bp, R. norvegicus
catgttccagcctcag

SEQ ID NO: 490092 - DNA, 16 bp, R. norvegicus
catgttctcagttcaa

SEQ ID NO: 490093 - DNA, 16 bp, R. norvegicus
catgttctctctgtgg

SEQ ID NO: 490094 - DNA, 16 bp, R. norvegicus
catgttggagtaggtg

SEQ ID NO: 490095 - DNA, 16 bp, R. norvegicus
catgttgggcaggctc

SEQ ID NO: 490096 - DNA, 16 bp, R. norvegicus
catgttggttcaataa

SEQ ID NO: 490097 - DNA, 16 bp, R. norvegicus
catgtttacctgtgtt

SEQ ID NO: 490098 - DNA, 16 bp, R. norvegicus
catgtttcctctttaa

SEQ ID NO: 490099 - DNA, 16 bp, R. norvegicus
catgtttgagttcctg

SEQ ID NO: 490100 - DNA, 45 bp, R. norvegicus
catgtttgcctggggggccattgtcctcttgggatgtggagtatg

SEQ ID NO: 490101 - DNA, 16 bp, R. norvegicus
cattaaaaatgttaaa

SEQ ID NO: 490102 - DNA, 16 bp, R. norvegicus
cattaaaaccaaccat

SEQ ID NO: 490103 - DNA, 16 bp, R. norvegicus
cattaaagaaagaaat

SEQ ID NO: 490104 - DNA, 16 bp, R. norvegicus
cattaaagaacacaca

SEQ ID NO: 490105 - DNA, 16 bp, R. norvegicus
cattaaagtggacaca

SEQ ID NO: 490106 - DNA, 16 bp, R. norvegicus
cattaaatgattttca

SEQ ID NO: 490107 - DNA, 18 bp, R. norvegicus
cattaactgggaaactaa

SEQ ID NO: 490108 - DNA, 16 bp, R. norvegicus
cattaactttgacagt

SEQ ID NO: 490109 - DNA, 16 bp, R. norvegicus
cattaagaagcaggca

SEQ ID NO: 490110 - DNA, 16 bp, R. norvegicus
cattacaggtctccca

SEQ ID NO: 490111 - DNA, 17 bp, R. norvegicus
cattacatggatgatat

SEQ ID NO: 490112 - DNA, 16 bp, R. norvegicus
cattaccgccctccct

SEQ ID NO: 490113 - DNA, 16 bp, R. norvegicus
cattacctttgacagt

SEQ ID NO: 490114 - DNA, 16 bp, R. norvegicus
cattactacttcataa

SEQ ID NO: 490115 - DNA, 16 bp, R. norvegicus
cattactgagggaagt

SEQ ID NO: 490116 - DNA, 16 bp, R. norvegicus
cattactgctgcagac

SEQ ID NO: 490117 - DNA, 16 bp, R. norvegicus
cattagatgctgagta

SEQ ID NO: 490118 - DNA, 16 bp, R. norvegicus
cattaggaattatttt

SEQ ID NO: 490119 - DNA, 16 bp, R. norvegicus
cattaggggtgggctt

SEQ ID NO: 490120 - DNA, 16 bp, R. norvegicus
cattaggtgctgagaa

SEQ ID NO: 490121 - DNA, 16 bp, R. norvegicus
cattatataaacaacc

SEQ ID NO: 490122 - DNA, 16 bp, R. norvegicus
cattatcatcaaggaa

SEQ ID NO: 490123 - DNA, 16 bp, R. norvegicus
cattatcatcaaggag

SEQ ID NO: 490124 - DNA, 16 bp, R. norvegicus
cattatctttgactat

SEQ ID NO: 490125 - DNA, 16 bp, R. norvegicus
cattatctttgatgat

SEQ ID NO: 490126 - DNA, 16 bp, R. norvegicus
cattattggaagtaaa

SEQ ID NO: 490127 - DNA, 16 bp, R. norvegicus
cattattgtcatggtg

SEQ ID NO: 490128 - DNA, 16 bp, R. norvegicus
cattatttaaaagaaa

SEQ ID NO: 490129 - DNA, 39 bp, R. norvegicus
cattcaaacaacaagcatcttcagtgagaagagtagcaa

SEQ ID NO: 490130 - DNA, 16 bp, R. norvegicus
cattcaaacacataag

SEQ ID NO: 490131 - DNA, 16 bp, R. norvegicus
cattcaaactactaca

SEQ ID NO: 490132 - DNA, 16 bp, R. norvegicus
cattcaaatgaccaca

SEQ ID NO: 490133 - DNA, 16 bp, R. norvegicus
cattcaagaggcagaa

SEQ ID NO: 490134 - DNA, 16 bp, R. norvegicus
cattcacacacacata

SEQ ID NO: 490135 - DNA, 19 bp, R. norvegicus
cattcacattttgatcatc

SEQ ID NO: 490136 - DNA, 16 bp, R. norvegicus
cattcaccatgaccaa

SEQ ID NO: 490137 - DNA, 17 bp, R. norvegicus
cattcacctatgtattt

SEQ ID NO: 490138 - DNA, 16 bp, R. norvegicus
cattcactcatacaca

SEQ ID NO: 490139 - DNA, 17 bp, R. norvegicus
cattcactgagggactc

SEQ ID NO: 490140 - DNA, 16 bp, R. norvegicus
cattcagaagacagag

SEQ ID NO: 490141 - DNA, 16 bp, R. norvegicus
cattcagagtctaccc

SEQ ID NO: 490142 - DNA, 16 bp, R. norvegicus
cattcagcagcagctg

SEQ ID NO: 490143 - DNA, 16 bp, R. norvegicus
cattcagctccttcaa

SEQ ID NO: 490144 - DNA, 16 bp, R. norvegicus
cattcaggaagctgag

SEQ ID NO: 490145 - DNA, 16 bp, R. norvegicus
cattcaggaggcaaag

SEQ ID NO: 490146 - DNA, 16 bp, R. norvegicus
cattcatccacccatc

SEQ ID NO: 490147 - DNA, 16 bp, R. norvegicus
cattcatccatctatc

SEQ ID NO: 490148 - DNA, 16 bp, R. norvegicus
cattcattcattcaaa

SEQ ID NO: 490149 - DNA, 16 bp, R. norvegicus
cattcattcattccag

SEQ ID NO: 490150 - DNA, 16 bp, R. norvegicus
cattcattctggatga

SEQ ID NO: 490151 - DNA, 16 bp, R. norvegicus
cattccagaggcagag

SEQ ID NO: 490152 - DNA, 16 bp, R. norvegicus
cattcccctacactgg

SEQ ID NO: 490153 - DNA, 17 bp, R. norvegicus
cattcccctatgtattt

SEQ ID NO: 490154 - DNA, 16 bp, R. norvegicus
cattccctacttcttc

SEQ ID NO: 490155 - DNA, 16 bp, R. norvegicus
cattccctaggcagat

SEQ ID NO: 490156 - DNA, 16 bp, R. norvegicus
cattcctcagctttga

SEQ ID NO: 490157 - DNA, 16 bp, R. norvegicus
cattcctcaggaactt

SEQ ID NO: 490158 - DNA, 16 bp, R. norvegicus
cattcctctaaactgg

SEQ ID NO: 490159 - DNA, 16 bp, R. norvegicus
cattcctctatggcct

SEQ ID NO: 490160 - DNA, 16 bp, R. norvegicus
cattcctctgatgaag

SEQ ID NO: 490161 - DNA, 16 bp, R. norvegicus
cattcctgagacagag

SEQ ID NO: 490162 - DNA, 16 bp, R. norvegicus
cattcctggtactgga

SEQ ID NO: 490163 - DNA, 16 bp, R. norvegicus
cattcctgtccactgg

SEQ ID NO: 490164 - DNA, 16 bp, R. norvegicus
cattcctgtctcctcc

SEQ ID NO: 490165 - DNA, 16 bp, R. norvegicus
cattccttcagtttct

SEQ ID NO: 490166 - DNA, 16 bp, R. norvegicus
cattccttcttagaag

SEQ ID NO: 490167 - DNA, 16 bp, R. norvegicus
cattcggccttcctca

SEQ ID NO: 490168 - DNA, 17 bp, R. norvegicus
cattctatcctaaagga

SEQ ID NO: 490169 - DNA, 16 bp, R. norvegicus
cattctcagctacata

SEQ ID NO: 490170 - DNA, 21 bp, R. norvegicus
cattctcagtgattacaggat

SEQ ID NO: 490171 - DNA, 16 bp, R. norvegicus
cattctcatctgtatt

SEQ ID NO: 490172 - DNA, 16 bp, R. norvegicus
cattctcctggccttc

SEQ ID NO: 490173 - DNA, 16 bp, R. norvegicus
cattctcctgtctctg

SEQ ID NO: 490174 - DNA, 16 bp, R. norvegicus
cattctctttgttttc

SEQ ID NO: 490175 - DNA, 16 bp, R. norvegicus
cattctgcccctccat

SEQ ID NO: 490176 - DNA, 16 bp, R. norvegicus
cattctgctacatgct

SEQ ID NO: 490177 - DNA, 16 bp, R. norvegicus
cattctgctgcctcca

SEQ ID NO: 490178 - DNA, 16 bp, R. norvegicus
cattctgctggccttc

SEQ ID NO: 490179 - DNA, 16 bp, R. norvegicus
cattctggaaatctgt

SEQ ID NO: 490180 - DNA, 16 bp, R. norvegicus
cattctgtaaatgtac

SEQ ID NO: 490181 - DNA, 16 bp, R. norvegicus
cattctgtcagttctg

SEQ ID NO: 490182 - DNA, 16 bp, R. norvegicus
cattcttcaacatgtt

SEQ ID NO: 490183 - DNA, 16 bp, R. norvegicus
cattcttcagcaaatc

SEQ ID NO: 490184 - DNA, 16 bp, R. norvegicus
cattcttcagtgtcag

SEQ ID NO: 490185 - DNA, 16 bp, R. norvegicus
cattcttctattgagg

SEQ ID NO: 490186 - DNA, 16 bp, R. norvegicus
cattctttgtgcaaac

SEQ ID NO: 490187 - DNA, 16 bp, R. norvegicus
cattgaaacaaaaact

SEQ ID NO: 490188 - DNA, 16 bp, R. norvegicus
cattgaaagcagtgct

SEQ ID NO: 490189 - DNA, 16 bp, R. norvegicus
cattgaactacttgag

SEQ ID NO: 490190 - DNA, 16 bp, R. norvegicus
cattgaactgaaaacg

SEQ ID NO: 490191 - DNA, 16 bp, R. norvegicus
cattgaactgagaatg

SEQ ID NO: 490192 - DNA, 16 bp, R. norvegicus
cattgaactgagcact

SEQ ID NO: 490193 - DNA, 16 bp, R. norvegicus
cattgaggtattttat

SEQ ID NO: 490194 - DNA, 16 bp, R. norvegicus
cattgaggtctttgat

SEQ ID NO: 490195 - DNA, 16 bp, R. norvegicus
cattgagttccaggac

SEQ ID NO: 490196 - DNA, 16 bp, R. norvegicus
cattgatgagagtgaa

SEQ ID NO: 490197 - DNA, 16 bp, R. norvegicus
cattgattcctgggag

SEQ ID NO: 490198 - DNA, 16 bp, R. norvegicus
cattgattttttttaa

SEQ ID NO: 490199 - DNA, 16 bp, R. norvegicus
cattgccagcatctgt

SEQ ID NO: 490200 - DNA, 16 bp, R. norvegicus
cattgccgccctctcc

SEQ ID NO: 490201 - DNA, 16 bp, R. norvegicus
cattgctacacaactc

SEQ ID NO: 490202 - DNA, 16 bp, R. norvegicus
cattgctcaacttcca

SEQ ID NO: 490203 - DNA, 16 bp, R. norvegicus
cattgctgttcatcac

SEQ ID NO: 490204 - DNA, 16 bp, R. norvegicus
cattggactgagtatg

SEQ ID NO: 490205 - DNA, 16 bp, R. norvegicus
cattggaggaaataga

SEQ ID NO: 490206 - DNA, 16 bp, R. norvegicus
cattggatcccattac

SEQ ID NO: 490207 - DNA, 16 bp, R. norvegicus
cattggattccttgga

SEQ ID NO: 490208 - DNA, 16 bp, R. norvegicus
cattgggcagagcttg

SEQ ID NO: 490209 - DNA, 16 bp, R. norvegicus
cattggggaccccatg

SEQ ID NO: 490210 - DNA, 16 bp, R. norvegicus
cattggggactccatt

SEQ ID NO: 490211 - DNA, 16 bp, R. norvegicus
cattggggttggggat

SEQ ID NO: 490212 - DNA, 16 bp, R. norvegicus
cattggtagcaatgaa

SEQ ID NO: 490213 - DNA, 16 bp, R. norvegicus
cattggtcccaagaaa

SEQ ID NO: 490214 - DNA, 16 bp, R. norvegicus
cattgtacaaggagat

SEQ ID NO: 490215 - DNA, 16 bp, R. norvegicus
cattgtactatcagcc

SEQ ID NO: 490216 - DNA, 16 bp, R. norvegicus
cattgtataatatttc

SEQ ID NO: 490217 - DNA, 16 bp, R. norvegicus
cattgtcgtcatcatc

SEQ ID NO: 490218 - DNA, 16 bp, R. norvegicus
cattgtctcaaaaaac

SEQ ID NO: 490219 - DNA, 16 bp, R. norvegicus
cattgtctctttgttg

SEQ ID NO: 490220 - DNA, 16 bp, R. norvegicus
cattgtctttgacagt

SEQ ID NO: 490221 - DNA, 16 bp, R. norvegicus
cattgtctttgatggt

SEQ ID NO: 490222 - DNA, 16 bp, R. norvegicus
cattgtgctgcataca

SEQ ID NO: 490223 - DNA, 16 bp, R. norvegicus
cattgtgctggagaag

SEQ ID NO: 490224 - DNA, 16 bp, R. norvegicus
cattgtgggtggtgtc

SEQ ID NO: 490225 - DNA, 16 bp, R. norvegicus
cattgtggtcatcctt

SEQ ID NO: 490226 - DNA, 16 bp, R. norvegicus
cattgtggtccccatg

SEQ ID NO: 490227 - DNA, 16 bp, R. norvegicus
cattgtggttttaatt

SEQ ID NO: 490228 - DNA, 19 bp, R. norvegicus
cattgtgtctacagtgtct

SEQ ID NO: 490229 - DNA, 19 bp, R. norvegicus
cattgtgtctgcagtgtct

SEQ ID NO: 490230 - DNA, 16 bp, R. norvegicus
cattgttggtggaatt

SEQ ID NO: 490231 - DNA, 17 bp, R. norvegicus
cattgtttttgaaagct

SEQ ID NO: 490232 - DNA, 16 bp, R. norvegicus
catttaaaaatacaca

SEQ ID NO: 490233 - DNA, 16 bp, R. norvegicus
catttaaaatatgaaa

SEQ ID NO: 490234 - DNA, 16 bp, R. norvegicus
catttaatcaagcaaa

SEQ ID NO: 490235 - DNA, 16 bp, R. norvegicus
catttacaaaagaaaa

SEQ ID NO: 490236 - DNA, 16 bp, R. norvegicus
catttacagaacattt

SEQ ID NO: 490237 - DNA, 16 bp, R. norvegicus
catttagaatgttatt

SEQ ID NO: 490238 - DNA, 16 bp, R. norvegicus
catttagtttagtgtt

SEQ ID NO: 490239 - DNA, 16 bp, R. norvegicus
catttatcagtgaatg

SEQ ID NO: 490240 - DNA, 16 bp, R. norvegicus
catttatgtatttatt

SEQ ID NO: 490241 - DNA, 16 bp, R. norvegicus
catttattctcctggc

SEQ ID NO: 490242 - DNA, 16 bp, R. norvegicus
catttattgagagaaa

SEQ ID NO: 490243 - DNA, 16 bp, R. norvegicus
catttcaacagttcaa

SEQ ID NO: 490244 - DNA, 16 bp, R. norvegicus
catttcacagtcaaaa

SEQ ID NO: 490245 - DNA, 16 bp, R. norvegicus
catttcacccagattt

SEQ ID NO: 490246 - DNA, 16 bp, R. norvegicus
catttcagatggttgt

SEQ ID NO: 490247 - DNA, 16 bp, R. norvegicus
catttcatccatattt

SEQ ID NO: 490248 - DNA, 16 bp, R. norvegicus
catttcatgtgtgtgt

SEQ ID NO: 490249 - DNA, 16 bp, R. norvegicus
catttcatgttaaaag

SEQ ID NO: 490250 - DNA, 16 bp, R. norvegicus
catttccagagtggtt

SEQ ID NO: 490251 - DNA, 16 bp, R. norvegicus
catttccaggagatct

SEQ ID NO: 490252 - DNA, 16 bp, R. norvegicus
catttcccatttccca

SEQ ID NO: 490253 - DNA, 16 bp, R. norvegicus
catttccctgatgtct

SEQ ID NO: 490254 - DNA, 24 bp, R. norvegicus
catttcccttatgactaaagatgc

SEQ ID NO: 490255 - DNA, 16 bp, R. norvegicus
catttcccttctgact

SEQ ID NO: 490256 - DNA, 16 bp, R. norvegicus
catttcctcaaggaag

SEQ ID NO: 490257 - DNA, 16 bp, R. norvegicus
catttcctcagctgag

SEQ ID NO: 490258 - DNA, 16 bp, R. norvegicus
catttcctcccatgag

SEQ ID NO: 490259 - DNA, 16 bp, R. norvegicus
catttcctctcccact

SEQ ID NO: 490260 - DNA, 16 bp, R. norvegicus
catttccttaggtgtt

SEQ ID NO: 490261 - DNA, 16 bp, R. norvegicus
catttccttcagattt

SEQ ID NO: 490262 - DNA, 16 bp, R. norvegicus
catttccttgattgat

SEQ ID NO: 490263 - DNA, 16 bp, R. norvegicus
catttctaactccaga

SEQ ID NO: 490264 - DNA, 16 bp, R. norvegicus
catttctccagcacca

SEQ ID NO: 490265 - DNA, 16 bp, R. norvegicus
catttctcctgctctc

SEQ ID NO: 490266 - DNA, 16 bp, R. norvegicus
catttctccttctcag

SEQ ID NO: 490267 - DNA, 16 bp, R. norvegicus
catttctgattttgta

SEQ ID NO: 490268 - DNA, 16 bp, R. norvegicus
catttctgctataaaa

SEQ ID NO: 490269 - DNA, 16 bp, R. norvegicus
catttctgctgctgtg

SEQ ID NO: 490270 - DNA, 16 bp, R. norvegicus
catttctgctttcttt

SEQ ID NO: 490271 - DNA, 16 bp, R. norvegicus
catttctggggctgga

SEQ ID NO: 490272 - DNA, 16 bp, R. norvegicus
catttctgggtcttct

SEQ ID NO: 490273 - DNA, 16 bp, R. norvegicus
catttctgtcacagaa

SEQ ID NO: 490274 - DNA, 16 bp, R. norvegicus
catttctgtcactgtg

SEQ ID NO: 490275 - DNA, 16 bp, R. norvegicus
catttctgtttccttt

SEQ ID NO: 490276 - DNA, 16 bp, R. norvegicus
catttctttaaaaaaa

SEQ ID NO: 490277 - DNA, 16 bp, R. norvegicus
catttgaagtgcaaat

SEQ ID NO: 490278 - DNA, 16 bp, R. norvegicus
catttgaggaattaga

SEQ ID NO: 490279 - DNA, 44 bp, R. norvegicus
catttgatcatgatgctggaggacttcaagaaagacatgaagaa

SEQ ID NO: 490280 - DNA, 16 bp, R. norvegicus
catttgcaaatgaaga

SEQ ID NO: 490281 - DNA, 16 bp, R. norvegicus
catttgcacacacaca

SEQ ID NO: 490282 - DNA, 16 bp, R. norvegicus
catttgcacacatgtg

SEQ ID NO: 490283 - DNA, 16 bp, R. norvegicus
catttgcacatgcaca

SEQ ID NO: 490284 - DNA, 16 bp, R. norvegicus
catttgccagcaaaat

SEQ ID NO: 490285 - DNA, 16 bp, R. norvegicus
catttgcctcagaatt

SEQ ID NO: 490286 - DNA, 16 bp, R. norvegicus
catttgcttctgcctc

SEQ ID NO: 490287 - DNA, 16 bp, R. norvegicus
catttgcttgtaaatt

SEQ ID NO: 490288 - DNA, 16 bp, R. norvegicus
catttggaaaagcaaa

SEQ ID NO: 490289 - DNA, 16 bp, R. norvegicus
catttggaaccttcaa

SEQ ID NO: 490290 - DNA, 16 bp, R. norvegicus
catttggaattgagtt

SEQ ID NO: 490291 - DNA, 16 bp, R. norvegicus
catttggagcataggt

SEQ ID NO: 490292 - DNA, 16 bp, R. norvegicus
catttggctttggcaa

SEQ ID NO: 490293 - DNA, 16 bp, R. norvegicus
catttgggaggctgaa

SEQ ID NO: 490294 - DNA, 16 bp, R. norvegicus
catttggtattggaca

SEQ ID NO: 490295 - DNA, 16 bp, R. norvegicus
catttggttttcttct

SEQ ID NO: 490296 - DNA, 16 bp, R. norvegicus
catttgtcaaaactca

SEQ ID NO: 490297 - DNA, 16 bp, R. norvegicus
catttgtctgtctgtc

SEQ ID NO: 490298 - DNA, 16 bp, R. norvegicus
catttgtcttctctta

SEQ ID NO: 490299 - DNA, 16 bp, R. norvegicus
catttgtggctgagca

SEQ ID NO: 490300 - DNA, 16 bp, R. norvegicus
catttgttgggaagag

SEQ ID NO: 490301 - DNA, 16 bp, R. norvegicus
catttgttgttttgat

SEQ ID NO: 490302 - DNA, 16 bp, R. norvegicus
catttgtttgagaatt

SEQ ID NO: 490303 - DNA, 16 bp, R. norvegicus
catttgtttgagacag

SEQ ID NO: 490304 - DNA, 16 bp, R. norvegicus
catttgttttatatat

SEQ ID NO: 490305 - DNA, 16 bp, R. norvegicus
catttgttttcttgac

SEQ ID NO: 490306 - DNA, 16 bp, R. norvegicus
cattttaaaacagaaa

SEQ ID NO: 490307 - DNA, 16 bp, R. norvegicus
cattttaaaatatcaa

SEQ ID NO: 490308 - DNA, 16 bp, R. norvegicus
cattttaaagacattt

SEQ ID NO: 490309 - DNA, 16 bp, R. norvegicus
cattttaaatatttgt

SEQ ID NO: 490310 - DNA, 16 bp, R. norvegicus
cattttaaatgcaaat

SEQ ID NO: 490311 - DNA, 16 bp, R. norvegicus
cattttaaggaacaca

SEQ ID NO: 490312 - DNA, 16 bp, R. norvegicus
cattttagccattctg

SEQ ID NO: 490313 - DNA, 16 bp, R. norvegicus
cattttataattttgt

SEQ ID NO: 490314 - DNA, 16 bp, R. norvegicus
cattttatacataaaa

SEQ ID NO: 490315 - DNA, 17 bp, R. norvegicus
cattttatcagtactaa

SEQ ID NO: 490316 - DNA, 16 bp, R. norvegicus
cattttattaattagt

SEQ ID NO: 490317 - DNA, 16 bp, R. norvegicus
cattttattgctctgt

SEQ ID NO: 490318 - DNA, 16 bp, R. norvegicus
cattttcatttccatt

SEQ ID NO: 490319 - DNA, 16 bp, R. norvegicus
cattttctccactgag

SEQ ID NO: 490320 - DNA, 16 bp, R. norvegicus
cattttctcttctgtt

SEQ ID NO: 490321 - DNA, 16 bp, R. norvegicus
cattttctgaaatctt

SEQ ID NO: 490322 - DNA, 16 bp, R. norvegicus
cattttctgaattagt

SEQ ID NO: 490323 - DNA, 16 bp, R. norvegicus
cattttctggtgtttt

SEQ ID NO: 490324 - DNA, 16 bp, R. norvegicus
cattttcttctttgta

SEQ ID NO: 490325 - DNA, 16 bp, R. norvegicus
cattttcttggttgct

SEQ ID NO: 490326 - DNA, 16 bp, R. norvegicus
cattttctttatgtat

SEQ ID NO: 490327 - DNA, 16 bp, R. norvegicus
cattttctttgactat

SEQ ID NO: 490328 - DNA, 16 bp, R. norvegicus
cattttgaaaaaaaaa

SEQ ID NO: 490329 - DNA, 16 bp, R. norvegicus
cattttgaaaaatgaa

SEQ ID NO: 490330 - DNA, 16 bp, R. norvegicus
cattttgaggggctga

SEQ ID NO: 490331 - DNA, 16 bp, R. norvegicus
cattttggggaaaaaa

SEQ ID NO: 490332 - DNA, 16 bp, R. norvegicus
cattttgggggtgggg

SEQ ID NO: 490333 - DNA, 16 bp, R. norvegicus
cattttgtttcattct

SEQ ID NO: 490334 - DNA, 16 bp, R. norvegicus
cattttgttttgcatt

SEQ ID NO: 490335 - DNA, 16 bp, R. norvegicus
cattttgtttttaaat

SEQ ID NO: 490336 - DNA, 16 bp, R. norvegicus
catttttaatagaatt

SEQ ID NO: 490337 - DNA, 16 bp, R. norvegicus
catttttacatgggtt

SEQ ID NO: 490338 - DNA, 16 bp, R. norvegicus
catttttctgagaaac

SEQ ID NO: 490339 - DNA, 16 bp, R. norvegicus
catttttgtccctgaa

SEQ ID NO: 490340 - DNA, 16 bp, R. norvegicus
cattttttgataactt

SEQ ID NO: 490341 - DNA, 16 bp, R. norvegicus
cattttttggatattt

SEQ ID NO: 490342 - DNA, 16 bp, R. norvegicus
catttttttcctcaga

SEQ ID NO: 490343 - DNA, 16 bp, R. norvegicus
cattttttttaaagat

SEQ ID NO: 490344 - DNA, 16 bp, R. norvegicus
ccaaaaaagcccagga

SEQ ID NO: 490345 - DNA, 17 bp, R. norvegicus
ccaaaaaatgccccaac

SEQ ID NO: 490346 - DNA, 16 bp, R. norvegicus
ccaaaaacatccagga

SEQ ID NO: 490347 - DNA, 16 bp, R. norvegicus
ccaaaaactggtcttc

SEQ ID NO: 490348 - DNA, 16 bp, R. norvegicus
ccaaaaagcagctgaa

SEQ ID NO: 490349 - DNA, 16 bp, R. norvegicus
ccaaaacatacatgaa

SEQ ID NO: 490350 - DNA, 16 bp, R. norvegicus
ccaaaactctgtgcct

SEQ ID NO: 490351 - DNA, 16 bp, R. norvegicus
ccaaaagaagagacac

SEQ ID NO: 490352 - DNA, 16 bp, R. norvegicus
ccaaaagaagctccaa

SEQ ID NO: 490353 - DNA, 16 bp, R. norvegicus
ccaaaagacctaacaa

SEQ ID NO: 490354 - DNA, 43 bp, R. norvegicus
ccaaaagagattttggaattatggcagccataatttcagccat

SEQ ID NO: 490355 - DNA, 16 bp, R. norvegicus
ccaaaagattccccaa

SEQ ID NO: 490356 - DNA, 16 bp, R. norvegicus
ccaaaagcaacctaca

SEQ ID NO: 490357 - DNA, 16 bp, R. norvegicus
ccaaaagcaacttgga

SEQ ID NO: 490358 - DNA, 16 bp, R. norvegicus
ccaaaagctcagaaaa

SEQ ID NO: 490359 - DNA, 16 bp, R. norvegicus
ccaaaagctctagaac

SEQ ID NO: 490360 - DNA, 16 bp, R. norvegicus
ccaaaaggaaatgcat

SEQ ID NO: 490361 - DNA, 16 bp, R. norvegicus
ccaaaaggacatacat

SEQ ID NO: 490362 - DNA, 16 bp, R. norvegicus
ccaaaaggcaaggtta

SEQ ID NO: 490363 - DNA, 16 bp, R. norvegicus
ccaaaaggccaagaag

SEQ ID NO: 490364 - DNA, 16 bp, R. norvegicus
ccaaaagttggaaaga

SEQ ID NO: 490365 - DNA, 16 bp, R. norvegicus
ccaaaataaatctttc

SEQ ID NO: 490366 - DNA, 16 bp, R. norvegicus
ccaaaatacataaaga

SEQ ID NO: 490367 - DNA, 16 bp, R. norvegicus
ccaaaatagctgagct

SEQ ID NO: 490368 - DNA, 16 bp, R. norvegicus
ccaaaatattttatgt

SEQ ID NO: 490369 - DNA, 16 bp, R. norvegicus
ccaaaatcctataaaa

SEQ ID NO: 490370 - DNA, 16 bp, R. norvegicus
ccaaaatctacatcat

SEQ ID NO: 490371 - DNA, 16 bp, R. norvegicus
ccaaaatgcttgaatt

SEQ ID NO: 490372 - DNA, 16 bp, R. norvegicus
ccaaaattcaacaccc

SEQ ID NO: 490373 - DNA, 16 bp, R. norvegicus
ccaaacaccaatggct

SEQ ID NO: 490374 - DNA, 16 bp, R. norvegicus
ccaaacagagccactc

SEQ ID NO: 490375 - DNA, 16 bp, R. norvegicus
ccaaacagcactacca

SEQ ID NO: 490376 - DNA, 16 bp, R. norvegicus
ccaaaccaagacaata

SEQ ID NO: 490377 - DNA, 16 bp, R. norvegicus
ccaaaccaagtcacta

SEQ ID NO: 490378 - DNA, 16 bp, R. norvegicus
ccaaacccagacaata

SEQ ID NO: 490379 - DNA, 16 bp, R. norvegicus
ccaaacctacatctga

SEQ ID NO: 490380 - DNA, 16 bp, R. norvegicus
ccaaaccttttgaact

SEQ ID NO: 490381 - DNA, 16 bp, R. norvegicus
ccaaactattccacac

SEQ ID NO: 490382 - DNA, 16 bp, R. norvegicus
ccaaactcagggctga

SEQ ID NO: 490383 - DNA, 16 bp, R. norvegicus
ccaaactcccctctca

SEQ ID NO: 490384 - DNA, 16 bp, R. norvegicus
ccaaactcctctccaa

SEQ ID NO: 490385 - DNA, 16 bp, R. norvegicus
ccaaactgcacatctg

SEQ ID NO: 490386 - DNA, 16 bp, R. norvegicus
ccaaactttctgctgc

SEQ ID NO: 490387 - DNA, 16 bp, R. norvegicus
ccaaactttgtatcca

SEQ ID NO: 490388 - DNA, 16 bp, R. norvegicus
ccaaagaaacaaactg

SEQ ID NO: 490389 - DNA, 16 bp, R. norvegicus
ccaaagaaacaagctg

SEQ ID NO: 490390 - DNA, 16 bp, R. norvegicus
ccaaagaaagccaagg

SEQ ID NO: 490391 - DNA, 16 bp, R. norvegicus
ccaaagaagatagcca

SEQ ID NO: 490392 - DNA, 16 bp, R. norvegicus
ccaaagactacatgga

SEQ ID NO: 490393 - DNA, 16 bp, R. norvegicus
ccaaagactgtcccac

SEQ ID NO: 490394 - DNA, 16 bp, R. norvegicus
ccaaagagcacacagg

SEQ ID NO: 490395 - DNA, 16 bp, R. norvegicus
ccaaagaggccaaaag

SEQ ID NO: 490396 - DNA, 16 bp, R. norvegicus
ccaaagagggcatcag

SEQ ID NO: 490397 - DNA, 16 bp, R. norvegicus
ccaaagaggtgaagga

SEQ ID NO: 490398 - DNA, 16 bp, R. norvegicus
ccaaagaggttgtgac

SEQ ID NO: 490399 - DNA, 16 bp, R. norvegicus
ccaaagagtacatatg

SEQ ID NO: 490400 - DNA, 16 bp, R. norvegicus
ccaaagataatgtaaa

SEQ ID NO: 490401 - DNA, 16 bp, R. norvegicus
ccaaagcaggcaaaag

SEQ ID NO: 490402 - DNA, 16 bp, R. norvegicus
ccaaagctgaccttga

SEQ ID NO: 490403 - DNA, 16 bp, R. norvegicus
ccaaagctgcagggtc

SEQ ID NO: 490404 - DNA, 16 bp, R. norvegicus
ccaaagctggaccccc

SEQ ID NO: 490405 - DNA, 16 bp, R. norvegicus
ccaaaggaaatcagga

SEQ ID NO: 490406 - DNA, 16 bp, R. norvegicus
ccaaaggaagacagga

SEQ ID NO: 490407 - DNA, 16 bp, R. norvegicus
ccaaaggaagtcagca

SEQ ID NO: 490408 - DNA, 16 bp, R. norvegicus
ccaaaggacatgcaca

SEQ ID NO: 490409 - DNA, 16 bp, R. norvegicus
ccaaaggacctgggtt

SEQ ID NO: 490410 - DNA, 16 bp, R. norvegicus
ccaaaggcagctgtcc

SEQ ID NO: 490411 - DNA, 16 bp, R. norvegicus
ccaaaggccatgtgga

SEQ ID NO: 490412 - DNA, 16 bp, R. norvegicus
ccaaagtcccaaaatt

SEQ ID NO: 490413 - DNA, 16 bp, R. norvegicus
ccaaagtgcaggtgct

SEQ ID NO: 490414 - DNA, 16 bp, R. norvegicus
ccaaagttgttctctg

SEQ ID NO: 490415 - DNA, 16 bp, R. norvegicus
ccaaataaaccttttc

SEQ ID NO: 490416 - DNA, 16 bp, R. norvegicus
ccaaataaatcttttt

SEQ ID NO: 490417 - DNA, 19 bp, R. norvegicus
ccaaataaccctattaaaa

SEQ ID NO: 490418 - DNA, 16 bp, R. norvegicus
ccaaatactactggtc

SEQ ID NO: 490419 - DNA, 16 bp, R. norvegicus
ccaaatactggaatta

SEQ ID NO: 490420 - DNA, 16 bp, R. norvegicus
ccaaatagaaacaaag

SEQ ID NO: 490421 - DNA, 16 bp, R. norvegicus
ccaaatcacaaaagaa

SEQ ID NO: 490422 - DNA, 16 bp, R. norvegicus
ccaaatgaatgtgcaa

SEQ ID NO: 490423 - DNA, 16 bp, R. norvegicus
ccaaatgaggacacct

SEQ ID NO: 490424 - DNA, 16 bp, R. norvegicus
ccaaatgattctccaa

SEQ ID NO: 490425 - DNA, 16 bp, R. norvegicus
ccaaatgctaagatta

SEQ ID NO: 490426 - DNA, 16 bp, R. norvegicus
ccaaatgctgcccctc

SEQ ID NO: 490427 - DNA, 16 bp, R. norvegicus
ccaaatggctgagaag

SEQ ID NO: 490428 - DNA, 16 bp, R. norvegicus
ccaaatggtattccca

SEQ ID NO: 490429 - DNA, 16 bp, R. norvegicus
ccaaattagcaaaatc

SEQ ID NO: 490430 - DNA, 16 bp, R. norvegicus
ccaaattcaaccacag

SEQ ID NO: 490431 - DNA, 16 bp, R. norvegicus
ccaaattcaagtcctc

SEQ ID NO: 490432 - DNA, 17 bp, R. norvegicus
ccaaattcataaaagaa

SEQ ID NO: 490433 - DNA, 16 bp, R. norvegicus
ccaaattgattttcag

SEQ ID NO: 490434 - DNA, 16 bp, R. norvegicus
ccaaattttctggatg

SEQ ID NO: 490435 - DNA, 16 bp, R. norvegicus
ccaacaaagggaagag

SEQ ID NO: 490436 - DNA, 16 bp, R. norvegicus
ccaacaaattggaaaa

SEQ ID NO: 490437 - DNA, 16 bp, R. norvegicus
ccaacaacagtgtcct

SEQ ID NO: 490438 - DNA, 16 bp, R. norvegicus
ccaacaactggagagg

SEQ ID NO: 490439 - DNA, 16 bp, R. norvegicus
ccaacaaggccactct

SEQ ID NO: 490440 - DNA, 16 bp, R. norvegicus
ccaacaaggccctcct

SEQ ID NO: 490441 - DNA, 16 bp, R. norvegicus
ccaacaatcactgggg

SEQ ID NO: 490442 - DNA, 16 bp, R. norvegicus
ccaacacaactgactc

SEQ ID NO: 490443 - DNA, 16 bp, R. norvegicus
ccaacacatctgaaaa

SEQ ID NO: 490444 - DNA, 16 bp, R. norvegicus
ccaacaccaagccttc

SEQ ID NO: 490445 - DNA, 16 bp, R. norvegicus
ccaacaccctctctgg

SEQ ID NO: 490446 - DNA, 16 bp, R. norvegicus
ccaacaccctcttctg

SEQ ID NO: 490447 - DNA, 16 bp, R. norvegicus
ccaacactgcccaacc

SEQ ID NO: 490448 - DNA, 16 bp, R. norvegicus
ccaacactggaggagt

SEQ ID NO: 490449 - DNA, 16 bp, R. norvegicus
ccaacactgggaaggc

SEQ ID NO: 490450 - DNA, 16 bp, R. norvegicus
ccaacactgtccaccc

SEQ ID NO: 490451 - DNA, 16 bp, R. norvegicus
ccaacagagtcaacca

SEQ ID NO: 490452 - DNA, 16 bp, R. norvegicus
ccaacagcagcaacaa

SEQ ID NO: 490453 - DNA, 16 bp, R. norvegicus
ccaacagcagggagat

SEQ ID NO: 490454 - DNA, 16 bp, R. norvegicus
ccaacagccaatagct

SEQ ID NO: 490455 - DNA, 16 bp, R. norvegicus
ccaacagctagtatgc

SEQ ID NO: 490456 - DNA, 16 bp, R. norvegicus
ccaacagtgctgccag

SEQ ID NO: 490457 - DNA, 16 bp, R. norvegicus
ccaacataaaacaaag

SEQ ID NO: 490458 - DNA, 19 bp, R. norvegicus
ccaacatataacaaagaca

SEQ ID NO: 490459 - DNA, 16 bp, R. norvegicus
ccaacatcactgcaga

SEQ ID NO: 490460 - DNA, 16 bp, R. norvegicus
ccaacatctaccccat

SEQ ID NO: 490461 - DNA, 16 bp, R. norvegicus
ccaacatgaggaggca

SEQ ID NO: 490462 - DNA, 16 bp, R. norvegicus
ccaacatggtctacat

SEQ ID NO: 490463 - DNA, 16 bp, R. norvegicus
ccaacattggcaggac

SEQ ID NO: 490464 - DNA, 16 bp, R. norvegicus
ccaaccaaccacagct

SEQ ID NO: 490465 - DNA, 16 bp, R. norvegicus
ccaaccacagaaagac

SEQ ID NO: 490466 - DNA, 16 bp, R. norvegicus
ccaaccagaccccaga

SEQ ID NO: 490467 - DNA, 16 bp, R. norvegicus
ccaaccagactcccag

SEQ ID NO: 490468 - DNA, 16 bp, R. norvegicus
ccaaccagatcttcca

SEQ ID NO: 490469 - DNA, 16 bp, R. norvegicus
ccaaccagccagccaa

SEQ ID NO: 490470 - DNA, 16 bp, R. norvegicus
ccaaccaggcagcaga

SEQ ID NO: 490471 - DNA, 16 bp, R. norvegicus
ccaaccaggggccttg

SEQ ID NO: 490472 - DNA, 16 bp, R. norvegicus
ccaaccattggactga

SEQ ID NO: 490473 - DNA, 16 bp, R. norvegicus
ccaaccattggcctga

SEQ ID NO: 490474 - DNA, 16 bp, R. norvegicus
ccaacccagactacta

SEQ ID NO: 490475 - DNA, 16 bp, R. norvegicus
ccaaccccaaaatgcc

SEQ ID NO: 490476 - DNA, 16 bp, R. norvegicus
ccaacctcctccagga

SEQ ID NO: 490477 - DNA, 30 bp, R. norvegicus
ccaacctctcactacgttcggtttctgaca

SEQ ID NO: 490478 - DNA, 16 bp, R. norvegicus
ccaacctgggctacct

SEQ ID NO: 490479 - DNA, 16 bp, R. norvegicus
ccaactacaaaattat

SEQ ID NO: 490480 - DNA, 16 bp, R. norvegicus
ccaactataccactct

SEQ ID NO: 490481 - DNA, 16 bp, R. norvegicus
ccaactccagcaggca

SEQ ID NO: 490482 - DNA, 16 bp, R. norvegicus
ccaactgcacaggatg

SEQ ID NO: 490483 - DNA, 16 bp, R. norvegicus
ccaactgcatatgtaa

SEQ ID NO: 490484 - DNA, 16 bp, R. norvegicus
ccaactgggatgacat

SEQ ID NO: 490485 - DNA, 16 bp, R. norvegicus
ccaactgttggactga

SEQ ID NO: 490486 - DNA, 16 bp, R. norvegicus
ccaacttgagacccat

SEQ ID NO: 490487 - DNA, 16 bp, R. norvegicus
ccaacttggtctacaa

SEQ ID NO: 490488 - DNA, 16 bp, R. norvegicus
ccaactttctgaagaa

SEQ ID NO: 490489 - DNA, 16 bp, R. norvegicus
ccaagaaacatataaa

SEQ ID NO: 490490 - DNA, 16 bp, R. norvegicus
ccaagaaaccaggaaa

SEQ ID NO: 490491 - DNA, 16 bp, R. norvegicus
ccaagaaagtgaaaga

SEQ ID NO: 490492 - DNA, 16 bp, R. norvegicus
ccaagaacaaattaaa

SEQ ID NO: 490493 - DNA, 16 bp, R. norvegicus
ccaagaaccagaaact

SEQ ID NO: 490494 - DNA, 16 bp, R. norvegicus
ccaagaagaaactgca

SEQ ID NO: 490495 - DNA, 16 bp, R. norvegicus
ccaagaaggagcccat

SEQ ID NO: 490496 - DNA, 16 bp, R. norvegicus
ccaagaaggccagaag

SEQ ID NO: 490497 - DNA, 16 bp, R. norvegicus
ccaagaagggctgcct

SEQ ID NO: 490498 - DNA, 16 bp, R. norvegicus
ccaagaagtacttgct

SEQ ID NO: 490499 - DNA, 16 bp, R. norvegicus
ccaagaagtgcttgca

SEQ ID NO: 490500 - DNA, 16 bp, R. norvegicus
ccaagaattgttcctg

SEQ ID NO: 490501 - DNA, 16 bp, R. norvegicus
ccaagacaaccagagc

SEQ ID NO: 490502 - DNA, 16 bp, R. norvegicus
ccaagacacagtttct

SEQ ID NO: 490503 - DNA, 16 bp, R. norvegicus
ccaagacctccctgga

SEQ ID NO: 490504 - DNA, 16 bp, R. norvegicus
ccaagacctgacatca

SEQ ID NO: 490505 - DNA, 16 bp, R. norvegicus
ccaagacctgctgagg

SEQ ID NO: 490506 - DNA, 16 bp, R. norvegicus
ccaagactgacaggcc

SEQ ID NO: 490507 - DNA, 16 bp, R. norvegicus
ccaagagaatgcaaga

SEQ ID NO: 490508 - DNA, 16 bp, R. norvegicus
ccaagagagctgtgag

SEQ ID NO: 490509 - DNA, 18 bp, R. norvegicus
ccaagagaggtatagatg

SEQ ID NO: 490510 - DNA, 16 bp, R. norvegicus
ccaagagatccaagat

SEQ ID NO: 490511 - DNA, 16 bp, R. norvegicus
ccaagagcacgtcaaa

SEQ ID NO: 490512 - DNA, 16 bp, R. norvegicus
ccaagagcagcagcag

SEQ ID NO: 490513 - DNA, 16 bp, R. norvegicus
ccaagagcagcttccc

SEQ ID NO: 490514 - DNA, 16 bp, R. norvegicus
ccaagagctcccagag

SEQ ID NO: 490515 - DNA, 16 bp, R. norvegicus
ccaagaggaaaatgta

SEQ ID NO: 490516 - DNA, 16 bp, R. norvegicus
ccaagaggaaactgga

SEQ ID NO: 490517 - DNA, 16 bp, R. norvegicus
ccaagaggaaatcacc

SEQ ID NO: 490518 - DNA, 16 bp, R. norvegicus
ccaagaggaaattgcc

SEQ ID NO: 490519 - DNA, 16 bp, R. norvegicus
ccaagaggaacccaca

SEQ ID NO: 490520 - DNA, 16 bp, R. norvegicus
ccaagaggctctccag

SEQ ID NO: 490521 - DNA, 16 bp, R. norvegicus
ccaagatcaccagccc

SEQ ID NO: 490522 - DNA, 16 bp, R. norvegicus
ccaagatccatgactt

SEQ ID NO: 490523 - DNA, 16 bp, R. norvegicus
ccaagatctctcagat

SEQ ID NO: 490524 - DNA, 16 bp, R. norvegicus
ccaagatctgacacta

SEQ ID NO: 490525 - DNA, 16 bp, R. norvegicus
ccaagatggaggagga

SEQ ID NO: 490526 - DNA, 16 bp, R. norvegicus
ccaagattcatgactt

SEQ ID NO: 490527 - DNA, 16 bp, R. norvegicus
ccaagcaacagaaacg

SEQ ID NO: 490528 - DNA, 16 bp, R. norvegicus
ccaagcacaaggccct

SEQ ID NO: 490529 - DNA, 16 bp, R. norvegicus
ccaagcactgggacta

SEQ ID NO: 490530 - DNA, 16 bp, R. norvegicus
ccaagcagaagattga

SEQ ID NO: 490531 - DNA, 16 bp, R. norvegicus
ccaagcaggtctcagt

SEQ ID NO: 490532 - DNA, 16 bp, R. norvegicus
ccaagcatggtggctc

SEQ ID NO: 490533 - DNA, 16 bp, R. norvegicus
ccaagccagatgacct

SEQ ID NO: 490534 - DNA, 16 bp, R. norvegicus
ccaagccagtgtcctg

SEQ ID NO: 490535 - DNA, 16 bp, R. norvegicus
ccaagcccagatccag

SEQ ID NO: 490536 - DNA, 16 bp, R. norvegicus
ccaagcccattgtggg

SEQ ID NO: 490537 - DNA, 16 bp, R. norvegicus
ccaagcctcagctgct

SEQ ID NO: 490538 - DNA, 16 bp, R. norvegicus
ccaagcctgaagacct

SEQ ID NO: 490539 - DNA, 16 bp, R. norvegicus
ccaagcctgacaacct

SEQ ID NO: 490540 - DNA, 16 bp, R. norvegicus
ccaagcctgagtttga

SEQ ID NO: 490541 - DNA, 16 bp, R. norvegicus
ccaagctcaaaggacc

SEQ ID NO: 490542 - DNA, 16 bp, R. norvegicus
ccaagctcccacagaa

SEQ ID NO: 490543 - DNA, 16 bp, R. norvegicus
ccaagctcctacagaa

SEQ ID NO: 490544 - DNA, 16 bp, R. norvegicus
ccaagctgacttcaaa

SEQ ID NO: 490545 - DNA, 16 bp, R. norvegicus
ccaagctgaggctggt

SEQ ID NO: 490546 - DNA, 16 bp, R. norvegicus
ccaagctggcctcaga

SEQ ID NO: 490547 - DNA, 16 bp, R. norvegicus
ccaagctggcttcaaa

SEQ ID NO: 490548 - DNA, 16 bp, R. norvegicus
ccaagcttgatgactt

SEQ ID NO: 490549 - DNA, 16 bp, R. norvegicus
ccaaggaagccagagg

SEQ ID NO: 490550 - DNA, 16 bp, R. norvegicus
ccaaggacaacagcaa

SEQ ID NO: 490551 - DNA, 16 bp, R. norvegicus
ccaaggacactgtggt

SEQ ID NO: 490552 - DNA, 16 bp, R. norvegicus
ccaaggacagctgctt

SEQ ID NO: 490553 - DNA, 16 bp, R. norvegicus
ccaaggacgaccttga

SEQ ID NO: 490554 - DNA, 16 bp, R. norvegicus
ccaaggacttcccttt

SEQ ID NO: 490555 - DNA, 16 bp, R. norvegicus
ccaaggagatggctca

SEQ ID NO: 490556 - DNA, 16 bp, R. norvegicus
ccaaggagcagcagga

SEQ ID NO: 490557 - DNA, 16 bp, R. norvegicus
ccaaggatgaccatga

SEQ ID NO: 490558 - DNA, 16 bp, R. norvegicus
ccaaggatgcagagat

SEQ ID NO: 490559 - DNA, 16 bp, R. norvegicus
ccaaggatggctttga

SEQ ID NO: 490560 - DNA, 16 bp, R. norvegicus
ccaaggcaggttgtca

SEQ ID NO: 490561 - DNA, 16 bp, R. norvegicus
ccaaggccaccagtca

SEQ ID NO: 490562 - DNA, 16 bp, R. norvegicus
ccaaggccatgctgga

SEQ ID NO: 490563 - DNA, 16 bp, R. norvegicus
ccaaggcctctgcatc

SEQ ID NO: 490564 - DNA, 16 bp, R. norvegicus
ccaaggcctggttgct

SEQ ID NO: 490565 - DNA, 16 bp, R. norvegicus
ccaaggctgaaccccc

SEQ ID NO: 490566 - DNA, 16 bp, R. norvegicus
ccaaggctgaccttga

SEQ ID NO: 490567 - DNA, 16 bp, R. norvegicus
ccaaggctggcctcaa

SEQ ID NO: 490568 - DNA, 16 bp, R. norvegicus
ccaaggcttctctccc

SEQ ID NO: 490569 - DNA, 16 bp, R. norvegicus
ccaagggagacaggag

SEQ ID NO: 490570 - DNA, 16 bp, R. norvegicus
ccaagggccagcagaa

SEQ ID NO: 490571 - DNA, 16 bp, R. norvegicus
ccaagggctcctcctc

SEQ ID NO: 490572 - DNA, 16 bp, R. norvegicus
ccaagggctgtgcaga

SEQ ID NO: 490573 - DNA, 16 bp, R. norvegicus
ccaagggcttcctctt

SEQ ID NO: 490574 - DNA, 16 bp, R. norvegicus
ccaagggtgtaaacaa

SEQ ID NO: 490575 - DNA, 16 bp, R. norvegicus
ccaaggtcaatgcctt

SEQ ID NO: 490576 - DNA, 16 bp, R. norvegicus
ccaaggtccattccct

SEQ ID NO: 490577 - DNA, 16 bp, R. norvegicus
ccaaggttgaccttga

SEQ ID NO: 490578 - DNA, 16 bp, R. norvegicus
ccaaggttggaccccc

SEQ ID NO: 490579 - DNA, 18 bp, R. norvegicus
ccaagtaaaagatctgta

SEQ ID NO: 490580 - DNA, 16 bp, R. norvegicus
ccaagtaaatgaaaga

SEQ ID NO: 490581 - DNA, 16 bp, R. norvegicus
ccaagtaagtaaaaga

SEQ ID NO: 490582 - DNA, 16 bp, R. norvegicus
ccaagtagcccaggct

SEQ ID NO: 490583 - DNA, 43 bp, R. norvegicus
ccaagtaggcttcatcccaggcatgcagggatggtttaatata

SEQ ID NO: 490584 - DNA, 16 bp, R. norvegicus
ccaagtctccagcttc

SEQ ID NO: 490585 - DNA, 16 bp, R. norvegicus
ccaagtctgatgactt

SEQ ID NO: 490586 - DNA, 16 bp, R. norvegicus
ccaagtcttttttttt

SEQ ID NO: 490587 - DNA, 16 bp, R. norvegicus
ccaagtgacctgccag

SEQ ID NO: 490588 - DNA, 16 bp, R. norvegicus
ccaagtgcctctcttc

SEQ ID NO: 490589 - DNA, 16 bp, R. norvegicus
ccaagtgctgggaatt

SEQ ID NO: 490590 - DNA, 16 bp, R. norvegicus
ccaagtggaacaagga

SEQ ID NO: 490591 - DNA, 16 bp, R. norvegicus
ccaagtgggactgagg

SEQ ID NO: 490592 - DNA, 16 bp, R. norvegicus
ccaagtggtcatccct

SEQ ID NO: 490593 - DNA, 16 bp, R. norvegicus
ccaagttatccctgat

SEQ ID NO: 490594 - DNA, 16 bp, R. norvegicus
ccaagttccatccact

SEQ ID NO: 490595 - DNA, 16 bp, R. norvegicus
ccaagttccatccatt

SEQ ID NO: 490596 - DNA, 16 bp, R. norvegicus
ccaagttcctcccacc

SEQ ID NO: 490597 - DNA, 16 bp, R. norvegicus
ccaagttcctgaggaa

SEQ ID NO: 490598 - DNA, 16 bp, R. norvegicus
ccaagttctgctgttt

SEQ ID NO: 490599 - DNA, 16 bp, R. norvegicus
ccaagttgctttggtt

SEQ ID NO: 490600 - DNA, 16 bp, R. norvegicus
ccaagttgcttttggt

SEQ ID NO: 490601 - DNA, 16 bp, R. norvegicus
ccaataaaaatgtaaa

SEQ ID NO: 490602 - DNA, 16 bp, R. norvegicus
ccaataaaattcttgc

SEQ ID NO: 490603 - DNA, 16 bp, R. norvegicus
ccaataagaagaacaa

SEQ ID NO: 490604 - DNA, 16 bp, R. norvegicus
ccaatatatatcagag

SEQ ID NO: 490605 - DNA, 16 bp, R. norvegicus
ccaatcaagggaaaga

SEQ ID NO: 490606 - DNA, 16 bp, R. norvegicus
ccaatcacagaagaac

SEQ ID NO: 490607 - DNA, 16 bp, R. norvegicus
ccaatcagaaagcagt

SEQ ID NO: 490608 - DNA, 16 bp, R. norvegicus
ccaatgacagtgtcct

SEQ ID NO: 490609 - DNA, 16 bp, R. norvegicus
ccaatgatgagagtgg

SEQ ID NO: 490610 - DNA, 16 bp, R. norvegicus
ccaatgcagaggggag

SEQ ID NO: 490611 - DNA, 16 bp, R. norvegicus
ccaatggaacaggatt

SEQ ID NO: 490612 - DNA, 16 bp, R. norvegicus
ccaatggacaagtcat

SEQ ID NO: 490613 - DNA, 16 bp, R. norvegicus
ccaatggacaggtcac

SEQ ID NO: 490614 - DNA, 16 bp, R. norvegicus
ccaatggctggctgtg

SEQ ID NO: 490615 - DNA, 16 bp, R. norvegicus
ccaatggcttctcctt

SEQ ID NO: 490616 - DNA, 17 bp, R. norvegicus
ccaatggtatggaagtg

SEQ ID NO: 490617 - DNA, 16 bp, R. norvegicus
ccaatggttgactgta

SEQ ID NO: 490618 - DNA, 16 bp, R. norvegicus
ccaattcattctataa

SEQ ID NO: 490619 - DNA, 16 bp, R. norvegicus
ccaattcccaaaatta

SEQ ID NO: 490620 - DNA, 16 bp, R. norvegicus
ccaatttcctgtatga

SEQ ID NO: 490621 - DNA, 16 bp, R. norvegicus
ccaatttctgaggaac

SEQ ID NO: 490622 - DNA, 16 bp, R. norvegicus
ccaatttcttttatga

SEQ ID NO: 490623 - DNA, 16 bp, R. norvegicus
ccaatttgtatccctc

SEQ ID NO: 490624 - DNA, 16 bp, R. norvegicus
ccaattttcccaccaa

SEQ ID NO: 490625 - DNA, 16 bp, R. norvegicus
ccaattttctgagaaa

SEQ ID NO: 490626 - DNA, 20 bp, R. norvegicus
ccaatttttctggctcttca

SEQ ID NO: 490627 - DNA, 16 bp, R. norvegicus
ccaattttttgaagaa

SEQ ID NO: 490628 - DNA, 16 bp, R. norvegicus
ccacaaaatcttcaac

SEQ ID NO: 490629 - DNA, 16 bp, R. norvegicus
ccacaaaattagaaaa

SEQ ID NO: 490630 - DNA, 16 bp, R. norvegicus
ccacaaaccaggcagc

SEQ ID NO: 490631 - DNA, 16 bp, R. norvegicus
ccacaaactgaaggca

SEQ ID NO: 490632 - DNA, 16 bp, R. norvegicus
ccacaaatttgaaaga

SEQ ID NO: 490633 - DNA, 16 bp, R. norvegicus
ccacaacagaaaaatg

SEQ ID NO: 490634 - DNA, 16 bp, R. norvegicus
ccacaagaaagtccca

SEQ ID NO: 490635 - DNA, 16 bp, R. norvegicus
ccacaagagggcactg

SEQ ID NO: 490636 - DNA, 16 bp, R. norvegicus
ccacaaggctctgcca

SEQ ID NO: 490637 - DNA, 18 bp, R. norvegicus
ccacaagtacaggccaga

SEQ ID NO: 490638 - DNA, 16 bp, R. norvegicus
ccacaagttcaagacc

SEQ ID NO: 490639 - DNA, 16 bp, R. norvegicus
ccacaagttcaaggcc

SEQ ID NO: 490640 - DNA, 16 bp, R. norvegicus
ccacaatgtggatgct

SEQ ID NO: 490641 - DNA, 16 bp, R. norvegicus
ccacacacagctcaca

SEQ ID NO: 490642 - DNA, 16 bp, R. norvegicus
ccacacacatatgcac

SEQ ID NO: 490643 - DNA, 16 bp, R. norvegicus
ccacacacctgcagcc

SEQ ID NO: 490644 - DNA, 16 bp, R. norvegicus
ccacacagtctccagc

SEQ ID NO: 490645 - DNA, 16 bp, R. norvegicus
ccacacagttttttat

SEQ ID NO: 490646 - DNA, 16 bp, R. norvegicus
ccacaccaggttcctg

SEQ ID NO: 490647 - DNA, 16 bp, R. norvegicus
ccacacccagcttccc

SEQ ID NO: 490648 - DNA, 16 bp, R. norvegicus
ccacacctactccagc

SEQ ID NO: 490649 - DNA, 16 bp, R. norvegicus
ccacacctgctcccca

SEQ ID NO: 490650 - DNA, 16 bp, R. norvegicus
ccacaccttctgatgg

SEQ ID NO: 490651 - DNA, 16 bp, R. norvegicus
ccacacggaggctcac

SEQ ID NO: 490652 - DNA, 16 bp, R. norvegicus
ccacacgggtgctggg

SEQ ID NO: 490653 - DNA, 16 bp, R. norvegicus
ccacactcatgtacac

SEQ ID NO: 490654 - DNA, 16 bp, R. norvegicus
ccacactccagggcag

SEQ ID NO: 490655 - DNA, 16 bp, R. norvegicus
ccacacttgatcttag

SEQ ID NO: 490656 - DNA, 16 bp, R. norvegicus
ccacactttgtttcca

SEQ ID NO: 490657 - DNA, 16 bp, R. norvegicus
ccacagaaaaagccag

SEQ ID NO: 490658 - DNA, 16 bp, R. norvegicus
ccacagaactcaaaag

SEQ ID NO: 490659 - DNA, 16 bp, R. norvegicus
ccacagaattgaaaca

SEQ ID NO: 490660 - DNA, 16 bp, R. norvegicus
ccacagacacacagac

SEQ ID NO: 490661 - DNA, 16 bp, R. norvegicus
ccacagaccacaggaa

SEQ ID NO: 490662 - DNA, 16 bp, R. norvegicus
ccacagacccagacat

SEQ ID NO: 490663 - DNA, 16 bp, R. norvegicus
ccacagaccctggaca

SEQ ID NO: 490664 - DNA, 16 bp, R. norvegicus
ccacagagccacagag

SEQ ID NO: 490665 - DNA, 16 bp, R. norvegicus
ccacagagccatttct

SEQ ID NO: 490666 - DNA, 16 bp, R. norvegicus
ccacagagcctgcagt

SEQ ID NO: 490667 - DNA, 16 bp, R. norvegicus
ccacagagctggagtt

SEQ ID NO: 490668 - DNA, 16 bp, R. norvegicus
ccacagaggccagcag

SEQ ID NO: 490669 - DNA, 16 bp, R. norvegicus
ccacagagtaaaaggc

SEQ ID NO: 490670 - DNA, 16 bp, R. norvegicus
ccacagagtggaagga

SEQ ID NO: 490671 - DNA, 16 bp, R. norvegicus
ccacagatacaaaatt

SEQ ID NO: 490672 - DNA, 16 bp, R. norvegicus
ccacagatgttcaacc

SEQ ID NO: 490673 - DNA, 16 bp, R. norvegicus
ccacagcacaccacag

SEQ ID NO: 490674 - DNA, 16 bp, R. norvegicus
ccacagcagccatcaa

SEQ ID NO: 490675 - DNA, 17 bp, R. norvegicus
ccacagcagctctctgc

SEQ ID NO: 490676 - DNA, 16 bp, R. norvegicus
ccacagcaggccctga

SEQ ID NO: 490677 - DNA, 16 bp, R. norvegicus
ccacagcatgagggac

SEQ ID NO: 490678 - DNA, 16 bp, R. norvegicus
ccacagccaaacagca

SEQ ID NO: 490679 - DNA, 16 bp, R. norvegicus
ccacagccacagccat

SEQ ID NO: 490680 - DNA, 16 bp, R. norvegicus
ccacagccacagcctc

SEQ ID NO: 490681 - DNA, 16 bp, R. norvegicus
ccacagccacagtcac

SEQ ID NO: 490682 - DNA, 16 bp, R. norvegicus
ccacagccctggccca

SEQ ID NO: 490683 - DNA, 16 bp, R. norvegicus
ccacagctggcctgga

SEQ ID NO: 490684 - DNA, 16 bp, R. norvegicus
ccacagcttctctcct

SEQ ID NO: 490685 - DNA, 16 bp, R. norvegicus
ccacaggaagacctac

SEQ ID NO: 490686 - DNA, 16 bp, R. norvegicus
ccacaggaagagctga

SEQ ID NO: 490687 - DNA, 16 bp, R. norvegicus
ccacaggaagctcagg

SEQ ID NO: 490688 - DNA, 16 bp, R. norvegicus
ccacaggatggtttta

SEQ ID NO: 490689 - DNA, 16 bp, R. norvegicus
ccacaggcactgcatg

SEQ ID NO: 490690 - DNA, 16 bp, R. norvegicus
ccacaggcagcaagga

SEQ ID NO: 490691 - DNA, 16 bp, R. norvegicus
ccacaggcagccagga

SEQ ID NO: 490692 - DNA, 16 bp, R. norvegicus
ccacaggctctctgtg

SEQ ID NO: 490693 - DNA, 16 bp, R. norvegicus
ccacagggacctggga

SEQ ID NO: 490694 - DNA, 16 bp, R. norvegicus
ccacagggagaaaaat

SEQ ID NO: 490695 - DNA, 16 bp, R. norvegicus
ccacagggtagaagga

SEQ ID NO: 490696 - DNA, 16 bp, R. norvegicus
ccacaggtcagaccaa

SEQ ID NO: 490697 - DNA, 16 bp, R. norvegicus
ccacagtcacagtcac

SEQ ID NO: 490698 - DNA, 16 bp, R. norvegicus
ccacagtccatggaag

SEQ ID NO: 490699 - DNA, 16 bp, R. norvegicus
ccacagtctctgcttc

SEQ ID NO: 490700 - DNA, 16 bp, R. norvegicus
ccacagtgacacacct

SEQ ID NO: 490701 - DNA, 16 bp, R. norvegicus
ccacagtgacactcct

SEQ ID NO: 490702 - DNA, 16 bp, R. norvegicus
ccacagtgacatattt

SEQ ID NO: 490703 - DNA, 16 bp, R. norvegicus
ccacagtgcccatgtg

SEQ ID NO: 490704 - DNA, 16 bp, R. norvegicus
ccacagtggagaggac

SEQ ID NO: 490705 - DNA, 16 bp, R. norvegicus
ccacagtggccagaag

SEQ ID NO: 490706 - DNA, 16 bp, R. norvegicus
ccacagttacctggca

SEQ ID NO: 490707 - DNA, 16 bp, R. norvegicus
ccacagtttctcatcc

SEQ ID NO: 490708 - DNA, 16 bp, R. norvegicus
ccacatcaaaccagaa

SEQ ID NO: 490709 - DNA, 16 bp, R. norvegicus
ccacatccacaccagc

SEQ ID NO: 490710 - DNA, 16 bp, R. norvegicus
ccacatcctcaacagc

SEQ ID NO: 490711 - DNA, 16 bp, R. norvegicus
ccacatcctggccagc

SEQ ID NO: 490712 - DNA, 16 bp, R. norvegicus
ccacatctcctaacag

SEQ ID NO: 490713 - DNA, 16 bp, R. norvegicus
ccacatcttcaccaac

SEQ ID NO: 490714 - DNA, 16 bp, R. norvegicus
ccacatctttgccaac

SEQ ID NO: 490715 - DNA, 16 bp, R. norvegicus
ccacatgaagatcaag

SEQ ID NO: 490716 - DNA, 16 bp, R. norvegicus
ccacatgaagcacaag

SEQ ID NO: 490717 - DNA, 16 bp, R. norvegicus
ccacatgaaggccaag

SEQ ID NO: 490718 - DNA, 16 bp, R. norvegicus
ccacatgacgctcaag

SEQ ID NO: 490719 - DNA, 16 bp, R. norvegicus
ccacatgcagctcaca

SEQ ID NO: 490720 - DNA, 16 bp, R. norvegicus
ccacatggaggaagga

SEQ ID NO: 490721 - DNA, 16 bp, R. norvegicus
ccacatggcagaagga

SEQ ID NO: 490722 - DNA, 16 bp, R. norvegicus
ccacatggccactcac

SEQ ID NO: 490723 - DNA, 16 bp, R. norvegicus
ccacatggtggaagga

SEQ ID NO: 490724 - DNA, 16 bp, R. norvegicus
ccacatggtggctcaa

SEQ ID NO: 490725 - DNA, 16 bp, R. norvegicus
ccacatggtggctcat

SEQ ID NO: 490726 - DNA, 16 bp, R. norvegicus
ccacattcacacacac

SEQ ID NO: 490727 - DNA, 16 bp, R. norvegicus
ccacattcctctttct

SEQ ID NO: 490728 - DNA, 16 bp, R. norvegicus
ccacattgcagctcac

SEQ ID NO: 490729 - DNA, 16 bp, R. norvegicus
ccacattttcttcatt

SEQ ID NO: 490730 - DNA, 16 bp, R. norvegicus
ccaccaacaatgtagg

SEQ ID NO: 490731 - DNA, 16 bp, R. norvegicus
ccaccaaccaaagagg

SEQ ID NO: 490732 - DNA, 16 bp, R. norvegicus
ccaccaaccaagcagc

SEQ ID NO: 490733 - DNA, 16 bp, R. norvegicus
ccaccaaccagggagc

SEQ ID NO: 490734 - DNA, 16 bp, R. norvegicus
ccaccaactctgctca

SEQ ID NO: 490735 - DNA, 16 bp, R. norvegicus
ccaccaagaaagaagc

SEQ ID NO: 490736 - DNA, 16 bp, R. norvegicus
ccaccaagaacagcag

SEQ ID NO: 490737 - DNA, 16 bp, R. norvegicus
ccaccaaggccatcct

SEQ ID NO: 490738 - DNA, 16 bp, R. norvegicus
ccaccaatccagccct

SEQ ID NO: 490739 - DNA, 16 bp, R. norvegicus
ccaccaatgcagaggg

SEQ ID NO: 490740 - DNA, 16 bp, R. norvegicus
ccaccaatgggaggag

SEQ ID NO: 490741 - DNA, 16 bp, R. norvegicus
ccaccacacccagtgt

SEQ ID NO: 490742 - DNA, 16 bp, R. norvegicus
ccaccacagccatcac

SEQ ID NO: 490743 - DNA, 16 bp, R. norvegicus
ccaccacagctgagag

SEQ ID NO: 490744 - DNA, 16 bp, R. norvegicus
ccaccacagctgctgc

SEQ ID NO: 490745 - DNA, 16 bp, R. norvegicus
ccaccacagggctcag

SEQ ID NO: 490746 - DNA, 16 bp, R. norvegicus
ccaccacatctggctt

SEQ ID NO: 490747 - DNA, 16 bp, R. norvegicus
ccaccaccaagcctgc

SEQ ID NO: 490748 - DNA, 16 bp, R. norvegicus
ccaccaccaccacagt

SEQ ID NO: 490749 - DNA, 16 bp, R. norvegicus
ccaccaccacccagct

SEQ ID NO: 490750 - DNA, 16 bp, R. norvegicus
ccaccaccacccaggg

SEQ ID NO: 490751 - DNA, 16 bp, R. norvegicus
ccaccaccaccctgct

SEQ ID NO: 490752 - DNA, 16 bp, R. norvegicus
ccaccaccacctgcct

SEQ ID NO: 490753 - DNA, 16 bp, R. norvegicus
ccaccacctctggctc

SEQ ID NO: 490754 - DNA, 16 bp, R. norvegicus
ccaccacctggcctga

SEQ ID NO: 490755 - DNA, 16 bp, R. norvegicus
ccaccactcctggttt

SEQ ID NO: 490756 - DNA, 16 bp, R. norvegicus
ccaccactgccaggct

SEQ ID NO: 490757 - DNA, 16 bp, R. norvegicus
ccaccactgccctgct

SEQ ID NO: 490758 - DNA, 16 bp, R. norvegicus
ccaccactgcctgcct

SEQ ID NO: 490759 - DNA, 16 bp, R. norvegicus
ccaccactgcctggcc

SEQ ID NO: 490760 - DNA, 16 bp, R. norvegicus
ccaccactgctgccac

SEQ ID NO: 490761 - DNA, 16 bp, R. norvegicus
ccaccactttactaaa

SEQ ID NO: 490762 - DNA, 17 bp, R. norvegicus
ccaccagaacctgaagg

SEQ ID NO: 490763 - DNA, 16 bp, R. norvegicus
ccaccagcagcagcaa

SEQ ID NO: 490764 - DNA, 16 bp, R. norvegicus
ccaccagccaaagagt

SEQ ID NO: 490765 - DNA, 16 bp, R. norvegicus
ccaccagccaggcagc

SEQ ID NO: 490766 - DNA, 16 bp, R. norvegicus
ccaccagcccagggac

SEQ ID NO: 490767 - DNA, 16 bp, R. norvegicus
ccaccagcccagggat

SEQ ID NO: 490768 - DNA, 16 bp, R. norvegicus
ccaccaggccagggat

SEQ ID NO: 490769 - DNA, 16 bp, R. norvegicus
ccaccaggcccagctg

SEQ ID NO: 490770 - DNA, 16 bp, R. norvegicus
ccaccagggggcagca

SEQ ID NO: 490771 - DNA, 16 bp, R. norvegicus
ccaccatacctggctt

SEQ ID NO: 490772 - DNA, 16 bp, R. norvegicus
ccaccatcaaggactt

SEQ ID NO: 490773 - DNA, 16 bp, R. norvegicus
ccaccatcatcatcag

SEQ ID NO: 490774 - DNA, 16 bp, R. norvegicus
ccaccatcatcatctt

SEQ ID NO: 490775 - DNA, 16 bp, R. norvegicus
ccaccatgaagataat

SEQ ID NO: 490776 - DNA, 16 bp, R. norvegicus
ccaccatgatgttctg

SEQ ID NO: 490777 - DNA, 16 bp, R. norvegicus
ccaccatgcccagcaa

SEQ ID NO: 490778 - DNA, 16 bp, R. norvegicus
ccaccatgcccagcat

SEQ ID NO: 490779 - DNA, 16 bp, R. norvegicus
ccaccatgcccagcca

SEQ ID NO: 490780 - DNA, 16 bp, R. norvegicus
ccaccatgcctagctg

SEQ ID NO: 490781 - DNA, 16 bp, R. norvegicus
ccaccatgcctgatga

SEQ ID NO: 490782 - DNA, 16 bp, R. norvegicus
ccaccatgccttccca

SEQ ID NO: 490783 - DNA, 16 bp, R. norvegicus
ccaccatgccttcccc

SEQ ID NO: 490784 - DNA, 16 bp, R. norvegicus
ccaccatgtagatgct

SEQ ID NO: 490785 - DNA, 16 bp, R. norvegicus
ccaccatgtcacaggg

SEQ ID NO: 490786 - DNA, 16 bp, R. norvegicus
ccacccaaccagacct

SEQ ID NO: 490787 - DNA, 16 bp, R. norvegicus
ccacccacagggacag

SEQ ID NO: 490788 - DNA, 16 bp, R. norvegicus
ccacccacagtgagct

SEQ ID NO: 490789 - DNA, 16 bp, R. norvegicus
ccacccacagtggaca

SEQ ID NO: 490790 - DNA, 16 bp, R. norvegicus
ccacccacagtgggtg

SEQ ID NO: 490791 - DNA, 16 bp, R. norvegicus
ccacccacagtgggtt

SEQ ID NO: 490792 - DNA, 16 bp, R. norvegicus
ccacccaccctgctga

SEQ ID NO: 490793 - DNA, 16 bp, R. norvegicus
ccacccactccaccag

SEQ ID NO: 490794 - DNA, 16 bp, R. norvegicus
ccacccactgtgggct

SEQ ID NO: 490795 - DNA, 16 bp, R. norvegicus
ccacccagatctgaag

SEQ ID NO: 490796 - DNA, 16 bp, R. norvegicus
ccacccagcagctgat

SEQ ID NO: 490797 - DNA, 16 bp, R. norvegicus
ccacccagcttccctt

SEQ ID NO: 490798 - DNA, 16 bp, R. norvegicus
ccacccagttctccca

SEQ ID NO: 490799 - DNA, 16 bp, R. norvegicus
ccacccataaaacctt

SEQ ID NO: 490800 - DNA, 16 bp, R. norvegicus
ccacccatttgcctgc

SEQ ID NO: 490801 - DNA, 16 bp, R. norvegicus
ccaccccaaaactgta

SEQ ID NO: 490802 - DNA, 16 bp, R. norvegicus
ccacccccggagctga

SEQ ID NO: 490803 - DNA, 16 bp, R. norvegicus
ccacccctaggctggt

SEQ ID NO: 490804 - DNA, 16 bp, R. norvegicus
ccaccccttcttctat

SEQ ID NO: 490805 - DNA, 16 bp, R. norvegicus
ccacccgcctctgcct

SEQ ID NO: 490806 - DNA, 16 bp, R. norvegicus
ccacccgtcacataat

SEQ ID NO: 490807 - DNA, 16 bp, R. norvegicus
ccaccctaccagcatc

SEQ ID NO: 490808 - DNA, 16 bp, R. norvegicus
ccaccctagagaagaa

SEQ ID NO: 490809 - DNA, 18 bp, R. norvegicus
ccaccctcaactaaaaca

SEQ ID NO: 490810 - DNA, 16 bp, R. norvegicus
ccaccctgagctacat

SEQ ID NO: 490811 - DNA, 16 bp, R. norvegicus
ccaccctgtctcctcc

SEQ ID NO: 490812 - DNA, 16 bp, R. norvegicus
ccacccttcagcctct

SEQ ID NO: 490813 - DNA, 16 bp, R. norvegicus
ccacccttgcaacctc

SEQ ID NO: 490814 - DNA, 16 bp, R. norvegicus
ccacctacaatgggct

SEQ ID NO: 490815 - DNA, 16 bp, R. norvegicus
ccacctatctctgcct

SEQ ID NO: 490816 - DNA, 16 bp, R. norvegicus
ccacctcaacaccctg

SEQ ID NO: 490817 - DNA, 16 bp, R. norvegicus
ccacctcaacactctg

SEQ ID NO: 490818 - DNA, 16 bp, R. norvegicus
ccacctcattgctgat

SEQ ID NO: 490819 - DNA, 16 bp, R. norvegicus
ccacctccaggttcct

SEQ ID NO: 490820 - DNA, 16 bp, R. norvegicus
ccacctcccaccctga

SEQ ID NO: 490821 - DNA, 16 bp, R. norvegicus
ccacctcccagccctg

SEQ ID NO: 490822 - DNA, 16 bp, R. norvegicus
ccacctcccaggtgct

SEQ ID NO: 490823 - DNA, 16 bp, R. norvegicus
ccacctccctgccctg

SEQ ID NO: 490824 - DNA, 16 bp, R. norvegicus
ccacctctccagacct

SEQ ID NO: 490825 - DNA, 16 bp, R. norvegicus
ccacctctccagcatc

SEQ ID NO: 490826 - DNA, 16 bp, R. norvegicus
ccacctctccagtccc

SEQ ID NO: 490827 - DNA, 16 bp, R. norvegicus
ccacctctctagctcc

SEQ ID NO: 490828 - DNA, 16 bp, R. norvegicus
ccacctctctgcttcc

SEQ ID NO: 490829 - DNA, 16 bp, R. norvegicus
ccacctcttcagccct

SEQ ID NO: 490830 - DNA, 16 bp, R. norvegicus
ccacctcttcctgcct

SEQ ID NO: 490831 - DNA, 16 bp, R. norvegicus
ccacctgagaatccat

SEQ ID NO: 490832 - DNA, 16 bp, R. norvegicus
ccacctgatcccagct

SEQ ID NO: 490833 - DNA, 16 bp, R. norvegicus
ccacctgccacctgcc

SEQ ID NO: 490834 - DNA, 16 bp, R. norvegicus
ccacctgcctatgcct

SEQ ID NO: 490835 - DNA, 16 bp, R. norvegicus
ccacctgcctctgctc

SEQ ID NO: 490836 - DNA, 16 bp, R. norvegicus
ccacctgcctctgtcc

SEQ ID NO: 490837 - DNA, 16 bp, R. norvegicus
ccacctgcctgtctcc

SEQ ID NO: 490838 - DNA, 16 bp, R. norvegicus
ccacctgctaccccag

SEQ ID NO: 490839 - DNA, 16 bp, R. norvegicus
ccacctgctggctgct

SEQ ID NO: 490840 - DNA, 16 bp, R. norvegicus
ccacctggaactccag

SEQ ID NO: 490841 - DNA, 16 bp, R. norvegicus
ccacctggggatccaa

SEQ ID NO: 490842 - DNA, 16 bp, R. norvegicus
ccacctgtctctgcct

SEQ ID NO: 490843 - DNA, 16 bp, R. norvegicus
ccaccttcaaaatttt

SEQ ID NO: 490844 - DNA, 16 bp, R. norvegicus
ccaccttcagcagaaa

SEQ ID NO: 490845 - DNA, 16 bp, R. norvegicus
ccaccttcctctgccc

SEQ ID NO: 490846 - DNA, 16 bp, R. norvegicus
ccaccttcctctgctt

SEQ ID NO: 490847 - DNA, 16 bp, R. norvegicus
ccaccttcctgaagaa

SEQ ID NO: 490848 - DNA, 16 bp, R. norvegicus
ccaccttcctgctgtg

SEQ ID NO: 490849 - DNA, 16 bp, R. norvegicus
ccaccttctaatcctg

SEQ ID NO: 490850 - DNA, 16 bp, R. norvegicus
ccaccttctacttcct

SEQ ID NO: 490851 - DNA, 16 bp, R. norvegicus
ccaccttctcagagga

SEQ ID NO: 490852 - DNA, 16 bp, R. norvegicus
ccaccttgagacccat

SEQ ID NO: 490853 - DNA, 16 bp, R. norvegicus
ccacggagatctctgg

SEQ ID NO: 490854 - DNA, 16 bp, R. norvegicus
ccacggctccaactgc

SEQ ID NO: 490855 - DNA, 16 bp, R. norvegicus
ccacgggctaaagctg

SEQ ID NO: 490856 - DNA, 17 bp, R. norvegicus
ccacggtgaccatccac

SEQ ID NO: 490857 - DNA, 16 bp, R. norvegicus
ccacgtgaagctcaag

SEQ ID NO: 490858 - DNA, 18 bp, R. norvegicus
ccacgtggaaggccagga

SEQ ID NO: 490859 - DNA, 16 bp, R. norvegicus
ccacgtgggttccagg

SEQ ID NO: 490860 - DNA, 16 bp, R. norvegicus
ccactaaaatcagggg

SEQ ID NO: 490861 - DNA, 16 bp, R. norvegicus
ccactaagacatctct

SEQ ID NO: 490862 - DNA, 16 bp, R. norvegicus
ccactacacccagctt

SEQ ID NO: 490863 - DNA, 16 bp, R. norvegicus
ccactacactactcta

SEQ ID NO: 490864 - DNA, 16 bp, R. norvegicus
ccactacataaagact

SEQ ID NO: 490865 - DNA, 16 bp, R. norvegicus
ccactaccaccaccag

SEQ ID NO: 490866 - DNA, 16 bp, R. norvegicus
ccactacccaaagcct

SEQ ID NO: 490867 - DNA, 16 bp, R. norvegicus
ccactacccatggact

SEQ ID NO: 490868 - DNA, 16 bp, R. norvegicus
ccactactcaaagact

SEQ ID NO: 490869 - DNA, 16 bp, R. norvegicus
ccactagatggtgctg

SEQ ID NO: 490870 - DNA, 16 bp, R. norvegicus
ccactaggctcctccc

SEQ ID NO: 490871 - DNA, 16 bp, R. norvegicus
ccactatataaagaaa

SEQ ID NO: 490872 - DNA, 32 bp, R. norvegicus
ccactatcacaaatgtgccatgagtgtcccat

SEQ ID NO: 490873 - DNA, 16 bp, R. norvegicus
ccactatgcccagcct

SEQ ID NO: 490874 - DNA, 16 bp, R. norvegicus
ccactattactgtgtg

SEQ ID NO: 490875 - DNA, 16 bp, R. norvegicus
ccactcacactccact

SEQ ID NO: 490876 - DNA, 16 bp, R. norvegicus
ccactcacaggccacc

SEQ ID NO: 490877 - DNA, 16 bp, R. norvegicus
ccactcactcctgctg

SEQ ID NO: 490878 - DNA, 16 bp, R. norvegicus
ccactcaggcagctgg

SEQ ID NO: 490879 - DNA, 16 bp, R. norvegicus
ccactccctgaggcct

SEQ ID NO: 490880 - DNA, 16 bp, R. norvegicus
ccactccctggccaag

SEQ ID NO: 490881 - DNA, 16 bp, R. norvegicus
ccactccctgggccag

SEQ ID NO: 490882 - DNA, 16 bp, R. norvegicus
ccactctcagaaacag

SEQ ID NO: 490883 - DNA, 16 bp, R. norvegicus
ccactctgctcctccc

SEQ ID NO: 490884 - DNA, 16 bp, R. norvegicus
ccactctgcttccttt

SEQ ID NO: 490885 - DNA, 16 bp, R. norvegicus
ccactgaaatcaggaa

SEQ ID NO: 490886 - DNA, 16 bp, R. norvegicus
ccactgagcaatccct

SEQ ID NO: 490887 - DNA, 16 bp, R. norvegicus
ccactgagcatctcct

SEQ ID NO: 490888 - DNA, 16 bp, R. norvegicus
ccactgagccaagtcc

SEQ ID NO: 490889 - DNA, 16 bp, R. norvegicus
ccactgagccacacct

SEQ ID NO: 490890 - DNA, 16 bp, R. norvegicus
ccactgagccatctcc

SEQ ID NO: 490891 - DNA, 16 bp, R. norvegicus
ccactgagctaccttt

SEQ ID NO: 490892 - DNA, 16 bp, R. norvegicus
ccactgagctatccct

SEQ ID NO: 490893 - DNA, 16 bp, R. norvegicus
ccactgccaccgccac

SEQ ID NO: 490894 - DNA, 16 bp, R. norvegicus
ccactgccagagacag

SEQ ID NO: 490895 - DNA, 16 bp, R. norvegicus
ccactgccatcaccag

SEQ ID NO: 490896 - DNA, 16 bp, R. norvegicus
ccactgcccacatccc

SEQ ID NO: 490897 - DNA, 16 bp, R. norvegicus
ccactgccccactgcc

SEQ ID NO: 490898 - DNA, 16 bp, R. norvegicus
ccactgccctctgctg

SEQ ID NO: 490899 - DNA, 16 bp, R. norvegicus
ccactgccgccgccgc

SEQ ID NO: 490900 - DNA, 16 bp, R. norvegicus
ccactgcctcaggtca

SEQ ID NO: 490901 - DNA, 16 bp, R. norvegicus
ccactgcctccactgc

SEQ ID NO: 490902 - DNA, 16 bp, R. norvegicus
ccactgcctctgctgg

SEQ ID NO: 490903 - DNA, 16 bp, R. norvegicus
ccactgcctctggctc

SEQ ID NO: 490904 - DNA, 16 bp, R. norvegicus
ccactgctgctgattt

SEQ ID NO: 490905 - DNA, 16 bp, R. norvegicus
ccactgctgctgcagt

SEQ ID NO: 490906 - DNA, 16 bp, R. norvegicus
ccactgctgctgccac

SEQ ID NO: 490907 - DNA, 16 bp, R. norvegicus
ccactgctgtgaacag

SEQ ID NO: 490908 - DNA, 16 bp, R. norvegicus
ccactggctgttcttc

SEQ ID NO: 490909 - DNA, 16 bp, R. norvegicus
ccactgggctggagag

SEQ ID NO: 490910 - DNA, 16 bp, R. norvegicus
ccactggggaggcaac

SEQ ID NO: 490911 - DNA, 16 bp, R. norvegicus
ccactggtgtccttac

SEQ ID NO: 490912 - DNA, 16 bp, R. norvegicus
ccactgtcagaaagag

SEQ ID NO: 490913 - DNA, 16 bp, R. norvegicus
ccactgtgagcagcac

SEQ ID NO: 490914 - DNA, 16 bp, R. norvegicus
ccactgtgcccagctc

SEQ ID NO: 490915 - DNA, 16 bp, R. norvegicus
ccactgtgtcctttgc

SEQ ID NO: 490916 - DNA, 16 bp, R. norvegicus
ccactgttgggaattt

SEQ ID NO: 490917 - DNA, 16 bp, R. norvegicus
ccactgtttgtgtttt

SEQ ID NO: 490918 - DNA, 16 bp, R. norvegicus
ccacttcccatgagcc

SEQ ID NO: 490919 - DNA, 16 bp, R. norvegicus
ccacttcctccagatt

SEQ ID NO: 490920 - DNA, 16 bp, R. norvegicus
ccacttcctgcccagc

SEQ ID NO: 490921 - DNA, 16 bp, R. norvegicus
ccacttcctgctgatt

SEQ ID NO: 490922 - DNA, 16 bp, R. norvegicus
ccacttctgctccaag

SEQ ID NO: 490923 - DNA, 16 bp, R. norvegicus
ccactttctgattgga

SEQ ID NO: 490924 - DNA, 16 bp, R. norvegicus
ccagaaaaacaagatt

SEQ ID NO: 490925 - DNA, 16 bp, R. norvegicus
ccagaaaaataaatat

SEQ ID NO: 490926 - DNA, 16 bp, R. norvegicus
ccagaaaaatcagaca

SEQ ID NO: 490927 - DNA, 16 bp, R. norvegicus
ccagaaaagaaaatct

SEQ ID NO: 490928 - DNA, 16 bp, R. norvegicus
ccagaaaagaaagtcc

SEQ ID NO: 490929 - DNA, 16 bp, R. norvegicus
ccagaaaagaaagttc

SEQ ID NO: 490930 - DNA, 16 bp, R. norvegicus
ccagaaaagaatttcc

SEQ ID NO: 490931 - DNA, 16 bp, R. norvegicus
ccagaaaatgagaagg

SEQ ID NO: 490932 - DNA, 16 bp, R. norvegicus
ccagaaaatggcatca

SEQ ID NO: 490933 - DNA, 16 bp, R. norvegicus
ccagaaaccacatggc

SEQ ID NO: 490934 - DNA, 16 bp, R. norvegicus
ccagaaactgcagtct

SEQ ID NO: 490935 - DNA, 16 bp, R. norvegicus
ccagaaactgtgaaag

SEQ ID NO: 490936 - DNA, 16 bp, R. norvegicus
ccagaaagataaacat

SEQ ID NO: 490937 - DNA, 16 bp, R. norvegicus
ccagaaagcagcagaa

SEQ ID NO: 490938 - DNA, 16 bp, R. norvegicus
ccagaaagtaccagag

SEQ ID NO: 490939 - DNA, 16 bp, R. norvegicus
ccagaaataaaactac

SEQ ID NO: 490940 - DNA, 16 bp, R. norvegicus
ccagaaatcctgagtt

SEQ ID NO: 490941 - DNA, 16 bp, R. norvegicus
ccagaaatgatcccac

SEQ ID NO: 490942 - DNA, 16 bp, R. norvegicus
ccagaaatggctgaaa

SEQ ID NO: 490943 - DNA, 16 bp, R. norvegicus
ccagaacagccaggac

SEQ ID NO: 490944 - DNA, 16 bp, R. norvegicus
ccagaacagccagggc

SEQ ID NO: 490945 - DNA, 16 bp, R. norvegicus
ccagaaccaagggcct

SEQ ID NO: 490946 - DNA, 16 bp, R. norvegicus
ccagaaccagaaccag

SEQ ID NO: 490947 - DNA, 16 bp, R. norvegicus
ccagaaccttctccca

SEQ ID NO: 490948 - DNA, 16 bp, R. norvegicus
ccagaactcccagagc

SEQ ID NO: 490949 - DNA, 16 bp, R. norvegicus
ccagaactgaccatat

SEQ ID NO: 490950 - DNA, 16 bp, R. norvegicus
ccagaactgtgagaaa

SEQ ID NO: 490951 - DNA, 16 bp, R. norvegicus
ccagaagaattttgcc

SEQ ID NO: 490952 - DNA, 16 bp, R. norvegicus
ccagaagagactgttc

SEQ ID NO: 490953 - DNA, 16 bp, R. norvegicus
ccagaagagagtgttg

SEQ ID NO: 490954 - DNA, 16 bp, R. norvegicus
ccagaagagcagccag

SEQ ID NO: 490955 - DNA, 16 bp, R. norvegicus
ccagaagagggcagca

SEQ ID NO: 490956 - DNA, 16 bp, R. norvegicus
ccagaagagggtgctg

SEQ ID NO: 490957 - DNA, 16 bp, R. norvegicus
ccagaagaggtgctgg

SEQ ID NO: 490958 - DNA, 16 bp, R. norvegicus
ccagaagatcctggag

SEQ ID NO: 490959 - DNA, 16 bp, R. norvegicus
ccagaagatcctgggc

SEQ ID NO: 490960 - DNA, 16 bp, R. norvegicus
ccagaagatggtgttg

SEQ ID NO: 490961 - DNA, 16 bp, R. norvegicus
ccagaagatttcactt

SEQ ID NO: 490962 - DNA, 16 bp, R. norvegicus
ccagaagccatcagtt

SEQ ID NO: 490963 - DNA, 16 bp, R. norvegicus
ccagaagctgcaaaga

SEQ ID NO: 490964 - DNA, 16 bp, R. norvegicus
ccagaagctggaagaa

SEQ ID NO: 490965 - DNA, 16 bp, R. norvegicus
ccagaagctgggaaaa

SEQ ID NO: 490966 - DNA, 16 bp, R. norvegicus
ccagaagctgggaaca

SEQ ID NO: 490967 - DNA, 16 bp, R. norvegicus
ccagaagctgggaaga

SEQ ID NO: 490968 - DNA, 16 bp, R. norvegicus
ccagaagctgtctcca

SEQ ID NO: 490969 - DNA, 16 bp, R. norvegicus
ccagaaggaaacagac

SEQ ID NO: 490970 - DNA, 16 bp, R. norvegicus
ccagaaggagactgtc

SEQ ID NO: 490971 - DNA, 16 bp, R. norvegicus
ccagaagggggcactg

SEQ ID NO: 490972 - DNA, 16 bp, R. norvegicus
ccagaagtcaacatca

SEQ ID NO: 490973 - DNA, 16 bp, R. norvegicus
ccagaagtcatcaact

SEQ ID NO: 490974 - DNA, 16 bp, R. norvegicus
ccagaagtcttgagtt

SEQ ID NO: 490975 - DNA, 16 bp, R. norvegicus
ccagaagttcatttat

SEQ ID NO: 490976 - DNA, 16 bp, R. norvegicus
ccagaatacagaaaat

SEQ ID NO: 490977 - DNA, 16 bp, R. norvegicus
ccagaatacatcaaat

SEQ ID NO: 490978 - DNA, 16 bp, R. norvegicus
ccagaatcctgaagaa

SEQ ID NO: 490979 - DNA, 16 bp, R. norvegicus
ccagaatcttctggct

SEQ ID NO: 490980 - DNA, 16 bp, R. norvegicus
ccagaatgcagtgtgt

SEQ ID NO: 490981 - DNA, 16 bp, R. norvegicus
ccagaatggttttaca

SEQ ID NO: 490982 - DNA, 16 bp, R. norvegicus
ccagaattcaatgaaa

SEQ ID NO: 490983 - DNA, 16 bp, R. norvegicus
ccagaattcctcctgt

SEQ ID NO: 490984 - DNA, 16 bp, R. norvegicus
ccagacaatgccaccc

SEQ ID NO: 490985 - DNA, 16 bp, R. norvegicus
ccagacaatgccatcc

SEQ ID NO: 490986 - DNA, 16 bp, R. norvegicus
ccagacaccacagagc

SEQ ID NO: 490987 - DNA, 16 bp, R. norvegicus
ccagacaccccagagc

SEQ ID NO: 490988 - DNA, 16 bp, R. norvegicus
ccagacacctcatctg

SEQ ID NO: 490989 - DNA, 16 bp, R. norvegicus
ccagacactgcccaga

SEQ ID NO: 490990 - DNA, 16 bp, R. norvegicus
ccagacacttccagtt

SEQ ID NO: 490991 - DNA, 16 bp, R. norvegicus
ccagacagaccacacc

SEQ ID NO: 490992 - DNA, 16 bp, R. norvegicus
ccagacagaggcagca

SEQ ID NO: 490993 - DNA, 16 bp, R. norvegicus
ccagacaggttcagtg

SEQ ID NO: 490994 - DNA, 16 bp, R. norvegicus
ccagacccagaaaggc

SEQ ID NO: 490995 - DNA, 16 bp, R. norvegicus
ccagacccagacccag

SEQ ID NO: 490996 - DNA, 16 bp, R. norvegicus
ccagacccagcagtcc

SEQ ID NO: 490997 - DNA, 16 bp, R. norvegicus
ccagaccccaccagaa

SEQ ID NO: 490998 - DNA, 18 bp, R. norvegicus
ccagaccctgaaggaaac

SEQ ID NO: 490999 - DNA, 16 bp, R. norvegicus
ccagaccctgtctcaa

SEQ ID NO: 491000 - DNA, 16 bp, R. norvegicus
ccagacccttcagagc

SEQ ID NO: 491001 - DNA, 16 bp, R. norvegicus
ccagacctcaccagag

SEQ ID NO: 491002 - DNA, 16 bp, R. norvegicus
ccagacctggggaaga

SEQ ID NO: 491003 - DNA, 16 bp, R. norvegicus
ccagaccttcaaagaa

SEQ ID NO: 491004 - DNA, 16 bp, R. norvegicus
ccagaccttcagagaa

SEQ ID NO: 491005 - DNA, 16 bp, R. norvegicus
ccagactcagaaaggc

SEQ ID NO: 491006 - DNA, 16 bp, R. norvegicus
ccagactggagccact

SEQ ID NO: 491007 - DNA, 16 bp, R. norvegicus
ccagactgtcctggaa

SEQ ID NO: 491008 - DNA, 16 bp, R. norvegicus
ccagacttccccagca

SEQ ID NO: 491009 - DNA, 16 bp, R. norvegicus
ccagacttcctcagca

SEQ ID NO: 491010 - DNA, 16 bp, R. norvegicus
ccagacttcctcagct

SEQ ID NO: 491011 - DNA, 16 bp, R. norvegicus
ccagacttctcgccaa

SEQ ID NO: 491012 - DNA, 16 bp, R. norvegicus
ccagacttgtcaccag

SEQ ID NO: 491013 - DNA, 16 bp, R. norvegicus
ccagacttgtgggcac

SEQ ID NO: 491014 - DNA, 16 bp, R. norvegicus
ccagagaaaaaagcca

SEQ ID NO: 491015 - DNA, 16 bp, R. norvegicus
ccagagaaccaaataa

SEQ ID NO: 491016 - DNA, 16 bp, R. norvegicus
ccagagaagccagaag

SEQ ID NO: 491017 - DNA, 16 bp, R. norvegicus
ccagagaatgaggagc

SEQ ID NO: 491018 - DNA, 16 bp, R. norvegicus
ccagagacagaagctg

SEQ ID NO: 491019 - DNA, 16 bp, R. norvegicus
ccagagaccagggagg

SEQ ID NO: 491020 - DNA, 16 bp, R. norvegicus
ccagagactgagccac

SEQ ID NO: 491021 - DNA, 16 bp, R. norvegicus
ccagagactgcccacc

SEQ ID NO: 491022 - DNA, 16 bp, R. norvegicus
ccagagactgtctcac

SEQ ID NO: 491023 - DNA, 16 bp, R. norvegicus
ccagagagcacagagg

SEQ ID NO: 491024 - DNA, 16 bp, R. norvegicus
ccagagagccaggaga

SEQ ID NO: 491025 - DNA, 16 bp, R. norvegicus
ccagagataacctgat

SEQ ID NO: 491026 - DNA, 16 bp, R. norvegicus
ccagagatcctgaatt

SEQ ID NO: 491027 - DNA, 16 bp, R. norvegicus
ccagagatctgggaag

SEQ ID NO: 491028 - DNA, 22 bp, R. norvegicus
ccagagatgtggtgtctgccaa

SEQ ID NO: 491029 - DNA, 16 bp, R. norvegicus
ccagagcaaagggaga

SEQ ID NO: 491030 - DNA, 28 bp, R. norvegicus
ccagagcaatcagacaacaaaaggagct

SEQ ID NO: 491031 - DNA, 16 bp, R. norvegicus
ccagagcaatgagaca

SEQ ID NO: 491032 - DNA, 16 bp, R. norvegicus
ccagagcacccaggga

SEQ ID NO: 491033 - DNA, 16 bp, R. norvegicus
ccagagcactgggatt

SEQ ID NO: 491034 - DNA, 16 bp, R. norvegicus
ccagagcagtcatgtt

SEQ ID NO: 491035 - DNA, 16 bp, R. norvegicus
ccagagccagctctac

SEQ ID NO: 491036 - DNA, 16 bp, R. norvegicus
ccagagcccagctatc

SEQ ID NO: 491037 - DNA, 16 bp, R. norvegicus
ccagagcccccagagc

SEQ ID NO: 491038 - DNA, 16 bp, R. norvegicus
ccagagcccccaggga

SEQ ID NO: 491039 - DNA, 16 bp, R. norvegicus
ccagagccctcaggac

SEQ ID NO: 491040 - DNA, 16 bp, R. norvegicus
ccagagcctaaccaat

SEQ ID NO: 491041 - DNA, 16 bp, R. norvegicus
ccagagctacccagag

SEQ ID NO: 491042 - DNA, 16 bp, R. norvegicus
ccagagctcctgggaa

SEQ ID NO: 491043 - DNA, 16 bp, R. norvegicus
ccagagctgacactgt

SEQ ID NO: 491044 - DNA, 16 bp, R. norvegicus
ccagagcttaaagcag

SEQ ID NO: 491045 - DNA, 16 bp, R. norvegicus
ccagagcttccacgga

SEQ ID NO: 491046 - DNA, 16 bp, R. norvegicus
ccagagcttccagaga

SEQ ID NO: 491047 - DNA, 16 bp, R. norvegicus
ccagagcttcctggga

SEQ ID NO: 491048 - DNA, 16 bp, R. norvegicus
ccagaggaaaaaatag

SEQ ID NO: 491049 - DNA, 16 bp, R. norvegicus
ccagaggaagacacca

SEQ ID NO: 491050 - DNA, 16 bp, R. norvegicus
ccagaggaaggcatca

SEQ ID NO: 491051 - DNA, 16 bp, R. norvegicus
ccagaggaaggctttg

SEQ ID NO: 491052 - DNA, 16 bp, R. norvegicus
ccagaggaattaaagg

SEQ ID NO: 491053 - DNA, 16 bp, R. norvegicus
ccagaggaattttaat

SEQ ID NO: 491054 - DNA, 16 bp, R. norvegicus
ccagaggacaaccttg

SEQ ID NO: 491055 - DNA, 16 bp, R. norvegicus
ccagaggacacagaga

SEQ ID NO: 491056 - DNA, 16 bp, R. norvegicus
ccagaggaccagagct

SEQ ID NO: 491057 - DNA, 16 bp, R. norvegicus
ccagaggacccaagtc

SEQ ID NO: 491058 - DNA, 16 bp, R. norvegicus
ccagaggacccagaga

SEQ ID NO: 491059 - DNA, 16 bp, R. norvegicus
ccagaggaggacactg

SEQ ID NO: 491060 - DNA, 16 bp, R. norvegicus
ccagaggaggacattg

SEQ ID NO: 491061 - DNA, 16 bp, R. norvegicus
ccagaggagggtgttg

SEQ ID NO: 491062 - DNA, 16 bp, R. norvegicus
ccagaggcaggaactg

SEQ ID NO: 491063 - DNA, 16 bp, R. norvegicus
ccagaggctcaagttc

SEQ ID NO: 491064 - DNA, 16 bp, R. norvegicus
ccagaggctctcttcc

SEQ ID NO: 491065 - DNA, 16 bp, R. norvegicus
ccagaggctgccccac

SEQ ID NO: 491066 - DNA, 16 bp, R. norvegicus
ccagagggagtggaaa

SEQ ID NO: 491067 - DNA, 16 bp, R. norvegicus
ccagagggcacagaga

SEQ ID NO: 491068 - DNA, 16 bp, R. norvegicus
ccagagggcaggagcc

SEQ ID NO: 491069 - DNA, 16 bp, R. norvegicus
ccagaggggagtgttt

SEQ ID NO: 491070 - DNA, 16 bp, R. norvegicus
ccagaggggtcagaag

SEQ ID NO: 491071 - DNA, 16 bp, R. norvegicus
ccagagggtcaggaga

SEQ ID NO: 491072 - DNA, 17 bp, R. norvegicus
ccagaggtggttgctga

SEQ ID NO: 491073 - DNA, 16 bp, R. norvegicus
ccagaggttgacatca

SEQ ID NO: 491074 - DNA, 16 bp, R. norvegicus
ccagagtcctccctcc

SEQ ID NO: 491075 - DNA, 16 bp, R. norvegicus
ccagagttcagttcct

SEQ ID NO: 491076 - DNA, 16 bp, R. norvegicus
ccagagttcctggctc

SEQ ID NO: 491077 - DNA, 16 bp, R. norvegicus
ccagagtttcaaagaa

SEQ ID NO: 491078 - DNA, 16 bp, R. norvegicus
ccagagttttcaggga

SEQ ID NO: 491079 - DNA, 16 bp, R. norvegicus
ccagatacaccagaag

SEQ ID NO: 491080 - DNA, 16 bp, R. norvegicus
ccagataggttcagtg

SEQ ID NO: 491081 - DNA, 16 bp, R. norvegicus
ccagatatagatctct

SEQ ID NO: 491082 - DNA, 16 bp, R. norvegicus
ccagatatgaggaaga

SEQ ID NO: 491083 - DNA, 16 bp, R. norvegicus
ccagatcagcaggcag

SEQ ID NO: 491084 - DNA, 16 bp, R. norvegicus
ccagatccagaaagac

SEQ ID NO: 491085 - DNA, 16 bp, R. norvegicus
ccagatcccctggagc

SEQ ID NO: 491086 - DNA, 16 bp, R. norvegicus
ccagatccctagaaca

SEQ ID NO: 491087 - DNA, 16 bp, R. norvegicus
ccagatcctcaccagc

SEQ ID NO: 491088 - DNA, 16 bp, R. norvegicus
ccagatcctgctggaa

SEQ ID NO: 491089 - DNA, 16 bp, R. norvegicus
ccagatgacaggaaag

SEQ ID NO: 491090 - DNA, 16 bp, R. norvegicus
ccagatgatccaggac

SEQ ID NO: 491091 - DNA, 16 bp, R. norvegicus
ccagatgatgagaggc

SEQ ID NO: 491092 - DNA, 16 bp, R. norvegicus
ccagatgcagatctct

SEQ ID NO: 491093 - DNA, 16 bp, R. norvegicus
ccagatgcccttcagt

SEQ ID NO: 491094 - DNA, 16 bp, R. norvegicus
ccagatggagtcccag

SEQ ID NO: 491095 - DNA, 16 bp, R. norvegicus
ccagatggccagaggc

SEQ ID NO: 491096 - DNA, 16 bp, R. norvegicus
ccagatggccttcaac

SEQ ID NO: 491097 - DNA, 16 bp, R. norvegicus
ccagatgtcagggaag

SEQ ID NO: 491098 - DNA, 16 bp, R. norvegicus
ccagatgtgtttcaga

SEQ ID NO: 491099 - DNA, 16 bp, R. norvegicus
ccagattcctccctcc

SEQ ID NO: 491100 - DNA, 16 bp, R. norvegicus
ccagattctccagttt

SEQ ID NO: 491101 - DNA, 16 bp, R. norvegicus
ccagattctttttttt

SEQ ID NO: 491102 - DNA, 16 bp, R. norvegicus
ccagatttcattacag

SEQ ID NO: 491103 - DNA, 16 bp, R. norvegicus
ccagatttctttttaa

SEQ ID NO: 491104 - DNA, 16 bp, R. norvegicus
ccagcaaaaatctcaa

SEQ ID NO: 491105 - DNA, 16 bp, R. norvegicus
ccagcaaaatggctca

SEQ ID NO: 491106 - DNA, 16 bp, R. norvegicus
ccagcaacagcagcag

SEQ ID NO: 491107 - DNA, 16 bp, R. norvegicus
ccagcaacatttgttg

SEQ ID NO: 491108 - DNA, 16 bp, R. norvegicus
ccagcaaccacattgg

SEQ ID NO: 491109 - DNA, 16 bp, R. norvegicus
ccagcaagccccagga

SEQ ID NO: 491110 - DNA, 16 bp, R. norvegicus
ccagcaaggacactga

SEQ ID NO: 491111 - DNA, 16 bp, R. norvegicus
ccagcaaggggcagag

SEQ ID NO: 491112 - DNA, 16 bp, R. norvegicus
ccagcaatcaaaagcc

SEQ ID NO: 491113 - DNA, 16 bp, R. norvegicus
ccagcacacaagaggc

SEQ ID NO: 491114 - DNA, 16 bp, R. norvegicus
ccagcacactggaggc

SEQ ID NO: 491115 - DNA, 16 bp, R. norvegicus
ccagcacatcttgcag

SEQ ID NO: 491116 - DNA, 16 bp, R. norvegicus
ccagcaccaaggaggc

SEQ ID NO: 491117 - DNA, 16 bp, R. norvegicus
ccagcaccaggcctgc

SEQ ID NO: 491118 - DNA, 16 bp, R. norvegicus
ccagcaccagggaggt

SEQ ID NO: 491119 - DNA, 16 bp, R. norvegicus
ccagcaccatttggtg

SEQ ID NO: 491120 - DNA, 16 bp, R. norvegicus
ccagcacccacaactg

SEQ ID NO: 491121 - DNA, 16 bp, R. norvegicus
ccagcacccacacaga

SEQ ID NO: 491122 - DNA, 16 bp, R. norvegicus
ccagcacccacagggc

SEQ ID NO: 491123 - DNA, 16 bp, R. norvegicus
ccagcacccacatcat

SEQ ID NO: 491124 - DNA, 16 bp, R. norvegicus
ccagcacccacatgaa

SEQ ID NO: 491125 - DNA, 16 bp, R. norvegicus
ccagcacccagatggt

SEQ ID NO: 491126 - DNA, 16 bp, R. norvegicus
ccagcacccaggccag

SEQ ID NO: 491127 - DNA, 16 bp, R. norvegicus
ccagcacccaggtcag

SEQ ID NO: 491128 - DNA, 16 bp, R. norvegicus
ccagcacctatgtaaa

SEQ ID NO: 491129 - DNA, 16 bp, R. norvegicus
ccagcacctgagaggc

SEQ ID NO: 491130 - DNA, 16 bp, R. norvegicus
ccagcacctgcatggc

SEQ ID NO: 491131 - DNA, 16 bp, R. norvegicus
ccagcacctgctgtca

SEQ ID NO: 491132 - DNA, 16 bp, R. norvegicus
ccagcacctgggaggt

SEQ ID NO: 491133 - DNA, 16 bp, R. norvegicus
ccagcactaagaaggc

SEQ ID NO: 491134 - DNA, 16 bp, R. norvegicus
ccagcactatgtctgc

SEQ ID NO: 491135 - DNA, 16 bp, R. norvegicus
ccagcactcaggaaat

SEQ ID NO: 491136 - DNA, 16 bp, R. norvegicus
ccagcactcaggagac

SEQ ID NO: 491137 - DNA, 16 bp, R. norvegicus
ccagcactcaggcagc

SEQ ID NO: 491138 - DNA, 16 bp, R. norvegicus
ccagcactgaggaggc

SEQ ID NO: 491139 - DNA, 16 bp, R. norvegicus
ccagcactgcccaccc

SEQ ID NO: 491140 - DNA, 16 bp, R. norvegicus
ccagcactgcccagct

SEQ ID NO: 491141 - DNA, 16 bp, R. norvegicus
ccagcactggagaagc

SEQ ID NO: 491142 - DNA, 16 bp, R. norvegicus
ccagcactggaggcag

SEQ ID NO: 491143 - DNA, 16 bp, R. norvegicus
ccagcacttaggaggc

SEQ ID NO: 491144 - DNA, 16 bp, R. norvegicus
ccagcactttgggagg

SEQ ID NO: 491145 - DNA, 16 bp, R. norvegicus
ccagcagaaggggaag

SEQ ID NO: 491146 - DNA, 16 bp, R. norvegicus
ccagcagaaggtgtgg

SEQ ID NO: 491147 - DNA, 16 bp, R. norvegicus
ccagcagaatgaatgg

SEQ ID NO: 491148 - DNA, 16 bp, R. norvegicus
ccagcagacaagaggc

SEQ ID NO: 491149 - DNA, 16 bp, R. norvegicus
ccagcagagagaatgg

SEQ ID NO: 491150 - DNA, 16 bp, R. norvegicus
ccagcagagaggcagg

SEQ ID NO: 491151 - DNA, 16 bp, R. norvegicus
ccagcagaggccagag

SEQ ID NO: 491152 - DNA, 16 bp, R. norvegicus
ccagcagagggcagca

SEQ ID NO: 491153 - DNA, 16 bp, R. norvegicus
ccagcagagggcagtg

SEQ ID NO: 491154 - DNA, 16 bp, R. norvegicus
ccagcagagggcgcca

SEQ ID NO: 491155 - DNA, 16 bp, R. norvegicus
ccagcagagggcgctg

SEQ ID NO: 491156 - DNA, 16 bp, R. norvegicus
ccagcagatcctggac

SEQ ID NO: 491157 - DNA, 16 bp, R. norvegicus
ccagcagatggcagca

SEQ ID NO: 491158 - DNA, 16 bp, R. norvegicus
ccagcagcaaggcaga

SEQ ID NO: 491159 - DNA, 16 bp, R. norvegicus
ccagcagcacctggaa

SEQ ID NO: 491160 - DNA, 19 bp, R. norvegicus
ccagcagcagcagcagcaa

SEQ ID NO: 491161 - DNA, 16 bp, R. norvegicus
ccagcagcagcagcat

SEQ ID NO: 491162 - DNA, 16 bp, R. norvegicus
ccagcagcagtttcca

SEQ ID NO: 491163 - DNA, 25 bp, R. norvegicus
ccagcagcataccactgaactgaga

SEQ ID NO: 491164 - DNA, 16 bp, R. norvegicus
ccagcagccacacagc

SEQ ID NO: 491165 - DNA, 16 bp, R. norvegicus
ccagcagccagcagcc

SEQ ID NO: 491166 - DNA, 16 bp, R. norvegicus
ccagcagcccagccca

SEQ ID NO: 491167 - DNA, 16 bp, R. norvegicus
ccagcagctcctcagc

SEQ ID NO: 491168 - DNA, 16 bp, R. norvegicus
ccagcagctgatagaa

SEQ ID NO: 491169 - DNA, 16 bp, R. norvegicus
ccagcagctgatggaa

SEQ ID NO: 491170 - DNA, 16 bp, R. norvegicus
ccagcaggaggcagag

SEQ ID NO: 491171 - DNA, 16 bp, R. norvegicus
ccagcagggccagctc

SEQ ID NO: 491172 - DNA, 16 bp, R. norvegicus
ccagcagggggcgctg

SEQ ID NO: 491173 - DNA, 16 bp, R. norvegicus
ccagcaggtggcagtg

SEQ ID NO: 491174 - DNA, 16 bp, R. norvegicus
ccagcaggtggcgctg

SEQ ID NO: 491175 - DNA, 16 bp, R. norvegicus
ccagcaggtggtggtg

SEQ ID NO: 491176 - DNA, 16 bp, R. norvegicus
ccagcagtcgggaggc

SEQ ID NO: 491177 - DNA, 16 bp, R. norvegicus
ccagcagtgatgtcac

SEQ ID NO: 491178 - DNA, 16 bp, R. norvegicus
ccagcagttcattgat

SEQ ID NO: 491179 - DNA, 16 bp, R. norvegicus
ccagcagttgactcag

SEQ ID NO: 491180 - DNA, 16 bp, R. norvegicus
ccagcatcaatgggag

SEQ ID NO: 491181 - DNA, 16 bp, R. norvegicus
ccagcatcaccaccac

SEQ ID NO: 491182 - DNA, 16 bp, R. norvegicus
ccagcatcagcaaagc

SEQ ID NO: 491183 - DNA, 16 bp, R. norvegicus
ccagcatcatgtctgc

SEQ ID NO: 491184 - DNA, 16 bp, R. norvegicus
ccagcatccacaaggc

SEQ ID NO: 491185 - DNA, 16 bp, R. norvegicus
ccagcatccacacagt

SEQ ID NO: 491186 - DNA, 16 bp, R. norvegicus
ccagcatccacatggc

SEQ ID NO: 491187 - DNA, 16 bp, R. norvegicus
ccagcatccaccccct

SEQ ID NO: 491188 - DNA, 16 bp, R. norvegicus
ccagcatccacctggt

SEQ ID NO: 491189 - DNA, 16 bp, R. norvegicus
ccagcatccaggaggt

SEQ ID NO: 491190 - DNA, 16 bp, R. norvegicus
ccagcatcctcttctg

SEQ ID NO: 491191 - DNA, 16 bp, R. norvegicus
ccagcatccttgatca

SEQ ID NO: 491192 - DNA, 16 bp, R. norvegicus
ccagcatctacactgg

SEQ ID NO: 491193 - DNA, 16 bp, R. norvegicus
ccagcatctactctca

SEQ ID NO: 491194 - DNA, 16 bp, R. norvegicus
ccagcatctcctgtca

SEQ ID NO: 491195 - DNA, 16 bp, R. norvegicus
ccagcatctgcctctg

SEQ ID NO: 491196 - DNA, 16 bp, R. norvegicus
ccagcatctgctgcca

SEQ ID NO: 491197 - DNA, 25 bp, R. norvegicus
ccagcatctgctgtcacctgagtct

SEQ ID NO: 491198 - DNA, 16 bp, R. norvegicus
ccagcatctgggaggc

SEQ ID NO: 491199 - DNA, 16 bp, R. norvegicus
ccagcatgcaggaggc

SEQ ID NO: 491200 - DNA, 16 bp, R. norvegicus
ccagcatgctggcctg

SEQ ID NO: 491201 - DNA, 16 bp, R. norvegicus
ccagcatgctggggtc

SEQ ID NO: 491202 - DNA, 16 bp, R. norvegicus
ccagcatggggctggc

SEQ ID NO: 491203 - DNA, 16 bp, R. norvegicus
ccagcatggtggtgca

SEQ ID NO: 491204 - DNA, 16 bp, R. norvegicus
ccagcatgtgctgcca

SEQ ID NO: 491205 - DNA, 16 bp, R. norvegicus
ccagcattcatctctc

SEQ ID NO: 491206 - DNA, 16 bp, R. norvegicus
ccagcatttaggagac

SEQ ID NO: 491207 - DNA, 16 bp, R. norvegicus
ccagcatttgatgtca

SEQ ID NO: 491208 - DNA, 16 bp, R. norvegicus
ccagcattttctttgg

SEQ ID NO: 491209 - DNA, 16 bp, R. norvegicus
ccagccaaccaaccag

SEQ ID NO: 491210 - DNA, 16 bp, R. norvegicus
ccagccaaccagccaa

SEQ ID NO: 491211 - DNA, 16 bp, R. norvegicus
ccagccaaggctacta

SEQ ID NO: 491212 - DNA, 16 bp, R. norvegicus
ccagccacagccacag

SEQ ID NO: 491213 - DNA, 16 bp, R. norvegicus
ccagccactctgctga

SEQ ID NO: 491214 - DNA, 20 bp, R. norvegicus
ccagccactttgctgaagtt

SEQ ID NO: 491215 - DNA, 16 bp, R. norvegicus
ccagccagagctacag

SEQ ID NO: 491216 - DNA, 16 bp, R. norvegicus
ccagccagagctgcac

SEQ ID NO: 491217 - DNA, 16 bp, R. norvegicus
ccagccagccagcagc

SEQ ID NO: 491218 - DNA, 16 bp, R. norvegicus
ccagccagccagccag

SEQ ID NO: 491219 - DNA, 16 bp, R. norvegicus
ccagccagccagcctg

SEQ ID NO: 491220 - DNA, 16 bp, R. norvegicus
ccagccagccagtcaa

SEQ ID NO: 491221 - DNA, 16 bp, R. norvegicus
ccagccagccagtcag

SEQ ID NO: 491222 - DNA, 16 bp, R. norvegicus
ccagccagcttcctgc

SEQ ID NO: 491223 - DNA, 16 bp, R. norvegicus
ccagccaggactacaa

SEQ ID NO: 491224 - DNA, 16 bp, R. norvegicus
ccagccaggcagcata

SEQ ID NO: 491225 - DNA, 16 bp, R. norvegicus
ccagccaggtctacaa

SEQ ID NO: 491226 - DNA, 16 bp, R. norvegicus
ccagccagtccagcca

SEQ ID NO: 491227 - DNA, 16 bp, R. norvegicus
ccagccagttctgagg

SEQ ID NO: 491228 - DNA, 16 bp, R. norvegicus
ccagccatttactctg

SEQ ID NO: 491229 - DNA, 16 bp, R. norvegicus
ccagcccactcctgac

SEQ ID NO: 491230 - DNA, 16 bp, R. norvegicus
ccagcccagaggctgg

SEQ ID NO: 491231 - DNA, 16 bp, R. norvegicus
ccagcccagctgctgt

SEQ ID NO: 491232 - DNA, 16 bp, R. norvegicus
ccagcccaggctacca

SEQ ID NO: 491233 - DNA, 16 bp, R. norvegicus
ccagccccaattaact

SEQ ID NO: 491234 - DNA, 16 bp, R. norvegicus
ccagccccacttcctg

SEQ ID NO: 491235 - DNA, 16 bp, R. norvegicus
ccagccccagctcctg

SEQ ID NO: 491236 - DNA, 16 bp, R. norvegicus
ccagccccaggaagca

SEQ ID NO: 491237 - DNA, 16 bp, R. norvegicus
ccagcccccacatggc

SEQ ID NO: 491238 - DNA, 16 bp, R. norvegicus
ccagccccctctttct

SEQ ID NO: 491239 - DNA, 17 bp, R. norvegicus
ccagccccctggggagc

SEQ ID NO: 491240 - DNA, 16 bp, R. norvegicus
ccagcccctcactggg

SEQ ID NO: 491241 - DNA, 16 bp, R. norvegicus
ccagcccctccagtgt

SEQ ID NO: 491242 - DNA, 16 bp, R. norvegicus
ccagcccctccctggg

SEQ ID NO: 491243 - DNA, 16 bp, R. norvegicus
ccagcccctcttttct

SEQ ID NO: 491244 - DNA, 16 bp, R. norvegicus
ccagcccctgccccag

SEQ ID NO: 491245 - DNA, 16 bp, R. norvegicus
ccagcccctgctgcca

SEQ ID NO: 491246 - DNA, 16 bp, R. norvegicus
ccagcccctggggagc

SEQ ID NO: 491247 - DNA, 16 bp, R. norvegicus
ccagccctccctctct

SEQ ID NO: 491248 - DNA, 16 bp, R. norvegicus
ccagccctctttcttt

SEQ ID NO: 491249 - DNA, 16 bp, R. norvegicus
ccagccctggcattcc

SEQ ID NO: 491250 - DNA, 16 bp, R. norvegicus
ccagcccttcactctg

SEQ ID NO: 491251 - DNA, 16 bp, R. norvegicus
ccagcccttctttttt

SEQ ID NO: 491252 - DNA, 16 bp, R. norvegicus
ccagccctttcctctg

SEQ ID NO: 491253 - DNA, 16 bp, R. norvegicus
ccagcctagccttgaa

SEQ ID NO: 491254 - DNA, 16 bp, R. norvegicus
ccagcctcaaactcag

SEQ ID NO: 491255 - DNA, 16 bp, R. norvegicus
ccagcctcacccctgc

SEQ ID NO: 491256 - DNA, 16 bp, R. norvegicus
ccagcctcagcctcag

SEQ ID NO: 491257 - DNA, 16 bp, R. norvegicus
ccagcctcagcctccc

SEQ ID NO: 491258 - DNA, 16 bp, R. norvegicus
ccagcctcagcctcct

SEQ ID NO: 491259 - DNA, 16 bp, R. norvegicus
ccagcctcagtttccc

SEQ ID NO: 491260 - DNA, 16 bp, R. norvegicus
ccagcctctacctccc

SEQ ID NO: 491261 - DNA, 16 bp, R. norvegicus
ccagcctctacctcct

SEQ ID NO: 491262 - DNA, 16 bp, R. norvegicus
ccagcctctgcctccc

SEQ ID NO: 491263 - DNA, 16 bp, R. norvegicus
ccagcctctgcctctg

SEQ ID NO: 491264 - DNA, 16 bp, R. norvegicus
ccagcctctggttcct

SEQ ID NO: 491265 - DNA, 16 bp, R. norvegicus
ccagcctctgtgggca

SEQ ID NO: 491266 - DNA, 18 bp, R. norvegicus
ccagcctgaggagtccag

SEQ ID NO: 491267 - DNA, 16 bp, R. norvegicus
ccagcctgcctctgcc

SEQ ID NO: 491268 - DNA, 16 bp, R. norvegicus
ccagcctggactatag

SEQ ID NO: 491269 - DNA, 16 bp, R. norvegicus
ccagcctggagtacat

SEQ ID NO: 491270 - DNA, 16 bp, R. norvegicus
ccagcctggcctactt

SEQ ID NO: 491271 - DNA, 16 bp, R. norvegicus
ccagcctggctacaca

SEQ ID NO: 491272 - DNA, 16 bp, R. norvegicus
ccagcctgggctacca

SEQ ID NO: 491273 - DNA, 16 bp, R. norvegicus
ccagcctgggctgtat

SEQ ID NO: 491274 - DNA, 16 bp, R. norvegicus
ccagcctgggcttcag

SEQ ID NO: 491275 - DNA, 16 bp, R. norvegicus
ccagcctggggtacat

SEQ ID NO: 491276 - DNA, 16 bp, R. norvegicus
ccagcctggtgtacat

SEQ ID NO: 491277 - DNA, 16 bp, R. norvegicus
ccagcctggtgtgcag

SEQ ID NO: 491278 - DNA, 16 bp, R. norvegicus
ccagccttatatacaa

SEQ ID NO: 491279 - DNA, 16 bp, R. norvegicus
ccagccttattccatg

SEQ ID NO: 491280 - DNA, 16 bp, R. norvegicus
ccagccttcacaggac

SEQ ID NO: 491281 - DNA, 16 bp, R. norvegicus
ccagcctttcacactg

SEQ ID NO: 491282 - DNA, 16 bp, R. norvegicus
ccagcgctcaggaagc

SEQ ID NO: 491283 - DNA, 16 bp, R. norvegicus
ccagctactctggagg

SEQ ID NO: 491284 - DNA, 16 bp, R. norvegicus
ccagctagtatatgct

SEQ ID NO: 491285 - DNA, 16 bp, R. norvegicus
ccagctataccactgc

SEQ ID NO: 491286 - DNA, 16 bp, R. norvegicus
ccagctatgggaacag

SEQ ID NO: 491287 - DNA, 16 bp, R. norvegicus
ccagctcaaggggaag

SEQ ID NO: 491288 - DNA, 16 bp, R. norvegicus
ccagctcacaggacca

SEQ ID NO: 491289 - DNA, 16 bp, R. norvegicus
ccagctcacctgcacc

SEQ ID NO: 491290 - DNA, 16 bp, R. norvegicus
ccagctcactgtgggc

SEQ ID NO: 491291 - DNA, 16 bp, R. norvegicus
ccagctcagagctgca

SEQ ID NO: 491292 - DNA, 16 bp, R. norvegicus
ccagctccaaaacaaa

SEQ ID NO: 491293 - DNA, 16 bp, R. norvegicus
ccagctccaagagatc

SEQ ID NO: 491294 - DNA, 16 bp, R. norvegicus
ccagctccagctgtgt

SEQ ID NO: 491295 - DNA, 16 bp, R. norvegicus
ccagctccaggggctc

SEQ ID NO: 491296 - DNA, 16 bp, R. norvegicus
ccagctccaggggtcc

SEQ ID NO: 491297 - DNA, 16 bp, R. norvegicus
ccagctccccagagct

SEQ ID NO: 491298 - DNA, 16 bp, R. norvegicus
ccagctccccagctcc

SEQ ID NO: 491299 - DNA, 16 bp, R. norvegicus
ccagctcctcttcctc

SEQ ID NO: 491300 - DNA, 16 bp, R. norvegicus
ccagctcctggttttt

SEQ ID NO: 491301 - DNA, 16 bp, R. norvegicus
ccagctcctgtttttg

SEQ ID NO: 491302 - DNA, 16 bp, R. norvegicus
ccagctccttgggagg

SEQ ID NO: 491303 - DNA, 16 bp, R. norvegicus
ccagctctaccctctg

SEQ ID NO: 491304 - DNA, 16 bp, R. norvegicus
ccagctctaggggacc

SEQ ID NO: 491305 - DNA, 16 bp, R. norvegicus
ccagctctccaacccc

SEQ ID NO: 491306 - DNA, 16 bp, R. norvegicus
ccagctctccagccca

SEQ ID NO: 491307 - DNA, 16 bp, R. norvegicus
ccagctctccagctct

SEQ ID NO: 491308 - DNA, 16 bp, R. norvegicus
ccagctctcccaccac

SEQ ID NO: 491309 - DNA, 16 bp, R. norvegicus
ccagctctcctgcacc

SEQ ID NO: 491310 - DNA, 16 bp, R. norvegicus
ccagctctcctgtgct

SEQ ID NO: 491311 - DNA, 16 bp, R. norvegicus
ccagctctctcccagc

SEQ ID NO: 491312 - DNA, 16 bp, R. norvegicus
ccagctctgaaaaaaa

SEQ ID NO: 491313 - DNA, 16 bp, R. norvegicus
ccagctctgcctctct

SEQ ID NO: 491314 - DNA, 16 bp, R. norvegicus
ccagctcttccacaag

SEQ ID NO: 491315 - DNA, 16 bp, R. norvegicus
ccagctgcagcactca

SEQ ID NO: 491316 - DNA, 16 bp, R. norvegicus
ccagctgcagcactgg

SEQ ID NO: 491317 - DNA, 16 bp, R. norvegicus
ccagctgcagcaggag

SEQ ID NO: 491318 - DNA, 16 bp, R. norvegicus
ccagctgcaggggatc

SEQ ID NO: 491319 - DNA, 16 bp, R. norvegicus
ccagctgctgagggaa

SEQ ID NO: 491320 - DNA, 16 bp, R. norvegicus
ccagctgctgctgctg

SEQ ID NO: 491321 - DNA, 16 bp, R. norvegicus
ccagctgctgctggac

SEQ ID NO: 491322 - DNA, 16 bp, R. norvegicus
ccagctgctgcttctg

SEQ ID NO: 491323 - DNA, 16 bp, R. norvegicus
ccagctgcttctgcct

SEQ ID NO: 491324 - DNA, 16 bp, R. norvegicus
ccagctggcctcaaac

SEQ ID NO: 491325 - DNA, 16 bp, R. norvegicus
ccagctgggcatggtg

SEQ ID NO: 491326 - DNA, 16 bp, R. norvegicus
ccagctggtcaggagt

SEQ ID NO: 491327 - DNA, 16 bp, R. norvegicus
ccagctggtttttggt

SEQ ID NO: 491328 - DNA, 18 bp, R. norvegicus
ccagctgtaacagcaaag

SEQ ID NO: 491329 - DNA, 16 bp, R. norvegicus
ccagctgtgcctgaca

SEQ ID NO: 491330 - DNA, 16 bp, R. norvegicus
ccagctgtgtgaccag

SEQ ID NO: 491331 - DNA, 16 bp, R. norvegicus
ccagcttcctgctctg

SEQ ID NO: 491332 - DNA, 16 bp, R. norvegicus
ccagcttccttcttct

SEQ ID NO: 491333 - DNA, 16 bp, R. norvegicus
ccagcttctgcctcca

SEQ ID NO: 491334 - DNA, 16 bp, R. norvegicus
ccagcttctgcctcct

SEQ ID NO: 491335 - DNA, 16 bp, R. norvegicus
ccagcttggctgtgaa

SEQ ID NO: 491336 - DNA, 16 bp, R. norvegicus
ccagcttggtctacac

SEQ ID NO: 491337 - DNA, 16 bp, R. norvegicus
ccagcttgtcccagag

SEQ ID NO: 491338 - DNA, 16 bp, R. norvegicus
ccagcttgtgtcaagc

SEQ ID NO: 491339 - DNA, 16 bp, R. norvegicus
ccaggaaaccaggctg

SEQ ID NO: 491340 - DNA, 16 bp, R. norvegicus
ccaggaaactgggaag

SEQ ID NO: 491341 - DNA, 16 bp, R. norvegicus
ccaggaaagagaaagg

SEQ ID NO: 491342 - DNA, 16 bp, R. norvegicus
ccaggaaagagatcag

SEQ ID NO: 491343 - DNA, 16 bp, R. norvegicus
ccaggaaagccaaggc

SEQ ID NO: 491344 - DNA, 16 bp, R. norvegicus
ccaggaaatccaggac

SEQ ID NO: 491345 - DNA, 16 bp, R. norvegicus
ccaggaaatctggaat

SEQ ID NO: 491346 - DNA, 16 bp, R. norvegicus
ccaggaactctctggt

SEQ ID NO: 491347 - DNA, 16 bp, R. norvegicus
ccaggaactgactgag

SEQ ID NO: 491348 - DNA, 16 bp, R. norvegicus
ccaggaactggtggac

SEQ ID NO: 491349 - DNA, 18 bp, R. norvegicus
ccaggaagacctgtgcct

SEQ ID NO: 491350 - DNA, 16 bp, R. norvegicus
ccaggaagatatgcac

SEQ ID NO: 491351 - DNA, 16 bp, R. norvegicus
ccaggaagcagcagtg

SEQ ID NO: 491352 - DNA, 16 bp, R. norvegicus
ccaggaagcaggagct

SEQ ID NO: 491353 - DNA, 16 bp, R. norvegicus
ccaggaagcagtgttc

SEQ ID NO: 491354 - DNA, 16 bp, R. norvegicus
ccaggaaggcatggtg

SEQ ID NO: 491355 - DNA, 16 bp, R. norvegicus
ccaggaagtccctgaa

SEQ ID NO: 491356 - DNA, 16 bp, R. norvegicus
ccaggaagtgtgtgtc

SEQ ID NO: 491357 - DNA, 16 bp, R. norvegicus
ccaggaatgtgaacag

SEQ ID NO: 491358 - DNA, 16 bp, R. norvegicus
ccaggacagcaagggc

SEQ ID NO: 491359 - DNA, 16 bp, R. norvegicus
ccaggacagccaggag

SEQ ID NO: 491360 - DNA, 16 bp, R. norvegicus
ccaggacagccaggat

SEQ ID NO: 491361 - DNA, 16 bp, R. norvegicus
ccaggacagccaggcc

SEQ ID NO: 491362 - DNA, 16 bp, R. norvegicus
ccaggacagccaggga

SEQ ID NO: 491363 - DNA, 16 bp, R. norvegicus
ccaggacagccgggac

SEQ ID NO: 491364 - DNA, 16 bp, R. norvegicus
ccaggacagcctgggt

SEQ ID NO: 491365 - DNA, 16 bp, R. norvegicus
ccaggacagtgagggc

SEQ ID NO: 491366 - DNA, 16 bp, R. norvegicus
ccaggacagtgaggtg

SEQ ID NO: 491367 - DNA, 16 bp, R. norvegicus
ccaggaccaaggcaag

SEQ ID NO: 491368 - DNA, 16 bp, R. norvegicus
ccaggaccacacagag

SEQ ID NO: 491369 - DNA, 16 bp, R. norvegicus
ccaggaccaccagcca

SEQ ID NO: 491370 - DNA, 16 bp, R. norvegicus
ccaggaccaccaggcc

SEQ ID NO: 491371 - DNA, 16 bp, R. norvegicus
ccaggaccaccaggga

SEQ ID NO: 491372 - DNA, 16 bp, R. norvegicus
ccaggaccaccagggc

SEQ ID NO: 491373 - DNA, 16 bp, R. norvegicus
ccaggaccactgtcag

SEQ ID NO: 491374 - DNA, 16 bp, R. norvegicus
ccaggaccagaggtgg

SEQ ID NO: 491375 - DNA, 16 bp, R. norvegicus
ccaggaccagcagccc

SEQ ID NO: 491376 - DNA, 16 bp, R. norvegicus
ccaggacccaaaaggg

SEQ ID NO: 491377 - DNA, 16 bp, R. norvegicus
ccaggacccaaatggt

SEQ ID NO: 491378 - DNA, 16 bp, R. norvegicus
ccaggacccaatggga

SEQ ID NO: 491379 - DNA, 16 bp, R. norvegicus
ccaggaccccagccca

SEQ ID NO: 491380 - DNA, 16 bp, R. norvegicus
ccaggacctccaggag

SEQ ID NO: 491381 - DNA, 16 bp, R. norvegicus
ccaggactacctgcct

SEQ ID NO: 491382 - DNA, 16 bp, R. norvegicus
ccaggactgcatagag

SEQ ID NO: 491383 - DNA, 16 bp, R. norvegicus
ccaggactgccagggc

SEQ ID NO: 491384 - DNA, 16 bp, R. norvegicus
ccaggagaaagaagtt

SEQ ID NO: 491385 - DNA, 16 bp, R. norvegicus
ccaggagaaagacagg

SEQ ID NO: 491386 - DNA, 16 bp, R. norvegicus
ccaggagaacaaggcc

SEQ ID NO: 491387 - DNA, 16 bp, R. norvegicus
ccaggagaacacagcc

SEQ ID NO: 491388 - DNA, 16 bp, R. norvegicus
ccaggagagccagggc

SEQ ID NO: 491389 - DNA, 16 bp, R. norvegicus
ccaggagagctggccc

SEQ ID NO: 491390 - DNA, 16 bp, R. norvegicus
ccaggagagggcagtg

SEQ ID NO: 491391 - DNA, 16 bp, R. norvegicus
ccaggagatccagctg

SEQ ID NO: 491392 - DNA, 16 bp, R. norvegicus
ccaggagcagaggcag

SEQ ID NO: 491393 - DNA, 16 bp, R. norvegicus
ccaggagcagcagatc

SEQ ID NO: 491394 - DNA, 16 bp, R. norvegicus
ccaggagcagctggag

SEQ ID NO: 491395 - DNA, 16 bp, R. norvegicus
ccaggagctgactcag

SEQ ID NO: 491396 - DNA, 16 bp, R. norvegicus
ccaggagctggaaaaa

SEQ ID NO: 491397 - DNA, 16 bp, R. norvegicus
ccaggagctggggacc

SEQ ID NO: 491398 - DNA, 16 bp, R. norvegicus
ccaggaggaagagaag

SEQ ID NO: 491399 - DNA, 16 bp, R. norvegicus
ccaggaggagaagaag

SEQ ID NO: 491400 - DNA, 16 bp, R. norvegicus
ccaggaggagaggaag

SEQ ID NO: 491401 - DNA, 16 bp, R. norvegicus
ccaggaggagcagaag

SEQ ID NO: 491402 - DNA, 16 bp, R. norvegicus
ccaggaggagggcagt

SEQ ID NO: 491403 - DNA, 16 bp, R. norvegicus
ccaggaggagtaaaag

SEQ ID NO: 491404 - DNA, 16 bp, R. norvegicus
ccaggaggcagaggca

SEQ ID NO: 491405 - DNA, 16 bp, R. norvegicus
ccaggaggccaggagg

SEQ ID NO: 491406 - DNA, 16 bp, R. norvegicus
ccaggaggctctccag

SEQ ID NO: 491407 - DNA, 16 bp, R. norvegicus
ccaggagggggcagtg

SEQ ID NO: 491408 - DNA, 16 bp, R. norvegicus
ccaggaggtggtggtg

SEQ ID NO: 491409 - DNA, 17 bp, R. norvegicus
ccaggagtgctctccct

SEQ ID NO: 491410 - DNA, 16 bp, R. norvegicus
ccaggatagccaagct

SEQ ID NO: 491411 - DNA, 16 bp, R. norvegicus
ccaggatagtgaaaac

SEQ ID NO: 491412 - DNA, 16 bp, R. norvegicus
ccaggatatcattgag

SEQ ID NO: 491413 - DNA, 16 bp, R. norvegicus
ccaggatcccagccag

SEQ ID NO: 491414 - DNA, 16 bp, R. norvegicus
ccaggatcctgtcctg

SEQ ID NO: 491415 - DNA, 16 bp, R. norvegicus
ccaggatctaaaattg

SEQ ID NO: 491416 - DNA, 16 bp, R. norvegicus
ccaggatctacatggt

SEQ ID NO: 491417 - DNA, 16 bp, R. norvegicus
ccaggatcttccagct

SEQ ID NO: 491418 - DNA, 16 bp, R. norvegicus
ccaggatcttctggca

SEQ ID NO: 491419 - DNA, 16 bp, R. norvegicus
ccaggatgaccttgaa

SEQ ID NO: 491420 - DNA, 16 bp, R. norvegicus
ccaggatggcaaaaac

SEQ ID NO: 491421 - DNA, 16 bp, R. norvegicus
ccaggatggcctcaga

SEQ ID NO: 491422 - DNA, 16 bp, R. norvegicus
ccaggattgaactcag

SEQ ID NO: 491423 - DNA, 16 bp, R. norvegicus
ccaggcacacatgtgg

SEQ ID NO: 491424 - DNA, 16 bp, R. norvegicus
ccaggcactgtgctgg

SEQ ID NO: 491425 - DNA, 16 bp, R. norvegicus
ccaggcagacctctgc

SEQ ID NO: 491426 - DNA, 16 bp, R. norvegicus
ccaggcagaggcagag

SEQ ID NO: 491427 - DNA, 16 bp, R. norvegicus
ccaggcagcagacacc

SEQ ID NO: 491428 - DNA, 16 bp, R. norvegicus
ccaggcagccaggagg

SEQ ID NO: 491429 - DNA, 16 bp, R. norvegicus
ccaggcagcctggctg

SEQ ID NO: 491430 - DNA, 16 bp, R. norvegicus
ccaggcaggaacctgg

SEQ ID NO: 491431 - DNA, 16 bp, R. norvegicus
ccaggcaggatttcca

SEQ ID NO: 491432 - DNA, 16 bp, R. norvegicus
ccaggcaggcagagaa

SEQ ID NO: 491433 - DNA, 16 bp, R. norvegicus
ccaggcaggcaggcag

SEQ ID NO: 491434 - DNA, 16 bp, R. norvegicus
ccaggcagggactgag

SEQ ID NO: 491435 - DNA, 16 bp, R. norvegicus
ccaggcaggtcactta

SEQ ID NO: 491436 - DNA, 16 bp, R. norvegicus
ccaggcaggtcacttt

SEQ ID NO: 491437 - DNA, 16 bp, R. norvegicus
ccaggcagtgagctct

SEQ ID NO: 491438 - DNA, 16 bp, R. norvegicus
ccaggcagtggtggcc

SEQ ID NO: 491439 - DNA, 16 bp, R. norvegicus
ccaggcatggtggagc

SEQ ID NO: 491440 - DNA, 16 bp, R. norvegicus
ccaggcatggtggtgc

SEQ ID NO: 491441 - DNA, 16 bp, R. norvegicus
ccaggccaacatcacc

SEQ ID NO: 491442 - DNA, 16 bp, R. norvegicus
ccaggccaacatcctc

SEQ ID NO: 491443 - DNA, 16 bp, R. norvegicus
ccaggccaacatctcc

SEQ ID NO: 491444 - DNA, 16 bp, R. norvegicus
ccaggccacaccttct

SEQ ID NO: 491445 - DNA, 16 bp, R. norvegicus
ccaggccagccaagac

SEQ ID NO: 491446 - DNA, 16 bp, R. norvegicus
ccaggccagccaggat

SEQ ID NO: 491447 - DNA, 16 bp, R. norvegicus
ccaggccagccaggcc

SEQ ID NO: 491448 - DNA, 16 bp, R. norvegicus
ccaggccagcctaggc

SEQ ID NO: 491449 - DNA, 16 bp, R. norvegicus
ccaggccagcctgagc

SEQ ID NO: 491450 - DNA, 16 bp, R. norvegicus
ccaggccagcctgggg

SEQ ID NO: 491451 - DNA, 16 bp, R. norvegicus
ccaggccagcctgtgc

SEQ ID NO: 491452 - DNA, 16 bp, R. norvegicus
ccaggccaggctgggc

SEQ ID NO: 491453 - DNA, 16 bp, R. norvegicus
ccaggccatcctctgc

SEQ ID NO: 491454 - DNA, 16 bp, R. norvegicus
ccaggccatcctgggc

SEQ ID NO: 491455 - DNA, 16 bp, R. norvegicus
ccaggcccacctgccc

SEQ ID NO: 491456 - DNA, 16 bp, R. norvegicus
ccaggcccagccccag

SEQ ID NO: 491457 - DNA, 16 bp, R. norvegicus
ccaggcccagtggctc

SEQ ID NO: 491458 - DNA, 16 bp, R. norvegicus
ccaggccctccctgag

SEQ ID NO: 491459 - DNA, 16 bp, R. norvegicus
ccaggccctcctggtt

SEQ ID NO: 491460 - DNA, 16 bp, R. norvegicus
ccaggccctgggctgg

SEQ ID NO: 491461 - DNA, 16 bp, R. norvegicus
ccaggcctacacagag

SEQ ID NO: 491462 - DNA, 16 bp, R. norvegicus
ccaggcctcagcctcg

SEQ ID NO: 491463 - DNA, 16 bp, R. norvegicus
ccaggcctctgctgaa

SEQ ID NO: 491464 - DNA, 16 bp, R. norvegicus
ccaggcctgcctgcct

SEQ ID NO: 491465 - DNA, 16 bp, R. norvegicus
ccaggcctgcctggac

SEQ ID NO: 491466 - DNA, 16 bp, R. norvegicus
ccaggccttgggggcc

SEQ ID NO: 491467 - DNA, 25 bp, R. norvegicus
ccaggcggttgggtctctctctcac

SEQ ID NO: 491468 - DNA, 16 bp, R. norvegicus
ccaggctacacagtga

SEQ ID NO: 491469 - DNA, 16 bp, R. norvegicus
ccaggctcagaaagaa

SEQ ID NO: 491470 - DNA, 16 bp, R. norvegicus
ccaggctcagaaagag

SEQ ID NO: 491471 - DNA, 16 bp, R. norvegicus
ccaggctcctgtctac

SEQ ID NO: 491472 - DNA, 16 bp, R. norvegicus
ccaggctgacctgaac

SEQ ID NO: 491473 - DNA, 16 bp, R. norvegicus
ccaggctgagctcaaa

SEQ ID NO: 491474 - DNA, 16 bp, R. norvegicus
ccaggctgaggtggag

SEQ ID NO: 491475 - DNA, 16 bp, R. norvegicus
ccaggctgcctgggat

SEQ ID NO: 491476 - DNA, 16 bp, R. norvegicus
ccaggctggccccaga

SEQ ID NO: 491477 - DNA, 16 bp, R. norvegicus
ccaggctggcccccaa

SEQ ID NO: 491478 - DNA, 16 bp, R. norvegicus
ccaggctggcctggaa

SEQ ID NO: 491479 - DNA, 16 bp, R. norvegicus
ccaggctggctctgaa

SEQ ID NO: 491480 - DNA, 16 bp, R. norvegicus
ccaggctggtcttcaa

SEQ ID NO: 491481 - DNA, 16 bp, R. norvegicus
ccaggctggtcttgga

SEQ ID NO: 491482 - DNA, 16 bp, R. norvegicus
ccaggctgtcttcaaa

SEQ ID NO: 491483 - DNA, 16 bp, R. norvegicus
ccaggcttctctgcct

SEQ ID NO: 491484 - DNA, 16 bp, R. norvegicus
ccagggaagcaagagg

SEQ ID NO: 491485 - DNA, 16 bp, R. norvegicus
ccagggaagcagggat

SEQ ID NO: 491486 - DNA, 16 bp, R. norvegicus
ccagggaagcaggtag

SEQ ID NO: 491487 - DNA, 16 bp, R. norvegicus
ccagggaagtcagggc

SEQ ID NO: 491488 - DNA, 16 bp, R. norvegicus
ccagggacaaagccac

SEQ ID NO: 491489 - DNA, 16 bp, R. norvegicus
ccagggacagcatcac

SEQ ID NO: 491490 - DNA, 16 bp, R. norvegicus
ccagggaccaagccac

SEQ ID NO: 491491 - DNA, 16 bp, R. norvegicus
ccagggacccacctgt

SEQ ID NO: 491492 - DNA, 16 bp, R. norvegicus
ccagggacctccagga

SEQ ID NO: 491493 - DNA, 16 bp, R. norvegicus
ccagggacctgcctgt

SEQ ID NO: 491494 - DNA, 16 bp, R. norvegicus
ccagggacctgtggga

SEQ ID NO: 491495 - DNA, 16 bp, R. norvegicus
ccagggactaaaccac

SEQ ID NO: 491496 - DNA, 16 bp, R. norvegicus
ccagggactgaattca

SEQ ID NO: 491497 - DNA, 16 bp, R. norvegicus
ccagggagctccaggg

SEQ ID NO: 491498 - DNA, 16 bp, R. norvegicus
ccagggaggagctggg

SEQ ID NO: 491499 - DNA, 16 bp, R. norvegicus
ccagggaggcagagac

SEQ ID NO: 491500 - DNA, 16 bp, R. norvegicus
ccagggaggtggctca

SEQ ID NO: 491501 - DNA, 16 bp, R. norvegicus
ccagggagtggaatgt

SEQ ID NO: 491502 - DNA, 16 bp, R. norvegicus
ccagggatatcaactg

SEQ ID NO: 491503 - DNA, 16 bp, R. norvegicus
ccagggatgagccccc

SEQ ID NO: 491504 - DNA, 16 bp, R. norvegicus
ccagggatggcaacac

SEQ ID NO: 491505 - DNA, 16 bp, R. norvegicus
ccagggatggcaccac

SEQ ID NO: 491506 - DNA, 16 bp, R. norvegicus
ccagggatgtggccag

SEQ ID NO: 491507 - DNA, 16 bp, R. norvegicus
ccagggcagccagaga

SEQ ID NO: 491508 - DNA, 16 bp, R. norvegicus
ccagggcaggagtgag

SEQ ID NO: 491509 - DNA, 16 bp, R. norvegicus
ccagggcagggaggct

SEQ ID NO: 491510 - DNA, 16 bp, R. norvegicus
ccagggcatccaagag

SEQ ID NO: 491511 - DNA, 16 bp, R. norvegicus
ccagggcatccccttc

SEQ ID NO: 491512 - DNA, 16 bp, R. norvegicus
ccagggccagctctgc

SEQ ID NO: 491513 - DNA, 16 bp, R. norvegicus
ccagggccttgcagtt

SEQ ID NO: 491514 - DNA, 16 bp, R. norvegicus
ccagggccttgtgcat

SEQ ID NO: 491515 - DNA, 16 bp, R. norvegicus
ccagggctacacaatg

SEQ ID NO: 491516 - DNA, 16 bp, R. norvegicus
ccagggctacacagaa

SEQ ID NO: 491517 - DNA, 16 bp, R. norvegicus
ccagggctacacggtg

SEQ ID NO: 491518 - DNA, 16 bp, R. norvegicus
ccagggctagacagag

SEQ ID NO: 491519 - DNA, 16 bp, R. norvegicus
ccagggctcaggaggc

SEQ ID NO: 491520 - DNA, 16 bp, R. norvegicus
ccagggctccaacttc

SEQ ID NO: 491521 - DNA, 16 bp, R. norvegicus
ccagggctcccaggga

SEQ ID NO: 491522 - DNA, 16 bp, R. norvegicus
ccagggctggagagat

SEQ ID NO: 491523 - DNA, 16 bp, R. norvegicus
ccagggctgtatggag

SEQ ID NO: 491524 - DNA, 16 bp, R. norvegicus
ccagggcttcatgcac

SEQ ID NO: 491525 - DNA, 16 bp, R. norvegicus
ccagggcttccccttt

SEQ ID NO: 491526 - DNA, 16 bp, R. norvegicus
ccagggcttctcctcc

SEQ ID NO: 491527 - DNA, 16 bp, R. norvegicus
ccagggcttgctcagc

SEQ ID NO: 491528 - DNA, 16 bp, R. norvegicus
ccagggcttgctgtgg

SEQ ID NO: 491529 - DNA, 16 bp, R. norvegicus
ccagggcttgctgtgt

SEQ ID NO: 491530 - DNA, 16 bp, R. norvegicus
ccaggggaaatggcag

SEQ ID NO: 491531 - DNA, 16 bp, R. norvegicus
ccaggggcctcagacc

SEQ ID NO: 491532 - DNA, 16 bp, R. norvegicus
ccaggggctctgacac

SEQ ID NO: 491533 - DNA, 16 bp, R. norvegicus
ccagggtgacacagag

SEQ ID NO: 491534 - DNA, 16 bp, R. norvegicus
ccagggtgggttgata

SEQ ID NO: 491535 - DNA, 16 bp, R. norvegicus
ccaggtaaacacagga

SEQ ID NO: 491536 - DNA, 18 bp, R. norvegicus
ccaggtagaaaatatctg

SEQ ID NO: 491537 - DNA, 16 bp, R. norvegicus
ccaggtagctgggacc

SEQ ID NO: 491538 - DNA, 16 bp, R. norvegicus
ccaggtatggtggcac

SEQ ID NO: 491539 - DNA, 16 bp, R. norvegicus
ccaggtcagaaacctg

SEQ ID NO: 491540 - DNA, 16 bp, R. norvegicus
ccaggtcatcctcagc

SEQ ID NO: 491541 - DNA, 16 bp, R. norvegicus
ccaggtccactttgat

SEQ ID NO: 491542 - DNA, 16 bp, R. norvegicus
ccaggtccagacggtt

SEQ ID NO: 491543 - DNA, 16 bp, R. norvegicus
ccaggtccaggagatc

SEQ ID NO: 491544 - DNA, 16 bp, R. norvegicus
ccaggtccagggcatc

SEQ ID NO: 491545 - DNA, 16 bp, R. norvegicus
ccaggtcccaggagga

SEQ ID NO: 491546 - DNA, 16 bp, R. norvegicus
ccaggtctctggtata

SEQ ID NO: 491547 - DNA, 16 bp, R. norvegicus
ccaggtctttggcaag

SEQ ID NO: 491548 - DNA, 16 bp, R. norvegicus
ccaggtgctgctggga

SEQ ID NO: 491549 - DNA, 16 bp, R. norvegicus
ccaggtggagagattt

SEQ ID NO: 491550 - DNA, 17 bp, R. norvegicus
ccaggtggcctgtgagt

SEQ ID NO: 491551 - DNA, 16 bp, R. norvegicus
ccaggtggggcagact

SEQ ID NO: 491552 - DNA, 16 bp, R. norvegicus
ccaggtgtggcagtgc

SEQ ID NO: 491553 - DNA, 16 bp, R. norvegicus
ccaggttcaatcccag

SEQ ID NO: 491554 - DNA, 16 bp, R. norvegicus
ccaggttcactgagag

SEQ ID NO: 491555 - DNA, 16 bp, R. norvegicus
ccaggttccagcttcc

SEQ ID NO: 491556 - DNA, 16 bp, R. norvegicus
ccaggttcccaccctg

SEQ ID NO: 491557 - DNA, 16 bp, R. norvegicus
ccaggttcctgcccta

SEQ ID NO: 491558 - DNA, 16 bp, R. norvegicus
ccaggttcctgtcctg

SEQ ID NO: 491559 - DNA, 16 bp, R. norvegicus
ccaggttctctggaaa

SEQ ID NO: 491560 - DNA, 16 bp, R. norvegicus
ccaggttctgcagtgg

SEQ ID NO: 491561 - DNA, 16 bp, R. norvegicus
ccaggttggcttcaaa

SEQ ID NO: 491562 - DNA, 16 bp, R. norvegicus
ccaggtttccaggcaa

SEQ ID NO: 491563 - DNA, 16 bp, R. norvegicus
ccaggtttgattctca

SEQ ID NO: 491564 - DNA, 16 bp, R. norvegicus
ccaggttttcaagttt

SEQ ID NO: 491565 - DNA, 16 bp, R. norvegicus
ccagtaagcagtgtcc

SEQ ID NO: 491566 - DNA, 16 bp, R. norvegicus
ccagtaccatgctgtt

SEQ ID NO: 491567 - DNA, 16 bp, R. norvegicus
ccagtaccctcttctg

SEQ ID NO: 491568 - DNA, 16 bp, R. norvegicus
ccagtacctgcagttc

SEQ ID NO: 491569 - DNA, 16 bp, R. norvegicus
ccagtactcaggaggc

SEQ ID NO: 491570 - DNA, 16 bp, R. norvegicus
ccagtagcagcagcag

SEQ ID NO: 491571 - DNA, 16 bp, R. norvegicus
ccagtagccaagatca

SEQ ID NO: 491572 - DNA, 16 bp, R. norvegicus
ccagtaggaggacaag

SEQ ID NO: 491573 - DNA, 16 bp, R. norvegicus
ccagtaggcaggaaag

SEQ ID NO: 491574 - DNA, 16 bp, R. norvegicus
ccagtataaggaaatg

SEQ ID NO: 491575 - DNA, 16 bp, R. norvegicus
ccagtatctctatggc

SEQ ID NO: 491576 - DNA, 20 bp, R. norvegicus
ccagtatgaaaatccgtgta

SEQ ID NO: 491577 - DNA, 16 bp, R. norvegicus
ccagtcacagaagaac

SEQ ID NO: 491578 - DNA, 16 bp, R. norvegicus
ccagtcaccaggagca

SEQ ID NO: 491579 - DNA, 16 bp, R. norvegicus
ccagtcaccaggagtg

SEQ ID NO: 491580 - DNA, 16 bp, R. norvegicus
ccagtcactttgctga

SEQ ID NO: 491581 - DNA, 16 bp, R. norvegicus
ccagtcagaatgactg

SEQ ID NO: 491582 - DNA, 16 bp, R. norvegicus
ccagtcagaggcagca

SEQ ID NO: 491583 - DNA, 16 bp, R. norvegicus
ccagtcagctccagga

SEQ ID NO: 491584 - DNA, 16 bp, R. norvegicus
ccagtccagggatggt

SEQ ID NO: 491585 - DNA, 16 bp, R. norvegicus
ccagtcccacccttac

SEQ ID NO: 491586 - DNA, 16 bp, R. norvegicus
ccagtcccaggagatc

SEQ ID NO: 491587 - DNA, 16 bp, R. norvegicus
ccagtcctcctcctcc

SEQ ID NO: 491588 - DNA, 16 bp, R. norvegicus
ccagtcctctcagcag

SEQ ID NO: 491589 - DNA, 16 bp, R. norvegicus
ccagtcctgaggacac

SEQ ID NO: 491590 - DNA, 16 bp, R. norvegicus
ccagtccttcctctga

SEQ ID NO: 491591 - DNA, 16 bp, R. norvegicus
ccagtctcagggaatc

SEQ ID NO: 491592 - DNA, 16 bp, R. norvegicus
ccagtctcatccccag

SEQ ID NO: 491593 - DNA, 16 bp, R. norvegicus
ccagtctcccagatca

SEQ ID NO: 491594 - DNA, 16 bp, R. norvegicus
ccagtctctgcctccc

SEQ ID NO: 491595 - DNA, 16 bp, R. norvegicus
ccagtctgaccttgaa

SEQ ID NO: 491596 - DNA, 16 bp, R. norvegicus
ccagtctgcaatgcca

SEQ ID NO: 491597 - DNA, 16 bp, R. norvegicus
ccagtctggctttgaa

SEQ ID NO: 491598 - DNA, 18 bp, R. norvegicus
ccagtgaacgtgattgtt

SEQ ID NO: 491599 - DNA, 16 bp, R. norvegicus
ccagtgaactagactt

SEQ ID NO: 491600 - DNA, 16 bp, R. norvegicus
ccagtgaagaggaatg

SEQ ID NO: 491601 - DNA, 16 bp, R. norvegicus
ccagtgaagggctggg

SEQ ID NO: 491602 - DNA, 16 bp, R. norvegicus
ccagtgaaggggaagc

SEQ ID NO: 491603 - DNA, 16 bp, R. norvegicus
ccagtgacaagcccaa

SEQ ID NO: 491604 - DNA, 16 bp, R. norvegicus
ccagtgacacacttcc

SEQ ID NO: 491605 - DNA, 16 bp, R. norvegicus
ccagtgacctcttctg

SEQ ID NO: 491606 - DNA, 16 bp, R. norvegicus
ccagtgagccccaggg

SEQ ID NO: 491607 - DNA, 16 bp, R. norvegicus
ccagtgaggagctggg

SEQ ID NO: 491608 - DNA, 16 bp, R. norvegicus
ccagtgcagccagaag

SEQ ID NO: 491609 - DNA, 16 bp, R. norvegicus
ccagtgccagtgccag

SEQ ID NO: 491610 - DNA, 16 bp, R. norvegicus
ccagtgccatcttgtg

SEQ ID NO: 491611 - DNA, 16 bp, R. norvegicus
ccagtgcccatggagg

SEQ ID NO: 491612 - DNA, 16 bp, R. norvegicus
ccagtgcccatgtggt

SEQ ID NO: 491613 - DNA, 16 bp, R. norvegicus
ccagtgccctgagcag

SEQ ID NO: 491614 - DNA, 16 bp, R. norvegicus
ccagtgctcaggaggc

SEQ ID NO: 491615 - DNA, 16 bp, R. norvegicus
ccagtgctcttaactg

SEQ ID NO: 491616 - DNA, 16 bp, R. norvegicus
ccagtgctggggaagt

SEQ ID NO: 491617 - DNA, 16 bp, R. norvegicus
ccagtgctggggagac

SEQ ID NO: 491618 - DNA, 16 bp, R. norvegicus
ccagtgctggggaggt

SEQ ID NO: 491619 - DNA, 16 bp, R. norvegicus
ccagtggaaaccacag

SEQ ID NO: 491620 - DNA, 16 bp, R. norvegicus
ccagtggaaagagaag

SEQ ID NO: 491621 - DNA, 16 bp, R. norvegicus
ccagtggaggccagag

SEQ ID NO: 491622 - DNA, 16 bp, R. norvegicus
ccagtggatgcaggga

SEQ ID NO: 491623 - DNA, 16 bp, R. norvegicus
ccagtggcctctcctg

SEQ ID NO: 491624 - DNA, 16 bp, R. norvegicus
ccagtgggaaaaaaag

SEQ ID NO: 491625 - DNA, 16 bp, R. norvegicus
ccagtgggcacagttg

SEQ ID NO: 491626 - DNA, 16 bp, R. norvegicus
ccagtgggcatatctt

SEQ ID NO: 491627 - DNA, 16 bp, R. norvegicus
ccagtgggccaatatc

SEQ ID NO: 491628 - DNA, 16 bp, R. norvegicus
ccagtgggccacatgg

SEQ ID NO: 491629 - DNA, 16 bp, R. norvegicus
ccagtgtaggggaacg

SEQ ID NO: 491630 - DNA, 16 bp, R. norvegicus
ccagtgtctcacagac

SEQ ID NO: 491631 - DNA, 16 bp, R. norvegicus
ccagtgtctccagcca

SEQ ID NO: 491632 - DNA, 16 bp, R. norvegicus
ccagtgtctccagctg

SEQ ID NO: 491633 - DNA, 16 bp, R. norvegicus
ccagtgtgaagacaga

SEQ ID NO: 491634 - DNA, 16 bp, R. norvegicus
ccagtgtgaatgctct

SEQ ID NO: 491635 - DNA, 16 bp, R. norvegicus
ccagtgtgaccatgca

SEQ ID NO: 491636 - DNA, 16 bp, R. norvegicus
ccagtgtggctgcttt

SEQ ID NO: 491637 - DNA, 16 bp, R. norvegicus
ccagtgtgtgaatatc

SEQ ID NO: 491638 - DNA, 16 bp, R. norvegicus
ccagtgtttgtcttgt

SEQ ID NO: 491639 - DNA, 16 bp, R. norvegicus
ccagttaccaaagtta

SEQ ID NO: 491640 - DNA, 16 bp, R. norvegicus
ccagttattcaggacc

SEQ ID NO: 491641 - DNA, 37 bp, R. norvegicus
ccagttattcagggtcccgaagaggctttctacctgt

SEQ ID NO: 491642 - DNA, 16 bp, R. norvegicus
ccagttcagctctggg

SEQ ID NO: 491643 - DNA, 16 bp, R. norvegicus
ccagttcattccattt

SEQ ID NO: 491644 - DNA, 16 bp, R. norvegicus
ccagttccaaggcatc

SEQ ID NO: 491645 - DNA, 16 bp, R. norvegicus
ccagttccagaaaatc

SEQ ID NO: 491646 - DNA, 16 bp, R. norvegicus
ccagttccagaagatc

SEQ ID NO: 491647 - DNA, 16 bp, R. norvegicus
ccagttccagagtatc

SEQ ID NO: 491648 - DNA, 16 bp, R. norvegicus
ccagttccaggagatg

SEQ ID NO: 491649 - DNA, 16 bp, R. norvegicus
ccagttccaggagatt

SEQ ID NO: 491650 - DNA, 16 bp, R. norvegicus
ccagttccagggcacc

SEQ ID NO: 491651 - DNA, 16 bp, R. norvegicus
ccagttcccagggatc

SEQ ID NO: 491652 - DNA, 16 bp, R. norvegicus
ccagttcctcctcctc

SEQ ID NO: 491653 - DNA, 16 bp, R. norvegicus
ccagttctacctctct

SEQ ID NO: 491654 - DNA, 16 bp, R. norvegicus
ccagttcttcagagag

SEQ ID NO: 491655 - DNA, 16 bp, R. norvegicus
ccagttctttgagaaa

SEQ ID NO: 491656 - DNA, 16 bp, R. norvegicus
ccagttgaaccagcac

SEQ ID NO: 491657 - DNA, 16 bp, R. norvegicus
ccagttgagaactctg

SEQ ID NO: 491658 - DNA, 16 bp, R. norvegicus
ccagttggcagaggaa

SEQ ID NO: 491659 - DNA, 16 bp, R. norvegicus
ccagttggctttgatt

SEQ ID NO: 491660 - DNA, 16 bp, R. norvegicus
ccagttggtggcactg

SEQ ID NO: 491661 - DNA, 16 bp, R. norvegicus
ccagttgtcccaccaa

SEQ ID NO: 491662 - DNA, 16 bp, R. norvegicus
ccagttgtccctcaac

SEQ ID NO: 491663 - DNA, 16 bp, R. norvegicus
ccagttgtctctccca

SEQ ID NO: 491664 - DNA, 16 bp, R. norvegicus
ccagttgtggtgtcag

SEQ ID NO: 491665 - DNA, 16 bp, R. norvegicus
ccagttgttggaggac

SEQ ID NO: 491666 - DNA, 16 bp, R. norvegicus
ccagtttcagaggatc

SEQ ID NO: 491667 - DNA, 16 bp, R. norvegicus
ccagtttccaggacaa

SEQ ID NO: 491668 - DNA, 16 bp, R. norvegicus
ccagtttccatctgtg

SEQ ID NO: 491669 - DNA, 16 bp, R. norvegicus
ccagtttcccagacat

SEQ ID NO: 491670 - DNA, 16 bp, R. norvegicus
ccagtttcctccttcc

SEQ ID NO: 491671 - DNA, 16 bp, R. norvegicus
ccagtttcctgtgcat

SEQ ID NO: 491672 - DNA, 16 bp, R. norvegicus
ccagtttctgcctgct

SEQ ID NO: 491673 - DNA, 16 bp, R. norvegicus
ccagtttctgcctgtg

SEQ ID NO: 491674 - DNA, 16 bp, R. norvegicus
ccagtttctggttttg

SEQ ID NO: 491675 - DNA, 16 bp, R. norvegicus
ccagtttcttttggag

SEQ ID NO: 491676 - DNA, 16 bp, R. norvegicus
ccagtttgctaatctg

SEQ ID NO: 491677 - DNA, 16 bp, R. norvegicus
ccagtttgcttttggt

SEQ ID NO: 491678 - DNA, 16 bp, R. norvegicus
ccagtttggccttgaa

SEQ ID NO: 491679 - DNA, 16 bp, R. norvegicus
ccagttttagatcctg

SEQ ID NO: 491680 - DNA, 16 bp, R. norvegicus
ccataaaaatcattga

SEQ ID NO: 491681 - DNA, 16 bp, R. norvegicus
ccataaaattatttct

SEQ ID NO: 491682 - DNA, 16 bp, R. norvegicus
ccataaatatgtacaa

SEQ ID NO: 491683 - DNA, 16 bp, R. norvegicus
ccataactaaacataa

SEQ ID NO: 491684 - DNA, 16 bp, R. norvegicus
ccataagccattggtg

SEQ ID NO: 491685 - DNA, 16 bp, R. norvegicus
ccatacacactcaaac

SEQ ID NO: 491686 - DNA, 16 bp, R. norvegicus
ccatacattttatatt

SEQ ID NO: 491687 - DNA, 16 bp, R. norvegicus
ccataccttggttgtt

SEQ ID NO: 491688 - DNA, 16 bp, R. norvegicus
ccatagaaaatatcga

SEQ ID NO: 491689 - DNA, 16 bp, R. norvegicus
ccatagaaatcagtga

SEQ ID NO: 491690 - DNA, 16 bp, R. norvegicus
ccatagacagggacat

SEQ ID NO: 491691 - DNA, 16 bp, R. norvegicus
ccatagagaagagaca

SEQ ID NO: 491692 - DNA, 16 bp, R. norvegicus
ccatagagaagaggag

SEQ ID NO: 491693 - DNA, 16 bp, R. norvegicus
ccatagcttctgcttc

SEQ ID NO: 491694 - DNA, 16 bp, R. norvegicus
ccataggcatataaga

SEQ ID NO: 491695 - DNA, 16 bp, R. norvegicus
ccatataaaaagctgg

SEQ ID NO: 491696 - DNA, 16 bp, R. norvegicus
ccatataaaaccagac

SEQ ID NO: 491697 - DNA, 16 bp, R. norvegicus
ccatatacacaaaata

SEQ ID NO: 491698 - DNA, 16 bp, R. norvegicus
ccatatctccagccct

SEQ ID NO: 491699 - DNA, 16 bp, R. norvegicus
ccatatgaaggtcaag

SEQ ID NO: 491700 - DNA, 16 bp, R. norvegicus
ccatatggcagcttac

SEQ ID NO: 491701 - DNA, 16 bp, R. norvegicus
ccatatgggtatttcc

SEQ ID NO: 491702 - DNA, 16 bp, R. norvegicus
ccatatttcctgtatc

SEQ ID NO: 491703 - DNA, 16 bp, R. norvegicus
ccatcaaaactccaat

SEQ ID NO: 491704 - DNA, 16 bp, R. norvegicus
ccatcaaaatcccaat

SEQ ID NO: 491705 - DNA, 16 bp, R. norvegicus
ccatcaaccagagagc

SEQ ID NO: 491706 - DNA, 16 bp, R. norvegicus
ccatcaacctgatcca

SEQ ID NO: 491707 - DNA, 16 bp, R. norvegicus
ccatcaagcagctgaa

SEQ ID NO: 491708 - DNA, 16 bp, R. norvegicus
ccatcaatcctttctc

SEQ ID NO: 491709 - DNA, 16 bp, R. norvegicus
ccatcaatggacagat

SEQ ID NO: 491710 - DNA, 16 bp, R. norvegicus
ccatcaccacccagct

SEQ ID NO: 491711 - DNA, 16 bp, R. norvegicus
ccatcaccatcaccat

SEQ ID NO: 491712 - DNA, 16 bp, R. norvegicus
ccatcaccatcatcac

SEQ ID NO: 491713 - DNA, 16 bp, R. norvegicus
ccatcaccatcctcca

SEQ ID NO: 491714 - DNA, 16 bp, R. norvegicus
ccatcaccatcttcca

SEQ ID NO: 491715 - DNA, 16 bp, R. norvegicus
ccatcactccagccct

SEQ ID NO: 491716 - DNA, 16 bp, R. norvegicus
ccatcactgaaggaac

SEQ ID NO: 491717 - DNA, 16 bp, R. norvegicus
ccatcactgacttcaa

SEQ ID NO: 491718 - DNA, 16 bp, R. norvegicus
ccatcactgagagaag

SEQ ID NO: 491719 - DNA, 16 bp, R. norvegicus
ccatcactgcccagct

SEQ ID NO: 491720 - DNA, 16 bp, R. norvegicus
ccatcactgcggtatc

SEQ ID NO: 491721 - DNA, 16 bp, R. norvegicus
ccatcactgtggggaa

SEQ ID NO: 491722 - DNA, 16 bp, R. norvegicus
ccatcagctggggacc

SEQ ID NO: 491723 - DNA, 16 bp, R. norvegicus
ccatcaggaaaatgca

SEQ ID NO: 491724 - DNA, 16 bp, R. norvegicus
ccatcagtgttctgtt

SEQ ID NO: 491725 - DNA, 16 bp, R. norvegicus
ccatcatagacacact

SEQ ID NO: 491726 - DNA, 16 bp, R. norvegicus
ccatcatcaccactac

SEQ ID NO: 491727 - DNA, 16 bp, R. norvegicus
ccatcatcatcaagta

SEQ ID NO: 491728 - DNA, 16 bp, R. norvegicus
ccatcatcatcaccat

SEQ ID NO: 491729 - DNA, 16 bp, R. norvegicus
ccatcatcctggccag

SEQ ID NO: 491730 - DNA, 16 bp, R. norvegicus
ccatcatctgcagaca

SEQ ID NO: 491731 - DNA, 16 bp, R. norvegicus
ccatcatgatcacgta

SEQ ID NO: 491732 - DNA, 16 bp, R. norvegicus
ccatcatggaaatgca

SEQ ID NO: 491733 - DNA, 16 bp, R. norvegicus
ccatcatggcggggaa

SEQ ID NO: 491734 - DNA, 16 bp, R. norvegicus
ccatcatggtggagaa

SEQ ID NO: 491735 - DNA, 17 bp, R. norvegicus
ccatccaaaaagagccc

SEQ ID NO: 491736 - DNA, 16 bp, R. norvegicus
ccatccacacagccat

SEQ ID NO: 491737 - DNA, 16 bp, R. norvegicus
ccatccacccatcatc

SEQ ID NO: 491738 - DNA, 16 bp, R. norvegicus
ccatccactcattcat

SEQ ID NO: 491739 - DNA, 16 bp, R. norvegicus
ccatccagagattgtc

SEQ ID NO: 491740 - DNA, 16 bp, R. norvegicus
ccatccaggaaaatga

SEQ ID NO: 491741 - DNA, 16 bp, R. norvegicus
ccatccagtggaagaa

SEQ ID NO: 491742 - DNA, 16 bp, R. norvegicus
ccatccatccttccat

SEQ ID NO: 491743 - DNA, 16 bp, R. norvegicus
ccatccatctgcctgc

SEQ ID NO: 491744 - DNA, 16 bp, R. norvegicus
ccatccatctgtctgc

SEQ ID NO: 491745 - DNA, 16 bp, R. norvegicus
ccatccatgacctcaa

SEQ ID NO: 491746 - DNA, 16 bp, R. norvegicus
ccatcccaacatctac

SEQ ID NO: 491747 - DNA, 16 bp, R. norvegicus
ccatcccaccagcaat

SEQ ID NO: 491748 - DNA, 16 bp, R. norvegicus
ccatcccagcaccaca

SEQ ID NO: 491749 - DNA, 16 bp, R. norvegicus
ccatcccagcatccct

SEQ ID NO: 491750 - DNA, 16 bp, R. norvegicus
ccatcccagcctactg

SEQ ID NO: 491751 - DNA, 16 bp, R. norvegicus
ccatcccaggtctctg

SEQ ID NO: 491752 - DNA, 17 bp, R. norvegicus
ccatccccacctgcatc

SEQ ID NO: 491753 - DNA, 16 bp, R. norvegicus
ccatccccagctctcc

SEQ ID NO: 491754 - DNA, 16 bp, R. norvegicus
ccatccccgggctggt

SEQ ID NO: 491755 - DNA, 16 bp, R. norvegicus
ccatcccctttggctc

SEQ ID NO: 491756 - DNA, 16 bp, R. norvegicus
ccatccctcaacctgg

SEQ ID NO: 491757 - DNA, 16 bp, R. norvegicus
ccatccctccactgag

SEQ ID NO: 491758 - DNA, 16 bp, R. norvegicus
ccatccctgacctcca

SEQ ID NO: 491759 - DNA, 16 bp, R. norvegicus
ccatccctgatgtgct

SEQ ID NO: 491760 - DNA, 16 bp, R. norvegicus
ccatccctgcatactt

SEQ ID NO: 491761 - DNA, 16 bp, R. norvegicus
ccatccctggactgga

SEQ ID NO: 491762 - DNA, 16 bp, R. norvegicus
ccatccgtccatctgt

SEQ ID NO: 491763 - DNA, 16 bp, R. norvegicus
ccatcctctactacat

SEQ ID NO: 491764 - DNA, 16 bp, R. norvegicus
ccatcctctactcaaa

SEQ ID NO: 491765 - DNA, 16 bp, R. norvegicus
ccatcctctgctccat

SEQ ID NO: 491766 - DNA, 16 bp, R. norvegicus
ccatcctgaatgtggg

SEQ ID NO: 491767 - DNA, 16 bp, R. norvegicus
ccatcctgcagcagct

SEQ ID NO: 491768 - DNA, 16 bp, R. norvegicus
ccatcctgccagcccc

SEQ ID NO: 491769 - DNA, 16 bp, R. norvegicus
ccatcctggaaatcag

SEQ ID NO: 491770 - DNA, 16 bp, R. norvegicus
ccatccttctcatcca

SEQ ID NO: 491771 - DNA, 16 bp, R. norvegicus
ccatctactcctcctg

SEQ ID NO: 491772 - DNA, 16 bp, R. norvegicus
ccatctactttctgac

SEQ ID NO: 491773 - DNA, 16 bp, R. norvegicus
ccatctatgttgattg

SEQ ID NO: 491774 - DNA, 16 bp, R. norvegicus
ccatctccactgtgtc

SEQ ID NO: 491775 - DNA, 16 bp, R. norvegicus
ccatctccagcccctc

SEQ ID NO: 491776 - DNA, 16 bp, R. norvegicus
ccatctccaggaggat

SEQ ID NO: 491777 - DNA, 16 bp, R. norvegicus
ccatctccatctctgt

SEQ ID NO: 491778 - DNA, 16 bp, R. norvegicus
ccatctcccagccctg

SEQ ID NO: 491779 - DNA, 16 bp, R. norvegicus
ccatctccccagccct

SEQ ID NO: 491780 - DNA, 16 bp, R. norvegicus
ccatctccccaggtcc

SEQ ID NO: 491781 - DNA, 16 bp, R. norvegicus
ccatctccctgcccag

SEQ ID NO: 491782 - DNA, 16 bp, R. norvegicus
ccatctccctgccctg

SEQ ID NO: 491783 - DNA, 16 bp, R. norvegicus
ccatctccctgcttct

SEQ ID NO: 491784 - DNA, 16 bp, R. norvegicus
ccatctccctggccct

SEQ ID NO: 491785 - DNA, 16 bp, R. norvegicus
ccatctcctcagctcc

SEQ ID NO: 491786 - DNA, 16 bp, R. norvegicus
ccatctcgggctgaga

SEQ ID NO: 491787 - DNA, 16 bp, R. norvegicus
ccatctctccaagccc

SEQ ID NO: 491788 - DNA, 16 bp, R. norvegicus
ccatctctccaccctg

SEQ ID NO: 491789 - DNA, 16 bp, R. norvegicus
ccatctctccagacct

SEQ ID NO: 491790 - DNA, 16 bp, R. norvegicus
ccatctctccagcttt

SEQ ID NO: 491791 - DNA, 16 bp, R. norvegicus
ccatctctccagtccc

SEQ ID NO: 491792 - DNA, 16 bp, R. norvegicus
ccatctctcccagccc

SEQ ID NO: 491793 - DNA, 16 bp, R. norvegicus
ccatctctcctgctcc

SEQ ID NO: 491794 - DNA, 16 bp, R. norvegicus
ccatctctctggccac

SEQ ID NO: 491795 - DNA, 16 bp, R. norvegicus
ccatctctctggcccc

SEQ ID NO: 491796 - DNA, 16 bp, R. norvegicus
ccatctctgacctcaa

SEQ ID NO: 491797 - DNA, 16 bp, R. norvegicus
ccatctctgccaccat

SEQ ID NO: 491798 - DNA, 16 bp, R. norvegicus
ccatctcttcagccca

SEQ ID NO: 491799 - DNA, 16 bp, R. norvegicus
ccatctcttcagctcc

SEQ ID NO: 491800 - DNA, 16 bp, R. norvegicus
ccatctcttcaggccc

SEQ ID NO: 491801 - DNA, 16 bp, R. norvegicus
ccatctctttccacac

SEQ ID NO: 491802 - DNA, 16 bp, R. norvegicus
ccatctgcaatgagat

SEQ ID NO: 491803 - DNA, 16 bp, R. norvegicus
ccatctgctcccagag

SEQ ID NO: 491804 - DNA, 16 bp, R. norvegicus
ccatctggaaccctag

SEQ ID NO: 491805 - DNA, 16 bp, R. norvegicus
ccatctggccctgggc

SEQ ID NO: 491806 - DNA, 16 bp, R. norvegicus
ccatctgggaatccat

SEQ ID NO: 491807 - DNA, 16 bp, R. norvegicus
ccatctgggcagctct

SEQ ID NO: 491808 - DNA, 16 bp, R. norvegicus
ccatctgggtgactct

SEQ ID NO: 491809 - DNA, 18 bp, R. norvegicus
ccatctgtaatgggatcc

SEQ ID NO: 491810 - DNA, 16 bp, R. norvegicus
ccatctgtaattggat

SEQ ID NO: 491811 - DNA, 16 bp, R. norvegicus
ccatctgtacctgggc

SEQ ID NO: 491812 - DNA, 16 bp, R. norvegicus
ccatctgtccagcccc

SEQ ID NO: 491813 - DNA, 16 bp, R. norvegicus
ccatctgtccctgggc

SEQ ID NO: 491814 - DNA, 16 bp, R. norvegicus
ccatctgtctgtctcc

SEQ ID NO: 491815 - DNA, 16 bp, R. norvegicus
ccatcttatccagttt

SEQ ID NO: 491816 - DNA, 16 bp, R. norvegicus
ccatcttcccagctcc

SEQ ID NO: 491817 - DNA, 16 bp, R. norvegicus
ccatcttcctgaggaa

SEQ ID NO: 491818 - DNA, 16 bp, R. norvegicus
ccatcttcctgtctct

SEQ ID NO: 491819 - DNA, 16 bp, R. norvegicus
ccatcttgaaaaacca

SEQ ID NO: 491820 - DNA, 16 bp, R. norvegicus
ccatcttgctgaaaac

SEQ ID NO: 491821 - DNA, 16 bp, R. norvegicus
ccatcttgtcagccca

SEQ ID NO: 491822 - DNA, 16 bp, R. norvegicus
ccatctttattaacat

SEQ ID NO: 491823 - DNA, 16 bp, R. norvegicus
ccatgaaactggagtt

SEQ ID NO: 491824 - DNA, 16 bp, R. norvegicus
ccatgaaatggaaaaa

SEQ ID NO: 491825 - DNA, 16 bp, R. norvegicus
ccatgaacacgtggag

SEQ ID NO: 491826 - DNA, 16 bp, R. norvegicus
ccatgaagaaggcctt

SEQ ID NO: 491827 - DNA, 16 bp, R. norvegicus
ccatgaagaaggggag

SEQ ID NO: 491828 - DNA, 16 bp, R. norvegicus
ccatgaaggtgctggg

SEQ ID NO: 491829 - DNA, 16 bp, R. norvegicus
ccatgaagttctgaga

SEQ ID NO: 491830 - DNA, 16 bp, R. norvegicus
ccatgaatttgagaag

SEQ ID NO: 491831 - DNA, 16 bp, R. norvegicus
ccatgacaaagccaaa

SEQ ID NO: 491832 - DNA, 16 bp, R. norvegicus
ccatgaccaagaagca

SEQ ID NO: 491833 - DNA, 16 bp, R. norvegicus
ccatgaccaaggacaa

SEQ ID NO: 491834 - DNA, 16 bp, R. norvegicus
ccatgaccaaggccac

SEQ ID NO: 491835 - DNA, 16 bp, R. norvegicus
ccatgaccatggcaag

SEQ ID NO: 491836 - DNA, 16 bp, R. norvegicus
ccatgacctctggaag

SEQ ID NO: 491837 - DNA, 16 bp, R. norvegicus
ccatgactccagctgg

SEQ ID NO: 491838 - DNA, 16 bp, R. norvegicus
ccatgactttgctatc

SEQ ID NO: 491839 - DNA, 16 bp, R. norvegicus
ccatgacttttttttt

SEQ ID NO: 491840 - DNA, 16 bp, R. norvegicus
ccatgagcatcactgt

SEQ ID NO: 491841 - DNA, 16 bp, R. norvegicus
ccatgagcctgggaga

SEQ ID NO: 491842 - DNA, 16 bp, R. norvegicus
ccatgagctctctgtg

SEQ ID NO: 491843 - DNA, 16 bp, R. norvegicus
ccatgaggatgctggg

SEQ ID NO: 491844 - DNA, 16 bp, R. norvegicus
ccatgagttcaaggct

SEQ ID NO: 491845 - DNA, 16 bp, R. norvegicus
ccatgagtttgaggcc

SEQ ID NO: 491846 - DNA, 16 bp, R. norvegicus
ccatgataaaagtcct

SEQ ID NO: 491847 - DNA, 16 bp, R. norvegicus
ccatgataacaatgga

SEQ ID NO: 491848 - DNA, 16 bp, R. norvegicus
ccatgatctgcccatt

SEQ ID NO: 491849 - DNA, 16 bp, R. norvegicus
ccatgatgatcatgga

SEQ ID NO: 491850 - DNA, 16 bp, R. norvegicus
ccatgcaaacacaggc

SEQ ID NO: 491851 - DNA, 16 bp, R. norvegicus
ccatgcacaggcacca

SEQ ID NO: 491852 - DNA, 16 bp, R. norvegicus
ccatgcagtcttggtt

SEQ ID NO: 491853 - DNA, 16 bp, R. norvegicus
ccatgcatttggagca

SEQ ID NO: 491854 - DNA, 16 bp, R. norvegicus
ccatgccacccacaga

SEQ ID NO: 491855 - DNA, 16 bp, R. norvegicus
ccatgccagaagcaca

SEQ ID NO: 491856 - DNA, 16 bp, R. norvegicus
ccatgccagcctggat

SEQ ID NO: 491857 - DNA, 16 bp, R. norvegicus
ccatgcccacagtgac

SEQ ID NO: 491858 - DNA, 16 bp, R. norvegicus
ccatgcctgacacaca

SEQ ID NO: 491859 - DNA, 16 bp, R. norvegicus
ccatgcctggcttatt

SEQ ID NO: 491860 - DNA, 16 bp, R. norvegicus
ccatgcgttctatcag

SEQ ID NO: 491861 - DNA, 16 bp, R. norvegicus
ccatgctcaccatgct

SEQ ID NO: 491862 - DNA, 16 bp, R. norvegicus
ccatgctcatggatgg

SEQ ID NO: 491863 - DNA, 16 bp, R. norvegicus
ccatgctcatggattt

SEQ ID NO: 491864 - DNA, 16 bp, R. norvegicus
ccatgctccagtaaat

SEQ ID NO: 491865 - DNA, 16 bp, R. norvegicus
ccatgctcctgacttg

SEQ ID NO: 491866 - DNA, 16 bp, R. norvegicus
ccatgctggagtgggc

SEQ ID NO: 491867 - DNA, 16 bp, R. norvegicus
ccatgctggccttgaa

SEQ ID NO: 491868 - DNA, 16 bp, R. norvegicus
ccatgctgggcagctc

SEQ ID NO: 491869 - DNA, 36 bp, R. norvegicus
ccatgcttatcaccctgtacaaagcttaagtccaaa

SEQ ID NO: 491870 - DNA, 16 bp, R. norvegicus
ccatgcttccctccat

SEQ ID NO: 491871 - DNA, 16 bp, R. norvegicus
ccatgcttcctgccct

SEQ ID NO: 491872 - DNA, 16 bp, R. norvegicus
ccatggaaattctcta

SEQ ID NO: 491873 - DNA, 16 bp, R. norvegicus
ccatggaagagagagc

SEQ ID NO: 491874 - DNA, 16 bp, R. norvegicus
ccatggacagacagac

SEQ ID NO: 491875 - DNA, 16 bp, R. norvegicus
ccatggagaacaagcc

SEQ ID NO: 491876 - DNA, 16 bp, R. norvegicus
ccatggagaaggcatt

SEQ ID NO: 491877 - DNA, 16 bp, R. norvegicus
ccatggagaaggcctt

SEQ ID NO: 491878 - DNA, 16 bp, R. norvegicus
ccatggagaggtgctg

SEQ ID NO: 491879 - DNA, 16 bp, R. norvegicus
ccatggagccatctct

SEQ ID NO: 491880 - DNA, 16 bp, R. norvegicus
ccatggaggatgctgc

SEQ ID NO: 491881 - DNA, 16 bp, R. norvegicus
ccatggcaacagtgac

SEQ ID NO: 491882 - DNA, 16 bp, R. norvegicus
ccatggcactggcatc

SEQ ID NO: 491883 - DNA, 16 bp, R. norvegicus
ccatggccaaaaagca

SEQ ID NO: 491884 - DNA, 16 bp, R. norvegicus
ccatggccagcctcct

SEQ ID NO: 491885 - DNA, 16 bp, R. norvegicus
ccatggcctttgcatc

SEQ ID NO: 491886 - DNA, 16 bp, R. norvegicus
ccatggctcctgccac

SEQ ID NO: 491887 - DNA, 16 bp, R. norvegicus
ccatggctcctgcttc

SEQ ID NO: 491888 - DNA, 16 bp, R. norvegicus
ccatggctcgagctgc

SEQ ID NO: 491889 - DNA, 16 bp, R. norvegicus
ccatggctctaactgc

SEQ ID NO: 491890 - DNA, 16 bp, R. norvegicus
ccatggctggaagaag

SEQ ID NO: 491891 - DNA, 16 bp, R. norvegicus
ccatggctgtcctgga

SEQ ID NO: 491892 - DNA, 16 bp, R. norvegicus
ccatggctgttctgga

SEQ ID NO: 491893 - DNA, 16 bp, R. norvegicus
ccatgggaaggagagc

SEQ ID NO: 491894 - DNA, 16 bp, R. norvegicus
ccatgggagctctggg

SEQ ID NO: 491895 - DNA, 16 bp, R. norvegicus
ccatgggcaagtacca

SEQ ID NO: 491896 - DNA, 16 bp, R. norvegicus
ccatgggtcagtccat

SEQ ID NO: 491897 - DNA, 16 bp, R. norvegicus
ccatggtaaaacaaat

SEQ ID NO: 491898 - DNA, 16 bp, R. norvegicus
ccatggtcatggtgtc

SEQ ID NO: 491899 - DNA, 16 bp, R. norvegicus
ccatggtggcttcctc

SEQ ID NO: 491900 - DNA, 16 bp, R. norvegicus
ccatgtacttcttcct

SEQ ID NO: 491901 - DNA, 16 bp, R. norvegicus
ccatgtactttttgct

SEQ ID NO: 491902 - DNA, 16 bp, R. norvegicus
ccatgtatatctttct

SEQ ID NO: 491903 - DNA, 16 bp, R. norvegicus
ccatgtatatttttct

SEQ ID NO: 491904 - DNA, 16 bp, R. norvegicus
ccatgtatgtatgtat

SEQ ID NO: 491905 - DNA, 16 bp, R. norvegicus
ccatgtatgtctttct

SEQ ID NO: 491906 - DNA, 16 bp, R. norvegicus
ccatgtatttcttcct

SEQ ID NO: 491907 - DNA, 16 bp, R. norvegicus
ccatgtatttctttct

SEQ ID NO: 491908 - DNA, 16 bp, R. norvegicus
ccatgtcctctgcatc

SEQ ID NO: 491909 - DNA, 16 bp, R. norvegicus
ccatgtctccacaagg

SEQ ID NO: 491910 - DNA, 16 bp, R. norvegicus
ccatgtctgagatctg

SEQ ID NO: 491911 - DNA, 16 bp, R. norvegicus
ccatgtctggaacatt

SEQ ID NO: 491912 - DNA, 16 bp, R. norvegicus
ccatgtgaaaaaaaaa

SEQ ID NO: 491913 - DNA, 16 bp, R. norvegicus
ccatgtgcacacacac

SEQ ID NO: 491914 - DNA, 16 bp, R. norvegicus
ccatgtgcctctgcct

SEQ ID NO: 491915 - DNA, 16 bp, R. norvegicus
ccatgtggaaggccag

SEQ ID NO: 491916 - DNA, 16 bp, R. norvegicus
ccatgtggatgctggg

SEQ ID NO: 491917 - DNA, 16 bp, R. norvegicus
ccatgtgggacagtct

SEQ ID NO: 491918 - DNA, 16 bp, R. norvegicus
ccatgtgggccctggg

SEQ ID NO: 491919 - DNA, 16 bp, R. norvegicus
ccatgtggtactggga

SEQ ID NO: 491920 - DNA, 16 bp, R. norvegicus
ccatgtggtgctggga

SEQ ID NO: 491921 - DNA, 16 bp, R. norvegicus
ccatgtgtgttagaga

SEQ ID NO: 491922 - DNA, 16 bp, R. norvegicus
ccatgttcactgctgc

SEQ ID NO: 491923 - DNA, 16 bp, R. norvegicus
ccatgttccccatcat

SEQ ID NO: 491924 - DNA, 16 bp, R. norvegicus
ccatgttggtactggg

SEQ ID NO: 491925 - DNA, 16 bp, R. norvegicus
ccattacaagatggtg

SEQ ID NO: 491926 - DNA, 25 bp, R. norvegicus
ccattacagatggttgtgagccacc

SEQ ID NO: 491927 - DNA, 16 bp, R. norvegicus
ccattaccaagataga

SEQ ID NO: 491928 - DNA, 16 bp, R. norvegicus
ccattaccaccctcac

SEQ ID NO: 491929 - DNA, 16 bp, R. norvegicus
ccattaccaccctcca

SEQ ID NO: 491930 - DNA, 16 bp, R. norvegicus
ccattaccatcatggc

SEQ ID NO: 491931 - DNA, 16 bp, R. norvegicus
ccattactaataattt

SEQ ID NO: 491932 - DNA, 16 bp, R. norvegicus
ccattatcatggtggg

SEQ ID NO: 491933 - DNA, 16 bp, R. norvegicus
ccattattattgtgtg

SEQ ID NO: 491934 - DNA, 16 bp, R. norvegicus
ccattcaaattcctga

SEQ ID NO: 491935 - DNA, 16 bp, R. norvegicus
ccattcagttcccaga

SEQ ID NO: 491936 - DNA, 16 bp, R. norvegicus
ccattccaacacagca

SEQ ID NO: 491937 - DNA, 16 bp, R. norvegicus
ccattccaagagaaca

SEQ ID NO: 491938 - DNA, 16 bp, R. norvegicus
ccattcctccagcccc

SEQ ID NO: 491939 - DNA, 16 bp, R. norvegicus
ccattcctccagccct

SEQ ID NO: 491940 - DNA, 16 bp, R. norvegicus
ccattcctctgttgat

SEQ ID NO: 491941 - DNA, 16 bp, R. norvegicus
ccattcctgcatacct

SEQ ID NO: 491942 - DNA, 16 bp, R. norvegicus
ccattcctgtggcttt

SEQ ID NO: 491943 - DNA, 16 bp, R. norvegicus
ccattctcattgccct

SEQ ID NO: 491944 - DNA, 16 bp, R. norvegicus
ccattctgattagtgt

SEQ ID NO: 491945 - DNA, 16 bp, R. norvegicus
ccattctgattggagt

SEQ ID NO: 491946 - DNA, 16 bp, R. norvegicus
ccattctgattggtgt

SEQ ID NO: 491947 - DNA, 16 bp, R. norvegicus
ccattctggaaagcag

SEQ ID NO: 491948 - DNA, 16 bp, R. norvegicus
ccattctgtagactgc

SEQ ID NO: 491949 - DNA, 16 bp, R. norvegicus
ccattctgtttggtgt

SEQ ID NO: 491950 - DNA, 16 bp, R. norvegicus
ccattcttcccaccat

SEQ ID NO: 491951 - DNA, 16 bp, R. norvegicus
ccattcttccttctca

SEQ ID NO: 491952 - DNA, 16 bp, R. norvegicus
ccattcttctgttaag

SEQ ID NO: 491953 - DNA, 16 bp, R. norvegicus
ccattctttctgatgg

SEQ ID NO: 491954 - DNA, 16 bp, R. norvegicus
ccattgaattgagaac

SEQ ID NO: 491955 - DNA, 16 bp, R. norvegicus
ccattgaatttcagga

SEQ ID NO: 491956 - DNA, 16 bp, R. norvegicus
ccattgaatttgtaaa

SEQ ID NO: 491957 - DNA, 16 bp, R. norvegicus
ccattgacacacttcc

SEQ ID NO: 491958 - DNA, 16 bp, R. norvegicus
ccattgagggtggtgc

SEQ ID NO: 491959 - DNA, 16 bp, R. norvegicus
ccattgagtcagttcc

SEQ ID NO: 491960 - DNA, 16 bp, R. norvegicus
ccattgataccaaggc

SEQ ID NO: 491961 - DNA, 16 bp, R. norvegicus
ccattgatgccagaga

SEQ ID NO: 491962 - DNA, 22 bp, R. norvegicus
ccattgatgttgagagatatta

SEQ ID NO: 491963 - DNA, 17 bp, R. norvegicus
ccattgcaccttggttc

SEQ ID NO: 491964 - DNA, 16 bp, R. norvegicus
ccattgccatcgcaca

SEQ ID NO: 491965 - DNA, 16 bp, R. norvegicus
ccattgctgagaatgg

SEQ ID NO: 491966 - DNA, 16 bp, R. norvegicus
ccattgctgatgggaa

SEQ ID NO: 491967 - DNA, 16 bp, R. norvegicus
ccattgcttcttcttt

SEQ ID NO: 491968 - DNA, 16 bp, R. norvegicus
ccattggacacagaat

SEQ ID NO: 491969 - DNA, 16 bp, R. norvegicus
ccattggactgaacat

SEQ ID NO: 491970 - DNA, 16 bp, R. norvegicus
ccattggagcctggtg

SEQ ID NO: 491971 - DNA, 16 bp, R. norvegicus
ccattggaggagctag

SEQ ID NO: 491972 - DNA, 25 bp, R. norvegicus
ccattggggtgcagtcctaactgca

SEQ ID NO: 491973 - DNA, 16 bp, R. norvegicus
ccattggtcaatctgt

SEQ ID NO: 491974 - DNA, 16 bp, R. norvegicus
ccattggtgtttggtt

SEQ ID NO: 491975 - DNA, 16 bp, R. norvegicus
ccattgtacaaatgta

SEQ ID NO: 491976 - DNA, 17 bp, R. norvegicus
ccattgtcactggtgtg

SEQ ID NO: 491977 - DNA, 16 bp, R. norvegicus
ccattgtctccatctt

SEQ ID NO: 491978 - DNA, 16 bp, R. norvegicus
ccattgtctgctacat

SEQ ID NO: 491979 - DNA, 16 bp, R. norvegicus
ccattgtggttgctgg

SEQ ID NO: 491980 - DNA, 16 bp, R. norvegicus
ccattgttggtggcat

SEQ ID NO: 491981 - DNA, 16 bp, R. norvegicus
ccatttaaaaaagaaa

SEQ ID NO: 491982 - DNA, 16 bp, R. norvegicus
ccatttacctacgaat

SEQ ID NO: 491983 - DNA, 16 bp, R. norvegicus
ccatttagctccttca

SEQ ID NO: 491984 - DNA, 16 bp, R. norvegicus
ccatttataatgagat

SEQ ID NO: 491985 - DNA, 16 bp, R. norvegicus
ccatttcacagatgag

SEQ ID NO: 491986 - DNA, 16 bp, R. norvegicus
ccatttcacaggtgag

SEQ ID NO: 491987 - DNA, 16 bp, R. norvegicus
ccatttcaccagccct

SEQ ID NO: 491988 - DNA, 16 bp, R. norvegicus
ccatttcagtaccaag

SEQ ID NO: 491989 - DNA, 16 bp, R. norvegicus
ccatttcagtctcctc

SEQ ID NO: 491990 - DNA, 16 bp, R. norvegicus
ccatttccacccctgc

SEQ ID NO: 491991 - DNA, 16 bp, R. norvegicus
ccatttccttcacctg

SEQ ID NO: 491992 - DNA, 16 bp, R. norvegicus
ccatttctgtatttgg

SEQ ID NO: 491993 - DNA, 16 bp, R. norvegicus
ccatttcttcagcccc

SEQ ID NO: 491994 - DNA, 16 bp, R. norvegicus
ccatttgatgatgcct

SEQ ID NO: 491995 - DNA, 16 bp, R. norvegicus
ccatttgcatggaaag

SEQ ID NO: 491996 - DNA, 16 bp, R. norvegicus
ccatttgggagggaga

SEQ ID NO: 491997 - DNA, 16 bp, R. norvegicus
ccatttgtaaattctt

SEQ ID NO: 491998 - DNA, 16 bp, R. norvegicus
ccatttgtaattccag

SEQ ID NO: 491999 - DNA, 16 bp, R. norvegicus
ccatttgtctgtctgt

SEQ ID NO: 492000 - DNA, 16 bp, R. norvegicus
ccatttgtctgtgaat

SEQ ID NO: 492001 - DNA, 16 bp, R. norvegicus
ccatttgttgaggatg

SEQ ID NO: 492002 - DNA, 16 bp, R. norvegicus
ccattttacagaagag

SEQ ID NO: 492003 - DNA, 16 bp, R. norvegicus
ccattttacagatgca

SEQ ID NO: 492004 - DNA, 16 bp, R. norvegicus
ccattttcctgacttt

SEQ ID NO: 492005 - DNA, 16 bp, R. norvegicus
ccattttcttgaaaaa

SEQ ID NO: 492006 - DNA, 16 bp, R. norvegicus
ccattttcttggaaaa

SEQ ID NO: 492007 - DNA, 16 bp, R. norvegicus
ccatttttactgttaa

SEQ ID NO: 492008 - DNA, 16 bp, R. norvegicus
ccatttttctgttgtg

SEQ ID NO: 492009 - DNA, 16 bp, R. norvegicus
cccaaaaaattctacc

SEQ ID NO: 492010 - DNA, 16 bp, R. norvegicus
cccaaaacagaagaat

SEQ ID NO: 492011 - DNA, 16 bp, R. norvegicus
cccaaaagaacataca

SEQ ID NO: 492012 - DNA, 16 bp, R. norvegicus
cccaaaagatggccca

SEQ ID NO: 492013 - DNA, 16 bp, R. norvegicus
cccaaaagcacatgca

SEQ ID NO: 492014 - DNA, 16 bp, R. norvegicus
cccaaaaggaaactgt

SEQ ID NO: 492015 - DNA, 16 bp, R. norvegicus
cccaaaaggacaagca

SEQ ID NO: 492016 - DNA, 16 bp, R. norvegicus
cccaaaaggagtagaa

SEQ ID NO: 492017 - DNA, 16 bp, R. norvegicus
cccaaaatatccaaga

SEQ ID NO: 492018 - DNA, 16 bp, R. norvegicus
cccaaaattgtcctct

SEQ ID NO: 492019 - DNA, 16 bp, R. norvegicus
cccaaacaccatggga

SEQ ID NO: 492020 - DNA, 16 bp, R. norvegicus
cccaaacataaaatta

SEQ ID NO: 492021 - DNA, 16 bp, R. norvegicus
cccaaaccccgtagga

SEQ ID NO: 492022 - DNA, 16 bp, R. norvegicus
cccaaagaggacaggg

SEQ ID NO: 492023 - DNA, 16 bp, R. norvegicus
cccaaagatgcaggga

SEQ ID NO: 492024 - DNA, 16 bp, R. norvegicus
cccaaaggtgtgtggg

SEQ ID NO: 492025 - DNA, 16 bp, R. norvegicus
cccaaagtcaattttc

SEQ ID NO: 492026 - DNA, 16 bp, R. norvegicus
cccaaagtccagggaa

SEQ ID NO: 492027 - DNA, 16 bp, R. norvegicus
cccaaatccagatatg

SEQ ID NO: 492028 - DNA, 16 bp, R. norvegicus
cccaaatctctaggga

SEQ ID NO: 492029 - DNA, 16 bp, R. norvegicus
cccaaatgccaggaaa

SEQ ID NO: 492030 - DNA, 16 bp, R. norvegicus
cccaaattcccctgca

SEQ ID NO: 492031 - DNA, 16 bp, R. norvegicus
cccaaattgtcctctg

SEQ ID NO: 492032 - DNA, 16 bp, R. norvegicus
cccaacaaggccatct

SEQ ID NO: 492033 - DNA, 16 bp, R. norvegicus
cccaacaaggtcattc

SEQ ID NO: 492034 - DNA, 16 bp, R. norvegicus
cccaacaatcagctga

SEQ ID NO: 492035 - DNA, 16 bp, R. norvegicus
cccaacacccacatgg

SEQ ID NO: 492036 - DNA, 16 bp, R. norvegicus
cccaacactcaggaga

SEQ ID NO: 492037 - DNA, 16 bp, R. norvegicus
cccaacagacagtggg

SEQ ID NO: 492038 - DNA, 21 bp, R. norvegicus
cccaacagtaatagcaggaca

SEQ ID NO: 492039 - DNA, 16 bp, R. norvegicus
cccaacagtggagaga

SEQ ID NO: 492040 - DNA, 16 bp, R. norvegicus
cccaaccaatcaacag

SEQ ID NO: 492041 - DNA, 16 bp, R. norvegicus
cccaaccaggcagttc

SEQ ID NO: 492042 - DNA, 16 bp, R. norvegicus
cccaaccagtgaacag

SEQ ID NO: 492043 - DNA, 16 bp, R. norvegicus
cccaaccccaggattt

SEQ ID NO: 492044 - DNA, 16 bp, R. norvegicus
cccaaccccaggcctt

SEQ ID NO: 492045 - DNA, 16 bp, R. norvegicus
cccaacccccagaatc

SEQ ID NO: 492046 - DNA, 16 bp, R. norvegicus
cccaacccccatattt

SEQ ID NO: 492047 - DNA, 16 bp, R. norvegicus
cccaaccccctgcttc

SEQ ID NO: 492048 - DNA, 16 bp, R. norvegicus
cccaacccctattttc

SEQ ID NO: 492049 - DNA, 16 bp, R. norvegicus
cccaaccctgacacag

SEQ ID NO: 492050 - DNA, 16 bp, R. norvegicus
cccaaccttgctgatc

SEQ ID NO: 492051 - DNA, 16 bp, R. norvegicus
cccaactcctctcaga

SEQ ID NO: 492052 - DNA, 16 bp, R. norvegicus
cccaacttgcttctta

SEQ ID NO: 492053 - DNA, 16 bp, R. norvegicus
cccaacttgctttttg

SEQ ID NO: 492054 - DNA, 16 bp, R. norvegicus
cccaagaaaaaggaag

SEQ ID NO: 492055 - DNA, 16 bp, R. norvegicus
cccaagaaacaacctg

SEQ ID NO: 492056 - DNA, 16 bp, R. norvegicus
cccaagaagaagaaag

SEQ ID NO: 492057 - DNA, 16 bp, R. norvegicus
cccaagaagagtagaa

SEQ ID NO: 492058 - DNA, 16 bp, R. norvegicus
cccaagaaggccatcc

SEQ ID NO: 492059 - DNA, 16 bp, R. norvegicus
cccaagaccaagttct

SEQ ID NO: 492060 - DNA, 36 bp, R. norvegicus
cccaagagaggtatagctggatcctcaggcagttcc

SEQ ID NO: 492061 - DNA, 19 bp, R. norvegicus
cccaagaggaaactgtata

SEQ ID NO: 492062 - DNA, 16 bp, R. norvegicus
cccaagaggaacctgt

SEQ ID NO: 492063 - DNA, 16 bp, R. norvegicus
cccaagaggaagctgt

SEQ ID NO: 492064 - DNA, 16 bp, R. norvegicus
cccaagagtccagaga

SEQ ID NO: 492065 - DNA, 16 bp, R. norvegicus
cccaagagtcctctgc

SEQ ID NO: 492066 - DNA, 16 bp, R. norvegicus
cccaagagtggtagag

SEQ ID NO: 492067 - DNA, 16 bp, R. norvegicus
cccaagatagaatcca

SEQ ID NO: 492068 - DNA, 18 bp, R. norvegicus
cccaagatatctgctgga

SEQ ID NO: 492069 - DNA, 16 bp, R. norvegicus
cccaagatcaccagcc

SEQ ID NO: 492070 - DNA, 16 bp, R. norvegicus
cccaagattaccagcc

SEQ ID NO: 492071 - DNA, 16 bp, R. norvegicus
cccaagccatgtattc

SEQ ID NO: 492072 - DNA, 16 bp, R. norvegicus
cccaagctcaccaggc

SEQ ID NO: 492073 - DNA, 16 bp, R. norvegicus
cccaaggacattgacc

SEQ ID NO: 492074 - DNA, 16 bp, R. norvegicus
cccaaggatcctcctg

SEQ ID NO: 492075 - DNA, 16 bp, R. norvegicus
cccaagggctctctga

SEQ ID NO: 492076 - DNA, 16 bp, R. norvegicus
cccaaggttgtcctct

SEQ ID NO: 492077 - DNA, 16 bp, R. norvegicus
cccaaggttgttctct

SEQ ID NO: 492078 - DNA, 16 bp, R. norvegicus
cccaagtactaaacca

SEQ ID NO: 492079 - DNA, 16 bp, R. norvegicus
cccaagtccctctcac

SEQ ID NO: 492080 - DNA, 16 bp, R. norvegicus
cccaagtctccaggta

SEQ ID NO: 492081 - DNA, 16 bp, R. norvegicus
cccaagtgagaatgct

SEQ ID NO: 492082 - DNA, 16 bp, R. norvegicus
cccaagtgctgagact

SEQ ID NO: 492083 - DNA, 16 bp, R. norvegicus
cccaagtgctgcgatt

SEQ ID NO: 492084 - DNA, 16 bp, R. norvegicus
cccaagtgctgggact

SEQ ID NO: 492085 - DNA, 16 bp, R. norvegicus
cccaagtgctgggctt

SEQ ID NO: 492086 - DNA, 16 bp, R. norvegicus
cccaagtgggactaag

SEQ ID NO: 492087 - DNA, 16 bp, R. norvegicus
cccaagttatccctga

SEQ ID NO: 492088 - DNA, 16 bp, R. norvegicus
cccaagttcaaggcca

SEQ ID NO: 492089 - DNA, 16 bp, R. norvegicus
cccaataaaggagacc

SEQ ID NO: 492090 - DNA, 16 bp, R. norvegicus
cccaatgctctcttct

SEQ ID NO: 492091 - DNA, 20 bp, R. norvegicus
cccaatgtgatgacctgtaa

SEQ ID NO: 492092 - DNA, 16 bp, R. norvegicus
cccaatttggggttct

SEQ ID NO: 492093 - DNA, 16 bp, R. norvegicus
cccacaaaggccagag

SEQ ID NO: 492094 - DNA, 16 bp, R. norvegicus
cccacaagaacagctg

SEQ ID NO: 492095 - DNA, 16 bp, R. norvegicus
cccacaaggtggctca

SEQ ID NO: 492096 - DNA, 26 bp, R. norvegicus
cccacaagtacaggccagagacaaag

SEQ ID NO: 492097 - DNA, 16 bp, R. norvegicus
cccacaagtctggcag

SEQ ID NO: 492098 - DNA, 16 bp, R. norvegicus
cccacacacctttggg

SEQ ID NO: 492099 - DNA, 16 bp, R. norvegicus
cccacaccaggcagct

SEQ ID NO: 492100 - DNA, 16 bp, R. norvegicus
cccacacctgattggt

SEQ ID NO: 492101 - DNA, 16 bp, R. norvegicus
cccacactcatgtgcc

SEQ ID NO: 492102 - DNA, 16 bp, R. norvegicus
cccacactccaggtca

SEQ ID NO: 492103 - DNA, 16 bp, R. norvegicus
cccacagaagaggaag

SEQ ID NO: 492104 - DNA, 16 bp, R. norvegicus
cccacagagactgaac

SEQ ID NO: 492105 - DNA, 16 bp, R. norvegicus
cccacagagcagctca

SEQ ID NO: 492106 - DNA, 16 bp, R. norvegicus
cccacagagccacctc

SEQ ID NO: 492107 - DNA, 16 bp, R. norvegicus
cccacagagcccagag

SEQ ID NO: 492108 - DNA, 16 bp, R. norvegicus
cccacagagcctgcag

SEQ ID NO: 492109 - DNA, 16 bp, R. norvegicus
cccacagagctggagt

SEQ ID NO: 492110 - DNA, 16 bp, R. norvegicus
cccacagagtggctca

SEQ ID NO: 492111 - DNA, 16 bp, R. norvegicus
cccacagcaaagagat

SEQ ID NO: 492112 - DNA, 16 bp, R. norvegicus
cccacagcaaccatca

SEQ ID NO: 492113 - DNA, 16 bp, R. norvegicus
cccacagcagcagcag

SEQ ID NO: 492114 - DNA, 16 bp, R. norvegicus
cccacagcagccagca

SEQ ID NO: 492115 - DNA, 16 bp, R. norvegicus
cccacagcaggcagct

SEQ ID NO: 492116 - DNA, 16 bp, R. norvegicus
cccacagccctctgga

SEQ ID NO: 492117 - DNA, 16 bp, R. norvegicus
cccacagcctgacacc

SEQ ID NO: 492118 - DNA, 16 bp, R. norvegicus
cccacagctgccactg

SEQ ID NO: 492119 - DNA, 16 bp, R. norvegicus
cccacagctgctgctg

SEQ ID NO: 492120 - DNA, 16 bp, R. norvegicus
cccacaggagcagctg

SEQ ID NO: 492121 - DNA, 16 bp, R. norvegicus
cccacaggagccagaa

SEQ ID NO: 492122 - DNA, 16 bp, R. norvegicus
cccacaggaggaacaa

SEQ ID NO: 492123 - DNA, 16 bp, R. norvegicus
cccacaggaggtctgc

SEQ ID NO: 492124 - DNA, 16 bp, R. norvegicus
cccacagggacagctg

SEQ ID NO: 492125 - DNA, 16 bp, R. norvegicus
cccacagtgagctgtc

SEQ ID NO: 492126 - DNA, 16 bp, R. norvegicus
cccacagtggcctggg

SEQ ID NO: 492127 - DNA, 16 bp, R. norvegicus
cccacagtgtttggga

SEQ ID NO: 492128 - DNA, 16 bp, R. norvegicus
cccacagttacctggc

SEQ ID NO: 492129 - DNA, 16 bp, R. norvegicus
cccacagttccctgca

SEQ ID NO: 492130 - DNA, 16 bp, R. norvegicus
cccacatccctggctc

SEQ ID NO: 492131 - DNA, 16 bp, R. norvegicus
cccacatgaagagcaa

SEQ ID NO: 492132 - DNA, 16 bp, R. norvegicus
cccacatgatgtcaag

SEQ ID NO: 492133 - DNA, 16 bp, R. norvegicus
cccacatggaggaagg

SEQ ID NO: 492134 - DNA, 16 bp, R. norvegicus
cccacatggcagctct

SEQ ID NO: 492135 - DNA, 16 bp, R. norvegicus
cccacatgtggtccat

SEQ ID NO: 492136 - DNA, 16 bp, R. norvegicus
cccaccaaaaagagcc

SEQ ID NO: 492137 - DNA, 16 bp, R. norvegicus
cccaccaaaggaaaca

SEQ ID NO: 492138 - DNA, 16 bp, R. norvegicus
cccaccacttcctgcc

SEQ ID NO: 492139 - DNA, 16 bp, R. norvegicus
cccaccatcctctgct

SEQ ID NO: 492140 - DNA, 16 bp, R. norvegicus
cccaccatgatgagaa

SEQ ID NO: 492141 - DNA, 16 bp, R. norvegicus
cccaccatgatggtca

SEQ ID NO: 492142 - DNA, 16 bp, R. norvegicus
cccaccatggtcccag

SEQ ID NO: 492143 - DNA, 16 bp, R. norvegicus
cccacccactgctgcc

SEQ ID NO: 492144 - DNA, 16 bp, R. norvegicus
cccacccaggcattca

SEQ ID NO: 492145 - DNA, 16 bp, R. norvegicus
cccacccccacaatga

SEQ ID NO: 492146 - DNA, 16 bp, R. norvegicus
cccacccccaccatga

SEQ ID NO: 492147 - DNA, 16 bp, R. norvegicus
cccacccccagagctg

SEQ ID NO: 492148 - DNA, 16 bp, R. norvegicus
cccacccccagctcag

SEQ ID NO: 492149 - DNA, 16 bp, R. norvegicus
cccacccccagctggg

SEQ ID NO: 492150 - DNA, 16 bp, R. norvegicus
cccacccccagtgaca

SEQ ID NO: 492151 - DNA, 16 bp, R. norvegicus
cccacccccagtggca

SEQ ID NO: 492152 - DNA, 16 bp, R. norvegicus
cccacccccatctctg

SEQ ID NO: 492153 - DNA, 16 bp, R. norvegicus
cccaccccccagtgta

SEQ ID NO: 492154 - DNA, 16 bp, R. norvegicus
cccaccccgacagtga

SEQ ID NO: 492155 - DNA, 16 bp, R. norvegicus
cccaccccgtgtgtgt

SEQ ID NO: 492156 - DNA, 16 bp, R. norvegicus
cccacccctgcacaca

SEQ ID NO: 492157 - DNA, 16 bp, R. norvegicus
cccacccctgcctcag

SEQ ID NO: 492158 - DNA, 16 bp, R. norvegicus
cccaccccttcctgct

SEQ ID NO: 492159 - DNA, 16 bp, R. norvegicus
cccaccctgaaattcc

SEQ ID NO: 492160 - DNA, 16 bp, R. norvegicus
cccacctccaatgaca

SEQ ID NO: 492161 - DNA, 16 bp, R. norvegicus
cccacctccacagtga

SEQ ID NO: 492162 - DNA, 16 bp, R. norvegicus
cccacctcccagctct

SEQ ID NO: 492163 - DNA, 16 bp, R. norvegicus
cccacctccctgcact

SEQ ID NO: 492164 - DNA, 17 bp, R. norvegicus
cccacctcggccggcaa

SEQ ID NO: 492165 - DNA, 16 bp, R. norvegicus
cccacctctgcctcct

SEQ ID NO: 492166 - DNA, 16 bp, R. norvegicus
cccacctgagaatcca

SEQ ID NO: 492167 - DNA, 16 bp, R. norvegicus
cccacctgccacaggt

SEQ ID NO: 492168 - DNA, 16 bp, R. norvegicus
cccacctggacctggg

SEQ ID NO: 492169 - DNA, 16 bp, R. norvegicus
cccacctggggatcca

SEQ ID NO: 492170 - DNA, 16 bp, R. norvegicus
cccactccctgccctg

SEQ ID NO: 492171 - DNA, 16 bp, R. norvegicus
cccactcctgcctcat

SEQ ID NO: 492172 - DNA, 16 bp, R. norvegicus
cccactcctgcttcag

SEQ ID NO: 492173 - DNA, 16 bp, R. norvegicus
cccactcctgtctccc

SEQ ID NO: 492174 - DNA, 16 bp, R. norvegicus
cccactgagccatcct

SEQ ID NO: 492175 - DNA, 16 bp, R. norvegicus
cccactgaggtcaaac

SEQ ID NO: 492176 - DNA, 16 bp, R. norvegicus
cccactgatccatctt

SEQ ID NO: 492177 - DNA, 16 bp, R. norvegicus
cccactgctgctgctg

SEQ ID NO: 492178 - DNA, 16 bp, R. norvegicus
cccactggccagccag

SEQ ID NO: 492179 - DNA, 16 bp, R. norvegicus
cccactgtccctgaag

SEQ ID NO: 492180 - DNA, 16 bp, R. norvegicus
cccactgtctccaaga

SEQ ID NO: 492181 - DNA, 16 bp, R. norvegicus
cccactgtgggcagta

SEQ ID NO: 492182 - DNA, 16 bp, R. norvegicus
cccactgtgggtggtg

SEQ ID NO: 492183 - DNA, 16 bp, R. norvegicus
cccacttccacctcaa

SEQ ID NO: 492184 - DNA, 16 bp, R. norvegicus
cccacttcccagtttc

SEQ ID NO: 492185 - DNA, 16 bp, R. norvegicus
cccacttcctccagct

SEQ ID NO: 492186 - DNA, 16 bp, R. norvegicus
cccacttcctcctgcc

SEQ ID NO: 492187 - DNA, 16 bp, R. norvegicus
cccacttcttcaggat

SEQ ID NO: 492188 - DNA, 16 bp, R. norvegicus
cccacttgaggatcca

SEQ ID NO: 492189 - DNA, 16 bp, R. norvegicus
cccactttttaaaaaa

SEQ ID NO: 492190 - DNA, 16 bp, R. norvegicus
cccagaaaccaggaaa

SEQ ID NO: 492191 - DNA, 16 bp, R. norvegicus
cccagaaatgcaggga

SEQ ID NO: 492192 - DNA, 16 bp, R. norvegicus
cccagaaccaacatgg

SEQ ID NO: 492193 - DNA, 16 bp, R. norvegicus
cccagaaccacataaa

SEQ ID NO: 492194 - DNA, 16 bp, R. norvegicus
cccagaaccacctgcc

SEQ ID NO: 492195 - DNA, 16 bp, R. norvegicus
cccagaacccacatgg

SEQ ID NO: 492196 - DNA, 16 bp, R. norvegicus
cccagaacctctggaa

SEQ ID NO: 492197 - DNA, 16 bp, R. norvegicus
cccagaactcacatgg

SEQ ID NO: 492198 - DNA, 16 bp, R. norvegicus
cccagaactcagagat

SEQ ID NO: 492199 - DNA, 16 bp, R. norvegicus
cccagaacttggaggt

SEQ ID NO: 492200 - DNA, 16 bp, R. norvegicus
cccagaagacctgggt

SEQ ID NO: 492201 - DNA, 16 bp, R. norvegicus
cccagaagatcatgta

SEQ ID NO: 492202 - DNA, 16 bp, R. norvegicus
cccagaagccacatgg

SEQ ID NO: 492203 - DNA, 16 bp, R. norvegicus
cccagaagctcagaat

SEQ ID NO: 492204 - DNA, 16 bp, R. norvegicus
cccagaaggagccagg

SEQ ID NO: 492205 - DNA, 16 bp, R. norvegicus
cccagaaggctgggaa

SEQ ID NO: 492206 - DNA, 16 bp, R. norvegicus
cccagaaggctgggag

SEQ ID NO: 492207 - DNA, 16 bp, R. norvegicus
cccagaagtcccgcct

SEQ ID NO: 492208 - DNA, 16 bp, R. norvegicus
cccagaagtcccttta

SEQ ID NO: 492209 - DNA, 16 bp, R. norvegicus
cccagaagtgttcctg

SEQ ID NO: 492210 - DNA, 16 bp, R. norvegicus
cccagaagttctgtta

SEQ ID NO: 492211 - DNA, 16 bp, R. norvegicus
cccagaagttttttta

SEQ ID NO: 492212 - DNA, 16 bp, R. norvegicus
cccagaattcctttct

SEQ ID NO: 492213 - DNA, 16 bp, R. norvegicus
cccagaattctgcaca

SEQ ID NO: 492214 - DNA, 16 bp, R. norvegicus
cccagacaccatggga

SEQ ID NO: 492215 - DNA, 16 bp, R. norvegicus
cccagaccagcaaaca

SEQ ID NO: 492216 - DNA, 16 bp, R. norvegicus
cccagacccaggagtc

SEQ ID NO: 492217 - DNA, 16 bp, R. norvegicus
cccagaccctgtgaga

SEQ ID NO: 492218 - DNA, 16 bp, R. norvegicus
cccagacctcctggga

SEQ ID NO: 492219 - DNA, 16 bp, R. norvegicus
cccagaccttagcaca

SEQ ID NO: 492220 - DNA, 16 bp, R. norvegicus
cccagactcaggagtc

SEQ ID NO: 492221 - DNA, 16 bp, R. norvegicus
cccagagaacaaagaa

SEQ ID NO: 492222 - DNA, 16 bp, R. norvegicus
cccagagaagagcaca

SEQ ID NO: 492223 - DNA, 16 bp, R. norvegicus
cccagagaagccagaa

SEQ ID NO: 492224 - DNA, 16 bp, R. norvegicus
cccagagaagggagat

SEQ ID NO: 492225 - DNA, 16 bp, R. norvegicus
cccagagacaaagaca

SEQ ID NO: 492226 - DNA, 16 bp, R. norvegicus
cccagagaccctgaag

SEQ ID NO: 492227 - DNA, 16 bp, R. norvegicus
cccagagactgaccca

SEQ ID NO: 492228 - DNA, 16 bp, R. norvegicus
cccagagcacagtgcc

SEQ ID NO: 492229 - DNA, 16 bp, R. norvegicus
cccagagcacccaggg

SEQ ID NO: 492230 - DNA, 16 bp, R. norvegicus
cccagagcccagagcc

SEQ ID NO: 492231 - DNA, 16 bp, R. norvegicus
cccagagccttgcact

SEQ ID NO: 492232 - DNA, 16 bp, R. norvegicus
cccagagctgaccctg

SEQ ID NO: 492233 - DNA, 16 bp, R. norvegicus
cccagagctggctgct

SEQ ID NO: 492234 - DNA, 16 bp, R. norvegicus
cccagagctggggact

SEQ ID NO: 492235 - DNA, 16 bp, R. norvegicus
cccagaggaagctcaa

SEQ ID NO: 492236 - DNA, 16 bp, R. norvegicus
cccagaggacttctgc

SEQ ID NO: 492237 - DNA, 16 bp, R. norvegicus
cccagaggccagagga

SEQ ID NO: 492238 - DNA, 16 bp, R. norvegicus
cccagaggctgggctg

SEQ ID NO: 492239 - DNA, 16 bp, R. norvegicus
cccagagtctctctct

SEQ ID NO: 492240 - DNA, 16 bp, R. norvegicus
cccagagttcccaagg

SEQ ID NO: 492241 - DNA, 16 bp, R. norvegicus
cccagagttcttcacc

SEQ ID NO: 492242 - DNA, 16 bp, R. norvegicus
cccagatccaaaagga

SEQ ID NO: 492243 - DNA, 16 bp, R. norvegicus
cccagatccagggttt

SEQ ID NO: 492244 - DNA, 16 bp, R. norvegicus
cccagatccctctggg

SEQ ID NO: 492245 - DNA, 16 bp, R. norvegicus
cccagatccctttctc

SEQ ID NO: 492246 - DNA, 16 bp, R. norvegicus
cccagatcctccccac

SEQ ID NO: 492247 - DNA, 16 bp, R. norvegicus
cccagatcctccctac

SEQ ID NO: 492248 - DNA, 16 bp, R. norvegicus
cccagatcttcctggt

SEQ ID NO: 492249 - DNA, 16 bp, R. norvegicus
cccagatgccaaggac

SEQ ID NO: 492250 - DNA, 16 bp, R. norvegicus
cccagattcctccctc

SEQ ID NO: 492251 - DNA, 16 bp, R. norvegicus
cccagcaaagccatcc

SEQ ID NO: 492252 - DNA, 16 bp, R. norvegicus
cccagcaaccacagag

SEQ ID NO: 492253 - DNA, 16 bp, R. norvegicus
cccagcacagagaagg

SEQ ID NO: 492254 - DNA, 16 bp, R. norvegicus
cccagcacagaggagg

SEQ ID NO: 492255 - DNA, 16 bp, R. norvegicus
cccagcacagcccagc

SEQ ID NO: 492256 - DNA, 16 bp, R. norvegicus
cccagcaccacataaa

SEQ ID NO: 492257 - DNA, 16 bp, R. norvegicus
cccagcaccagcatgg

SEQ ID NO: 492258 - DNA, 16 bp, R. norvegicus
cccagcacccaggaga

SEQ ID NO: 492259 - DNA, 16 bp, R. norvegicus
cccagcactcacacca

SEQ ID NO: 492260 - DNA, 16 bp, R. norvegicus
cccagcactctggagc

SEQ ID NO: 492261 - DNA, 16 bp, R. norvegicus
cccagcactgaagaga

SEQ ID NO: 492262 - DNA, 16 bp, R. norvegicus
cccagcactgaagagg

SEQ ID NO: 492263 - DNA, 16 bp, R. norvegicus
cccagcactgaggaag

SEQ ID NO: 492264 - DNA, 16 bp, R. norvegicus
cccagcactgaggaga

SEQ ID NO: 492265 - DNA, 16 bp, R. norvegicus
cccagcactggaaagg

SEQ ID NO: 492266 - DNA, 16 bp, R. norvegicus
cccagcactggggaag

SEQ ID NO: 492267 - DNA, 16 bp, R. norvegicus
cccagcacttggcaga

SEQ ID NO: 492268 - DNA, 16 bp, R. norvegicus
cccagcagaggcagag

SEQ ID NO: 492269 - DNA, 16 bp, R. norvegicus
cccagcagcaatctct

SEQ ID NO: 492270 - DNA, 16 bp, R. norvegicus
cccagcagcacctgga

SEQ ID NO: 492271 - DNA, 16 bp, R. norvegicus
cccagcagcagcagct

SEQ ID NO: 492272 - DNA, 16 bp, R. norvegicus
cccagcagcagctgcc

SEQ ID NO: 492273 - DNA, 16 bp, R. norvegicus
cccagcagccccatcc

SEQ ID NO: 492274 - DNA, 16 bp, R. norvegicus
cccagcagctccagca

SEQ ID NO: 492275 - DNA, 16 bp, R. norvegicus
cccagcagctgactca

SEQ ID NO: 492276 - DNA, 16 bp, R. norvegicus
cccagcaggtggtggg

SEQ ID NO: 492277 - DNA, 16 bp, R. norvegicus
cccagcagtgcctgga

SEQ ID NO: 492278 - DNA, 16 bp, R. norvegicus
cccagcatcctcttct

SEQ ID NO: 492279 - DNA, 16 bp, R. norvegicus
cccagcatcctttgct

SEQ ID NO: 492280 - DNA, 16 bp, R. norvegicus
cccagcatgcacagag

SEQ ID NO: 492281 - DNA, 16 bp, R. norvegicus
cccagcatgcaccagg

SEQ ID NO: 492282 - DNA, 16 bp, R. norvegicus
cccagcattcagtcct

SEQ ID NO: 492283 - DNA, 16 bp, R. norvegicus
cccagcattgaggaag

SEQ ID NO: 492284 - DNA, 16 bp, R. norvegicus
cccagcatttgagaag

SEQ ID NO: 492285 - DNA, 16 bp, R. norvegicus
cccagcatttggaaag

SEQ ID NO: 492286 - DNA, 16 bp, R. norvegicus
cccagcatttggcagg

SEQ ID NO: 492287 - DNA, 16 bp, R. norvegicus
cccagcattttggaga

SEQ ID NO: 492288 - DNA, 16 bp, R. norvegicus
cccagccagcctcact

SEQ ID NO: 492289 - DNA, 16 bp, R. norvegicus
cccagccatctctcca

SEQ ID NO: 492290 - DNA, 16 bp, R. norvegicus
cccagcccactgtgag

SEQ ID NO: 492291 - DNA, 16 bp, R. norvegicus
cccagcccactgtggg

SEQ ID NO: 492292 - DNA, 16 bp, R. norvegicus
cccagcccagctcagc

SEQ ID NO: 492293 - DNA, 16 bp, R. norvegicus
cccagcccagggaatg

SEQ ID NO: 492294 - DNA, 16 bp, R. norvegicus
cccagcccagggacag

SEQ ID NO: 492295 - DNA, 16 bp, R. norvegicus
cccagccccactgagc

SEQ ID NO: 492296 - DNA, 16 bp, R. norvegicus
cccagccccactggca

SEQ ID NO: 492297 - DNA, 16 bp, R. norvegicus
cccagccccagtgaca

SEQ ID NO: 492298 - DNA, 16 bp, R. norvegicus
cccagccctcaagagg

SEQ ID NO: 492299 - DNA, 16 bp, R. norvegicus
cccagccctcagaagg

SEQ ID NO: 492300 - DNA, 16 bp, R. norvegicus
cccagccctcaggaga

SEQ ID NO: 492301 - DNA, 16 bp, R. norvegicus
cccagccctgaggagc

SEQ ID NO: 492302 - DNA, 16 bp, R. norvegicus
cccagccctggggaga

SEQ ID NO: 492303 - DNA, 16 bp, R. norvegicus
cccagcccttgagagg

SEQ ID NO: 492304 - DNA, 16 bp, R. norvegicus
cccagcctcaagatca

SEQ ID NO: 492305 - DNA, 16 bp, R. norvegicus
cccagcctcagcccca

SEQ ID NO: 492306 - DNA, 16 bp, R. norvegicus
cccagcctcagctgct

SEQ ID NO: 492307 - DNA, 16 bp, R. norvegicus
cccagcctccaacacc

SEQ ID NO: 492308 - DNA, 16 bp, R. norvegicus
cccagcctccttgcag

SEQ ID NO: 492309 - DNA, 16 bp, R. norvegicus
cccagcctcttggggt

SEQ ID NO: 492310 - DNA, 16 bp, R. norvegicus
cccagcctgaccttga

SEQ ID NO: 492311 - DNA, 16 bp, R. norvegicus
cccagcctgcagcagc

SEQ ID NO: 492312 - DNA, 16 bp, R. norvegicus
cccagcctggcctgga

SEQ ID NO: 492313 - DNA, 16 bp, R. norvegicus
cccagcctggtcccca

SEQ ID NO: 492314 - DNA, 16 bp, R. norvegicus
cccagcctggtctaca

SEQ ID NO: 492315 - DNA, 16 bp, R. norvegicus
cccagccttctccatg

SEQ ID NO: 492316 - DNA, 16 bp, R. norvegicus
cccagctagaagaaca

SEQ ID NO: 492317 - DNA, 16 bp, R. norvegicus
cccagctcagagctgc

SEQ ID NO: 492318 - DNA, 16 bp, R. norvegicus
cccagctcattgtggg

SEQ ID NO: 492319 - DNA, 16 bp, R. norvegicus
cccagctccaaaaaaa

SEQ ID NO: 492320 - DNA, 16 bp, R. norvegicus
cccagctccaaggacc

SEQ ID NO: 492321 - DNA, 16 bp, R. norvegicus
cccagctccagcctcc

SEQ ID NO: 492322 - DNA, 16 bp, R. norvegicus
cccagctcccagctcc

SEQ ID NO: 492323 - DNA, 16 bp, R. norvegicus
cccagctcctccagct

SEQ ID NO: 492324 - DNA, 16 bp, R. norvegicus
cccagctcctcctcct

SEQ ID NO: 492325 - DNA, 16 bp, R. norvegicus
cccagctcctcctgca

SEQ ID NO: 492326 - DNA, 16 bp, R. norvegicus
cccagctccttcctcc

SEQ ID NO: 492327 - DNA, 16 bp, R. norvegicus
cccagctctcagcccc

SEQ ID NO: 492328 - DNA, 16 bp, R. norvegicus
cccagctctgaaaaga

SEQ ID NO: 492329 - DNA, 16 bp, R. norvegicus
cccagctctggagagg

SEQ ID NO: 492330 - DNA, 16 bp, R. norvegicus
cccagctctgggaaaa

SEQ ID NO: 492331 - DNA, 16 bp, R. norvegicus
cccagctctggggaga

SEQ ID NO: 492332 - DNA, 16 bp, R. norvegicus
cccagctgaggaatat

SEQ ID NO: 492333 - DNA, 16 bp, R. norvegicus
cccagctgctccctgg

SEQ ID NO: 492334 - DNA, 16 bp, R. norvegicus
cccagctgctgctgct

SEQ ID NO: 492335 - DNA, 16 bp, R. norvegicus
cccagctggcctagaa

SEQ ID NO: 492336 - DNA, 16 bp, R. norvegicus
cccagctggctttgaa

SEQ ID NO: 492337 - DNA, 16 bp, R. norvegicus
cccagctggttttctg

SEQ ID NO: 492338 - DNA, 16 bp, R. norvegicus
cccagcttcctgagga

SEQ ID NO: 492339 - DNA, 16 bp, R. norvegicus
cccagcttcggaaaaa

SEQ ID NO: 492340 - DNA, 16 bp, R. norvegicus
cccagcttctggctgt

SEQ ID NO: 492341 - DNA, 16 bp, R. norvegicus
cccagcttgagaccca

SEQ ID NO: 492342 - DNA, 16 bp, R. norvegicus
cccaggaaaagctaaa

SEQ ID NO: 492343 - DNA, 16 bp, R. norvegicus
cccaggaaataaaaca

SEQ ID NO: 492344 - DNA, 16 bp, R. norvegicus
cccaggaacacacaca

SEQ ID NO: 492345 - DNA, 16 bp, R. norvegicus
cccaggaacagatggg

SEQ ID NO: 492346 - DNA, 16 bp, R. norvegicus
cccaggaaccacacag

SEQ ID NO: 492347 - DNA, 16 bp, R. norvegicus
cccaggaagcagcaga

SEQ ID NO: 492348 - DNA, 16 bp, R. norvegicus
cccaggaatggcacca

SEQ ID NO: 492349 - DNA, 16 bp, R. norvegicus
cccaggaattaaacca

SEQ ID NO: 492350 - DNA, 16 bp, R. norvegicus
cccaggacagctccag

SEQ ID NO: 492351 - DNA, 16 bp, R. norvegicus
cccaggacatcagaag

SEQ ID NO: 492352 - DNA, 16 bp, R. norvegicus
cccaggaccaaggacc

SEQ ID NO: 492353 - DNA, 16 bp, R. norvegicus
cccaggaccacatggt

SEQ ID NO: 492354 - DNA, 16 bp, R. norvegicus
cccaggaccaccagct

SEQ ID NO: 492355 - DNA, 16 bp, R. norvegicus
cccaggaccagcagcc

SEQ ID NO: 492356 - DNA, 16 bp, R. norvegicus
cccaggacccaacaga

SEQ ID NO: 492357 - DNA, 16 bp, R. norvegicus
cccaggacccacagaa

SEQ ID NO: 492358 - DNA, 16 bp, R. norvegicus
cccaggacccacatgg

SEQ ID NO: 492359 - DNA, 16 bp, R. norvegicus
cccaggacccagtggg

SEQ ID NO: 492360 - DNA, 16 bp, R. norvegicus
cccaggacctacatgg

SEQ ID NO: 492361 - DNA, 16 bp, R. norvegicus
cccaggacctccagcc

SEQ ID NO: 492362 - DNA, 16 bp, R. norvegicus
cccaggagcagaagat

SEQ ID NO: 492363 - DNA, 16 bp, R. norvegicus
cccaggagcagaagga

SEQ ID NO: 492364 - DNA, 16 bp, R. norvegicus
cccaggagcaggctct

SEQ ID NO: 492365 - DNA, 17 bp, R. norvegicus
cccaggagcgacaggac

SEQ ID NO: 492366 - DNA, 16 bp, R. norvegicus
cccaggagctctgaaa

SEQ ID NO: 492367 - DNA, 16 bp, R. norvegicus
cccaggagctctgagg

SEQ ID NO: 492368 - DNA, 16 bp, R. norvegicus
cccaggagctctggtt

SEQ ID NO: 492369 - DNA, 16 bp, R. norvegicus
cccaggagctgcagga

SEQ ID NO: 492370 - DNA, 16 bp, R. norvegicus
cccaggaggaggagaa

SEQ ID NO: 492371 - DNA, 16 bp, R. norvegicus
cccaggaggctctgac

SEQ ID NO: 492372 - DNA, 16 bp, R. norvegicus
cccaggaggctgaggc

SEQ ID NO: 492373 - DNA, 16 bp, R. norvegicus
cccaggaggggcaggc

SEQ ID NO: 492374 - DNA, 16 bp, R. norvegicus
cccaggaggtggaggc

SEQ ID NO: 492375 - DNA, 16 bp, R. norvegicus
cccaggagtacagaca

SEQ ID NO: 492376 - DNA, 16 bp, R. norvegicus
cccaggagtggcacca

SEQ ID NO: 492377 - DNA, 16 bp, R. norvegicus
cccaggagtggcagga

SEQ ID NO: 492378 - DNA, 16 bp, R. norvegicus
cccaggatcacagagg

SEQ ID NO: 492379 - DNA, 16 bp, R. norvegicus
cccaggattttttttt

SEQ ID NO: 492380 - DNA, 16 bp, R. norvegicus
cccaggcagcctggcc

SEQ ID NO: 492381 - DNA, 16 bp, R. norvegicus
cccaggcagctaggag

SEQ ID NO: 492382 - DNA, 16 bp, R. norvegicus
cccaggcagctgcaga

SEQ ID NO: 492383 - DNA, 16 bp, R. norvegicus
cccaggccagcctgga

SEQ ID NO: 492384 - DNA, 16 bp, R. norvegicus
cccaggccctggacag

SEQ ID NO: 492385 - DNA, 16 bp, R. norvegicus
cccaggctagcctgga

SEQ ID NO: 492386 - DNA, 16 bp, R. norvegicus
cccaggctcagtccaa

SEQ ID NO: 492387 - DNA, 16 bp, R. norvegicus
cccaggctctgaccct

SEQ ID NO: 492388 - DNA, 16 bp, R. norvegicus
cccaggctgaacttga

SEQ ID NO: 492389 - DNA, 16 bp, R. norvegicus
cccaggctgaggtgga

SEQ ID NO: 492390 - DNA, 16 bp, R. norvegicus
cccaggctggcctaca

SEQ ID NO: 492391 - DNA, 16 bp, R. norvegicus
cccaggctggcctcaa

SEQ ID NO: 492392 - DNA, 16 bp, R. norvegicus
cccaggctggcctctt

SEQ ID NO: 492393 - DNA, 16 bp, R. norvegicus
cccaggctggccttga

SEQ ID NO: 492394 - DNA, 16 bp, R. norvegicus
cccaggctggctcaga

SEQ ID NO: 492395 - DNA, 16 bp, R. norvegicus
cccaggctggtctcag

SEQ ID NO: 492396 - DNA, 16 bp, R. norvegicus
cccaggctgtccctga

SEQ ID NO: 492397 - DNA, 16 bp, R. norvegicus
cccaggctgtgtgata

SEQ ID NO: 492398 - DNA, 16 bp, R. norvegicus
cccaggcttgtctgtc

SEQ ID NO: 492399 - DNA, 16 bp, R. norvegicus
cccagggaagagcaca

SEQ ID NO: 492400 - DNA, 16 bp, R. norvegicus
cccagggactggagag

SEQ ID NO: 492401 - DNA, 16 bp, R. norvegicus
cccagggaggcagagg

SEQ ID NO: 492402 - DNA, 16 bp, R. norvegicus
cccagggaggccagag

SEQ ID NO: 492403 - DNA, 16 bp, R. norvegicus
cccagggagtagcatt

SEQ ID NO: 492404 - DNA, 16 bp, R. norvegicus
cccagggagtggcact

SEQ ID NO: 492405 - DNA, 16 bp, R. norvegicus
cccagggagtggcagt

SEQ ID NO: 492406 - DNA, 16 bp, R. norvegicus
cccagggagtggccct

SEQ ID NO: 492407 - DNA, 16 bp, R. norvegicus
cccagggatatcaacc

SEQ ID NO: 492408 - DNA, 16 bp, R. norvegicus
cccagggatggcaccg

SEQ ID NO: 492409 - DNA, 16 bp, R. norvegicus
cccagggccacacaga

SEQ ID NO: 492410 - DNA, 17 bp, R. norvegicus
cccagggccttgtgctc

SEQ ID NO: 492411 - DNA, 16 bp, R. norvegicus
cccagggccttgtggt

SEQ ID NO: 492412 - DNA, 16 bp, R. norvegicus
cccagggctcactggc

SEQ ID NO: 492413 - DNA, 16 bp, R. norvegicus
cccagggctccagcag

SEQ ID NO: 492414 - DNA, 16 bp, R. norvegicus
cccagggctccagctg

SEQ ID NO: 492415 - DNA, 16 bp, R. norvegicus
cccaggggccactccc

SEQ ID NO: 492416 - DNA, 16 bp, R. norvegicus
cccagggtcacacagc

SEQ ID NO: 492417 - DNA, 16 bp, R. norvegicus
cccagggtcttgtgca

SEQ ID NO: 492418 - DNA, 16 bp, R. norvegicus
cccaggtcacacagct

SEQ ID NO: 492419 - DNA, 16 bp, R. norvegicus
cccaggtccagacagg

SEQ ID NO: 492420 - DNA, 16 bp, R. norvegicus
cccaggtcctcaggaa

SEQ ID NO: 492421 - DNA, 16 bp, R. norvegicus
cccaggtgactcacag

SEQ ID NO: 492422 - DNA, 16 bp, R. norvegicus
cccaggtgctgggatg

SEQ ID NO: 492423 - DNA, 16 bp, R. norvegicus
cccaggtggcagggct

SEQ ID NO: 492424 - DNA, 16 bp, R. norvegicus
cccaggtggtactgat

SEQ ID NO: 492425 - DNA, 16 bp, R. norvegicus
cccaggtgtccctggg

SEQ ID NO: 492426 - DNA, 16 bp, R. norvegicus
cccagtacccacattg

SEQ ID NO: 492427 - DNA, 16 bp, R. norvegicus
cccagtactggggagg

SEQ ID NO: 492428 - DNA, 16 bp, R. norvegicus
cccagtatctctgagg

SEQ ID NO: 492429 - DNA, 16 bp, R. norvegicus
cccagtcacctcctcc

SEQ ID NO: 492430 - DNA, 16 bp, R. norvegicus
cccagtcagcaggaag

SEQ ID NO: 492431 - DNA, 16 bp, R. norvegicus
cccagtcccacagctc

SEQ ID NO: 492432 - DNA, 16 bp, R. norvegicus
cccagtcccagcccca

SEQ ID NO: 492433 - DNA, 16 bp, R. norvegicus
cccagtcccagtccca

SEQ ID NO: 492434 - DNA, 16 bp, R. norvegicus
cccagtctgtgccagt

SEQ ID NO: 492435 - DNA, 16 bp, R. norvegicus
cccagtcttttattga

SEQ ID NO: 492436 - DNA, 16 bp, R. norvegicus
cccagtgaacgggatt

SEQ ID NO: 492437 - DNA, 16 bp, R. norvegicus
cccagtgaactggact

SEQ ID NO: 492438 - DNA, 16 bp, R. norvegicus
cccagtgacacacttc

SEQ ID NO: 492439 - DNA, 16 bp, R. norvegicus
cccagtgacatgcctc

SEQ ID NO: 492440 - DNA, 16 bp, R. norvegicus
cccagtgagaatggct

SEQ ID NO: 492441 - DNA, 16 bp, R. norvegicus
cccagtgagccacctc

SEQ ID NO: 492442 - DNA, 16 bp, R. norvegicus
cccagtgcccaggtgt

SEQ ID NO: 492443 - DNA, 16 bp, R. norvegicus
cccagtgctctgttgc

SEQ ID NO: 492444 - DNA, 16 bp, R. norvegicus
cccagtggaagagtta

SEQ ID NO: 492445 - DNA, 16 bp, R. norvegicus
cccagtggccacacct

SEQ ID NO: 492446 - DNA, 16 bp, R. norvegicus
cccagtggctgtctct

SEQ ID NO: 492447 - DNA, 16 bp, R. norvegicus
cccagtggttcttctg

SEQ ID NO: 492448 - DNA, 16 bp, R. norvegicus
cccagtgtagggcaat

SEQ ID NO: 492449 - DNA, 16 bp, R. norvegicus
cccagtgtcaacctct

SEQ ID NO: 492450 - DNA, 16 bp, R. norvegicus
cccagtgtctctagcc

SEQ ID NO: 492451 - DNA, 16 bp, R. norvegicus
cccagtgtctgtctct

SEQ ID NO: 492452 - DNA, 16 bp, R. norvegicus
cccagtgtggatgctg

SEQ ID NO: 492453 - DNA, 16 bp, R. norvegicus
cccagtgtgggtgctg

SEQ ID NO: 492454 - DNA, 16 bp, R. norvegicus
cccagtgtgtccagcc

SEQ ID NO: 492455 - DNA, 16 bp, R. norvegicus
cccagttcagttccca

SEQ ID NO: 492456 - DNA, 16 bp, R. norvegicus
cccagttccccttccc

SEQ ID NO: 492457 - DNA, 16 bp, R. norvegicus
cccagttcctccctcc

SEQ ID NO: 492458 - DNA, 16 bp, R. norvegicus
cccagttgcagcagaa

SEQ ID NO: 492459 - DNA, 16 bp, R. norvegicus
cccagtttcaagcaag

SEQ ID NO: 492460 - DNA, 16 bp, R. norvegicus
cccagtttccaagcca

SEQ ID NO: 492461 - DNA, 16 bp, R. norvegicus
cccagtttccccctct

SEQ ID NO: 492462 - DNA, 16 bp, R. norvegicus
cccataactgtctgaa

SEQ ID NO: 492463 - DNA, 16 bp, R. norvegicus
cccataagaagagcaa

SEQ ID NO: 492464 - DNA, 16 bp, R. norvegicus
cccataagtgttacca

SEQ ID NO: 492465 - DNA, 16 bp, R. norvegicus
cccataattccagttc

SEQ ID NO: 492466 - DNA, 16 bp, R. norvegicus
cccatacacataaaat

SEQ ID NO: 492467 - DNA, 16 bp, R. norvegicus
cccataccacactgcc

SEQ ID NO: 492468 - DNA, 16 bp, R. norvegicus
cccatagacttatgtg

SEQ ID NO: 492469 - DNA, 18 bp, R. norvegicus
cccatagagaggagacac

SEQ ID NO: 492470 - DNA, 16 bp, R. norvegicus
cccatagctggctgaa

SEQ ID NO: 492471 - DNA, 16 bp, R. norvegicus
cccatatctgactcct

SEQ ID NO: 492472 - DNA, 16 bp, R. norvegicus
cccatatgtttgagac

SEQ ID NO: 492473 - DNA, 16 bp, R. norvegicus
cccatcaaaattcaaa

SEQ ID NO: 492474 - DNA, 16 bp, R. norvegicus
cccatcaggttgtctc

SEQ ID NO: 492475 - DNA, 16 bp, R. norvegicus
cccatccaattcttca

SEQ ID NO: 492476 - DNA, 16 bp, R. norvegicus
cccatcccactgtggg

SEQ ID NO: 492477 - DNA, 16 bp, R. norvegicus
cccatcccttcctgcc

SEQ ID NO: 492478 - DNA, 16 bp, R. norvegicus
cccatcgggacttgaa

SEQ ID NO: 492479 - DNA, 16 bp, R. norvegicus
cccatctcatgatgat

SEQ ID NO: 492480 - DNA, 16 bp, R. norvegicus
cccatctcctcccaga

SEQ ID NO: 492481 - DNA, 16 bp, R. norvegicus
cccatctctaagagga

SEQ ID NO: 492482 - DNA, 16 bp, R. norvegicus
cccatctcttcccaca

SEQ ID NO: 492483 - DNA, 16 bp, R. norvegicus
cccatctgcaaacacc

SEQ ID NO: 492484 - DNA, 16 bp, R. norvegicus
cccatcttctgctaca

SEQ ID NO: 492485 - DNA, 16 bp, R. norvegicus
cccatgaaagccagaa

SEQ ID NO: 492486 - DNA, 16 bp, R. norvegicus
cccatgagcaacttca

SEQ ID NO: 492487 - DNA, 16 bp, R. norvegicus
cccatgatacaactca

SEQ ID NO: 492488 - DNA, 16 bp, R. norvegicus
cccatgatcctcctgc

SEQ ID NO: 492489 - DNA, 16 bp, R. norvegicus
cccatgcatgcatgca

SEQ ID NO: 492490 - DNA, 16 bp, R. norvegicus
cccatgccaggcagct

SEQ ID NO: 492491 - DNA, 16 bp, R. norvegicus
cccatgcccacatccc

SEQ ID NO: 492492 - DNA, 16 bp, R. norvegicus
cccatggaaacagtgg

SEQ ID NO: 492493 - DNA, 16 bp, R. norvegicus
cccatggaagtcagaa

SEQ ID NO: 492494 - DNA, 16 bp, R. norvegicus
cccatggcaagttcaa

SEQ ID NO: 492495 - DNA, 16 bp, R. norvegicus
cccatggctcaagctg

SEQ ID NO: 492496 - DNA, 16 bp, R. norvegicus
cccatggctccagctc

SEQ ID NO: 492497 - DNA, 16 bp, R. norvegicus
cccatggctctagcca

SEQ ID NO: 492498 - DNA, 16 bp, R. norvegicus
cccatgggaagaacaa

SEQ ID NO: 492499 - DNA, 16 bp, R. norvegicus
cccatgggggagagag

SEQ ID NO: 492500 - DNA, 16 bp, R. norvegicus
cccatgggggccattc

SEQ ID NO: 492501 - DNA, 16 bp, R. norvegicus
cccatgtattctatca

SEQ ID NO: 492502 - DNA, 16 bp, R. norvegicus
cccatgtctccacaag

SEQ ID NO: 492503 - DNA, 16 bp, R. norvegicus
cccatgtgaagaccaa

SEQ ID NO: 492504 - DNA, 16 bp, R. norvegicus
cccatgtgcatgcatg

SEQ ID NO: 492505 - DNA, 16 bp, R. norvegicus
cccatgtggtagaaga

SEQ ID NO: 492506 - DNA, 16 bp, R. norvegicus
cccatgtgttcgagac

SEQ ID NO: 492507 - DNA, 16 bp, R. norvegicus
cccatgtttgaaaatg

SEQ ID NO: 492508 - DNA, 16 bp, R. norvegicus
cccattactgccctcc

SEQ ID NO: 492509 - DNA, 16 bp, R. norvegicus
cccattcacagctgcc

SEQ ID NO: 492510 - DNA, 16 bp, R. norvegicus
cccattctcagccttg

SEQ ID NO: 492511 - DNA, 16 bp, R. norvegicus
cccattgaaatcctga

SEQ ID NO: 492512 - DNA, 16 bp, R. norvegicus
cccattgccgacctcc

SEQ ID NO: 492513 - DNA, 16 bp, R. norvegicus
cccattgctccaactg

SEQ ID NO: 492514 - DNA, 16 bp, R. norvegicus
cccattgctccagctg

SEQ ID NO: 492515 - DNA, 16 bp, R. norvegicus
cccattgtgtcctgga

SEQ ID NO: 492516 - DNA, 16 bp, R. norvegicus
cccatttcacagagga

SEQ ID NO: 492517 - DNA, 16 bp, R. norvegicus
cccatttcacagatga

SEQ ID NO: 492518 - DNA, 16 bp, R. norvegicus
cccattttaccaaaag

SEQ ID NO: 492519 - DNA, 16 bp, R. norvegicus
cccattttttaatagg

SEQ ID NO: 492520 - DNA, 16 bp, R. norvegicus
ccccaaaacaagacag

SEQ ID NO: 492521 - DNA, 16 bp, R. norvegicus
ccccaaaacctgacac

SEQ ID NO: 492522 - DNA, 16 bp, R. norvegicus
ccccaaagcccactcc

SEQ ID NO: 492523 - DNA, 16 bp, R. norvegicus
ccccaaagctgttgcc

SEQ ID NO: 492524 - DNA, 16 bp, R. norvegicus
ccccaaaggggttgag

SEQ ID NO: 492525 - DNA, 16 bp, R. norvegicus
ccccaacacatataga

SEQ ID NO: 492526 - DNA, 16 bp, R. norvegicus
ccccaacaccaagcct

SEQ ID NO: 492527 - DNA, 21 bp, R. norvegicus
ccccaacatgtaaaaaagaca

SEQ ID NO: 492528 - DNA, 16 bp, R. norvegicus
ccccaaccccaaaagt

SEQ ID NO: 492529 - DNA, 16 bp, R. norvegicus
ccccaaccccaaggtc

SEQ ID NO: 492530 - DNA, 16 bp, R. norvegicus
ccccaaccccaagtgt

SEQ ID NO: 492531 - DNA, 16 bp, R. norvegicus
ccccaaccccaatatt

SEQ ID NO: 492532 - DNA, 16 bp, R. norvegicus
ccccaaccccaatttt

SEQ ID NO: 492533 - DNA, 16 bp, R. norvegicus
ccccaaccccagaact

SEQ ID NO: 492534 - DNA, 16 bp, R. norvegicus
ccccaaccccagagag

SEQ ID NO: 492535 - DNA, 16 bp, R. norvegicus
ccccaaccccagatta

SEQ ID NO: 492536 - DNA, 16 bp, R. norvegicus
ccccaaccccagcact

SEQ ID NO: 492537 - DNA, 16 bp, R. norvegicus
ccccaaccccaggaga

SEQ ID NO: 492538 - DNA, 16 bp, R. norvegicus
ccccaaccccaggagt

SEQ ID NO: 492539 - DNA, 16 bp, R. norvegicus
ccccaaccccagtatt

SEQ ID NO: 492540 - DNA, 16 bp, R. norvegicus
ccccaaccccataata

SEQ ID NO: 492541 - DNA, 16 bp, R. norvegicus
ccccaacccccactgt

SEQ ID NO: 492542 - DNA, 16 bp, R. norvegicus
ccccaacccccagttt

SEQ ID NO: 492543 - DNA, 16 bp, R. norvegicus
ccccaacccccatgca

SEQ ID NO: 492544 - DNA, 16 bp, R. norvegicus
ccccaaccccccaagt

SEQ ID NO: 492545 - DNA, 16 bp, R. norvegicus
ccccaaccccctgctt

SEQ ID NO: 492546 - DNA, 16 bp, R. norvegicus
ccccaacccctcactg

SEQ ID NO: 492547 - DNA, 16 bp, R. norvegicus
ccccaacccctctgaa

SEQ ID NO: 492548 - DNA, 16 bp, R. norvegicus
ccccaacccctgcatc

SEQ ID NO: 492549 - DNA, 16 bp, R. norvegicus
ccccaacccctggacc

SEQ ID NO: 492550 - DNA, 16 bp, R. norvegicus
ccccaacccctggact

SEQ ID NO: 492551 - DNA, 16 bp, R. norvegicus
ccccaacccctggatc

SEQ ID NO: 492552 - DNA, 16 bp, R. norvegicus
ccccaaccccttgcct

SEQ ID NO: 492553 - DNA, 16 bp, R. norvegicus
ccccaagcccccagct

SEQ ID NO: 492554 - DNA, 16 bp, R. norvegicus
ccccaaggacagcagc

SEQ ID NO: 492555 - DNA, 16 bp, R. norvegicus
ccccaaggcctgacac

SEQ ID NO: 492556 - DNA, 16 bp, R. norvegicus
ccccaaggtctgacac

SEQ ID NO: 492557 - DNA, 16 bp, R. norvegicus
ccccaagtcctcccag

SEQ ID NO: 492558 - DNA, 16 bp, R. norvegicus
ccccaagtggcagtgt

SEQ ID NO: 492559 - DNA, 16 bp, R. norvegicus
ccccaatgaggggctg

SEQ ID NO: 492560 - DNA, 21 bp, R. norvegicus
ccccaatgctgttcctttcag

SEQ ID NO: 492561 - DNA, 16 bp, R. norvegicus
ccccacacacaccctg

SEQ ID NO: 492562 - DNA, 16 bp, R. norvegicus
ccccacagacatgctc

SEQ ID NO: 492563 - DNA, 16 bp, R. norvegicus
ccccacaggaacagct

SEQ ID NO: 492564 - DNA, 16 bp, R. norvegicus
ccccacaggaagacca

SEQ ID NO: 492565 - DNA, 16 bp, R. norvegicus
ccccacagttgcctgg

SEQ ID NO: 492566 - DNA, 16 bp, R. norvegicus
ccccacatgtcgccca

SEQ ID NO: 492567 - DNA, 17 bp, R. norvegicus
ccccaccaagcaagaga

SEQ ID NO: 492568 - DNA, 16 bp, R. norvegicus
ccccaccaggttccct

SEQ ID NO: 492569 - DNA, 16 bp, R. norvegicus
ccccacccctgcttct

SEQ ID NO: 492570 - DNA, 16 bp, R. norvegicus
ccccacccctgtgtgt

SEQ ID NO: 492571 - DNA, 16 bp, R. norvegicus
ccccaccctgggacat

SEQ ID NO: 492572 - DNA, 16 bp, R. norvegicus
ccccacctctgtctct

SEQ ID NO: 492573 - DNA, 16 bp, R. norvegicus
ccccacctggagatct

SEQ ID NO: 492574 - DNA, 16 bp, R. norvegicus
ccccacctggggaatc

SEQ ID NO: 492575 - DNA, 16 bp, R. norvegicus
ccccactcccactgct

SEQ ID NO: 492576 - DNA, 16 bp, R. norvegicus
ccccagaaaaagcaag

SEQ ID NO: 492577 - DNA, 16 bp, R. norvegicus
ccccagaacccacaga

SEQ ID NO: 492578 - DNA, 16 bp, R. norvegicus
ccccagaacctgaagg

SEQ ID NO: 492579 - DNA, 16 bp, R. norvegicus
ccccagaaggcagcag

SEQ ID NO: 492580 - DNA, 16 bp, R. norvegicus
ccccagaagtgagtca

SEQ ID NO: 492581 - DNA, 17 bp, R. norvegicus
ccccagacacagagaga

SEQ ID NO: 492582 - DNA, 16 bp, R. norvegicus
ccccagagaaggaggg

SEQ ID NO: 492583 - DNA, 16 bp, R. norvegicus
ccccagagacaaagac

SEQ ID NO: 492584 - DNA, 16 bp, R. norvegicus
ccccagagctccaagg

SEQ ID NO: 492585 - DNA, 16 bp, R. norvegicus
ccccagaggaccccag

SEQ ID NO: 492586 - DNA, 16 bp, R. norvegicus
ccccagagtttccagg

SEQ ID NO: 492587 - DNA, 16 bp, R. norvegicus
ccccagatgccaggaa

SEQ ID NO: 492588 - DNA, 16 bp, R. norvegicus
ccccagcaaaatacca

SEQ ID NO: 492589 - DNA, 16 bp, R. norvegicus
ccccagcaacagtttc

SEQ ID NO: 492590 - DNA, 16 bp, R. norvegicus
ccccagcaatggttct

SEQ ID NO: 492591 - DNA, 16 bp, R. norvegicus
ccccagcacactccct

SEQ ID NO: 492592 - DNA, 16 bp, R. norvegicus
ccccagcagccatcaa

SEQ ID NO: 492593 - DNA, 16 bp, R. norvegicus
ccccagcatctggctc

SEQ ID NO: 492594 - DNA, 16 bp, R. norvegicus
ccccagccccaagatg

SEQ ID NO: 492595 - DNA, 16 bp, R. norvegicus
ccccagccccaagtca

SEQ ID NO: 492596 - DNA, 16 bp, R. norvegicus
ccccagccccagcctg

SEQ ID NO: 492597 - DNA, 16 bp, R. norvegicus
ccccagccccaggagc

SEQ ID NO: 492598 - DNA, 16 bp, R. norvegicus
ccccagccccagtcct

SEQ ID NO: 492599 - DNA, 16 bp, R. norvegicus
ccccagcccccagttc

SEQ ID NO: 492600 - DNA, 16 bp, R. norvegicus
ccccagccccctttct

SEQ ID NO: 492601 - DNA, 16 bp, R. norvegicus
ccccagccccgtgtgt

SEQ ID NO: 492602 - DNA, 16 bp, R. norvegicus
ccccagcccctctttt

SEQ ID NO: 492603 - DNA, 16 bp, R. norvegicus
ccccagcccctgcctt

SEQ ID NO: 492604 - DNA, 16 bp, R. norvegicus
ccccagcccctgcttc

SEQ ID NO: 492605 - DNA, 16 bp, R. norvegicus
ccccagccccttcttt

SEQ ID NO: 492606 - DNA, 16 bp, R. norvegicus
ccccagccctggcctc

SEQ ID NO: 492607 - DNA, 16 bp, R. norvegicus
ccccagcctcagtttc

SEQ ID NO: 492608 - DNA, 16 bp, R. norvegicus
ccccagcctgtcccct

SEQ ID NO: 492609 - DNA, 16 bp, R. norvegicus
ccccagctatcctgga

SEQ ID NO: 492610 - DNA, 16 bp, R. norvegicus
ccccagctccagcctc

SEQ ID NO: 492611 - DNA, 16 bp, R. norvegicus
ccccagctccccagct

SEQ ID NO: 492612 - DNA, 17 bp, R. norvegicus
ccccagctctgaagaaa

SEQ ID NO: 492613 - DNA, 16 bp, R. norvegicus
ccccagctctgagaaa

SEQ ID NO: 492614 - DNA, 16 bp, R. norvegicus
ccccagctctgccctc

SEQ ID NO: 492615 - DNA, 16 bp, R. norvegicus
ccccagctctgggaga

SEQ ID NO: 492616 - DNA, 16 bp, R. norvegicus
ccccagctctgggcac

SEQ ID NO: 492617 - DNA, 16 bp, R. norvegicus
ccccagcttccccaca

SEQ ID NO: 492618 - DNA, 16 bp, R. norvegicus
ccccaggaagcagcag

SEQ ID NO: 492619 - DNA, 16 bp, R. norvegicus
ccccaggaccaccagc

SEQ ID NO: 492620 - DNA, 16 bp, R. norvegicus
ccccaggagctgggga

SEQ ID NO: 492621 - DNA, 16 bp, R. norvegicus
ccccaggatccaggga

SEQ ID NO: 492622 - DNA, 16 bp, R. norvegicus
ccccaggcaaacatgc

SEQ ID NO: 492623 - DNA, 27 bp, R. norvegicus
ccccaggccctgtacatctggaaggtg

SEQ ID NO: 492624 - DNA, 16 bp, R. norvegicus
ccccaggctggcctgg

SEQ ID NO: 492625 - DNA, 16 bp, R. norvegicus
ccccaggctggctttg

SEQ ID NO: 492626 - DNA, 16 bp, R. norvegicus
ccccagggaagagcat

SEQ ID NO: 492627 - DNA, 16 bp, R. norvegicus
ccccagggatcctcct

SEQ ID NO: 492628 - DNA, 16 bp, R. norvegicus
ccccagggctgggatt

SEQ ID NO: 492629 - DNA, 16 bp, R. norvegicus
ccccagtcagctgcag

SEQ ID NO: 492630 - DNA, 16 bp, R. norvegicus
ccccagtctctgtctc

SEQ ID NO: 492631 - DNA, 16 bp, R. norvegicus
ccccagtgaacctgat

SEQ ID NO: 492632 - DNA, 21 bp, R. norvegicus
ccccagtgaacgtgattgttg

SEQ ID NO: 492633 - DNA, 16 bp, R. norvegicus
ccccagtgaaggggga

SEQ ID NO: 492634 - DNA, 16 bp, R. norvegicus
ccccagtgaccctgaa

SEQ ID NO: 492635 - DNA, 19 bp, R. norvegicus
ccccagtgaggggctgggg

SEQ ID NO: 492636 - DNA, 16 bp, R. norvegicus
ccccagtgcaccaggg

SEQ ID NO: 492637 - DNA, 16 bp, R. norvegicus
ccccagtgctcccagg

SEQ ID NO: 492638 - DNA, 16 bp, R. norvegicus
ccccagtggaagggga

SEQ ID NO: 492639 - DNA, 16 bp, R. norvegicus
ccccagtggacaaatt

SEQ ID NO: 492640 - DNA, 16 bp, R. norvegicus
ccccagtggaggagct

SEQ ID NO: 492641 - DNA, 16 bp, R. norvegicus
ccccagtgtgtgtgtg

SEQ ID NO: 492642 - DNA, 16 bp, R. norvegicus
ccccagttccagagga

SEQ ID NO: 492643 - DNA, 17 bp, R. norvegicus
ccccagttccggaaaaa

SEQ ID NO: 492644 - DNA, 16 bp, R. norvegicus
ccccatatatttgagg

SEQ ID NO: 492645 - DNA, 16 bp, R. norvegicus
ccccatcaagctcttc

SEQ ID NO: 492646 - DNA, 16 bp, R. norvegicus
ccccatcccccaactg

SEQ ID NO: 492647 - DNA, 16 bp, R. norvegicus
ccccatcccctgggct

SEQ ID NO: 492648 - DNA, 16 bp, R. norvegicus
ccccatccctgtctcc

SEQ ID NO: 492649 - DNA, 16 bp, R. norvegicus
ccccatcctccactgc

SEQ ID NO: 492650 - DNA, 16 bp, R. norvegicus
ccccatccttgccagc

SEQ ID NO: 492651 - DNA, 16 bp, R. norvegicus
ccccatctccaagaag

SEQ ID NO: 492652 - DNA, 16 bp, R. norvegicus
ccccatctgcatcagc

SEQ ID NO: 492653 - DNA, 16 bp, R. norvegicus
ccccatgaaactgaaa

SEQ ID NO: 492654 - DNA, 16 bp, R. norvegicus
ccccatgaagaccaag

SEQ ID NO: 492655 - DNA, 16 bp, R. norvegicus
ccccatgggatttggg

SEQ ID NO: 492656 - DNA, 16 bp, R. norvegicus
ccccatgtgggtgctg

SEQ ID NO: 492657 - DNA, 16 bp, R. norvegicus
ccccattagaagatgc

SEQ ID NO: 492658 - DNA, 16 bp, R. norvegicus
ccccattctattgtta

SEQ ID NO: 492659 - DNA, 16 bp, R. norvegicus
ccccattctccttcaa

SEQ ID NO: 492660 - DNA, 16 bp, R. norvegicus
ccccattgtcaccctc

SEQ ID NO: 492661 - DNA, 16 bp, R. norvegicus
ccccatttctttgttt

SEQ ID NO: 492662 - DNA, 16 bp, R. norvegicus
cccccaaagtccaggg

SEQ ID NO: 492663 - DNA, 16 bp, R. norvegicus
cccccaacaactggag

SEQ ID NO: 492664 - DNA, 16 bp, R. norvegicus
cccccaacaatcttgt

SEQ ID NO: 492665 - DNA, 16 bp, R. norvegicus
cccccaacactgagca

SEQ ID NO: 492666 - DNA, 16 bp, R. norvegicus
cccccaaccataaagt

SEQ ID NO: 492667 - DNA, 16 bp, R. norvegicus
cccccaagaactcaca

SEQ ID NO: 492668 - DNA, 16 bp, R. norvegicus
cccccaagaactcatg

SEQ ID NO: 492669 - DNA, 16 bp, R. norvegicus
cccccaaggaactact

SEQ ID NO: 492670 - DNA, 16 bp, R. norvegicus
cccccaagggtccagg

SEQ ID NO: 492671 - DNA, 16 bp, R. norvegicus
cccccaatccccaggg

SEQ ID NO: 492672 - DNA, 16 bp, R. norvegicus
cccccacccccgtttt

SEQ ID NO: 492673 - DNA, 16 bp, R. norvegicus
cccccacctcctgctt

SEQ ID NO: 492674 - DNA, 16 bp, R. norvegicus
cccccactcactcctg

SEQ ID NO: 492675 - DNA, 16 bp, R. norvegicus
cccccagagtgctggg

SEQ ID NO: 492676 - DNA, 16 bp, R. norvegicus
cccccagctggggacc

SEQ ID NO: 492677 - DNA, 16 bp, R. norvegicus
cccccagtgaccgtga

SEQ ID NO: 492678 - DNA, 16 bp, R. norvegicus
cccccagtttactcag

SEQ ID NO: 492679 - DNA, 16 bp, R. norvegicus
cccccatcccctggtg

SEQ ID NO: 492680 - DNA, 16 bp, R. norvegicus
cccccatggcagctca

SEQ ID NO: 492681 - DNA, 16 bp, R. norvegicus
cccccatgtatactct

SEQ ID NO: 492682 - DNA, 16 bp, R. norvegicus
cccccatgtgtgtgtg

SEQ ID NO: 492683 - DNA, 16 bp, R. norvegicus
cccccattaccgctct

SEQ ID NO: 492684 - DNA, 16 bp, R. norvegicus
ccccccaaaagtccag

SEQ ID NO: 492685 - DNA, 16 bp, R. norvegicus
ccccccagagctgggg

SEQ ID NO: 492686 - DNA, 16 bp, R. norvegicus
ccccccatctccaaga

SEQ ID NO: 492687 - DNA, 16 bp, R. norvegicus
ccccccattgctgccc

SEQ ID NO: 492688 - DNA, 16 bp, R. norvegicus
cccccctggagctgag

SEQ ID NO: 492689 - DNA, 16 bp, R. norvegicus
cccccgacattcccct

SEQ ID NO: 492690 - DNA, 16 bp, R. norvegicus
cccccgcggagagctc

SEQ ID NO: 492691 - DNA, 16 bp, R. norvegicus
cccccggagctgggga

SEQ ID NO: 492692 - DNA, 16 bp, R. norvegicus
ccccctccatggcctc

SEQ ID NO: 492693 - DNA, 16 bp, R. norvegicus
ccccctgcctcaacct

SEQ ID NO: 492694 - DNA, 16 bp, R. norvegicus
ccccctgcctcagctt

SEQ ID NO: 492695 - DNA, 16 bp, R. norvegicus
ccccctggaactgaag

SEQ ID NO: 492696 - DNA, 16 bp, R. norvegicus
ccccctggagctagag

SEQ ID NO: 492697 - DNA, 16 bp, R. norvegicus
ccccctggagctggag

SEQ ID NO: 492698 - DNA, 16 bp, R. norvegicus
ccccctgtgtactctt

SEQ ID NO: 492699 - DNA, 16 bp, R. norvegicus
cccccttcccagtctc

SEQ ID NO: 492700 - DNA, 16 bp, R. norvegicus
cccccttgagctggat

SEQ ID NO: 492701 - DNA, 16 bp, R. norvegicus
cccccttttgagaagg

SEQ ID NO: 492702 - DNA, 16 bp, R. norvegicus
ccccctttttgtttta

SEQ ID NO: 492703 - DNA, 16 bp, R. norvegicus
ccccgcaagcaaactt

SEQ ID NO: 492704 - DNA, 16 bp, R. norvegicus
ccccgcagatgccatg

SEQ ID NO: 492705 - DNA, 16 bp, R. norvegicus
ccccgcccacagtggg

SEQ ID NO: 492706 - DNA, 17 bp, R. norvegicus
ccccggagacccctgag

SEQ ID NO: 492707 - DNA, 16 bp, R. norvegicus
ccccggggctggggat

SEQ ID NO: 492708 - DNA, 16 bp, R. norvegicus
ccccgggtgaggagaa

SEQ ID NO: 492709 - DNA, 16 bp, R. norvegicus
cccctaatctactctt

SEQ ID NO: 492710 - DNA, 16 bp, R. norvegicus
cccctaccattttaac

SEQ ID NO: 492711 - DNA, 16 bp, R. norvegicus
cccctacttctcctgg

SEQ ID NO: 492712 - DNA, 16 bp, R. norvegicus
cccctagcagccttca

SEQ ID NO: 492713 - DNA, 16 bp, R. norvegicus
cccctataaaaacccc

SEQ ID NO: 492714 - DNA, 16 bp, R. norvegicus
cccctatacattcccc

SEQ ID NO: 492715 - DNA, 16 bp, R. norvegicus
cccctatcccatctgc

SEQ ID NO: 492716 - DNA, 16 bp, R. norvegicus
cccctatgccaatgag

SEQ ID NO: 492717 - DNA, 16 bp, R. norvegicus
cccctatgcctatgtg

SEQ ID NO: 492718 - DNA, 16 bp, R. norvegicus
cccctcaagtagcttc

SEQ ID NO: 492719 - DNA, 16 bp, R. norvegicus
cccctcagaggacagc

SEQ ID NO: 492720 - DNA, 16 bp, R. norvegicus
cccctcagccccaggc

SEQ ID NO: 492721 - DNA, 16 bp, R. norvegicus
cccctccagaagcccc

SEQ ID NO: 492722 - DNA, 16 bp, R. norvegicus
cccctccagctcttca

SEQ ID NO: 492723 - DNA, 16 bp, R. norvegicus
cccctccaggtccacc

SEQ ID NO: 492724 - DNA, 16 bp, R. norvegicus
cccctccatggcccct

SEQ ID NO: 492725 - DNA, 16 bp, R. norvegicus
cccctccatggtctct

SEQ ID NO: 492726 - DNA, 16 bp, R. norvegicus
cccctcccagaaaggg

SEQ ID NO: 492727 - DNA, 16 bp, R. norvegicus
cccctcccagtcacct

SEQ ID NO: 492728 - DNA, 16 bp, R. norvegicus
cccctcccccagagct

SEQ ID NO: 492729 - DNA, 16 bp, R. norvegicus
cccctccccttctgta

SEQ ID NO: 492730 - DNA, 16 bp, R. norvegicus
cccctctgactcctac

SEQ ID NO: 492731 - DNA, 16 bp, R. norvegicus
cccctctgactttcat

SEQ ID NO: 492732 - DNA, 16 bp, R. norvegicus
cccctctgctcacctt

SEQ ID NO: 492733 - DNA, 16 bp, R. norvegicus
cccctcttctggtgtg

SEQ ID NO: 492734 - DNA, 16 bp, R. norvegicus
cccctgaaatcctttt

SEQ ID NO: 492735 - DNA, 16 bp, R. norvegicus
cccctgaactcttcct

SEQ ID NO: 492736 - DNA, 36 bp, R. norvegicus
cccctgactgtattagatgatgttactgaaccaaca

SEQ ID NO: 492737 - DNA, 16 bp, R. norvegicus
cccctgagaagctctg

SEQ ID NO: 492738 - DNA, 16 bp, R. norvegicus
cccctgagcactggga

SEQ ID NO: 492739 - DNA, 16 bp, R. norvegicus
cccctgcatcctatca

SEQ ID NO: 492740 - DNA, 16 bp, R. norvegicus
cccctgccagctgcag

SEQ ID NO: 492741 - DNA, 16 bp, R. norvegicus
cccctgcccacatcac

SEQ ID NO: 492742 - DNA, 16 bp, R. norvegicus
cccctgcccacatcca

SEQ ID NO: 492743 - DNA, 16 bp, R. norvegicus
cccctgcctcagtctc

SEQ ID NO: 492744 - DNA, 16 bp, R. norvegicus
cccctgcctccccagt

SEQ ID NO: 492745 - DNA, 16 bp, R. norvegicus
cccctgcctctgtgag

SEQ ID NO: 492746 - DNA, 16 bp, R. norvegicus
cccctgctgagcccgg

SEQ ID NO: 492747 - DNA, 16 bp, R. norvegicus
cccctgctgctgcagg

SEQ ID NO: 492748 - DNA, 16 bp, R. norvegicus
cccctgcttccactct

SEQ ID NO: 492749 - DNA, 16 bp, R. norvegicus
cccctgcttccatgag

SEQ ID NO: 492750 - DNA, 16 bp, R. norvegicus
cccctggaagaacagc

SEQ ID NO: 492751 - DNA, 16 bp, R. norvegicus
cccctggacaggtggt

SEQ ID NO: 492752 - DNA, 16 bp, R. norvegicus
cccctggagctggagt

SEQ ID NO: 492753 - DNA, 17 bp, R. norvegicus
cccctggagctggagtc

SEQ ID NO: 492754 - DNA, 16 bp, R. norvegicus
cccctggagctggtgt

SEQ ID NO: 492755 - DNA, 16 bp, R. norvegicus
cccctggcttgcccag

SEQ ID NO: 492756 - DNA, 16 bp, R. norvegicus
cccctgtcttcctgtt

SEQ ID NO: 492757 - DNA, 16 bp, R. norvegicus
cccctgtggcctggtg

SEQ ID NO: 492758 - DNA, 17 bp, R. norvegicus
ccccttacactgatgat

SEQ ID NO: 492759 - DNA, 16 bp, R. norvegicus
ccccttcaactctttc

SEQ ID NO: 492760 - DNA, 16 bp, R. norvegicus
ccccttcagccccttc

SEQ ID NO: 492761 - DNA, 16 bp, R. norvegicus
ccccttcagctcctcc

SEQ ID NO: 492762 - DNA, 16 bp, R. norvegicus
ccccttcaggctcttt

SEQ ID NO: 492763 - DNA, 16 bp, R. norvegicus
ccccttcatgacaaaa

SEQ ID NO: 492764 - DNA, 16 bp, R. norvegicus
ccccttccactgatgc

SEQ ID NO: 492765 - DNA, 16 bp, R. norvegicus
ccccttcccagttccc

SEQ ID NO: 492766 - DNA, 16 bp, R. norvegicus
ccccttccctggggca

SEQ ID NO: 492767 - DNA, 16 bp, R. norvegicus
ccccttcctggtttcc

SEQ ID NO: 492768 - DNA, 16 bp, R. norvegicus
ccccttctaagaatga

SEQ ID NO: 492769 - DNA, 16 bp, R. norvegicus
ccccttctcagagaag

SEQ ID NO: 492770 - DNA, 16 bp, R. norvegicus
ccccttctctatgtgt

SEQ ID NO: 492771 - DNA, 16 bp, R. norvegicus
ccccttctctgagaag

SEQ ID NO: 492772 - DNA, 16 bp, R. norvegicus
ccccttctgctgcctg

SEQ ID NO: 492773 - DNA, 16 bp, R. norvegicus
cccctttcccaggttc

SEQ ID NO: 492774 - DNA, 16 bp, R. norvegicus
cccctttgcctctctg

SEQ ID NO: 492775 - DNA, 16 bp, R. norvegicus
ccccttttacagtgtc

SEQ ID NO: 492776 - DNA, 16 bp, R. norvegicus
cccgaaggcagaacac

SEQ ID NO: 492777 - DNA, 16 bp, R. norvegicus
cccgaggctgcagagc

SEQ ID NO: 492778 - DNA, 18 bp, R. norvegicus
cccgatcccagtatctct

SEQ ID NO: 492779 - DNA, 16 bp, R. norvegicus
cccgcatggcagctca

SEQ ID NO: 492780 - DNA, 16 bp, R. norvegicus
cccgcccccagtgaca

SEQ ID NO: 492781 - DNA, 16 bp, R. norvegicus
cccgcggatcccggcc

SEQ ID NO: 492782 - DNA, 16 bp, R. norvegicus
cccggaaactgggaaa

SEQ ID NO: 492783 - DNA, 16 bp, R. norvegicus
cccggaagtcctgcct

SEQ ID NO: 492784 - DNA, 16 bp, R. norvegicus
cccggaatgggcaaag

SEQ ID NO: 492785 - DNA, 18 bp, R. norvegicus
cccggcctgcagcagctc

SEQ ID NO: 492786 - DNA, 16 bp, R. norvegicus
cccgggcagcttctcc

SEQ ID NO: 492787 - DNA, 16 bp, R. norvegicus
cccggtttcctgccca

SEQ ID NO: 492788 - DNA, 16 bp, R. norvegicus
cccgtatagaagggga

SEQ ID NO: 492789 - DNA, 17 bp, R. norvegicus
cccgtcagaaatctgag

SEQ ID NO: 492790 - DNA, 16 bp, R. norvegicus
cccgtctggacctgag

SEQ ID NO: 492791 - DNA, 16 bp, R. norvegicus
cccgtctggacctggc

SEQ ID NO: 492792 - DNA, 16 bp, R. norvegicus
cccgtctggtcctggg

SEQ ID NO: 492793 - DNA, 16 bp, R. norvegicus
ccctaaaagaattaca

SEQ ID NO: 492794 - DNA, 17 bp, R. norvegicus
ccctaaagaaatgttca

SEQ ID NO: 492795 - DNA, 16 bp, R. norvegicus
ccctaaagatgcccca

SEQ ID NO: 492796 - DNA, 16 bp, R. norvegicus
ccctaagcctctcaaa

SEQ ID NO: 492797 - DNA, 16 bp, R. norvegicus
ccctaaggaaataaaa

SEQ ID NO: 492798 - DNA, 16 bp, R. norvegicus
ccctacagagactgcc

SEQ ID NO: 492799 - DNA, 16 bp, R. norvegicus
ccctaccagaggactt

SEQ ID NO: 492800 - DNA, 16 bp, R. norvegicus
ccctaccatgccacag

SEQ ID NO: 492801 - DNA, 16 bp, R. norvegicus
ccctaccctgccctgc

SEQ ID NO: 492802 - DNA, 16 bp, R. norvegicus
ccctactgacacagat

SEQ ID NO: 492803 - DNA, 16 bp, R. norvegicus
ccctagaaaaagcaaa

SEQ ID NO: 492804 - DNA, 16 bp, R. norvegicus
ccctagctgggctgcc

SEQ ID NO: 492805 - DNA, 16 bp, R. norvegicus
ccctagtgcccatgtg

SEQ ID NO: 492806 - DNA, 31 bp, R. norvegicus
ccctataaaagccccatgctggagctgctgg

SEQ ID NO: 492807 - DNA, 16 bp, R. norvegicus
ccctatacatcctcct

SEQ ID NO: 492808 - DNA, 16 bp, R. norvegicus
ccctataccatcctcc

SEQ ID NO: 492809 - DNA, 16 bp, R. norvegicus
ccctatgaatgtaacc

SEQ ID NO: 492810 - DNA, 16 bp, R. norvegicus
ccctatgacccagatg

SEQ ID NO: 492811 - DNA, 16 bp, R. norvegicus
ccctattcctgctcca

SEQ ID NO: 492812 - DNA, 16 bp, R. norvegicus
ccctcaactacctcag

SEQ ID NO: 492813 - DNA, 16 bp, R. norvegicus
ccctcaactgagggcc

SEQ ID NO: 492814 - DNA, 16 bp, R. norvegicus
ccctcacactgcctct

SEQ ID NO: 492815 - DNA, 16 bp, R. norvegicus
ccctcaccaaagaagc

SEQ ID NO: 492816 - DNA, 16 bp, R. norvegicus
ccctcaccagctgtgt

SEQ ID NO: 492817 - DNA, 16 bp, R. norvegicus
ccctcagaaaagagca

SEQ ID NO: 492818 - DNA, 16 bp, R. norvegicus
ccctcagaactcaggg

SEQ ID NO: 492819 - DNA, 16 bp, R. norvegicus
ccctcagacattgctg

SEQ ID NO: 492820 - DNA, 16 bp, R. norvegicus
ccctcagagaagggga

SEQ ID NO: 492821 - DNA, 16 bp, R. norvegicus
ccctcagcccctcagc

SEQ ID NO: 492822 - DNA, 16 bp, R. norvegicus
ccctcagctacttcag

SEQ ID NO: 492823 - DNA, 16 bp, R. norvegicus
ccctcaggagacagag

SEQ ID NO: 492824 - DNA, 18 bp, R. norvegicus
ccctcaggccagaccctg

SEQ ID NO: 492825 - DNA, 16 bp, R. norvegicus
ccctcagtttgtgttt

SEQ ID NO: 492826 - DNA, 16 bp, R. norvegicus
ccctcatcaaagaagc

SEQ ID NO: 492827 - DNA, 16 bp, R. norvegicus
ccctcatcaaaggcat

SEQ ID NO: 492828 - DNA, 16 bp, R. norvegicus
ccctcatcaagaaaac

SEQ ID NO: 492829 - DNA, 16 bp, R. norvegicus
ccctcatccccacaga

SEQ ID NO: 492830 - DNA, 16 bp, R. norvegicus
ccctcatcctggctgc

SEQ ID NO: 492831 - DNA, 16 bp, R. norvegicus
ccctcatctcctgggg

SEQ ID NO: 492832 - DNA, 16 bp, R. norvegicus
ccctcatggcttcagt

SEQ ID NO: 492833 - DNA, 16 bp, R. norvegicus
ccctcatgggctgctc

SEQ ID NO: 492834 - DNA, 16 bp, R. norvegicus
ccctcatggtggctca

SEQ ID NO: 492835 - DNA, 16 bp, R. norvegicus
ccctcatttctcagga

SEQ ID NO: 492836 - DNA, 16 bp, R. norvegicus
ccctccaagaggccca

SEQ ID NO: 492837 - DNA, 16 bp, R. norvegicus
ccctccactcctccag

SEQ ID NO: 492838 - DNA, 16 bp, R. norvegicus
ccctccactggaggtg

SEQ ID NO: 492839 - DNA, 16 bp, R. norvegicus
ccctccacttgatgcc

SEQ ID NO: 492840 - DNA, 16 bp, R. norvegicus
ccctccagaaacaccc

SEQ ID NO: 492841 - DNA, 16 bp, R. norvegicus
ccctccagcaatggag

SEQ ID NO: 492842 - DNA, 16 bp, R. norvegicus
ccctccatctgccttc

SEQ ID NO: 492843 - DNA, 16 bp, R. norvegicus
ccctcccacctcactg

SEQ ID NO: 492844 - DNA, 16 bp, R. norvegicus
ccctccccatacctga

SEQ ID NO: 492845 - DNA, 16 bp, R. norvegicus
ccctccccatgcttct

SEQ ID NO: 492846 - DNA, 16 bp, R. norvegicus
ccctcccccaaataaa

SEQ ID NO: 492847 - DNA, 16 bp, R. norvegicus
ccctcccccagcttct

SEQ ID NO: 492848 - DNA, 16 bp, R. norvegicus
ccctcccccattgctg

SEQ ID NO: 492849 - DNA, 16 bp, R. norvegicus
ccctccccgactaggg

SEQ ID NO: 492850 - DNA, 16 bp, R. norvegicus
ccctccctcagtagcc

SEQ ID NO: 492851 - DNA, 17 bp, R. norvegicus
ccctccctctgttaccc

SEQ ID NO: 492852 - DNA, 16 bp, R. norvegicus
ccctccctgcctgagt

SEQ ID NO: 492853 - DNA, 17 bp, R. norvegicus
ccctcccttgctgtaca

SEQ ID NO: 492854 - DNA, 16 bp, R. norvegicus
ccctcctctcctggag

SEQ ID NO: 492855 - DNA, 16 bp, R. norvegicus
ccctcctctgacctct

SEQ ID NO: 492856 - DNA, 16 bp, R. norvegicus
ccctcctgatgtcctg

SEQ ID NO: 492857 - DNA, 16 bp, R. norvegicus
ccctcctgctgactgg

SEQ ID NO: 492858 - DNA, 16 bp, R. norvegicus
ccctcctggtccacct

SEQ ID NO: 492859 - DNA, 16 bp, R. norvegicus
ccctccttcctcaaaa

SEQ ID NO: 492860 - DNA, 16 bp, R. norvegicus
ccctcctttgtgtttc

SEQ ID NO: 492861 - DNA, 16 bp, R. norvegicus
ccctcgacattcccct

SEQ ID NO: 492862 - DNA, 16 bp, R. norvegicus
ccctcgtggggtgctg

SEQ ID NO: 492863 - DNA, 16 bp, R. norvegicus
ccctctacttcctgtg

SEQ ID NO: 492864 - DNA, 16 bp, R. norvegicus
ccctctcaaatttatg

SEQ ID NO: 492865 - DNA, 16 bp, R. norvegicus
ccctctcacaggattt

SEQ ID NO: 492866 - DNA, 16 bp, R. norvegicus
ccctctcagaggaaaa

SEQ ID NO: 492867 - DNA, 16 bp, R. norvegicus
ccctctcagtgatgcc

SEQ ID NO: 492868 - DNA, 16 bp, R. norvegicus
ccctctcctggtgtgc

SEQ ID NO: 492869 - DNA, 16 bp, R. norvegicus
ccctctctccagtcct

SEQ ID NO: 492870 - DNA, 16 bp, R. norvegicus
ccctctctctcacaca

SEQ ID NO: 492871 - DNA, 16 bp, R. norvegicus
ccctctctctctgtgt

SEQ ID NO: 492872 - DNA, 16 bp, R. norvegicus
ccctctctctgttacc

SEQ ID NO: 492873 - DNA, 16 bp, R. norvegicus
ccctctctgacctcca

SEQ ID NO: 492874 - DNA, 16 bp, R. norvegicus
ccctctctggcctctg

SEQ ID NO: 492875 - DNA, 16 bp, R. norvegicus
ccctctctgtgctgct

SEQ ID NO: 492876 - DNA, 17 bp, R. norvegicus
ccctctgaagtcctttt

SEQ ID NO: 492877 - DNA, 16 bp, R. norvegicus
ccctctgacctctgag

SEQ ID NO: 492878 - DNA, 16 bp, R. norvegicus
ccctctgcctctgtgt

SEQ ID NO: 492879 - DNA, 16 bp, R. norvegicus
ccctctgctgatgggc

SEQ ID NO: 492880 - DNA, 16 bp, R. norvegicus
ccctctgctgtgtgtg

SEQ ID NO: 492881 - DNA, 16 bp, R. norvegicus
ccctctggaactggag

SEQ ID NO: 492882 - DNA, 16 bp, R. norvegicus
ccctctggaggagcag

SEQ ID NO: 492883 - DNA, 16 bp, R. norvegicus
ccctctgggtccctcc

SEQ ID NO: 492884 - DNA, 16 bp, R. norvegicus
ccctctggtcccagat

SEQ ID NO: 492885 - DNA, 16 bp, R. norvegicus
ccctctgtacatctct

SEQ ID NO: 492886 - DNA, 16 bp, R. norvegicus
ccctctgtctgcctct

SEQ ID NO: 492887 - DNA, 16 bp, R. norvegicus
ccctcttcctcctgtg

SEQ ID NO: 492888 - DNA, 16 bp, R. norvegicus
ccctcttcctggatga

SEQ ID NO: 492889 - DNA, 16 bp, R. norvegicus
ccctcttctcagataa

SEQ ID NO: 492890 - DNA, 16 bp, R. norvegicus
ccctcttctgacctcc

SEQ ID NO: 492891 - DNA, 16 bp, R. norvegicus
ccctcttctggcatgc

SEQ ID NO: 492892 - DNA, 16 bp, R. norvegicus
ccctcttctggctctg

SEQ ID NO: 492893 - DNA, 16 bp, R. norvegicus
ccctcttctggtgtct

SEQ ID NO: 492894 - DNA, 16 bp, R. norvegicus
ccctcttctgtggggt

SEQ ID NO: 492895 - DNA, 16 bp, R. norvegicus
ccctcttcttgagctt

SEQ ID NO: 492896 - DNA, 16 bp, R. norvegicus
ccctgaaaaaaagaaa

SEQ ID NO: 492897 - DNA, 16 bp, R. norvegicus
ccctgaaagagttcca

SEQ ID NO: 492898 - DNA, 16 bp, R. norvegicus
ccctgaaaggtttaca

SEQ ID NO: 492899 - DNA, 16 bp, R. norvegicus
ccctgaaattccacct

SEQ ID NO: 492900 - DNA, 16 bp, R. norvegicus
ccctgaactcagaaat

SEQ ID NO: 492901 - DNA, 17 bp, R. norvegicus
ccctgaactctgacctc

SEQ ID NO: 492902 - DNA, 16 bp, R. norvegicus
ccctgaatgctgacag

SEQ ID NO: 492903 - DNA, 16 bp, R. norvegicus
ccctgaccaaggcaac

SEQ ID NO: 492904 - DNA, 16 bp, R. norvegicus
ccctgacccagaggac

SEQ ID NO: 492905 - DNA, 16 bp, R. norvegicus
ccctgacccagtgtct

SEQ ID NO: 492906 - DNA, 16 bp, R. norvegicus
ccctgaccccagccct

SEQ ID NO: 492907 - DNA, 16 bp, R. norvegicus
ccctgacccctgaccc

SEQ ID NO: 492908 - DNA, 16 bp, R. norvegicus
ccctgaccctgaccct

SEQ ID NO: 492909 - DNA, 16 bp, R. norvegicus
ccctgacctaaagaaa

SEQ ID NO: 492910 - DNA, 16 bp, R. norvegicus
ccctgactggcctaga

SEQ ID NO: 492911 - DNA, 16 bp, R. norvegicus
ccctgacttctttctc

SEQ ID NO: 492912 - DNA, 16 bp, R. norvegicus
ccctgacttgaaaaac

SEQ ID NO: 492913 - DNA, 16 bp, R. norvegicus
ccctgactttagtgga

SEQ ID NO: 492914 - DNA, 16 bp, R. norvegicus
ccctgagaagcaggag

SEQ ID NO: 492915 - DNA, 16 bp, R. norvegicus
ccctgagagctcaggg

SEQ ID NO: 492916 - DNA, 16 bp, R. norvegicus
ccctgagatccagctg

SEQ ID NO: 492917 - DNA, 16 bp, R. norvegicus
ccctgagattcaacct

SEQ ID NO: 492918 - DNA, 16 bp, R. norvegicus
ccctgagcagattcct

SEQ ID NO: 492919 - DNA, 18 bp, R. norvegicus
ccctgagcagattcctga

SEQ ID NO: 492920 - DNA, 16 bp, R. norvegicus
ccctgagccacctctc

SEQ ID NO: 492921 - DNA, 16 bp, R. norvegicus
ccctgagccagctctg

SEQ ID NO: 492922 - DNA, 16 bp, R. norvegicus
ccctgagcctgaggtg

SEQ ID NO: 492923 - DNA, 16 bp, R. norvegicus
ccctgagccttgggag

SEQ ID NO: 492924 - DNA, 16 bp, R. norvegicus
ccctgagctccttgga

SEQ ID NO: 492925 - DNA, 16 bp, R. norvegicus
ccctgagctggtggtt

SEQ ID NO: 492926 - DNA, 16 bp, R. norvegicus
ccctgagcttccaaac

SEQ ID NO: 492927 - DNA, 16 bp, R. norvegicus
ccctgagtgcctgcag

SEQ ID NO: 492928 - DNA, 16 bp, R. norvegicus
ccctgatgaataaaga

SEQ ID NO: 492929 - DNA, 16 bp, R. norvegicus
ccctgatgaataagga

SEQ ID NO: 492930 - DNA, 16 bp, R. norvegicus
ccctgatgactaagta

SEQ ID NO: 492931 - DNA, 16 bp, R. norvegicus
ccctgatgattccttg

SEQ ID NO: 492932 - DNA, 16 bp, R. norvegicus
ccctgattctatgagg

SEQ ID NO: 492933 - DNA, 16 bp, R. norvegicus
ccctgcaccctgcacc

SEQ ID NO: 492934 - DNA, 16 bp, R. norvegicus
ccctgcacctctcctg

SEQ ID NO: 492935 - DNA, 16 bp, R. norvegicus
ccctgcactcaggagg

SEQ ID NO: 492936 - DNA, 16 bp, R. norvegicus
ccctgcagaagaggag

SEQ ID NO: 492937 - DNA, 16 bp, R. norvegicus
ccctgcagcagctgga

SEQ ID NO: 492938 - DNA, 16 bp, R. norvegicus
ccctgcaggaggacca

SEQ ID NO: 492939 - DNA, 16 bp, R. norvegicus
ccctgcagtggcttca

SEQ ID NO: 492940 - DNA, 16 bp, R. norvegicus
ccctgcagttccttca

SEQ ID NO: 492941 - DNA, 17 bp, R. norvegicus
ccctgcatccacacttc

SEQ ID NO: 492942 - DNA, 16 bp, R. norvegicus
ccctgcattctgctgg

SEQ ID NO: 492943 - DNA, 16 bp, R. norvegicus
ccctgcattctgctgt

SEQ ID NO: 492944 - DNA, 16 bp, R. norvegicus
ccctgcatttcttcca

SEQ ID NO: 492945 - DNA, 16 bp, R. norvegicus
ccctgccagagtaagc

SEQ ID NO: 492946 - DNA, 16 bp, R. norvegicus
ccctgcccaacctcct

SEQ ID NO: 492947 - DNA, 16 bp, R. norvegicus
ccctgcccacagcagc

SEQ ID NO: 492948 - DNA, 16 bp, R. norvegicus
ccctgcccactgtggg

SEQ ID NO: 492949 - DNA, 16 bp, R. norvegicus
ccctgcccagccagag

SEQ ID NO: 492950 - DNA, 16 bp, R. norvegicus
ccctgcccagcccagc

SEQ ID NO: 492951 - DNA, 16 bp, R. norvegicus
ccctgccccagccctg

SEQ ID NO: 492952 - DNA, 16 bp, R. norvegicus
ccctgccccagcttcc

SEQ ID NO: 492953 - DNA, 16 bp, R. norvegicus
ccctgccctcactcac

SEQ ID NO: 492954 - DNA, 16 bp, R. norvegicus
ccctgccctgacactc

SEQ ID NO: 492955 - DNA, 16 bp, R. norvegicus
ccctgccctgccctgt

SEQ ID NO: 492956 - DNA, 16 bp, R. norvegicus
ccctgccctgctctgc

SEQ ID NO: 492957 - DNA, 16 bp, R. norvegicus
ccctgccctggctttc

SEQ ID NO: 492958 - DNA, 16 bp, R. norvegicus
ccctgcctccaggttt

SEQ ID NO: 492959 - DNA, 16 bp, R. norvegicus
ccctgcctgctgcctg

SEQ ID NO: 492960 - DNA, 16 bp, R. norvegicus
ccctgccttccctcag

SEQ ID NO: 492961 - DNA, 17 bp, R. norvegicus
ccctgcgtctgagacac

SEQ ID NO: 492962 - DNA, 17 bp, R. norvegicus
ccctgcgttctgctgcc

SEQ ID NO: 492963 - DNA, 16 bp, R. norvegicus
ccctgctctctgccag

SEQ ID NO: 492964 - DNA, 16 bp, R. norvegicus
ccctgctgctgcaggg

SEQ ID NO: 492965 - DNA, 16 bp, R. norvegicus
ccctgctgctgcccct

SEQ ID NO: 492966 - DNA, 16 bp, R. norvegicus
ccctgctgctgctggt

SEQ ID NO: 492967 - DNA, 16 bp, R. norvegicus
ccctgctggctctgtt

SEQ ID NO: 492968 - DNA, 16 bp, R. norvegicus
ccctgctggtcctggt

SEQ ID NO: 492969 - DNA, 16 bp, R. norvegicus
ccctgctgtgagttgc

SEQ ID NO: 492970 - DNA, 16 bp, R. norvegicus
ccctgctgtgtccaga

SEQ ID NO: 492971 - DNA, 16 bp, R. norvegicus
ccctgctgtgtgtgtg

SEQ ID NO: 492972 - DNA, 16 bp, R. norvegicus
ccctgcttctatcagg

SEQ ID NO: 492973 - DNA, 16 bp, R. norvegicus
ccctgcttctatgagg

SEQ ID NO: 492974 - DNA, 16 bp, R. norvegicus
ccctggaactcactct

SEQ ID NO: 492975 - DNA, 16 bp, R. norvegicus
ccctggaactggactt

SEQ ID NO: 492976 - DNA, 16 bp, R. norvegicus
ccctggaactggagtt

SEQ ID NO: 492977 - DNA, 17 bp, R. norvegicus
ccctggaagacgttcca

SEQ ID NO: 492978 - DNA, 16 bp, R. norvegicus
ccctggaagccctggt

SEQ ID NO: 492979 - DNA, 16 bp, R. norvegicus
ccctggaagtgatgtc

SEQ ID NO: 492980 - DNA, 16 bp, R. norvegicus
ccctggacaacaagga

SEQ ID NO: 492981 - DNA, 16 bp, R. norvegicus
ccctggacctggagct

SEQ ID NO: 492982 - DNA, 16 bp, R. norvegicus
ccctggactctcacct

SEQ ID NO: 492983 - DNA, 22 bp, R. norvegicus
ccctggactggaagctacaggt

SEQ ID NO: 492984 - DNA, 16 bp, R. norvegicus
ccctggactgtgacct

SEQ ID NO: 492985 - DNA, 16 bp, R. norvegicus
ccctggagagcctgct

SEQ ID NO: 492986 - DNA, 16 bp, R. norvegicus
ccctggagatggagtt

SEQ ID NO: 492987 - DNA, 16 bp, R. norvegicus
ccctggagcctccagt

SEQ ID NO: 492988 - DNA, 16 bp, R. norvegicus
ccctggagctacagtt

SEQ ID NO: 492989 - DNA, 16 bp, R. norvegicus
ccctggagctcactgg

SEQ ID NO: 492990 - DNA, 16 bp, R. norvegicus
ccctggagctctctgc

SEQ ID NO: 492991 - DNA, 16 bp, R. norvegicus
ccctggagctggagtt

SEQ ID NO: 492992 - DNA, 16 bp, R. norvegicus
ccctggagctggtgtt

SEQ ID NO: 492993 - DNA, 16 bp, R. norvegicus
ccctggaggcctgctg

SEQ ID NO: 492994 - DNA, 16 bp, R. norvegicus
ccctggagtcctccct

SEQ ID NO: 492995 - DNA, 16 bp, R. norvegicus
ccctggagtcctttta

SEQ ID NO: 492996 - DNA, 16 bp, R. norvegicus
ccctggagtctgggac

SEQ ID NO: 492997 - DNA, 16 bp, R. norvegicus
ccctggatctaggcct

SEQ ID NO: 492998 - DNA, 16 bp, R. norvegicus
ccctggatgctgccat

SEQ ID NO: 492999 - DNA, 16 bp, R. norvegicus
ccctggcagctctggt

SEQ ID NO: 493000 - DNA, 16 bp, R. norvegicus
ccctggcatctttatt

SEQ ID NO: 493001 - DNA, 16 bp, R. norvegicus
ccctggccaagcatat

SEQ ID NO: 493002 - DNA, 16 bp, R. norvegicus
ccctggccatcctaga

SEQ ID NO: 493003 - DNA, 16 bp, R. norvegicus
ccctggcccaggagga

SEQ ID NO: 493004 - DNA, 16 bp, R. norvegicus
ccctggctaacctgga

SEQ ID NO: 493005 - DNA, 16 bp, R. norvegicus
ccctggctatcccgga

SEQ ID NO: 493006 - DNA, 16 bp, R. norvegicus
ccctggctccttctgg

SEQ ID NO: 493007 - DNA, 16 bp, R. norvegicus
ccctggctgccctgaa

SEQ ID NO: 493008 - DNA, 16 bp, R. norvegicus
ccctggctgccctgga

SEQ ID NO: 493009 - DNA, 16 bp, R. norvegicus
ccctggctgccttgga

SEQ ID NO: 493010 - DNA, 16 bp, R. norvegicus
ccctggctgggctgga

SEQ ID NO: 493011 - DNA, 16 bp, R. norvegicus
ccctggctggtctgga

SEQ ID NO: 493012 - DNA, 16 bp, R. norvegicus
ccctggctgtccagga

SEQ ID NO: 493013 - DNA, 16 bp, R. norvegicus
ccctggctgtccggga

SEQ ID NO: 493014 - DNA, 16 bp, R. norvegicus
ccctggctgtctggaa

SEQ ID NO: 493015 - DNA, 16 bp, R. norvegicus
ccctggctgttccaga

SEQ ID NO: 493016 - DNA, 16 bp, R. norvegicus
ccctggcttgcctgga

SEQ ID NO: 493017 - DNA, 16 bp, R. norvegicus
ccctgggaatcacttt

SEQ ID NO: 493018 - DNA, 16 bp, R. norvegicus
ccctgggaatggagtt

SEQ ID NO: 493019 - DNA, 16 bp, R. norvegicus
ccctgggacactgctc

SEQ ID NO: 493020 - DNA, 16 bp, R. norvegicus
ccctgggacctacatg

SEQ ID NO: 493021 - DNA, 16 bp, R. norvegicus
ccctgggactggagct

SEQ ID NO: 493022 - DNA, 16 bp, R. norvegicus
ccctgggagccctggt

SEQ ID NO: 493023 - DNA, 16 bp, R. norvegicus
ccctgggagctccagg

SEQ ID NO: 493024 - DNA, 16 bp, R. norvegicus
ccctgggagctctggg

SEQ ID NO: 493025 - DNA, 16 bp, R. norvegicus
ccctgggatggagcct

SEQ ID NO: 493026 - DNA, 16 bp, R. norvegicus
ccctgggcagcagccc

SEQ ID NO: 493027 - DNA, 16 bp, R. norvegicus
ccctgggctccaactc

SEQ ID NO: 493028 - DNA, 16 bp, R. norvegicus
ccctgggctcctacct

SEQ ID NO: 493029 - DNA, 16 bp, R. norvegicus
ccctgggctctgacct

SEQ ID NO: 493030 - DNA, 16 bp, R. norvegicus
ccctgggctggaaagt

SEQ ID NO: 493031 - DNA, 16 bp, R. norvegicus
ccctggggcctgctgg

SEQ ID NO: 493032 - DNA, 16 bp, R. norvegicus
ccctgggtaccaaccc

SEQ ID NO: 493033 - DNA, 16 bp, R. norvegicus
ccctgggtccccagct

SEQ ID NO: 493034 - DNA, 16 bp, R. norvegicus
ccctgggtgctctggg

SEQ ID NO: 493035 - DNA, 16 bp, R. norvegicus
ccctgggtggcctgga

SEQ ID NO: 493036 - DNA, 16 bp, R. norvegicus
ccctgggttcaacccc

SEQ ID NO: 493037 - DNA, 16 bp, R. norvegicus
ccctgggttcagttct

SEQ ID NO: 493038 - DNA, 16 bp, R. norvegicus
ccctgggttggtcccc

SEQ ID NO: 493039 - DNA, 16 bp, R. norvegicus
ccctggtccctcctgc

SEQ ID NO: 493040 - DNA, 16 bp, R. norvegicus
ccctggtcctctggga

SEQ ID NO: 493041 - DNA, 16 bp, R. norvegicus
ccctggtctcccaggc

SEQ ID NO: 493042 - DNA, 29 bp, R. norvegicus
ccctggtgactcttgctgccttaactggt

SEQ ID NO: 493043 - DNA, 16 bp, R. norvegicus
ccctggttatcctgga

SEQ ID NO: 493044 - DNA, 16 bp, R. norvegicus
ccctgtacaaaactca

SEQ ID NO: 493045 - DNA, 16 bp, R. norvegicus
ccctgtacccacatgg

SEQ ID NO: 493046 - DNA, 16 bp, R. norvegicus
ccctgtatttcctctt

SEQ ID NO: 493047 - DNA, 16 bp, R. norvegicus
ccctgtcagggcagct

SEQ ID NO: 493048 - DNA, 16 bp, R. norvegicus
ccctgtccagcactct

SEQ ID NO: 493049 - DNA, 16 bp, R. norvegicus
ccctgtccctcacctg

SEQ ID NO: 493050 - DNA, 16 bp, R. norvegicus
ccctgtcctgcccatc

SEQ ID NO: 493051 - DNA, 16 bp, R. norvegicus
ccctgtctaccctgac

SEQ ID NO: 493052 - DNA, 16 bp, R. norvegicus
ccctgtctagtccctg

SEQ ID NO: 493053 - DNA, 16 bp, R. norvegicus
ccctgtctcaaagcag

SEQ ID NO: 493054 - DNA, 16 bp, R. norvegicus
ccctgtctcagaagac

SEQ ID NO: 493055 - DNA, 16 bp, R. norvegicus
ccctgtctcagagaaa

SEQ ID NO: 493056 - DNA, 16 bp, R. norvegicus
ccctgtctccaaaaaa

SEQ ID NO: 493057 - DNA, 16 bp, R. norvegicus
ccctgtctccaaaaat

SEQ ID NO: 493058 - DNA, 16 bp, R. norvegicus
ccctgtctccaaaaga

SEQ ID NO: 493059 - DNA, 16 bp, R. norvegicus
ccctgtctccagaaaa

SEQ ID NO: 493060 - DNA, 16 bp, R. norvegicus
ccctgtctctaaaaaa

SEQ ID NO: 493061 - DNA, 16 bp, R. norvegicus
ccctgtctctgtccct

SEQ ID NO: 493062 - DNA, 16 bp, R. norvegicus
ccctgtctgcctgcat

SEQ ID NO: 493063 - DNA, 16 bp, R. norvegicus
ccctgtctgggaaaaa

SEQ ID NO: 493064 - DNA, 16 bp, R. norvegicus
ccctgtctgtctcctg

SEQ ID NO: 493065 - DNA, 16 bp, R. norvegicus
ccctgtcttgaaaaac

SEQ ID NO: 493066 - DNA, 16 bp, R. norvegicus
ccctgtgagccctgct

SEQ ID NO: 493067 - DNA, 16 bp, R. norvegicus
ccctgtgcatgctgct

SEQ ID NO: 493068 - DNA, 16 bp, R. norvegicus
ccctgtgcccagccca

SEQ ID NO: 493069 - DNA, 16 bp, R. norvegicus
ccctgtgcttgctgct

SEQ ID NO: 493070 - DNA, 16 bp, R. norvegicus
ccctgtggcacagctc

SEQ ID NO: 493071 - DNA, 16 bp, R. norvegicus
ccctgtgggtcctggg

SEQ ID NO: 493072 - DNA, 16 bp, R. norvegicus
ccctgtgggtgctgag

SEQ ID NO: 493073 - DNA, 16 bp, R. norvegicus
ccctgtggtccagaca

SEQ ID NO: 493074 - DNA, 16 bp, R. norvegicus
ccctgtgtgagttctt

SEQ ID NO: 493075 - DNA, 16 bp, R. norvegicus
ccctgttcccaaaccc

SEQ ID NO: 493076 - DNA, 16 bp, R. norvegicus
ccctgttcctgctgtt

SEQ ID NO: 493077 - DNA, 16 bp, R. norvegicus
ccctgttctggtatgt

SEQ ID NO: 493078 - DNA, 16 bp, R. norvegicus
ccctgttgctgtaaaa

SEQ ID NO: 493079 - DNA, 16 bp, R. norvegicus
ccctgttgtgtcctgg

SEQ ID NO: 493080 - DNA, 16 bp, R. norvegicus
ccctgtttccaagagg

SEQ ID NO: 493081 - DNA, 16 bp, R. norvegicus
cccttaaacaggaaac

SEQ ID NO: 493082 - DNA, 16 bp, R. norvegicus
cccttaaacatacaag

SEQ ID NO: 493083 - DNA, 16 bp, R. norvegicus
cccttaaagaaaactg

SEQ ID NO: 493084 - DNA, 17 bp, R. norvegicus
cccttaatcccagcact

SEQ ID NO: 493085 - DNA, 17 bp, R. norvegicus
cccttacacttgcccaa

SEQ ID NO: 493086 - DNA, 46 bp, R. norvegicus
cccttactcacagacctacttcataaacagtgtacattctgctggt

SEQ ID NO: 493087 - DNA, 16 bp, R. norvegicus
cccttagagaggaaac

SEQ ID NO: 493088 - DNA, 16 bp, R. norvegicus
cccttcaaagaaggac

SEQ ID NO: 493089 - DNA, 16 bp, R. norvegicus
cccttcaactcaaaga

SEQ ID NO: 493090 - DNA, 16 bp, R. norvegicus
cccttcaagagaggaa

SEQ ID NO: 493091 - DNA, 16 bp, R. norvegicus
cccttcaatggaggaa

SEQ ID NO: 493092 - DNA, 16 bp, R. norvegicus
cccttcacctctgaga

SEQ ID NO: 493093 - DNA, 16 bp, R. norvegicus
cccttcagatccttca

SEQ ID NO: 493094 - DNA, 16 bp, R. norvegicus
cccttcagatggactc

SEQ ID NO: 493095 - DNA, 16 bp, R. norvegicus
cccttcagcaacttca

SEQ ID NO: 493096 - DNA, 16 bp, R. norvegicus
cccttcagctacctca

SEQ ID NO: 493097 - DNA, 16 bp, R. norvegicus
cccttcagctcctaca

SEQ ID NO: 493098 - DNA, 16 bp, R. norvegicus
cccttcagctccttca

SEQ ID NO: 493099 - DNA, 16 bp, R. norvegicus
cccttcagctctgtca

SEQ ID NO: 493100 - DNA, 16 bp, R. norvegicus
cccttcagcttcttca

SEQ ID NO: 493101 - DNA, 16 bp, R. norvegicus
cccttcagtgctctgg

SEQ ID NO: 493102 - DNA, 16 bp, R. norvegicus
cccttccactggttct

SEQ ID NO: 493103 - DNA, 16 bp, R. norvegicus
cccttccagatgcctc

SEQ ID NO: 493104 - DNA, 16 bp, R. norvegicus
cccttcccagtcttcc

SEQ ID NO: 493105 - DNA, 16 bp, R. norvegicus
cccttcccccagaggc

SEQ ID NO: 493106 - DNA, 16 bp, R. norvegicus
cccttcccccagctct

SEQ ID NO: 493107 - DNA, 16 bp, R. norvegicus
cccttccctgcccagg

SEQ ID NO: 493108 - DNA, 18 bp, R. norvegicus
cccttccgggagcttctg

SEQ ID NO: 493109 - DNA, 16 bp, R. norvegicus
cccttcctccagctct

SEQ ID NO: 493110 - DNA, 16 bp, R. norvegicus
cccttcctgtctccca

SEQ ID NO: 493111 - DNA, 16 bp, R. norvegicus
cccttcctgtgacttc

SEQ ID NO: 493112 - DNA, 16 bp, R. norvegicus
cccttcgagctcttcc

SEQ ID NO: 493113 - DNA, 16 bp, R. norvegicus
cccttctcccacccag

SEQ ID NO: 493114 - DNA, 16 bp, R. norvegicus
cccttctcctatgagg

SEQ ID NO: 493115 - DNA, 16 bp, R. norvegicus
cccttctctatggctg

SEQ ID NO: 493116 - DNA, 16 bp, R. norvegicus
cccttctctccacatg

SEQ ID NO: 493117 - DNA, 16 bp, R. norvegicus
cccttctgtgggcctg

SEQ ID NO: 493118 - DNA, 16 bp, R. norvegicus
cccttcttctttgagg

SEQ ID NO: 493119 - DNA, 16 bp, R. norvegicus
cccttctttaaaaaaa

SEQ ID NO: 493120 - DNA, 16 bp, R. norvegicus
cccttgatgatgcagt

SEQ ID NO: 493121 - DNA, 16 bp, R. norvegicus
cccttgcactgggggg

SEQ ID NO: 493122 - DNA, 16 bp, R. norvegicus
cccttgcctaggaagc

SEQ ID NO: 493123 - DNA, 16 bp, R. norvegicus
cccttggaactggact

SEQ ID NO: 493124 - DNA, 16 bp, R. norvegicus
cccttggctcctggga

SEQ ID NO: 493125 - DNA, 16 bp, R. norvegicus
cccttggggctggctc

SEQ ID NO: 493126 - DNA, 16 bp, R. norvegicus
cccttgggtatcaccc

SEQ ID NO: 493127 - DNA, 16 bp, R. norvegicus
cccttgttcctgccat

SEQ ID NO: 493128 - DNA, 16 bp, R. norvegicus
ccctttaaagaaggag

SEQ ID NO: 493129 - DNA, 16 bp, R. norvegicus
ccctttagctccttca

SEQ ID NO: 493130 - DNA, 16 bp, R. norvegicus
ccctttcccagttgcc

SEQ ID NO: 493131 - DNA, 16 bp, R. norvegicus
ccctttccccagacct

SEQ ID NO: 493132 - DNA, 16 bp, R. norvegicus
ccctttccctgcttag

SEQ ID NO: 493133 - DNA, 16 bp, R. norvegicus
ccctttcctctcccag

SEQ ID NO: 493134 - DNA, 16 bp, R. norvegicus
ccctttcctgacctct

SEQ ID NO: 493135 - DNA, 16 bp, R. norvegicus
ccctttcctggcttcc

SEQ ID NO: 493136 - DNA, 16 bp, R. norvegicus
ccctttcctggtttat

SEQ ID NO: 493137 - DNA, 16 bp, R. norvegicus
ccctttcttctcagag

SEQ ID NO: 493138 - DNA, 16 bp, R. norvegicus
ccctttgatacagcag

SEQ ID NO: 493139 - DNA, 16 bp, R. norvegicus
ccctttgccagtttcc

SEQ ID NO: 493140 - DNA, 16 bp, R. norvegicus
ccctttggggcctgca

SEQ ID NO: 493141 - DNA, 16 bp, R. norvegicus
ccctttgtcctgtgga

SEQ ID NO: 493142 - DNA, 16 bp, R. norvegicus
cccttttaaaaaagga

SEQ ID NO: 493143 - DNA, 16 bp, R. norvegicus
ccgaacccagggccac

SEQ ID NO: 493144 - DNA, 16 bp, R. norvegicus
ccgaagcagctctctg

SEQ ID NO: 493145 - DNA, 16 bp, R. norvegicus
ccgaagctttgaagca

SEQ ID NO: 493146 - DNA, 75 bp, R. norvegicus
ccgaagttaaatcaggaacagataaaccagttaaacaaccccataactcctaaggaaatagaagcagtcattaaa

SEQ ID NO: 493147 - DNA, 16 bp, R. norvegicus
ccgacaggagccgaat

SEQ ID NO: 493148 - DNA, 16 bp, R. norvegicus
ccgactcaagaggaaa

SEQ ID NO: 493149 - DNA, 16 bp, R. norvegicus
ccgactcctccctctg

SEQ ID NO: 493150 - DNA, 21 bp, R. norvegicus
ccgactgctcttccagaggtc

SEQ ID NO: 493151 - DNA, 16 bp, R. norvegicus
ccgagaaagcatttga

SEQ ID NO: 493152 - DNA, 16 bp, R. norvegicus
ccgagccaccaaccag

SEQ ID NO: 493153 - DNA, 16 bp, R. norvegicus
ccgagctgctggagag

SEQ ID NO: 493154 - DNA, 16 bp, R. norvegicus
ccgaggaggcagaggc

SEQ ID NO: 493155 - DNA, 16 bp, R. norvegicus
ccgaggctcaaatttg

SEQ ID NO: 493156 - DNA, 16 bp, R. norvegicus
ccgagtcctctggaag

SEQ ID NO: 493157 - DNA, 16 bp, R. norvegicus
ccgatgtttggctgtg

SEQ ID NO: 493158 - DNA, 17 bp, R. norvegicus
ccgcaaagagcccgtgg

SEQ ID NO: 493159 - DNA, 16 bp, R. norvegicus
ccgcagcagcagcaac

SEQ ID NO: 493160 - DNA, 16 bp, R. norvegicus
ccgcatgaagctcaag

SEQ ID NO: 493161 - DNA, 16 bp, R. norvegicus
ccgccaccatcaccac

SEQ ID NO: 493162 - DNA, 16 bp, R. norvegicus
ccgccatgctcctgcc

SEQ ID NO: 493163 - DNA, 16 bp, R. norvegicus
ccgcccacagtgagct

SEQ ID NO: 493164 - DNA, 16 bp, R. norvegicus
ccgcccacatccctgg

SEQ ID NO: 493165 - DNA, 16 bp, R. norvegicus
ccgccgctgccaccac

SEQ ID NO: 493166 - DNA, 16 bp, R. norvegicus
ccgccgctgctgctgc

SEQ ID NO: 493167 - DNA, 16 bp, R. norvegicus
ccgcctctgcttccca

SEQ ID NO: 493168 - DNA, 16 bp, R. norvegicus
ccgcggcgtccccaga

SEQ ID NO: 493169 - DNA, 16 bp, R. norvegicus
ccgctccccacatcct

SEQ ID NO: 493170 - DNA, 17 bp, R. norvegicus
ccgctgagctaaacccc

SEQ ID NO: 493171 - DNA, 16 bp, R. norvegicus
ccgctgatccatctct

SEQ ID NO: 493172 - DNA, 16 bp, R. norvegicus
ccgcttccactggtgc

SEQ ID NO: 493173 - DNA, 16 bp, R. norvegicus
ccggaacctgaaagaa

SEQ ID NO: 493174 - DNA, 16 bp, R. norvegicus
ccggaaggaagccagg

SEQ ID NO: 493175 - DNA, 16 bp, R. norvegicus
ccggagagatggctcg

SEQ ID NO: 493176 - DNA, 29 bp, R. norvegicus
ccggagctggggaccgaacccagggcctt

SEQ ID NO: 493177 - DNA, 16 bp, R. norvegicus
ccggcctgcctgcctg

SEQ ID NO: 493178 - DNA, 16 bp, R. norvegicus
ccggctcacaggaacc

SEQ ID NO: 493179 - DNA, 16 bp, R. norvegicus
ccggctcctgtctgcc

SEQ ID NO: 493180 - DNA, 16 bp, R. norvegicus
ccgggacagccagagc

SEQ ID NO: 493181 - DNA, 16 bp, R. norvegicus
ccgggcaaacattccc

SEQ ID NO: 493182 - DNA, 16 bp, R. norvegicus
ccgggcagtggtggtg

SEQ ID NO: 493183 - DNA, 17 bp, R. norvegicus
ccgggcccgcagcagct

SEQ ID NO: 493184 - DNA, 16 bp, R. norvegicus
ccggtttccaggacaa

SEQ ID NO: 493185 - DNA, 16 bp, R. norvegicus
ccgtctctctagcccc

SEQ ID NO: 493186 - DNA, 16 bp, R. norvegicus
ccgtctctgtaccaat

SEQ ID NO: 493187 - DNA, 16 bp, R. norvegicus
ccgtctggacctgggc

SEQ ID NO: 493188 - DNA, 16 bp, R. norvegicus
ccgtctgtgttgtctg

SEQ ID NO: 493189 - DNA, 16 bp, R. norvegicus
ccgtgagatccagctg

SEQ ID NO: 493190 - DNA, 16 bp, R. norvegicus
ccgtgggcctgtgtct

SEQ ID NO: 493191 - DNA, 16 bp, R. norvegicus
ccgtgtggttgctgga

SEQ ID NO: 493192 - DNA, 16 bp, R. norvegicus
ccgttcttccagaggt

SEQ ID NO: 493193 - DNA, 16 bp, R. norvegicus
ccgtttcacggaagaa

SEQ ID NO: 493194 - DNA, 16 bp, R. norvegicus
cctaaaacaaaagtat

SEQ ID NO: 493195 - DNA, 16 bp, R. norvegicus
cctaaaagatcagaaa

SEQ ID NO: 493196 - DNA, 16 bp, R. norvegicus
cctaaaagcactagaa

SEQ ID NO: 493197 - DNA, 16 bp, R. norvegicus
cctaaaagctcgaatt

SEQ ID NO: 493198 - DNA, 21 bp, R. norvegicus
cctaaaatggtggaggaacct

SEQ ID NO: 493199 - DNA, 16 bp, R. norvegicus
cctaaagaaatagagg

SEQ ID NO: 493200 - DNA, 16 bp, R. norvegicus
cctaaagaaatgttta

SEQ ID NO: 493201 - DNA, 16 bp, R. norvegicus
cctaaagaactagaag

SEQ ID NO: 493202 - DNA, 16 bp, R. norvegicus
cctaaagaatgagatg

SEQ ID NO: 493203 - DNA, 16 bp, R. norvegicus
cctaaagatacagttg

SEQ ID NO: 493204 - DNA, 16 bp, R. norvegicus
cctaaagatttggcaa

SEQ ID NO: 493205 - DNA, 16 bp, R. norvegicus
cctaaaggaaacagac

SEQ ID NO: 493206 - DNA, 16 bp, R. norvegicus
cctaaaggaagagatg

SEQ ID NO: 493207 - DNA, 16 bp, R. norvegicus
cctaacacacaggcct

SEQ ID NO: 493208 - DNA, 16 bp, R. norvegicus
cctaacagaacacaaa

SEQ ID NO: 493209 - DNA, 16 bp, R. norvegicus
cctaacccatggtggc

SEQ ID NO: 493210 - DNA, 16 bp, R. norvegicus
cctaaccctaaccctg

SEQ ID NO: 493211 - DNA, 16 bp, R. norvegicus
cctaaccctctagaga

SEQ ID NO: 493212 - DNA, 16 bp, R. norvegicus
cctaactcttccacaa

SEQ ID NO: 493213 - DNA, 16 bp, R. norvegicus
cctaagaaagaaaaag

SEQ ID NO: 493214 - DNA, 16 bp, R. norvegicus
cctaagagctctagaa

SEQ ID NO: 493215 - DNA, 16 bp, R. norvegicus
cctaaggaaatagaac

SEQ ID NO: 493216 - DNA, 16 bp, R. norvegicus
cctaaggaaatcccct

SEQ ID NO: 493217 - DNA, 16 bp, R. norvegicus
cctaaggaaatggaag

SEQ ID NO: 493218 - DNA, 16 bp, R. norvegicus
cctaaggcagcctttg

SEQ ID NO: 493219 - DNA, 16 bp, R. norvegicus
cctaagtgctgggatg

SEQ ID NO: 493220 - DNA, 16 bp, R. norvegicus
cctaatatgggtgctg

SEQ ID NO: 493221 - DNA, 16 bp, R. norvegicus
cctaatccctccacct

SEQ ID NO: 493222 - DNA, 16 bp, R. norvegicus
cctacaaaggataata

SEQ ID NO: 493223 - DNA, 16 bp, R. norvegicus
cctacaaaggattata

SEQ ID NO: 493224 - DNA, 16 bp, R. norvegicus
cctacaagcctgtgtg

SEQ ID NO: 493225 - DNA, 17 bp, R. norvegicus
cctacacaccaaggtca

SEQ ID NO: 493226 - DNA, 16 bp, R. norvegicus
cctacagcatcatgat

SEQ ID NO: 493227 - DNA, 16 bp, R. norvegicus
cctacagctccctgct

SEQ ID NO: 493228 - DNA, 16 bp, R. norvegicus
cctacagctggatctt

SEQ ID NO: 493229 - DNA, 16 bp, R. norvegicus
cctacagtgaggagag

SEQ ID NO: 493230 - DNA, 16 bp, R. norvegicus
cctacatgctgccatg

SEQ ID NO: 493231 - DNA, 16 bp, R. norvegicus
cctacattctgctgcc

SEQ ID NO: 493232 - DNA, 16 bp, R. norvegicus
cctaccaaggctggat

SEQ ID NO: 493233 - DNA, 16 bp, R. norvegicus
cctaccaaggttggac

SEQ ID NO: 493234 - DNA, 16 bp, R. norvegicus
cctacccctgcctcca

SEQ ID NO: 493235 - DNA, 16 bp, R. norvegicus
cctaccctggaattcc

SEQ ID NO: 493236 - DNA, 16 bp, R. norvegicus
cctacctacaagatgt

SEQ ID NO: 493237 - DNA, 16 bp, R. norvegicus
cctacctcacagggtt

SEQ ID NO: 493238 - DNA, 16 bp, R. norvegicus
cctacctcactgctct

SEQ ID NO: 493239 - DNA, 16 bp, R. norvegicus
cctacctcagcctcca

SEQ ID NO: 493240 - DNA, 16 bp, R. norvegicus
cctacctcagcctcct

SEQ ID NO: 493241 - DNA, 16 bp, R. norvegicus
cctacctccagcagaa

SEQ ID NO: 493242 - DNA, 16 bp, R. norvegicus
cctacctctgcctcct

SEQ ID NO: 493243 - DNA, 16 bp, R. norvegicus
cctacctgcctctgcc

SEQ ID NO: 493244 - DNA, 16 bp, R. norvegicus
cctacctggactgcct

SEQ ID NO: 493245 - DNA, 16 bp, R. norvegicus
cctactcctcagcttc

SEQ ID NO: 493246 - DNA, 16 bp, R. norvegicus
cctactcctggtacca

SEQ ID NO: 493247 - DNA, 16 bp, R. norvegicus
cctactccttcccaaa

SEQ ID NO: 493248 - DNA, 16 bp, R. norvegicus
cctactctgtgctgtc

SEQ ID NO: 493249 - DNA, 16 bp, R. norvegicus
cctactgtcccttcag

SEQ ID NO: 493250 - DNA, 16 bp, R. norvegicus
cctacttcaacaaagc

SEQ ID NO: 493251 - DNA, 16 bp, R. norvegicus
cctacttcctgacctg

SEQ ID NO: 493252 - DNA, 16 bp, R. norvegicus
cctactttgggcctgt

SEQ ID NO: 493253 - DNA, 16 bp, R. norvegicus
cctacttttgttgatt

SEQ ID NO: 493254 - DNA, 16 bp, R. norvegicus
cctagaacaaaaagaa

SEQ ID NO: 493255 - DNA, 16 bp, R. norvegicus
cctagaactccctctg

SEQ ID NO: 493256 - DNA, 16 bp, R. norvegicus
cctagaagaaaacttc

SEQ ID NO: 493257 - DNA, 17 bp, R. norvegicus
cctagaagaaacgaaac

SEQ ID NO: 493258 - DNA, 16 bp, R. norvegicus
cctagaattccccagt

SEQ ID NO: 493259 - DNA, 16 bp, R. norvegicus
cctagagagctgctgg

SEQ ID NO: 493260 - DNA, 16 bp, R. norvegicus
cctagagctggagtta

SEQ ID NO: 493261 - DNA, 16 bp, R. norvegicus
cctagatgcccagaac

SEQ ID NO: 493262 - DNA, 18 bp, R. norvegicus
cctagcaaatgcaaggcc

SEQ ID NO: 493263 - DNA, 16 bp, R. norvegicus
cctagcaagagcaagg

SEQ ID NO: 493264 - DNA, 16 bp, R. norvegicus
cctagcactttggagg

SEQ ID NO: 493265 - DNA, 16 bp, R. norvegicus
cctagcatgtacaaag

SEQ ID NO: 493266 - DNA, 16 bp, R. norvegicus
cctagcatttgagagg

SEQ ID NO: 493267 - DNA, 16 bp, R. norvegicus
cctagccaagaagcta

SEQ ID NO: 493268 - DNA, 16 bp, R. norvegicus
cctagcccctccacct

SEQ ID NO: 493269 - DNA, 16 bp, R. norvegicus
cctagcccctcctcct

SEQ ID NO: 493270 - DNA, 16 bp, R. norvegicus
cctagctacttgggag

SEQ ID NO: 493271 - DNA, 16 bp, R. norvegicus
cctagctgccctggaa

SEQ ID NO: 493272 - DNA, 16 bp, R. norvegicus
cctagctgcctggaag

SEQ ID NO: 493273 - DNA, 25 bp, R. norvegicus
cctaggaagcgcaaggccctgggtt

SEQ ID NO: 493274 - DNA, 18 bp, R. norvegicus
cctaggaagcgcaaggct

SEQ ID NO: 493275 - DNA, 16 bp, R. norvegicus
cctaggagaacacaaa

SEQ ID NO: 493276 - DNA, 16 bp, R. norvegicus
cctaggcaggaccaag

SEQ ID NO: 493277 - DNA, 16 bp, R. norvegicus
cctaggctctctgcac

SEQ ID NO: 493278 - DNA, 16 bp, R. norvegicus
cctaggctgaccttga

SEQ ID NO: 493279 - DNA, 18 bp, R. norvegicus
cctagtaagagcaccagc

SEQ ID NO: 493280 - DNA, 16 bp, R. norvegicus
cctagtcctcctcctc

SEQ ID NO: 493281 - DNA, 16 bp, R. norvegicus
cctagtcctgctggga

SEQ ID NO: 493282 - DNA, 16 bp, R. norvegicus
cctagttgtcaacttg

SEQ ID NO: 493283 - DNA, 16 bp, R. norvegicus
cctataaaaacccatc

SEQ ID NO: 493284 - DNA, 16 bp, R. norvegicus
cctataccctgaaaaa

SEQ ID NO: 493285 - DNA, 16 bp, R. norvegicus
cctatacctgcccctc

SEQ ID NO: 493286 - DNA, 16 bp, R. norvegicus
cctatagaaacttgat

SEQ ID NO: 493287 - DNA, 16 bp, R. norvegicus
cctatatcatcatcat

SEQ ID NO: 493288 - DNA, 16 bp, R. norvegicus
cctatcagaacaccat

SEQ ID NO: 493289 - DNA, 16 bp, R. norvegicus
cctatcagatttacac

SEQ ID NO: 493290 - DNA, 16 bp, R. norvegicus
cctatccattcatcca

SEQ ID NO: 493291 - DNA, 16 bp, R. norvegicus
cctatccctcaaccag

SEQ ID NO: 493292 - DNA, 16 bp, R. norvegicus
cctatctgcctctgcc

SEQ ID NO: 493293 - DNA, 16 bp, R. norvegicus
cctatgaactcacaga

SEQ ID NO: 493294 - DNA, 16 bp, R. norvegicus
cctatgaatgtcatga

SEQ ID NO: 493295 - DNA, 16 bp, R. norvegicus
cctatgaatttgctgt

SEQ ID NO: 493296 - DNA, 16 bp, R. norvegicus
cctatgactccagctg

SEQ ID NO: 493297 - DNA, 16 bp, R. norvegicus
cctatgactctgccta

SEQ ID NO: 493298 - DNA, 16 bp, R. norvegicus
cctatgagaagccatg

SEQ ID NO: 493299 - DNA, 16 bp, R. norvegicus
cctatggcatggtggg

SEQ ID NO: 493300 - DNA, 16 bp, R. norvegicus
cctattggaatctggg

SEQ ID NO: 493301 - DNA, 16 bp, R. norvegicus
cctatttgatcatgat

SEQ ID NO: 493302 - DNA, 16 bp, R. norvegicus
cctattttgtgaccga

SEQ ID NO: 493303 - DNA, 16 bp, R. norvegicus
cctcaaactcaccaag

SEQ ID NO: 493304 - DNA, 17 bp, R. norvegicus
cctcaaagatggcgctg

SEQ ID NO: 493305 - DNA, 16 bp, R. norvegicus
cctcaaagctcccagg

SEQ ID NO: 493306 - DNA, 16 bp, R. norvegicus
cctcaaatctcttgag

SEQ ID NO: 493307 - DNA, 16 bp, R. norvegicus
cctcaaatttgctatg

SEQ ID NO: 493308 - DNA, 16 bp, R. norvegicus
cctcaacaacctggca

SEQ ID NO: 493309 - DNA, 20 bp, R. norvegicus
cctcaacatataaaagagat

SEQ ID NO: 493310 - DNA, 16 bp, R. norvegicus
cctcaacctcacagag

SEQ ID NO: 493311 - DNA, 16 bp, R. norvegicus
cctcaactacatagtg

SEQ ID NO: 493312 - DNA, 16 bp, R. norvegicus
cctcaactcacagaga

SEQ ID NO: 493313 - DNA, 16 bp, R. norvegicus
cctcaactccttccag

SEQ ID NO: 493314 - DNA, 16 bp, R. norvegicus
cctcaagacacaggaa

SEQ ID NO: 493315 - DNA, 16 bp, R. norvegicus
cctcaagatcttcatg

SEQ ID NO: 493316 - DNA, 16 bp, R. norvegicus
cctcaaggacagggaa

SEQ ID NO: 493317 - DNA, 16 bp, R. norvegicus
cctcaaggcccacccc

SEQ ID NO: 493318 - DNA, 16 bp, R. norvegicus
cctcaaggccctgggt

SEQ ID NO: 493319 - DNA, 16 bp, R. norvegicus
cctcaaggttcctgcc

SEQ ID NO: 493320 - DNA, 16 bp, R. norvegicus
cctcaagtctctggag

SEQ ID NO: 493321 - DNA, 16 bp, R. norvegicus
cctcaagtgggagcac

SEQ ID NO: 493322 - DNA, 16 bp, R. norvegicus
cctcaagttggaccag

SEQ ID NO: 493323 - DNA, 17 bp, R. norvegicus
cctcaagttgtggaatg

SEQ ID NO: 493324 - DNA, 16 bp, R. norvegicus
cctcaatatctatgcc

SEQ ID NO: 493325 - DNA, 16 bp, R. norvegicus
cctcaatcccagcact

SEQ ID NO: 493326 - DNA, 16 bp, R. norvegicus
cctcacaagtgctggg

SEQ ID NO: 493327 - DNA, 16 bp, R. norvegicus
cctcacacacactgtc

SEQ ID NO: 493328 - DNA, 16 bp, R. norvegicus
cctcacactcctgctg

SEQ ID NO: 493329 - DNA, 16 bp, R. norvegicus
cctcacagaagaaggg

SEQ ID NO: 493330 - DNA, 18 bp, R. norvegicus
cctcacagagatgtgagg

SEQ ID NO: 493331 - DNA, 16 bp, R. norvegicus
cctcacattgtggtga

SEQ ID NO: 493332 - DNA, 16 bp, R. norvegicus
cctcaccaagatcctt

SEQ ID NO: 493333 - DNA, 16 bp, R. norvegicus
cctcaccaccttagca

SEQ ID NO: 493334 - DNA, 20 bp, R. norvegicus
cctcaccagatcttcaacta

SEQ ID NO: 493335 - DNA, 16 bp, R. norvegicus
cctcaccagcacccag

SEQ ID NO: 493336 - DNA, 16 bp, R. norvegicus
cctcaccccatccctg

SEQ ID NO: 493337 - DNA, 16 bp, R. norvegicus
cctcacctcaagctgt

SEQ ID NO: 493338 - DNA, 16 bp, R. norvegicus
cctcaccttgccagag

SEQ ID NO: 493339 - DNA, 16 bp, R. norvegicus
cctcacggagagctca

SEQ ID NO: 493340 - DNA, 16 bp, R. norvegicus
cctcactcaggataac

SEQ ID NO: 493341 - DNA, 16 bp, R. norvegicus
cctcactcagtgtgat

SEQ ID NO: 493342 - DNA, 16 bp, R. norvegicus
cctcactgggggactc

SEQ ID NO: 493343 - DNA, 16 bp, R. norvegicus
cctcacttctgagggt

SEQ ID NO: 493344 - DNA, 16 bp, R. norvegicus
cctcagaagaaggaaa

SEQ ID NO: 493345 - DNA, 16 bp, R. norvegicus
cctcagaagtcagaag

SEQ ID NO: 493346 - DNA, 16 bp, R. norvegicus
cctcagacagctcctc

SEQ ID NO: 493347 - DNA, 16 bp, R. norvegicus
cctcagacttacagag

SEQ ID NO: 493348 - DNA, 16 bp, R. norvegicus
cctcagagaagaagga

SEQ ID NO: 493349 - DNA, 16 bp, R. norvegicus
cctcagagaagaaggg

SEQ ID NO: 493350 - DNA, 16 bp, R. norvegicus
cctcagagaaggagaa

SEQ ID NO: 493351 - DNA, 16 bp, R. norvegicus
cctcagagacaacaat

SEQ ID NO: 493352 - DNA, 16 bp, R. norvegicus
cctcagagacagagac

SEQ ID NO: 493353 - DNA, 16 bp, R. norvegicus
cctcagagagagaaga

SEQ ID NO: 493354 - DNA, 16 bp, R. norvegicus
cctcagagctcaggaa

SEQ ID NO: 493355 - DNA, 16 bp, R. norvegicus
cctcagagctggagtt

SEQ ID NO: 493356 - DNA, 17 bp, R. norvegicus
cctcagagtgctccacc

SEQ ID NO: 493357 - DNA, 16 bp, R. norvegicus
cctcagagtggaaggc

SEQ ID NO: 493358 - DNA, 16 bp, R. norvegicus
cctcagagtgtgtgtg

SEQ ID NO: 493359 - DNA, 16 bp, R. norvegicus
cctcagatgatggaaa

SEQ ID NO: 493360 - DNA, 16 bp, R. norvegicus
cctcagcaaccacatg

SEQ ID NO: 493361 - DNA, 16 bp, R. norvegicus
cctcagcaagagcagt

SEQ ID NO: 493362 - DNA, 16 bp, R. norvegicus
cctcagcaccacataa

SEQ ID NO: 493363 - DNA, 16 bp, R. norvegicus
cctcagcagataccag

SEQ ID NO: 493364 - DNA, 16 bp, R. norvegicus
cctcagccatctctcc

SEQ ID NO: 493365 - DNA, 16 bp, R. norvegicus
cctcagccatctctct

SEQ ID NO: 493366 - DNA, 16 bp, R. norvegicus
cctcagccatttgtcc

SEQ ID NO: 493367 - DNA, 16 bp, R. norvegicus
cctcagcccacatccc

SEQ ID NO: 493368 - DNA, 16 bp, R. norvegicus
cctcagcctcagcccc

SEQ ID NO: 493369 - DNA, 16 bp, R. norvegicus
cctcagcctcagcctc

SEQ ID NO: 493370 - DNA, 16 bp, R. norvegicus
cctcagcctcagcttg

SEQ ID NO: 493371 - DNA, 16 bp, R. norvegicus
cctcagcctccaaagt

SEQ ID NO: 493372 - DNA, 16 bp, R. norvegicus
cctcagcctcccagat

SEQ ID NO: 493373 - DNA, 16 bp, R. norvegicus
cctcagcctcccaggc

SEQ ID NO: 493374 - DNA, 16 bp, R. norvegicus
cctcagcctcccagtg

SEQ ID NO: 493375 - DNA, 16 bp, R. norvegicus
cctcagcctccccagg

SEQ ID NO: 493376 - DNA, 16 bp, R. norvegicus
cctcagcctccctagt

SEQ ID NO: 493377 - DNA, 16 bp, R. norvegicus
cctcagcctcctcaga

SEQ ID NO: 493378 - DNA, 16 bp, R. norvegicus
cctcagcctcctgagg

SEQ ID NO: 493379 - DNA, 16 bp, R. norvegicus
cctcagcctcctgatt

SEQ ID NO: 493380 - DNA, 16 bp, R. norvegicus
cctcagcctcctggat

SEQ ID NO: 493381 - DNA, 16 bp, R. norvegicus
cctcagcctctcaagg

SEQ ID NO: 493382 - DNA, 16 bp, R. norvegicus
cctcagcctctccagt

SEQ ID NO: 493383 - DNA, 16 bp, R. norvegicus
cctcagcctctgaagt

SEQ ID NO: 493384 - DNA, 16 bp, R. norvegicus
cctcagcctctgcctc

SEQ ID NO: 493385 - DNA, 16 bp, R. norvegicus
cctcagcgatgtagaa

SEQ ID NO: 493386 - DNA, 16 bp, R. norvegicus
cctcagctcctcccag

SEQ ID NO: 493387 - DNA, 16 bp, R. norvegicus
cctcagctcctctcca

SEQ ID NO: 493388 - DNA, 16 bp, R. norvegicus
cctcagctcctgcttc

SEQ ID NO: 493389 - DNA, 16 bp, R. norvegicus
cctcagctgaggaatt

SEQ ID NO: 493390 - DNA, 16 bp, R. norvegicus
cctcagctgctctctg

SEQ ID NO: 493391 - DNA, 16 bp, R. norvegicus
cctcagctgtttgtcc

SEQ ID NO: 493392 - DNA, 16 bp, R. norvegicus
cctcagcttcctccag

SEQ ID NO: 493393 - DNA, 16 bp, R. norvegicus
cctcagcttcctggat

SEQ ID NO: 493394 - DNA, 16 bp, R. norvegicus
cctcagcttggagagg

SEQ ID NO: 493395 - DNA, 16 bp, R. norvegicus
cctcagctttcagcag

SEQ ID NO: 493396 - DNA, 16 bp, R. norvegicus
cctcaggaagagcaat

SEQ ID NO: 493397 - DNA, 16 bp, R. norvegicus
cctcaggacctcagga

SEQ ID NO: 493398 - DNA, 16 bp, R. norvegicus
cctcaggagctggagt

SEQ ID NO: 493399 - DNA, 16 bp, R. norvegicus
cctcaggaggaggaag

SEQ ID NO: 493400 - DNA, 16 bp, R. norvegicus
cctcaggagtgccctc

SEQ ID NO: 493401 - DNA, 16 bp, R. norvegicus
cctcaggcagctcaat

SEQ ID NO: 493402 - DNA, 16 bp, R. norvegicus
cctcaggcatttcaat

SEQ ID NO: 493403 - DNA, 16 bp, R. norvegicus
cctcaggctggcctca

SEQ ID NO: 493404 - DNA, 16 bp, R. norvegicus
cctcagggagtgaagg

SEQ ID NO: 493405 - DNA, 16 bp, R. norvegicus
cctcaggtatcagaga

SEQ ID NO: 493406 - DNA, 16 bp, R. norvegicus
cctcaggtgctgtcca

SEQ ID NO: 493407 - DNA, 16 bp, R. norvegicus
cctcaggttctactgg

SEQ ID NO: 493408 - DNA, 16 bp, R. norvegicus
cctcaggttcttctcc

SEQ ID NO: 493409 - DNA, 16 bp, R. norvegicus
cctcagtcacctcagc

SEQ ID NO: 493410 - DNA, 16 bp, R. norvegicus
cctcagtctcctcatc

SEQ ID NO: 493411 - DNA, 16 bp, R. norvegicus
cctcagtctctgcccc

SEQ ID NO: 493412 - DNA, 16 bp, R. norvegicus
cctcagtctctgtgag

SEQ ID NO: 493413 - DNA, 16 bp, R. norvegicus
cctcagtctcttctct

SEQ ID NO: 493414 - DNA, 16 bp, R. norvegicus
cctcagtgatggacag

SEQ ID NO: 493415 - DNA, 16 bp, R. norvegicus
cctcagtgcaggggaa

SEQ ID NO: 493416 - DNA, 16 bp, R. norvegicus
cctcagtgcccagggc

SEQ ID NO: 493417 - DNA, 16 bp, R. norvegicus
cctcagtgctgggact

SEQ ID NO: 493418 - DNA, 16 bp, R. norvegicus
cctcagtggaagaaga

SEQ ID NO: 493419 - DNA, 16 bp, R. norvegicus
cctcagtggagaggat

SEQ ID NO: 493420 - DNA, 16 bp, R. norvegicus
cctcagtggctttcct

SEQ ID NO: 493421 - DNA, 16 bp, R. norvegicus
cctcagtgggaggaga

SEQ ID NO: 493422 - DNA, 16 bp, R. norvegicus
cctcagtgggcaccag

SEQ ID NO: 493423 - DNA, 17 bp, R. norvegicus
cctcagtgtccatgatg

SEQ ID NO: 493424 - DNA, 16 bp, R. norvegicus
cctcagttcctgcctc

SEQ ID NO: 493425 - DNA, 16 bp, R. norvegicus
cctcagtttccccaaa

SEQ ID NO: 493426 - DNA, 16 bp, R. norvegicus
cctcagtttccccacc

SEQ ID NO: 493427 - DNA, 16 bp, R. norvegicus
cctcagtttccccagt

SEQ ID NO: 493428 - DNA, 16 bp, R. norvegicus
cctcagtttcctcttc

SEQ ID NO: 493429 - DNA, 16 bp, R. norvegicus
cctcagttttcccatc

SEQ ID NO: 493430 - DNA, 16 bp, R. norvegicus
cctcagtttttgatct

SEQ ID NO: 493431 - DNA, 16 bp, R. norvegicus
cctcataagtgctggg

SEQ ID NO: 493432 - DNA, 16 bp, R. norvegicus
cctcatacaaatatta

SEQ ID NO: 493433 - DNA, 16 bp, R. norvegicus
cctcatagaaacagtg

SEQ ID NO: 493434 - DNA, 16 bp, R. norvegicus
cctcatagaagaagaa

SEQ ID NO: 493435 - DNA, 16 bp, R. norvegicus
cctcatcaaaggcatc

SEQ ID NO: 493436 - DNA, 16 bp, R. norvegicus
cctcatcaccctcatc

SEQ ID NO: 493437 - DNA, 16 bp, R. norvegicus
cctcatcagagaagtt

SEQ ID NO: 493438 - DNA, 16 bp, R. norvegicus
cctcatcatcctcatc

SEQ ID NO: 493439 - DNA, 16 bp, R. norvegicus
cctcatccagcaagga

SEQ ID NO: 493440 - DNA, 16 bp, R. norvegicus
cctcatcctaaaacag

SEQ ID NO: 493441 - DNA, 16 bp, R. norvegicus
cctcatcctcaccagc

SEQ ID NO: 493442 - DNA, 16 bp, R. norvegicus
cctcatcctcatcttc

SEQ ID NO: 493443 - DNA, 16 bp, R. norvegicus
cctcatcctctatctc

SEQ ID NO: 493444 - DNA, 16 bp, R. norvegicus
cctcatgaagaccaag

SEQ ID NO: 493445 - DNA, 16 bp, R. norvegicus
cctcatgctcacacag

SEQ ID NO: 493446 - DNA, 21 bp, R. norvegicus
cctcatgggacaaacttggaa

SEQ ID NO: 493447 - DNA, 45 bp, R. norvegicus
cctcatggtactttctccaaaattgaccatataattggtcaaaac

SEQ ID NO: 493448 - DNA, 16 bp, R. norvegicus
cctcatgttgtggaga

SEQ ID NO: 493449 - DNA, 16 bp, R. norvegicus
cctcattctggacctc

SEQ ID NO: 493450 - DNA, 16 bp, R. norvegicus
cctcattgagactctc

SEQ ID NO: 493451 - DNA, 16 bp, R. norvegicus
cctcattggaggagtt

SEQ ID NO: 493452 - DNA, 16 bp, R. norvegicus
cctccaaaaggaaact

SEQ ID NO: 493453 - DNA, 16 bp, R. norvegicus
cctccaacagaaagac

SEQ ID NO: 493454 - DNA, 16 bp, R. norvegicus
cctccaagcacaagga

SEQ ID NO: 493455 - DNA, 16 bp, R. norvegicus
cctccaaggacacagg

SEQ ID NO: 493456 - DNA, 16 bp, R. norvegicus
cctccaaggctcaggg

SEQ ID NO: 493457 - DNA, 16 bp, R. norvegicus
cctccaatggtgaccc

SEQ ID NO: 493458 - DNA, 16 bp, R. norvegicus
cctccaatgttggtgg

SEQ ID NO: 493459 - DNA, 16 bp, R. norvegicus
cctccacaggctcatg

SEQ ID NO: 493460 - DNA, 16 bp, R. norvegicus
cctccacagtctctgc

SEQ ID NO: 493461 - DNA, 16 bp, R. norvegicus
cctccaccaaggccac

SEQ ID NO: 493462 - DNA, 16 bp, R. norvegicus
cctccaccacactgac

SEQ ID NO: 493463 - DNA, 16 bp, R. norvegicus
cctccaccaccatcat

SEQ ID NO: 493464 - DNA, 16 bp, R. norvegicus
cctccacctcctgagt

SEQ ID NO: 493465 - DNA, 16 bp, R. norvegicus
cctccacctctgcctc

SEQ ID NO: 493466 - DNA, 16 bp, R. norvegicus
cctccacggcttctgc

SEQ ID NO: 493467 - DNA, 16 bp, R. norvegicus
cctccactgctgctgc

SEQ ID NO: 493468 - DNA, 16 bp, R. norvegicus
cctccagaaacctcct

SEQ ID NO: 493469 - DNA, 16 bp, R. norvegicus
cctccagaaccatgag

SEQ ID NO: 493470 - DNA, 16 bp, R. norvegicus
cctccagaacctgaag

SEQ ID NO: 493471 - DNA, 16 bp, R. norvegicus
cctccagaactcccag

SEQ ID NO: 493472 - DNA, 16 bp, R. norvegicus
cctccagaagaacagc

SEQ ID NO: 493473 - DNA, 16 bp, R. norvegicus
cctccagacttatttc

SEQ ID NO: 493474 - DNA, 16 bp, R. norvegicus
cctccagagaggcaga

SEQ ID NO: 493475 - DNA, 16 bp, R. norvegicus
cctccagagttctggg

SEQ ID NO: 493476 - DNA, 16 bp, R. norvegicus
cctccagatgttccaa

SEQ ID NO: 493477 - DNA, 16 bp, R. norvegicus
cctccagcagaaagac

SEQ ID NO: 493478 - DNA, 16 bp, R. norvegicus
cctccagcaggaagac

SEQ ID NO: 493479 - DNA, 16 bp, R. norvegicus
cctccagcatcaagat

SEQ ID NO: 493480 - DNA, 16 bp, R. norvegicus
cctccagcccctccag

SEQ ID NO: 493481 - DNA, 16 bp, R. norvegicus
cctccagcctccagcc

SEQ ID NO: 493482 - DNA, 16 bp, R. norvegicus
cctccagcctcctcct

SEQ ID NO: 493483 - DNA, 16 bp, R. norvegicus
cctccaggctcttgag

SEQ ID NO: 493484 - DNA, 16 bp, R. norvegicus
cctccagggagcagga

SEQ ID NO: 493485 - DNA, 16 bp, R. norvegicus
cctccagggcctctgc

SEQ ID NO: 493486 - DNA, 16 bp, R. norvegicus
cctccaggtgctggga

SEQ ID NO: 493487 - DNA, 16 bp, R. norvegicus
cctccaggttcctcct

SEQ ID NO: 493488 - DNA, 16 bp, R. norvegicus
cctccagtacctgata

SEQ ID NO: 493489 - DNA, 16 bp, R. norvegicus
cctccagtattcctgg

SEQ ID NO: 493490 - DNA, 16 bp, R. norvegicus
cctccagtccttcccc

SEQ ID NO: 493491 - DNA, 16 bp, R. norvegicus
cctccagtggaaccag

SEQ ID NO: 493492 - DNA, 16 bp, R. norvegicus
cctccagtggagggac

SEQ ID NO: 493493 - DNA, 16 bp, R. norvegicus
cctccagtggggtccc

SEQ ID NO: 493494 - DNA, 16 bp, R. norvegicus
cctccagtttcctgcc

SEQ ID NO: 493495 - DNA, 16 bp, R. norvegicus
cctccataggaccaag

SEQ ID NO: 493496 - DNA, 16 bp, R. norvegicus
cctccatagtctctgc

SEQ ID NO: 493497 - DNA, 21 bp, R. norvegicus
cctccatatgagacacgctca

SEQ ID NO: 493498 - DNA, 16 bp, R. norvegicus
cctccatcagttgtag

SEQ ID NO: 493499 - DNA, 16 bp, R. norvegicus
cctccatcctctctgg

SEQ ID NO: 493500 - DNA, 16 bp, R. norvegicus
cctccatcttctgcac

SEQ ID NO: 493501 - DNA, 16 bp, R. norvegicus
cctccatgaaggtgct

SEQ ID NO: 493502 - DNA, 16 bp, R. norvegicus
cctccatgccctgaca

SEQ ID NO: 493503 - DNA, 16 bp, R. norvegicus
cctccatggcctctgc

SEQ ID NO: 493504 - DNA, 16 bp, R. norvegicus
cctccatggtctctgc

SEQ ID NO: 493505 - DNA, 18 bp, R. norvegicus
cctccattattgatgtta

SEQ ID NO: 493506 - DNA, 16 bp, R. norvegicus
cctccattggagttcc

SEQ ID NO: 493507 - DNA, 16 bp, R. norvegicus
cctccattggtgaccc

SEQ ID NO: 493508 - DNA, 16 bp, R. norvegicus
cctcccaaaggctggg

SEQ ID NO: 493509 - DNA, 16 bp, R. norvegicus
cctcccaaattctggg

SEQ ID NO: 493510 - DNA, 16 bp, R. norvegicus
cctcccaagcgctggg

SEQ ID NO: 493511 - DNA, 16 bp, R. norvegicus
cctcccaaggagctgg

SEQ ID NO: 493512 - DNA, 16 bp, R. norvegicus
cctcccaaggctggac

SEQ ID NO: 493513 - DNA, 16 bp, R. norvegicus
cctcccaagtgccaga

SEQ ID NO: 493514 - DNA, 16 bp, R. norvegicus
cctcccaagtgctgac

SEQ ID NO: 493515 - DNA, 16 bp, R. norvegicus
cctcccacaggtccct

SEQ ID NO: 493516 - DNA, 16 bp, R. norvegicus
cctcccacagttcctc

SEQ ID NO: 493517 - DNA, 16 bp, R. norvegicus
cctcccagagttccca

SEQ ID NO: 493518 - DNA, 16 bp, R. norvegicus
cctcccagatcagggt

SEQ ID NO: 493519 - DNA, 16 bp, R. norvegicus
cctcccagcacctgct

SEQ ID NO: 493520 - DNA, 16 bp, R. norvegicus
cctcccagccaggggc

SEQ ID NO: 493521 - DNA, 16 bp, R. norvegicus
cctcccagccctggca

SEQ ID NO: 493522 - DNA, 16 bp, R. norvegicus
cctcccaggagctggg

SEQ ID NO: 493523 - DNA, 16 bp, R. norvegicus
cctcccaggcctctgg

SEQ ID NO: 493524 - DNA, 16 bp, R. norvegicus
cctcccaggtctctcc

SEQ ID NO: 493525 - DNA, 16 bp, R. norvegicus
cctcccaggtctctga

SEQ ID NO: 493526 - DNA, 16 bp, R. norvegicus
cctcccagtcctgccc

SEQ ID NO: 493527 - DNA, 16 bp, R. norvegicus
cctcccagtctgccct

SEQ ID NO: 493528 - DNA, 16 bp, R. norvegicus
cctcccagtgctgggg

SEQ ID NO: 493529 - DNA, 16 bp, R. norvegicus
cctcccagttcctcct

SEQ ID NO: 493530 - DNA, 16 bp, R. norvegicus
cctcccagttccttcc

SEQ ID NO: 493531 - DNA, 16 bp, R. norvegicus
cctcccagttcttccc

SEQ ID NO: 493532 - DNA, 16 bp, R. norvegicus
cctcccatcaaataat

SEQ ID NO: 493533 - DNA, 16 bp, R. norvegicus
cctcccatctcactgt

SEQ ID NO: 493534 - DNA, 16 bp, R. norvegicus
cctcccatctctgctt

SEQ ID NO: 493535 - DNA, 16 bp, R. norvegicus
cctcccatctggatcc

SEQ ID NO: 493536 - DNA, 16 bp, R. norvegicus
cctcccatggatgtca

SEQ ID NO: 493537 - DNA, 16 bp, R. norvegicus
cctccccaagttgctg

SEQ ID NO: 493538 - DNA, 16 bp, R. norvegicus
cctccccacacctgat

SEQ ID NO: 493539 - DNA, 16 bp, R. norvegicus
cctccccacttcctgg

SEQ ID NO: 493540 - DNA, 16 bp, R. norvegicus
cctccccagccctgca

SEQ ID NO: 493541 - DNA, 16 bp, R. norvegicus
cctccccaggctgctt

SEQ ID NO: 493542 - DNA, 16 bp, R. norvegicus
cctccccagtgccagg

SEQ ID NO: 493543 - DNA, 20 bp, R. norvegicus
cctcccccaatctattgtta

SEQ ID NO: 493544 - DNA, 16 bp, R. norvegicus
cctcccccactgctac

SEQ ID NO: 493545 - DNA, 16 bp, R. norvegicus
cctcccccagcagcca

SEQ ID NO: 493546 - DNA, 16 bp, R. norvegicus
cctcccccatgcaggt

SEQ ID NO: 493547 - DNA, 16 bp, R. norvegicus
cctcccctcagggctc

SEQ ID NO: 493548 - DNA, 16 bp, R. norvegicus
cctcccctgtcccagg

SEQ ID NO: 493549 - DNA, 16 bp, R. norvegicus
cctccccttctacatg

SEQ ID NO: 493550 - DNA, 16 bp, R. norvegicus
cctccccttttctatg

SEQ ID NO: 493551 - DNA, 16 bp, R. norvegicus
cctcccgccacataat

SEQ ID NO: 493552 - DNA, 16 bp, R. norvegicus
cctccctccagtctca

SEQ ID NO: 493553 - DNA, 16 bp, R. norvegicus
cctccctccctccagt

SEQ ID NO: 493554 - DNA, 16 bp, R. norvegicus
cctccctctgctgtgt

SEQ ID NO: 493555 - DNA, 16 bp, R. norvegicus
cctccctgagtcccag

SEQ ID NO: 493556 - DNA, 16 bp, R. norvegicus
cctccctggcctctgt

SEQ ID NO: 493557 - DNA, 16 bp, R. norvegicus
cctccctgggccccaa

SEQ ID NO: 493558 - DNA, 16 bp, R. norvegicus
cctccctggtgctgga

SEQ ID NO: 493559 - DNA, 16 bp, R. norvegicus
cctccctgtcctccac

SEQ ID NO: 493560 - DNA, 16 bp, R. norvegicus
cctccctgttaatgtt

SEQ ID NO: 493561 - DNA, 16 bp, R. norvegicus
cctcccttccctgaca

SEQ ID NO: 493562 - DNA, 16 bp, R. norvegicus
cctcctaaaggttcca

SEQ ID NO: 493563 - DNA, 16 bp, R. norvegicus
cctcctacagttcctc

SEQ ID NO: 493564 - DNA, 16 bp, R. norvegicus
cctcctacatcaatta

SEQ ID NO: 493565 - DNA, 16 bp, R. norvegicus
cctcctacatcagtta

SEQ ID NO: 493566 - DNA, 16 bp, R. norvegicus
cctcctacatgctggg

SEQ ID NO: 493567 - DNA, 16 bp, R. norvegicus
cctcctactgagttgc

SEQ ID NO: 493568 - DNA, 16 bp, R. norvegicus
cctcctactgggctgc

SEQ ID NO: 493569 - DNA, 16 bp, R. norvegicus
cctcctagaagcaggg

SEQ ID NO: 493570 - DNA, 16 bp, R. norvegicus
cctcctaggaatattt

SEQ ID NO: 493571 - DNA, 16 bp, R. norvegicus
cctcctaggtgtattt

SEQ ID NO: 493572 - DNA, 16 bp, R. norvegicus
cctcctcacctctgcc

SEQ ID NO: 493573 - DNA, 16 bp, R. norvegicus
cctcctcagcagaggc

SEQ ID NO: 493574 - DNA, 16 bp, R. norvegicus
cctcctcagcctcctc

SEQ ID NO: 493575 - DNA, 16 bp, R. norvegicus
cctcctcagctctctc

SEQ ID NO: 493576 - DNA, 16 bp, R. norvegicus
cctcctcatcatcttc

SEQ ID NO: 493577 - DNA, 16 bp, R. norvegicus
cctcctccagcctcct

SEQ ID NO: 493578 - DNA, 16 bp, R. norvegicus
cctcctcccagatgac

SEQ ID NO: 493579 - DNA, 16 bp, R. norvegicus
cctcctcccagctgcc

SEQ ID NO: 493580 - DNA, 16 bp, R. norvegicus
cctcctcctatcctgt

SEQ ID NO: 493581 - DNA, 16 bp, R. norvegicus
cctcctcctcacagtc

SEQ ID NO: 493582 - DNA, 16 bp, R. norvegicus
cctcctcctcagcctc

SEQ ID NO: 493583 - DNA, 16 bp, R. norvegicus
cctcctcctcctcagc

SEQ ID NO: 493584 - DNA, 16 bp, R. norvegicus
cctcctcctcctcagg

SEQ ID NO: 493585 - DNA, 16 bp, R. norvegicus
cctcctcctcctctag

SEQ ID NO: 493586 - DNA, 16 bp, R. norvegicus
cctcctcctctgagaa

SEQ ID NO: 493587 - DNA, 16 bp, R. norvegicus
cctcctcctgactgcc

SEQ ID NO: 493588 - DNA, 16 bp, R. norvegicus
cctcctcctgtgtgcc

SEQ ID NO: 493589 - DNA, 16 bp, R. norvegicus
cctcctcgtcgtcttc

SEQ ID NO: 493590 - DNA, 16 bp, R. norvegicus
cctcctctaacaacaa

SEQ ID NO: 493591 - DNA, 16 bp, R. norvegicus
cctcctctcctctcag

SEQ ID NO: 493592 - DNA, 16 bp, R. norvegicus
cctcctctcctggagc

SEQ ID NO: 493593 - DNA, 16 bp, R. norvegicus
cctcctctggcctgca

SEQ ID NO: 493594 - DNA, 16 bp, R. norvegicus
cctcctctggtgtgca

SEQ ID NO: 493595 - DNA, 16 bp, R. norvegicus
cctcctctgtgtccct

SEQ ID NO: 493596 - DNA, 16 bp, R. norvegicus
cctcctcttcagcttc

SEQ ID NO: 493597 - DNA, 16 bp, R. norvegicus
cctcctcttcctcagt

SEQ ID NO: 493598 - DNA, 16 bp, R. norvegicus
cctcctcttcctcatg

SEQ ID NO: 493599 - DNA, 16 bp, R. norvegicus
cctcctcttcctgctg

SEQ ID NO: 493600 - DNA, 16 bp, R. norvegicus
cctcctgacctctgag

SEQ ID NO: 493601 - DNA, 16 bp, R. norvegicus
cctcctgagattaaag

SEQ ID NO: 493602 - DNA, 16 bp, R. norvegicus
cctcctgagcactgag

SEQ ID NO: 493603 - DNA, 16 bp, R. norvegicus
cctcctgagtgagcta

SEQ ID NO: 493604 - DNA, 16 bp, R. norvegicus
cctcctgagtgccggg

SEQ ID NO: 493605 - DNA, 16 bp, R. norvegicus
cctcctgatccttccc

SEQ ID NO: 493606 - DNA, 16 bp, R. norvegicus
cctcctgatgtcctgg

SEQ ID NO: 493607 - DNA, 16 bp, R. norvegicus
cctcctgcagcagata

SEQ ID NO: 493608 - DNA, 16 bp, R. norvegicus
cctcctgcagcagcca

SEQ ID NO: 493609 - DNA, 16 bp, R. norvegicus
cctcctgcatgctggg

SEQ ID NO: 493610 - DNA, 16 bp, R. norvegicus
cctcctgcccatcctt

SEQ ID NO: 493611 - DNA, 16 bp, R. norvegicus
cctcctgcctcatcat

SEQ ID NO: 493612 - DNA, 16 bp, R. norvegicus
cctcctgcctcccagc

SEQ ID NO: 493613 - DNA, 16 bp, R. norvegicus
cctcctgcctcggcct

SEQ ID NO: 493614 - DNA, 16 bp, R. norvegicus
cctcctgccttcatct

SEQ ID NO: 493615 - DNA, 16 bp, R. norvegicus
cctcctgctcttccca

SEQ ID NO: 493616 - DNA, 16 bp, R. norvegicus
cctcctgctgcagctg

SEQ ID NO: 493617 - DNA, 16 bp, R. norvegicus
cctcctgctgctcctg

SEQ ID NO: 493618 - DNA, 16 bp, R. norvegicus
cctcctgctggctcag

SEQ ID NO: 493619 - DNA, 16 bp, R. norvegicus
cctcctgctttcacct

SEQ ID NO: 493620 - DNA, 16 bp, R. norvegicus
cctcctgcttttatga

SEQ ID NO: 493621 - DNA, 16 bp, R. norvegicus
cctcctggaactggag

SEQ ID NO: 493622 - DNA, 16 bp, R. norvegicus
cctcctggctgcctgc

SEQ ID NO: 493623 - DNA, 16 bp, R. norvegicus
cctcctggggatccag

SEQ ID NO: 493624 - DNA, 16 bp, R. norvegicus
cctcctgggtatattt

SEQ ID NO: 493625 - DNA, 16 bp, R. norvegicus
cctcctgggtcccctg

SEQ ID NO: 493626 - DNA, 16 bp, R. norvegicus
cctcctgggtcctggg

SEQ ID NO: 493627 - DNA, 16 bp, R. norvegicus
cctcctggtccaccct

SEQ ID NO: 493628 - DNA, 16 bp, R. norvegicus
cctcctggtcctcctg

SEQ ID NO: 493629 - DNA, 16 bp, R. norvegicus
cctcctgtaactccag

SEQ ID NO: 493630 - DNA, 16 bp, R. norvegicus
cctcctgtacactctg

SEQ ID NO: 493631 - DNA, 16 bp, R. norvegicus
cctcctgtctcagctg

SEQ ID NO: 493632 - DNA, 16 bp, R. norvegicus
cctcctgtctccatcc

SEQ ID NO: 493633 - DNA, 16 bp, R. norvegicus
cctcctgtctcccttg

SEQ ID NO: 493634 - DNA, 16 bp, R. norvegicus
cctcctgtctgtctct

SEQ ID NO: 493635 - DNA, 16 bp, R. norvegicus
cctcctgtcttagctt

SEQ ID NO: 493636 - DNA, 16 bp, R. norvegicus
cctcctgttcccattc

SEQ ID NO: 493637 - DNA, 16 bp, R. norvegicus
cctccttcctcagcaa

SEQ ID NO: 493638 - DNA, 16 bp, R. norvegicus
cctccttcctgcccca

SEQ ID NO: 493639 - DNA, 16 bp, R. norvegicus
cctccttctacaaact

SEQ ID NO: 493640 - DNA, 16 bp, R. norvegicus
cctccttctgtcccca

SEQ ID NO: 493641 - DNA, 16 bp, R. norvegicus
cctccttcttctataa

SEQ ID NO: 493642 - DNA, 16 bp, R. norvegicus
cctccttgctggctcc

SEQ ID NO: 493643 - DNA, 16 bp, R. norvegicus
cctccttggtgctggg

SEQ ID NO: 493644 - DNA, 16 bp, R. norvegicus
cctccttgttcagctg

SEQ ID NO: 493645 - DNA, 16 bp, R. norvegicus
cctcctttaaaaaaaa

SEQ ID NO: 493646 - DNA, 16 bp, R. norvegicus
cctcggcctcggcctc

SEQ ID NO: 493647 - DNA, 16 bp, R. norvegicus
cctcggggctggagag

SEQ ID NO: 493648 - DNA, 16 bp, R. norvegicus
cctcggggctggggat

SEQ ID NO: 493649 - DNA, 16 bp, R. norvegicus
cctctaaaatctgtgt

SEQ ID NO: 493650 - DNA, 16 bp, R. norvegicus
cctctaattctgtagt

SEQ ID NO: 493651 - DNA, 16 bp, R. norvegicus
cctctactcacctctg

SEQ ID NO: 493652 - DNA, 16 bp, R. norvegicus
cctctactcctctact

SEQ ID NO: 493653 - DNA, 16 bp, R. norvegicus
cctctactccttccag

SEQ ID NO: 493654 - DNA, 16 bp, R. norvegicus
cctctacttctcaagt

SEQ ID NO: 493655 - DNA, 16 bp, R. norvegicus
cctctacttctcccag

SEQ ID NO: 493656 - DNA, 16 bp, R. norvegicus
cctctactttatctcc

SEQ ID NO: 493657 - DNA, 16 bp, R. norvegicus
cctctagaatcagaaa

SEQ ID NO: 493658 - DNA, 16 bp, R. norvegicus
cctctagaatgtacca

SEQ ID NO: 493659 - DNA, 16 bp, R. norvegicus
cctctagcattcccct

SEQ ID NO: 493660 - DNA, 16 bp, R. norvegicus
cctctatcatctttgt

SEQ ID NO: 493661 - DNA, 17 bp, R. norvegicus
cctctatctcttgtagg

SEQ ID NO: 493662 - DNA, 16 bp, R. norvegicus
cctctattgaagagca

SEQ ID NO: 493663 - DNA, 16 bp, R. norvegicus
cctctcaaatgctgga

SEQ ID NO: 493664 - DNA, 16 bp, R. norvegicus
cctctcaaggaacagc

SEQ ID NO: 493665 - DNA, 16 bp, R. norvegicus
cctctcaagtgtctgt

SEQ ID NO: 493666 - DNA, 16 bp, R. norvegicus
cctctcacctgctctg

SEQ ID NO: 493667 - DNA, 16 bp, R. norvegicus
cctctcactgggggat

SEQ ID NO: 493668 - DNA, 16 bp, R. norvegicus
cctctcagaggcaaag

SEQ ID NO: 493669 - DNA, 16 bp, R. norvegicus
cctctcaggaaatagc

SEQ ID NO: 493670 - DNA, 16 bp, R. norvegicus
cctctcaggagacaca

SEQ ID NO: 493671 - DNA, 16 bp, R. norvegicus
cctctcaggcctgctg

SEQ ID NO: 493672 - DNA, 16 bp, R. norvegicus
cctctcagtggacagc

SEQ ID NO: 493673 - DNA, 16 bp, R. norvegicus
cctctcatagtgccaa

SEQ ID NO: 493674 - DNA, 16 bp, R. norvegicus
cctctccaaactgact

SEQ ID NO: 493675 - DNA, 16 bp, R. norvegicus
cctctccaacaccatg

SEQ ID NO: 493676 - DNA, 16 bp, R. norvegicus
cctctccagcaccgtg

SEQ ID NO: 493677 - DNA, 16 bp, R. norvegicus
cctctccatgcaaatg

SEQ ID NO: 493678 - DNA, 16 bp, R. norvegicus
cctctccatgctcccc

SEQ ID NO: 493679 - DNA, 16 bp, R. norvegicus
cctctccatggcctct

SEQ ID NO: 493680 - DNA, 16 bp, R. norvegicus
cctctcccagattggg

SEQ ID NO: 493681 - DNA, 16 bp, R. norvegicus
cctctcccatgaattt

SEQ ID NO: 493682 - DNA, 16 bp, R. norvegicus
cctctccccatcagat

SEQ ID NO: 493683 - DNA, 16 bp, R. norvegicus
cctctccccatcccag

SEQ ID NO: 493684 - DNA, 17 bp, R. norvegicus
cctctcccttcccagcc

SEQ ID NO: 493685 - DNA, 16 bp, R. norvegicus
cctctcccttgctctg

SEQ ID NO: 493686 - DNA, 16 bp, R. norvegicus
cctctcctccaaatcc

SEQ ID NO: 493687 - DNA, 16 bp, R. norvegicus
cctctcctccaagtcc

SEQ ID NO: 493688 - DNA, 16 bp, R. norvegicus
cctctcctgaaactct

SEQ ID NO: 493689 - DNA, 16 bp, R. norvegicus
cctctcctggcctctg

SEQ ID NO: 493690 - DNA, 16 bp, R. norvegicus
cctctccttctaaaac

SEQ ID NO: 493691 - DNA, 45 bp, R. norvegicus
cctctctacaggtcttcagctgttcctgtgggcctgtgtcttgag

SEQ ID NO: 493692 - DNA, 16 bp, R. norvegicus
cctctctatctctgtc

SEQ ID NO: 493693 - DNA, 16 bp, R. norvegicus
cctctctctgcctgct

SEQ ID NO: 493694 - DNA, 16 bp, R. norvegicus
cctctctgacctctgt

SEQ ID NO: 493695 - DNA, 16 bp, R. norvegicus
cctctctgatgactgt

SEQ ID NO: 493696 - DNA, 16 bp, R. norvegicus
cctctctgctcctctg

SEQ ID NO: 493697 - DNA, 16 bp, R. norvegicus
cctctctgctgactcc

SEQ ID NO: 493698 - DNA, 16 bp, R. norvegicus
cctctctggcctccat

SEQ ID NO: 493699 - DNA, 16 bp, R. norvegicus
cctctctgggcctcag

SEQ ID NO: 493700 - DNA, 16 bp, R. norvegicus
cctctcttcagcctca

SEQ ID NO: 493701 - DNA, 16 bp, R. norvegicus
cctctcttctatacct

SEQ ID NO: 493702 - DNA, 16 bp, R. norvegicus
cctctcttggcctctg

SEQ ID NO: 493703 - DNA, 49 bp, R. norvegicus
cctctcttgggcatatacccaaaagatgccccaacatataaaagagaca

SEQ ID NO: 493704 - DNA, 16 bp, R. norvegicus
cctctctttcaatcag

SEQ ID NO: 493705 - DNA, 16 bp, R. norvegicus
cctctgaaaagttccc

SEQ ID NO: 493706 - DNA, 16 bp, R. norvegicus
cctctgaaagagcagc

SEQ ID NO: 493707 - DNA, 16 bp, R. norvegicus
cctctgaagaaagaat

SEQ ID NO: 493708 - DNA, 16 bp, R. norvegicus
cctctgaagaaataaa

SEQ ID NO: 493709 - DNA, 16 bp, R. norvegicus
cctctgaagagcagca

SEQ ID NO: 493710 - DNA, 16 bp, R. norvegicus
cctctgaaggagcagt

SEQ ID NO: 493711 - DNA, 16 bp, R. norvegicus
cctctgaaggagtttt

SEQ ID NO: 493712 - DNA, 16 bp, R. norvegicus
cctctgaccccaagcc

SEQ ID NO: 493713 - DNA, 16 bp, R. norvegicus
cctctgacctccatgc

SEQ ID NO: 493714 - DNA, 16 bp, R. norvegicus
cctctgacctctaccc

SEQ ID NO: 493715 - DNA, 16 bp, R. norvegicus
cctctgacctctgctt

SEQ ID NO: 493716 - DNA, 16 bp, R. norvegicus
cctctgactcccacac

SEQ ID NO: 493717 - DNA, 16 bp, R. norvegicus
cctctgactgttcccc

SEQ ID NO: 493718 - DNA, 16 bp, R. norvegicus
cctctgagcaggtgga

SEQ ID NO: 493719 - DNA, 16 bp, R. norvegicus
cctctgagccacaccc

SEQ ID NO: 493720 - DNA, 16 bp, R. norvegicus
cctctgagcctggcag

SEQ ID NO: 493721 - DNA, 16 bp, R. norvegicus
cctctgagcctgtaag

SEQ ID NO: 493722 - DNA, 16 bp, R. norvegicus
cctctgagctccacat

SEQ ID NO: 493723 - DNA, 16 bp, R. norvegicus
cctctgagctctcaga

SEQ ID NO: 493724 - DNA, 35 bp, R. norvegicus
cctctgaggaagaggatttagaagatgaggcagct

SEQ ID NO: 493725 - DNA, 16 bp, R. norvegicus
cctctgatctacacac

SEQ ID NO: 493726 - DNA, 16 bp, R. norvegicus
cctctgatcttcacat

SEQ ID NO: 493727 - DNA, 16 bp, R. norvegicus
cctctgatgaatatga

SEQ ID NO: 493728 - DNA, 16 bp, R. norvegicus
cctctgatgtccacat

SEQ ID NO: 493729 - DNA, 16 bp, R. norvegicus
cctctgatgtgtctga

SEQ ID NO: 493730 - DNA, 16 bp, R. norvegicus
cctctgcaaaagcagc

SEQ ID NO: 493731 - DNA, 16 bp, R. norvegicus
cctctgcagacacctg

SEQ ID NO: 493732 - DNA, 16 bp, R. norvegicus
cctctgcagacactgc

SEQ ID NO: 493733 - DNA, 16 bp, R. norvegicus
cctctgcagcctgagg

SEQ ID NO: 493734 - DNA, 16 bp, R. norvegicus
cctctgcaggcaccaa

SEQ ID NO: 493735 - DNA, 16 bp, R. norvegicus
cctctgcagtgctggg

SEQ ID NO: 493736 - DNA, 29 bp, R. norvegicus
cctctgcagtgtggaaggttttcctggtt

SEQ ID NO: 493737 - DNA, 16 bp, R. norvegicus
cctctgcatcagcccc

SEQ ID NO: 493738 - DNA, 16 bp, R. norvegicus
cctctgcatcatctcc

SEQ ID NO: 493739 - DNA, 16 bp, R. norvegicus
cctctgccaccaccac

SEQ ID NO: 493740 - DNA, 16 bp, R. norvegicus
cctctgccgcctctgc

SEQ ID NO: 493741 - DNA, 16 bp, R. norvegicus
cctctgcctccacatg

SEQ ID NO: 493742 - DNA, 16 bp, R. norvegicus
cctctgcctcccacag

SEQ ID NO: 493743 - DNA, 16 bp, R. norvegicus
cctctgcctcccacct

SEQ ID NO: 493744 - DNA, 16 bp, R. norvegicus
cctctgcctcccaggt

SEQ ID NO: 493745 - DNA, 16 bp, R. norvegicus
cctctgcctccccaag

SEQ ID NO: 493746 - DNA, 16 bp, R. norvegicus
cctctgcctcccgagt

SEQ ID NO: 493747 - DNA, 16 bp, R. norvegicus
cctctgcctcctgagc

SEQ ID NO: 493748 - DNA, 16 bp, R. norvegicus
cctctgcctcctggag

SEQ ID NO: 493749 - DNA, 16 bp, R. norvegicus
cctctgcctcctgggc

SEQ ID NO: 493750 - DNA, 16 bp, R. norvegicus
cctctgcctctctctg

SEQ ID NO: 493751 - DNA, 16 bp, R. norvegicus
cctctgcctctctggc

SEQ ID NO: 493752 - DNA, 16 bp, R. norvegicus
cctctgcctctgctct

SEQ ID NO: 493753 - DNA, 16 bp, R. norvegicus
cctctgcctctggagt

SEQ ID NO: 493754 - DNA, 16 bp, R. norvegicus
cctctgccttcaccct

SEQ ID NO: 493755 - DNA, 16 bp, R. norvegicus
cctctgccttctctgt

SEQ ID NO: 493756 - DNA, 16 bp, R. norvegicus
cctctgccttctgagt

SEQ ID NO: 493757 - DNA, 16 bp, R. norvegicus
cctctgccttctgcct

SEQ ID NO: 493758 - DNA, 16 bp, R. norvegicus
cctctgccttgctaaa

SEQ ID NO: 493759 - DNA, 16 bp, R. norvegicus
cctctgctcagacaga

SEQ ID NO: 493760 - DNA, 16 bp, R. norvegicus
cctctgctctgcagcc

SEQ ID NO: 493761 - DNA, 16 bp, R. norvegicus
cctctgctctgcctct

SEQ ID NO: 493762 - DNA, 16 bp, R. norvegicus
cctctgctcttcacca

SEQ ID NO: 493763 - DNA, 16 bp, R. norvegicus
cctctgctcttcagcc

SEQ ID NO: 493764 - DNA, 16 bp, R. norvegicus
cctctgctgtgtgtgt

SEQ ID NO: 493765 - DNA, 16 bp, R. norvegicus
cctctgcttccaagtg

SEQ ID NO: 493766 - DNA, 16 bp, R. norvegicus
cctctgcttctctgcc

SEQ ID NO: 493767 - DNA, 27 bp, R. norvegicus
cctctgctttaacactgtttccaaggc

SEQ ID NO: 493768 - DNA, 16 bp, R. norvegicus
cctctggaaagagcag

SEQ ID NO: 493769 - DNA, 16 bp, R. norvegicus
cctctggaacagcagt

SEQ ID NO: 493770 - DNA, 16 bp, R. norvegicus
cctctggaagagcaaa

SEQ ID NO: 493771 - DNA, 16 bp, R. norvegicus
cctctggaagagcagc

SEQ ID NO: 493772 - DNA, 19 bp, R. norvegicus
cctctggaagagcagtcag

SEQ ID NO: 493773 - DNA, 16 bp, R. norvegicus
cctctggaagagctct

SEQ ID NO: 493774 - DNA, 16 bp, R. norvegicus
cctctggaagagctgc

SEQ ID NO: 493775 - DNA, 16 bp, R. norvegicus
cctctggaagaggagc

SEQ ID NO: 493776 - DNA, 16 bp, R. norvegicus
cctctggaagaggagt

SEQ ID NO: 493777 - DNA, 16 bp, R. norvegicus
cctctggaagggtagc

SEQ ID NO: 493778 - DNA, 16 bp, R. norvegicus
cctctggagagcagtc

SEQ ID NO: 493779 - DNA, 16 bp, R. norvegicus
cctctggagcactggg

SEQ ID NO: 493780 - DNA, 16 bp, R. norvegicus
cctctggaggcagagg

SEQ ID NO: 493781 - DNA, 16 bp, R. norvegicus
cctctggagtgcccac

SEQ ID NO: 493782 - DNA, 16 bp, R. norvegicus
cctctggcaacataga

SEQ ID NO: 493783 - DNA, 16 bp, R. norvegicus
cctctggccatcagat

SEQ ID NO: 493784 - DNA, 16 bp, R. norvegicus
cctctggcctccaaag

SEQ ID NO: 493785 - DNA, 16 bp, R. norvegicus
cctctggcctcccagg

SEQ ID NO: 493786 - DNA, 16 bp, R. norvegicus
cctctggcctctacat

SEQ ID NO: 493787 - DNA, 16 bp, R. norvegicus
cctctggcctctgtgg

SEQ ID NO: 493788 - DNA, 16 bp, R. norvegicus
cctctggctccttcaa

SEQ ID NO: 493789 - DNA, 16 bp, R. norvegicus
cctctggctggcctgc

SEQ ID NO: 493790 - DNA, 16 bp, R. norvegicus
cctctggcttccatat

SEQ ID NO: 493791 - DNA, 16 bp, R. norvegicus
cctctggcttccatgg

SEQ ID NO: 493792 - DNA, 16 bp, R. norvegicus
cctctggcttcctcag

SEQ ID NO: 493793 - DNA, 16 bp, R. norvegicus
cctctggctttccagg

SEQ ID NO: 493794 - DNA, 16 bp, R. norvegicus
cctctgggaacagaaa

SEQ ID NO: 493795 - DNA, 16 bp, R. norvegicus
cctctgggagagcagc

SEQ ID NO: 493796 - DNA, 16 bp, R. norvegicus
cctctgggccatctct

SEQ ID NO: 493797 - DNA, 16 bp, R. norvegicus
cctctgggcctggctg

SEQ ID NO: 493798 - DNA, 16 bp, R. norvegicus
cctctgggctcccctg

SEQ ID NO: 493799 - DNA, 16 bp, R. norvegicus
cctctgggtcctggcc

SEQ ID NO: 493800 - DNA, 16 bp, R. norvegicus
cctctggtctccatct

SEQ ID NO: 493801 - DNA, 16 bp, R. norvegicus
cctctggttcctggtc

SEQ ID NO: 493802 - DNA, 16 bp, R. norvegicus
cctctggtttctgcct

SEQ ID NO: 493803 - DNA, 16 bp, R. norvegicus
cctctgtaaaagcaac

SEQ ID NO: 493804 - DNA, 16 bp, R. norvegicus
cctctgtatcccattt

SEQ ID NO: 493805 - DNA, 16 bp, R. norvegicus
cctctgtccccacctc

SEQ ID NO: 493806 - DNA, 16 bp, R. norvegicus
cctctgtctcagcctc

SEQ ID NO: 493807 - DNA, 16 bp, R. norvegicus
cctctgtctcccaagg

SEQ ID NO: 493808 - DNA, 16 bp, R. norvegicus
cctctgtctcctgagt

SEQ ID NO: 493809 - DNA, 16 bp, R. norvegicus
cctctgtctgccctgc

SEQ ID NO: 493810 - DNA, 16 bp, R. norvegicus
cctctgtgcaccaggg

SEQ ID NO: 493811 - DNA, 16 bp, R. norvegicus
cctctgtgcactttct

SEQ ID NO: 493812 - DNA, 16 bp, R. norvegicus
cctctgtgcttctctc

SEQ ID NO: 493813 - DNA, 16 bp, R. norvegicus
cctctgtgggcactga

SEQ ID NO: 493814 - DNA, 16 bp, R. norvegicus
cctctgtgggcactgt

SEQ ID NO: 493815 - DNA, 16 bp, R. norvegicus
cctctgtgtgtctctg

SEQ ID NO: 493816 - DNA, 16 bp, R. norvegicus
cctctgtgtttgccat

SEQ ID NO: 493817 - DNA, 33 bp, R. norvegicus
cctctgtgtttgctgtattctggctgtgtctct

SEQ ID NO: 493818 - DNA, 16 bp, R. norvegicus
cctctgttcaagggca

SEQ ID NO: 493819 - DNA, 16 bp, R. norvegicus
cctctgttgctggtgg

SEQ ID NO: 493820 - DNA, 16 bp, R. norvegicus
cctctgttgtatatgt

SEQ ID NO: 493821 - DNA, 16 bp, R. norvegicus
cctcttacctcagcct

SEQ ID NO: 493822 - DNA, 16 bp, R. norvegicus
cctcttacctctgcct

SEQ ID NO: 493823 - DNA, 16 bp, R. norvegicus
cctcttattgatgcca

SEQ ID NO: 493824 - DNA, 16 bp, R. norvegicus
cctcttcaagctcttc

SEQ ID NO: 493825 - DNA, 16 bp, R. norvegicus
cctcttcacctcctgc

SEQ ID NO: 493826 - DNA, 16 bp, R. norvegicus
cctcttccagcctctg

SEQ ID NO: 493827 - DNA, 16 bp, R. norvegicus
cctcttccaggcagct

SEQ ID NO: 493828 - DNA, 16 bp, R. norvegicus
cctcttccagtgtgtc

SEQ ID NO: 493829 - DNA, 16 bp, R. norvegicus
cctcttccctcagcct

SEQ ID NO: 493830 - DNA, 16 bp, R. norvegicus
cctcttcctaaaacag

SEQ ID NO: 493831 - DNA, 16 bp, R. norvegicus
cctcttcctcagcctc

SEQ ID NO: 493832 - DNA, 16 bp, R. norvegicus
cctcttcctcagcttc

SEQ ID NO: 493833 - DNA, 16 bp, R. norvegicus
cctcttcctcccaagt

SEQ ID NO: 493834 - DNA, 16 bp, R. norvegicus
cctcttcctcctggga

SEQ ID NO: 493835 - DNA, 16 bp, R. norvegicus
cctcttcctgctgcct

SEQ ID NO: 493836 - DNA, 16 bp, R. norvegicus
cctcttcctggatgag

SEQ ID NO: 493837 - DNA, 16 bp, R. norvegicus
cctcttccttcaaact

SEQ ID NO: 493838 - DNA, 16 bp, R. norvegicus
cctcttcctttacact

SEQ ID NO: 493839 - DNA, 16 bp, R. norvegicus
cctcttctcccagtcc

SEQ ID NO: 493840 - DNA, 16 bp, R. norvegicus
cctcttctcctctgaa

SEQ ID NO: 493841 - DNA, 16 bp, R. norvegicus
cctcttctgaccttca

SEQ ID NO: 493842 - DNA, 16 bp, R. norvegicus
cctcttctgccttctg

SEQ ID NO: 493843 - DNA, 16 bp, R. norvegicus
cctcttctggacttca

SEQ ID NO: 493844 - DNA, 16 bp, R. norvegicus
cctcttctggccccca

SEQ ID NO: 493845 - DNA, 16 bp, R. norvegicus
cctcttctggcctctg

SEQ ID NO: 493846 - DNA, 16 bp, R. norvegicus
cctcttctggccttgg

SEQ ID NO: 493847 - DNA, 16 bp, R. norvegicus
cctcttctggcctttg

SEQ ID NO: 493848 - DNA, 16 bp, R. norvegicus
cctcttctggctgctg

SEQ ID NO: 493849 - DNA, 16 bp, R. norvegicus
cctcttctggcttcct

SEQ ID NO: 493850 - DNA, 16 bp, R. norvegicus
cctcttctgtccttca

SEQ ID NO: 493851 - DNA, 16 bp, R. norvegicus
cctcttctgtgggatt

SEQ ID NO: 493852 - DNA, 16 bp, R. norvegicus
cctcttgagtcctggg

SEQ ID NO: 493853 - DNA, 16 bp, R. norvegicus
cctcttgagtttattt

SEQ ID NO: 493854 - DNA, 16 bp, R. norvegicus
cctcttgatctccttt

SEQ ID NO: 493855 - DNA, 16 bp, R. norvegicus
cctcttgcttctatga

SEQ ID NO: 493856 - DNA, 16 bp, R. norvegicus
cctcttggagatggag

SEQ ID NO: 493857 - DNA, 16 bp, R. norvegicus
cctcttgggacaggga

SEQ ID NO: 493858 - DNA, 16 bp, R. norvegicus
cctcttgggcccggga

SEQ ID NO: 493859 - DNA, 16 bp, R. norvegicus
cctcttggggttgggg

SEQ ID NO: 493860 - DNA, 16 bp, R. norvegicus
cctcttgtggcctctg

SEQ ID NO: 493861 - DNA, 16 bp, R. norvegicus
cctctttctggcctct

SEQ ID NO: 493862 - DNA, 16 bp, R. norvegicus
cctcttttcctcccag

SEQ ID NO: 493863 - DNA, 16 bp, R. norvegicus
cctgaaaatatcttca

SEQ ID NO: 493864 - DNA, 16 bp, R. norvegicus
cctgaaaatcaggaag

SEQ ID NO: 493865 - DNA, 21 bp, R. norvegicus
cctgaaagaatcgcaaaaatc

SEQ ID NO: 493866 - DNA, 16 bp, R. norvegicus
cctgaaaggaaaaaaa

SEQ ID NO: 493867 - DNA, 16 bp, R. norvegicus
cctgaacagaacacca

SEQ ID NO: 493868 - DNA, 16 bp, R. norvegicus
cctgaacagcacccca

SEQ ID NO: 493869 - DNA, 16 bp, R. norvegicus
cctgaacctgagggaa

SEQ ID NO: 493870 - DNA, 16 bp, R. norvegicus
cctgaactgaagcagt

SEQ ID NO: 493871 - DNA, 16 bp, R. norvegicus
cctgaagaaactgcaa

SEQ ID NO: 493872 - DNA, 16 bp, R. norvegicus
cctgaagaaatgttca

SEQ ID NO: 493873 - DNA, 16 bp, R. norvegicus
cctgaagacaccacag

SEQ ID NO: 493874 - DNA, 16 bp, R. norvegicus
cctgaagacagtgaca

SEQ ID NO: 493875 - DNA, 16 bp, R. norvegicus
cctgaagacccagctc

SEQ ID NO: 493876 - DNA, 16 bp, R. norvegicus
cctgaagaggacaggg

SEQ ID NO: 493877 - DNA, 16 bp, R. norvegicus
cctgaagatcctggac

SEQ ID NO: 493878 - DNA, 16 bp, R. norvegicus
cctgaagcccagagag

SEQ ID NO: 493879 - DNA, 16 bp, R. norvegicus
cctgaagctcaagaag

SEQ ID NO: 493880 - DNA, 16 bp, R. norvegicus
cctgaagctcacacag

SEQ ID NO: 493881 - DNA, 16 bp, R. norvegicus
cctgaaggaaacagac

SEQ ID NO: 493882 - DNA, 16 bp, R. norvegicus
cctgaaggaggaacat

SEQ ID NO: 493883 - DNA, 16 bp, R. norvegicus
cctgaagtccttttct

SEQ ID NO: 493884 - DNA, 16 bp, R. norvegicus
cctgaagtgaccacct

SEQ ID NO: 493885 - DNA, 16 bp, R. norvegicus
cctgaagttacagatg

SEQ ID NO: 493886 - DNA, 16 bp, R. norvegicus
cctgaagttgctcctg

SEQ ID NO: 493887 - DNA, 16 bp, R. norvegicus
cctgaatgtcctggaa

SEQ ID NO: 493888 - DNA, 16 bp, R. norvegicus
cctgaattccattccc

SEQ ID NO: 493889 - DNA, 16 bp, R. norvegicus
cctgaatttcctggat

SEQ ID NO: 493890 - DNA, 16 bp, R. norvegicus
cctgaatttgatcccc

SEQ ID NO: 493891 - DNA, 16 bp, R. norvegicus
cctgaatttggatccc

SEQ ID NO: 493892 - DNA, 16 bp, R. norvegicus
cctgacaacctgagtt

SEQ ID NO: 493893 - DNA, 16 bp, R. norvegicus
cctgacacacagtagg

SEQ ID NO: 493894 - DNA, 16 bp, R. norvegicus
cctgacactataaagg

SEQ ID NO: 493895 - DNA, 16 bp, R. norvegicus
cctgacactgttgctg

SEQ ID NO: 493896 - DNA, 16 bp, R. norvegicus
cctgacacttcaagtc

SEQ ID NO: 493897 - DNA, 16 bp, R. norvegicus
cctgacagcagaggta

SEQ ID NO: 493898 - DNA, 16 bp, R. norvegicus
cctgacattattattg

SEQ ID NO: 493899 - DNA, 16 bp, R. norvegicus
cctgaccaaattgacc

SEQ ID NO: 493900 - DNA, 16 bp, R. norvegicus
cctgaccacgccccca

SEQ ID NO: 493901 - DNA, 16 bp, R. norvegicus
cctgaccatccagcca

SEQ ID NO: 493902 - DNA, 16 bp, R. norvegicus
cctgaccatgttgttt

SEQ ID NO: 493903 - DNA, 16 bp, R. norvegicus
cctgacccctgacccc

SEQ ID NO: 493904 - DNA, 16 bp, R. norvegicus
cctgaccctgaaggaa

SEQ ID NO: 493905 - DNA, 16 bp, R. norvegicus
cctgaccctgaccctg

SEQ ID NO: 493906 - DNA, 16 bp, R. norvegicus
cctgaccctgcccaac

SEQ ID NO: 493907 - DNA, 16 bp, R. norvegicus
cctgacctacagagtg

SEQ ID NO: 493908 - DNA, 16 bp, R. norvegicus
cctgacctctggctct

SEQ ID NO: 493909 - DNA, 16 bp, R. norvegicus
cctgacctgcctgagt

SEQ ID NO: 493910 - DNA, 16 bp, R. norvegicus
cctgacctggagccac

SEQ ID NO: 493911 - DNA, 16 bp, R. norvegicus
cctgactatcctggaa

SEQ ID NO: 493912 - DNA, 16 bp, R. norvegicus
cctgactcccttcagt

SEQ ID NO: 493913 - DNA, 16 bp, R. norvegicus
cctgactcttcctcct

SEQ ID NO: 493914 - DNA, 16 bp, R. norvegicus
cctgactgcctctgcc

SEQ ID NO: 493915 - DNA, 16 bp, R. norvegicus
cctgactgcctgcctg

SEQ ID NO: 493916 - DNA, 16 bp, R. norvegicus
cctgactgctgagcca

SEQ ID NO: 493917 - DNA, 16 bp, R. norvegicus
cctgactgtcctggag

SEQ ID NO: 493918 - DNA, 16 bp, R. norvegicus
cctgactgtctgtctg

SEQ ID NO: 493919 - DNA, 16 bp, R. norvegicus
cctgacttgagcatct

SEQ ID NO: 493920 - DNA, 16 bp, R. norvegicus
cctgagaaaaacgaga

SEQ ID NO: 493921 - DNA, 16 bp, R. norvegicus
cctgagaaacaagctg

SEQ ID NO: 493922 - DNA, 16 bp, R. norvegicus
cctgagaaacacatcc

SEQ ID NO: 493923 - DNA, 16 bp, R. norvegicus
cctgagaaatacagag

SEQ ID NO: 493924 - DNA, 16 bp, R. norvegicus
cctgagacactgctgg

SEQ ID NO: 493925 - DNA, 16 bp, R. norvegicus
cctgagagaagcacag

SEQ ID NO: 493926 - DNA, 16 bp, R. norvegicus
cctgagagacacatca

SEQ ID NO: 493927 - DNA, 16 bp, R. norvegicus
cctgagagccagcaga

SEQ ID NO: 493928 - DNA, 16 bp, R. norvegicus
cctgagaggccctgcc

SEQ ID NO: 493929 - DNA, 16 bp, R. norvegicus
cctgagcatgctcagt

SEQ ID NO: 493930 - DNA, 16 bp, R. norvegicus
cctgagccatccctcc

SEQ ID NO: 493931 - DNA, 16 bp, R. norvegicus
cctgagccctgaggag

SEQ ID NO: 493932 - DNA, 16 bp, R. norvegicus
cctgagcctgagcctg

SEQ ID NO: 493933 - DNA, 16 bp, R. norvegicus
cctgagcctttctcag

SEQ ID NO: 493934 - DNA, 16 bp, R. norvegicus
cctgagctcaaatccc

SEQ ID NO: 493935 - DNA, 16 bp, R. norvegicus
cctgagctcagtcccc

SEQ ID NO: 493936 - DNA, 16 bp, R. norvegicus
cctgagctccacctga

SEQ ID NO: 493937 - DNA, 16 bp, R. norvegicus
cctgaggaaaaggaag

SEQ ID NO: 493938 - DNA, 16 bp, R. norvegicus
cctgaggaatgacacc

SEQ ID NO: 493939 - DNA, 16 bp, R. norvegicus
cctgaggaatgtcaca

SEQ ID NO: 493940 - DNA, 16 bp, R. norvegicus
cctgaggacccagcca

SEQ ID NO: 493941 - DNA, 16 bp, R. norvegicus
cctgaggagatggctc

SEQ ID NO: 493942 - DNA, 16 bp, R. norvegicus
cctgaggaggccagaa

SEQ ID NO: 493943 - DNA, 16 bp, R. norvegicus
cctgaggcacagccag

SEQ ID NO: 493944 - DNA, 16 bp, R. norvegicus
cctgaggcggtgggtg

SEQ ID NO: 493945 - DNA, 16 bp, R. norvegicus
cctgaggctgcagaga

SEQ ID NO: 493946 - DNA, 16 bp, R. norvegicus
cctgaggctgcagggc

SEQ ID NO: 493947 - DNA, 16 bp, R. norvegicus
cctgaggcttgctggc

SEQ ID NO: 493948 - DNA, 16 bp, R. norvegicus
cctgagggccagaaga

SEQ ID NO: 493949 - DNA, 16 bp, R. norvegicus
cctgaggggctggaga

SEQ ID NO: 493950 - DNA, 16 bp, R. norvegicus
cctgaggtaccagcca

SEQ ID NO: 493951 - DNA, 16 bp, R. norvegicus
cctgagtccagatccc

SEQ ID NO: 493952 - DNA, 16 bp, R. norvegicus
cctgagtcccaggatg

SEQ ID NO: 493953 - DNA, 16 bp, R. norvegicus
cctgagtcctgagtac

SEQ ID NO: 493954 - DNA, 16 bp, R. norvegicus
cctgagtctgaggaag

SEQ ID NO: 493955 - DNA, 16 bp, R. norvegicus
cctgagtgaggtcacc

SEQ ID NO: 493956 - DNA, 16 bp, R. norvegicus
cctgagtgccagcaga

SEQ ID NO: 493957 - DNA, 16 bp, R. norvegicus
cctgagtgctggcatc

SEQ ID NO: 493958 - DNA, 16 bp, R. norvegicus
cctgagtgctgggaac

SEQ ID NO: 493959 - DNA, 16 bp, R. norvegicus
cctgagtgctgtgact

SEQ ID NO: 493960 - DNA, 16 bp, R. norvegicus
cctgagttcaatatcc

SEQ ID NO: 493961 - DNA, 16 bp, R. norvegicus
cctgagttcagttcct

SEQ ID NO: 493962 - DNA, 16 bp, R. norvegicus
cctgagttcagttctc

SEQ ID NO: 493963 - DNA, 16 bp, R. norvegicus
cctgagttcatctctc

SEQ ID NO: 493964 - DNA, 16 bp, R. norvegicus
cctgagtttgacccct

SEQ ID NO: 493965 - DNA, 16 bp, R. norvegicus
cctgagtttgaggcca

SEQ ID NO: 493966 - DNA, 32 bp, R. norvegicus
cctgagtttttgatcttagccattctcactgt

SEQ ID NO: 493967 - DNA, 16 bp, R. norvegicus
cctgataccttcagta

SEQ ID NO: 493968 - DNA, 16 bp, R. norvegicus
cctgatagcctgagtt

SEQ ID NO: 493969 - DNA, 16 bp, R. norvegicus
cctgatcctcctgcct

SEQ ID NO: 493970 - DNA, 16 bp, R. norvegicus
cctgatccttctacct

SEQ ID NO: 493971 - DNA, 16 bp, R. norvegicus
cctgatctggcctcag

SEQ ID NO: 493972 - DNA, 16 bp, R. norvegicus
cctgatcttccttcct

SEQ ID NO: 493973 - DNA, 16 bp, R. norvegicus
cctgatgctgggagat

SEQ ID NO: 493974 - DNA, 16 bp, R. norvegicus
cctgatggcaagagga

SEQ ID NO: 493975 - DNA, 16 bp, R. norvegicus
cctgatggccagaggc

SEQ ID NO: 493976 - DNA, 16 bp, R. norvegicus
cctgatggtaccttct

SEQ ID NO: 493977 - DNA, 16 bp, R. norvegicus
cctgatgtgggtgctg

SEQ ID NO: 493978 - DNA, 16 bp, R. norvegicus
cctgattttagtggta

SEQ ID NO: 493979 - DNA, 16 bp, R. norvegicus
cctgcaaggtggtctg

SEQ ID NO: 493980 - DNA, 16 bp, R. norvegicus
cctgcaattccagcac

SEQ ID NO: 493981 - DNA, 16 bp, R. norvegicus
cctgcacaaaatcaag

SEQ ID NO: 493982 - DNA, 16 bp, R. norvegicus
cctgcaccaagagctg

SEQ ID NO: 493983 - DNA, 16 bp, R. norvegicus
cctgcaccaccaccac

SEQ ID NO: 493984 - DNA, 16 bp, R. norvegicus
cctgcaccaggcctgc

SEQ ID NO: 493985 - DNA, 16 bp, R. norvegicus
cctgcaccatgcctcc

SEQ ID NO: 493986 - DNA, 16 bp, R. norvegicus
cctgcaccatgcctgc

SEQ ID NO: 493987 - DNA, 16 bp, R. norvegicus
cctgcaccctgcaccc

SEQ ID NO: 493988 - DNA, 16 bp, R. norvegicus
cctgcacctcagtgca

SEQ ID NO: 493989 - DNA, 16 bp, R. norvegicus
cctgcacctgggcaca

SEQ ID NO: 493990 - DNA, 16 bp, R. norvegicus
cctgcactcacacaca

SEQ ID NO: 493991 - DNA, 16 bp, R. norvegicus
cctgcactcaggagac

SEQ ID NO: 493992 - DNA, 16 bp, R. norvegicus
cctgcactgcaccatc

SEQ ID NO: 493993 - DNA, 16 bp, R. norvegicus
cctgcactgtgcctgc

SEQ ID NO: 493994 - DNA, 16 bp, R. norvegicus
cctgcagaagttcttt

SEQ ID NO: 493995 - DNA, 16 bp, R. norvegicus
cctgcagacatacatg

SEQ ID NO: 493996 - DNA, 16 bp, R. norvegicus
cctgcagagcccagaa

SEQ ID NO: 493997 - DNA, 16 bp, R. norvegicus
cctgcagagctcccag

SEQ ID NO: 493998 - DNA, 16 bp, R. norvegicus
cctgcagcagagacca

SEQ ID NO: 493999 - DNA, 16 bp, R. norvegicus
cctgcagcagctcttt

SEQ ID NO: 494000 - DNA, 16 bp, R. norvegicus
cctgcagcaggagcca

SEQ ID NO: 494001 - DNA, 16 bp, R. norvegicus
cctgcagcctgcagcc

SEQ ID NO: 494002 - DNA, 16 bp, R. norvegicus
cctgcagctccagctc

SEQ ID NO: 494003 - DNA, 16 bp, R. norvegicus
cctgcagctccttcag

SEQ ID NO: 494004 - DNA, 16 bp, R. norvegicus
cctgcagctctgacag

SEQ ID NO: 494005 - DNA, 17 bp, R. norvegicus
cctgcagctgcccaagt

SEQ ID NO: 494006 - DNA, 17 bp, R. norvegicus
cctgcaggaaatggaca

SEQ ID NO: 494007 - DNA, 16 bp, R. norvegicus
cctgcaggcagctcag

SEQ ID NO: 494008 - DNA, 16 bp, R. norvegicus
cctgcaggttgtcctc

SEQ ID NO: 494009 - DNA, 16 bp, R. norvegicus
cctgcagtagatggga

SEQ ID NO: 494010 - DNA, 16 bp, R. norvegicus
cctgcagtcctctgct

SEQ ID NO: 494011 - DNA, 16 bp, R. norvegicus
cctgcagtctaacatc

SEQ ID NO: 494012 - DNA, 16 bp, R. norvegicus
cctgcagtctaatttc

SEQ ID NO: 494013 - DNA, 16 bp, R. norvegicus
cctgcagttgaaccag

SEQ ID NO: 494014 - DNA, 16 bp, R. norvegicus
cctgcatcccacagcc

SEQ ID NO: 494015 - DNA, 16 bp, R. norvegicus
cctgcatccctgcctc

SEQ ID NO: 494016 - DNA, 16 bp, R. norvegicus
cctgcatgccaccatg

SEQ ID NO: 494017 - DNA, 16 bp, R. norvegicus
cctgcatgcctcagag

SEQ ID NO: 494018 - DNA, 16 bp, R. norvegicus
cctgcatgcctgcatg

SEQ ID NO: 494019 - DNA, 16 bp, R. norvegicus
cctgcatgggatacga

SEQ ID NO: 494020 - DNA, 16 bp, R. norvegicus
cctgcattcttctgcc

SEQ ID NO: 494021 - DNA, 16 bp, R. norvegicus
cctgccaaggagagca

SEQ ID NO: 494022 - DNA, 16 bp, R. norvegicus
cctgccaatccatgat

SEQ ID NO: 494023 - DNA, 16 bp, R. norvegicus
cctgccagccagccag

SEQ ID NO: 494024 - DNA, 16 bp, R. norvegicus
cctgccagccagtcca

SEQ ID NO: 494025 - DNA, 16 bp, R. norvegicus
cctgccaggtggccca

SEQ ID NO: 494026 - DNA, 16 bp, R. norvegicus
cctgcccacagagagc

SEQ ID NO: 494027 - DNA, 16 bp, R. norvegicus
cctgcccacagctccc

SEQ ID NO: 494028 - DNA, 16 bp, R. norvegicus
cctgcccacatccccg

SEQ ID NO: 494029 - DNA, 16 bp, R. norvegicus
cctgcccaccctgaca

SEQ ID NO: 494030 - DNA, 16 bp, R. norvegicus
cctgcccacctccctg

SEQ ID NO: 494031 - DNA, 16 bp, R. norvegicus
cctgcccacctgcctg

SEQ ID NO: 494032 - DNA, 16 bp, R. norvegicus
cctgcccagagatggc

SEQ ID NO: 494033 - DNA, 16 bp, R. norvegicus
cctgccccacatgtgg

SEQ ID NO: 494034 - DNA, 16 bp, R. norvegicus
cctgccccacctgtgg

SEQ ID NO: 494035 - DNA, 16 bp, R. norvegicus
cctgccccactgctcc

SEQ ID NO: 494036 - DNA, 16 bp, R. norvegicus
cctgccccacttcctg

SEQ ID NO: 494037 - DNA, 16 bp, R. norvegicus
cctgccccatatgtgg

SEQ ID NO: 494038 - DNA, 16 bp, R. norvegicus
cctgccccatcctcct

SEQ ID NO: 494039 - DNA, 16 bp, R. norvegicus
cctgcccccaacaatc

SEQ ID NO: 494040 - DNA, 16 bp, R. norvegicus
cctgcccccacccagt

SEQ ID NO: 494041 - DNA, 16 bp, R. norvegicus
cctgccccccaaaaaa

SEQ ID NO: 494042 - DNA, 16 bp, R. norvegicus
cctgcccctcacctgt

SEQ ID NO: 494043 - DNA, 16 bp, R. norvegicus
cctgcccctgctcctg

SEQ ID NO: 494044 - DNA, 16 bp, R. norvegicus
cctgcccctgtccctg

SEQ ID NO: 494045 - DNA, 16 bp, R. norvegicus
cctgcccctgtctcca

SEQ ID NO: 494046 - DNA, 16 bp, R. norvegicus
cctgcccgcctgcctg

SEQ ID NO: 494047 - DNA, 16 bp, R. norvegicus
cctgccctcacctgta

SEQ ID NO: 494048 - DNA, 16 bp, R. norvegicus
cctgccctgaagtctc

SEQ ID NO: 494049 - DNA, 16 bp, R. norvegicus
cctgccctgcagtctc

SEQ ID NO: 494050 - DNA, 16 bp, R. norvegicus
cctgccctgcccagcc

SEQ ID NO: 494051 - DNA, 16 bp, R. norvegicus
cctgccctgccctgct

SEQ ID NO: 494052 - DNA, 16 bp, R. norvegicus
cctgccctgccctgtg

SEQ ID NO: 494053 - DNA, 16 bp, R. norvegicus
cctgccctggcatccc

SEQ ID NO: 494054 - DNA, 16 bp, R. norvegicus
cctgccctggcttctc

SEQ ID NO: 494055 - DNA, 16 bp, R. norvegicus
cctgccctgtctgagt

SEQ ID NO: 494056 - DNA, 16 bp, R. norvegicus
cctgccctgtgtccca

SEQ ID NO: 494057 - DNA, 17 bp, R. norvegicus
cctgccgctcctggacc

SEQ ID NO: 494058 - DNA, 16 bp, R. norvegicus
cctgcctagctacagg

SEQ ID NO: 494059 - DNA, 16 bp, R. norvegicus
cctgcctcaaaaccaa

SEQ ID NO: 494060 - DNA, 16 bp, R. norvegicus
cctgcctcaaccttcc

SEQ ID NO: 494061 - DNA, 16 bp, R. norvegicus
cctgcctcaagctcct

SEQ ID NO: 494062 - DNA, 16 bp, R. norvegicus
cctgcctcaccatcct

SEQ ID NO: 494063 - DNA, 16 bp, R. norvegicus
cctgcctcagactccc

SEQ ID NO: 494064 - DNA, 16 bp, R. norvegicus
cctgcctcagactcct

SEQ ID NO: 494065 - DNA, 16 bp, R. norvegicus
cctgcctcagactctc

SEQ ID NO: 494066 - DNA, 16 bp, R. norvegicus
cctgcctcagactctg

SEQ ID NO: 494067 - DNA, 16 bp, R. norvegicus
cctgcctcagcatctc

SEQ ID NO: 494068 - DNA, 16 bp, R. norvegicus
cctgcctcagcctcag

SEQ ID NO: 494069 - DNA, 16 bp, R. norvegicus
cctgcctcagcctgag

SEQ ID NO: 494070 - DNA, 16 bp, R. norvegicus
cctgcctcagcctgct

SEQ ID NO: 494071 - DNA, 16 bp, R. norvegicus
cctgcctcagctgccc

SEQ ID NO: 494072 - DNA, 16 bp, R. norvegicus
cctgcctcagcttctc

SEQ ID NO: 494073 - DNA, 16 bp, R. norvegicus
cctgcctcagtctacc

SEQ ID NO: 494074 - DNA, 16 bp, R. norvegicus
cctgcctcagtctccc

SEQ ID NO: 494075 - DNA, 16 bp, R. norvegicus
cctgcctcagtctcct

SEQ ID NO: 494076 - DNA, 16 bp, R. norvegicus
cctgcctcagtctctg

SEQ ID NO: 494077 - DNA, 16 bp, R. norvegicus
cctgcctcagtgtccc

SEQ ID NO: 494078 - DNA, 16 bp, R. norvegicus
cctgcctcagtttccc

SEQ ID NO: 494079 - DNA, 16 bp, R. norvegicus
cctgcctcagtttcct

SEQ ID NO: 494080 - DNA, 16 bp, R. norvegicus
cctgcctccacatccc

SEQ ID NO: 494081 - DNA, 16 bp, R. norvegicus
cctgcctccacctctg

SEQ ID NO: 494082 - DNA, 16 bp, R. norvegicus
cctgcctccaccttcc

SEQ ID NO: 494083 - DNA, 16 bp, R. norvegicus
cctgcctccagtttcc

SEQ ID NO: 494084 - DNA, 16 bp, R. norvegicus
cctgcctccatttccc

SEQ ID NO: 494085 - DNA, 16 bp, R. norvegicus
cctgcctcctgccatg

SEQ ID NO: 494086 - DNA, 16 bp, R. norvegicus
cctgcctcggtctcct

SEQ ID NO: 494087 - DNA, 16 bp, R. norvegicus
cctgcctctacatccc

SEQ ID NO: 494088 - DNA, 16 bp, R. norvegicus
cctgcctctacctccc

SEQ ID NO: 494089 - DNA, 16 bp, R. norvegicus
cctgcctctactcccc

SEQ ID NO: 494090 - DNA, 16 bp, R. norvegicus
cctgcctctctctacc

SEQ ID NO: 494091 - DNA, 16 bp, R. norvegicus
cctgcctctgactccc

SEQ ID NO: 494092 - DNA, 16 bp, R. norvegicus
cctgcctctgcatccc

SEQ ID NO: 494093 - DNA, 16 bp, R. norvegicus
cctgcctctgccaccc

SEQ ID NO: 494094 - DNA, 16 bp, R. norvegicus
cctgcctctgcctctg

SEQ ID NO: 494095 - DNA, 16 bp, R. norvegicus
cctgcctctgcctgcc

SEQ ID NO: 494096 - DNA, 16 bp, R. norvegicus
cctgcctctgctaccc

SEQ ID NO: 494097 - DNA, 16 bp, R. norvegicus
cctgcctctgctcctg

SEQ ID NO: 494098 - DNA, 16 bp, R. norvegicus
cctgcctctgcttctg

SEQ ID NO: 494099 - DNA, 16 bp, R. norvegicus
cctgcctctgcttctt

SEQ ID NO: 494100 - DNA, 16 bp, R. norvegicus
cctgcctctgctttcc

SEQ ID NO: 494101 - DNA, 16 bp, R. norvegicus
cctgcctctggctctg

SEQ ID NO: 494102 - DNA, 16 bp, R. norvegicus
cctgcctctgggatta

SEQ ID NO: 494103 - DNA, 16 bp, R. norvegicus
cctgcctcttcctcca

SEQ ID NO: 494104 - DNA, 16 bp, R. norvegicus
cctgcctgagttcctg

SEQ ID NO: 494105 - DNA, 16 bp, R. norvegicus
cctgcctgatgccatg

SEQ ID NO: 494106 - DNA, 16 bp, R. norvegicus
cctgcctgatggactc

SEQ ID NO: 494107 - DNA, 16 bp, R. norvegicus
cctgcctgccctgtgt

SEQ ID NO: 494108 - DNA, 16 bp, R. norvegicus
cctgcctgcctacctg

SEQ ID NO: 494109 - DNA, 16 bp, R. norvegicus
cctgcctgcctcctga

SEQ ID NO: 494110 - DNA, 16 bp, R. norvegicus
cctgcctgcctcctgg

SEQ ID NO: 494111 - DNA, 16 bp, R. norvegicus
cctgcctgcctgccag

SEQ ID NO: 494112 - DNA, 16 bp, R. norvegicus
cctgcctgcctgccta

SEQ ID NO: 494113 - DNA, 16 bp, R. norvegicus
cctgcctgcctgcctc

SEQ ID NO: 494114 - DNA, 16 bp, R. norvegicus
cctgcctgcctgctcc

SEQ ID NO: 494115 - DNA, 16 bp, R. norvegicus
cctgcctgcctgtctc

SEQ ID NO: 494116 - DNA, 16 bp, R. norvegicus
cctgcctgctaccaca

SEQ ID NO: 494117 - DNA, 16 bp, R. norvegicus
cctgcctgctgagctg

SEQ ID NO: 494118 - DNA, 16 bp, R. norvegicus
cctgcctgctgccatg

SEQ ID NO: 494119 - DNA, 16 bp, R. norvegicus
cctgcctgctgcctct

SEQ ID NO: 494120 - DNA, 16 bp, R. norvegicus
cctgcctgctgccttc

SEQ ID NO: 494121 - DNA, 16 bp, R. norvegicus
cctgcctgctgtctgc

SEQ ID NO: 494122 - DNA, 16 bp, R. norvegicus
cctgcctgcttcctgc

SEQ ID NO: 494123 - DNA, 16 bp, R. norvegicus
cctgcctgcttctgct

SEQ ID NO: 494124 - DNA, 16 bp, R. norvegicus
cctgcctggacactgc

SEQ ID NO: 494125 - DNA, 17 bp, R. norvegicus
cctgcctggacagtgtt

SEQ ID NO: 494126 - DNA, 16 bp, R. norvegicus
cctgcctggactctgc

SEQ ID NO: 494127 - DNA, 16 bp, R. norvegicus
cctgcctggatgctgt

SEQ ID NO: 494128 - DNA, 16 bp, R. norvegicus
cctgcctgtctcagta

SEQ ID NO: 494129 - DNA, 16 bp, R. norvegicus
cctgcctgtctctgct

SEQ ID NO: 494130 - DNA, 16 bp, R. norvegicus
cctgcctgtctctgtc

SEQ ID NO: 494131 - DNA, 16 bp, R. norvegicus
cctgcctgtctgtctg

SEQ ID NO: 494132 - DNA, 16 bp, R. norvegicus
cctgcctgtgccttcc

SEQ ID NO: 494133 - DNA, 16 bp, R. norvegicus
cctgcctgtgcttcct

SEQ ID NO: 494134 - DNA, 16 bp, R. norvegicus
cctgcctgtgtctccc

SEQ ID NO: 494135 - DNA, 16 bp, R. norvegicus
cctgcctgtgtctgta

SEQ ID NO: 494136 - DNA, 16 bp, R. norvegicus
cctgccttaaaaacaa

SEQ ID NO: 494137 - DNA, 16 bp, R. norvegicus
cctgccttcccaccct

SEQ ID NO: 494138 - DNA, 16 bp, R. norvegicus
cctgccttccccacca

SEQ ID NO: 494139 - DNA, 16 bp, R. norvegicus
cctgccttctacttct

SEQ ID NO: 494140 - DNA, 16 bp, R. norvegicus
cctgccttctgctcct

SEQ ID NO: 494141 - DNA, 16 bp, R. norvegicus
cctgccttctgttcct

SEQ ID NO: 494142 - DNA, 16 bp, R. norvegicus
cctgccttggcctcct

SEQ ID NO: 494143 - DNA, 16 bp, R. norvegicus
cctgcctttctgcctg

SEQ ID NO: 494144 - DNA, 16 bp, R. norvegicus
cctgcctttggatctc

SEQ ID NO: 494145 - DNA, 16 bp, R. norvegicus
cctgcgatcccagcac

SEQ ID NO: 494146 - DNA, 19 bp, R. norvegicus
cctgcgccacccagagaag

SEQ ID NO: 494147 - DNA, 16 bp, R. norvegicus
cctgcgctccagacac

SEQ ID NO: 494148 - DNA, 16 bp, R. norvegicus
cctgctaccatgcctt

SEQ ID NO: 494149 - DNA, 16 bp, R. norvegicus
cctgctagcagccttc

SEQ ID NO: 494150 - DNA, 16 bp, R. norvegicus
cctgctcacacccctg

SEQ ID NO: 494151 - DNA, 16 bp, R. norvegicus
cctgctccaagcaacc

SEQ ID NO: 494152 - DNA, 16 bp, R. norvegicus
cctgctccacactttg

SEQ ID NO: 494153 - DNA, 16 bp, R. norvegicus
cctgctccagcaccat

SEQ ID NO: 494154 - DNA, 16 bp, R. norvegicus
cctgctcccagagctg

SEQ ID NO: 494155 - DNA, 16 bp, R. norvegicus
cctgctcctcctgctg

SEQ ID NO: 494156 - DNA, 16 bp, R. norvegicus
cctgctcctcttcctg

SEQ ID NO: 494157 - DNA, 16 bp, R. norvegicus
cctgctcctgccacca

SEQ ID NO: 494158 - DNA, 16 bp, R. norvegicus
cctgctcctgctgcca

SEQ ID NO: 494159 - DNA, 16 bp, R. norvegicus
cctgctcctgttcctg

SEQ ID NO: 494160 - DNA, 16 bp, R. norvegicus
cctgctctacacagtg

SEQ ID NO: 494161 - DNA, 16 bp, R. norvegicus
cctgctctacccaacc

SEQ ID NO: 494162 - DNA, 16 bp, R. norvegicus
cctgctctactctttg

SEQ ID NO: 494163 - DNA, 16 bp, R. norvegicus
cctgctctcagtgctc

SEQ ID NO: 494164 - DNA, 16 bp, R. norvegicus
cctgctctcctgctct

SEQ ID NO: 494165 - DNA, 16 bp, R. norvegicus
cctgctctgacttccc

SEQ ID NO: 494166 - DNA, 16 bp, R. norvegicus
cctgctctgatttccc

SEQ ID NO: 494167 - DNA, 16 bp, R. norvegicus
cctgctctgccttttc

SEQ ID NO: 494168 - DNA, 16 bp, R. norvegicus
cctgctctggcttccc

SEQ ID NO: 494169 - DNA, 16 bp, R. norvegicus
cctgctcttcctcctg

SEQ ID NO: 494170 - DNA, 16 bp, R. norvegicus
cctgctgaattcacca

SEQ ID NO: 494171 - DNA, 16 bp, R. norvegicus
cctgctgactttgggg

SEQ ID NO: 494172 - DNA, 16 bp, R. norvegicus
cctgctgagccagctc

SEQ ID NO: 494173 - DNA, 16 bp, R. norvegicus
cctgctgagccctgct

SEQ ID NO: 494174 - DNA, 16 bp, R. norvegicus
cctgctgagggtgtgg

SEQ ID NO: 494175 - DNA, 16 bp, R. norvegicus
cctgctgatccatgag

SEQ ID NO: 494176 - DNA, 16 bp, R. norvegicus
cctgctgcagcctccc

SEQ ID NO: 494177 - DNA, 16 bp, R. norvegicus
cctgctgccaggcctg

SEQ ID NO: 494178 - DNA, 16 bp, R. norvegicus
cctgctgccatgactt

SEQ ID NO: 494179 - DNA, 16 bp, R. norvegicus
cctgctgccatgctcc

SEQ ID NO: 494180 - DNA, 16 bp, R. norvegicus
cctgctgcccctgctg

SEQ ID NO: 494181 - DNA, 16 bp, R. norvegicus
cctgctgcctacagat

SEQ ID NO: 494182 - DNA, 16 bp, R. norvegicus
cctgctgcctgcctgc

SEQ ID NO: 494183 - DNA, 16 bp, R. norvegicus
cctgctgctcctctgt

SEQ ID NO: 494184 - DNA, 16 bp, R. norvegicus
cctgctgctcctgcag

SEQ ID NO: 494185 - DNA, 18 bp, R. norvegicus
cctgctgctcctgctcct

SEQ ID NO: 494186 - DNA, 16 bp, R. norvegicus
cctgctgctcctgctg

SEQ ID NO: 494187 - DNA, 16 bp, R. norvegicus
cctgctgctcctggac

SEQ ID NO: 494188 - DNA, 16 bp, R. norvegicus
cctgctgctcctgtgc

SEQ ID NO: 494189 - DNA, 16 bp, R. norvegicus
cctgctgctgcctccc

SEQ ID NO: 494190 - DNA, 16 bp, R. norvegicus
cctgctgctgcctttg

SEQ ID NO: 494191 - DNA, 16 bp, R. norvegicus
cctgctgctgctcctg

SEQ ID NO: 494192 - DNA, 17 bp, R. norvegicus
cctgctgctgctgccca

SEQ ID NO: 494193 - DNA, 16 bp, R. norvegicus
cctgctgctgctgcct

SEQ ID NO: 494194 - DNA, 17 bp, R. norvegicus
cctgctgctgctgctcc

SEQ ID NO: 494195 - DNA, 17 bp, R. norvegicus
cctgctgctgttgctgc

SEQ ID NO: 494196 - DNA, 16 bp, R. norvegicus
cctgctgcttctatga

SEQ ID NO: 494197 - DNA, 16 bp, R. norvegicus
cctgctgcttctgcct

SEQ ID NO: 494198 - DNA, 16 bp, R. norvegicus
cctgctggagatgggc

SEQ ID NO: 494199 - DNA, 16 bp, R. norvegicus
cctgctgggagagagc

SEQ ID NO: 494200 - DNA, 16 bp, R. norvegicus
cctgctgtcctgctgt

SEQ ID NO: 494201 - DNA, 16 bp, R. norvegicus
cctgctgtccttcctg

SEQ ID NO: 494202 - DNA, 16 bp, R. norvegicus
cctgctgtctctgcct

SEQ ID NO: 494203 - DNA, 16 bp, R. norvegicus
cctgctgtggtggtgg

SEQ ID NO: 494204 - DNA, 16 bp, R. norvegicus
cctgctgttgctgaca

SEQ ID NO: 494205 - DNA, 16 bp, R. norvegicus
cctgcttcacagaaaa

SEQ ID NO: 494206 - DNA, 19 bp, R. norvegicus
cctgcttcaccaccttctt

SEQ ID NO: 494207 - DNA, 16 bp, R. norvegicus
cctgcttcagcctcca

SEQ ID NO: 494208 - DNA, 16 bp, R. norvegicus
cctgcttcagtttccc

SEQ ID NO: 494209 - DNA, 16 bp, R. norvegicus
cctgcttccatgaggg

SEQ ID NO: 494210 - DNA, 16 bp, R. norvegicus
cctgcttcctcttgct

SEQ ID NO: 494211 - DNA, 16 bp, R. norvegicus
cctgcttctacctcct

SEQ ID NO: 494212 - DNA, 16 bp, R. norvegicus
cctgcttctaccttct

SEQ ID NO: 494213 - DNA, 16 bp, R. norvegicus
cctgcttctctgcctc

SEQ ID NO: 494214 - DNA, 16 bp, R. norvegicus
cctgcttctgcctcct

SEQ ID NO: 494215 - DNA, 16 bp, R. norvegicus
cctgcttctgcctgct

SEQ ID NO: 494216 - DNA, 16 bp, R. norvegicus
cctgcttctgctttct

SEQ ID NO: 494217 - DNA, 16 bp, R. norvegicus
cctgcttgccttcact

SEQ ID NO: 494218 - DNA, 16 bp, R. norvegicus
cctgcttgcttcttgg

SEQ ID NO: 494219 - DNA, 16 bp, R. norvegicus
cctgctttctgacctg

SEQ ID NO: 494220 - DNA, 16 bp, R. norvegicus
cctgctttcttgtaca

SEQ ID NO: 494221 - DNA, 16 bp, R. norvegicus
cctgctttgacttcct

SEQ ID NO: 494222 - DNA, 16 bp, R. norvegicus
cctgctttgagctcct

SEQ ID NO: 494223 - DNA, 16 bp, R. norvegicus
cctgcttttactcttc

SEQ ID NO: 494224 - DNA, 16 bp, R. norvegicus
cctggaaactctagtt

SEQ ID NO: 494225 - DNA, 16 bp, R. norvegicus
cctggaaactgggaag

SEQ ID NO: 494226 - DNA, 16 bp, R. norvegicus
cctggaacaggagaag

SEQ ID NO: 494227 - DNA, 16 bp, R. norvegicus
cctggaacccactgtg

SEQ ID NO: 494228 - DNA, 16 bp, R. norvegicus
cctggaactaactcac

SEQ ID NO: 494229 - DNA, 16 bp, R. norvegicus
cctggaactcaactct

SEQ ID NO: 494230 - DNA, 16 bp, R. norvegicus
cctggaactcactgta

SEQ ID NO: 494231 - DNA, 16 bp, R. norvegicus
cctggaactcagagac

SEQ ID NO: 494232 - DNA, 16 bp, R. norvegicus
cctggaactcattggc

SEQ ID NO: 494233 - DNA, 16 bp, R. norvegicus
cctggaactgaccctg

SEQ ID NO: 494234 - DNA, 16 bp, R. norvegicus
cctggaactggagtta

SEQ ID NO: 494235 - DNA, 16 bp, R. norvegicus
cctggaactggctgtg

SEQ ID NO: 494236 - DNA, 16 bp, R. norvegicus
cctggaacttgctatg

SEQ ID NO: 494237 - DNA, 16 bp, R. norvegicus
cctggaagagcagtca

SEQ ID NO: 494238 - DNA, 16 bp, R. norvegicus
cctggaagcaggagct

SEQ ID NO: 494239 - DNA, 16 bp, R. norvegicus
cctggaagccaggaaa

SEQ ID NO: 494240 - DNA, 16 bp, R. norvegicus
cctggaagctctgctt

SEQ ID NO: 494241 - DNA, 16 bp, R. norvegicus
cctggaagctctggag

SEQ ID NO: 494242 - DNA, 16 bp, R. norvegicus
cctggaaggacaaaag

SEQ ID NO: 494243 - DNA, 16 bp, R. norvegicus
cctggaaggaccagaa

SEQ ID NO: 494244 - DNA, 16 bp, R. norvegicus
cctggaaggcagagac

SEQ ID NO: 494245 - DNA, 16 bp, R. norvegicus
cctggaagtgaactga

SEQ ID NO: 494246 - DNA, 16 bp, R. norvegicus
cctggaattcttgcag

SEQ ID NO: 494247 - DNA, 16 bp, R. norvegicus
cctggaattctttgag

SEQ ID NO: 494248 - DNA, 16 bp, R. norvegicus
cctggaattggagttg

SEQ ID NO: 494249 - DNA, 16 bp, R. norvegicus
cctggacagaagtcat

SEQ ID NO: 494250 - DNA, 16 bp, R. norvegicus
cctggacagatgttct

SEQ ID NO: 494251 - DNA, 16 bp, R. norvegicus
cctggacagccaggac

SEQ ID NO: 494252 - DNA, 16 bp, R. norvegicus
cctggaccactgagat

SEQ ID NO: 494253 - DNA, 16 bp, R. norvegicus
cctggaccccaagatc

SEQ ID NO: 494254 - DNA, 16 bp, R. norvegicus
cctggacctcacagag

SEQ ID NO: 494255 - DNA, 16 bp, R. norvegicus
cctggactacacagtg

SEQ ID NO: 494256 - DNA, 16 bp, R. norvegicus
cctggactacagagca

SEQ ID NO: 494257 - DNA, 16 bp, R. norvegicus
cctggactacatgaaa

SEQ ID NO: 494258 - DNA, 16 bp, R. norvegicus
cctggactacatgaga

SEQ ID NO: 494259 - DNA, 16 bp, R. norvegicus
cctggactacatggtg

SEQ ID NO: 494260 - DNA, 16 bp, R. norvegicus
cctggactccaacctc

SEQ ID NO: 494261 - DNA, 16 bp, R. norvegicus
cctggactctcagaag

SEQ ID NO: 494262 - DNA, 16 bp, R. norvegicus
cctggactctgacatc

SEQ ID NO: 494263 - DNA, 16 bp, R. norvegicus
cctggactctgacttc

SEQ ID NO: 494264 - DNA, 16 bp, R. norvegicus
cctggactctgagctc

SEQ ID NO: 494265 - DNA, 16 bp, R. norvegicus
cctggactctgccctc

SEQ ID NO: 494266 - DNA, 16 bp, R. norvegicus
cctggactggtggtct

SEQ ID NO: 494267 - DNA, 16 bp, R. norvegicus
cctggacttcctggat

SEQ ID NO: 494268 - DNA, 16 bp, R. norvegicus
cctggacttcctgtat

SEQ ID NO: 494269 - DNA, 16 bp, R. norvegicus
cctggagaaagaaaca

SEQ ID NO: 494270 - DNA, 16 bp, R. norvegicus
cctggagaacagcttc

SEQ ID NO: 494271 - DNA, 20 bp, R. norvegicus
cctggagaactcaggacaca

SEQ ID NO: 494272 - DNA, 16 bp, R. norvegicus
cctggagaagactgga

SEQ ID NO: 494273 - DNA, 16 bp, R. norvegicus
cctggagaaggagctg

SEQ ID NO: 494274 - DNA, 16 bp, R. norvegicus
cctggagacactggtc

SEQ ID NO: 494275 - DNA, 16 bp, R. norvegicus
cctggagaccagaaga

SEQ ID NO: 494276 - DNA, 16 bp, R. norvegicus
cctggagacttgggta

SEQ ID NO: 494277 - DNA, 16 bp, R. norvegicus
cctggagagctgctgg

SEQ ID NO: 494278 - DNA, 16 bp, R. norvegicus
cctggagatagaaaag

SEQ ID NO: 494279 - DNA, 16 bp, R. norvegicus
cctggagatgccccca

SEQ ID NO: 494280 - DNA, 16 bp, R. norvegicus
cctggagattgaactc

SEQ ID NO: 494281 - DNA, 16 bp, R. norvegicus
cctggagcaaacccag

SEQ ID NO: 494282 - DNA, 16 bp, R. norvegicus
cctggagcaggagctg

SEQ ID NO: 494283 - DNA, 16 bp, R. norvegicus
cctggagccaggagct

SEQ ID NO: 494284 - DNA, 16 bp, R. norvegicus
cctggagccaggtgtc

SEQ ID NO: 494285 - DNA, 16 bp, R. norvegicus
cctggagccctcagga

SEQ ID NO: 494286 - DNA, 16 bp, R. norvegicus
cctggagcctctccca

SEQ ID NO: 494287 - DNA, 16 bp, R. norvegicus
cctggagctcactgat

SEQ ID NO: 494288 - DNA, 16 bp, R. norvegicus
cctggagctccctggc

SEQ ID NO: 494289 - DNA, 16 bp, R. norvegicus
cctggagctctctctg

SEQ ID NO: 494290 - DNA, 16 bp, R. norvegicus
cctggagctgaccctg

SEQ ID NO: 494291 - DNA, 16 bp, R. norvegicus
cctggagctgactgga

SEQ ID NO: 494292 - DNA, 16 bp, R. norvegicus
cctggagctgaggacc

SEQ ID NO: 494293 - DNA, 16 bp, R. norvegicus
cctggagctggaatta

SEQ ID NO: 494294 - DNA, 16 bp, R. norvegicus
cctggagctggagata

SEQ ID NO: 494295 - DNA, 16 bp, R. norvegicus
cctggagctggaggtg

SEQ ID NO: 494296 - DNA, 16 bp, R. norvegicus
cctggagctggggacc

SEQ ID NO: 494297 - DNA, 16 bp, R. norvegicus
cctggagctggtgcct

SEQ ID NO: 494298 - DNA, 16 bp, R. norvegicus
cctggagcttcagtgc

SEQ ID NO: 494299 - DNA, 16 bp, R. norvegicus
cctggagcttgctgat

SEQ ID NO: 494300 - DNA, 16 bp, R. norvegicus
cctggagcttgctggc

SEQ ID NO: 494301 - DNA, 16 bp, R. norvegicus
cctggaggacaagtag

SEQ ID NO: 494302 - DNA, 16 bp, R. norvegicus
cctggaggagctgaga

SEQ ID NO: 494303 - DNA, 16 bp, R. norvegicus
cctggaggcagaagct

SEQ ID NO: 494304 - DNA, 16 bp, R. norvegicus
cctggaggcagagctg

SEQ ID NO: 494305 - DNA, 16 bp, R. norvegicus
cctggagggatggctc

SEQ ID NO: 494306 - DNA, 16 bp, R. norvegicus
cctggagggccaggac

SEQ ID NO: 494307 - DNA, 16 bp, R. norvegicus
cctggagtcaggaact

SEQ ID NO: 494308 - DNA, 16 bp, R. norvegicus
cctggagttatagatg

SEQ ID NO: 494309 - DNA, 16 bp, R. norvegicus
cctggagttctttcag

SEQ ID NO: 494310 - DNA, 16 bp, R. norvegicus
cctggagtttcctcag

SEQ ID NO: 494311 - DNA, 16 bp, R. norvegicus
cctggataaagaaaac

SEQ ID NO: 494312 - DNA, 16 bp, R. norvegicus
cctggataccccatca

SEQ ID NO: 494313 - DNA, 16 bp, R. norvegicus
cctggatatagaaaat

SEQ ID NO: 494314 - DNA, 16 bp, R. norvegicus
cctggatctggagtta

SEQ ID NO: 494315 - DNA, 16 bp, R. norvegicus
cctggatctgggcctg

SEQ ID NO: 494316 - DNA, 16 bp, R. norvegicus
cctggatgccaccatg

SEQ ID NO: 494317 - DNA, 16 bp, R. norvegicus
cctggatgctgccacg

SEQ ID NO: 494318 - DNA, 16 bp, R. norvegicus
cctggatgctgccatg

SEQ ID NO: 494319 - DNA, 16 bp, R. norvegicus
cctggatggcctggaa

SEQ ID NO: 494320 - DNA, 16 bp, R. norvegicus
cctggatggctttgtt

SEQ ID NO: 494321 - DNA, 16 bp, R. norvegicus
cctggatgttcttgtt

SEQ ID NO: 494322 - DNA, 16 bp, R. norvegicus
cctggatgtttggggt

SEQ ID NO: 494323 - DNA, 16 bp, R. norvegicus
cctggattctctggaa

SEQ ID NO: 494324 - DNA, 16 bp, R. norvegicus
cctggatttagaaaac

SEQ ID NO: 494325 - DNA, 16 bp, R. norvegicus
cctggatttggtcctc

SEQ ID NO: 494326 - DNA, 16 bp, R. norvegicus
cctggcaacaggagga

SEQ ID NO: 494327 - DNA, 16 bp, R. norvegicus
cctggcacacagcagg

SEQ ID NO: 494328 - DNA, 16 bp, R. norvegicus
cctggcacatcaagtc

SEQ ID NO: 494329 - DNA, 16 bp, R. norvegicus
cctggcacccacatgg

SEQ ID NO: 494330 - DNA, 16 bp, R. norvegicus
cctggccagcctgggc

SEQ ID NO: 494331 - DNA, 16 bp, R. norvegicus
cctggcccacagcagc

SEQ ID NO: 494332 - DNA, 16 bp, R. norvegicus
cctggccccagaggaa

SEQ ID NO: 494333 - DNA, 16 bp, R. norvegicus
cctggccctgcctcct

SEQ ID NO: 494334 - DNA, 16 bp, R. norvegicus
cctggccctggccctg

SEQ ID NO: 494335 - DNA, 16 bp, R. norvegicus
cctggccctggctctg

SEQ ID NO: 494336 - DNA, 16 bp, R. norvegicus
cctggcctacagagag

SEQ ID NO: 494337 - DNA, 16 bp, R. norvegicus
cctggcctcacctgca

SEQ ID NO: 494338 - DNA, 16 bp, R. norvegicus
cctggcctcagtgaga

SEQ ID NO: 494339 - DNA, 16 bp, R. norvegicus
cctggcctgcagcagc

SEQ ID NO: 494340 - DNA, 16 bp, R. norvegicus
cctggcctggcctcag

SEQ ID NO: 494341 - DNA, 16 bp, R. norvegicus
cctggcctggcctggc

SEQ ID NO: 494342 - DNA, 16 bp, R. norvegicus
cctggccttggagaat

SEQ ID NO: 494343 - DNA, 16 bp, R. norvegicus
cctggctagcctggag

SEQ ID NO: 494344 - DNA, 16 bp, R. norvegicus
cctggctagctcaccc

SEQ ID NO: 494345 - DNA, 16 bp, R. norvegicus
cctggctcctggctcc

SEQ ID NO: 494346 - DNA, 16 bp, R. norvegicus
cctggctctcctggaa

SEQ ID NO: 494347 - DNA, 16 bp, R. norvegicus
cctggctctgcctcct

SEQ ID NO: 494348 - DNA, 16 bp, R. norvegicus
cctggctctgcctctg

SEQ ID NO: 494349 - DNA, 16 bp, R. norvegicus
cctggctctgcttctc

SEQ ID NO: 494350 - DNA, 16 bp, R. norvegicus
cctggctgccctagaa

SEQ ID NO: 494351 - DNA, 16 bp, R. norvegicus
cctggctgcctctgct

SEQ ID NO: 494352 - DNA, 16 bp, R. norvegicus
cctggctgcctggaag

SEQ ID NO: 494353 - DNA, 16 bp, R. norvegicus
cctggctgctgcacct

SEQ ID NO: 494354 - DNA, 16 bp, R. norvegicus
cctggctgctgcagct

SEQ ID NO: 494355 - DNA, 16 bp, R. norvegicus
cctggctggcccagaa

SEQ ID NO: 494356 - DNA, 16 bp, R. norvegicus
cctggctggcctggag

SEQ ID NO: 494357 - DNA, 16 bp, R. norvegicus
cctggctggcctggca

SEQ ID NO: 494358 - DNA, 16 bp, R. norvegicus
cctggctgggatcctg

SEQ ID NO: 494359 - DNA, 16 bp, R. norvegicus
cctggctgtcatggaa

SEQ ID NO: 494360 - DNA, 16 bp, R. norvegicus
cctggctgtcctgaga

SEQ ID NO: 494361 - DNA, 16 bp, R. norvegicus
cctggctgtcctggaa

SEQ ID NO: 494362 - DNA, 16 bp, R. norvegicus
cctggctgtcctggga

SEQ ID NO: 494363 - DNA, 16 bp, R. norvegicus
cctggctgtccttgga

SEQ ID NO: 494364 - DNA, 16 bp, R. norvegicus
cctggctgtctttgga

SEQ ID NO: 494365 - DNA, 16 bp, R. norvegicus
cctggctgttgccagg

SEQ ID NO: 494366 - DNA, 16 bp, R. norvegicus
cctggctgttgctagg

SEQ ID NO: 494367 - DNA, 16 bp, R. norvegicus
cctggcttcaattccc

SEQ ID NO: 494368 - DNA, 16 bp, R. norvegicus
cctggcttcagttccc

SEQ ID NO: 494369 - DNA, 16 bp, R. norvegicus
cctggcttctcctata

SEQ ID NO: 494370 - DNA, 16 bp, R. norvegicus
cctggcttgagcatct

SEQ ID NO: 494371 - DNA, 16 bp, R. norvegicus
cctggcttgctcagat

SEQ ID NO: 494372 - DNA, 16 bp, R. norvegicus
cctggctttcctggat

SEQ ID NO: 494373 - DNA, 18 bp, R. norvegicus
cctgggaaaccagaagac

SEQ ID NO: 494374 - DNA, 16 bp, R. norvegicus
cctgggaaacctaaac

SEQ ID NO: 494375 - DNA, 16 bp, R. norvegicus
cctgggaactctgggt

SEQ ID NO: 494376 - DNA, 16 bp, R. norvegicus
cctgggaaggagtgtg

SEQ ID NO: 494377 - DNA, 16 bp, R. norvegicus
cctgggaaggcagagg

SEQ ID NO: 494378 - DNA, 16 bp, R. norvegicus
cctgggaaggctccat

SEQ ID NO: 494379 - DNA, 16 bp, R. norvegicus
cctgggacaccagaag

SEQ ID NO: 494380 - DNA, 16 bp, R. norvegicus
cctgggactcacagag

SEQ ID NO: 494381 - DNA, 16 bp, R. norvegicus
cctgggactcactctg

SEQ ID NO: 494382 - DNA, 16 bp, R. norvegicus
cctgggagaagctgct

SEQ ID NO: 494383 - DNA, 16 bp, R. norvegicus
cctgggagagagagag

SEQ ID NO: 494384 - DNA, 16 bp, R. norvegicus
cctgggagcctcccca

SEQ ID NO: 494385 - DNA, 16 bp, R. norvegicus
cctgggagcctcccct

SEQ ID NO: 494386 - DNA, 16 bp, R. norvegicus
cctgggagctctggct

SEQ ID NO: 494387 - DNA, 16 bp, R. norvegicus
cctgggagctctggtg

SEQ ID NO: 494388 - DNA, 16 bp, R. norvegicus
cctgggaggaagccta

SEQ ID NO: 494389 - DNA, 16 bp, R. norvegicus
cctgggaggcagaggc

SEQ ID NO: 494390 - DNA, 16 bp, R. norvegicus
cctgggagggagagct

SEQ ID NO: 494391 - DNA, 16 bp, R. norvegicus
cctgggaggtgacaga

SEQ ID NO: 494392 - DNA, 16 bp, R. norvegicus
cctgggaggtgagaaa

SEQ ID NO: 494393 - DNA, 16 bp, R. norvegicus
cctgggagtcctctgc

SEQ ID NO: 494394 - DNA, 16 bp, R. norvegicus
cctgggagtctcttgc

SEQ ID NO: 494395 - DNA, 16 bp, R. norvegicus
cctgggagtggggagg

SEQ ID NO: 494396 - DNA, 16 bp, R. norvegicus
cctgggagttcccaga

SEQ ID NO: 494397 - DNA, 16 bp, R. norvegicus
cctgggatcaaaggtg

SEQ ID NO: 494398 - DNA, 16 bp, R. norvegicus
cctgggatgctgggtg

SEQ ID NO: 494399 - DNA, 16 bp, R. norvegicus
cctgggcaacacagca

SEQ ID NO: 494400 - DNA, 16 bp, R. norvegicus
cctgggcactgccatg

SEQ ID NO: 494401 - DNA, 16 bp, R. norvegicus
cctgggcactgggatt

SEQ ID NO: 494402 - DNA, 16 bp, R. norvegicus
cctgggcagatgtcat

SEQ ID NO: 494403 - DNA, 16 bp, R. norvegicus
cctgggcagatgtctt

SEQ ID NO: 494404 - DNA, 16 bp, R. norvegicus
cctgggcatggtggtg

SEQ ID NO: 494405 - DNA, 16 bp, R. norvegicus
cctgggccaagcattt

SEQ ID NO: 494406 - DNA, 16 bp, R. norvegicus
cctgggccacagagtg

SEQ ID NO: 494407 - DNA, 16 bp, R. norvegicus
cctgggcctgctcagg

SEQ ID NO: 494408 - DNA, 16 bp, R. norvegicus
cctgggcctggagtta

SEQ ID NO: 494409 - DNA, 16 bp, R. norvegicus
cctgggctacacagtg

SEQ ID NO: 494410 - DNA, 16 bp, R. norvegicus
cctgggctacagtgag

SEQ ID NO: 494411 - DNA, 16 bp, R. norvegicus
cctgggctacagtgtg

SEQ ID NO: 494412 - DNA, 16 bp, R. norvegicus
cctgggctacatagca

SEQ ID NO: 494413 - DNA, 16 bp, R. norvegicus
cctgggctacatgaaa

SEQ ID NO: 494414 - DNA, 16 bp, R. norvegicus
cctgggctacatgaga

SEQ ID NO: 494415 - DNA, 16 bp, R. norvegicus
cctgggctacattgtg

SEQ ID NO: 494416 - DNA, 16 bp, R. norvegicus
cctgggctacccagtg

SEQ ID NO: 494417 - DNA, 16 bp, R. norvegicus
cctgggctatgcagtg

SEQ ID NO: 494418 - DNA, 16 bp, R. norvegicus
cctgggctcagtcctc

SEQ ID NO: 494419 - DNA, 16 bp, R. norvegicus
cctgggctccagctgc

SEQ ID NO: 494420 - DNA, 16 bp, R. norvegicus
cctgggctcttattgg

SEQ ID NO: 494421 - DNA, 16 bp, R. norvegicus
cctgggctggggagat

SEQ ID NO: 494422 - DNA, 16 bp, R. norvegicus
cctggggatccagcac

SEQ ID NO: 494423 - DNA, 16 bp, R. norvegicus
cctggggatccagcca

SEQ ID NO: 494424 - DNA, 16 bp, R. norvegicus
cctggggatccatgcc

SEQ ID NO: 494425 - DNA, 16 bp, R. norvegicus
cctggggatgcagccc

SEQ ID NO: 494426 - DNA, 16 bp, R. norvegicus
cctggggcctccagtc

SEQ ID NO: 494427 - DNA, 16 bp, R. norvegicus
cctggggctcacagcc

SEQ ID NO: 494428 - DNA, 16 bp, R. norvegicus
cctggggctgcagagc

SEQ ID NO: 494429 - DNA, 16 bp, R. norvegicus
cctggggctggagtta

SEQ ID NO: 494430 - DNA, 16 bp, R. norvegicus
cctggggctggggctg

SEQ ID NO: 494431 - DNA, 16 bp, R. norvegicus
cctggggcttgctgga

SEQ ID NO: 494432 - DNA, 16 bp, R. norvegicus
cctggggtgctggctc

SEQ ID NO: 494433 - DNA, 16 bp, R. norvegicus
cctggggttacaggtg

SEQ ID NO: 494434 - DNA, 16 bp, R. norvegicus
cctggggtttctaccc

SEQ ID NO: 494435 - DNA, 16 bp, R. norvegicus
cctgggtaccaaccca

SEQ ID NO: 494436 - DNA, 16 bp, R. norvegicus
cctgggtcatcaaacc

SEQ ID NO: 494437 - DNA, 16 bp, R. norvegicus
cctgggtcctccccca

SEQ ID NO: 494438 - DNA, 16 bp, R. norvegicus
cctgggtcctgcaaag

SEQ ID NO: 494439 - DNA, 16 bp, R. norvegicus
cctgggtcctgctcag

SEQ ID NO: 494440 - DNA, 16 bp, R. norvegicus
cctgggtctcctggaa

SEQ ID NO: 494441 - DNA, 16 bp, R. norvegicus
cctgggtctgggcctg

SEQ ID NO: 494442 - DNA, 16 bp, R. norvegicus
cctgggtcttctggaa

SEQ ID NO: 494443 - DNA, 16 bp, R. norvegicus
cctgggtgtatttgct

SEQ ID NO: 494444 - DNA, 16 bp, R. norvegicus
cctgggttcaaccctc

SEQ ID NO: 494445 - DNA, 16 bp, R. norvegicus
cctgggttcaatctcc

SEQ ID NO: 494446 - DNA, 16 bp, R. norvegicus
cctgggttccacccca

SEQ ID NO: 494447 - DNA, 16 bp, R. norvegicus
cctgggttccatccca

SEQ ID NO: 494448 - DNA, 16 bp, R. norvegicus
cctgggttccattccc

SEQ ID NO: 494449 - DNA, 19 bp, R. norvegicus
cctgggttcggtacccagc

SEQ ID NO: 494450 - DNA, 16 bp, R. norvegicus
cctgggttctataaga

SEQ ID NO: 494451 - DNA, 16 bp, R. norvegicus
cctgggttctgtgaga

SEQ ID NO: 494452 - DNA, 16 bp, R. norvegicus
cctgggttctttggaa

SEQ ID NO: 494453 - DNA, 16 bp, R. norvegicus
cctgggtttgatcttc

SEQ ID NO: 494454 - DNA, 16 bp, R. norvegicus
cctgggtttgattccc

SEQ ID NO: 494455 - DNA, 16 bp, R. norvegicus
cctggtcaagaagaaa

SEQ ID NO: 494456 - DNA, 16 bp, R. norvegicus
cctggtcactcctgct

SEQ ID NO: 494457 - DNA, 16 bp, R. norvegicus
cctggtcaggtgagca

SEQ ID NO: 494458 - DNA, 16 bp, R. norvegicus
cctggtccacagagta

SEQ ID NO: 494459 - DNA, 16 bp, R. norvegicus
cctggtccacaggaag

SEQ ID NO: 494460 - DNA, 16 bp, R. norvegicus
cctggtcccagaggaa

SEQ ID NO: 494461 - DNA, 16 bp, R. norvegicus
cctggtcctgccaagg

SEQ ID NO: 494462 - DNA, 16 bp, R. norvegicus
cctggtctacaaaggg

SEQ ID NO: 494463 - DNA, 16 bp, R. norvegicus
cctggtctgcatagta

SEQ ID NO: 494464 - DNA, 16 bp, R. norvegicus
cctggtcttcagagca

SEQ ID NO: 494465 - DNA, 16 bp, R. norvegicus
cctggtcttccttcct

SEQ ID NO: 494466 - DNA, 17 bp, R. norvegicus
cctggtgaaatcaagac

SEQ ID NO: 494467 - DNA, 17 bp, R. norvegicus
cctggtgaagtcaagac

SEQ ID NO: 494468 - DNA, 16 bp, R. norvegicus
cctggtgccagccaga

SEQ ID NO: 494469 - DNA, 16 bp, R. norvegicus
cctggtgcccagagag

SEQ ID NO: 494470 - DNA, 16 bp, R. norvegicus
cctggtgcccatggag

SEQ ID NO: 494471 - DNA, 16 bp, R. norvegicus
cctggtgcccctggag

SEQ ID NO: 494472 - DNA, 16 bp, R. norvegicus
cctggtgcccgtggag

SEQ ID NO: 494473 - DNA, 16 bp, R. norvegicus
cctggtgctgcccttc

SEQ ID NO: 494474 - DNA, 16 bp, R. norvegicus
cctggtgctggagaag

SEQ ID NO: 494475 - DNA, 16 bp, R. norvegicus
cctggtggcaggagct

SEQ ID NO: 494476 - DNA, 16 bp, R. norvegicus
cctggtggcctgagtt

SEQ ID NO: 494477 - DNA, 16 bp, R. norvegicus
cctggtggctcacaac

SEQ ID NO: 494478 - DNA, 16 bp, R. norvegicus
cctggtggctctctgc

SEQ ID NO: 494479 - DNA, 16 bp, R. norvegicus
cctggtggctgccacc

SEQ ID NO: 494480 - DNA, 16 bp, R. norvegicus
cctggtgggggagctg

SEQ ID NO: 494481 - DNA, 16 bp, R. norvegicus
cctggtggtcttcttt

SEQ ID NO: 494482 - DNA, 16 bp, R. norvegicus
cctggtgtcagttggc

SEQ ID NO: 494483 - DNA, 16 bp, R. norvegicus
cctggtgtccacagag

SEQ ID NO: 494484 - DNA, 16 bp, R. norvegicus
cctggtgtctgcaggg

SEQ ID NO: 494485 - DNA, 16 bp, R. norvegicus
cctggtgtctgtggag

SEQ ID NO: 494486 - DNA, 16 bp, R. norvegicus
cctggtgtgattctga

SEQ ID NO: 494487 - DNA, 16 bp, R. norvegicus
cctggtgtggctgttc

SEQ ID NO: 494488 - DNA, 16 bp, R. norvegicus
cctggtgtggtggtgc

SEQ ID NO: 494489 - DNA, 16 bp, R. norvegicus
cctggtgttggctgga

SEQ ID NO: 494490 - DNA, 16 bp, R. norvegicus
cctggttattgttttc

SEQ ID NO: 494491 - DNA, 16 bp, R. norvegicus
cctggttcaaagaaca

SEQ ID NO: 494492 - DNA, 16 bp, R. norvegicus
cctggttcccagttga

SEQ ID NO: 494493 - DNA, 16 bp, R. norvegicus
cctggttcctgtcctg

SEQ ID NO: 494494 - DNA, 16 bp, R. norvegicus
cctggttgggggatgg

SEQ ID NO: 494495 - DNA, 16 bp, R. norvegicus
cctggttttctgtcca

SEQ ID NO: 494496 - DNA, 16 bp, R. norvegicus
cctgtaactccacctc

SEQ ID NO: 494497 - DNA, 16 bp, R. norvegicus
cctgtaactccagctc

SEQ ID NO: 494498 - DNA, 16 bp, R. norvegicus
cctgtaactccagttt

SEQ ID NO: 494499 - DNA, 16 bp, R. norvegicus
cctgtaattccagcct

SEQ ID NO: 494500 - DNA, 16 bp, R. norvegicus
cctgtaattccagcta

SEQ ID NO: 494501 - DNA, 16 bp, R. norvegicus
cctgtaattccagtac

SEQ ID NO: 494502 - DNA, 16 bp, R. norvegicus
cctgtaattctggcac

SEQ ID NO: 494503 - DNA, 16 bp, R. norvegicus
cctgtaattttttcag

SEQ ID NO: 494504 - DNA, 16 bp, R. norvegicus
cctgtacatatgtagc

SEQ ID NO: 494505 - DNA, 16 bp, R. norvegicus
cctgtagagacctcct

SEQ ID NO: 494506 - DNA, 16 bp, R. norvegicus
cctgtagatcccaagc

SEQ ID NO: 494507 - DNA, 16 bp, R. norvegicus
cctgtagccaggcaga

SEQ ID NO: 494508 - DNA, 16 bp, R. norvegicus
cctgtagctaggcagg

SEQ ID NO: 494509 - DNA, 16 bp, R. norvegicus
cctgtagctgcctgta

SEQ ID NO: 494510 - DNA, 17 bp, R. norvegicus
cctgtatcacagtcaca

SEQ ID NO: 494511 - DNA, 16 bp, R. norvegicus
cctgtatgagttcctg

SEQ ID NO: 494512 - DNA, 18 bp, R. norvegicus
cctgtatgcctgggatga

SEQ ID NO: 494513 - DNA, 16 bp, R. norvegicus
cctgtcaaagataatg

SEQ ID NO: 494514 - DNA, 16 bp, R. norvegicus
cctgtcaataaccctg

SEQ ID NO: 494515 - DNA, 16 bp, R. norvegicus
cctgtcactggacctc

SEQ ID NO: 494516 - DNA, 16 bp, R. norvegicus
cctgtcagaaatccaa

SEQ ID NO: 494517 - DNA, 16 bp, R. norvegicus
cctgtcaggctgcact

SEQ ID NO: 494518 - DNA, 16 bp, R. norvegicus
cctgtcattggaggag

SEQ ID NO: 494519 - DNA, 16 bp, R. norvegicus
cctgtccataaacccc

SEQ ID NO: 494520 - DNA, 16 bp, R. norvegicus
cctgtcccagagtgct

SEQ ID NO: 494521 - DNA, 16 bp, R. norvegicus
cctgtccccagcagtg

SEQ ID NO: 494522 - DNA, 16 bp, R. norvegicus
cctgtccccagccctg

SEQ ID NO: 494523 - DNA, 16 bp, R. norvegicus
cctgtcccccattctt

SEQ ID NO: 494524 - DNA, 16 bp, R. norvegicus
cctgtccctgcctgtc

SEQ ID NO: 494525 - DNA, 16 bp, R. norvegicus
cctgtccctgtctgtc

SEQ ID NO: 494526 - DNA, 16 bp, R. norvegicus
cctgtcctagttaggg

SEQ ID NO: 494527 - DNA, 16 bp, R. norvegicus
cctgtcctcacttcct

SEQ ID NO: 494528 - DNA, 16 bp, R. norvegicus
cctgtcctcccctcca

SEQ ID NO: 494529 - DNA, 16 bp, R. norvegicus
cctgtcctcctgtcct

SEQ ID NO: 494530 - DNA, 16 bp, R. norvegicus
cctgtcctgagctctg

SEQ ID NO: 494531 - DNA, 16 bp, R. norvegicus
cctgtcctgccctgcc

SEQ ID NO: 494532 - DNA, 16 bp, R. norvegicus
cctgtccttcagtctc

SEQ ID NO: 494533 - DNA, 16 bp, R. norvegicus
cctgtccttgtccctg

SEQ ID NO: 494534 - DNA, 16 bp, R. norvegicus
cctgtctatcatctat

SEQ ID NO: 494535 - DNA, 16 bp, R. norvegicus
cctgtctcaaaagaag

SEQ ID NO: 494536 - DNA, 16 bp, R. norvegicus
cctgtctcaaagaaaa

SEQ ID NO: 494537 - DNA, 16 bp, R. norvegicus
cctgtctcaacaacaa

SEQ ID NO: 494538 - DNA, 16 bp, R. norvegicus
cctgtctcaagataaa

SEQ ID NO: 494539 - DNA, 16 bp, R. norvegicus
cctgtctcagaaaaac

SEQ ID NO: 494540 - DNA, 16 bp, R. norvegicus
cctgtctcagaaacaa

SEQ ID NO: 494541 - DNA, 16 bp, R. norvegicus
cctgtctcagagaaaa

SEQ ID NO: 494542 - DNA, 16 bp, R. norvegicus
cctgtctcagccttct

SEQ ID NO: 494543 - DNA, 16 bp, R. norvegicus
cctgtctcagtctcct

SEQ ID NO: 494544 - DNA, 16 bp, R. norvegicus
cctgtctccaaacaaa

SEQ ID NO: 494545 - DNA, 16 bp, R. norvegicus
cctgtctccagctcct

SEQ ID NO: 494546 - DNA, 16 bp, R. norvegicus
cctgtctctgccccac

SEQ ID NO: 494547 - DNA, 16 bp, R. norvegicus
cctgtctctgcctctc

SEQ ID NO: 494548 - DNA, 16 bp, R. norvegicus
cctgtctctgcctgcc

SEQ ID NO: 494549 - DNA, 16 bp, R. norvegicus
cctgtctctgctggga

SEQ ID NO: 494550 - DNA, 16 bp, R. norvegicus
cctgtctgaaggaact

SEQ ID NO: 494551 - DNA, 16 bp, R. norvegicus
cctgtctgatctgcat

SEQ ID NO: 494552 - DNA, 16 bp, R. norvegicus
cctgtctgcaagatat

SEQ ID NO: 494553 - DNA, 16 bp, R. norvegicus
cctgtctgcaagcaaa

SEQ ID NO: 494554 - DNA, 16 bp, R. norvegicus
cctgtctgctgccatg

SEQ ID NO: 494555 - DNA, 16 bp, R. norvegicus
cctgtctggacactgc

SEQ ID NO: 494556 - DNA, 16 bp, R. norvegicus
cctgtctggggtgagt

SEQ ID NO: 494557 - DNA, 16 bp, R. norvegicus
cctgtctggtgaactc

SEQ ID NO: 494558 - DNA, 16 bp, R. norvegicus
cctgtctgtattccag

SEQ ID NO: 494559 - DNA, 16 bp, R. norvegicus
cctgtctgtcctgaaa

SEQ ID NO: 494560 - DNA, 16 bp, R. norvegicus
cctgtctgtctctgcc

SEQ ID NO: 494561 - DNA, 16 bp, R. norvegicus
cctgtctgtctgcctg

SEQ ID NO: 494562 - DNA, 16 bp, R. norvegicus
cctgtctgtgcctccc

SEQ ID NO: 494563 - DNA, 16 bp, R. norvegicus
cctgtctgtttgtctg

SEQ ID NO: 494564 - DNA, 16 bp, R. norvegicus
cctgtcttgacttcct

SEQ ID NO: 494565 - DNA, 16 bp, R. norvegicus
cctgtgaaggcttctt

SEQ ID NO: 494566 - DNA, 16 bp, R. norvegicus
cctgtgaatctgtagt

SEQ ID NO: 494567 - DNA, 16 bp, R. norvegicus
cctgtgacacagatct

SEQ ID NO: 494568 - DNA, 16 bp, R. norvegicus
cctgtgacacttgaga

SEQ ID NO: 494569 - DNA, 16 bp, R. norvegicus
cctgtgactccagctc

SEQ ID NO: 494570 - DNA, 16 bp, R. norvegicus
cctgtgactccagctt

SEQ ID NO: 494571 - DNA, 16 bp, R. norvegicus
cctgtgagcagcagtg

SEQ ID NO: 494572 - DNA, 16 bp, R. norvegicus
cctgtgaggatccagt

SEQ ID NO: 494573 - DNA, 16 bp, R. norvegicus
cctgtgatcctgggca

SEQ ID NO: 494574 - DNA, 16 bp, R. norvegicus
cctgtgatctttggag

SEQ ID NO: 494575 - DNA, 16 bp, R. norvegicus
cctgtgcacacacaca

SEQ ID NO: 494576 - DNA, 16 bp, R. norvegicus
cctgtgcacgggtgga

SEQ ID NO: 494577 - DNA, 16 bp, R. norvegicus
cctgtgcatgctgtca

SEQ ID NO: 494578 - DNA, 17 bp, R. norvegicus
cctgtgccagatggaat

SEQ ID NO: 494579 - DNA, 16 bp, R. norvegicus
cctgtgccagctgcag

SEQ ID NO: 494580 - DNA, 16 bp, R. norvegicus
cctgtgcccagcccag

SEQ ID NO: 494581 - DNA, 16 bp, R. norvegicus
cctgtgcccaggggac

SEQ ID NO: 494582 - DNA, 16 bp, R. norvegicus
cctgtgccctgtgcac

SEQ ID NO: 494583 - DNA, 16 bp, R. norvegicus
cctgtgcctctggctg

SEQ ID NO: 494584 - DNA, 16 bp, R. norvegicus
cctgtgctccaactgc

SEQ ID NO: 494585 - DNA, 16 bp, R. norvegicus
cctgtgctccctctgc

SEQ ID NO: 494586 - DNA, 16 bp, R. norvegicus
cctgtgctctgaagca

SEQ ID NO: 494587 - DNA, 16 bp, R. norvegicus
cctgtgctgagagctg

SEQ ID NO: 494588 - DNA, 16 bp, R. norvegicus
cctgtgctgccccagg

SEQ ID NO: 494589 - DNA, 16 bp, R. norvegicus
cctgtgctgcctcctg

SEQ ID NO: 494590 - DNA, 16 bp, R. norvegicus
cctgtgcttcccatcc

SEQ ID NO: 494591 - DNA, 16 bp, R. norvegicus
cctgtggaagaacagc

SEQ ID NO: 494592 - DNA, 16 bp, R. norvegicus
cctgtggaagacagtc

SEQ ID NO: 494593 - DNA, 16 bp, R. norvegicus
cctgtggaagaggagg

SEQ ID NO: 494594 - DNA, 16 bp, R. norvegicus
cctgtggaagctgcca

SEQ ID NO: 494595 - DNA, 16 bp, R. norvegicus
cctgtggaaggggaag

SEQ ID NO: 494596 - DNA, 16 bp, R. norvegicus
cctgtggagttcctac

SEQ ID NO: 494597 - DNA, 16 bp, R. norvegicus
cctgtggatctggatg

SEQ ID NO: 494598 - DNA, 16 bp, R. norvegicus
cctgtggctgctgctg

SEQ ID NO: 494599 - DNA, 16 bp, R. norvegicus
cctgtgggcctatgtc

SEQ ID NO: 494600 - DNA, 16 bp, R. norvegicus
cctgtggggaccattc

SEQ ID NO: 494601 - DNA, 16 bp, R. norvegicus
cctgtggggcaggctc

SEQ ID NO: 494602 - DNA, 17 bp, R. norvegicus
cctgtggggcaggctct

SEQ ID NO: 494603 - DNA, 16 bp, R. norvegicus
cctgtgggggtcccag

SEQ ID NO: 494604 - DNA, 16 bp, R. norvegicus
cctgtggggtttcaaa

SEQ ID NO: 494605 - DNA, 16 bp, R. norvegicus
cctgtggtcctgagcc

SEQ ID NO: 494606 - DNA, 16 bp, R. norvegicus
cctgtggtctcctggc

SEQ ID NO: 494607 - DNA, 16 bp, R. norvegicus
cctgtggtggagcaga

SEQ ID NO: 494608 - DNA, 17 bp, R. norvegicus
cctgtgtactggtcttc

SEQ ID NO: 494609 - DNA, 16 bp, R. norvegicus
cctgtgtcaatttcca

SEQ ID NO: 494610 - DNA, 16 bp, R. norvegicus
cctgtgtcacagcctc

SEQ ID NO: 494611 - DNA, 16 bp, R. norvegicus
cctgtgtcatgaagat

SEQ ID NO: 494612 - DNA, 16 bp, R. norvegicus
cctgtgtccacctccc

SEQ ID NO: 494613 - DNA, 16 bp, R. norvegicus
cctgtgtccagagctg

SEQ ID NO: 494614 - DNA, 16 bp, R. norvegicus
cctgtgtcctctagaa

SEQ ID NO: 494615 - DNA, 16 bp, R. norvegicus
cctgtgtcctgagtca

SEQ ID NO: 494616 - DNA, 16 bp, R. norvegicus
cctgtgtcctgagtgc

SEQ ID NO: 494617 - DNA, 18 bp, R. norvegicus
cctgtgtcgaggctggac

SEQ ID NO: 494618 - DNA, 16 bp, R. norvegicus
cctgtgtctgcctccc

SEQ ID NO: 494619 - DNA, 16 bp, R. norvegicus
cctgtgtctgctctgc

SEQ ID NO: 494620 - DNA, 16 bp, R. norvegicus
cctgtgtctgcttcag

SEQ ID NO: 494621 - DNA, 16 bp, R. norvegicus
cctgtgtgagctcctg

SEQ ID NO: 494622 - DNA, 16 bp, R. norvegicus
cctgtgtgccgcctcc

SEQ ID NO: 494623 - DNA, 16 bp, R. norvegicus
cctgtgtgcctctgtg

SEQ ID NO: 494624 - DNA, 16 bp, R. norvegicus
cctgtgtggaggagac

SEQ ID NO: 494625 - DNA, 23 bp, R. norvegicus
cctgtgtggaggagacctcttgg

SEQ ID NO: 494626 - DNA, 16 bp, R. norvegicus
cctgtgtggatgagca

SEQ ID NO: 494627 - DNA, 16 bp, R. norvegicus
cctgtgtgtctgcatg

SEQ ID NO: 494628 - DNA, 16 bp, R. norvegicus
cctgtgttgaaaaaca

SEQ ID NO: 494629 - DNA, 27 bp, R. norvegicus
cctgtgtttaggagacttgtggacaga

SEQ ID NO: 494630 - DNA, 16 bp, R. norvegicus
cctgtgtttgctggag

SEQ ID NO: 494631 - DNA, 16 bp, R. norvegicus
cctgttcccaaacccc

SEQ ID NO: 494632 - DNA, 16 bp, R. norvegicus
cctgttcctgatttta

SEQ ID NO: 494633 - DNA, 16 bp, R. norvegicus
cctgttcctgccacca

SEQ ID NO: 494634 - DNA, 16 bp, R. norvegicus
cctgttctacagagtg

SEQ ID NO: 494635 - DNA, 16 bp, R. norvegicus
cctgttgctgctgctg

SEQ ID NO: 494636 - DNA, 16 bp, R. norvegicus
cctgttggccctggtc

SEQ ID NO: 494637 - DNA, 16 bp, R. norvegicus
cctgttgtctgtctgt

SEQ ID NO: 494638 - DNA, 16 bp, R. norvegicus
cctgttgtctgtggat

SEQ ID NO: 494639 - DNA, 16 bp, R. norvegicus
cctgtttactgtgttg

SEQ ID NO: 494640 - DNA, 16 bp, R. norvegicus
cctgtttcaaaagaaa

SEQ ID NO: 494641 - DNA, 16 bp, R. norvegicus
cctgtttcctgacctg

SEQ ID NO: 494642 - DNA, 16 bp, R. norvegicus
cctgtttctctcccag

SEQ ID NO: 494643 - DNA, 16 bp, R. norvegicus
cctgtttctgcctcca

SEQ ID NO: 494644 - DNA, 16 bp, R. norvegicus
cctgtttctggctctg

SEQ ID NO: 494645 - DNA, 16 bp, R. norvegicus
cctgtttgattttctt

SEQ ID NO: 494646 - DNA, 16 bp, R. norvegicus
cctgtttgattttgtt

SEQ ID NO: 494647 - DNA, 16 bp, R. norvegicus
ccttaaagaaacacaa

SEQ ID NO: 494648 - DNA, 16 bp, R. norvegicus
ccttaaagagaaaata

SEQ ID NO: 494649 - DNA, 16 bp, R. norvegicus
ccttaaagaggaaaaa

SEQ ID NO: 494650 - DNA, 16 bp, R. norvegicus
ccttaatatctttctg

SEQ ID NO: 494651 - DNA, 16 bp, R. norvegicus
ccttacaaatgtaatg

SEQ ID NO: 494652 - DNA, 16 bp, R. norvegicus
ccttacaccaaccaga

SEQ ID NO: 494653 - DNA, 16 bp, R. norvegicus
ccttacagaagcttcc

SEQ ID NO: 494654 - DNA, 16 bp, R. norvegicus
ccttacagagacttga

SEQ ID NO: 494655 - DNA, 16 bp, R. norvegicus
ccttacttgatgccct

SEQ ID NO: 494656 - DNA, 16 bp, R. norvegicus
ccttagcacttgggag

SEQ ID NO: 494657 - DNA, 16 bp, R. norvegicus
ccttagccagcctaac

SEQ ID NO: 494658 - DNA, 16 bp, R. norvegicus
ccttagctgtgactca

SEQ ID NO: 494659 - DNA, 16 bp, R. norvegicus
ccttagggaaatgcag

SEQ ID NO: 494660 - DNA, 16 bp, R. norvegicus
ccttaggtttggactt

SEQ ID NO: 494661 - DNA, 16 bp, R. norvegicus
ccttagtgctgggatt

SEQ ID NO: 494662 - DNA, 16 bp, R. norvegicus
ccttatactcctcctg

SEQ ID NO: 494663 - DNA, 16 bp, R. norvegicus
ccttatctatggcttc

SEQ ID NO: 494664 - DNA, 19 bp, R. norvegicus
ccttatgctctaagatcaa

SEQ ID NO: 494665 - DNA, 16 bp, R. norvegicus
ccttatggaagagttg

SEQ ID NO: 494666 - DNA, 16 bp, R. norvegicus
ccttatggacaggtac

SEQ ID NO: 494667 - DNA, 33 bp, R. norvegicus
ccttatgttgggctttaccatttattatccttt

SEQ ID NO: 494668 - DNA, 22 bp, R. norvegicus
ccttattcaagtcttgggaaat

SEQ ID NO: 494669 - DNA, 16 bp, R. norvegicus
ccttattgggcatcag

SEQ ID NO: 494670 - DNA, 16 bp, R. norvegicus
ccttatttggccactt

SEQ ID NO: 494671 - DNA, 16 bp, R. norvegicus
ccttcaaaatctgcat

SEQ ID NO: 494672 - DNA, 16 bp, R. norvegicus
ccttcaaaatttttga

SEQ ID NO: 494673 - DNA, 16 bp, R. norvegicus
ccttcaaacttctctc

SEQ ID NO: 494674 - DNA, 16 bp, R. norvegicus
ccttcaaagaaaagct

SEQ ID NO: 494675 - DNA, 21 bp, R. norvegicus
ccttcaacagaggaatggatt

SEQ ID NO: 494676 - DNA, 16 bp, R. norvegicus
ccttcaactcaaagac

SEQ ID NO: 494677 - DNA, 16 bp, R. norvegicus
ccttcaacttcttcaa

SEQ ID NO: 494678 - DNA, 16 bp, R. norvegicus
ccttcaagcacttcca

SEQ ID NO: 494679 - DNA, 17 bp, R. norvegicus
ccttcaagctctaccag

SEQ ID NO: 494680 - DNA, 16 bp, R. norvegicus
ccttcaatcccagaac

SEQ ID NO: 494681 - DNA, 16 bp, R. norvegicus
ccttcaatcccagcat

SEQ ID NO: 494682 - DNA, 16 bp, R. norvegicus
ccttcacaattgtcac

SEQ ID NO: 494683 - DNA, 16 bp, R. norvegicus
ccttcacagcaccaag

SEQ ID NO: 494684 - DNA, 16 bp, R. norvegicus
ccttcacccactgagc

SEQ ID NO: 494685 - DNA, 16 bp, R. norvegicus
ccttcacctctttcag

SEQ ID NO: 494686 - DNA, 16 bp, R. norvegicus
ccttcacctgtataat

SEQ ID NO: 494687 - DNA, 16 bp, R. norvegicus
ccttcactggggtccc

SEQ ID NO: 494688 - DNA, 16 bp, R. norvegicus
ccttcagaacaaaatg

SEQ ID NO: 494689 - DNA, 16 bp, R. norvegicus
ccttcagaataagaga

SEQ ID NO: 494690 - DNA, 16 bp, R. norvegicus
ccttcagagaagcaga

SEQ ID NO: 494691 - DNA, 16 bp, R. norvegicus
ccttcagaggccagaa

SEQ ID NO: 494692 - DNA, 16 bp, R. norvegicus
ccttcagatacaccag

SEQ ID NO: 494693 - DNA, 16 bp, R. norvegicus
ccttcagatcaagatg

SEQ ID NO: 494694 - DNA, 16 bp, R. norvegicus
ccttcagatgaaggtg

SEQ ID NO: 494695 - DNA, 16 bp, R. norvegicus
ccttcagcaacttcag

SEQ ID NO: 494696 - DNA, 16 bp, R. norvegicus
ccttcagcagaagaat

SEQ ID NO: 494697 - DNA, 16 bp, R. norvegicus
ccttcagcagagaaat

SEQ ID NO: 494698 - DNA, 16 bp, R. norvegicus
ccttcagcctttgctc

SEQ ID NO: 494699 - DNA, 16 bp, R. norvegicus
ccttcagctgcttcag

SEQ ID NO: 494700 - DNA, 16 bp, R. norvegicus
ccttcagcttcttcat

SEQ ID NO: 494701 - DNA, 16 bp, R. norvegicus
ccttcagggaggcaga

SEQ ID NO: 494702 - DNA, 16 bp, R. norvegicus
ccttcagtctctgctg

SEQ ID NO: 494703 - DNA, 16 bp, R. norvegicus
ccttcagtgtggctgg

SEQ ID NO: 494704 - DNA, 16 bp, R. norvegicus
ccttcatttctctctg

SEQ ID NO: 494705 - DNA, 16 bp, R. norvegicus
ccttcattttcactga

SEQ ID NO: 494706 - DNA, 16 bp, R. norvegicus
ccttcatttttattaa

SEQ ID NO: 494707 - DNA, 16 bp, R. norvegicus
ccttccaagaaggact

SEQ ID NO: 494708 - DNA, 16 bp, R. norvegicus
ccttccaagagctggg

SEQ ID NO: 494709 - DNA, 16 bp, R. norvegicus
ccttccaccgtgtggg

SEQ ID NO: 494710 - DNA, 16 bp, R. norvegicus
ccttccactggtggcc

SEQ ID NO: 494711 - DNA, 16 bp, R. norvegicus
ccttccactgtgccct

SEQ ID NO: 494712 - DNA, 16 bp, R. norvegicus
ccttccagatcctctc

SEQ ID NO: 494713 - DNA, 16 bp, R. norvegicus
ccttccagattcagct

SEQ ID NO: 494714 - DNA, 16 bp, R. norvegicus
ccttccagcatgtggg

SEQ ID NO: 494715 - DNA, 16 bp, R. norvegicus
ccttcccaatttcctg

SEQ ID NO: 494716 - DNA, 16 bp, R. norvegicus
ccttcccagagttcct

SEQ ID NO: 494717 - DNA, 16 bp, R. norvegicus
ccttcccagcttcctt

SEQ ID NO: 494718 - DNA, 16 bp, R. norvegicus
ccttcccagtttcttg

SEQ ID NO: 494719 - DNA, 16 bp, R. norvegicus
ccttcccatcttcctg

SEQ ID NO: 494720 - DNA, 16 bp, R. norvegicus
ccttccccacctgggg

SEQ ID NO: 494721 - DNA, 16 bp, R. norvegicus
ccttccccactgagcc

SEQ ID NO: 494722 - DNA, 16 bp, R. norvegicus
ccttcccccaacaatc

SEQ ID NO: 494723 - DNA, 16 bp, R. norvegicus
ccttcccccagcttct

SEQ ID NO: 494724 - DNA, 16 bp, R. norvegicus
ccttcccctgtggctg

SEQ ID NO: 494725 - DNA, 16 bp, R. norvegicus
ccttccctccctccag

SEQ ID NO: 494726 - DNA, 16 bp, R. norvegicus
ccttccctgacttcaa

SEQ ID NO: 494727 - DNA, 16 bp, R. norvegicus
ccttccctgcatgcct

SEQ ID NO: 494728 - DNA, 16 bp, R. norvegicus
ccttccctgccaatgg

SEQ ID NO: 494729 - DNA, 16 bp, R. norvegicus
ccttccctggcttctc

SEQ ID NO: 494730 - DNA, 16 bp, R. norvegicus
ccttcccttccccagc

SEQ ID NO: 494731 - DNA, 16 bp, R. norvegicus
ccttcctagacttttc

SEQ ID NO: 494732 - DNA, 16 bp, R. norvegicus
ccttcctcacctgcct

SEQ ID NO: 494733 - DNA, 16 bp, R. norvegicus
ccttcctcatcatgct

SEQ ID NO: 494734 - DNA, 16 bp, R. norvegicus
ccttcctccagctccc

SEQ ID NO: 494735 - DNA, 16 bp, R. norvegicus
ccttcctccagctcct

SEQ ID NO: 494736 - DNA, 16 bp, R. norvegicus
ccttcctccccactga

SEQ ID NO: 494737 - DNA, 16 bp, R. norvegicus
ccttcctcctctcaga

SEQ ID NO: 494738 - DNA, 16 bp, R. norvegicus
ccttcctctgactcct

SEQ ID NO: 494739 - DNA, 16 bp, R. norvegicus
ccttcctctgggcctg

SEQ ID NO: 494740 - DNA, 16 bp, R. norvegicus
ccttcctctggtgtgt

SEQ ID NO: 494741 - DNA, 16 bp, R. norvegicus
ccttcctctgtctctg

SEQ ID NO: 494742 - DNA, 16 bp, R. norvegicus
ccttcctgaagttgct

SEQ ID NO: 494743 - DNA, 16 bp, R. norvegicus
ccttcctgcctacctg

SEQ ID NO: 494744 - DNA, 16 bp, R. norvegicus
ccttcctgcctccttg

SEQ ID NO: 494745 - DNA, 16 bp, R. norvegicus
ccttcctggaaagctg

SEQ ID NO: 494746 - DNA, 16 bp, R. norvegicus
ccttcctggtttcctg

SEQ ID NO: 494747 - DNA, 16 bp, R. norvegicus
ccttcctgtctccacc

SEQ ID NO: 494748 - DNA, 16 bp, R. norvegicus
ccttcctgtctctgcc

SEQ ID NO: 494749 - DNA, 16 bp, R. norvegicus
ccttcctgtgtgttct

SEQ ID NO: 494750 - DNA, 16 bp, R. norvegicus
ccttccttccattcat

SEQ ID NO: 494751 - DNA, 16 bp, R. norvegicus
ccttccttccttaagt

SEQ ID NO: 494752 - DNA, 16 bp, R. norvegicus
ccttccttctcatcta

SEQ ID NO: 494753 - DNA, 16 bp, R. norvegicus
ccttccttttcatcca

SEQ ID NO: 494754 - DNA, 16 bp, R. norvegicus
ccttcgcctacagagc

SEQ ID NO: 494755 - DNA, 16 bp, R. norvegicus
ccttcgtcatcaggga

SEQ ID NO: 494756 - DNA, 16 bp, R. norvegicus
ccttctaagaaggact

SEQ ID NO: 494757 - DNA, 16 bp, R. norvegicus
ccttctagctgcctga

SEQ ID NO: 494758 - DNA, 16 bp, R. norvegicus
ccttctatgaggatgc

SEQ ID NO: 494759 - DNA, 16 bp, R. norvegicus
ccttctattctggact

SEQ ID NO: 494760 - DNA, 16 bp, R. norvegicus
ccttctcactagtccc

SEQ ID NO: 494761 - DNA, 16 bp, R. norvegicus
ccttctcaggtctcag

SEQ ID NO: 494762 - DNA, 16 bp, R. norvegicus
ccttctcaggtctctg

SEQ ID NO: 494763 - DNA, 16 bp, R. norvegicus
ccttctcagtgctgag

SEQ ID NO: 494764 - DNA, 16 bp, R. norvegicus
ccttctccaaaatgga

SEQ ID NO: 494765 - DNA, 16 bp, R. norvegicus
ccttctccatcaatca

SEQ ID NO: 494766 - DNA, 16 bp, R. norvegicus
ccttctccatgactcc

SEQ ID NO: 494767 - DNA, 16 bp, R. norvegicus
ccttctcccaactctt

SEQ ID NO: 494768 - DNA, 16 bp, R. norvegicus
ccttctcctcagagga

SEQ ID NO: 494769 - DNA, 16 bp, R. norvegicus
ccttctcctctgagaa

SEQ ID NO: 494770 - DNA, 16 bp, R. norvegicus
ccttctctagtccctg

SEQ ID NO: 494771 - DNA, 16 bp, R. norvegicus
ccttctctgacctctg

SEQ ID NO: 494772 - DNA, 16 bp, R. norvegicus
ccttctctgagaagaa

SEQ ID NO: 494773 - DNA, 16 bp, R. norvegicus
ccttctcttcagcttc

SEQ ID NO: 494774 - DNA, 16 bp, R. norvegicus
ccttctcttctgagag

SEQ ID NO: 494775 - DNA, 16 bp, R. norvegicus
ccttctgagtgagatt

SEQ ID NO: 494776 - DNA, 19 bp, R. norvegicus
ccttctgcaaacaaggcag

SEQ ID NO: 494777 - DNA, 16 bp, R. norvegicus
ccttctgcagcaaagt

SEQ ID NO: 494778 - DNA, 16 bp, R. norvegicus
ccttctgcctcaacct

SEQ ID NO: 494779 - DNA, 16 bp, R. norvegicus
ccttctgcctcagtct

SEQ ID NO: 494780 - DNA, 16 bp, R. norvegicus
ccttctgcctcatcct

SEQ ID NO: 494781 - DNA, 16 bp, R. norvegicus
ccttctgcctgtgttc

SEQ ID NO: 494782 - DNA, 16 bp, R. norvegicus
ccttctgctcctgggc

SEQ ID NO: 494783 - DNA, 16 bp, R. norvegicus
ccttctgctctctgca

SEQ ID NO: 494784 - DNA, 16 bp, R. norvegicus
ccttctgctgcctgca

SEQ ID NO: 494785 - DNA, 16 bp, R. norvegicus
ccttctgctgcctgtg

SEQ ID NO: 494786 - DNA, 16 bp, R. norvegicus
ccttctgctggggatt

SEQ ID NO: 494787 - DNA, 16 bp, R. norvegicus
ccttctgctgtgtctg

SEQ ID NO: 494788 - DNA, 16 bp, R. norvegicus
ccttctgcttcaacct

SEQ ID NO: 494789 - DNA, 16 bp, R. norvegicus
ccttctgcttcctgag

SEQ ID NO: 494790 - DNA, 16 bp, R. norvegicus
ccttctgcttctattt

SEQ ID NO: 494791 - DNA, 16 bp, R. norvegicus
ccttctggcccaggat

SEQ ID NO: 494792 - DNA, 16 bp, R. norvegicus
ccttctggccttcatg

SEQ ID NO: 494793 - DNA, 16 bp, R. norvegicus
ccttctgggcagcccc

SEQ ID NO: 494794 - DNA, 16 bp, R. norvegicus
ccttctggtggcagcc

SEQ ID NO: 494795 - DNA, 16 bp, R. norvegicus
ccttcttaaagtcttc

SEQ ID NO: 494796 - DNA, 16 bp, R. norvegicus
ccttcttccacatcct

SEQ ID NO: 494797 - DNA, 16 bp, R. norvegicus
ccttcttctatgaggt

SEQ ID NO: 494798 - DNA, 16 bp, R. norvegicus
ccttcttctctgagaa

SEQ ID NO: 494799 - DNA, 16 bp, R. norvegicus
ccttcttcttgaattt

SEQ ID NO: 494800 - DNA, 16 bp, R. norvegicus
ccttcttgagtatcat

SEQ ID NO: 494801 - DNA, 16 bp, R. norvegicus
ccttcttgatgggtgt

SEQ ID NO: 494802 - DNA, 16 bp, R. norvegicus
ccttcttgttctccac

SEQ ID NO: 494803 - DNA, 16 bp, R. norvegicus
ccttcttttggcctct

SEQ ID NO: 494804 - DNA, 16 bp, R. norvegicus
ccttgaactcagagag

SEQ ID NO: 494805 - DNA, 16 bp, R. norvegicus
ccttgaactcctgatc

SEQ ID NO: 494806 - DNA, 16 bp, R. norvegicus
ccttgaactgacagag

SEQ ID NO: 494807 - DNA, 16 bp, R. norvegicus
ccttgaagaattggat

SEQ ID NO: 494808 - DNA, 16 bp, R. norvegicus
ccttgaattcacagag

SEQ ID NO: 494809 - DNA, 16 bp, R. norvegicus
ccttgaccctggggat

SEQ ID NO: 494810 - DNA, 16 bp, R. norvegicus
ccttgacctcaagcag

SEQ ID NO: 494811 - DNA, 16 bp, R. norvegicus
ccttgacctctctggc

SEQ ID NO: 494812 - DNA, 16 bp, R. norvegicus
ccttgactggcctgga

SEQ ID NO: 494813 - DNA, 16 bp, R. norvegicus
ccttgactgggcagca

SEQ ID NO: 494814 - DNA, 16 bp, R. norvegicus
ccttgagctgggtccc

SEQ ID NO: 494815 - DNA, 19 bp, R. norvegicus
ccttgagttcaccaggcag

SEQ ID NO: 494816 - DNA, 16 bp, R. norvegicus
ccttgagttgctgctc

SEQ ID NO: 494817 - DNA, 16 bp, R. norvegicus
ccttgatacctcatct

SEQ ID NO: 494818 - DNA, 16 bp, R. norvegicus
ccttgatcctgggaag

SEQ ID NO: 494819 - DNA, 16 bp, R. norvegicus
ccttgatgacactgga

SEQ ID NO: 494820 - DNA, 16 bp, R. norvegicus
ccttgatgatgatgga

SEQ ID NO: 494821 - DNA, 21 bp, R. norvegicus
ccttgatttttgacaaaggag

SEQ ID NO: 494822 - DNA, 16 bp, R. norvegicus
ccttgcaacctccccc

SEQ ID NO: 494823 - DNA, 16 bp, R. norvegicus
ccttgcagaggatctg

SEQ ID NO: 494824 - DNA, 16 bp, R. norvegicus
ccttgcagtctcagga

SEQ ID NO: 494825 - DNA, 16 bp, R. norvegicus
ccttgcatttggaaca

SEQ ID NO: 494826 - DNA, 16 bp, R. norvegicus
ccttgccaacactgta

SEQ ID NO: 494827 - DNA, 16 bp, R. norvegicus
ccttgccagggccttg

SEQ ID NO: 494828 - DNA, 16 bp, R. norvegicus
ccttgcctcaaacaaa

SEQ ID NO: 494829 - DNA, 16 bp, R. norvegicus
ccttgcctggcctgga

SEQ ID NO: 494830 - DNA, 16 bp, R. norvegicus
ccttgcctgggctggg

SEQ ID NO: 494831 - DNA, 16 bp, R. norvegicus
ccttgccttccacctt

SEQ ID NO: 494832 - DNA, 17 bp, R. norvegicus
ccttgcgcttcctaggt

SEQ ID NO: 494833 - DNA, 16 bp, R. norvegicus
ccttgctcagctcatg

SEQ ID NO: 494834 - DNA, 16 bp, R. norvegicus
ccttgctccagcctct

SEQ ID NO: 494835 - DNA, 16 bp, R. norvegicus
ccttgctgaaggaagt

SEQ ID NO: 494836 - DNA, 16 bp, R. norvegicus
ccttgctggagaaggt

SEQ ID NO: 494837 - DNA, 16 bp, R. norvegicus
ccttgctggtcttcat

SEQ ID NO: 494838 - DNA, 16 bp, R. norvegicus
ccttgctgtcctggaa

SEQ ID NO: 494839 - DNA, 16 bp, R. norvegicus
ccttgcttcctgccat

SEQ ID NO: 494840 - DNA, 16 bp, R. norvegicus
ccttgcttctcatcca

SEQ ID NO: 494841 - DNA, 16 bp, R. norvegicus
ccttgcttgcttcctt

SEQ ID NO: 494842 - DNA, 16 bp, R. norvegicus
ccttgctttgtgttcc

SEQ ID NO: 494843 - DNA, 16 bp, R. norvegicus
ccttggaactggagtt

SEQ ID NO: 494844 - DNA, 16 bp, R. norvegicus
ccttggagcagaagag

SEQ ID NO: 494845 - DNA, 16 bp, R. norvegicus
ccttggagctctgggg

SEQ ID NO: 494846 - DNA, 16 bp, R. norvegicus
ccttggcagagaggac

SEQ ID NO: 494847 - DNA, 16 bp, R. norvegicus
ccttggccatcctgga

SEQ ID NO: 494848 - DNA, 16 bp, R. norvegicus
ccttggccctgccaag

SEQ ID NO: 494849 - DNA, 16 bp, R. norvegicus
ccttggccctgtgaaa

SEQ ID NO: 494850 - DNA, 16 bp, R. norvegicus
ccttggcctctgcatc

SEQ ID NO: 494851 - DNA, 22 bp, R. norvegicus
ccttggcctgtgtaaatgtttc

SEQ ID NO: 494852 - DNA, 16 bp, R. norvegicus
ccttggctacacagag

SEQ ID NO: 494853 - DNA, 16 bp, R. norvegicus
ccttggctggcctcag

SEQ ID NO: 494854 - DNA, 16 bp, R. norvegicus
ccttggctggcttgga

SEQ ID NO: 494855 - DNA, 16 bp, R. norvegicus
ccttgggaactctggg

SEQ ID NO: 494856 - DNA, 16 bp, R. norvegicus
ccttgggaagcagagg

SEQ ID NO: 494857 - DNA, 46 bp, R. norvegicus
ccttgggaaggatttgttgaggctatagtatttgtcctgggagcca

SEQ ID NO: 494858 - DNA, 16 bp, R. norvegicus
ccttgggaccagtgaa

SEQ ID NO: 494859 - DNA, 16 bp, R. norvegicus
ccttgggatgtctgca

SEQ ID NO: 494860 - DNA, 16 bp, R. norvegicus
ccttgggcaagtcact

SEQ ID NO: 494861 - DNA, 16 bp, R. norvegicus
ccttgggcactccaga

SEQ ID NO: 494862 - DNA, 16 bp, R. norvegicus
ccttgggggagagagc

SEQ ID NO: 494863 - DNA, 16 bp, R. norvegicus
ccttgggggttgggga

SEQ ID NO: 494864 - DNA, 16 bp, R. norvegicus
ccttgggtcaaggcta

SEQ ID NO: 494865 - DNA, 16 bp, R. norvegicus
ccttggtcctgtcagg

SEQ ID NO: 494866 - DNA, 16 bp, R. norvegicus
ccttggtcctgtgaag

SEQ ID NO: 494867 - DNA, 16 bp, R. norvegicus
ccttggtgatgcagct

SEQ ID NO: 494868 - DNA, 16 bp, R. norvegicus
ccttggtggtaaccaa

SEQ ID NO: 494869 - DNA, 16 bp, R. norvegicus
ccttggtttcctcatc

SEQ ID NO: 494870 - DNA, 16 bp, R. norvegicus
ccttgtatgctctttg

SEQ ID NO: 494871 - DNA, 16 bp, R. norvegicus
ccttgtcagacatcaa

SEQ ID NO: 494872 - DNA, 16 bp, R. norvegicus
ccttgtccagtccctg

SEQ ID NO: 494873 - DNA, 16 bp, R. norvegicus
ccttgtctaaaaacaa

SEQ ID NO: 494874 - DNA, 16 bp, R. norvegicus
ccttgtctcaaaacaa

SEQ ID NO: 494875 - DNA, 16 bp, R. norvegicus
ccttgtctcatccctg

SEQ ID NO: 494876 - DNA, 16 bp, R. norvegicus
ccttgtctccacaagg

SEQ ID NO: 494877 - DNA, 16 bp, R. norvegicus
ccttgtcttgaaaaat

SEQ ID NO: 494878 - DNA, 16 bp, R. norvegicus
ccttgtgcatgccagg

SEQ ID NO: 494879 - DNA, 16 bp, R. norvegicus
ccttgtgcatgttagg

SEQ ID NO: 494880 - DNA, 16 bp, R. norvegicus
ccttgtgcctgccctc

SEQ ID NO: 494881 - DNA, 16 bp, R. norvegicus
ccttgtgtctgtgaaa

SEQ ID NO: 494882 - DNA, 16 bp, R. norvegicus
ccttgttggaaaaagt

SEQ ID NO: 494883 - DNA, 16 bp, R. norvegicus
ccttgttggacatcaa

SEQ ID NO: 494884 - DNA, 16 bp, R. norvegicus
ccttgttgtagtaggt

SEQ ID NO: 494885 - DNA, 16 bp, R. norvegicus
cctttaaagaaaactg

SEQ ID NO: 494886 - DNA, 16 bp, R. norvegicus
cctttaaccaagcaag

SEQ ID NO: 494887 - DNA, 16 bp, R. norvegicus
cctttaaccccaacac

SEQ ID NO: 494888 - DNA, 16 bp, R. norvegicus
cctttaagaggtgggg

SEQ ID NO: 494889 - DNA, 16 bp, R. norvegicus
cctttaatcccaccac

SEQ ID NO: 494890 - DNA, 16 bp, R. norvegicus
cctttaatcccagcag

SEQ ID NO: 494891 - DNA, 16 bp, R. norvegicus
cctttaatcctaatac

SEQ ID NO: 494892 - DNA, 16 bp, R. norvegicus
cctttaattcctgcac

SEQ ID NO: 494893 - DNA, 16 bp, R. norvegicus
cctttaattttgttta

SEQ ID NO: 494894 - DNA, 16 bp, R. norvegicus
cctttacctctatgag

SEQ ID NO: 494895 - DNA, 16 bp, R. norvegicus
cctttacctgtttgat

SEQ ID NO: 494896 - DNA, 16 bp, R. norvegicus
cctttagaagagcagc

SEQ ID NO: 494897 - DNA, 16 bp, R. norvegicus
cctttatcccagcact

SEQ ID NO: 494898 - DNA, 16 bp, R. norvegicus
cctttatttcctttgt

SEQ ID NO: 494899 - DNA, 16 bp, R. norvegicus
cctttcaccatcagct

SEQ ID NO: 494900 - DNA, 16 bp, R. norvegicus
cctttcagaggagaag

SEQ ID NO: 494901 - DNA, 16 bp, R. norvegicus
cctttcattatgtgtg

SEQ ID NO: 494902 - DNA, 16 bp, R. norvegicus
cctttcattgtctgat

SEQ ID NO: 494903 - DNA, 16 bp, R. norvegicus
cctttcccagaagcca

SEQ ID NO: 494904 - DNA, 16 bp, R. norvegicus
cctttcccaggggtca

SEQ ID NO: 494905 - DNA, 16 bp, R. norvegicus
cctttcccagtttaca

SEQ ID NO: 494906 - DNA, 16 bp, R. norvegicus
cctttcctcttcaagt

SEQ ID NO: 494907 - DNA, 16 bp, R. norvegicus
cctttcctggcttccc

SEQ ID NO: 494908 - DNA, 16 bp, R. norvegicus
cctttcctggtttcct

SEQ ID NO: 494909 - DNA, 16 bp, R. norvegicus
cctttccttcttaaag

SEQ ID NO: 494910 - DNA, 16 bp, R. norvegicus
cctttctccagttctt

SEQ ID NO: 494911 - DNA, 16 bp, R. norvegicus
cctttctgctccttca

SEQ ID NO: 494912 - DNA, 16 bp, R. norvegicus
cctttctgctggaggt

SEQ ID NO: 494913 - DNA, 16 bp, R. norvegicus
cctttctggtgtcctg

SEQ ID NO: 494914 - DNA, 16 bp, R. norvegicus
cctttctgtcagtgac

SEQ ID NO: 494915 - DNA, 16 bp, R. norvegicus
cctttcttcagaggct

SEQ ID NO: 494916 - DNA, 16 bp, R. norvegicus
cctttgaaacttcaaa

SEQ ID NO: 494917 - DNA, 16 bp, R. norvegicus
cctttgaataaaatgt

SEQ ID NO: 494918 - DNA, 16 bp, R. norvegicus
cctttgacctgggttt

SEQ ID NO: 494919 - DNA, 16 bp, R. norvegicus
cctttgactccttttt

SEQ ID NO: 494920 - DNA, 16 bp, R. norvegicus
cctttgataaaataca

SEQ ID NO: 494921 - DNA, 16 bp, R. norvegicus
cctttgatcccagcag

SEQ ID NO: 494922 - DNA, 16 bp, R. norvegicus
cctttgatgaatttga

SEQ ID NO: 494923 - DNA, 16 bp, R. norvegicus
cctttgatgagcatga

SEQ ID NO: 494924 - DNA, 16 bp, R. norvegicus
cctttgattccagcac

SEQ ID NO: 494925 - DNA, 16 bp, R. norvegicus
cctttgcccacatcct

SEQ ID NO: 494926 - DNA, 16 bp, R. norvegicus
cctttgcccatttgga

SEQ ID NO: 494927 - DNA, 16 bp, R. norvegicus
cctttgcctctgctcc

SEQ ID NO: 494928 - DNA, 16 bp, R. norvegicus
cctttgctccccaagt

SEQ ID NO: 494929 - DNA, 16 bp, R. norvegicus
cctttgctgaaggtgt

SEQ ID NO: 494930 - DNA, 16 bp, R. norvegicus
cctttgcttctgagag

SEQ ID NO: 494931 - DNA, 16 bp, R. norvegicus
cctttgcttctgcctc

SEQ ID NO: 494932 - DNA, 16 bp, R. norvegicus
cctttgcttgcctctt

SEQ ID NO: 494933 - DNA, 16 bp, R. norvegicus
cctttggaaaagcagc

SEQ ID NO: 494934 - DNA, 16 bp, R. norvegicus
cctttggaacaagatg

SEQ ID NO: 494935 - DNA, 16 bp, R. norvegicus
cctttggatccagatg

SEQ ID NO: 494936 - DNA, 16 bp, R. norvegicus
cctttggcaacagcat

SEQ ID NO: 494937 - DNA, 16 bp, R. norvegicus
cctttggtcaacaact

SEQ ID NO: 494938 - DNA, 16 bp, R. norvegicus
cctttgtcactgaggt

SEQ ID NO: 494939 - DNA, 16 bp, R. norvegicus
cctttgtcatcaggga

SEQ ID NO: 494940 - DNA, 16 bp, R. norvegicus
cctttgtccagaggca

SEQ ID NO: 494941 - DNA, 16 bp, R. norvegicus
cctttgtgattacttt

SEQ ID NO: 494942 - DNA, 16 bp, R. norvegicus
cctttgtgctgtcttt

SEQ ID NO: 494943 - DNA, 16 bp, R. norvegicus
cctttgttcaatttcc

SEQ ID NO: 494944 - DNA, 16 bp, R. norvegicus
ccttttaacacagttc

SEQ ID NO: 494945 - DNA, 16 bp, R. norvegicus
ccttttaagaaagact

SEQ ID NO: 494946 - DNA, 16 bp, R. norvegicus
ccttttaagaagaact

SEQ ID NO: 494947 - DNA, 16 bp, R. norvegicus
ccttttactctgagga

SEQ ID NO: 494948 - DNA, 16 bp, R. norvegicus
ccttttattggatatt

SEQ ID NO: 494949 - DNA, 16 bp, R. norvegicus
ccttttcccagaggcc

SEQ ID NO: 494950 - DNA, 16 bp, R. norvegicus
ccttttcccaggcagc

SEQ ID NO: 494951 - DNA, 16 bp, R. norvegicus
ccttttccccacccaa

SEQ ID NO: 494952 - DNA, 16 bp, R. norvegicus
ccttttctcttacaaa

SEQ ID NO: 494953 - DNA, 16 bp, R. norvegicus
ccttttctcttgcagc

SEQ ID NO: 494954 - DNA, 16 bp, R. norvegicus
ccttttctgaggagaa

SEQ ID NO: 494955 - DNA, 16 bp, R. norvegicus
ccttttctgctctcag

SEQ ID NO: 494956 - DNA, 16 bp, R. norvegicus
ccttttctggacagta

SEQ ID NO: 494957 - DNA, 16 bp, R. norvegicus
ccttttctggcttcag

SEQ ID NO: 494958 - DNA, 16 bp, R. norvegicus
ccttttgcaggaagga

SEQ ID NO: 494959 - DNA, 16 bp, R. norvegicus
ccttttgctttagggt

SEQ ID NO: 494960 - DNA, 16 bp, R. norvegicus
ccttttggagatgggg

SEQ ID NO: 494961 - DNA, 16 bp, R. norvegicus
ccttttggggtttatt

SEQ ID NO: 494962 - DNA, 16 bp, R. norvegicus
ccttttgggtctgtgt

SEQ ID NO: 494963 - DNA, 16 bp, R. norvegicus
cctttttaaaaattgt

SEQ ID NO: 494964 - DNA, 16 bp, R. norvegicus
cctttttttaaaaaaa

SEQ ID NO: 494965 - DNA, 16 bp, R. norvegicus
cgaaatggacaatttc

SEQ ID NO: 494966 - DNA, 17 bp, R. norvegicus
cgaatatgaagtgtcct

SEQ ID NO: 494967 - DNA, 16 bp, R. norvegicus
cgacagaaactatgaa

SEQ ID NO: 494968 - DNA, 16 bp, R. norvegicus
cgagagagcgagagcg

SEQ ID NO: 494969 - DNA, 16 bp, R. norvegicus
cgagaggctgaggcag

SEQ ID NO: 494970 - DNA, 16 bp, R. norvegicus
cgagcaaacttgagac

SEQ ID NO: 494971 - DNA, 16 bp, R. norvegicus
cgagcgcaaggctctg

SEQ ID NO: 494972 - DNA, 16 bp, R. norvegicus
cgagctcccagggact

SEQ ID NO: 494973 - DNA, 16 bp, R. norvegicus
cgagctgatcttaaag

SEQ ID NO: 494974 - DNA, 16 bp, R. norvegicus
cgaggaggcagaggca

SEQ ID NO: 494975 - DNA, 16 bp, R. norvegicus
cgagggcacctacata

SEQ ID NO: 494976 - DNA, 16 bp, R. norvegicus
cgagggctgccagagc

SEQ ID NO: 494977 - DNA, 16 bp, R. norvegicus
cgagggctggagagat

SEQ ID NO: 494978 - DNA, 16 bp, R. norvegicus
cgagtcaaacgctcag

SEQ ID NO: 494979 - DNA, 16 bp, R. norvegicus
cgagtccattgatgtt

SEQ ID NO: 494980 - DNA, 16 bp, R. norvegicus
cgagtgccaccaaggc

SEQ ID NO: 494981 - DNA, 16 bp, R. norvegicus
cgagtgctgggactaa

SEQ ID NO: 494982 - DNA, 16 bp, R. norvegicus
cgagttcaaggccagc

SEQ ID NO: 494983 - DNA, 16 bp, R. norvegicus
cgataaggccatcctc

SEQ ID NO: 494984 - DNA, 16 bp, R. norvegicus
cgatcatgtggttttt

SEQ ID NO: 494985 - DNA, 16 bp, R. norvegicus
cgatgaaggattcttt

SEQ ID NO: 494986 - DNA, 16 bp, R. norvegicus
cgatgatgatgatgac

SEQ ID NO: 494987 - DNA, 16 bp, R. norvegicus
cgatggtgatggtgat

SEQ ID NO: 494988 - DNA, 16 bp, R. norvegicus
cgattttctgaggaac

SEQ ID NO: 494989 - DNA, 16 bp, R. norvegicus
cgcaagggtgtgttcg

SEQ ID NO: 494990 - DNA, 16 bp, R. norvegicus
cgcaatgaggaccctg

SEQ ID NO: 494991 - DNA, 16 bp, R. norvegicus
cgcacacacacaggca

SEQ ID NO: 494992 - DNA, 16 bp, R. norvegicus
cgcacacacatacaca

SEQ ID NO: 494993 - DNA, 16 bp, R. norvegicus
cgcacgcacacacaca

SEQ ID NO: 494994 - DNA, 16 bp, R. norvegicus
cgcacgcacatgcacg

SEQ ID NO: 494995 - DNA, 16 bp, R. norvegicus
cgcacgcacgtgcaca

SEQ ID NO: 494996 - DNA, 21 bp, R. norvegicus
cgcaggaaataatcaaactca

SEQ ID NO: 494997 - DNA, 16 bp, R. norvegicus
cgcaggcccacaggaa

SEQ ID NO: 494998 - DNA, 16 bp, R. norvegicus
cgcagtggaagccagc

SEQ ID NO: 494999 - DNA, 16 bp, R. norvegicus
cgcatgaacacacaca

SEQ ID NO: 495000 - DNA, 16 bp, R. norvegicus
cgccaacatccagcct

SEQ ID NO: 495001 - DNA, 16 bp, R. norvegicus
cgccactgccaccacc

SEQ ID NO: 495002 - DNA, 16 bp, R. norvegicus
cgccatcaccaccacc

SEQ ID NO: 495003 - DNA, 22 bp, R. norvegicus
cgccattcggcattcctcagct

SEQ ID NO: 495004 - DNA, 16 bp, R. norvegicus
cgcccacctcggccag

SEQ ID NO: 495005 - DNA, 17 bp, R. norvegicus
cgcccagcagctccagc

SEQ ID NO: 495006 - DNA, 16 bp, R. norvegicus
cgcccatccttccttc

SEQ ID NO: 495007 - DNA, 18 bp, R. norvegicus
cgccgccgctgctgctgc

SEQ ID NO: 495008 - DNA, 16 bp, R. norvegicus
cgcctcaccatcgccg

SEQ ID NO: 495009 - DNA, 16 bp, R. norvegicus
cgcctctgcctctgcc

SEQ ID NO: 495010 - DNA, 16 bp, R. norvegicus
cgcctctggattcctg

SEQ ID NO: 495011 - DNA, 16 bp, R. norvegicus
cgcctgggagaccaga

SEQ ID NO: 495012 - DNA, 16 bp, R. norvegicus
cgcctgtgtctgcttc

SEQ ID NO: 495013 - DNA, 16 bp, R. norvegicus
cgcgacctcgccagca

SEQ ID NO: 495014 - DNA, 16 bp, R. norvegicus
cgcgcacgcacgcgcg

SEQ ID NO: 495015 - DNA, 16 bp, R. norvegicus
cgcgcgcgcgctcaca

SEQ ID NO: 495016 - DNA, 16 bp, R. norvegicus
cgcgcgtgcacgcgca

SEQ ID NO: 495017 - DNA, 16 bp, R. norvegicus
cgcgtgcgcgcgcgca

SEQ ID NO: 495018 - DNA, 16 bp, R. norvegicus
cgcgtgtgcacacaca

SEQ ID NO: 495019 - DNA, 16 bp, R. norvegicus
cgctcagccatctctc

SEQ ID NO: 495020 - DNA, 17 bp, R. norvegicus
cgctccactatgttcat

SEQ ID NO: 495021 - DNA, 16 bp, R. norvegicus
cgctccagtctcctcc

SEQ ID NO: 495022 - DNA, 16 bp, R. norvegicus
cgctcctgagccctcc

SEQ ID NO: 495023 - DNA, 16 bp, R. norvegicus
cgctcgctaggcaagc

SEQ ID NO: 495024 - DNA, 16 bp, R. norvegicus
cgctctctctgtctct

SEQ ID NO: 495025 - DNA, 16 bp, R. norvegicus
cgctgccaccaccacc

SEQ ID NO: 495026 - DNA, 16 bp, R. norvegicus
cgctgccatgctccca

SEQ ID NO: 495027 - DNA, 16 bp, R. norvegicus
cgctggctgctcttcc

SEQ ID NO: 495028 - DNA, 16 bp, R. norvegicus
cgcttacctaggaagc

SEQ ID NO: 495029 - DNA, 16 bp, R. norvegicus
cgcttcctagggaagc

SEQ ID NO: 495030 - DNA, 16 bp, R. norvegicus
cgcttgcccaggaagc

SEQ ID NO: 495031 - DNA, 16 bp, R. norvegicus
cgcttgcctagcaacc

SEQ ID NO: 495032 - DNA, 16 bp, R. norvegicus
cgcttgcctagcaagc

SEQ ID NO: 495033 - DNA, 16 bp, R. norvegicus
cgcttgcctagcaatc

SEQ ID NO: 495034 - DNA, 16 bp, R. norvegicus
cgcttgcctaggaagc

SEQ ID NO: 495035 - DNA, 16 bp, R. norvegicus
cgcttggagctggaag

SEQ ID NO: 495036 - DNA, 16 bp, R. norvegicus
cgctttgctacagaag

SEQ ID NO: 495037 - DNA, 16 bp, R. norvegicus
cggaaaaagcaactgg

SEQ ID NO: 495038 - DNA, 16 bp, R. norvegicus
cggaaatcaaccaagt

SEQ ID NO: 495039 - DNA, 16 bp, R. norvegicus
cggaagaccccagtgt

SEQ ID NO: 495040 - DNA, 16 bp, R. norvegicus
cggaagagactaccaa

SEQ ID NO: 495041 - DNA, 16 bp, R. norvegicus
cggacggacagacgga

SEQ ID NO: 495042 - DNA, 16 bp, R. norvegicus
cggagaaagaggaata

SEQ ID NO: 495043 - DNA, 17 bp, R. norvegicus
cggagacataactacag

SEQ ID NO: 495044 - DNA, 16 bp, R. norvegicus
cggagctctgagctct

SEQ ID NO: 495045 - DNA, 23 bp, R. norvegicus
cggagctggggaccgaacccaga

SEQ ID NO: 495046 - DNA, 16 bp, R. norvegicus
cggatggagccatagg

SEQ ID NO: 495047 - DNA, 16 bp, R. norvegicus
cggcaccacagtgccc

SEQ ID NO: 495048 - DNA, 16 bp, R. norvegicus
cggcactctgcacaca

SEQ ID NO: 495049 - DNA, 16 bp, R. norvegicus
cggcagcggcggcagc

SEQ ID NO: 495050 - DNA, 17 bp, R. norvegicus
cggcaggacccctgcca

SEQ ID NO: 495051 - DNA, 17 bp, R. norvegicus
cggcatcatcagagccc

SEQ ID NO: 495052 - DNA, 16 bp, R. norvegicus
cggcatttctcagctg

SEQ ID NO: 495053 - DNA, 16 bp, R. norvegicus
cggccagcagcagctc

SEQ ID NO: 495054 - DNA, 16 bp, R. norvegicus
cggcctcaactcccca

SEQ ID NO: 495055 - DNA, 16 bp, R. norvegicus
cggcctctactcctct

SEQ ID NO: 495056 - DNA, 16 bp, R. norvegicus
cggcgcgcggggcttc

SEQ ID NO: 495057 - DNA, 16 bp, R. norvegicus
cggcggcagcaaccgg

SEQ ID NO: 495058 - DNA, 17 bp, R. norvegicus
cggcggcagcagcagca

SEQ ID NO: 495059 - DNA, 16 bp, R. norvegicus
cggctacagcatttgc

SEQ ID NO: 495060 - DNA, 16 bp, R. norvegicus
cggctcctccagcacc

SEQ ID NO: 495061 - DNA, 19 bp, R. norvegicus
cggctcctttcgagtgggc

SEQ ID NO: 495062 - DNA, 16 bp, R. norvegicus
cgggaaagaacccaga

SEQ ID NO: 495063 - DNA, 16 bp, R. norvegicus
cgggcaacttcctctg

SEQ ID NO: 495064 - DNA, 16 bp, R. norvegicus
cgggcacatctcaggc

SEQ ID NO: 495065 - DNA, 16 bp, R. norvegicus
cgggctcctgtcagca

SEQ ID NO: 495066 - DNA, 16 bp, R. norvegicus
cgggctggtgggcccc

SEQ ID NO: 495067 - DNA, 27 bp, R. norvegicus
cggggctggggatttagctcagtggta

SEQ ID NO: 495068 - DNA, 17 bp, R. norvegicus
cggggtagtcaggagga

SEQ ID NO: 495069 - DNA, 16 bp, R. norvegicus
cggggtccgggagcag

SEQ ID NO: 495070 - DNA, 16 bp, R. norvegicus
cggtagagtgcttgcc

SEQ ID NO: 495071 - DNA, 16 bp, R. norvegicus
cggtcattcagagcct

SEQ ID NO: 495072 - DNA, 16 bp, R. norvegicus
cggtgatggtggtggt

SEQ ID NO: 495073 - DNA, 16 bp, R. norvegicus
cggtgcacacctgtaa

SEQ ID NO: 495074 - DNA, 16 bp, R. norvegicus
cggtggctcacaacca

SEQ ID NO: 495075 - DNA, 16 bp, R. norvegicus
cggtgttttatcacag

SEQ ID NO: 495076 - DNA, 21 bp, R. norvegicus
cggttaagagcacccgactac

SEQ ID NO: 495077 - DNA, 16 bp, R. norvegicus
cggttcctgtctgcct

SEQ ID NO: 495078 - DNA, 16 bp, R. norvegicus
cggttctttccagttt

SEQ ID NO: 495079 - DNA, 16 bp, R. norvegicus
cggtttcccaggcttg

SEQ ID NO: 495080 - DNA, 16 bp, R. norvegicus
cgtagagaaactaaca

SEQ ID NO: 495081 - DNA, 16 bp, R. norvegicus
cgtagtcaagctgctc

SEQ ID NO: 495082 - DNA, 18 bp, R. norvegicus
cgtatagctggatcctca

SEQ ID NO: 495083 - DNA, 16 bp, R. norvegicus
cgtatgtctttctgtg

SEQ ID NO: 495084 - DNA, 34 bp, R. norvegicus
cgtcccagagccaggacccaacaaaggctgactc

SEQ ID NO: 495085 - DNA, 16 bp, R. norvegicus
cgtccgtccgtctgtc

SEQ ID NO: 495086 - DNA, 16 bp, R. norvegicus
cgtccgtctgtccgtc

SEQ ID NO: 495087 - DNA, 16 bp, R. norvegicus
cgtctgtccgtctgtc

SEQ ID NO: 495088 - DNA, 16 bp, R. norvegicus
cgtgagtatttcttat

SEQ ID NO: 495089 - DNA, 16 bp, R. norvegicus
cgtgcacacatgcatg

SEQ ID NO: 495090 - DNA, 17 bp, R. norvegicus
cgtgcagaattctatca

SEQ ID NO: 495091 - DNA, 16 bp, R. norvegicus
cgtgcgcacacacaca

SEQ ID NO: 495092 - DNA, 16 bp, R. norvegicus
cgtgcgtgcgtgtgcg

SEQ ID NO: 495093 - DNA, 16 bp, R. norvegicus
cgtgctgtctgctgcc

SEQ ID NO: 495094 - DNA, 16 bp, R. norvegicus
cgtggacattctggaa

SEQ ID NO: 495095 - DNA, 16 bp, R. norvegicus
cgtggactgaccctgg

SEQ ID NO: 495096 - DNA, 16 bp, R. norvegicus
cgtggcagcaggcagg

SEQ ID NO: 495097 - DNA, 16 bp, R. norvegicus
cgtgggaccacaggta

SEQ ID NO: 495098 - DNA, 16 bp, R. norvegicus
cgtgggtgttgggaac

SEQ ID NO: 495099 - DNA, 16 bp, R. norvegicus
cgtggtcctgtgaagg

SEQ ID NO: 495100 - DNA, 24 bp, R. norvegicus
cgtgtctcttttatatgttgaggc

SEQ ID NO: 495101 - DNA, 16 bp, R. norvegicus
cgtgtctttgttgtac

SEQ ID NO: 495102 - DNA, 16 bp, R. norvegicus
cgtgtgccaccaccac

SEQ ID NO: 495103 - DNA, 16 bp, R. norvegicus
cgtgtgtgcatgtgtg

SEQ ID NO: 495104 - DNA, 16 bp, R. norvegicus
cgtgtgtgcgtgtgtg

SEQ ID NO: 495105 - DNA, 16 bp, R. norvegicus
cgtgtgtgtgcgtgtg

SEQ ID NO: 495106 - DNA, 16 bp, R. norvegicus
cgtgttcacagaagag

SEQ ID NO: 495107 - DNA, 16 bp, R. norvegicus
cgtgttttcttgctgg

SEQ ID NO: 495108 - DNA, 16 bp, R. norvegicus
cgttgttgtacttttg

SEQ ID NO: 495109 - DNA, 16 bp, R. norvegicus
cgttttttgaacaatt

SEQ ID NO: 495110 - DNA, 16 bp, R. norvegicus
cgttttttgaccattt

SEQ ID NO: 495111 - DNA, 16 bp, R. norvegicus
ctaaaaatgcaactaa

SEQ ID NO: 495112 - DNA, 16 bp, R. norvegicus
ctaaaacaatcctaaa

SEQ ID NO: 495113 - DNA, 16 bp, R. norvegicus
ctaaaactccagttcc

SEQ ID NO: 495114 - DNA, 16 bp, R. norvegicus
ctaaaactggttttca

SEQ ID NO: 495115 - DNA, 16 bp, R. norvegicus
ctaaaagaagagaaac

SEQ ID NO: 495116 - DNA, 16 bp, R. norvegicus
ctaaaaggctcagtga

SEQ ID NO: 495117 - DNA, 16 bp, R. norvegicus
ctaaaagggagacagc

SEQ ID NO: 495118 - DNA, 16 bp, R. norvegicus
ctaaaagtggaaatag

SEQ ID NO: 495119 - DNA, 16 bp, R. norvegicus
ctaaaatgaattccct

SEQ ID NO: 495120 - DNA, 16 bp, R. norvegicus
ctaaaatgcagatgct

SEQ ID NO: 495121 - DNA, 16 bp, R. norvegicus
ctaaacaaaatatttt

SEQ ID NO: 495122 - DNA, 16 bp, R. norvegicus
ctaaacactgtccagg

SEQ ID NO: 495123 - DNA, 16 bp, R. norvegicus
ctaaaccaccaaccag

SEQ ID NO: 495124 - DNA, 16 bp, R. norvegicus
ctaaaccagtggttct

SEQ ID NO: 495125 - DNA, 16 bp, R. norvegicus
ctaaacctacacacca

SEQ ID NO: 495126 - DNA, 16 bp, R. norvegicus
ctaaacctacagaggg

SEQ ID NO: 495127 - DNA, 16 bp, R. norvegicus
ctaaagaaaatgttca

SEQ ID NO: 495128 - DNA, 16 bp, R. norvegicus
ctaaagaaatgttgaa

SEQ ID NO: 495129 - DNA, 16 bp, R. norvegicus
ctaaagaaattgaagc

SEQ ID NO: 495130 - DNA, 16 bp, R. norvegicus
ctaaagcagacacatg

SEQ ID NO: 495131 - DNA, 16 bp, R. norvegicus
ctaaagctgacaaaca

SEQ ID NO: 495132 - DNA, 16 bp, R. norvegicus
ctaaaggaaatgcagg

SEQ ID NO: 495133 - DNA, 16 bp, R. norvegicus
ctaaaggagctgaaga

SEQ ID NO: 495134 - DNA, 16 bp, R. norvegicus
ctaaaggcaaacagga

SEQ ID NO: 495135 - DNA, 16 bp, R. norvegicus
ctaaagtcatctgaga

SEQ ID NO: 495136 - DNA, 16 bp, R. norvegicus
ctaaagtcctgaaagc

SEQ ID NO: 495137 - DNA, 16 bp, R. norvegicus
ctaaataaagaatttt

SEQ ID NO: 495138 - DNA, 16 bp, R. norvegicus
ctaaatacaagggcac

SEQ ID NO: 495139 - DNA, 16 bp, R. norvegicus
ctaaatacctggccac

SEQ ID NO: 495140 - DNA, 16 bp, R. norvegicus
ctaaatcacacaaaga

SEQ ID NO: 495141 - DNA, 16 bp, R. norvegicus
ctaaatccaaaaaggg

SEQ ID NO: 495142 - DNA, 16 bp, R. norvegicus
ctaaatccccaaccct

SEQ ID NO: 495143 - DNA, 16 bp, R. norvegicus
ctaaatccccagcccg

SEQ ID NO: 495144 - DNA, 16 bp, R. norvegicus
ctaaatccccagcctc

SEQ ID NO: 495145 - DNA, 16 bp, R. norvegicus
ctaaatgaaaagaaac

SEQ ID NO: 495146 - DNA, 16 bp, R. norvegicus
ctaaatgggatgtctt

SEQ ID NO: 495147 - DNA, 16 bp, R. norvegicus
ctaacacatctaagca

SEQ ID NO: 495148 - DNA, 16 bp, R. norvegicus
ctaacaccagagacaa

SEQ ID NO: 495149 - DNA, 16 bp, R. norvegicus
ctaacactagagacca

SEQ ID NO: 495150 - DNA, 16 bp, R. norvegicus
ctaacactagagataa

SEQ ID NO: 495151 - DNA, 16 bp, R. norvegicus
ctaacagaagaaaaat

SEQ ID NO: 495152 - DNA, 16 bp, R. norvegicus
ctaacagactggatag

SEQ ID NO: 495153 - DNA, 16 bp, R. norvegicus
ctaacagcaggaacag

SEQ ID NO: 495154 - DNA, 30 bp, R. norvegicus
ctaacagtaaatccaatgtatagaccaaca

SEQ ID NO: 495155 - DNA, 16 bp, R. norvegicus
ctaacagtggggacat

SEQ ID NO: 495156 - DNA, 16 bp, R. norvegicus
ctaacatatacaaaga

SEQ ID NO: 495157 - DNA, 16 bp, R. norvegicus
ctaacatcaaatgggg

SEQ ID NO: 495158 - DNA, 16 bp, R. norvegicus
ctaacatcagagacaa

SEQ ID NO: 495159 - DNA, 16 bp, R. norvegicus
ctaacatgcatgaagc

SEQ ID NO: 495160 - DNA, 16 bp, R. norvegicus
ctaaccaagcatgtga

SEQ ID NO: 495161 - DNA, 16 bp, R. norvegicus
ctaaccattggactga

SEQ ID NO: 495162 - DNA, 16 bp, R. norvegicus
ctaacctagaaaaaga

SEQ ID NO: 495163 - DNA, 16 bp, R. norvegicus
ctaacctggtctacat

SEQ ID NO: 495164 - DNA, 16 bp, R. norvegicus
ctaactactccctgga

SEQ ID NO: 495165 - DNA, 16 bp, R. norvegicus
ctaactactgagccat

SEQ ID NO: 495166 - DNA, 16 bp, R. norvegicus
ctaactcttccattag

SEQ ID NO: 495167 - DNA, 16 bp, R. norvegicus
ctaactgtctgaagaa

SEQ ID NO: 495168 - DNA, 16 bp, R. norvegicus
ctaagaaaatgtccta

SEQ ID NO: 495169 - DNA, 16 bp, R. norvegicus
ctaagaaagagaccag

SEQ ID NO: 495170 - DNA, 16 bp, R. norvegicus
ctaagaaattagctgt

SEQ ID NO: 495171 - DNA, 16 bp, R. norvegicus
ctaagaaattagtggt

SEQ ID NO: 495172 - DNA, 16 bp, R. norvegicus
ctaagaagaaagtata

SEQ ID NO: 495173 - DNA, 16 bp, R. norvegicus
ctaagaatttctttaa

SEQ ID NO: 495174 - DNA, 16 bp, R. norvegicus
ctaagacagaagcaga

SEQ ID NO: 495175 - DNA, 16 bp, R. norvegicus
ctaagactgaacgccc

SEQ ID NO: 495176 - DNA, 16 bp, R. norvegicus
ctaagagaaaagttca

SEQ ID NO: 495177 - DNA, 16 bp, R. norvegicus
ctaagagaagaaaaat

SEQ ID NO: 495178 - DNA, 16 bp, R. norvegicus
ctaagagaagtcatgg

SEQ ID NO: 495179 - DNA, 16 bp, R. norvegicus
ctaagagagcaagctg

SEQ ID NO: 495180 - DNA, 16 bp, R. norvegicus
ctaagagatccctaga

SEQ ID NO: 495181 - DNA, 16 bp, R. norvegicus
ctaagagcaggagaaa

SEQ ID NO: 495182 - DNA, 20 bp, R. norvegicus
ctaagatcaaaaactcaggc

SEQ ID NO: 495183 - DNA, 16 bp, R. norvegicus
ctaagatcaaaaactt

SEQ ID NO: 495184 - DNA, 16 bp, R. norvegicus
ctaagatcactgcctc

SEQ ID NO: 495185 - DNA, 16 bp, R. norvegicus
ctaagcagctgacaaa

SEQ ID NO: 495186 - DNA, 16 bp, R. norvegicus
ctaagctacagagtga

SEQ ID NO: 495187 - DNA, 16 bp, R. norvegicus
ctaaggaaatagaaga

SEQ ID NO: 495188 - DNA, 16 bp, R. norvegicus
ctaaggaaattaaaaa

SEQ ID NO: 495189 - DNA, 16 bp, R. norvegicus
ctaaggaagttcttca

SEQ ID NO: 495190 - DNA, 16 bp, R. norvegicus
ctaaggacatagaagc

SEQ ID NO: 495191 - DNA, 16 bp, R. norvegicus
ctaaggagacagaggc

SEQ ID NO: 495192 - DNA, 16 bp, R. norvegicus
ctaaggaggaggacaa

SEQ ID NO: 495193 - DNA, 16 bp, R. norvegicus
ctaaggctctggcaga

SEQ ID NO: 495194 - DNA, 16 bp, R. norvegicus
ctaagtaacaaggagg

SEQ ID NO: 495195 - DNA, 16 bp, R. norvegicus
ctaagtgctgagatta

SEQ ID NO: 495196 - DNA, 16 bp, R. norvegicus
ctaagtgggactgagg

SEQ ID NO: 495197 - DNA, 16 bp, R. norvegicus
ctaatactaatactgt

SEQ ID NO: 495198 - DNA, 16 bp, R. norvegicus
ctaatagaaaaaagtg

SEQ ID NO: 495199 - DNA, 16 bp, R. norvegicus
ctaatagctacttatc

SEQ ID NO: 495200 - DNA, 18 bp, R. norvegicus
ctaatataaaggaccagc

SEQ ID NO: 495201 - DNA, 16 bp, R. norvegicus
ctaatatgtaataaaa

SEQ ID NO: 495202 - DNA, 16 bp, R. norvegicus
ctaatcctctggctcc

SEQ ID NO: 495203 - DNA, 16 bp, R. norvegicus
ctaatctcagtaggag

SEQ ID NO: 495204 - DNA, 16 bp, R. norvegicus
ctaatgaaagtgtcct

SEQ ID NO: 495205 - DNA, 22 bp, R. norvegicus
ctaatgaaatgatcatgtggtt

SEQ ID NO: 495206 - DNA, 17 bp, R. norvegicus
ctaatgaaatgatcgtg

SEQ ID NO: 495207 - DNA, 16 bp, R. norvegicus
ctaatgaccaagcatt

SEQ ID NO: 495208 - DNA, 16 bp, R. norvegicus
ctaatgagaagacaca

SEQ ID NO: 495209 - DNA, 16 bp, R. norvegicus
ctaatgagatgattgt

SEQ ID NO: 495210 - DNA, 16 bp, R. norvegicus
ctaatgattttttgaa

SEQ ID NO: 495211 - DNA, 16 bp, R. norvegicus
ctaatgccctcttctg

SEQ ID NO: 495212 - DNA, 16 bp, R. norvegicus
ctaatgctgcaaccat

SEQ ID NO: 495213 - DNA, 16 bp, R. norvegicus
ctaatgctttcttctg

SEQ ID NO: 495214 - DNA, 16 bp, R. norvegicus
ctaatgggggagagag

SEQ ID NO: 495215 - DNA, 16 bp, R. norvegicus
ctaattaaggtcaaag

SEQ ID NO: 495216 - DNA, 16 bp, R. norvegicus
ctaattcaaccacagt

SEQ ID NO: 495217 - DNA, 16 bp, R. norvegicus
ctaattgagaaagtgc

SEQ ID NO: 495218 - DNA, 17 bp, R. norvegicus
ctaatttcactgcccca

SEQ ID NO: 495219 - DNA, 16 bp, R. norvegicus
ctaatttctcactctg

SEQ ID NO: 495220 - DNA, 16 bp, R. norvegicus
ctaatttctgtttcca

SEQ ID NO: 495221 - DNA, 16 bp, R. norvegicus
ctacaaaatcaactaa

SEQ ID NO: 495222 - DNA, 16 bp, R. norvegicus
ctacaaacataaaaga

SEQ ID NO: 495223 - DNA, 16 bp, R. norvegicus
ctacaaaccaggaagt

SEQ ID NO: 495224 - DNA, 16 bp, R. norvegicus
ctacaaagtgaagacc

SEQ ID NO: 495225 - DNA, 16 bp, R. norvegicus
ctacaacaaagacaca

SEQ ID NO: 495226 - DNA, 16 bp, R. norvegicus
ctacaacaggccaggg

SEQ ID NO: 495227 - DNA, 16 bp, R. norvegicus
ctacaaggacatctgc

SEQ ID NO: 495228 - DNA, 16 bp, R. norvegicus
ctacacaaagaataaa

SEQ ID NO: 495229 - DNA, 16 bp, R. norvegicus
ctacacaactcactga

SEQ ID NO: 495230 - DNA, 16 bp, R. norvegicus
ctacacaatggagcac

SEQ ID NO: 495231 - DNA, 16 bp, R. norvegicus
ctacacacacatatac

SEQ ID NO: 495232 - DNA, 16 bp, R. norvegicus
ctacacagaaaaactg

SEQ ID NO: 495233 - DNA, 16 bp, R. norvegicus
ctacacagagagttca

SEQ ID NO: 495234 - DNA, 16 bp, R. norvegicus
ctacacagtgagacac

SEQ ID NO: 495235 - DNA, 16 bp, R. norvegicus
ctacacagtgagtccc

SEQ ID NO: 495236 - DNA, 16 bp, R. norvegicus
ctacacccggctcctg

SEQ ID NO: 495237 - DNA, 16 bp, R. norvegicus
ctacaccttctgctgg

SEQ ID NO: 495238 - DNA, 16 bp, R. norvegicus
ctacacgaaagagaaa

SEQ ID NO: 495239 - DNA, 16 bp, R. norvegicus
ctacacggtggctcac

SEQ ID NO: 495240 - DNA, 16 bp, R. norvegicus
ctacactctgtccaca

SEQ ID NO: 495241 - DNA, 16 bp, R. norvegicus
ctacactgagggtcca

SEQ ID NO: 495242 - DNA, 16 bp, R. norvegicus
ctacactgtgtggtac

SEQ ID NO: 495243 - DNA, 16 bp, R. norvegicus
ctacagaaaaccacaa

SEQ ID NO: 495244 - DNA, 16 bp, R. norvegicus
ctacagaaaccaggaa

SEQ ID NO: 495245 - DNA, 16 bp, R. norvegicus
ctacagaaaggaatca

SEQ ID NO: 495246 - DNA, 16 bp, R. norvegicus
ctacagaacaagttca

SEQ ID NO: 495247 - DNA, 16 bp, R. norvegicus
ctacagaagccaaaaa

SEQ ID NO: 495248 - DNA, 16 bp, R. norvegicus
ctacagaatcaactaa

SEQ ID NO: 495249 - DNA, 16 bp, R. norvegicus
ctacagaatcagaaga

SEQ ID NO: 495250 - DNA, 16 bp, R. norvegicus
ctacagagaaagttcc

SEQ ID NO: 495251 - DNA, 16 bp, R. norvegicus
ctacagagaccagaag

SEQ ID NO: 495252 - DNA, 16 bp, R. norvegicus
ctacagagaggcagac

SEQ ID NO: 495253 - DNA, 16 bp, R. norvegicus
ctacagagtgagctcc

SEQ ID NO: 495254 - DNA, 17 bp, R. norvegicus
ctacagatacagaggaa

SEQ ID NO: 495255 - DNA, 17 bp, R. norvegicus
ctacagatggtcaatgt

SEQ ID NO: 495256 - DNA, 16 bp, R. norvegicus
ctacagcacccctgac

SEQ ID NO: 495257 - DNA, 16 bp, R. norvegicus
ctacagcagatgctgg

SEQ ID NO: 495258 - DNA, 16 bp, R. norvegicus
ctacagcagcagcttc

SEQ ID NO: 495259 - DNA, 16 bp, R. norvegicus
ctacagcatgaggaac

SEQ ID NO: 495260 - DNA, 16 bp, R. norvegicus
ctacagccagggccac

SEQ ID NO: 495261 - DNA, 16 bp, R. norvegicus
ctacagccccagccct

SEQ ID NO: 495262 - DNA, 16 bp, R. norvegicus
ctacagctccttgtct

SEQ ID NO: 495263 - DNA, 16 bp, R. norvegicus
ctacagctctttgtct

SEQ ID NO: 495264 - DNA, 16 bp, R. norvegicus
ctacaggccaatctta

SEQ ID NO: 495265 - DNA, 40 bp, R. norvegicus
ctacagtgactggagaactctgtcctggttatacagatct

SEQ ID NO: 495266 - DNA, 16 bp, R. norvegicus
ctacagtgtgctcaca

SEQ ID NO: 495267 - DNA, 16 bp, R. norvegicus
ctacagtgtggaagtg

SEQ ID NO: 495268 - DNA, 16 bp, R. norvegicus
ctacagttgccttgtg

SEQ ID NO: 495269 - DNA, 16 bp, R. norvegicus
ctacatagcaagctct

SEQ ID NO: 495270 - DNA, 16 bp, R. norvegicus
ctacatagcccaagct

SEQ ID NO: 495271 - DNA, 16 bp, R. norvegicus
ctacatatatgtatat

SEQ ID NO: 495272 - DNA, 16 bp, R. norvegicus
ctacatatctatctat

SEQ ID NO: 495273 - DNA, 16 bp, R. norvegicus
ctacatatgcagttgg

SEQ ID NO: 495274 - DNA, 16 bp, R. norvegicus
ctacatcaggctgcag

SEQ ID NO: 495275 - DNA, 16 bp, R. norvegicus
ctacatcatcatcatc

SEQ ID NO: 495276 - DNA, 16 bp, R. norvegicus
ctacatccccagctct

SEQ ID NO: 495277 - DNA, 16 bp, R. norvegicus
ctacatcctcaccaac

SEQ ID NO: 495278 - DNA, 16 bp, R. norvegicus
ctacatctacatctat

SEQ ID NO: 495279 - DNA, 16 bp, R. norvegicus
ctacatcttcatctgg

SEQ ID NO: 495280 - DNA, 16 bp, R. norvegicus
ctacatgaagttcaag

SEQ ID NO: 495281 - DNA, 16 bp, R. norvegicus
ctacatgagaccctgt

SEQ ID NO: 495282 - DNA, 16 bp, R. norvegicus
ctacatgctgacctac

SEQ ID NO: 495283 - DNA, 16 bp, R. norvegicus
ctacatggagagaaac

SEQ ID NO: 495284 - DNA, 16 bp, R. norvegicus
ctacatgtatgtgtat

SEQ ID NO: 495285 - DNA, 16 bp, R. norvegicus
ctacatgtctgtctgt

SEQ ID NO: 495286 - DNA, 16 bp, R. norvegicus
ctacatgttgacctca

SEQ ID NO: 495287 - DNA, 16 bp, R. norvegicus
ctacattcagttcctg

SEQ ID NO: 495288 - DNA, 16 bp, R. norvegicus
ctacattgtggaaatg

SEQ ID NO: 495289 - DNA, 16 bp, R. norvegicus
ctacattttaaaagga

SEQ ID NO: 495290 - DNA, 16 bp, R. norvegicus
ctaccaactgagctgc

SEQ ID NO: 495291 - DNA, 16 bp, R. norvegicus
ctaccaagcctgacaa

SEQ ID NO: 495292 - DNA, 16 bp, R. norvegicus
ctaccaagtgctggga

SEQ ID NO: 495293 - DNA, 16 bp, R. norvegicus
ctaccacccttctcca

SEQ ID NO: 495294 - DNA, 16 bp, R. norvegicus
ctaccactgagcctca

SEQ ID NO: 495295 - DNA, 28 bp, R. norvegicus
ctaccactgagctaaatccccaacccgt

SEQ ID NO: 495296 - DNA, 16 bp, R. norvegicus
ctaccagtgagctaca

SEQ ID NO: 495297 - DNA, 16 bp, R. norvegicus
ctaccagtttgctgta

SEQ ID NO: 495298 - DNA, 16 bp, R. norvegicus
ctaccatatcatctgc

SEQ ID NO: 495299 - DNA, 16 bp, R. norvegicus
ctaccatctatccatc

SEQ ID NO: 495300 - DNA, 16 bp, R. norvegicus
ctaccatgtgggccct

SEQ ID NO: 495301 - DNA, 16 bp, R. norvegicus
ctaccatgtgtgttct

SEQ ID NO: 495302 - DNA, 16 bp, R. norvegicus
ctaccatttccccttc

SEQ ID NO: 495303 - DNA, 16 bp, R. norvegicus
ctacccaaagaatata

SEQ ID NO: 495304 - DNA, 16 bp, R. norvegicus
ctacccacctacctac

SEQ ID NO: 495305 - DNA, 16 bp, R. norvegicus
ctacccatccatcatc

SEQ ID NO: 495306 - DNA, 16 bp, R. norvegicus
ctaccccacctgggga

SEQ ID NO: 495307 - DNA, 16 bp, R. norvegicus
ctaccccaggcacccc

SEQ ID NO: 495308 - DNA, 16 bp, R. norvegicus
ctaccccataggaaga

SEQ ID NO: 495309 - DNA, 16 bp, R. norvegicus
ctaccccatctatgaa

SEQ ID NO: 495310 - DNA, 16 bp, R. norvegicus
ctacccccaaggacat

SEQ ID NO: 495311 - DNA, 16 bp, R. norvegicus
ctacccctgagctaca

SEQ ID NO: 495312 - DNA, 16 bp, R. norvegicus
ctaccccttctccagg

SEQ ID NO: 495313 - DNA, 59 bp, R. norvegicus
ctaccctaaagcaaaaggatataccttcttctcagctcctcatggtactttctccaaaa

SEQ ID NO: 495314 - DNA, 16 bp, R. norvegicus
ctaccctctgagccat

SEQ ID NO: 495315 - DNA, 16 bp, R. norvegicus
ctaccctgacattccc

SEQ ID NO: 495316 - DNA, 17 bp, R. norvegicus
ctaccgaattccttcta

SEQ ID NO: 495317 - DNA, 41 bp, R. norvegicus
ctaccgatgacacctacacaggaccactatcacaaatgtgc

SEQ ID NO: 495318 - DNA, 16 bp, R. norvegicus
ctacctcaccaccctg

SEQ ID NO: 495319 - DNA, 16 bp, R. norvegicus
ctacctcagcctccta

SEQ ID NO: 495320 - DNA, 16 bp, R. norvegicus
ctacctccagaggttg

SEQ ID NO: 495321 - DNA, 16 bp, R. norvegicus
ctacctcccaagtcct

SEQ ID NO: 495322 - DNA, 16 bp, R. norvegicus
ctacctcccaggccca

SEQ ID NO: 495323 - DNA, 16 bp, R. norvegicus
ctacctccccaccctg

SEQ ID NO: 495324 - DNA, 16 bp, R. norvegicus
ctacctctccaacacc

SEQ ID NO: 495325 - DNA, 16 bp, R. norvegicus
ctacctctccagctcc

SEQ ID NO: 495326 - DNA, 16 bp, R. norvegicus
ctacctctgcctccca

SEQ ID NO: 495327 - DNA, 16 bp, R. norvegicus
ctacctctgcctctga

SEQ ID NO: 495328 - DNA, 16 bp, R. norvegicus
ctacctcttcctgcct

SEQ ID NO: 495329 - DNA, 16 bp, R. norvegicus
ctacctgaagaacagt

SEQ ID NO: 495330 - DNA, 16 bp, R. norvegicus
ctacctgaagacacag

SEQ ID NO: 495331 - DNA, 16 bp, R. norvegicus
ctacctgaagacccag

SEQ ID NO: 495332 - DNA, 16 bp, R. norvegicus
ctacctgagcacccag

SEQ ID NO: 495333 - DNA, 16 bp, R. norvegicus
ctacctgaggacctgg

SEQ ID NO: 495334 - DNA, 16 bp, R. norvegicus
ctacctgaggatgcag

SEQ ID NO: 495335 - DNA, 16 bp, R. norvegicus
ctacctgcccacccac

SEQ ID NO: 495336 - DNA, 16 bp, R. norvegicus
ctacctgcctctgcca

SEQ ID NO: 495337 - DNA, 16 bp, R. norvegicus
ctacctgcctctgcct

SEQ ID NO: 495338 - DNA, 16 bp, R. norvegicus
ctacctgcctctggct

SEQ ID NO: 495339 - DNA, 16 bp, R. norvegicus
ctacctgctgagccat

SEQ ID NO: 495340 - DNA, 16 bp, R. norvegicus
ctacctggagatccag

SEQ ID NO: 495341 - DNA, 16 bp, R. norvegicus
ctacctgtggacccag

SEQ ID NO: 495342 - DNA, 20 bp, R. norvegicus
ctaccttcaggcgtattgaa

SEQ ID NO: 495343 - DNA, 16 bp, R. norvegicus
ctaccttctcactgag

SEQ ID NO: 495344 - DNA, 16 bp, R. norvegicus
ctacgaattttataaa

SEQ ID NO: 495345 - DNA, 16 bp, R. norvegicus
ctactacagtcctgat

SEQ ID NO: 495346 - DNA, 16 bp, R. norvegicus
ctactaccaccaccaa

SEQ ID NO: 495347 - DNA, 16 bp, R. norvegicus
ctactcaaaagagaaa

SEQ ID NO: 495348 - DNA, 16 bp, R. norvegicus
ctactccaataaagcc

SEQ ID NO: 495349 - DNA, 16 bp, R. norvegicus
ctactccaatgaggcc

SEQ ID NO: 495350 - DNA, 16 bp, R. norvegicus
ctactccctggaccaa

SEQ ID NO: 495351 - DNA, 16 bp, R. norvegicus
ctactcctgcctcagc

SEQ ID NO: 495352 - DNA, 16 bp, R. norvegicus
ctactcctgggcatgg

SEQ ID NO: 495353 - DNA, 16 bp, R. norvegicus
ctactctaacaaggct

SEQ ID NO: 495354 - DNA, 16 bp, R. norvegicus
ctactctgctgcccag

SEQ ID NO: 495355 - DNA, 16 bp, R. norvegicus
ctactgacttgtttga

SEQ ID NO: 495356 - DNA, 16 bp, R. norvegicus
ctactgagccatttct

SEQ ID NO: 495357 - DNA, 16 bp, R. norvegicus
ctactgaggccagaca

SEQ ID NO: 495358 - DNA, 16 bp, R. norvegicus
ctactgatgatgatga

SEQ ID NO: 495359 - DNA, 16 bp, R. norvegicus
ctactgcaagaggaag

SEQ ID NO: 495360 - DNA, 16 bp, R. norvegicus
ctactgcaggaggaag

SEQ ID NO: 495361 - DNA, 16 bp, R. norvegicus
ctactgctactactgc

SEQ ID NO: 495362 - DNA, 16 bp, R. norvegicus
ctactgctgctgctgc

SEQ ID NO: 495363 - DNA, 16 bp, R. norvegicus
ctactgctgtgaggag

SEQ ID NO: 495364 - DNA, 16 bp, R. norvegicus
ctactggagtgggtgt

SEQ ID NO: 495365 - DNA, 16 bp, R. norvegicus
ctactggtttgctttt

SEQ ID NO: 495366 - DNA, 16 bp, R. norvegicus
ctactgtgagttcatg

SEQ ID NO: 495367 - DNA, 16 bp, R. norvegicus
ctactgtgtgctggga

SEQ ID NO: 495368 - DNA, 16 bp, R. norvegicus
ctactgtgtgctgggt

SEQ ID NO: 495369 - DNA, 16 bp, R. norvegicus
ctacttcaagttcctg

SEQ ID NO: 495370 - DNA, 16 bp, R. norvegicus
ctacttcagcaaagtg

SEQ ID NO: 495371 - DNA, 16 bp, R. norvegicus
ctacttctttacctgt

SEQ ID NO: 495372 - DNA, 16 bp, R. norvegicus
ctacttgagtttcatg

SEQ ID NO: 495373 - DNA, 16 bp, R. norvegicus
ctacttgataatggtg

SEQ ID NO: 495374 - DNA, 16 bp, R. norvegicus
ctactttaataagggt

SEQ ID NO: 495375 - DNA, 16 bp, R. norvegicus
ctagaaaaatcaagaa

SEQ ID NO: 495376 - DNA, 16 bp, R. norvegicus
ctagaaaagcaagaaa

SEQ ID NO: 495377 - DNA, 16 bp, R. norvegicus
ctagaaagaacccaaa

SEQ ID NO: 495378 - DNA, 16 bp, R. norvegicus
ctagaaagaactcaga

SEQ ID NO: 495379 - DNA, 16 bp, R. norvegicus
ctagaacaaaaagaac

SEQ ID NO: 495380 - DNA, 16 bp, R. norvegicus
ctagaacacagaggct

SEQ ID NO: 495381 - DNA, 16 bp, R. norvegicus
ctagaagaaactattg

SEQ ID NO: 495382 - DNA, 16 bp, R. norvegicus
ctagaagaagcaaaaa

SEQ ID NO: 495383 - DNA, 16 bp, R. norvegicus
ctagaagagcagccag

SEQ ID NO: 495384 - DNA, 16 bp, R. norvegicus
ctagaagagggtgtca

SEQ ID NO: 495385 - DNA, 16 bp, R. norvegicus
ctagaaggaaaactgc

SEQ ID NO: 495386 - DNA, 21 bp, R. norvegicus
ctagaatcccccagtgaggga

SEQ ID NO: 495387 - DNA, 16 bp, R. norvegicus
ctagaattacctggga

SEQ ID NO: 495388 - DNA, 16 bp, R. norvegicus
ctagaattcctgatct

SEQ ID NO: 495389 - DNA, 16 bp, R. norvegicus
ctagacaagcacttta

SEQ ID NO: 495390 - DNA, 16 bp, R. norvegicus
ctagaccagctggcca

SEQ ID NO: 495391 - DNA, 16 bp, R. norvegicus
ctagacctccttttcc

SEQ ID NO: 495392 - DNA, 16 bp, R. norvegicus
ctagactggctgtcca

SEQ ID NO: 495393 - DNA, 16 bp, R. norvegicus
ctagagaaacagctca

SEQ ID NO: 495394 - DNA, 16 bp, R. norvegicus
ctagagacagaggcag

SEQ ID NO: 495395 - DNA, 16 bp, R. norvegicus
ctagagaggccaggcc

SEQ ID NO: 495396 - DNA, 16 bp, R. norvegicus
ctagagccctcaggac

SEQ ID NO: 495397 - DNA, 16 bp, R. norvegicus
ctagaggaaaatgcct

SEQ ID NO: 495398 - DNA, 16 bp, R. norvegicus
ctagaggaacagaact

SEQ ID NO: 495399 - DNA, 16 bp, R. norvegicus
ctagagggttccccca

SEQ ID NO: 495400 - DNA, 16 bp, R. norvegicus
ctagagtcatttgaaa

SEQ ID NO: 495401 - DNA, 16 bp, R. norvegicus
ctagagtgttgggatt

SEQ ID NO: 495402 - DNA, 16 bp, R. norvegicus
ctagatagcccagaga

SEQ ID NO: 495403 - DNA, 16 bp, R. norvegicus
ctagatatcaacaaac

SEQ ID NO: 495404 - DNA, 16 bp, R. norvegicus
ctagatccacagaaca

SEQ ID NO: 495405 - DNA, 16 bp, R. norvegicus
ctagatgaaatggatg

SEQ ID NO: 495406 - DNA, 16 bp, R. norvegicus
ctagattccaagtgtg

SEQ ID NO: 495407 - DNA, 16 bp, R. norvegicus
ctagcactacaaagga

SEQ ID NO: 495408 - DNA, 16 bp, R. norvegicus
ctagcactgacctctg

SEQ ID NO: 495409 - DNA, 16 bp, R. norvegicus
ctagcagaggacccag

SEQ ID NO: 495410 - DNA, 16 bp, R. norvegicus
ctagcagctttctgag

SEQ ID NO: 495411 - DNA, 16 bp, R. norvegicus
ctagcatctgggactt

SEQ ID NO: 495412 - DNA, 16 bp, R. norvegicus
ctagccatggaggcag

SEQ ID NO: 495413 - DNA, 16 bp, R. norvegicus
ctagccccacagagac

SEQ ID NO: 495414 - DNA, 16 bp, R. norvegicus
ctagccctgcccctca

SEQ ID NO: 495415 - DNA, 16 bp, R. norvegicus
ctagcctagactacat

SEQ ID NO: 495416 - DNA, 16 bp, R. norvegicus
ctagcctgggctacat

SEQ ID NO: 495417 - DNA, 16 bp, R. norvegicus
ctagccttgacccgag

SEQ ID NO: 495418 - DNA, 16 bp, R. norvegicus
ctagcgagcacaaggc

SEQ ID NO: 495419 - DNA, 16 bp, R. norvegicus
ctagctaagttgggag

SEQ ID NO: 495420 - DNA, 16 bp, R. norvegicus
ctagctacaggaggtg

SEQ ID NO: 495421 - DNA, 16 bp, R. norvegicus
ctagctatgattttaa

SEQ ID NO: 495422 - DNA, 16 bp, R. norvegicus
ctagctcctgtcagca

SEQ ID NO: 495423 - DNA, 16 bp, R. norvegicus
ctagctggcctggaac

SEQ ID NO: 495424 - DNA, 16 bp, R. norvegicus
ctagctgtctggaagt

SEQ ID NO: 495425 - DNA, 16 bp, R. norvegicus
ctagcttgttttctct

SEQ ID NO: 495426 - DNA, 16 bp, R. norvegicus
ctagctttcttgcctg

SEQ ID NO: 495427 - DNA, 16 bp, R. norvegicus
ctaggaaagatcagga

SEQ ID NO: 495428 - DNA, 17 bp, R. norvegicus
ctaggaagacagtacct

SEQ ID NO: 495429 - DNA, 16 bp, R. norvegicus
ctaggaagcgtaaggc

SEQ ID NO: 495430 - DNA, 16 bp, R. norvegicus
ctaggaagtgttttct

SEQ ID NO: 495431 - DNA, 16 bp, R. norvegicus
ctaggactacacagtg

SEQ ID NO: 495432 - DNA, 16 bp, R. norvegicus
ctaggactagagttac

SEQ ID NO: 495433 - DNA, 16 bp, R. norvegicus
ctaggaggaatgctaa

SEQ ID NO: 495434 - DNA, 16 bp, R. norvegicus
ctaggattacaggtgt

SEQ ID NO: 495435 - DNA, 25 bp, R. norvegicus
ctaggcaagtgctctaccactgagc

SEQ ID NO: 495436 - DNA, 16 bp, R. norvegicus
ctaggcacagtcagaa

SEQ ID NO: 495437 - DNA, 16 bp, R. norvegicus
ctaggcctaggcctgg

SEQ ID NO: 495438 - DNA, 16 bp, R. norvegicus
ctaggctccacctctt

SEQ ID NO: 495439 - DNA, 16 bp, R. norvegicus
ctaggctcttcctctc

SEQ ID NO: 495440 - DNA, 16 bp, R. norvegicus
ctaggctggccttgaa

SEQ ID NO: 495441 - DNA, 17 bp, R. norvegicus
ctaggcttgtttctctt

SEQ ID NO: 495442 - DNA, 16 bp, R. norvegicus
ctaggtagctgtcctt

SEQ ID NO: 495443 - DNA, 16 bp, R. norvegicus
ctaggttggtcttgaa

SEQ ID NO: 495444 - DNA, 16 bp, R. norvegicus
ctagtactgcccaccc

SEQ ID NO: 495445 - DNA, 16 bp, R. norvegicus
ctagtagaagactgac

SEQ ID NO: 495446 - DNA, 16 bp, R. norvegicus
ctagtatcttctgtag

SEQ ID NO: 495447 - DNA, 16 bp, R. norvegicus
ctagtcatggtggcac

SEQ ID NO: 495448 - DNA, 16 bp, R. norvegicus
ctagtccctgccaagg

SEQ ID NO: 495449 - DNA, 16 bp, R. norvegicus
ctagtctggctggcca

SEQ ID NO: 495450 - DNA, 16 bp, R. norvegicus
ctagtgcctttgttgc

SEQ ID NO: 495451 - DNA, 16 bp, R. norvegicus
ctagtggggtctggtt

SEQ ID NO: 495452 - DNA, 16 bp, R. norvegicus
ctagttcctgggagag

SEQ ID NO: 495453 - DNA, 16 bp, R. norvegicus
ctagtttcatgtcaac

SEQ ID NO: 495454 - DNA, 16 bp, R. norvegicus
ctataaaattccatcc

SEQ ID NO: 495455 - DNA, 16 bp, R. norvegicus
ctataaacatagtgga

SEQ ID NO: 495456 - DNA, 16 bp, R. norvegicus
ctataaattttcctct

SEQ ID NO: 495457 - DNA, 16 bp, R. norvegicus
ctataagccagctcca

SEQ ID NO: 495458 - DNA, 16 bp, R. norvegicus
ctataatcccagcact

SEQ ID NO: 495459 - DNA, 16 bp, R. norvegicus
ctataatttcagcact

SEQ ID NO: 495460 - DNA, 16 bp, R. norvegicus
ctataatttttttgaa

SEQ ID NO: 495461 - DNA, 16 bp, R. norvegicus
ctatacaaaagagaac

SEQ ID NO: 495462 - DNA, 16 bp, R. norvegicus
ctatacacataggaag

SEQ ID NO: 495463 - DNA, 16 bp, R. norvegicus
ctatacagaagagaaa

SEQ ID NO: 495464 - DNA, 16 bp, R. norvegicus
ctataccctaaaagaa

SEQ ID NO: 495465 - DNA, 16 bp, R. norvegicus
ctatacttctcttggg

SEQ ID NO: 495466 - DNA, 16 bp, R. norvegicus
ctatagcccaggctgg

SEQ ID NO: 495467 - DNA, 16 bp, R. norvegicus
ctatataaaaatgaca

SEQ ID NO: 495468 - DNA, 16 bp, R. norvegicus
ctatatacaataagaa

SEQ ID NO: 495469 - DNA, 16 bp, R. norvegicus
ctatatactcatcaaa

SEQ ID NO: 495470 - DNA, 16 bp, R. norvegicus
ctatatatgtgctggg

SEQ ID NO: 495471 - DNA, 16 bp, R. norvegicus
ctatatcatcatcatc

SEQ ID NO: 495472 - DNA, 16 bp, R. norvegicus
ctatattaaataggta

SEQ ID NO: 495473 - DNA, 16 bp, R. norvegicus
ctatcaacatcaatgg

SEQ ID NO: 495474 - DNA, 16 bp, R. norvegicus
ctatcaccctgcacaa

SEQ ID NO: 495475 - DNA, 16 bp, R. norvegicus
ctatcacgttggagaa

SEQ ID NO: 495476 - DNA, 16 bp, R. norvegicus
ctatcacttccttcct

SEQ ID NO: 495477 - DNA, 16 bp, R. norvegicus
ctatcatcatcattat

SEQ ID NO: 495478 - DNA, 16 bp, R. norvegicus
ctatcatgactgctct

SEQ ID NO: 495479 - DNA, 16 bp, R. norvegicus
ctatccaaaagcaaaa

SEQ ID NO: 495480 - DNA, 16 bp, R. norvegicus
ctatccaaactatttc

SEQ ID NO: 495481 - DNA, 16 bp, R. norvegicus
ctatcccatcaccctc

SEQ ID NO: 495482 - DNA, 16 bp, R. norvegicus
ctatcccatcccccaa

SEQ ID NO: 495483 - DNA, 30 bp, R. norvegicus
ctatcctcaacaataaaaggacttcaggga

SEQ ID NO: 495484 - DNA, 31 bp, R. norvegicus
ctatcctcaacaataaaaggacttcaggggg

SEQ ID NO: 495485 - DNA, 121 bp, R. norvegicus
ctatcctcaacaataagaggacttcagggggaatcactatccctgaactcaagcagtattacagagcaatagtgataaaaactgcatggtattggtacagagacagacagatagaccaatg

SEQ ID NO: 495486 - DNA, 16 bp, R. norvegicus
ctatcctctgagaggc

SEQ ID NO: 495487 - DNA, 16 bp, R. norvegicus
ctatcctgagctacat

SEQ ID NO: 495488 - DNA, 16 bp, R. norvegicus
ctatcctggatttttt

SEQ ID NO: 495489 - DNA, 16 bp, R. norvegicus
ctatctactggaggtg

SEQ ID NO: 495490 - DNA, 16 bp, R. norvegicus
ctatctatccacccat

SEQ ID NO: 495491 - DNA, 16 bp, R. norvegicus
ctatctcagaccacta

SEQ ID NO: 495492 - DNA, 16 bp, R. norvegicus
ctatctctgtctccat

SEQ ID NO: 495493 - DNA, 16 bp, R. norvegicus
ctatctctgtgtctct

SEQ ID NO: 495494 - DNA, 16 bp, R. norvegicus
ctatctctgtgtctgt

SEQ ID NO: 495495 - DNA, 16 bp, R. norvegicus
ctatctgcagctgaca

SEQ ID NO: 495496 - DNA, 16 bp, R. norvegicus
ctatctgcctctgtct

SEQ ID NO: 495497 - DNA, 16 bp, R. norvegicus
ctatctggacctgggc

SEQ ID NO: 495498 - DNA, 16 bp, R. norvegicus
ctatctgtccatctgt

SEQ ID NO: 495499 - DNA, 16 bp, R. norvegicus
ctatctgtttgtctat

SEQ ID NO: 495500 - DNA, 16 bp, R. norvegicus
ctatcttggaacttgc

SEQ ID NO: 495501 - DNA, 16 bp, R. norvegicus
ctatgaaaacacaaac

SEQ ID NO: 495502 - DNA, 16 bp, R. norvegicus
ctatgaaaagatcaaa

SEQ ID NO: 495503 - DNA, 16 bp, R. norvegicus
ctatgaaatccagaag

SEQ ID NO: 495504 - DNA, 16 bp, R. norvegicus
ctatgaacatactgga

SEQ ID NO: 495505 - DNA, 16 bp, R. norvegicus
ctatgaaccgggacag

SEQ ID NO: 495506 - DNA, 16 bp, R. norvegicus
ctatgaatgggaagtc

SEQ ID NO: 495507 - DNA, 16 bp, R. norvegicus
ctatgaccaagacaac

SEQ ID NO: 495508 - DNA, 21 bp, R. norvegicus
ctatgaccaatcaaatacaga

SEQ ID NO: 495509 - DNA, 16 bp, R. norvegicus
ctatgaccaatgtaag

SEQ ID NO: 495510 - DNA, 16 bp, R. norvegicus
ctatgacctggaagtg

SEQ ID NO: 495511 - DNA, 16 bp, R. norvegicus
ctatgactctagagaa

SEQ ID NO: 495512 - DNA, 16 bp, R. norvegicus
ctatgacttcatgaaa

SEQ ID NO: 495513 - DNA, 16 bp, R. norvegicus
ctatgagaacacaaat

SEQ ID NO: 495514 - DNA, 16 bp, R. norvegicus
ctatgagattgcaaac

SEQ ID NO: 495515 - DNA, 16 bp, R. norvegicus
ctatgaggatgctgcc

SEQ ID NO: 495516 - DNA, 16 bp, R. norvegicus
ctatgaggatggagcc

SEQ ID NO: 495517 - DNA, 16 bp, R. norvegicus
ctatgaggttgccctc

SEQ ID NO: 495518 - DNA, 16 bp, R. norvegicus
ctatgattatgttgaa

SEQ ID NO: 495519 - DNA, 16 bp, R. norvegicus
ctatgattttcatgaa

SEQ ID NO: 495520 - DNA, 16 bp, R. norvegicus
ctatgcagctggagcc

SEQ ID NO: 495521 - DNA, 16 bp, R. norvegicus
ctatgccaagaagtaa

SEQ ID NO: 495522 - DNA, 16 bp, R. norvegicus
ctatgctggcctcaaa

SEQ ID NO: 495523 - DNA, 16 bp, R. norvegicus
ctatgctgggacatca

SEQ ID NO: 495524 - DNA, 16 bp, R. norvegicus
ctatgctgtgtgtgtg

SEQ ID NO: 495525 - DNA, 16 bp, R. norvegicus
ctatggaaatcagtct

SEQ ID NO: 495526 - DNA, 16 bp, R. norvegicus
ctatggaacatttcat

SEQ ID NO: 495527 - DNA, 16 bp, R. norvegicus
ctatggaagagcagca

SEQ ID NO: 495528 - DNA, 16 bp, R. norvegicus
ctatggaatcttctac

SEQ ID NO: 495529 - DNA, 16 bp, R. norvegicus
ctatggaatggactct

SEQ ID NO: 495530 - DNA, 16 bp, R. norvegicus
ctatggagatggctca

SEQ ID NO: 495531 - DNA, 16 bp, R. norvegicus
ctatggaggcagaggc

SEQ ID NO: 495532 - DNA, 16 bp, R. norvegicus
ctatggctccagcctc

SEQ ID NO: 495533 - DNA, 16 bp, R. norvegicus
ctatggctgtgaagag

SEQ ID NO: 495534 - DNA, 16 bp, R. norvegicus
ctatggcttcagctgc

SEQ ID NO: 495535 - DNA, 16 bp, R. norvegicus
ctatggcttttttgcc

SEQ ID NO: 495536 - DNA, 16 bp, R. norvegicus
ctatggtataaattca

SEQ ID NO: 495537 - DNA, 17 bp, R. norvegicus
ctatggtatagcttgcc

SEQ ID NO: 495538 - DNA, 16 bp, R. norvegicus
ctatggtatcctctgc

SEQ ID NO: 495539 - DNA, 16 bp, R. norvegicus
ctatgtagaccagact

SEQ ID NO: 495540 - DNA, 16 bp, R. norvegicus
ctatgtagaccaggtt

SEQ ID NO: 495541 - DNA, 16 bp, R. norvegicus
ctatgtagccgaggct
